United States Patent 9,719,131 (METHOD FOR DETERMINING THE DEGREE OF METHYLATION OF DEFINED CYTOSINES IN GENOMIC DNA IN THE SEQUENCE CONTEXT OF 5'-CPG-3') - sequence listing, part 11

SEQ ID NO: 33007 - DNA, 1009 bp, Artificial Sequence
  chemically treated genomic DNA (Homo sapiens) CpG-island No: 33007
  misc_feature (21)..(21): n is either a, c, g or t
  misc_feature (324)..(324): n is either a, c, g or t
  misc_feature (437)..(437): n is either a, c, g or t
  misc_feature (606)..(606): n is either a, c, g or t
  misc_feature (616)..(616): n is either a, c, g or t
  misc_feature (642)..(642): n is either a, c, g or t
  misc_feature (701)..(702): n is either a, c, g or t
  misc_feature (750)..(750): n is either a, c, g or t
aacgttagtgggtgagtatgncgattgaggcgaggggtggggcggcggagatggtgtgagttagttcggatggcggagagagagtcgagagggcgggtcgtcgtcgcgggggtgtttaagtcgcgttgtgggcgcgcgggcggcgggagtagttgcgtgggtaggcgtagagaatggagtgcgaagcggagcggcgggcgcgtgtggtggggataagtgagaggtgtgttcgacgcgtggagggcgcgtgcgggtggttcgttaattatgaggaaggcggggggtttgcgacgtttttattgtgtgtttttattggtgagcgancggcgggacggaggtggttggcggtgttgtagtgggggacgaggggtttcgtgggggagaatgtgggttaattgatttcgggggttcgcgcggtggggcgtatgtgtgggatnagtcggcggagttgtcgggtaatttttgttgtttaaagatgcggtggggcggggtcgaacgggtggtgttaagaagaggtcgaggggagggggttatggtgttataaggggaaagaaagacgcgggggcgcgtggtatgggagatgtagggaaaatggggcgcggcgtncgaacgtttncgaaggcgagggtggaaaggtcgggngggtgtcgcggtggagggggtgtgttagggggaaggggcgggcgtgttcgagggatatnngtggtttggtggcgaatgggcgggtagggcgggcgttaagtgggtgantgggtggttagagggggggcggttatggggtgagtggggtgaggggggggcggggggcgaatggggaggggaggtggcggggacgggggcgagagggggtggggagggggtaaagggggggggcgtcggttggtgggtttgtagggaggagcggaatcggggggtaattagggggtgttggcggggggtggtgggacggcgcgggggggtggggggcggtggttgcggggtggtcgttagcgtaggggggagtgtgagt

SEQ ID NO: 33008 - DNA, 1009 bp, Artificial Sequence
  chemically treated genomic DNA (Homo sapiens) CpG-island No: 33008
  misc_feature (260)..(260): n is either a, c, g or t
  misc_feature (308)..(309): n is either a, c, g or t
  misc_feature (368)..(368): n is either a, c, g or t
  misc_feature (394)..(394): n is either a, c, g or t
  misc_feature (404)..(404): n is either a, c, g or t
  misc_feature (573)..(573): n is either a, c, g or t
  misc_feature (686)..(686): n is either a, c, g or t
  misc_feature (989)..(989): n is either a, c, g or t
actcacactcccccctacgctaacgaccaccccgcaaccaccgccccccacccccccgcgccgtcccaccaccccccgccaacaccccctaattaccccccgattccgctcctccctacaaacccaccaaccgacgccccccccctttaccccctccccaccccctctcgcccccgtccccgccacctcccctccccattcgccccccgcccccccctcaccccactcaccccataaccgccccccctctaaccacccantcacccacttaacgcccgccctacccgcccattcgccaccaaaccacnnatatccctcgaacacgcccgccccttccccctaacacaccccctccaccgcgacacccncccgacctttccaccctcgccttcgnaaacgttcgnacgccgcgccccattttccctacatctcccataccacgcgcccccgcgtctttctttccccttataacaccataaccccctcccctcgacctcttcttaacaccacccgttcgaccccgccccaccgcatctttaaacaacaaaaattacccgacaactccgccgactnatcccacacatacgccccaccgcgcgaacccccgaaatcaattaacccacattctcccccacgaaacccctcgtcccccactacaacaccgccaaccacctccgtcccgccgntcgctcaccaataaaaacacacaataaaaacgtcgcaaaccccccgccttcctcataattaacgaaccacccgcacgcgccctccacgcgtcgaacacacctctcacttatccccaccacacgcgcccgccgctccgcttcgcactccattctctacgcctacccacgcaactactcccgccgcccgcgcgcccacaacgcgacttaaacacccccgcgacgacgacccgccctctcgactctctctccgccatccgaactaactcacaccatctccgccgccccacccctcgcctcaatcgncatactcacccactaacgtt

SEQ ID NO: 33009 - DNA, 610 bp, Artificial Sequence
  chemically treated genomic DNA (Homo sapiens) CpG-island No: 33009
gggagcggcgagcggtgttcggcgtaggatagaaagggagtgcgcgttcgagttttttagatttttgggaattcgcgttattttttcgtttttgtttattttcggtcgcgttgttagtttttattagcgttaataggttttagacggagcgggtcgggcgttgggttaatgtaatcggcgcgttatttggggcgtaggttatattattagtttcggttttcgttaggtacggttagaattagttagttcgcgttttgtcggtcgtttcgcgtttttagttttttttcggtttcgttcgaacgttatacggcggagtttagttttagttcgcgttttagagtttgttaaggtattcgtcggtcgggggtcggtagggcgtaaggtattagggattttttcgtcgtcggatacgtgagtgcgttttgagcgcgggatagggttaggtttgtttgggaggttcgggtcgagacgcgttagtagagggttagcgagtttgtagtgtagtgacgttaagtgttcgagaaggtttttgtggttgttgaagtgtcgcggatttgagttggggagggggtcggtacgttgtttttagtttcggtgagtttaattttag

SEQ ID NO: 33010 - DNA, 610 bp, Artificial Sequence
  chemically treated genomic DNA (Homo sapiens) CpG-island No: 33010
ctaaaattaaactcaccgaaactaaaaacaacgtaccgaccccctccccaactcaaatccgcgacacttcaacaaccacaaaaaccttctcgaacacttaacgtcactacactacaaactcgctaaccctctactaacgcgtctcgacccgaacctcccaaacaaacctaaccctatcccgcgctcaaaacgcactcacgtatccgacgacgaaaaaatccctaataccttacgccctaccgacccccgaccgacgaataccttaacaaactctaaaacgcgaactaaaactaaactccgccgtataacgttcgaacgaaaccgaaaaaaaactaaaaacgcgaaacgaccgacaaaacgcgaactaactaattctaaccgtacctaacgaaaaccgaaactaataatataacctacgccccaaataacgcgccgattacattaacccaacgcccgacccgctccgtctaaaacctattaacgctaataaaaactaacaacgcgaccgaaaataaacaaaaacgaaaaaataacgcgaattcccaaaaatctaaaaaactcgaacgcgcactccctttctatcctacgccgaacaccgctcgccgctccc

SEQ ID NO: 33011 - DNA, 610 bp, Artificial Sequence
  chemically treated genomic DNA (Homo sapiens) CpG-island No: 33011
ttgggattgaatttatcgaggttgagggtagcgtgtcgattttttttttagtttaggttcgcgatattttaatagttataggagttttttcggatatttaacgttattgtattataaattcgttagttttttgttggcgcgtttcggttcgggttttttaggtagatttagttttgtttcgcgtttagggcgtatttacgtgttcggcggcgaggggatttttggtgttttgcgttttgtcggttttcgatcggcgggtgttttggtaggttttagggcgcgggttggggttgggtttcgtcgtgtggcgttcgggcggagtcggggaagagttggaggcgcggggcggtcggtagggcgcgggttgattggttttggtcgtgtttggcgggggtcggggttggtaatgtagtttgcgttttaggtaacgcgtcgattgtattaatttagcgttcggttcgtttcgtttggagtttgttagcgttaatggagattgatagcgcggtcggggatgggtaggggcgggagggtggcgcgggtttttagggatttgggggattcgggcgcgtattttttttttattttgcgtcgagtatcgttcgtcgttttt

SEQ ID NO: 33012 - DNA, 610 bp, Artificial Sequence
  chemically treated genomic DNA (Homo sapiens) CpG-island No: 33012
aaaaacgacgaacgatactcgacgcaaaataaaaaaaaaatacgcgcccgaatcccccaaatccctaaaaacccgcgccaccctcccgcccctacccatccccgaccgcgctatcaatctccattaacgctaacaaactccaaacgaaacgaaccgaacgctaaattaatacaatcgacgcgttacctaaaacgcaaactacattaccaaccccgacccccgccaaacacgaccaaaaccaatcaacccgcgccctaccgaccgccccgcgcctccaactcttccccgactccgcccgaacgccacacgacgaaacccaaccccaacccgcgccctaaaacctaccaaaacacccgccgatcgaaaaccgacaaaacgcaaaacaccaaaaatcccctcgccgccgaacacgtaaatacgccctaaacgcgaaacaaaactaaatctacctaaaaaacccgaaccgaaacgcgccaacaaaaaactaacgaatttataatacaataacgttaaatatccgaaaaaactcctataactattaaaatatcgcgaacctaaactaaaaaaaaaatcgacacgctaccctcaacctcgataaattcaatcccaa

SEQ ID NO: 33013 - DNA, 619 bp, Artificial Sequence
  chemically treated genomic DNA (Homo sapiens) CpG-island No: 33013
  misc_feature (439)..(439): n is either a, c, g or t
gataaagtggtgaagatgtttggcgtgagtgttgacgattagcgtttgttgaagaaattgaagttcgatatgtttagtattatcgagtatgtatcggtgtggattattatggcggtcgcgttggcgttaggtatcggtacgatgattggttggcgtcgtgtggtaacgattatcggtgagaaaatcggtaagaaaggtatgatttacgtttaggggatgtttgtttagatgacggcggtagtgtttatcggtttggcgagttatatcgggatgtcggtttttattatttacgtattttttttttttgtcgcggggacgatggtggtagatggtggcggtttatagcgtaaaatcgtgattagtattttgatggtttgggtgtttatttttttcgttgcggtattgtttttcggcgggttgtattggttttttttgtagnttttgtaatcgtacgtattaaaacgagcggggtaattgtttcgttttagattgttgattaagtgcgcgttgtatacgtcggatgcggcgtgaacgttttattcggtttacgaaatcgtgttaatttaatatattgtgggttttacgtaggtttgataagcgttacgtattacgtagtttt

SEQ ID NO: 33014 - DNA, 619 bp, Artificial Sequence
  chemically treated genomic DNA (Homo sapiens) CpG-island No: 33014
  misc_feature (181)..(181): n is either a, c, g or t
aaaactacgtaatacgtaacgcttatcaaacctacgtaaaacccacaatatattaaattaacacgatttcgtaaaccgaataaaacgttcacgccgcatccgacgtatacaacgcgcacttaatcaacaatctaaaacgaaacaattaccccgctcgttttaatacgtacgattacaaaanctacaaaaaaaaccaatacaacccgccgaaaaacaataccgcaacgaaaaaaataaacacccaaaccatcaaaatactaatcacgattttacgctataaaccgccaccatctaccaccatcgtccccgcgacaaaaaaaaaaaatacgtaaataataaaaaccgacatcccgatataactcgccaaaccgataaacactaccgccgtcatctaaacaaacatcccctaaacgtaaatcatacctttcttaccgattttctcaccgataatcgttaccacacgacgccaaccaatcatcgtaccgatacctaacgccaacgcgaccgccataataatccacaccgatacatactcgataatactaaacatatcgaacttcaatttcttcaacaaacgctaatcgtcaacactcacgccaaacatcttcaccactttatc

SEQ ID NO: 33015 - DNA, 619 bp, Artificial Sequence
  chemically treated genomic DNA (Homo sapiens) CpG-island No: 33015
  misc_feature (181)..(181): n is either a, c, g or t
aaaattgcgtgatgcgtaacgtttattaggtttacgtggagtttataatatattgaattagtacgatttcgtaggtcggataaggcgtttacgtcgtattcggcgtgtataacgcgtatttggttaataatttgaagcggggtagttgtttcgttcgttttggtgcgtacgattatagganttgtagggagagttagtatagttcgtcggaaagtagtatcgtagcggaaagggtaaatatttaggttattagaatgttggttacggttttacgttgtaagtcgttattatttattattatcgttttcgcgatagaagaggagagtacgtgagtagtggaaatcggtatttcggtataattcgttaggtcgatagatattgtcgtcgttatttgggtagatattttttgagcgtaggttatgttttttttatcgatttttttatcgatagtcgttgttatacggcgttagttaattatcgtatcgatatttaacgttagcgcgatcgttatgatgatttatatcggtgtatattcgatggtgttaagtatgtcggattttagtttttttaataggcgttgatcgttagtatttacgttaggtatttttattattttgtt

SEQ ID NO: 33016 - DNA, 619 bp, Artificial Sequence
  chemically treated genomic DNA (Homo sapiens) CpG-island No: 33016
  misc_feature (439)..(439): n is either a, c, g or t
aacaaaataataaaaatacctaacgtaaatactaacgatcaacgcctattaaaaaaactaaaatccgacatacttaacaccatcgaatatacaccgatataaatcatcataacgatcgcgctaacgttaaatatcgatacgataattaactaacgccgtataacaacgactatcgataaaaaaatcgataaaaaaaacataacctacgctcaaaaaatatctacccaaataacgacgacaatatctatcgacctaacgaattataccgaaataccgatttccactactcacgtactctcctcttctatcgcgaaaacgataataataaataataacgacttacaacgtaaaaccgtaaccaacattctaataacctaaatatttaccctttccgctacgatactactttccgacgaactatactaactctccctacaantcctataatcgtacgcaccaaaacgaacgaaacaactaccccgcttcaaattattaaccaaatacgcgttatacacgccgaatacgacgtaaacgccttatccgacctacgaaatcgtactaattcaatatattataaactccacgtaaacctaataaacgttacgcatcacgcaatttt

SEQ ID NO: 33017 - DNA, 1007 bp, Artificial Sequence
  chemically treated genomic DNA (Homo sapiens) CpG-island No: 33017
ggacgagcgtggtttcgggacgcgcggtgtagttaggtgcgtcggcggtagtggtagtcgttgagcgtcgcgtcgtacgtggtaataggtgtagcgttgtttcgggttggcgtcggggggcgtggggcgcgttcgtatttagttcgggagcgcgcggagcgtcgggattgggattcgagagcgggagcggagagcgggagcgttcgagcggagtttagcgtttcgaggtacggtttcgtacgttatttaggtttttcgagggtcgttttttgggacggcggttggttttggtttttcgtagcgagtcgttggagtggagttttcggaaggagtcgtttcgggttggggcgggaggttcgagttcggttatttataagtttttcgaatttttcgttttgttttattttttggcggtttcggaggcggggaggcggggaggtcggggtttcgggtttcgtttggtagtcgtcgtaggcgtggggtggtgtcgcgtcgcgcgtttttaggtgtagacgtcgttttcgagattttcggggcgggttttcggcgatttcgttagtggtgtaaagggcgttagtttttttcgtttttgcgtttttgttttcggagcgtttgaaggagttgcgggtaagtgcgcgttggaatttgttttcgttgttcggcggtcggggtggggaggggataggcgagcgcgtcgtttagggtgacgggatcggttttcggggaggggagggggcgttttaggggtttgggggtcgaagttgagggttaaagggggcggtagcgtcggcggagcggaggcgggttttacgtgggttagcgtagagtttgcggaagggacggatgcggatttcgtcgttgttattttgaaagtgatcgaggggtttgattgtggattttttacgtcgtttattcgggttcggcggttttagttttttcgtagggtttttttttagtagaagtaagcggggtcgagaaagcgggtggaatagggttgttgtaggttt

SEQ ID NO: 33018 - DNA, 1007 bp, Artificial Sequence
  chemically treated genomic DNA (Homo sapiens) CpG-island No: 33018
aaacctacaacaaccctattccacccgctttctcgaccccgcttacttctactaaaaaaaaaccctacgaaaaaactaaaaccgccgaacccgaataaacgacgtaaaaaatccacaatcaaacccctcgatcactttcaaaataacaacgacgaaatccgcatccgtcccttccgcaaactctacgctaacccacgtaaaacccgcctccgctccgccgacgctaccgccccctttaaccctcaacttcgacccccaaacccctaaaacgccccctcccctccccgaaaaccgatcccgtcaccctaaacgacgcgctcgcctatcccctccccaccccgaccgccgaacaacgaaaacaaattccaacgcgcacttacccgcaactccttcaaacgctccgaaaacaaaaacgcaaaaacgaaaaaaactaacgccctttacaccactaacgaaatcgccgaaaacccgccccgaaaatctcgaaaacgacgtctacacctaaaaacgcgcgacgcgacaccaccccacgcctacgacgactaccaaacgaaacccgaaaccccgacctccccgcctccccgcctccgaaaccgccaaaaaataaaacaaaacgaaaaattcgaaaaacttataaataaccgaactcgaacctcccgccccaacccgaaacgactccttccgaaaactccactccaacgactcgctacgaaaaaccaaaaccaaccgccgtcccaaaaaacgaccctcgaaaaacctaaataacgtacgaaaccgtacctcgaaacgctaaactccgctcgaacgctcccgctctccgctcccgctctcgaatcccaatcccgacgctccgcgcgctcccgaactaaatacgaacgcgccccacgccccccgacgccaacccgaaacaacgctacacctattaccacgtacgacgcgacgctcaacgactaccactaccgccgacgcacctaactacaccgcgcgtcccgaaaccacgctcgtcc

SEQ ID NO: 33019 - DNA, 1007 bp, Artificial Sequence
  chemically treated genomic DNA (Homo sapiens) CpG-island No: 33019
ggatttgtagtaattttattttattcgttttttcggtttcgtttgtttttgttgagaaggggttttgcgagaaggttgggatcgtcgggttcgggtgggcggcgtaaggagtttatagttaagtttttcggttatttttaaggtgatagcgacgagattcgtattcgtttttttcgtaggttttgcgttggtttacgtgagattcgttttcgtttcgtcggcgttgtcgttttttttagtttttagtttcggtttttaggtttttggaacgttttttttttttttcgaggatcggtttcgttattttgggcggcgcgttcgtttgttttttttttatttcggtcgtcgggtagcgggaatagattttagcgcgtatttattcgtagtttttttaagcgtttcgggagtaaagacgtagaggcggggagggttggcgttttttgtattattggcggggtcgtcgagaattcgtttcggaggtttcgggggcggcgtttgtatttgggggcgcgcggcgcggtattattttacgtttgcggcggttattaggcgggattcggagtttcggttttttcgttttttcgttttcggggtcgttagggggtggagtagggcggggagttcgggaaatttgtaaatagtcgaattcgggtttttcgttttaattcggggcggtttttttcgaaggttttattttagcggttcgttgcgggagattaaggttagtcgtcgttttaggggacggttttcggggaatttgaatgacgtgcgaggtcgtatttcggggcgttggatttcgttcgggcgttttcgtttttcgttttcgttttcgggttttaatttcgacgtttcgcgcgttttcggattaagtgcggacgcgttttacgtttttcggcgttagttcgggatagcgttgtatttgttgttacgtgcgacgcggcgtttagcggttgttattgtcgtcggcgtatttggttgtatcgcgcgtttcgggattacgttcgttt

SEQ ID NO: 33020 - DNA, 1007 bp, Artificial Sequence
  chemically treated genomic DNA (Homo sapiens) CpG-island No: 33020
aaacgaacgtaatcccgaaacgcgcgatacaaccaaatacgccgacgacaataacaaccgctaaacgccgcgtcgcacgtaacaacaaatacaacgctatcccgaactaacgccgaaaaacgtaaaacgcgtccgcacttaatccgaaaacgcgcgaaacgtcgaaattaaaacccgaaaacgaaaacgaaaaacgaaaacgcccgaacgaaatccaacgccccgaaatacgacctcgcacgtcattcaaattccccgaaaaccgtcccctaaaacgacgactaaccttaatctcccgcaacgaaccgctaaaataaaaccttcgaaaaaaaccgccccgaattaaaacgaaaaacccgaattcgactatttacaaatttcccgaactccccgccctactccaccccctaacgaccccgaaaacgaaaaaacgaaaaaaccgaaactccgaatcccgcctaataaccgccgcaaacgtaaaataataccgcgccgcgcgcccccaaatacaaacgccgcccccgaaacctccgaaacgaattctcgacgaccccgccaataatacaaaaaacgccaaccctccccgcctctacgtctttactcccgaaacgcttaaaaaaactacgaataaatacgcgctaaaatctattcccgctacccgacgaccgaaataaaaaaaaaacaaacgaacgcgccgcccaaaataacgaaaccgatcctcgaaaaaaaaaaaaaacgttccaaaaacctaaaaaccgaaactaaaaactaaaaaaaacgacaacgccgacgaaacgaaaacgaatctcacgtaaaccaacgcaaaacctacgaaaaaaacgaatacgaatctcgtcgctatcaccttaaaaataaccgaaaaacttaactataaactccttacgccgcccacccgaacccgacgatcccaaccttctcgcaaaaccccttctcaacaaaaacaaacgaaaccgaaaaaacgaataaaataaaattactacaaatcc

SEQ ID NO: 33021 - DNA, 902 bp, Artificial Sequence
  chemically treated genomic DNA (Homo sapiens) CpG-island No: 33021
cgtcgtcgggggtaggggcgatgggagtgggcgtagggcgataaggggggacggtcggggacgcggagggggttgtttcgtcggttttgttcgttagtttaattacggttatttatgttttgtttgtggtttttgggcgggttggcggtcggggtagcgtaatggtatggttttggtttggatgacggtttcgttttcggtttttttgggttcgtagggcggttggcgagggttataagttggacgagaggcgcgagcgcgcggagttttgggggtttaggtcgttggcggcgtcgggtgaggcggagtttttgcgattcgggttgggcgcggcggttcgggtagcgggcgtgggttttagaagcggtgtggagttgttggtcgggcgtgtggaggtcgttgggacgggcgtttcgtggggtagcgagggttgcgaggcggatagtgggcgtaacgcgcggtttaggcggcgcgagggtagggcggttttagtaaggggggcggcgggtaagttgtcgtagggcgaggttcgcggtgttcgggggttggcgggcgcgtttagggggttggcggggggcgggggttcgggtgaggcggcggtaggtgcgggtttcgggggcgggcggcgtacgaggcgcggcgagtcgagcgttagcggttttacgagcggtcgcgttatttgcgggtagaagtttatgattacggtttgttgtagcgtggcgatggtcgaggtgatttgcggcggcggcggcggcgggaagaggtttaggcgttgatttagttcggtttgttgtattatttcgtcgtcgtatttgacgattttttggatgatggcgttttattggttgttgaatacgttcgagttaaggttatgttgtattttgtgtaggaggatggaattt

SEQ ID NO: 33022 - DNA, 902 bp, Artificial Sequence
  chemically treated genomic DNA (Homo sapiens) CpG-island No: 33022
aaattccatcctcctacacaaaatacaacataaccttaactcgaacgtattcaacaaccaataaaacgccatcatccaaaaaatcgtcaaatacgacgacgaaataatacaacaaaccgaactaaatcaacgcctaaacctcttcccgccgccgccgccgccgcaaatcacctcgaccatcgccacgctacaacaaaccgtaatcataaacttctacccgcaaataacgcgaccgctcgtaaaaccgctaacgctcgactcgccgcgcctcgtacgccgcccgcccccgaaacccgcacctaccgccgcctcacccgaacccccgccccccgccaaccccctaaacgcgcccgccaacccccgaacaccgcgaacctcgccctacgacaacttacccgccgccccccttactaaaaccgccctaccctcgcgccgcctaaaccgcgcgttacgcccactatccgcctcgcaaccctcgctaccccacgaaacgcccgtcccaacgacctccacacgcccgaccaacaactccacaccgcttctaaaacccacgcccgctacccgaaccgccgcgcccaacccgaatcgcaaaaactccgcctcacccgacgccgccaacgacctaaacccccaaaactccgcgcgctcgcgcctctcgtccaacttataaccctcgccaaccgccctacgaacccaaaaaaaccgaaaacgaaaccgtcatccaaaccaaaaccataccattacgctaccccgaccgccaacccgcccaaaaaccacaaacaaaacataaataaccgtaattaaactaacgaacaaaaccgacgaaacaaccccctccgcgtccccgaccgtccccccttatcgccctacgcccactcccatcgcccctacccccgacgacg

SEQ ID NO: 33023 - DNA, 902 bp, Artificial Sequence
  chemically treated genomic DNA (Homo sapiens) CpG-island No: 33023
gaattttatttttttgtataaggtgtagtatgattttaattcgggcgtatttaataattagtagaacgttattatttaggagatcgttaagtacgacggcgagatggtgtagtaggtcgagttgggttagcgtttgggttttttttcgtcgtcgtcgtcgtcgtaggttatttcggttatcgttacgttgtagtaggtcgtggttatgagtttttgttcgtaggtggcgcggtcgttcgtggggtcgttggcgttcggttcgtcgcgtttcgtgcgtcgttcgttttcggggttcgtatttgtcgtcgttttattcgggttttcgtttttcgttagttttttgggcgcgttcgttagttttcgggtatcgcggatttcgttttacggtagtttgttcgtcgttttttttgttgggatcgttttgttttcgcgtcgtttgagtcgcgcgttgcgtttattgttcgtttcgtagttttcgttgttttacggaacgttcgttttagcggtttttatacgttcggttagtagttttatatcgtttttgggatttacgttcgttgttcgggtcgtcgcgtttagttcggatcgtagggatttcgttttattcggcgtcgttagcggtttggatttttaggatttcgcgcgttcgcgtttttcgtttaatttgtgattttcgttaatcgttttgcgggtttaggagggtcggaggcggggtcgttatttagattaaagttatgttattgcgttgtttcggtcgttagttcgtttagaaattatagataagatataggtagtcgtagttggattgacgggtagggtcggcggggtagtttttttcgcgttttcggtcgtttttttttatcgttttgcgtttatttttatcgtttttgttttcggcggcg

SEQ ID NO: 33024 - DNA, 902 bp, Artificial Sequence
  chemically treated genomic DNA (Homo sapiens) CpG-island No: 33024
cgccgccgaaaacaaaaacgataaaaataaacgcaaaacgataaaaaaaaacgaccgaaaacgcgaaaaaaactaccccgccgaccctacccgtcaatccaactacgactacctatatcttatctataatttctaaacgaactaacgaccgaaacaacgcaataacataactttaatctaaataacgaccccgcctccgaccctcctaaacccgcaaaacgattaacgaaaatcacaaattaaacgaaaaacgcgaacgcgcgaaatcctaaaaatccaaaccgctaacgacgccgaataaaacgaaatccctacgatccgaactaaacgcgacgacccgaacaacgaacgtaaatcccaaaaacgatataaaactactaaccgaacgtataaaaaccgctaaaacgaacgttccgtaaaacaacgaaaactacgaaacgaacaataaacgcaacgcgcgactcaaacgacgcgaaaacaaaacgatcccaacaaaaaaaacgacgaacaaactaccgtaaaacgaaatccgcgatacccgaaaactaacgaacgcgcccaaaaaactaacgaaaaacgaaaacccgaataaaacgacgacaaatacgaaccccgaaaacgaacgacgcacgaaacgcgacgaaccgaacgccaacgaccccacgaacgaccgcgccacctacgaacaaaaactcataaccacgacctactacaacgtaacgataaccgaaataacctacgacgacgacgacgacgaaaaaaaacccaaacgctaacccaactcgacctactacaccatctcgccgtcgtacttaacgatctcctaaataataacgttctactaattattaaatacgcccgaattaaaatcatactacaccttatacaaaaaaataaaattc

SEQ ID NO: 33025 - DNA, 709 bp, Artificial Sequence
  chemically treated genomic DNA (Homo sapiens) CpG-island No: 33025
gtcgatgcggtttaggcggtcgatggttatcgtttcgaaggcgcgtcgtattatggggtatttttttagtatttcgttgaagttgtttacgtttagcgaaaggaggcggtaataggtgttggttcgtacgttcgttatgcggtggtttcgggtgagtaggtagattttttcgaagtaggagttatcgaatagttttatttttttgttgtttttagcgagtacgttgattacgtcgtgttgaatgaagtatattttttcgatggtgttttcgcggatgaggtagttattcggttggaagatttcgaatttgagtttggttagtatggtcgtgacgaagttggggttagtattggcgaatagcggtatggaggttattagttttcggtagttgaagttgataattttttttcgtaggggttcgttgagttcgtttaggatgttgttttcgtcgaatattttgttttggtaacggtgttcgtagtagtcgtggattttttggcggaagtcggtcggtagtttgtggaaggatatgtattgttttatttgtttgtatttttggtattggcgtcgcgaggagtttagcgattggatgagggtagtggcgtggtcgatgaatatggcgtagtaggtgttatttataattatgttgagtatggttagttagatgttcgttatgttttcgggcgtttgtcggttatatttaatgtat

SEQ ID NO: 33026 - DNA, 709 bp, Artificial Sequence
  chemically treated genomic DNA (Homo sapiens) CpG-island No: 33026
atacattaaatataaccgacaaacgcccgaaaacataacgaacatctaactaaccatactcaacataattataaataacacctactacgccatattcatcgaccacgccactaccctcatccaatcgctaaactcctcgcgacgccaataccaaaaatacaaacaaataaaacaatacatatccttccacaaactaccgaccgacttccgccaaaaaatccacgactactacgaacaccgttaccaaaacaaaatattcgacgaaaacaacatcctaaacgaactcaacgaacccctacgaaaaaaaattatcaacttcaactaccgaaaactaataacctccataccgctattcgccaatactaaccccaacttcgtcacgaccatactaaccaaactcaaattcgaaatcttccaaccgaataactacctcatccgcgaaaacaccatcgaaaaaatatacttcattcaacacgacgtaatcaacgtactcgctaaaaacaacaaaaaaataaaactattcgataactcctacttcgaaaaaatctacctactcacccgaaaccaccgcataacgaacgtacgaaccaacacctattaccgcctcctttcgctaaacgtaaacaacttcaacgaaatactaaaaaaataccccataatacgacgcgccttcgaaacgataaccatcgaccgcctaaaccgcatcgac

SEQ ID NO: 33027 - DNA, 709 bp, Artificial Sequence
  chemically treated genomic DNA (Homo sapiens) CpG-island No: 33027
gtgtattgggtatggtcggtaggcgttcgagagtatgacggatatttggttgattatgtttagtatgattgtgagtgatatttgttacgttatgtttatcggttacgttattgtttttatttagtcgttggatttttcgcggcgttaatattagaagtataagtaggtggagtagtatatgtttttttataagttgtcggtcgattttcgttagaagatttacgattattacgagtatcgttattagggtaagatgttcgacgaggatagtattttgggcgagtttaacgggtttttgcgggaggagattgttaattttaattgtcggaagttggtgatttttatgtcgttgttcgttaatgttgattttaatttcgttacggttatgttgattaagtttaagttcgaggttttttagtcgggtgattattttattcgcgaaggtattatcgggaagatgtattttatttagtacggcgtggttagcgtgttcgttaagggtaataaggagatgaagttgttcgatggtttttatttcggagagatttgtttgtttattcggggttatcgtatggcgagcgtgcgggttaatatttattgtcgttttttttcgttgagcgtggataattttaacgaggtgttggaggagtattttatgatgcggcgcgttttcgagacggtggttatcgatcgtttggatcgtatcggt

SEQ ID NO: 33028 - DNA, 709 bp, Artificial Sequence
  chemically treated genomic DNA (Homo sapiens) CpG-island No: 33028
accgatacgatccaaacgatcgataaccaccgtctcgaaaacgcgccgcatcataaaatactcctccaacacctcgttaaaattatccacgctcaacgaaaaaaaacgacaataaatattaacccgcacgctcgccatacgataaccccgaataaacaaacaaatctctccgaaataaaaaccatcgaacaacttcatctccttattacccttaacgaacacgctaaccacgccgtactaaataaaatacatcttcccgataataccttcgcgaataaaataatcacccgactaaaaaacctcgaacttaaacttaatcaacataaccgtaacgaaattaaaatcaacattaacgaacaacgacataaaaatcaccaacttccgacaattaaaattaacaatctcctcccgcaaaaacccgttaaactcgcccaaaatactatcctcgtcgaacatcttaccctaataacgatactcgtaataatcgtaaatcttctaacgaaaatcgaccgacaacttataaaaaaacatatactactccacctacttatacttctaatattaacgccgcgaaaaatccaacgactaaataaaaacaataacgtaaccgataaacataacgtaacaaatatcactcacaatcatactaaacataatcaaccaaatatccgtcatactctcgaacgcctaccgaccatacccaatacac

SEQ ID NO: 33029 - DNA, 557 bp, Artificial Sequence
  chemically treated genomic DNA (Homo sapiens) CpG-island No: 33029
  misc_feature (469)..(469): n is either a, c, g or t
tttttgttcgcgttttacggttttttggttgtcgaatattcgtagcgagaatttgttgacgtttagttgtaggagcgcgtcgaagtggcgttgtatgaagttggtttaagttgcggcgcggtttcgtcgtcgggtcgttatttcgttgtcggtttttttcgtcggtttcggtttcggtttcggcgcgggtttcgaggtcgtttcggggtataagaattatattttgggttttcgcgtcgggttttcgggtttcgcggggttgtattgcggttagtcgcgttcgtattcggtcgtttcggttgtttttggtcgtgttcgtcgtgttcgggatgtcggggttgtcgtattagttgtcgcggttgcggcgttggtttcgcgggtcgttttttttcgtcgttttcgggggtaacgtttcggttcggggcggttgttgttgggggggagcgacggtggcggggtttttttcggntcgttcgtcgttttcgcgcgcgtttatggcgaggcggcgttcggtagtgcggagcggagtcgtcgattagtttaagtttttatatggt

SEQ ID NO: 33030 - DNA, 557 bp, Artificial Sequence
  chemically treated genomic DNA (Homo sapiens) CpG-island No: 33030
  misc_feature (89)..(89): n is either a, c, g or t
accatataaaaacttaaactaatcgacgactccgctccgcactaccgaacgccgcctcgccataaacgcgcgcgaaaacgacgaacganccgaaaaaaaccccgccaccgtcgctcccccccaacaacaaccgccccgaaccgaaacgttacccccgaaaacgacgaaaaaaaacgacccgcgaaaccaacgccgcaaccgcgacaactaatacgacaaccccgacatcccgaacacgacgaacacgaccaaaaacaaccgaaacgaccgaatacgaacgcgactaaccgcaatacaaccccgcgaaacccgaaaacccgacgcgaaaacccaaaatataattcttataccccgaaacgacctcgaaacccgcgccgaaaccgaaaccgaaaccgacgaaaaaaaccgacaacgaaataacgacccgacgacgaaaccgcgccgcaacttaaaccaacttcatacaacgccacttcgacgcgctcctacaactaaacgtcaacaaattctcgctacgaatattcgacaaccaaaaaaccgtaaaacgcgaacaaaaa

SEQ ID NO: 33031 - DNA, 557 bp, Artificial Sequence
  chemically treated genomic DNA (Homo sapiens) CpG-island No: 33031
  misc_feature (89)..(89): n is either a, c, g or t
gttatgtaaagatttgaattggtcggcggtttcgtttcgtattgtcgggcgtcgtttcgttatggacgcgcgcgggggcggcgggcggntcggggagagtttcgttatcgtcgtttttttttaatagtagtcgtttcgggtcgaggcgttgttttcggaggcggcggaggagggcggttcgcggggttagcgtcgtagtcgcgatagttagtgcggtagtttcggtatttcgggtacggcgagtacggttaagggtagtcggaacggtcgagtgcgggcgcggttagtcgtagtgtagtttcgcggggttcgagggttcggcgcgggggtttaaggtgtagtttttgtgtttcggggcggtttcggggttcgcgtcggggtcggggtcggggtcggcggaggaggtcggtagcgaggtggcggttcggcggcggagtcgcgtcgtagtttgggttagttttatgtagcgttatttcggcgcgtttttgtagttgggcgttaataagttttcgttgcggatgttcggtagttagaaggtcgtggagcgcgagtaggag

SEQ ID NO: 33032 - DNA, 557 bp, Artificial Sequence
  chemically treated genomic DNA (Homo sapiens) CpG-island No: 33032
  misc_feature (469)..(469): n is either a, c, g or t
ctcctactcgcgctccacgaccttctaactaccgaacatccgcaacgaaaacttattaacgcccaactacaaaaacgcgccgaaataacgctacataaaactaacccaaactacgacgcgactccgccgccgaaccgccacctcgctaccgacctcctccgccgaccccgaccccgaccccgacgcgaaccccgaaaccgccccgaaacacaaaaactacaccttaaacccccgcgccgaaccctcgaaccccgcgaaactacactacgactaaccgcgcccgcactcgaccgttccgactacccttaaccgtactcgccgtacccgaaataccgaaactaccgcactaactatcgcgactacgacgctaaccccgcgaaccgccctcctccgccgcctccgaaaacaacgcctcgacccgaaacgactactattaaaaaaaaacgacgataacgaaactctccccganccgcccgccgcccccgcgcgcgtccataacgaaacgacgcccgacaatacgaaacgaaaccgccgaccaattcaaatctttacataac

SEQ ID NO: 33033 - DNA, 527 bp, Artificial Sequence
  chemically treated genomic DNA (Homo sapiens) CpG-island No: 33033
gcgggcggacgcggggttattaaacggtgatatttcgatttttggggtttggcgtttatcgcgggataaattaagagtaggattgagttcgcggtgggaattgtaattcggaaatttatgggcgtcggaattatttggttagatttcggggaggtgttttgaattatttcgggaatttttcgtttttaatttattttttttcgcggagagttcgggtttaacgcggagagaaggcgagagaagtcgcggtgttttagcgttgggatcggggatttgcggggaagtaaaggcgattcgtcgtagagaagtcgtgggaagggcgcggggaggtgtatgaagtgggcgtgcggagagaagtgggtgttgggcgcgtgggatttcgtcgcgtttgtttcgttgaggaggagttggaagaatatgttcgcgcgattttggggagtttttggcgtagagtggggtgtgtcggaggtatcggcggtgcgtaggattggttgtttttttgagcgtttttgttttgtcgtagtcgt

SEQ ID NO: 33034 - DNA, 527 bp, Artificial Sequence
  chemically treated genomic DNA (Homo sapiens) CpG-island No: 33034
acgactacgacaaaacaaaaacgctcaaaaaaacaaccaatcctacgcaccgccgatacctccgacacaccccactctacgccaaaaactccccaaaatcgcgcgaacatattcttccaactcctcctcaacgaaacaaacgcgacgaaatcccacgcgcccaacacccacttctctccgcacgcccacttcatacacctccccgcgcccttcccacgacttctctacgacgaatcgcctttacttccccgcaaatccccgatcccaacgctaaaacaccgcgacttctctcgccttctctccgcgttaaacccgaactctccgcgaaaaaaaataaattaaaaacgaaaaattcccgaaataattcaaaacacctccccgaaatctaaccaaataattccgacgcccataaatttccgaattacaattcccaccgcgaactcaatcctactcttaatttatcccgcgataaacgccaaaccccaaaaatcgaaatatcaccgtttaataaccccgcgtccgcccgc

SEQ ID NO: 33035 - DNA, 527 bp, Artificial Sequence
  chemically treated genomic DNA (Homo sapiens) CpG-island No: 33035
acggttgcggtaaggtaggggcgtttagaaaggtagttagttttgcgtatcgtcggtgttttcggtatattttattttgcgttaggggttttttagggtcgcgcgagtatgtttttttagtttttttttagcgaagtaggcgcggcggggttttacgcgtttagtatttattttttttcgtacgtttattttatgtattttttcgcgttttttttacggtttttttgcggcgagtcgtttttgttttttcgtaggttttcggttttagcgttaaggtatcgcggtttttttcgtttttttttcgcgttgaattcgggtttttcgcggggagaaataggttgggggcgaggggttttcgagataatttaggatattttttcggggtttagttaggtaatttcgacgtttatggattttcggattatagtttttatcgcgggtttagttttatttttagtttatttcgcggtgagcgttaagttttaaaagtcggagtgttatcgtttggtgatttcgcgttcgttcgt

SEQ ID NO: 33036 - DNA, 527 bp, Artificial Sequence
  chemically treated genomic DNA (Homo sapiens) CpG-island No: 33036
acgaacgaacgcgaaatcaccaaacgataacactccgacttttaaaacttaacgctcaccgcgaaataaactaaaaataaaactaaacccgcgataaaaactataatccgaaaatccataaacgtcgaaattacctaactaaaccccgaaaaaatatcctaaattatctcgaaaacccctcgcccccaacctatttctccccgcgaaaaacccgaattcaacgcgaaaaaaaaacgaaaaaaaccgcgataccttaacgctaaaaccgaaaacctacgaaaaaacaaaaacgactcgccgcaaaaaaaccgtaaaaaaaacgcgaaaaaatacataaaataaacgtacgaaaaaaaataaatactaaacgcgtaaaaccccgccgcgcctacttcgctaaaaaaaaactaaaaaaacatactcgcgcgaccctaaaaaacccctaacgcaaaataaaatataccgaaaacaccgacgatacgcaaaactaactacctttctaaacgcccctaccttaccgcaaccgt

SEQ ID NO: 33037 - DNA, 950 bp, Artificial Sequence
  chemically treated genomic DNA (Homo sapiens) CpG-island No: 33037
tttatggtatgtacggtattttcgcggttggtgaagtgtacgaaggcgtagtcgcggatttttttgacgcgttttacgtagtcggggttgaattggtcgaagttttttttgatggtgttttcggtggtttcgattatgaggttgcgtacgtagaggatttttacggtttttattacgttttcgtttacgtcgattttaggttcggtttagtttacggcgatttggtggttttatagttggatgcggttaggtatgagtttgcggcgagttatggtagtcgcgcggtggttttcgtattttacgaaggcgaagtcgcggttttttattttgtcggtcgcgttggcgtagacgattacgtttagtacgttttcggtgattttggtaattttttttaggattttttcgcgtttttttattttggggatttcgtcgatgaagaggcggtagttgtttacgttgtagtatacgtcgagtaggcggttcgggcggatttcgtagttgttgagtttacgtattgcgcgtttggtttcgtgtttgtggtagtatatgacgaaggcgtagtcgcggtttttgtcgttaaagtttattatgaggcgtagttcgtagatgcggtttacggtttcgaatacgggtattagttcgttttcgtatacgtcgcgcgggattttgtttacgaagatttcgtagttacgttgcgggtgcgggtttttttagtcgggcggtgggtcgtcgtatttgcgttgttcgtttttttgtattatgttgtagttcgtgcgttttattagcgttagtagtgttgtttcgttgggcgcgttcgttacgttttcgggtattttggcggaggattcggcggtcgagttattgtttatggttgcggtggaattttttgcggttataatgttaaaggtatttatagttggcggaaatttggggaagtagaaagaagcgtg

SEQ ID NO: 33038 - DNA, 950 bp, Artificial Sequence
  chemically treated genomic DNA (Homo sapiens) CpG-island No: 33038
cacgcttctttctacttccccaaatttccgccaactataaatacctttaacattataaccgcaaaaaattccaccgcaaccataaacaataactcgaccgccgaatcctccgccaaaatacccgaaaacgtaacgaacgcgcccaacgaaacaacactactaacgctaataaaacgcacgaactacaacataatacaaaaaaacgaacaacgcaaatacgacgacccaccgcccgactaaaaaaacccgcacccgcaacgtaactacgaaatcttcgtaaacaaaatcccgcgcgacgtatacgaaaacgaactaatacccgtattcgaaaccgtaaaccgcatctacgaactacgcctcataataaactttaacgacaaaaaccgcgactacgccttcgtcatatactaccacaaacacgaaaccaaacgcgcaatacgtaaactcaacaactacgaaatccgcccgaaccgcctactcgacgtatactacaacgtaaacaactaccgcctcttcatcgacgaaatccccaaaataaaaaaacgcgaaaaaatcctaaaaaaaattaccaaaatcaccgaaaacgtactaaacgtaatcgtctacgccaacgcgaccgacaaaataaaaaaccgcgacttcgccttcgtaaaatacgaaaaccaccgcgcgactaccataactcgccgcaaactcatacctaaccgcatccaactataaaaccaccaaatcgccgtaaactaaaccgaacctaaaatcgacgtaaacgaaaacgtaataaaaaccgtaaaaatcctctacgtacgcaacctcataatcgaaaccaccgaaaacaccatcaaaaaaaacttcgaccaattcaaccccgactacgtaaaacgcgtcaaaaaaatccgcgactacgccttcgtacacttcaccaaccgcgaaaataccgtacataccataaa

SEQ ID NO: 33039 - DNA, 950 bp, Artificial Sequence
  chemically treated genomic DNA (Homo sapiens) CpG-island No: 33039
tacgtttttttttgtttttttaggttttcgttagttgtggatgtttttgatattatgatcgtagaggattttatcgtagttatgagtagtgattcggtcgtcgggtttttcgttaaggtgttcgagggcgtggcgggcgcgtttaacgaggtagtattgttggcgttgatggagcgtacgggttatagtatggtgtaagagaacgggtagcgtaagtacggcggtttatcgttcggttgggagggttcgtattcgtagcgtggttgcgaggttttcgtgggtaagatttcgcgcgacgtgtacgaggacgagttggtgttcgtgttcgaggtcgtgggtcgtatttacgagttgcgttttatgatggattttgacggtaagaatcgcggttacgttttcgttatgtattgttataagtacgaggttaagcgcgtagtgcgtgagtttaataattacgagattcgttcgggtcgtttgttcggcgtgtgttgtagcgtggataattgtcgtttttttatcggcgggatttttaagatgaagaagcgcgaggaaattttggaggagattgttaaggttatcgagggcgtgttggacgtgatcgtttacgttagcgcggtcgataagatgaagaatcgcggtttcgttttcgtggagtacgagagttatcgcgcggttgttatggttcgtcgtaagtttatgtttggtcgtatttagttgtggggttattagatcgtcgtggattgggtcgaatttgagatcgacgtggacgaggacgtgatggagatcgtgaagattttttacgtgcgtaattttatgatcgagattatcgaggatattattaagaagagtttcggttagtttaatttcggttgcgtggagcgcgttaagaagattcgcgattacgttttcgtgtattttattagtcgcgaggatgtcgtgtatgttatgaa

SEQ ID NO: 33040 - DNA, 950 bp, Artificial Sequence
  chemically treated genomic DNA (Homo sapiens) CpG-island No: 33040
ttcataacatacacgacatcctcgcgactaataaaatacacgaaaacgtaatcgcgaatcttcttaacgcgctccacgcaaccgaaattaaactaaccgaaactcttcttaataatatcctcgataatctcgatcataaaattacgcacgtaaaaaatcttcacgatctccatcacgtcctcgtccacgtcgatctcaaattcgacccaatccacgacgatctaataaccccacaactaaatacgaccaaacataaacttacgacgaaccataacaaccgcgcgataactctcgtactccacgaaaacgaaaccgcgattcttcatcttatcgaccgcgctaacgtaaacgatcacgtccaacacgccctcgataaccttaacaatctcctccaaaatttcctcgcgcttcttcatcttaaaaatcccgccgataaaaaaacgacaattatccacgctacaacacacgccgaacaaacgacccgaacgaatctcgtaattattaaactcacgcactacgcgcttaacctcgtacttataacaatacataacgaaaacgtaaccgcgattcttaccgtcaaaatccatcataaaacgcaactcgtaaatacgacccacgacctcgaacacgaacaccaactcgtcctcgtacacgtcgcgcgaaatcttacccacgaaaacctcgcaaccacgctacgaatacgaaccctcccaaccgaacgataaaccgccgtacttacgctacccgttctcttacaccatactataacccgtacgctccatcaacgccaacaatactacctcgttaaacgcgcccgccacgccctcgaacaccttaacgaaaaacccgacgaccgaatcactactcataactacgataaaatcctctacgatcataatatcaaaaacatccacaactaacgaaaacctaaaaaaacaaaaaaaaacgta

SEQ ID NO: 33041 - DNA, 603 bp, Artificial Sequence
  chemically treated genomic DNA (Homo sapiens) CpG-island No: 33041
aaaggggcgaaggggcggggtggcgttgggtgggagcgcggcggcggggaggagggtttgggagttcgggtgcgatttgtaagcgttttgagtttgcgttcgtcgagggggagggtttttttagttcggtcggagttgcggttgtgcgttgtttttggtttataacgtcgacgattgttaagagagttggggagtggaattgtcggaagtgtttgcgcgtcgtgagagaaatttttttgtttcggtcgcggtcggagtttcgtcgttttcgcgtttcgaacgacgatgcgtttagatgataataatttgaggggattcgcgtttcggttcgtcgttcgcgtttgcgtcgtttagtttcgggggaggaagattgagttcggcgtagcgggcggcgtcggggttcgatttttttcgcgtaattagttttttcgcgtttcggcgtttttttcgcgatcggcgattttagcgtcgtcgcgtcgtcggtgttttcgttttgatttcggttcggacgtgtcgcggttcgttggtagttttggtgttatgggttgttattttggagtttagcgatttttatttggatagtttagattttagggagcgttt

SEQ ID NO: 33042 - DNA, 603 bp, Artificial Sequence
  chemically treated genomic DNA (Homo sapiens) CpG-island No: 33042
aaacgctccctaaaatctaaactatccaaataaaaatcgctaaactccaaaataacaacccataacaccaaaactaccaacgaaccgcgacacgtccgaaccgaaatcaaaacgaaaacaccgacgacgcgacgacgctaaaatcgccgatcgcgaaaaaaacgccgaaacgcgaaaaaactaattacgcgaaaaaaatcgaaccccgacgccgcccgctacgccgaactcaatcttcctcccccgaaactaaacgacgcaaacgcgaacgacgaaccgaaacgcgaatcccctcaaattattatcatctaaacgcatcgtcgttcgaaacgcgaaaacgacgaaactccgaccgcgaccgaaacaaaaaaatttctctcacgacgcgcaaacacttccgacaattccactccccaactctcttaacaatcgtcgacgttataaaccaaaaacaacgcacaaccgcaactccgaccgaactaaaaaaaccctccccctcgacgaacgcaaactcaaaacgcttacaaatcgcacccgaactcccaaaccctcctccccgccgccgcgctcccacccaacgccaccccgccccttcgccccttt

SEQ ID NO: 33043 - DNA, 603 bp, Artificial Sequence
  chemically treated genomic DNA (Homo sapiens) CpG-island No: 33043
aagcgttttttgaaatttgggttgtttaagtaggaatcgttgaattttagagtggtagtttatggtattagggttgttagcgggtcgcgatacgttcgggtcgaggttagggcgggggtatcggcggcgcggcggcgttggggtcgtcgatcgcggggaaggcgtcgggacgcgaggggattgattgcgcggaggaaatcgggtttcgacgtcgttcgttgcgtcgggtttagtttttttttttcgaggttaggcgacgtaggcgcgggcggcgggtcgaggcgcgagtttttttaggttgttgttatttggacgtatcgtcgttcggaacgcgggggcggcgaggtttcggtcgcggtcggagtaggaaagttttttttacggcgcgtagatattttcggtagttttattttttaatttttttgatagtcgtcggcgttgtgagttagaagtagcgtatagtcgtaatttcggtcgggttggggaaattttttttttcggcggacgtaggtttagagcgtttgtaaatcgtattcgggtttttagattttttttttcgtcgtcgcgtttttatttagcgttatttcgttttttcgttttttt

SEQ ID NO: 33044 - DNA, 603 bp, Artificial Sequence
  chemically treated genomic DNA (Homo sapiens) CpG-island No: 33044
aaaaaaacgaaaaaacgaaataacgctaaataaaaacgcgacgacgaaaaaaaaaatctaaaaacccgaatacgatttacaaacgctctaaacctacgtccgccgaaaaaaaaaatttccccaacccgaccgaaattacgactatacgctacttctaactcacaacgccgacgactatcaaaaaaattaaaaaataaaactaccgaaaatatctacgcgccgtaaaaaaaactttcctactccgaccgcgaccgaaacctcgccgcccccgcgttccgaacgacgatacgtccaaataacaacaacctaaaaaaactcgcgcctcgacccgccgcccgcgcctacgtcgcctaacctcgaaaaaaaaaaactaaacccgacgcaacgaacgacgtcgaaacccgatttcctccgcgcaatcaatcccctcgcgtcccgacgccttccccgcgatcgacgaccccaacgccgccgcgccgccgatacccccgccctaacctcgacccgaacgtatcgcgacccgctaacaaccctaataccataaactaccactctaaaattcaacgattcctacttaaacaacccaaatttcaaaaaacgctt

SEQ ID NO: 33045 - DNA, 820 bp, Artificial Sequence
  chemically treated genomic DNA (Homo sapiens) CpG-island No: 33045
  misc_feature (279)..(279): n is either a, c, g or t
agcgcgagacggggtttcgaggattgttaattttattacggtggttttttcggggtttcgtttttttttgagcgtgcgtgggtttttttgatttcgtgatatagtgtacgcggcgtattggtttttaggagttggggcgtaggtttggttcggaattttcggcggagcggtttgggcggtggggacgttttatcgggcggttggcgtgtacgtcgtcggggttacgcggttttttcgacggattcgagtttttcgtggcggggatggggcggtattagnttcggttttttcgaacgatcgggttcggtttagttttagagcgtttagtcgttgcgtttatttttttgcgtacgtttagtaacgagtaatagtttttattgtttagttttttttcgtttaaggtcgtcgttattttcgtaattttttatttcgttaaatcggtaaggtcgtgtttaagaggggttagtgattcgcgttagggatagcgcgggttagtcggttgcgttatagcggttcgttggggttcggtagcgtatcgcgttcggcggagatgcgtttgcgttgtgtcgttcgtaggaaaatagtggggtatgtgcgaggttattggtgggttttcggtttgtagcgtggatagacgtgatttatgagaattgggcgcggtagatttatcgcgtgttatgtttgattttttatataacgtagcgatatcggcgtatattagtttattatttcgtggtttcgattgatatttagagggttacgtgggtttttttatcgtgtgatatagggggtaatacggttgtttttcgtatttttgaga

SEQ ID NO: 33046 - DNA, 820 bp, Artificial Sequence
  chemically treated genomic DNA (Homo sapiens) CpG-island No: 33046
  misc_feature (542)..(542): n is either a, c, g or t
tctcaaaaatacgaaaaacaaccgtattaccccctatatcacacgataaaaaaacccacgtaaccctctaaatatcaatcgaaaccacgaaataataaactaatatacgccgatatcgctacgttatataaaaaatcaaacataacacgcgataaatctaccgcgcccaattctcataaatcacgtctatccacgctacaaaccgaaaacccaccaataacctcgcacataccccactattttcctacgaacgacacaacgcaaacgcatctccgccgaacgcgatacgctaccgaaccccaacgaaccgctataacgcaaccgactaacccgcgctatccctaacgcgaatcactaacccctcttaaacacgaccttaccgatttaacgaaataaaaaattacgaaaataacgacgaccttaaacgaaaaaaaactaaacaataaaaactattactcgttactaaacgtacgcaaaaaaataaacgcaacgactaaacgctctaaaactaaaccgaacccgatcgttcgaaaaaaccgaanctaataccgccccatccccgccacgaaaaactcgaatccgtcgaaaaaaccgcgtaaccccgacgacgtacacgccaaccgcccgataaaacgtccccaccgcccaaaccgctccgccgaaaattccgaaccaaacctacgccccaactcctaaaaaccaatacgccgcgtacactatatcacgaaatcaaaaaaacccacgcacgctcaaaaaaaaacgaaaccccgaaaaaaccaccgtaataaaattaacaatcctcgaaaccccgtctcgcgct

SEQ ID NO: 33047 - DNA, 820 bp, Artificial Sequence
  chemically treated genomic DNA (Homo sapiens) CpG-island No: 33047
  misc_feature (542)..(542): n is either a, c, g or t
ttttaaaagtacggaaagtaatcgtgttgttttttatgttatacgataaaaagatttacgtaattttttgagtgttagtcgaggttacgagatggtgagttaatatgcgtcggtgtcgttgcgttatatggaagattagatatagtacgcggtgggtttatcgcgtttagtttttataagttacgtttatttacgttataggtcgggggtttattaatagtttcgtatatattttattatttttttgcgggcggtataacgtaggcgtattttcgtcgggcgcggtacgttatcgggttttagcgggtcgttgtgacgtagtcggttggttcgcgttgtttttgacgcggattattggttttttttgagtacggttttgtcggtttggcggggtgaaaggttgcgaagatggcgacggttttgagcgaggaggagttggataatgaagattattattcgttgttgaacgtgcgtagggaggtgagcgtagcggttggacgttttggggttgagtcgagttcggtcgttcgggagggtcgggnttggtgtcgttttattttcgttacgggaggttcgggttcgtcggggaggtcgcgtgatttcggcgacgtgtacgttagtcgttcgatggagcgtttttatcgtttagatcgtttcgtcgggggtttcgggttaagtttacgttttagtttttgaaggttagtgcgtcgcgtgtattgtgttacgggattagagaggtttacgtacgtttaagaggaaacggggtttcgaggaggttatcgtagtggggttagtagttttcgagatttcgtttcgcgtt

SEQ ID NO: 33048 - DNA, 820 bp, Artificial Sequence
  chemically treated genomic DNA (Homo sapiens) CpG-island No: 33048
  misc_feature (279)..(279): n is either a, c, g or t
aacgcgaaacgaaatctcgaaaactactaaccccactacgataacctcctcgaaaccccgtttcctcttaaacgtacgtaaacctctctaatcccgtaacacaatacacgcgacgcactaaccttcaaaaactaaaacgtaaacttaacccgaaacccccgacgaaacgatctaaacgataaaaacgctccatcgaacgactaacgtacacgtcgccgaaatcacgcgacctccccgacgaacccgaacctcccgtaacgaaaataaaacgacaccaancccgaccctcccgaacgaccgaactcgactcaaccccaaaacgtccaaccgctacgctcacctccctacgcacgttcaacaacgaataataatcttcattatccaactcctcctcgctcaaaaccgtcgccatcttcgcaacctttcaccccgccaaaccgacaaaaccgtactcaaaaaaaaccaataatccgcgtcaaaaacaacgcgaaccaaccgactacgtcacaacgacccgctaaaacccgataacgtaccgcgcccgacgaaaatacgcctacgttataccgcccgcaaaaaaataataaaatatatacgaaactattaataaacccccgacctataacgtaaataaacgtaacttataaaaactaaacgcgataaacccaccgcgtactatatctaatcttccatataacgcaacgacaccgacgcatattaactcaccatctcgtaacctcgactaacactcaaaaaattacgtaaatctttttatcgtataacataaaaaacaacacgattactttccgtacttttaaaa

SEQ ID NO: 33049 - DNA, 964 bp, Artificial Sequence
  chemically treated genomic DNA (Homo sapiens) CpG-island No: 33049
  misc_feature (424)..(424): n is either a, c, g or t
cgtacgtttagtcgtttcgagagtcgtattcggcggattcggtttttaggttcgttttcggggtatttggcgggcgtttatttttcggggggtacgtgttttcgtacgtagcgcgagggtagcgggtgtttggttatttattaggaaaagtttcgcgcggatttttcggattgaggagggtgggaaattcggttgtttagcgttttattcgggcggtcgggttggcgtttttttgttttcggtcggcgttttattttgggataggtaattatgagttattcgtttcgcggttatatgggtaacgtgattaaaataaagtttcggtattttaagtcgttagaaaaggggataacggagtttatcgggggcgggtataggaggcgggcgtaggcgggcggcgcggggtcgtggggacgcggttagngtgggcggtggtttggcgggaggttcgtttttttttacggtcggtagcgacgttcggatttttaggtagtcggattttagggcgcggtatttttgcggattttagtttcgaggtttttcgcgttcggttttttatcggtagcggcggcgggttgcgggatttcggagatttcggcgcgtttttatagttatcgggattttacgcgttagtagcggttttttcgggaacgttttttagtttcgggagtaacgcgggaaaagtttagcgtgttaatgagggagcgttttttttatgacgtttacgttcgggggcgggttttttttcgtcgttttcgagtttcggaattttttttgattggtttggacggtttgggaaatattgtagtgacgtttaattaaaacgttacgtttcggtttcgaggaaatatttcgtgtcgggttcgttttgattggatagttttttcgggttttggttattaggaagttttgtttaggttcggaaggcgggtttttttgggagtgggtggggagggggcgttga

SEQ ID NO: 33050 - DNA, 964 bp, Artificial Sequence
  chemically treated genomic DNA (Homo sapiens) CpG-island No: 33050
  misc_feature (541)..(541): n is either a, c, g or t
tcaacgccccctccccacccactcccaaaaaaacccgccttccgaacctaaacaaaacttcctaataaccaaaacccgaaaaaactatccaatcaaaacgaacccgacacgaaatatttcctcgaaaccgaaacgtaacgttttaattaaacgtcactacaatatttcccaaaccgtccaaaccaatcaaaaaaaattccgaaactcgaaaacgacgaaaaaaaacccgcccccgaacgtaaacgtcataaaaaaaacgctccctcattaacacgctaaacttttcccgcgttactcccgaaactaaaaaacgttcccgaaaaaaccgctactaacgcgtaaaatcccgataactataaaaacgcgccgaaatctccgaaatcccgcaacccgccgccgctaccgataaaaaaccgaacgcgaaaaacctcgaaactaaaatccgcaaaaataccgcgccctaaaatccgactacctaaaaatccgaacgtcgctaccgaccgtaaaaaaaaacgaacctcccgccaaaccaccgcccacnctaaccgcgtccccacgaccccgcgccgcccgcctacgcccgcctcctatacccgcccccgataaactccgttatccccttttctaacgacttaaaataccgaaactttattttaatcacgttacccatataaccgcgaaacgaataactcataattacctatcccaaaataaaacgccgaccgaaaacaaaaaaacgccaacccgaccgcccgaataaaacgctaaacaaccgaatttcccaccctcctcaatccgaaaaatccgcgcgaaacttttcctaataaataaccaaacacccgctaccctcgcgctacgtacgaaaacacgtaccccccgaaaaataaacgcccgccaaataccccgaaaacgaacctaaaaaccgaatccgccgaatacgactctcgaaacgactaaacgtacg

SEQ ID NO: 33051 - DNA, 964 bp, Artificial Sequence
  chemically treated genomic DNA (Homo sapiens) CpG-island No: 33051
  misc_feature (541)..(541): n is either a, c, g or t
ttaacgttttttttttatttatttttaggaaagttcgtttttcggatttaaataaagttttttagtggttagaattcgaaagaattgtttaattaggacgggttcgatacggaatattttttcgaggtcgagacgtggcgttttgattgggcgttattatagtgttttttaggtcgtttagattaattaaagggggtttcggaattcgggagcggcgaagggaagttcgttttcgagcgtgaacgttatgaggaaggcgtttttttattggtacgttgggtttttttcgcgttgttttcggggttgaaggacgttttcggggaagtcgttgttggcgcgtggggtttcggtggttgtggggacgcgtcgggattttcgggatttcgtagttcgtcgtcgttgtcggtggggagtcggacgcggggggtttcggggttgaggttcgtaggggtgtcgcgttttggagttcgattgtttaggagttcgggcgtcgttgtcggtcgtgggggagggcgagtttttcgttaggttatcgtttatnttagtcgcgtttttacggtttcgcgtcgttcgtttgcgttcgttttttgtgttcgttttcggtgagtttcgttgtttttttttttggcggtttaaaatatcgaaattttattttggttacgttgtttatgtgatcgcggagcggatgatttatggttgtttgttttaggatgaagcgtcggtcgaaagtagagaagcgttagttcggtcgttcgggtggagcgttgggtagtcgagttttttattttttttaattcggagagttcgcgcggggttttttttaataaatagttaggtattcgttgttttcgcgttgcgtacgggagtacgtgtttttcgggaggtgggcgttcgttaggtgtttcgggaacgagtttaggaatcgggttcgtcgagtgcggttttcggggcggttaggcgtgcg

SEQ ID NO: 33052 - DNA, 964 bp, Artificial Sequence
  chemically treated genomic DNA (Homo sapiens) CpG-island No: 33052
  misc_feature (424)..(424): n is either a, c, g or t
cgcacgcctaaccgccccgaaaaccgcactcgacgaacccgattcctaaactcgttcccgaaacacctaacgaacgcccacctcccgaaaaacacgtactcccgtacgcaacgcgaaaacaacgaatacctaactatttattaaaaaaaaccccgcgcgaactctccgaattaaaaaaaataaaaaactcgactacccaacgctccacccgaacgaccgaactaacgcttctctactttcgaccgacgcttcatcctaaaacaaacaaccataaatcatccgctccgcgatcacataaacaacgtaaccaaaataaaatttcgatattttaaaccgccaaaaaaaaaaacaacgaaactcaccgaaaacgaacacaaaaaacgaacgcaaacgaacgacgcgaaaccgtaaaaacgcgactaanataaacgataacctaacgaaaaactcgccctcccccacgaccgacaacgacgcccgaactcctaaacaatcgaactccaaaacgcgacacccctacgaacctcaaccccgaaaccccccgcgtccgactccccaccgacaacgacgacgaactacgaaatcccgaaaatcccgacgcgtccccacaaccaccgaaaccccacgcgccaacaacgacttccccgaaaacgtccttcaaccccgaaaacaacgcgaaaaaaacccaacgtaccaataaaaaaacgccttcctcataacgttcacgctcgaaaacgaacttcccttcgccgctcccgaattccgaaaccccctttaattaatctaaacgacctaaaaaacactataataacgcccaatcaaaacgccacgtctcgacctcgaaaaaatattccgtatcgaacccgtcctaattaaacaattctttcgaattctaaccactaaaaaactttatttaaatccgaaaaacgaactttcctaaaaataaataaaaaaaaaacgttaa

SEQ ID NO: 33053 - DNA, 704 bp, Artificial Sequence
  chemically treated genomic DNA (Homo sapiens) CpG-island No: 33053
atcgcgcgtttttatgttggaataggtatcgcgcgtttttatgttggaatagatatcgcgcgattttatgttggaatatatattataagattttagattggaataaattttggtacgtttttatattggaatacgtatcgtacgattttatattggaatacgtatcgtacgattttatattggaatacgtatcgtacgattttatattggaatacgtatcgtacgattttatattggaatacgtatcgtacgattttatattggaatacgtatcgtacgattttatattggaatacgtatcgtacgattttatattggaatacgtatcgtacgattttatattggaatacgtatcgtacgattttatattggaatacgtatcgtacgattttatattggaatacgtatcgtacgattttatattggaatacgtatcgtacgattttatattggaatacgtatcgtacgattttatattggaatacgtatcgtacgattttatattggaatacgtatcgtacgattttatattggaatacgtatcgtacgattttatattggaatacgtatcgtacgattttatattggaatacgtatcgtacgattttatattggaatacgtatcgtacgattttatattggaatacgtatcgtacgattttatattggaatacgtatcgtacgattttatattggaatacgta

SEQ ID NO: 33054 - DNA, 704 bp, Artificial Sequence
  chemically treated genomic DNA (Homo sapiens) CpG-island No: 33054
tacgtattccaatataaaatcgtacgatacgtattccaatataaaatcgtacgatacgtattccaatataaaatcgtacgatacgtattccaatataaaatcgtacgatacgtattccaatataaaatcgtacgatacgtattccaatataaaatcgtacgatacgtattccaatataaaatcgtacgatacgtattccaatataaaatcgtacgatacgtattccaatataaaatcgtacgatacgtattccaatataaaatcgtacgatacgtattccaatataaaatcgtacgatacgtattccaatataaaatcgtacgatacgtattccaatataaaatcgtacgatacgtattccaatataaaatcgtacgatacgtattccaatataaaatcgtacgatacgtattccaatataaaatcgtacgatacgtattccaatataaaatcgtacgatacgtattccaatataaaatcgtacgatacgtattccaatataaaatcgtacgatacgtattccaatataaaatcgtacgatacgtattccaatataaaatcgtacgatacgtattccaatataaaaacgtaccaaaatttattccaatctaaaatcttataatatatattccaacataaaatcgcgcgatatctattccaacataaaaacgcgcgatacctattccaacataaaaacgcgcgat

SEQ ID NO: 33055 - DNA, 704 bp, Artificial Sequence
  chemically treated genomic DNA (Homo sapiens) CpG-island No: 33055
tgcgtgttttagtgtagggtcgtgcggtgcgtgttttagtgtagggtcgtgcggtgcgtgttttagtgtagggtcgtgcggtgcgtgttttagtgtagggtcgtgcggtgcgtgttttagtgtagggtcgtgcggtgcgtgttttagtgtagggtcgtgcggtgcgtgttttagtgtagggtcgtgcggtgcgtgttttagtgtagggtcgtgcggtgcgtgttttagtgtagggtcgtgcggtgcgtgttttagtgtagggtcgtgcggtgcgtgttttagtgtagggtcgtgcggtgcgtgttttagtgtagggtcgtgcggtgcgtgttttagtgtagggtcgtgcggtgcgtgttttagtgtagggtcgtgcggtgcgtgttttagtgtagggtcgtgcggtgcgtgttttagtgtagggtcgtgcggtgcgtgttttagtgtagggtcgtgcggtgcgtgttttagtgtagggtcgtgcggtgcgtgttttagtgtagggtcgtgcggtgcgtgttttagtgtagggtcgtgcggtgcgtgttttagtgtagggtcgtgcggtgcgtgttttagtgtaggaacgtgttagggtttgttttagtttaggattttgtgatgtgtgttttagtataggatcgcgcggtgtttgttttagtataggaacgcgcggtgtttgttttagtataggaacgcgcggt

SEQ ID NO: 33056 - DNA, 704 bp, Artificial Sequence
  chemically treated genomic DNA (Homo sapiens) CpG-island No: 33056
accgcgcgttcctatactaaaacaaacaccgcgcgttcctatactaaaacaaacaccgcgcgatcctatactaaaacacacatcacaaaatcctaaactaaaacaaaccctaacacgttcctacactaaaacacgcaccgcacgaccctacactaaaacacgcaccgcacgaccctacactaaaacacgcaccgcacgaccctacactaaaacacgcaccgcacgaccctacactaaaacacgcaccgcacgaccctacactaaaacacgcaccgcacgaccctacactaaaacacgcaccgcacgaccctacactaaaacacgcaccgcacgaccctacactaaaacacgcaccgcacgaccctacactaaaacacgcaccgcacgaccctacactaaaacacgcaccgcacgaccctacactaaaacacgcaccgcacgaccctacactaaaacacgcaccgcacgaccctacactaaaacacgcaccgcacgaccctacactaaaacacgcaccgcacgaccctacactaaaacacgcaccgcacgaccctacactaaaacacgcaccgcacgaccctacactaaaacacgcaccgcacgaccctacactaaaacacgcaccgcacgaccctacactaaaacacgcaccgcacgaccctacactaaaacacgcaccgcacgaccctacactaaaacacgca

SEQ ID NO: 33057 - DNA, 601 bp, Artificial Sequence
  chemically treated genomic DNA (Homo sapiens) CpG-island No: 33057
cgagaagtgacgatattacggggcggaggggaacggagaggaaagttgttgacgttagggagagatgtcgttgggttaggtacggttgttcgtaggagaggttttcgtagggagaggtatcgttggattaggcgagggtgcgcgtaggagaggttttcgtagggagaggtatcgttggattaggcgagggtgcgcgtaggggaggttttcgtagggagaggtatcgttggattaggcgagggtgcgcgtaggggaggttttcgtagggagaggtatcgttggattaggcgagggtgcgcgtaggggaggttttcgtagggagaggtatcgttggattaggcgagggtgcgcgtaggggaggttttcgtagggagaggtatcgttggattaggcgagggtgttcgtaggagaggttttcgtagggagaggtatcgttggattaggcgagggtgcgcgtaggagaggttttcgtagggagaggtatcgttggattaggcgagggtgcgcgtaggggaggttttcgtagggagcggtgtcgttgggttaggtacgggtgttcgtaggagaggttttcgtagggagaggtgtcgttgggttaggt

SEQ ID NO: 33058 - DNA, 601 bp, Artificial Sequence
  chemically treated genomic DNA (Homo sapiens) CpG-island No: 33058
acctaacccaacgacacctctccctacgaaaacctctcctacgaacacccgtacctaacccaacgacaccgctccctacgaaaacctcccctacgcgcaccctcgcctaatccaacgatacctctccctacgaaaacctctcctacgcgcaccctcgcctaatccaacgatacctctccctacgaaaacctctcctacgaacaccctcgcctaatccaacgatacctctccctacgaaaacctcccctacgcgcaccctcgcctaatccaacgatacctctccctacgaaaacctcccctacgcgcaccctcgcctaatccaacgatacctctccctacgaaaacctcccctacgcgcaccctcgcctaatccaacgatacctctccctacgaaaacctcccctacgcgcaccctcgcctaatccaacgatacctctccctacgaaaacctctcctacgcgcaccctcgcctaatccaacgatacctctccctacgaaaacctctcctacgaacaaccgtacctaacccaacgacatctctccctaacgtcaacaactttcctctccgttcccctccgccccgtaatatcgtcacttctcg

SEQ ID NO: 33059 - DNA, 601 bp, Artificial Sequence
  chemically treated genomic DNA (Homo sapiens) CpG-island No: 33059
gtttggtttagcggtatttttttttgcggaggttttttttgcgggtattcgtgtttggtttagcggtatcgttttttgcggaggttttttttgcgcgtattttcgtttgatttagcggtatttttttttgcggaggttttttttgcgcgtattttcgtttgatttagcggtatttttttttgcggaggttttttttgcgggtattttcgtttgatttagcggtatttttttttgcggaggttttttttgcgcgtattttcgtttgatttagcggtatttttttttgcggaggttttttttgcgcgtattttcgtttgatttagcggtatttttttttgcggaggttttttttgcgcgtattttcgtttgatttagcggtatttttttttgcggaggttttttttgcgcgtattttcgtttgatttagcggtatttttttttgcggaggttttttttgcgcgtattttcgtttgatttagcggtatttttttttgcggaggttttttttgcgggtagtcgtgtttggtttagcggtatttttttttggcgttagtagttttttttttcgttttttttcgtttcgtggtgtcgttatttttcg

SEQ ID NO: 33060 - DNA, 601 bp, Artificial Sequence
  chemically treated genomic DNA (Homo sapiens) CpG-island No: 33060
cgaaaaataacgacaccacgaaacgaaaaaaaacgaaaaaaaaaactactaacgccaaaaaaaaataccgctaaaccaaacacgactacccgcaaaaaaaacctccgcaaaaaaaaataccgctaaatcaaacgaaaatacgcgcaaaaaaaacctccgcaaaaaaaaataccgctaaatcaaacgaaaatacgcgcaaaaaaaacctccgcaaaaaaaaataccgctaaatcaaacgaaaatacgcgcaaaaaaaacctccgcaaaaaaaaataccgctaaatcaaacgaaaatacgcgcaaaaaaaacctccgcaaaaaaaaataccgctaaatcaaacgaaaatacgcgcaaaaaaaacctccgcaaaaaaaaataccgctaaatcaaacgaaaatacccgcaaaaaaaacctccgcaaaaaaaaataccgctaaatcaaacgaaaatacgcgcaaaaaaaacctccgcaaaaaaaaataccgctaaatcaaacgaaaatacgcgcaaaaaaaacctccgcaaaaaacgataccgctaaaccaaacacgaatacccgcaaaaaaaacctccgcaaaaaaaaataccgctaaaccaaac

SEQ ID NO: 33061 - DNA, 857 bp, Artificial Sequence
  chemically treated genomic DNA (Homo sapiens) CpG-island No: 33061
tttatagaatttagagtgtagggagatatataggtgtgtatcgtgtggacgcgttcgtagaatttagagtgtagggagatacgtaggtgtgtatcgtgtggacgcgatcgtagaatttagagtgtggggagacgtgtaggcgtgtatcgtgtggacgcgttcgtagaatttagagtgtggggagacgtgtaggcgtgtatcgtgtggacgcgttcgtagaatttagagtgtagggagacgtgtaggtatgtatcgtgtagacgcgtttttagaatttagagtgtggggaaaagtgtaggcgtgtattatgtggacgcgttcgtagaatttagagtgtagggaaacgtgtaggcgtgtatcgtgtagacgcgttcgtagaatttaaagtgtggggagacgtgtaggcgtgtatcgtgtggatacgttcgtagaatttagagtgtggggagacgtgtaggcgtgtatcgtgtggacgcgttcgtagaatttagagtgtggggagacgtgtaggcgtgtatcgtgtggacgcgttcgtagaatttagagtgtggggagacgtgtaggcgtgtatcgtgtggacgcgttcgtagaatttagagtgtggggagacgtgtaggcgtgtatcgtgtggacgcgttcgtagaatttagagtgtggggagacgtgtagacgtgtatcgtgtggacgcgttcgtagaatttagagtgtggggagacgtgtaggcgtgtatcgtgtagacgcgtttatataatttagagtgtacggagatatgtaggtgtgtatcgtgtagatgcgtttgtagaatttagagtgtggggagacgtataggttaaacggtttggggaaagaggagtagg

SEQ ID NO: 33062 - DNA, 857 bp, Artificial Sequence
  chemically treated genomic DNA (Homo sapiens) CpG-island No: 33062
cctactcctctttccccaaaccgtttaacctatacgtctccccacactctaaattctacaaacgcatctacacgatacacacctacatatctccgtacactctaaattatataaacgcgtctacacgatacacgcctacacgtctccccacactctaaattctacgaacgcgtccacacgatacacgtctacacgtctccccacactctaaattctacgaacgcgtccacacgatacacgcctacacgtctccccacactctaaattctacgaacgcgtccacacgatacacgcctacacgtctccccacactctaaattctacgaacgcgtccacacgatacacgcctacacgtctccccacactctaaattctacgaacgcgtccacacgatacacgcctacacgtctccccacactctaaattctacgaacgtatccacacgatacacgcctacacgtctccccacactttaaattctacgaacgcgtctacacgatacacgcctacacgtttccctacactctaaattctacgaacgcgtccacataatacacgcctacacttttccccacactctaaattctaaaaacgcgtctacacgatacatacctacacgtctccctacactctaaattctacgaacgcgtccacacgatacacgcctacacgtctccccacactctaaattctacgaacgcgtccacacgatacacgcctacacgtctccccacactctaaattctacgatcgcgtccacacgatacacacctacgtatctccctacactctaaattctacgaacgcgtccacacgatacacacctatatatctccctacactctaaattctataaa

SEQ ID NO: 33063 - DNA, 857 bp, Artificial Sequence
  chemically treated genomic DNA (Homo sapiens) CpG-island No: 33063
tttgtttttttttttttaggtcgtttggtttgtacgtttttttatattttgggttttgtaagcgtatttatacggtgtatatttgtatgttttcgtatattttggattgtgtgagcgcgtttatacggtgtacgtttgtacgtttttttatattttggattttgcgagcgcgtttatacggtgtacgtttgtacgtttttttatattttggattttgcgagcgcgtttatacggtgtacgtttgtacgtttttttatattttggattttgcgagcgcgtttatacggtgtacgtttgtacgtttttttatattttggattttgcgagcgcgtttatacggtgtacgtttgtacgtttttttatattttggattttgcgagcgcgtttatacggtgtacgtttgtacgtttttttatattttggattttgcgagcgtgtttatacggtgtacgtttgtacgtttttttatattttggattttgcgagcgcgtttatacggtgtacgtttgtacgtttttttatattttggattttgcgagcgcgtttatatggtgtacgtttgtatttttttttatattttggattttgggagcgcgtttatacggtatatgtttgtacgtttttttatattttggattttgcgagcgcgtttatacggtgtacgtttgtacgtttttttatattttggattttgcgagcgcgtttatacggtgtacgtttgtacgtttttttatattttggattttgcgatcgcgtttatacggtgtatatttgcgtgtttttttatattttggattttgcgagcgcgtttatacggtgtatatttgtatgtttttttatattttggattttgtgag

SEQ ID NO: 33064 - DNA, 857 bp, Artificial Sequence
  chemically treated genomic DNA (Homo sapiens) CpG-island No: 33064
ctcacaaaatccaaaatataaaaaaacatacaaatatacaccgtataaacgcgctcgcaaaatccaaaatataaaaaaacacgcaaatatacaccgtataaacgcgatcgcaaaatccaaaatataaaaaaacgtacaaacgtacaccgtataaacgcgctcgcaaaatccaaaatataaaaaaacgtacaaacgtacaccgtataaacgcgctcgcaaaatccaaaatataaaaaaacgtacaaacatataccgtataaacgcgctcccaaaatccaaaatataaaaaaaaatacaaacgtacaccatataaacgcgctcgcaaaatccaaaatataaaaaaacgtacaaacgtacaccgtataaacgcgctcgcaaaatccaaaatataaaaaaacgtacaaacgtacaccgtataaacacgctcgcaaaatccaaaatataaaaaaacgtacaaacgtacaccgtataaacgcgctcgcaaaatccaaaatataaaaaaacgtacaaacgtacaccgtataaacgcgctcgcaaaatccaaaatataaaaaaacgtacaaacgtacaccgtataaacgcgctcgcaaaatccaaaatataaaaaaacgtacaaacgtacaccgtataaacgcgctcgcaaaatccaaaatataaaaaaacgtacaaacgtacaccgtataaacgcgctcgcaaaatccaaaatataaaaaaacgtacaaacgtacaccgtataaacgcgctcacacaatccaaaatatacgaaaacatacaaatatacaccgtataaatacgcttacaaaacccaaaatataaaaaaacgtacaaaccaaacgacctaaaaaaaaaaaaacaaa

SEQ ID NO: 33065 - DNA, 885 bp, Artificial Sequence
  chemically treated genomic DNA (Homo sapiens) CpG-island No: 33065
tttcgcgattttttttttatggcgttagacgattcggagaagttgagtcgtcgtagttatgatttttatacgttgtgattcgaggtttacggggttcgcgtttgtttttttttttcgttatcgggttttttgttattaaagttttcgtgtttcgttttttttttttggtttattttttgggcgttattttcgggttcgtagggtgttgggcgttgcggttttcgaggtgcggggagtagttgggggtttgcgagttttagtttagtaaggtgcgatttcggggagcgaggcggtagtttcggtcgcggtttgagcgtagggcgttgcggggcgggggttttcgggttggggcgacgtggttagtttagttttgtcgaggggtggggttggttttggggttcgttggtttcgcgtcgtcgcggagagagcgcgttcgggttatttcggttggaaggtattttcggaatgcggcggtttagtattcgttttttcgggaatttttcgggggagtcgttgggagggattcggttttcgggttgggtcggtcgggtttcgggttttgagcggtgggattagaggttttagtttcgtcgatttgtagacgtgagatcgggtatatttgagcggcggcggggcggtcgtggttatattcggggcgacgtgtttgagttatttcgtttcgttagcgtttgttagtttagttagttcgtttagtttttcgcgttcgagattcgtttttagttttttattttcgttcgggtcgcgcgagtttcgcgggggcgggggcggggcgttaaggggcggggttgttttttaaagggtttcgggtcgttgtttttaggttattttttgggggcggagaggattttagcggttgcggcgata

SEQ ID NO: 33066 - DNA, 885 bp, Artificial Sequence
  chemically treated genomic DNA (Homo sapiens) CpG-island No: 33066
tatcgccgcaaccgctaaaatcctctccgcccccaaaaaataacctaaaaacaacgacccgaaaccctttaaaaaacaaccccgccccttaacgccccgcccccgcccccgcgaaactcgcgcgacccgaacgaaaataaaaaactaaaaacgaatctcgaacgcgaaaaactaaacgaactaactaaactaacaaacgctaacgaaacgaaataactcaaacacgtcgccccgaatataaccacgaccgccccgccgccgctcaaatatacccgatctcacgtctacaaatcgacgaaactaaaacctctaatcccaccgctcaaaacccgaaacccgaccgacccaacccgaaaaccgaatccctcccaacgactcccccgaaaaattcccgaaaaaacgaatactaaaccgccgcattccgaaaataccttccaaccgaaataacccgaacgcgctctctccgcgacgacgcgaaaccaacgaaccccaaaaccaaccccacccctcgacaaaactaaactaaccacgtcgccccaacccgaaaacccccgccccgcaacgccctacgctcaaaccgcgaccgaaactaccgcctcgctccccgaaatcgcaccttactaaactaaaactcgcaaacccccaactactccccgcacctcgaaaaccgcaacgcccaacaccctacgaacccgaaaataacgcccaaaaaataaaccaaaaaaaaaaaacgaaacacgaaaactttaataacaaaaaacccgataacgaaaaaaaaaaacaaacgcgaaccccgtaaacctcgaatcacaacgtataaaaatcataactacgacgactcaacttctccgaatcgtctaacgccataaaaaaaaaatcgcgaaa

SEQ ID NO: 33067 - DNA, 885 bp, Artificial Sequence
  chemically treated genomic DNA (Homo sapiens) CpG-island No: 33067
tgtcgtcgtagtcgttgaggtttttttcgtttttaggaagtggtttaagggtagcggttcggggttttttaagagatagtttcgttttttggcgtttcgttttcgttttcgcgaggttcgcgcggttcgggcggaggtgggaggttggaggcgagtttcggacgcgagagattgggcggattggttggattggtagacgttggcgggacggggtgatttaggtacgtcgtttcggatgtggttacgatcgtttcgtcgtcgtttaggtgtgttcgattttacgtttgtaagtcggcggggttggagtttttaattttatcgtttagagttcgaggttcggtcggtttagttcgggagtcgagttttttttagcggttttttcggggaattttcgagggggcgggtgttgagtcgtcgtatttcggggatgttttttagtcggggtggttcgggcgcgtttttttcgcggcggcgcggggttagcgagttttagggttagttttatttttcggtaggattgggttggttacgtcgttttagttcgagagttttcgtttcgtagcgttttgcgtttaggtcgcggtcgaagttgtcgtttcgtttttcggagtcgtattttgttggattggagttcgtaaatttttagttgtttttcgtatttcgggagtcgtagcgtttaatattttacgggttcgaaggtggcgtttaagaagtgaattagaagggaagagcgaagtacggaggttttaatggtagagggttcggtggcggggaagggaggtaggcgcgggtttcgtgggtttcgggttatagcgtgtggaggttatgattgcgacggtttagttttttcgggtcgtttgacgttatgagggagaagtcgcggaa

SEQ ID NO: 33068 - DNA, 885 bp, Artificial Sequence
  chemically treated genomic DNA (Homo sapiens) CpG-island No: 33068
ttccgcgacttctccctcataacgtcaaacgacccgaaaaaactaaaccgtcgcaatcataacctccacacgctataacccgaaacccacgaaacccgcgcctacctcccttccccgccaccgaaccctctaccattaaaacctccgtacttcgctcttcccttctaattcacttcttaaacgccaccttcgaacccgtaaaatattaaacgctacgactcccgaaatacgaaaaacaactaaaaatttacgaactccaatccaacaaaatacgactccgaaaaacgaaacgacaacttcgaccgcgacctaaacgcaaaacgctacgaaacgaaaactctcgaactaaaacgacgtaaccaacccaatcctaccgaaaaataaaactaaccctaaaactcgctaaccccgcgccgccgcgaaaaaaacgcgcccgaaccaccccgactaaaaaacatccccgaaatacgacgactcaacacccgccccctcgaaaattccccgaaaaaaccgctaaaaaaaactcgactcccgaactaaaccgaccgaacctcgaactctaaacgataaaattaaaaactccaaccccgccgacttacaaacgtaaaatcgaacacacctaaacgacgacgaaacgatcgtaaccacatccgaaacgacgtacctaaatcaccccgtcccgccaacgtctaccaatccaaccaatccgcccaatctctcgcgtccgaaactcgcctccaacctcccacctccgcccgaaccgcgcgaacctcgcgaaaacgaaaacgaaacgccaaaaaacgaaactatctcttaaaaaaccccgaaccgctacccttaaaccacttcctaaaaacgaaaaaaacctcaacgactacgacgaca

SEQ ID NO: 33069 - DNA, 578 bp, Artificial Sequence
  chemically treated genomic DNA (Homo sapiens) CpG-island No: 33069
gttatttttcgttttttttttagatagaaacggtttcggggcgcggggtacggggcgcgtcgagggtcgaagggcggtgcggttggttagagtgggtcgtcgtttgttgtttttaattttatcggtcgattagtcgaagttataaattcggtggtttcgatagcgggtttagagtagggacgtcggttggtatgtgcgtcgcgcggggtttcggattatcgtttcggttttttttcgttgtatttttttatttttttttttatttaggatagttttatcgaaatttcggcgtttcgggcggatttttgagcggagagggcggggcgggagtaggaaggtcgcgttgtcgggaggggcggggatttgttcgtttggtttaggttttggatatttgggcgtttttggttttcggtagaatacggcgtcggatagaagaggtttagcggttagtgggcgcggtcggcggtacgaaggttggagtcgtttgtatttttagtaatgacggcgtttttttttttcgttcgtagcggttttgtaggttattcgagttttaatggtggtttttttggtgttgggtt

SEQ ID NO: 33070 - DNA, 578 bp, Artificial Sequence
  chemically treated genomic DNA (Homo sapiens) CpG-island No: 33070
aacccaacaccaaaaaaaccaccattaaaactcgaataacctacaaaaccgctacgaacgaaaaaaaaaaacgccgtcattactaaaaatacaaacgactccaaccttcgtaccgccgaccgcgcccactaaccgctaaacctcttctatccgacgccgtattctaccgaaaaccaaaaacgcccaaatatccaaaacctaaaccaaacgaacaaatccccgcccctcccgacaacgcgaccttcctactcccgccccgccctctccgctcaaaaatccgcccgaaacgccgaaatttcgataaaactatcctaaataaaaaaaaaaataaaaaaatacaacgaaaaaaaaccgaaacgataatccgaaaccccgcgcgacgcacataccaaccgacgtccctactctaaacccgctatcgaaaccaccgaatttataacttcgactaatcgaccgataaaattaaaaacaacaaacgacgacccactctaaccaaccgcaccgcccttcgaccctcgacgcgccccgtaccccgcgccccgaaaccgtttctatctaaaaaaaaaacgaaaaataac

SEQ ID NO: 33071 - DNA, 578 bp, Artificial Sequence
  chemically treated genomic DNA (Homo sapiens) CpG-island No: 33071
agtttagtattagggagattattattagggttcgagtggtttgtaaggtcgttgcgggcgaggggaaagggcgtcgttattgttggaaatgtaggcggttttagttttcgtgtcgtcggtcgcgtttattaatcgttggattttttttgttcggcgtcgtgttttgtcgagggttaggggcgtttaggtgtttaagatttgggttaagcgggtaggttttcgtttttttcgatagcgcggtttttttgttttcgtttcgtttttttcgtttaaggattcgttcggggcgtcggggtttcggtgaaattgttttggatagggggaagggtgaaagggtgtagcgaagagaagtcgagacggtggttcgaagtttcgcgcggcgtatatgttagtcggcgtttttgttttgagttcgttatcgaggttatcgggtttgtggtttcggttaatcggtcgataagattagaggtagtaggcggcggtttattttgattagtcgtatcgtttttcggttttcggcgcgtttcgtgtttcgcgtttcggggtcgtttttgtttgagaaaaggacgggagatgat

SEQ ID NO: 33072 - DNA, 578 bp, Artificial Sequence
  chemically treated genomic DNA (Homo sapiens) CpG-island No: 33072
atcatctcccgtccttttctcaaacaaaaacgaccccgaaacgcgaaacacgaaacgcgccgaaaaccgaaaaacgatacgactaatcaaaataaaccgccgcctactacctctaatcttatcgaccgattaaccgaaaccacaaacccgataacctcgataacgaactcaaaacaaaaacgccgactaacatatacgccgcgcgaaacttcgaaccaccgtctcgacttctcttcgctacaccctttcacccttccccctatccaaaacaatttcaccgaaaccccgacgccccgaacgaatccttaaacgaaaaaaacgaaacgaaaacaaaaaaaccgcgctatcgaaaaaaacgaaaacctacccgcttaacccaaatcttaaacacctaaacgcccctaaccctcgacaaaacacgacgccgaacaaaaaaaatccaacgattaataaacgcgaccgacgacacgaaaactaaaaccgcctacatttccaacaataacgacgccctttcccctcgcccgcaacgaccttacaaaccactcgaaccctaataataatctccctaatactaaact

SEQ ID NO: 33073 - DNA, 726 bp, Artificial Sequence
  chemically treated genomic DNA (Homo sapiens) CpG-island No: 33073
tcggtttttttttcgcgcgttttttttcggagttcgcgttttttggggtgttattaggtgggttcgcgaaattaaagagagttgaggatgttaaggttagtttgtagtcgtcgtcgtttacgttttcggcgacggggtttgtacgtcgcgggtattcgtcgtagcgcgttttcgtttttttttatttgtgaggtcggtcgtcgtcgtgatttcggaaggattcggtcgggtcgtcggatgtgacgtaggggttagggcgcgtcggagtcgttgagaaagcgtagagaaggcgggtaggaagggtagtcgttcgcgttggttgggtagggagcggtagtagcgagtcggggatttcggcgtcgttcgcgcgcggtgggattggggttgcggtttcggtcgggtggcgggtttttgggatacgtgatcggggcggcgagcgggtcgggcggacgggttttcgtttgggtcgggcgcggttttttttgagcgttcgttttttcgtaggtttcgtttgaggtttggtagttagagatagtcgggcgtttacggttcgagcgtttacggtagtattatgttcgtatttttggagcgttttaagttttttaacgttatggttagggcgttgtatcggtatattatgatggagcgggagcgtaagcggtagggtgagtcggggttatagtagggggacgtacggtttagaatggtttttgtattttaaggttg

SEQ ID NO: 33074 - DNA, 726 bp, Artificial Sequence
  chemically treated genomic DNA (Homo sapiens) CpG-island No: 33074
caaccttaaaatacaaaaaccattctaaaccgtacgtccccctactataaccccgactcaccctaccgcttacgctcccgctccatcataatataccgatacaacgccctaaccataacgttaaaaaacttaaaacgctccaaaaatacgaacataatactaccgtaaacgctcgaaccgtaaacgcccgactatctctaactaccaaacctcaaacgaaacctacgaaaaaacgaacgctcaaaaaaaaccgcgcccgacccaaacgaaaacccgtccgcccgacccgctcgccgccccgatcacgtatcccaaaaacccgccacccgaccgaaaccgcaaccccaatcccaccgcgcgcgaacgacgccgaaatccccgactcgctactaccgctccctacccaaccaacgcgaacgactacccttcctacccgccttctctacgctttctcaacgactccgacgcgccctaacccctacgtcacatccgacgacccgaccgaatccttccgaaatcacgacgacgaccgacctcacaaataaaaaaaaacgaaaacgcgctacgacgaatacccgcgacgtacaaaccccgtcgccgaaaacgtaaacgacgacgactacaaactaaccttaacatcctcaactctctttaatttcgcgaacccacctaataacaccccaaaaaacgcgaactccgaaaaaaaacgcgcgaaaaaaaaaccga

SEQ ID NO: 33075 - DNA, 726 bp, Artificial Sequence
  chemically treated genomic DNA (Homo sapiens) CpG-island No: 33075
tagttttgaggtataggagttattttgggtcgtgcgtttttttgttatggtttcggtttattttgtcgtttgcgttttcgttttattataatgtgtcggtgtagcgttttggttatggcgttggaaagtttggggcgttttaggagtgcgggtatggtgttgtcgtgggcgttcgggtcgtgggcgttcggttgtttttgattgttagattttagacggggtttgcggggaggcgggcgtttagagggggtcgcgttcggtttaggcggaagttcgttcgttcggttcgttcgtcgtttcggttacgtgttttaggagttcgttattcggtcgggatcgtagttttagttttatcgcgcgcgggcggcgtcggggttttcggttcgttgttgtcgttttttgtttagttagcgcggacgattgttttttttattcgttttttttgcgtttttttagcggtttcgacgcgttttggtttttgcgttatattcggcggttcggtcgagttttttcggagttacggcggcggtcgattttataggtgaaagaaggcggaagcgcgttgcgacgggtgttcgcggcgtataaatttcgtcgtcgggaacgtgagcgacgacggttgtagattggttttggtatttttagttttttttaatttcgcgggtttatttggtggtattttaggggacgcgggtttcggagaggggcgcgcgagagagaggtcga

SEQ ID NO: 33076 - DNA, 726 bp, Artificial Sequence
  chemically treated genomic DNA (Homo sapiens) CpG-island No: 33076
tcgacctctctctcgcgcgcccctctccgaaacccgcgtcccctaaaataccaccaaataaacccgcgaaattaaaaaaaactaaaaataccaaaaccaatctacaaccgtcgtcgctcacgttcccgacgacgaaatttatacgccgcgaacacccgtcgcaacgcgcttccgccttctttcacctataaaatcgaccgccgccgtaactccgaaaaaactcgaccgaaccgccgaatataacgcaaaaaccaaaacgcgtcgaaaccgctaaaaaaacgcaaaaaaaacgaataaaaaaaacaatcgtccgcgctaactaaacaaaaaacgacaacaacgaaccgaaaaccccgacgccgcccgcgcgcgataaaactaaaactacgatcccgaccgaataacgaactcctaaaacacgtaaccgaaacgacgaacgaaccgaacgaacgaacttccgcctaaaccgaacgcgaccccctctaaacgcccgcctccccgcaaaccccgtctaaaatctaacaatcaaaaacaaccgaacgcccacgacccgaacgcccacgacaacaccatacccgcactcctaaaacgccccaaactttccaacgccataaccaaaacgctacaccgacacattataataaaacgaaaacgcaaacgacaaaataaaccgaaaccataacaaaaaaacgcacgacccaaaataactcctatacctcaaaacta

SEQ ID NO: 33077 - DNA, 894 bp, Artificial Sequence
  chemically treated genomic DNA (Homo sapiens) CpG-island No: 33077
gcggcgtggtttttttaacgtttggcgtattgacggcgtttgaggtggaaggggttgtttaggatttcgaatacgtatgcgttttgagatttaggcgttttttttagagggtgtggagtgtagggttttttattgcgtaggcgtaaggattgttcggtaggacgagcggtttattaaggggagggaagatgaggttgaagagattaaaaaatcgggtgcgtttgcgcgttgtagattagttgaaaacgtttagggtttgtgaggggcggggttacgtatgcgcgttattggacgggtcggtgggagggagggtggagatgggtagggtgtgtgcgtttgcgtagtgcgggggtggagggcggaggagatagatagtacgtttgcgcggttgttatagggttgtttggttggttagtggggagtcggcgtttgcgtattaagattcgtgtgtagtagcggcggcggcggtagaggcggcggcggcggcggtagcgggttcggaggtagcggttgggttcgcggcgagcggacggggtcgagttagtgcgttcgcgcgaggtgagagcgggtagggcgcgtgtgcgcggtattttggtttgggttcgggagaagatggaattgcgcgggggtcggggagggggtagaggggagcggcggtcgtcgtcgtacgggttcggttagagagcggcgcgaggtgaggagaggcgcgggcgcgcgtttcggttggcgcgcggggtgacggttggggttggttcggtgacgttggagcgacgtagggcgggggacggcgagtcgcgaggtagttacgcggtgagaggtcgttaggcggttacgtcggggcgagggttaggggttagatcggtttatcggggtaagggtatttgggtcgttgag

SEQ ID NO: 33078 - DNA, 894 bp, Artificial Sequence
  chemically treated genomic DNA (Homo sapiens) CpG-island No: 33078
ctcaacgacccaaatacccttaccccgataaaccgatctaacccctaaccctcgccccgacgtaaccgcctaacgacctctcaccgcgtaactacctcgcgactcgccgtcccccgccctacgtcgctccaacgtcaccgaaccaaccccaaccgtcaccccgcgcgccaaccgaaacgcgcgcccgcgcctctcctcacctcgcgccgctctctaaccgaacccgtacgacgacgaccgccgctcccctctaccccctccccgacccccgcgcaattccatcttctcccgaacccaaaccaaaataccgcgcacacgcgccctacccgctctcacctcgcgcgaacgcactaactcgaccccgtccgctcgccgcgaacccaaccgctacctccgaacccgctaccgccgccgccgccgcctctaccgccgccgccgctactacacacgaatcttaatacgcaaacgccgactccccactaaccaaccaaacaaccctataacaaccgcgcaaacgtactatctatctcctccgccctccacccccgcactacgcaaacgcacacaccctacccatctccaccctccctcccaccgacccgtccaataacgcgcatacgtaaccccgcccctcacaaaccctaaacgttttcaactaatctacaacgcgcaaacgcacccgattttttaatctcttcaacctcatcttccctccccttaataaaccgctcgtcctaccgaacaatccttacgcctacgcaataaaaaaccctacactccacaccctctaaaaaaaacgcctaaatctcaaaacgcatacgtattcgaaatcctaaacaaccccttccacctcaaacgccgtcaatacgccaaacgttaaaaaaaccacgccgc

SEQ ID NO: 33079 - DNA, 894 bp, Artificial Sequence
  chemically treated genomic DNA (Homo sapiens) CpG-island No: 33079
tttaacggtttaggtatttttgtttcggtgggtcgatttggtttttggttttcgtttcggcgtggtcgtttggcggttttttatcgcgtggttgtttcgcggttcgtcgtttttcgttttgcgtcgttttaacgttatcgggttaattttaatcgttatttcgcgcgttaatcggggcgcgcgttcgcgtttttttttatttcgcgtcgttttttggtcgaattcgtgcggcggcggtcgtcgtttttttttgtttttttttcgattttcgcgtagttttattttttttcgggtttaagttaaggtatcgcgtatacgcgttttgttcgtttttatttcgcgcgaacgtattgattcgatttcgttcgttcgtcgcgagtttaatcgttgttttcgagttcgttgtcgtcgtcgtcgtcgtttttatcgtcgtcgtcgttgttgtatacgggttttagtacgtaggcgtcgattttttattgattaattaagtagttttatgatagtcgcgtaagcgtgttatttatttttttcgttttttattttcgtattgcgtaagcgtatatattttatttatttttatttttttttttatcgattcgtttaatgacgcgtatacgtgatttcgttttttataaattttgagcgtttttaattaatttgtaacgcgtaggcgtattcggttttttaatttttttaattttattttttttttttttgatagatcgttcgttttatcgggtagtttttgcgtttgcgtaataaggagttttgtattttatattttttaaaggaaacgtttgggttttagaacgtatgcgtgttcggaattttaaataattttttttattttagacgtcgttagtacgttaggcgttgaaaagattacgtcgt

SEQ ID NO: 33080 - DNA, 894 bp, Artificial Sequence
  chemically treated genomic DNA (Homo sapiens) CpG-island No: 33080
acgacgtaatcttttcaacgcctaacgtactaacgacgtctaaaataaaaaaaattatttaaaattccgaacacgcatacgttctaaaacccaaacgtttcctttaaaaaatataaaatacaaaactccttattacgcaaacgcaaaaactacccgataaaacgaacgatctatcaaaaaaaaaaaaaataaaattaaaaaaattaaaaaaccgaatacgcctacgcgttacaaattaattaaaaacgctcaaaatttataaaaaacgaaatcacgtatacgcgtcattaaacgaatcgataaaaaaaaaaataaaaataaataaaatatatacgcttacgcaatacgaaaataaaaaacgaaaaaaataaataacacgcttacgcgactatcataaaactacttaattaatcaataaaaaatcgacgcctacgtactaaaacccgtatacaacaacgacgacgacgataaaaacgacgacgacgacgacaacgaactcgaaaacaacgattaaactcgcgacgaacgaacgaaatcgaatcaatacgttcgcgcgaaataaaaacgaacaaaacgcgtatacgcgataccttaacttaaacccgaaaaaaaataaaactacgcgaaaatcgaaaaaaaaacaaaaaaaaacgacgaccgccgccgcacgaattcgaccaaaaaacgacgcgaaataaaaaaaaacgcgaacgcgcgccccgattaacgcgcgaaataacgattaaaattaacccgataacgttaaaacgacgcaaaacgaaaaacgacgaaccgcgaaacaaccacgcgataaaaaaccgccaaacgaccacgccgaaacgaaaaccaaaaaccaaatcgacccaccgaaacaaaaatacctaaaccgttaaa

SEQ ID NO: 33081 - DNA, 553 bp, Artificial Sequence
  chemically treated genomic DNA (Homo sapiens) CpG-island No: 33081
cgatacggtatatatatatatatattcgtatatattttcgagcgagtgtatattcgtatttttattcgatagtcggttagggatagttatttttaagattaatatcgtagtttgaattgtttcggtaaattttttttcgggttcgacggatgtgcgttttagatgtgttgatatatgttcgatgtttcgttgttttggaggttttttcgttcgcgtgtttttttttttcgtattagcggcggaaatcgtattagtagcggcggcggcggcggcggcggtagtagttatttgaagttattaatattgggtttttttagtaaaaacgagatttcgattcgtttggcgttttaagaagatatagacgatagtttttcgtcgggttgcgtcgtgtaatttcgggttttcgggagcgcgtagttcgttggttaagtttaggtagttcgcggtaagttgttttcgaagttcgttttttttatcggggtatggtcggagggtggttgttgcgtttcggggtagttttttttttgttttcggggggcggggaaggagtaga

SEQ ID NO: 33082 - DNA, 553 bp, Artificial Sequence
  chemically treated genomic DNA (Homo sapiens) CpG-island No: 33082
tctactccttccccgccccccgaaaacaaaaaaaaaactaccccgaaacgcaacaaccaccctccgaccataccccgataaaaaaaacgaacttcgaaaacaacttaccgcgaactacctaaacttaaccaacgaactacgcgctcccgaaaacccgaaattacacgacgcaacccgacgaaaaactatcgtctatatcttcttaaaacgccaaacgaatcgaaatctcgtttttactaaaaaaacccaatattaataacttcaaataactactaccgccgccgccgccgccgccgctactaatacgatttccgccgctaatacgaaaaaaaaaaacacgcgaacgaaaaaacctccaaaacaacgaaacatcgaacatatatcaacacatctaaaacgcacatccgtcgaacccgaaaaaaaatttaccgaaacaattcaaactacgatattaatcttaaaaataactatccctaaccgactatcgaataaaaatacgaatatacactcgctcgaaaatatatacgaatatatatatatatataccgtatcg

SEQ ID NO: 33083 - DNA, 553 bp, Artificial Sequence
  chemically treated genomic DNA (Homo sapiens) CpG-island No: 33083
tttgtttttttttcgtttttcggaagtaggagaagaattgtttcggagcgtagtagttatttttcgattatgtttcggtgaggggggcggatttcgagggtaatttgtcgcggattgtttgggtttagttagcgagttacgcgttttcgggagttcggaattgtacggcgtagttcggcggggggttatcgtttatgtttttttggggcgttagacgaatcggggtttcgtttttgttggaagagtttagtgttggtggttttaggtggttgttgtcgtcgtcgtcgtcgtcgtcgttgttagtgcggttttcgtcgttggtgcgaagagaagagatacgcgagcggggagatttttaaggtagcgaggtatcggatatgtgttagtatatttggggcgtatattcgtcgagttcgaggggagatttgtcggaataatttaaattgcgatattgattttgggggtgattgtttttggtcggttgtcgggtgggagtgcgagtgtgtattcgttcggaagtgtgtgcgagtgtgtatgtgtgtgtgtcgtgtcg

SEQ ID NO: 33084 - DNA, 553 bp, Artificial Sequence
  chemically treated genomic DNA (Homo sapiens) CpG-island No: 33084
cgacacgacacacacacatacacactcgcacacacttccgaacgaatacacactcgcactcccacccgacaaccgaccaaaaacaatcacccccaaaatcaatatcgcaatttaaattattccgacaaatctcccctcgaactcgacgaatatacgccccaaatatactaacacatatccgatacctcgctaccttaaaaatctccccgctcgcgtatctcttctcttcgcaccaacgacgaaaaccgcactaacaacgacgacgacgacgacgacgacaacaaccacctaaaaccaccaacactaaactcttccaacaaaaacgaaaccccgattcgtctaacgccccaaaaaaacataaacgataaccccccgccgaactacgccgtacaattccgaactcccgaaaacgcgtaactcgctaactaaacccaaacaatccgcgacaaattaccctcgaaatccgcccccctcaccgaaacataatcgaaaaataactactacgctccgaaacaattcttctcctacttccgaaaaacgaaaaaaaaacaaa

SEQ ID NO: 33085 - DNA, 1098 bp, Artificial Sequence
  chemically treated genomic DNA (Homo sapiens) CpG-island No: 33085
aaaagggcgattcgagtttttcgatacggaaaacgggattttaggttttggggcgtacgggtagagtgattttcggcgcgggttgtttatttgcgcgggagcgtacgagatataaaagtatacgttcgtttatattggtaatcgcgcgcgcgcgcgttcgcgtttgtatttttgtttttttgggtagtatttcgtttaattggttttgaaattgaggatgggaaagttaaaagttggttgtcgcgcgagttcggttcgttcggtcgttggcgatttttggaatgtatggtattagtgtttagtatacgttcggcgttcgggtcgagattttgcgggttttgatacgcgtacgagcgtcgcgtcgttatcgcggggacgtaggttatagcgttagcgggcggcgcgggcgtgcgcgttcgttgtttttatttttttttttcgtgtttcgcggtcgagtatgcgtagtgcgcgcgaggagcgggcgggttttttaaggcgggcgttgcggagcgcgcgtcggtttcgttcgcggtttcgtttcgacgggaggtgagcgttttttgttcggtcgttttttgtgcgtttttcggggtgggggtggcggtagagggaggttgcgacggtatttgtcggcgaggacggcgagttgcgttttttttcggattttttagggatcgttttcgagtgcgagagagaaggaaggaggatttgaggggcgggtcggggcggtgcgcgttggtttttttcgcgcgtattttttttcgtcgtttattagggcggacgttttttcgggtttcgcgcgttttgttgttttttgtttcgggagtcgtcgggttcgtcgcgttttttgcgtttcgttgcggatcgtttcgtagagcggttgggttcgcggtttatagagtcgtttaagatttttatagagggacgtttttttaaaataatgaggttatgcggtcgtagtcgtatacgggttgattggggagatttcgtggtgtcgcggggcggtttcggggttcgaaggtagaggtttttttaggtgtgttttgtttgatttcggttataggaacgagcgttgtgggtttcggttttttattcgta

SEQ ID NO: 33086 - DNA, 1098 bp, Artificial Sequence
  chemically treated genomic DNA (Homo sapiens) CpG-island No: 33086
tacgaataaaaaaccgaaacccacaacgctcgttcctataaccgaaatcaaacaaaacacacctaaaaaaacctctaccttcgaaccccgaaaccgccccgcgacaccacgaaatctccccaatcaacccgtatacgactacgaccgcataacctcattattttaaaaaaacgtccctctataaaaatcttaaacgactctataaaccgcgaacccaaccgctctacgaaacgatccgcaacgaaacgcaaaaaacgcgacgaacccgacgactcccgaaacaaaaaacaacaaaacgcgcgaaacccgaaaaaacgtccgccctaataaacgacgaaaaaaaatacgcgcgaaaaaaaccaacgcgcaccgccccgacccgcccctcaaatcctccttccttctctctcgcactcgaaaacgatccctaaaaaatccgaaaaaaaacgcaactcgccgtcctcgccgacaaataccgtcgcaacctccctctaccgccacccccaccccgaaaaacgcacaaaaaacgaccgaacaaaaaacgctcacctcccgtcgaaacgaaaccgcgaacgaaaccgacgcgcgctccgcaacgcccgccttaaaaaacccgcccgctcctcgcgcgcactacgcatactcgaccgcgaaacacgaaaaaaaaaaataaaaacaacgaacgcgcacgcccgcgccgcccgctaacgctataacctacgtccccgcgataacgacgcgacgctcgtacgcgtatcaaaacccgcaaaatctcgacccgaacgccgaacgtatactaaacactaataccatacattccaaaaatcgccaacgaccgaacgaaccgaactcgcgcgacaaccaacttttaactttcccatcctcaatttcaaaaccaattaaacgaaatactacccaaaaaaacaaaaatacaaacgcgaacgcgcgcgcgcgcgattaccaatataaacgaacgtatacttttatatctcgtacgctcccgcgcaaataaacaacccgcgccgaaaatcactctacccgtacgccccaaaacctaaaatcccgttttccgtatcgaaaaactcgaatcgccctttt

SEQ ID NO: 33087 - DNA, 1098 bp, Artificial Sequence
  chemically treated genomic DNA (Homo sapiens) CpG-island No: 33087
tacgggtgagaaatcgaggtttatagcgttcgtttttgtagtcggggttaggtagggtatatttaggggagtttttgttttcgagtttcgggatcgtttcgcggtattacgagatttttttagttagttcgtgtgcggttgcggtcgtatggttttattgttttgggaagacgtttttttgtgaggattttgggcgattttatgaatcgcgggtttagtcgttttgcggaacgattcgtagcgggacgtaaagggcgcggcgagttcggcggttttcggaataaaggatagtagagcgcgcggggttcgaaggggcgttcgttttagtgggcggcggagggggatgcgcgcggagaggattagcgcgtatcgtttcggttcgttttttaaattttttttttttttttttcgtattcggagacggtttttgggagattcgggagggggcgtagttcgtcgttttcgtcggtaagtgtcgtcgtaatttttttttgtcgttatttttatttcgagaagcgtataaagagcggtcgggtagggagcgtttatttttcgtcggggcggggtcgcgggcggggtcggcgcgcgtttcgtagcgttcgttttaaagggttcgttcgtttttcgcgcgtattgcgtatgttcggtcgcggggtacggaggggagggatgggaatagcgggcgcgtacgttcgcgtcgttcgttggcgttgtggtttgcgttttcgcggtggcggcgcggcgttcgtgcgcgtgttagaattcgtagggtttcggttcgggcgtcgggcgtgtgttggatattggtgttatgtattttagaggtcgttagcggtcgggcgggtcgagttcgcgcggtagttagtttttagtttttttatttttagttttagggttagttgggcgaagtgttgtttaaggagatagaaatgtaggcgcgggcgcgcgcgcgcgcggttgttagtgtgggcgggcgtgtgtttttgtgtttcgtgcgttttcgcgtaggtggataattcgcgtcgggagttattttgttcgtgcgttttaagatttggagtttcgtttttcgtgtcggagggttcgggtcgttttttt

SEQ ID NO: 33088 - DNA, 1098 bp, Artificial Sequence
  chemically treated genomic DNA (Homo sapiens) CpG-island No: 33088
aaaaaaacgacccgaaccctccgacacgaaaaacgaaactccaaatcttaaaacgcacgaacaaaataactcccgacgcgaattatccacctacgcgaaaacgcacgaaacacaaaaacacacgcccgcccacactaacaaccgcgcgcgcgcgcgcccgcgcctacatttctatctccttaaacaacacttcgcccaactaaccctaaaactaaaaataaaaaaactaaaaactaactaccgcgcgaactcgacccgcccgaccgctaacgacctctaaaatacataacaccaatatccaacacacgcccgacgcccgaaccgaaaccctacgaattctaacacgcgcacgaacgccgcgccgccaccgcgaaaacgcaaaccacaacgccaacgaacgacgcgaacgtacgcgcccgctattcccatccctcccctccgtaccccgcgaccgaacatacgcaatacgcgcgaaaaacgaacgaaccctttaaaacgaacgctacgaaacgcgcgccgaccccgcccgcgaccccgccccgacgaaaaataaacgctccctacccgaccgctctttatacgcttctcgaaataaaaataacgacaaaaaaaaattacgacgacacttaccgacgaaaacgacgaactacgccccctcccgaatctcccaaaaaccgtctccgaatacgaaaaaaaaaaaaaaaaaatttaaaaaacgaaccgaaacgatacgcgctaatcctctccgcgcgcatccccctccgccgcccactaaaacgaacgccccttcgaaccccgcgcgctctactatcctttattccgaaaaccgccgaactcgccgcgccctttacgtcccgctacgaatcgttccgcaaaacgactaaacccgcgattcataaaatcgcccaaaatcctcacaaaaaaacgtcttcccaaaacaataaaaccatacgaccgcaaccgcacacgaactaactaaaaaaatctcgtaataccgcgaaacgatcccgaaactcgaaaacaaaaactcccctaaatataccctacctaaccccgactacaaaaacgaacgctataaacctcgatttctcacccgta

SEQ ID NO: 33089 - DNA, 1342 bp, Artificial Sequence
  chemically treated genomic DNA (Homo sapiens) CpG-island No: 33089
gtttgcgattaacgcggggatagttttcgtcgcgcgttatcgtcgtattttaggtatcgggtttttacgtagggacggcgtggattattttattttcgaatttcgaggttttggttaatattgaggttttttgtgtttcgaggtcgcgtttaatttttttcgcggcgtcggtttatatggtttcgttcgtcgcgggtcgcgttatttaggagatcgattcgtcgcggtcgcgtcggaggttacggagtttacgttttttagagagtttttattcgacggatttagaggttcggcggtcggtgtttaacggagttataagtttgaggatcgaggattggtcgaggggcgcgtttcgttcgttgttattcgcgggaggagtttcggaaggcggcgtatcgcgtcgtatatttagtttaagaattcgtttcgcgttattgtcgtcgttagggtcgcggagttaattagagtttaagtcgagggttacgttttgcgagcgttagttaatcggtgcggcggcgggtttattttgatttgtatgttcgacgattttttaattaatggtaatgtgattggcgtgaataatagttaattagaagttggaagaggcgtggtttcgggcgttttacgaggtgaagatgttgttggcggaatttgtaggagttagcgggattcgggggcgttaaagtcgtaggggtagggcgggaaggaagattcggcgcggggtataggattcggagttggagtttttaggtgagtatcggggagatttcggcggggcgcgttttttattaagttgtttcgggacggcggcggcgggtattcgcgaggttcgcgttgcggtaggcgtcgcggtttcgtttttattttttttttttcggttttgcgtttttgttttcgtcgttgttttattttttttttagtttttttatttttttttttatcgtttttttttttttatttttttttgtttttttttttttgttttttcgttcgttcgattttttagttcgtatttttgatttttgtttttgtcgtcgttttttttttcggtgtattttttttttatttttgttcgtttcggttttagtagtttcgttttttttttttttttattttttttttattttttttttcggtttttgcgtagttttatcggggcgttgttgttttcggttttttttatttttttttttgatcgttttttaaggtttattcgtcgttttcgttgtttgtttttgtgtcgtttcggtttttttttttatttttttattttgtttttagttttttcgattttttttcgcgggtacgtttttattattttattttgttttttaagattgtg

SEQ ID NO: 33090 - DNA, 1342 bp, Artificial Sequence
  chemically treated genomic DNA (Homo sapiens) CpG-island No: 33090
cacaatcttaaaaaacaaaataaaataataaaaacgtacccgcgaaaaaaaatcgaaaaaactaaaaacaaaataaaaaaataaaaaaaaaaaccgaaacgacacaaaaacaaacaacgaaaacgacgaataaaccttaaaaaacgatcaaaaaaaaaaataaaaaaaaccgaaaacaacaacgccccgataaaactacgcaaaaaccgaaaaaaaaaataaaaaaaaaataaaaaaaaaaaaaaaacgaaactactaaaaccgaaacgaacaaaaataaaaaaaaaatacaccgaaaaaaaaaacgacgacaaaaacaaaaatcaaaaatacgaactaaaaaatcgaacgaacgaaaaaacaaaaaaaaaaaaacaaaaaaaaataaaaaaaaaaaaacgataaaaaaaaaaataaaaaaactaaaaaaaaaataaaacaacgacgaaaacaaaaacgcaaaaccgaaaaaaaaaaaataaaaacgaaaccgcgacgcctaccgcaacgcgaacctcgcgaatacccgccgccgccgtcccgaaacaacttaataaaaaacgcgccccgccgaaatctccccgatactcacctaaaaactccaactccgaatcctataccccgcgccgaatcttccttcccgccctacccctacgactttaacgcccccgaatcccgctaactcctacaaattccgccaacaacatcttcacctcgtaaaacgcccgaaaccacgcctcttccaacttctaattaactattattcacgccaatcacattaccattaattaaaaaatcgtcgaacatacaaatcaaaataaacccgccgccgcaccgattaactaacgctcgcaaaacgtaaccctcgacttaaactctaattaactccgcgaccctaacgacgacaataacgcgaaacgaattcttaaactaaatatacgacgcgatacgccgccttccgaaactcctcccgcgaataacaacgaacgaaacgcgcccctcgaccaatcctcgatcctcaaacttataactccgttaaacaccgaccgccgaacctctaaatccgtcgaataaaaactctctaaaaaacgtaaactccgtaacctccgacgcgaccgcgacgaatcgatctcctaaataacgcgacccgcgacgaacgaaaccatataaaccgacgccgcgaaaaaaattaaacgcgacctcgaaacacaaaaaacctcaatattaaccaaaacctcgaaattcgaaaataaaataatccacgccgtccctacgtaaaaacccgatacctaaaatacgacgataacgcgcgacgaaaactatccccgcgttaatcgcaaac

SEQ ID NO: 33091 - DNA, 1342 bp, Artificial Sequence
  chemically treated genomic DNA (Homo sapiens) CpG-island No: 33091
tatagttttggggagtagggtaaggtggtgagagcgtgttcgcggggagaggtcggaggggttgggggtagaatgggagggtggggaaagggatcggagcgatatagggataggtagcgagaacgacggatgagttttgagaagcgattaggaggagagatggggaggatcgggaatagtagcgtttcggtggggttgcgtagaggtcgggagaggggatgagaggaggatggaggaaaggggagggcgaggttgttaggatcggagcgggtagagatggggaagaggtgtatcgggaagagggacggcggtaggggtaggggttagggatgcgagttgaagggtcgggcgggcgggaggatagggaaggaaagatagaaagggatgggggaagggagacgatggagaaggaggtgaggaggttggagaggaggtgagatagcggcggaggtagggacgtagggtcggggaagaagagatggagacgggatcgcggcgtttgtcgtagcgcgggtttcgcggatattcgtcgtcgtcgtttcggagtagtttggtggaaagcgcgtttcgtcggggttttttcggtatttatttgggggttttagtttcggattttgtgtttcgcgtcggattttttttttcgttttgtttttgcgattttagcgttttcgaatttcgttagtttttgtaggtttcgttagtagtatttttatttcgtgggacgttcggggttacgttttttttagtttttgattggttattgtttacgttagttatattattattggttgaggggtcgtcggatatgtaaattaagatgggttcgtcgtcgtatcgattggttggcgttcgtaaagcgtagttttcgatttgggttttgattggtttcgcggttttgacggcgatagtgacgcgaggcgggtttttggattgagtgtgcggcgcggtgcgtcgtttttcgaggtttttttcgcgggtggtagcggacggggcgcgtttttcggttagttttcggtttttaggtttgtggtttcgttgagtatcggtcgtcgggtttttgggttcgtcgagtggagattttttgaaaagcgtgggtttcgtggttttcggcgcggtcgcggcgggtcggttttttaggtaacgcggttcgcggcgggcggaattatgtgggtcggcgtcgcgggggaggttggacgcggtttcgaggtatagggggttttagtgttggttagagtttcggggttcgggggtagggtggtttacgtcgtttttgcgtgggggttcggtgtttggggtgcggcggtggcgcgcggcgggggttgttttcgcgttagtcgtaggt

SEQ ID NO: 33092 - DNA, 1342 bp, Artificial Sequence
  chemically treated genomic DNA (Homo sapiens) CpG-island No: 33092
acctacgactaacgcgaaaacaacccccgccgcgcgccaccgccgcaccccaaacaccgaacccccacgcaaaaacgacgtaaaccaccctacccccgaaccccgaaactctaaccaacactaaaaccccctatacctcgaaaccgcgtccaacctcccccgcgacgccgacccacataattccgcccgccgcgaaccgcgttacctaaaaaaccgacccgccgcgaccgcgccgaaaaccacgaaacccacgcttttcaaaaaatctccactcgacgaacccaaaaacccgacgaccgatactcaacgaaaccacaaacctaaaaaccgaaaactaaccgaaaaacgcgccccgtccgctaccacccgcgaaaaaaacctcgaaaaacgacgcaccgcgccgcacactcaatccaaaaacccgcctcgcgtcactatcgccgtcaaaaccgcgaaaccaatcaaaacccaaatcgaaaactacgctttacgaacgccaaccaatcgatacgacgacgaacccatcttaatttacatatccgacgacccctcaaccaataataatataactaacgtaaacaataaccaatcaaaaactaaaaaaaacgtaaccccgaacgtcccacgaaataaaaatactactaacgaaacctacaaaaactaacgaaattcgaaaacgctaaaatcgcaaaaacaaaacgaaaaaaaaaatccgacgcgaaacacaaaatccgaaactaaaacccccaaataaataccgaaaaaaccccgacgaaacgcgctttccaccaaactactccgaaacgacgacgacgaatatccgcgaaacccgcgctacgacaaacgccgcgatcccgtctccatctcttcttccccgaccctacgtccctacctccgccgctatctcacctcctctccaacctcctcacctccttctccatcgtctcccttcccccatccctttctatctttccttccctatcctcccgcccgcccgacccttcaactcgcatccctaacccctacccctaccgccgtccctcttcccgatacacctcttccccatctctacccgctccgatcctaacaacctcgccctcccctttcctccatcctcctctcatcccctctcccgacctctacgcaaccccaccgaaacgctactattcccgatcctccccatctctcctcctaatcgcttctcaaaactcatccgtcgttctcgctacctatccctatatcgctccgatccctttccccaccctcccattctacccccaacccctccgacctctccccgcgaacacgctctcaccaccttaccctactccccaaaactata

SEQ ID NO: 33093 - DNA, 527 bp, Artificial Sequence
  chemically treated genomic DNA (Homo sapiens) CpG-island No: 33093
ggtatcgtgcggattggtagggaggtttcggacgtcgtaagtcgggtacgtagtgataggtcgcggacgttaggggcgggatttatttaggttttttaggatttattcgtttgtgttgcgcgttaatacggcgttggtttttttttagtagcgcggttcggcgtttgttttcgatgcgttcgttaatagaggtggtttggttgtaaaggttgcggatcgcggcgcggagatcgttcgttagaacgttgagttttgtttcgatcgtcgttattcgtaatgtcgtcgttatttttgttgtgtcggcgcgttttttatcggcgtatttgagtacgtatgtgttaaagcgtgggtacggcgtttgcgtagtatcggttggttgtagggagtcgcgggggttggattatagaatttgtttgggagtaaggcgtgagagttcgagattcggtgttgttcgaggagggtcgcgtagagaaaaagtatagggtttgtttggttgtataaaaaagggatatagtttttgttttttt

SEQ ID NO: 33094 - DNA, 527 bp, Artificial Sequence
  chemically treated genomic DNA (Homo sapiens) CpG-island No: 33094
aaaaaaacaaaaactatatcccttttttatacaaccaaacaaaccctatactttttctctacgcgaccctcctcgaacaacaccgaatctcgaactctcacgccttactcccaaacaaattctataatccaacccccgcgactccctacaaccaaccgatactacgcaaacgccgtacccacgctttaacacatacgtactcaaatacgccgataaaaaacgcgccgacacaacaaaaataacgacgacattacgaataacgacgatcgaaacaaaactcaacgttctaacgaacgatctccgcgccgcgatccgcaacctttacaaccaaaccacctctattaacgaacgcatcgaaaacaaacgccgaaccgcgctactaaaaaaaaaccaacgccgtattaacgcgcaacacaaacgaataaatcctaaaaaacctaaataaatcccgcccctaacgtccgcgacctatcactacgtacccgacttacgacgtccgaaacctccctaccaatccgcacgatacc

SEQ ID NO: 33095 - DNA, 527 bp, Artificial Sequence
  chemically treated genomic DNA (Homo sapiens) CpG-island No: 33095
agaagagtaaggattatgttttttttttgtgtagttaggtaggttttgtattttttttttgcgcgatttttttcgggtagtatcgggtttcgaatttttacgttttatttttaagtaggttttgtagtttagttttcgcggttttttatagttagtcgatgttgcgtaagcgtcgtatttacgttttagtatatgcgtatttaggtgcgtcggtaggggacgcgtcggtatagtaaaaatggcggcggtattacgggtggcggcggtcggggtaaggtttagcgttttggcgagcggttttcgcgtcgcggttcgtagtttttgtagttaggttatttttgttaacgaacgtatcgaaaataagcgtcggatcgcgttgttgggagggggttaacgtcgtattgacgcgtagtataagcgagtgagttttgaggggtttaagtgagtttcgtttttggcgttcgcgatttattattgcgtgttcggtttgcggcgttcgaggtttttttgttaattcgtacggtgtt

SEQ ID NO: 33096 - DNA, 527 bp, Artificial Sequence
  chemically treated genomic DNA (Homo sapiens) CpG-island No: 33096
aacaccgtacgaattaacaaaaaaacctcgaacgccgcaaaccgaacacgcaataataaatcgcgaacgccaaaaacgaaactcacttaaacccctcaaaactcactcgcttatactacgcgtcaatacgacgttaaccccctcccaacaacgcgatccgacgcttattttcgatacgttcgttaacaaaaataacctaactacaaaaactacgaaccgcgacgcgaaaaccgctcgccaaaacgctaaaccttaccccgaccgccgccacccgtaataccgccgccatttttactataccgacgcgtcccctaccgacgcacctaaatacgcatatactaaaacgtaaatacgacgcttacgcaacatcgactaactataaaaaaccgcgaaaactaaactacaaaacctacttaaaaataaaacgtaaaaattcgaaacccgatactacccgaaaaaaatcgcgcaaaaaaaaaatacaaaacctacctaactacacaaaaaaaaaacataatccttactcttct

SEQ ID NO: 33097 - DNA, 899 bp, Artificial Sequence
  chemically treated genomic DNA (Homo sapiens) CpG-island No: 33097
gagcgggacgaggaggtggggtttagggggtttcggggcggatagattgatcgtcggatagtttaggtgtcggtatagcgtgggcggtgtttagagtcgcgtttcgtttttcgtaggttagcgtttagggttcgcgggtcgtgttcgtttttagtatggtcgttcgtcgcgtttgattcgcggttttttcgtttcgattgtttgtaggcgatgtttaggtaaagatcgtgattgatattttcgtttatacgtacgtacggatttaggtttacgttcggagatcgagtttcgggttcgtaatcgttgtcgttttcggcgtcgcggttagagttcggattacggttttcgcgtcgtcgtcgtttcgtcgagaagggtcgcgtcggatttcgagcgcggcggttttcggtcggtagggatggggaagcgggcgggaggaggagtaatcggagttattatcgtcgtcgtttttacgttcgtcggggtcgggttggaatttgcggtcgttcgtagcgggggttcgcggagcgcggtcgtcggttttttaggcgcgttgtatttggtgatgattttcgtagtggttgcggcgcgggtcgagaaggaaggtgggtgtttttcggcggcgtttttgcggcggggttgttatttcgttttcgcggaggtcgggagggttgggtcgggaggaagggtcgcggtcggggtttcggcgtaaagttgggcggtcgggtatcgtttcgagtcgggatttcgcggcgttcgtcgtacggagtggttttcgtttttcgtgattttttttcgtgttttttttcgttttttgttattgttattttaaaattttttgatttttcgtacgtttttgttatttggttcgttaggtaggaggggtatattttttggtttta

SEQ ID NO: 33098 - DNA, 899 bp, Artificial Sequence
  chemically treated genomic DNA (Homo sapiens) CpG-island No: 33098
taaaaccaaaaaatatacccctcctacctaacgaaccaaataacaaaaacgtacgaaaaatcaaaaaattttaaaataacaataacaaaaaacgaaaaaaaacacgaaaaaaaatcacgaaaaacgaaaaccactccgtacgacgaacgccgcgaaatcccgactcgaaacgatacccgaccgcccaactttacgccgaaaccccgaccgcgacccttcctcccgacccaaccctcccgacctccgcgaaaacgaaataacaaccccgccgcaaaaacgccgccgaaaaacacccaccttccttctcgacccgcgccgcaaccactacgaaaatcatcaccaaatacaacgcgcctaaaaaaccgacgaccgcgctccgcgaacccccgctacgaacgaccgcaaattccaacccgaccccgacgaacgtaaaaacgacgacgataataactccgattactcctcctcccgcccgcttccccatccctaccgaccgaaaaccgccgcgctcgaaatccgacgcgacccttctcgacgaaacgacgacgacgcgaaaaccgtaatccgaactctaaccgcgacgccgaaaacgacaacgattacgaacccgaaactcgatctccgaacgtaaacctaaatccgtacgtacgtataaacgaaaatatcaatcacgatctttacctaaacatcgcctacaaacaatcgaaacgaaaaaaccgcgaatcaaacgcgacgaacgaccatactaaaaacgaacacgacccgcgaaccctaaacgctaacctacgaaaaacgaaacgcgactctaaacaccgcccacgctataccgacacctaaactatccgacgatcaatctatccgccccgaaaccccctaaaccccacctcctcgtcccgctc

SEQ ID NO: 33099 - DNA, 899 bp, Artificial Sequence
  chemically treated genomic DNA (Homo sapiens) CpG-island No: 33099
taaagttaaaaaatatgttttttttatttagcgggttaagtggtaagaacgtacgagaagttaggaagttttgaaatggtagtgataggagacgggggaaggtacgggaaggaattacggagagcgaaggttatttcgtgcggcgggcgtcgcgaggtttcggttcgggacggtattcgatcgtttaattttgcgtcggagtttcggtcgcggttttttttttcggtttagttttttcggttttcgcgagagcggggtgatagtttcgtcgtagggacgtcgtcgggggatatttattttttttttcggttcgcgtcgtagttattacgagggttattattaggtgtagcgcgtttaggaggtcggcggtcgcgtttcgcgggttttcgttacgggcggtcgtaggttttagttcggtttcggcggacgtggagacggcggcggtggtggtttcggttgttttttttttcgttcgtttttttatttttgtcggtcgggggtcgtcgcgttcgaggttcggcgcggtttttttcggcgaggcggcggcggcgcggaagtcgtggttcgggttttggtcgcggcgtcgggagcgataacggttgcgagttcggggttcgattttcgagcgtgggtttgggttcgtgcgtgcgtgtgagcgagagtgttagttacggtttttgtttgggtatcgtttataagtagtcggagcggagaggtcgcgggttaggcgcggcgggcggttatattggaaacgggtacggttcgcgagttttgagcgttggtttgcgaggggcggggcgcggttttgggtatcgtttacgttgtgtcgatatttgggttgttcggcggttagtttgttcgtttcggagttttttgggttttattttttcgtttcgttt

SEQ ID NO: 33100 - DNA, 899 bp, Artificial Sequence
  chemically treated genomic DNA (Homo sapiens) CpG-island No: 33100
aaacgaaacgaaaaaataaaacccaaaaaactccgaaacgaacaaactaaccgccgaacaacccaaatatcgacacaacgtaaacgatacccaaaaccgcgccccgcccctcgcaaaccaacgctcaaaactcgcgaaccgtacccgtttccaatataaccgcccgccgcgcctaacccgcgacctctccgctccgactacttataaacgatacccaaacaaaaaccgtaactaacactctcgctcacacgcacgcacgaacccaaacccacgctcgaaaatcgaaccccgaactcgcaaccgttatcgctcccgacgccgcgaccaaaacccgaaccacgacttccgcgccgccgccgcctcgccgaaaaaaaccgcgccgaacctcgaacgcgacgacccccgaccgacaaaaataaaaaaacgaacgaaaaaaaaaacaaccgaaaccaccaccgccgccgtctccacgtccgccgaaaccgaactaaaacctacgaccgcccgtaacgaaaacccgcgaaacgcgaccgccgacctcctaaacgcgctacacctaataataaccctcgtaataactacgacgcgaaccgaaaaaaaaaataaatatcccccgacgacgtccctacgacgaaactatcaccccgctctcgcgaaaaccgaaaaaactaaaccgaaaaaaaaaaccgcgaccgaaactccgacgcaaaattaaacgatcgaataccgtcccgaaccgaaacctcgcgacgcccgccgcacgaaataaccttcgctctccgtaattccttcccgtaccttcccccgtctcctatcactaccatttcaaaacttcctaacttctcgtacgttcttaccacttaacccgctaaataaaaaaaacatattttttaacttta

SEQ ID NO: 33101 - DNA, 510 bp, Artificial Sequence
  chemically treated genomic DNA (Homo sapiens) CpG-island No: 33101
gttgttttttttcgggtttttcgtgttgcggaattgtagggttttttagcgttttttgtttttttcgtcggcggcgcggaagtcggggtttttcggacgttttcgatgagggtatttatttttttgtcggggatattttgtagacggttttaatattggtaaatattatagagaattgatttcgttcggtcgtcgtcggtttttatttttcgggtttttcgtttttcgttttcgttcgttttcgttcgttttttcggcgttttcgtcgcgttttttcgcgttcgcgtcgcgcgttttcgtttgcgtagtcgttttcgcgttttagtacgttcggtcggcgcgcgcgttcggtatcggttttatttttatttcgtttttcgtcggttcgcgattaagcgcggttattgttcgcgacgtagttttcgttttttggcggttgtcgggttttagtagttgtaggttttgcggggttagcggcggcgagttgggtttttgggcgagggttatttt

SEQ ID NO: 33102 - DNA, 510 bp, Artificial Sequence
  chemically treated genomic DNA (Homo sapiens) CpG-island No: 33102
aaaataaccctcgcccaaaaacccaactcgccgccgctaaccccgcaaaacctacaactactaaaacccgacaaccgccaaaaaacgaaaactacgtcgcgaacaataaccgcgcttaatcgcgaaccgacgaaaaacgaaataaaaataaaaccgataccgaacgcgcgcgccgaccgaacgtactaaaacgcgaaaacgactacgcaaacgaaaacgcgcgacgcgaacgcgaaaaaacgcgacgaaaacgccgaaaaaacgaacgaaaacgaacgaaaacgaaaaacgaaaaacccgaaaaataaaaaccgacgacgaccgaacgaaatcaattctctataatatttaccaatattaaaaccgtctacaaaatatccccgacaaaaaaataaataccctcatcgaaaacgtccgaaaaaccccgacttccgcgccgccgacgaaaaaaacaaaaaacgctaaaaaaccctacaattccgcaacacgaaaaacccgaaaaaaaacaac

SEQ ID NO: 33103 - DNA, 510 bp, Artificial Sequence
  chemically treated genomic DNA (Homo sapiens) CpG-island No: 33103
ggaatggttttcgtttaggggtttagttcgtcgtcgttagtttcgtagagtttgtagttgttggggttcggtagtcgttagggggcgggagttgcgtcgcgaataatggtcgcgtttggtcgcgggtcggcgggaggcggagtggaggtagagtcggtgtcgggcgcgcgcgtcggtcgggcgtgttggggcgcgggagcggttgcgtaggcgggggcgcgcggcgcgagcgcgggagggcgcggcgggagcgtcggggaggcgggcggaggcgggcggaggcggggggcggggagttcgaggggtggaagtcggcggcggtcgagcggggttagttttttgtagtgtttgttaatgttggagtcgtttgtaaagtgttttcggtaagaaggtaaatatttttatcgggggcgttcgggagatttcgattttcgcgtcgtcggcgaagaaggtagagggcgttggggagttttgtagtttcgtagtacggggaattcggagaaaagtagt

SEQ ID NO: 33104 - DNA, 510 bp, Artificial Sequence
  chemically treated genomic DNA (Homo sapiens) CpG-island No: 33104
actacttttctccgaattccccgtactacgaaactacaaaactccccaacgccctctaccttcttcgccgacgacgcgaaaatcgaaatctcccgaacgcccccgataaaaatatttaccttcttaccgaaaacactttacaaacgactccaacattaacaaacactacaaaaaactaaccccgctcgaccgccgccgacttccacccctcgaactccccgccccccgcctccgcccgcctccgcccgcctccccgacgctcccgccgcgccctcccgcgctcgcgccgcgcgcccccgcctacgcaaccgctcccgcgccccaacacgcccgaccgacgcgcgcgcccgacaccgactctacctccactccgcctcccgccgacccgcgaccaaacgcgaccattattcgcgacgcaactcccgccccctaacgactaccgaaccccaacaactacaaactctacgaaactaacgacgacgaactaaacccctaaacgaaaaccattcc

SEQ ID NO: 33105 - DNA, 2386 bp, Artificial Sequence
  chemically treated genomic DNA (Homo sapiens) CpG-island No: 33105
gttcggaaggaattattcgttcgttttttatttgcgttcggaaggaattttttttttatttgcgttcggaaggaagttattcgttcgtcgtttatttgcgttcggaaggaagttattcgttcgttttttatttgcgttcggaaggaagttattcgttcgttttttatttgcgttcggaaggaagttattcgttcgtcgtttatttgcgttcggaaggaagttattcgttcgttttttatttgcgttcggaaggaagttattcgttcgttttttatttgcgtttcgaaggaattattcgttcgttttttatttgcgttcggaaggaagttattcgttcgttttttatttgtgttcggaaggaagttattagttcgttttttatttgcgttcggaaggaagttattcgttcgttttttatttgcgttcggaaggaagttattcgttcgttttttatttgcgtttggaaggaagttatttgttcgttttttatttgcgttcggaaggaagttatttgttcgttttttatttgcgttcggaaggaagttattcgtttattttttatttgcgtttggaaggaagttatttattcgtcgtttatttgcgttcggaaggaagttattcgttcgttttttatttgcgttcggaaggaattattcgttcgttttttatttgcgtttggaaggaagttattcgttcgttttttatttgcgttttgaaggaagttattcgttttttttttatttgcgtttggaaggaagttattcgttcgttttttatttgcgttttgaaggaattatttattcgttttttatcggcgtttcgaaggaagttattcgttcgttttttatttgcgtttggaaggaagttattcgttcgttttttatttgcgttcggaaggaagttattcgttcgttttttatttgcgttttgaaggaagttattcgttcgttttttatttgcgtttggaaggaattatttattcgttttttatttgcgtttggaaggaagttatttattcgttttttatttgcgttttgaaggaattatttattcgttttttatttgcgtttggaaggaagttattcgttcgttttttatttgcgtttggaaggaagttattcgttcgttttttatttgcgttcggaaggaggttattcgttcgttttttatgtgcgttttgaaggaattatttattcgttttttatcggcgtttcgaaggaagttattcgttcgttttttatttgcgtttggaaggaagttattcgttcgttttttatttgcgttttgaaggaattattcgttcgttttttatttgcgttcggaaggaggttattcgttcgttttttatttgcgtttggaaggaattatttattcgttttttatttgcgttcggaaggaagttatttgttcgttttttatttgcgtttggaaggaattatttattcgttttttatttgcgttttgaaggaattatttattcgttttttatttgcgttcggaaggaggttattcgttcgttttttatttgcgttcggaaggaattatttattcgttttttatttgcgttttgaaggaattatttatttattttttatttgcgtttggaaggaagttattcgttcgttttttatttgcgttttgaaggaagttattcgttcgttttttatttgcgtttggaaggaagttattcgttcgttttttatttgcgttttgaaggaattatttattcgttttttatttgcgttttgaaggaagttatttattcgttttttatttgcgtttggaaggaattatttattcgttttttatttgcgttttgaaggaattatttattcgttttttatttgcgtttggaaggaagttattcgttcgttttttatttgcgttttgaaggaattatttattcgttttttatttgcgttttgaaggaattatttattcgttttttatcggcgtttcgaaggaagttattcgttcgttttttatttgcgtttggaaggaattattcgttcgttttttatttgcgttcggaaggaattattcgttcgttttttatttgcgtttcgaaggaagttattcgttcgttttttatttgcgtttcgaaggaagttattcgttcgttttttatttgcgttcggaaggaagttattcgttcgttttttatttgcgttcggaaggaagttatttattcgttttttatttgcgttcggaaggaagttatttattcgttttttatttgcgttcggaaggaagttattcgttcgttttttatttgcgttcggaaggaattatttattcgttttttatttgcgttttgaaggaattatttattcgttttttattaggttgtgttggacggggtatgattagcgttttttttgtaggt

SEQ ID NO: 33106 - DNA, 2386 bp, Artificial Sequence
  chemically treated genomic DNA (Homo sapiens) CpG-island No: 33106
acctacaaaaaaaacgctaatcataccccgtccaacacaacctaataaaaaacgaataaataattccttcaaaacgcaaataaaaaacgaataaataattccttccgaacgcaaataaaaaacgaacgaataacttccttccgaacgcaaataaaaaacgaataaataacttccttccgaacgcaaataaaaaacgaataaataacttccttccgaacgcaaataaaaaacgaacgaataacttccttccgaacgcaaataaaaaacgaacgaataacttccttcgaaacgcaaataaaaaacgaacgaataacttccttcgaaacgcaaataaaaaacgaacgaataattccttccgaacgcaaataaaaaacgaacgaataattccttccaaacgcaaataaaaaacgaacgaataacttccttcgaaacgccgataaaaaacgaataaataattccttcaaaacgcaaataaaaaacgaataaataattccttcaaaacgcaaataaaaaacgaacgaataacttccttccaaacgcaaataaaaaacgaataaataattccttcaaaacgcaaataaaaaacgaataaataattccttccaaacgcaaataaaaaacgaataaataacttccttcaaaacgcaaataaaaaacgaataaataattccttcaaaacgcaaataaaaaacgaacgaataacttccttccaaacgcaaataaaaaacgaacgaataacttccttcaaaacgcaaataaaaaacgaacgaataacttccttccaaacgcaaataaaaaataaataaataattccttcaaaacgcaaataaaaaacgaataaataattccttccgaacgcaaataaaaaacgaacgaataacctccttccgaacgcaaataaaaaacgaataaataattccttcaaaacgcaaataaaaaacgaataaataattccttccaaacgcaaataaaaaacgaacaaataacttccttccgaacgcaaataaaaaacgaataaataattccttccaaacgcaaataaaaaacgaacgaataacctccttccgaacgcaaataaaaaacgaacgaataattccttcaaaacgcaaataaaaaacgaacgaataacttccttccaaacgcaaataaaaaacgaacgaataacttccttcgaaacgccgataaaaaacgaataaataattccttcaaaacgcacataaaaaacgaacgaataacctccttccgaacgcaaataaaaaacgaacgaataacttccttccaaacgcaaataaaaaacgaacgaataacttccttccaaacgcaaataaaaaacgaataaataattccttcaaaacgcaaataaaaaacgaataaataacttccttccaaacgcaaataaaaaacgaataaataattccttccaaacgcaaataaaaaacgaacgaataacttccttcaaaacgcaaataaaaaacgaacgaataacttccttccgaacgcaaataaaaaacgaacgaataacttccttccaaacgcaaataaaaaacgaacgaataacttccttcgaaacgccgataaaaaacgaataaataattccttcaaaacgcaaataaaaaacgaacgaataacttccttccaaacgcaaataaaaaaaaaacgaataacttccttcaaaacgcaaataaaaaacgaacgaataacttccttccaaacgcaaataaaaaacgaacgaataattccttccgaacgcaaataaaaaacgaacgaataacttccttccgaacgcaaataaacgacgaataaataacttccttccaaacgcaaataaaaaataaacgaataacttccttccgaacgcaaataaaaaacgaacaaataacttccttccgaacgcaaataaaaaacgaacaaataacttccttccaaacgcaaataaaaaacgaacgaataacttccttccgaacgcaaataaaaaacgaacgaataacttccttccgaacgcaaataaaaaacgaactaataacttccttccgaacacaaataaaaaacgaacgaataacttccttccgaacgcaaataaaaaacgaacgaataattccttcgaaacgcaaataaaaaacgaacgaataacttccttccgaacgcaaataaaaaacgaacgaataacttccttccgaacgcaaataaacgacgaacgaataacttccttccgaacgcaaataaaaaacgaacgaataacttccttccgaacgcaaataaaaaacgaacgaataacttccttccgaacgcaaataaacgacgaacgaataacttccttccgaacgcaaataaaaaaaaaattccttccgaacgcaaataaaaaacgaacgaataattccttccgaac

SEQ ID NO: 33107 - DNA, 2386 bp, Artificial Sequence
  chemically treated genomic DNA (Homo sapiens) CpG-island No: 33107
gtttgtagaggaagcgttagttatgtttcgtttagtatagtttgatgagaaacgggtggatgatttttttaggacgtagatgagggacgggtggatgatttttttcggacgtagatgagggacgggcggatgattttttttcggacgtagatgagggacgggtggatgattttttttcggacgtagatgagggacgggtggatgattttttttcggacgtagatgagggacgggcggatgattttttttcggacgtagatgagggacgggcggatgatttttttcgggacgtagatgagggacgggcggatgatttttttcgggacgtagatgagggacgggcggatgatttttttcggacgtagatgaggaacgggcggatgattttttttagacgtagatgagggacgggcggatgatttttttcgggacgtcgatgaggaacgggtggatgatttttttaggacgtagatgagggacgggtggatgatttttttaggacgtagatgagggacgggcggatgatttttttttagacgtagatgagggacgggtggatgatttttttaggacgtagatgagggacgggtggatgattttttttagacgtagatgagggacgggtggatgattttttttaggacgtagatgaggaacgggtggatgatttttttaggacgtagatgagggacgggcggatgatttttttttagacgtagatgaggaacgggcggatgattttttttaggacgtagatgagggacgggcggatgatttttttttagacgtagatgagggatgggtggatgatttttttaggacgtagatgagggacgggtggatgatttttttcggacgtagatgaggaacgggcggatgattttttttcggacgtagatgagggacgggtggatgatttttttaggacgtagatgagggacgggtggatgattttttttagacgtagatgagggacgggtagatgattttttttcggacgtagatgagggacgggtggatgattttttttagacgtagatgaggaacgggcggatgattttttttcggacgtagatgagggacgggcggatgatttttttaggacgtagatgagggacgggcggatgatttttttttagacgtagatgagggacgggcggatgatttttttcgggacgtcgatgaggaacgggtggatgatttttttaggacgtatatgagggacgggcggatgattttttttcggacgtagatgagggacgggcggatgatttttttttagacgtagatgagggacgggcggatgatttttttttagacgtaaatgagggacgggtggatgatttttttaggacgtaaatgagggacgggtggatgatttttttttagacgtagatgagggacgggtggatgattttttttagacgtagatgagggacgggcggatgattttttttaggacgtagatgagggacgggcggatgattttttttcggacgtagatgagggacgggcggatgatttttttttagacgtagatgagggacgggcggatgatttttttcgggacgtcgatgaggaacgggtggatgatttttttaggacgtagatgaggaacgggcggatgatttttttttagacgtagatgaggaaagggcggatgattttttttaggacgtagatgagggacgggcggatgatttttttttagacgtagatgagggacgggcggatgatttttttcggacgtagatgagggacgggcggatgattttttttcggacgtagatgagcgacgggtggatgatttttttttagacgtagatgagggatgggcggatgattttttttcggacgtagatgaggaacgagtagatgattttttttcggacgtagatgaggaacgagtagatgatttttttttagacgtagatgagggacgggcggatgattttttttcggacgtagatgagggacgggcggatgattttttttcggacgtagatgagggacgggttgatgattttttttcggatatagatgagggacgggcggatgattttttttcggacgtagatgagggacgggcggatgattttttcgggacgtagatgagggacgggcggatgattttttttcggacgtagatgagggacgggcggatgattttttttcggacgtagatgagcgacgggcggatgattttttttcggacgtagatgagggacgggcggatgattttttttcggacgtagatgagggacgggcggatgattttttttcggacgtagatgagcgacgggcggatgattttttttcggacgtagatgaggaagggatttttttcggacgtagatgagggacgggcggatgatttttttcggat

SEQ ID NO: 33108 - DNA, 2386 bp, Artificial Sequence
  chemically treated genomic DNA (Homo sapiens) CpG-island No: 33108
atccgaaaaaaatcatccgcccgtccctcatctacgtccgaaaaaaatcccttcctcatctacgtccgaaaaaaaatcatccgcccgtcgctcatctacgtccgaaaaaaaatcatccgcccgtccctcatctacgtccgaaaaaaaatcatccgcccgtccctcatctacgtccgaaaaaaaatcatccgcccgtcgctcatctacgtccgaaaaaaaatcatccgcccgtccctcatctacgtccgaaaaaaaatcatccgcccgtccctcatctacgtcccgaaaaaatcatccgcccgtccctcatctacgtccgaaaaaaaatcatccgcccgtccctcatctatatccgaaaaaaaatcatcaacccgtccctcatctacgtccgaaaaaaaatcatccgcccgtccctcatctacgtccgaaaaaaaatcatccgcccgtccctcatctacgtctaaaaaaaaatcatctactcgttcctcatctacgtccgaaaaaaaatcatctactcgttcctcatctacgtccgaaaaaaaatcatccgcccatccctcatctacgtctaaaaaaaaatcatccacccgtcgctcatctacgtccgaaaaaaaatcatccgcccgtccctcatctacgtccgaaaaaaatcatccgcccgtccctcatctacgtctaaaaaaaaatcatccgcccgtccctcatctacgtcctaaaaaaaatcatccgccctttcctcatctacgtctaaaaaaaaatcatccgcccgttcctcatctacgtcctaaaaaaatcatccacccgttcctcatcgacgtcccgaaaaaaatcatccgcccgtccctcatctacgtctaaaaaaaaatcatccgcccgtccctcatctacgtccgaaaaaaaatcatccgcccgtccctcatctacgtcctaaaaaaaatcatccgcccgtccctcatctacgtctaaaaaaaatcatccacccgtccctcatctacgtctaaaaaaaaatcatccacccgtccctcatttacgtcctaaaaaaatcatccacccgtccctcatttacgtctaaaaaaaaatcatccgcccgtccctcatctacgtctaaaaaaaaatcatccgcccgtccctcatctacgtccgaaaaaaaatcatccgcccgtccctcatatacgtcctaaaaaaatcatccacccgttcctcatcgacgtcccgaaaaaaatcatccgcccgtccctcatctacgtctaaaaaaaaatcatccgcccgtccctcatctacgtcctaaaaaaatcatccgcccgtccctcatctacgtccgaaaaaaaatcatccgcccgttcctcatctacgtctaaaaaaaatcatccacccgtccctcatctacgtccgaaaaaaaatcatctacccgtccctcatctacgtctaaaaaaaatcatccacccgtccctcatctacgtcctaaaaaaatcatccacccgtccctcatctacgtccgaaaaaaaatcatccgcccgttcctcatctacgtccgaaaaaaatcatccacccgtccctcatctacgtcctaaaaaaatcatccacccatccctcatctacgtctaaaaaaaaatcatccgcccgtccctcatctacgtcctaaaaaaaatcatccgcccgttcctcatctacgtctaaaaaaaaatcatccgcccgtccctcatctacgtcctaaaaaaatcatccacccgttcctcatctacgtcctaaaaaaaatcatccacccgtccctcatctacgtctaaaaaaaatcatccacccgtccctcatctacgtcctaaaaaaatcatccacccgtccctcatctacgtctaaaaaaaaatcatccgcccgtccctcatctacgtcctaaaaaaatcatccacccgtccctcatctacgtcctaaaaaaatcatccacccgttcctcatcgacgtcccgaaaaaaatcatccgcccgtccctcatctacgtctaaaaaaaatcatccgcccgttcctcatctacgtccgaaaaaaatcatccgcccgtccctcatctacgtcccgaaaaaaatcatccgcccgtccctcatctacgtcccgaaaaaaatcatccgcccgtccctcatctacgtccgaaaaaaaatcatccgcccgtccctcatctacgtccgaaaaaaaatcatccacccgtccctcatctacgtccgaaaaaaaatcatccacccgtccctcatctacgtccgaaaaaaaatcatccgcccgtccctcatctacgtccgaaaaaaatcatccacccgtccctcatctacgtcctaaaaaaatcatccacccgtttctcatcaaactatactaaacgaaacataactaacgcttcctctacaaac

SEQ ID NO: 33109 - DNA, 676 bp, Artificial Sequence
  chemically treated genomic DNA (Homo sapiens) CpG-island No: 33109
gaggtcggtgtaggacgagtgtggtttaggcgtagtatttgaaaagggcgtttagggagggagtcggcggtcgttgggcgttttttcggttcgtattcgggtatttttcgattcgggttggaggggtagtgtttcgggatgtatcgttgcggggatttttcgttcggtttcgcggattcgtttcggtttaggacggaggaggaggtaggtgcggggttcggggcgggtgcggggacggtaggtggagggaagagggtatcgggttttgtttatcgcggtgtgtggggttgttcgatcgcgtttttcgtaggtgtcgtttagatttcggtcgagggttttcgttttcgcgtaggtttaggtcgaggtcgagagagggttcgtgttttcgcgtagatttaggtcgagagagggttcgtgatttcgcgtaggttaaggtcgagagagggttcgtgttttcgcggaggttaaggtcgagagagggttcgtgttttcgcgtaggttaaggtttagagttttcgtgttcgtatagatggtgttttggggtttagtcgcgtttttcgttcgcggtagttttcgtgtattgggttttgtaaagttcgttaggagcgttttagggcgatagtgtttagcggttaataagtttgtaattattttcgtgggtttttacgttgtaaat

SEQ ID NO: 33110 - DNA, 676 bp, Artificial Sequence
  chemically treated genomic DNA (Homo sapiens) CpG-island No: 33110
atttacaacgtaaaaacccacgaaaataattacaaacttattaaccgctaaacactatcgccctaaaacgctcctaacgaactttacaaaacccaatacacgaaaactaccgcgaacgaaaaacgcgactaaaccccaaaacaccatctatacgaacacgaaaactctaaaccttaacctacgcgaaaacacgaaccctctctcgaccttaacctccgcgaaaacacgaaccctctctcgaccttaacctacgcgaaatcacgaaccctctctcgacctaaatctacgcgaaaacacgaaccctctctcgacctcgacctaaacctacgcgaaaacgaaaaccctcgaccgaaatctaaacgacacctacgaaaaacgcgatcgaacaaccccacacaccgcgataaacaaaacccgataccctcttccctccacctaccgtccccgcacccgccccgaaccccgcacctacctcctcctccgtcctaaaccgaaacgaatccgcgaaaccgaacgaaaaatccccgcaacgatacatcccgaaacactacccctccaacccgaatcgaaaaatacccgaatacgaaccgaaaaaacgcccaacgaccgccgactccctccctaaacgcccttttcaaatactacgcctaaaccacactcgtcctacaccgacctc

SEQ ID NO: 33111 - DNA, 676 bp, Artificial Sequence
  chemically treated genomic DNA (Homo sapiens) CpG-island No: 33111
atttgtaacgtagaaatttacgaaagtaattataaatttgttaatcgttgggtattgtcgttttggagcgtttttaacggattttgtaaggtttagtatacgggggttgtcgcgagcggggagcgcgattgggttttaggatattatttgtgcgagtacggggattttgggttttgatttgcgcggggatacgggttttttttcggttttgattttcgcggggatacgggttttttttcggttttgatttgcgcggggttacgggttttttttcggtttaggtttgcgcggggatacgggttttttttcggtttcgatttgggtttgcgcggggacgaggattttcggtcggggtttgggcggtatttgcggggggcgcggtcgggtagttttatatatcgcggtgagtagggttcgatgtttttttttttttatttgtcgttttcgtattcgtttcgggtttcgtatttgttttttttttcgttttgggtcgaggcgggttcgcgaggtcgggcggggggttttcgtagcggtgtatttcgggatattgtttttttagttcgggtcgagggatgttcgggtgcgggtcgagagagcgtttaacgatcgtcggttttttttttgggcgttttttttaggtattgcgtttggattatattcgttttatatcggtttt

SEQ ID NO: 33112 - DNA, 676 bp, Artificial Sequence
  chemically treated genomic DNA (Homo sapiens) CpG-island No: 33112
aaaaccgatataaaacgaatataatccaaacgcaatacctaaaaaaaacgcccaaaaaaaaaaccgacgatcgttaaacgctctctcgacccgcacccgaacatccctcgacccgaactaaaaaaacaatatcccgaaatacaccgctacgaaaaccccccgcccgacctcgcgaacccgcctcgacccaaaacgaaaaaaaaaacaaatacgaaacccgaaacgaatacgaaaacgacaaataaaaaaaaaaaaacatcgaaccctactcaccgcgatatataaaactacccgaccgcgccccccgcaaataccgcccaaaccccgaccgaaaatcctcgtccccgcgcaaacccaaatcgaaaccgaaaaaaaacccgtatccccgcgcaaacctaaaccgaaaaaaaacccgtaaccccgcgcaaatcaaaaccgaaaaaaaacccgtatccccgcgaaaatcaaaaccgaaaaaaaacccgtatccccgcgcaaatcaaaacccaaaatccccgtactcgcacaaataatatcctaaaacccaatcgcgctccccgctcgcgacaacccccgtatactaaaccttacaaaatccgttaaaaacgctccaaaacgacaatacccaacgattaacaaatttataattactttcgtaaatttctacgttacaaat

SEQ ID NO: 33113 - DNA, 517 bp, Artificial Sequence
  chemically treated genomic DNA (Homo sapiens) CpG-island No: 33113
gaatcgtttttacgggacgtatgagtttcgttaggtgtcggttaggaatgtatcgcgtttttttgttcggttagattttgggagaggcgggttcgttgttatttgattttcgttatttgattcgtggggtcggatttcggcgagatgagttttgggagttgtagttttcgcgcgttttagacggatagagcgtagttgggtcgggtcggggcgtagagatcggggtttcggcgtgagggaagatgaggttcgttgttagggatatagagatttttggagtcgttagcgtttttcggtttttttcgtgagcgaagtttagatcgttttttattgggcggaaattagagttcgtgggggcggggttttttttaggtttcgtttttcgtcgttttttcgtttatagtcggggttcgtcgagaggttgcgtggaagttcgtttttttcggttagtgggaagacgagaagtttttatgttgggtgtggttgaaagattggtaggcgatttttcgtttttgtt

SEQ ID NO: 33114 - DNA, 517 bp, Artificial Sequence
  chemically treated genomic DNA (Homo sapiens) CpG-island No: 33114
aacaaaaacgaaaaatcgcctaccaatctttcaaccacacccaacataaaaacttctcgtcttcccactaaccgaaaaaaacgaacttccacgcaacctctcgacgaaccccgactataaacgaaaaaacgacgaaaaacgaaacctaaaaaaaaccccgcccccacgaactctaatttccgcccaataaaaaacgatctaaacttcgctcacgaaaaaaaccgaaaaacgctaacgactccaaaaatctctatatccctaacaacgaacctcatcttccctcacgccgaaaccccgatctctacgccccgacccgacccaactacgctctatccgtctaaaacgcgcgaaaactacaactcccaaaactcatctcgccgaaatccgaccccacgaatcaaataacgaaaatcaaataacaacgaacccgcctctcccaaaatctaaccgaacaaaaaaacgcgatacattcctaaccgacacctaacgaaactcatacgtcccgtaaaaacgattc

SEQ ID NO: 33115 - DNA, 517 bp, Artificial Sequence
  chemically treated genomic DNA (Homo sapiens) CpG-island No: 33115
ggtaggggcggggagtcgtttgttaattttttagttatatttaatatggaggtttttcgtttttttattggtcggggaaggcgagtttttacgtaatttttcggcgggtttcggttataggcggagaggcggcggaaggcgggatttaaagggggtttcgtttttacgggttttgattttcgtttaatggagggcggtttgagtttcgtttacgaaaggagtcgggaggcgttggcggttttaagagtttttgtgtttttggtagcggattttatttttttttacgtcggagtttcgatttttgcgtttcggttcgatttagttgcgttttgttcgtttaagacgcgcggaaattataatttttagagtttatttcgtcgagattcggttttacgagttaggtggcggaggttaggtgatagcggattcgttttttttaaagtttagtcgggtaggggaacgcggtgtatttttgatcggtatttggcgaggtttatgcgtttcgtgagggcggttt

SEQ ID NO: 33116 - DNA, 517 bp, Artificial Sequence
  chemically treated genomic DNA (Homo sapiens) CpG-island No: 33116
aaaccgccctcacgaaacgcataaacctcgccaaataccgatcaaaaatacaccgcgttcccctacccgactaaactttaaaaaaaacgaatccgctatcacctaacctccgccacctaactcgtaaaaccgaatctcgacgaaataaactctaaaaattataatttccgcgcgtcttaaacgaacaaaacgcaactaaatcgaaccgaaacgcaaaaatcgaaactccgacgtaaaaaaaaataaaatccgctaccaaaaacacaaaaactcttaaaaccgccaacgcctcccgactcctttcgtaaacgaaactcaaaccgccctccattaaacgaaaatcaaaacccgtaaaaacgaaaccccctttaaatcccgccttccgccgcctctccgcctataaccgaaacccgccgaaaaattacgtaaaaactcgccttccccgaccaataaaaaaacgaaaaacctccatattaaatataactaaaaaattaacaaacgactccccgcccctacc

SEQ ID NO: 33117 - DNA, 681 bp, Artificial Sequence
  chemically treated genomic DNA (Homo sapiens) CpG-island No: 33117
gtcgttcgttcgtttcgcgttcgggggtttcgcgtttggagttgcgtcggcggtagttatggatttgggtttcggggacgcggtaggagggggatcgttcgcgtttcggtttcgtcgtcgtcgttttttgcgtcgtttgtttagtcgttttttgttggcgttgggtagtcgtttacgtttcggggatttatcgtttcggttttagtcgggatattgtgatggcgacggtgaggggggtttcgtttgcgtttcgggtttagttttagcggttttcgggagtttcggggaggaacgttcgttcggattttagttttagttttagtttttcgtcggcgatggggcgcggtcgtcgggcgtttagggtttgaagaattacggtaatatttgttttatgaacgcggtggtgtagtgttttagtaatatcgatttgttggtcgagtttttggcgttggggcgttatcgggcggtttcgggtcgcgtcgaggttatcgagtagttggcggcgttggtgcgcgcgttttggattcgcgaatatacgttttaatttttcgcggagtttaaggtaggtagcgttgcgtcgtcgatcgttttgtttttttggtttcgttttttgaaaagtgtgtgtacgattaggaaagggtttttttggggttttttttaaatgtcgttgattagtttagt

SEQ ID NO: 33118 - DNA, 681 bp, Artificial Sequence
  chemically treated genomic DNA (Homo sapiens) CpG-island No: 33118
actaaactaatcaacgacatttaaaaaaaaccccaaaaaaaccctttcctaatcgtacacacacttttcaaaaaacgaaaccaaaaaaacaaaacgatcgacgacgcaacgctacctaccttaaactccgcgaaaaattaaaacgtatattcgcgaatccaaaacgcgcgcaccaacgccgccaactactcgataacctcgacgcgacccgaaaccgcccgataacgccccaacgccaaaaactcgaccaacaaatcgatattactaaaacactacaccaccgcgttcataaaacaaatattaccgtaattcttcaaaccctaaacgcccgacgaccgcgccccatcgccgacgaaaaactaaaactaaaactaaaatccgaacgaacgttcctccccgaaactcccgaaaaccgctaaaactaaacccgaaacgcaaacgaaacccccctcaccgtcgccatcacaatatcccgactaaaaccgaaacgataaatccccgaaacgtaaacgactacccaacgccaacaaaaaacgactaaacaaacgacgcaaaaaacgacgacgacgaaaccgaaacgcgaacgatccccctcctaccgcgtccccgaaacccaaatccataactaccgccgacgcaactccaaacgcgaaacccccgaacgcgaaacgaacgaacgac

SEQ ID NO: 33119 - DNA, 681 bp, Artificial Sequence
  chemically treated genomic DNA (Homo sapiens) CpG-island No: 33119
gttgaattggttaacggtatttaaagaaggttttaagaaaatttttttttgatcgtgtatatattttttaagaggcgaaattagggggatagggcggtcggcggcgtagcgttgtttattttgaatttcgcggaaagttggggcgtgtattcgcgagtttagagcgcgcgtattagcgtcgttagttgttcggtgatttcggcgcggttcggagtcgttcggtagcgttttagcgttaggaattcggttagtaggtcggtgttgttgagatattgtattatcgcgtttatgaaataggtgttgtcgtggttttttaagttttgagcgttcggcggtcgcgttttatcgtcggcggggagttggagttggggttggggttcgggcgggcgttttttttcggggttttcgggggtcgttggaattgggttcggggcgtaggcgaagttttttttatcgtcgttattatagtgtttcggttggggtcggggcggtgagttttcggggcgtgagcggttgtttagcgttagtaggaagcggttgaataggcggcgtagggagcggcggcggcggggtcggggcgcgagcggttttttttttgtcgcgttttcggggtttaggtttatggttgtcgtcggcgtagttttaggcgcggagttttcgggcgcgaggcggacgagcggt

SEQ ID NO: 33120 - DNA, 681 bp, Artificial Sequence
  chemically treated genomic DNA (Homo sapiens) CpG-island No: 33120
accgctcgtccgcctcgcgcccgaaaactccgcgcctaaaactacgccgacgacaaccataaacctaaaccccgaaaacgcgacaaaaaaaaaaccgctcgcgccccgaccccgccgccgccgctccctacgccgcctattcaaccgcttcctactaacgctaaacaaccgctcacgccccgaaaactcaccgccccgaccccaaccgaaacactataataacgacgataaaaaaaacttcgcctacgccccgaacccaattccaacgacccccgaaaaccccgaaaaaaaacgcccgcccgaaccccaaccccaactccaactccccgccgacgataaaacgcgaccgccgaacgctcaaaacttaaaaaaccacgacaacacctatttcataaacgcgataatacaatatctcaacaacaccgacctactaaccgaattcctaacgctaaaacgctaccgaacgactccgaaccgcgccgaaatcaccgaacaactaacgacgctaatacgcgcgctctaaactcgcgaatacacgccccaactttccgcgaaattcaaaataaacaacgctacgccgccgaccgccctatccccctaatttcgcctcttaaaaaatatatacacgatcaaaaaaaaattttcttaaaaccttctttaaataccgttaaccaattcaac

SEQ ID NO: 33121 - DNA, 931 bp, Artificial Sequence
  chemically treated genomic DNA (Homo sapiens) CpG-island No: 33121
tttcgcgcggatattttttttagaagtagatgtgattattttgtttcgggttatttacgtgttttacggtgacgtgcgtaattagttcgtgtatggtgttgaaagttttgttgtacgattttttggggttggttagttgttcgggttcgatttatttgtagatgagtttttgtttgatgggttggcgtatgtagcggaagaaggcgtcggcgtcgtgatgcgcggttatgtttacgtttatgggttcgtagtcgtgtagttgcggcgtagtatagtgtttcgaacgcgggttggttatttggtcgtattgtttcggtcgcgggtatatgtttttcgagaagtcgagttttatttgttcgttgattacgttaggcgacgcgtggtcggtagtttgttcgtgaagttcggggaagaggaggtggttcgcggcgttcgtgtggtcgtgtgggttttcgaagttttcggtcgatgtagtaaagaggttgtgttgtgcgttggttgtcgtcgtcgcgtcgttaaaatttcggttgcggaatagaaagtttcgcgtggagttgaaggttgcgttggaataggagtcgacgtggttcgggtgatggtgatggtttagggtcgtagtagtcgcgtagtttggcgtttgcgacgtgaaggtcgtttggtcggtcgaagttagttcgtgcgaattggggttgagtttgaaggcgtttatgtcgtcggcgaacgggttgatgtttaggtttacgtttcgttcggttacgtcgttcgcggagtggtggcgggacgcgttaaaggtggttacgtcgatcgttgggtattgggggtcggcgtttaggagtatcgtggttgttcggggcgagtttcggtttttttcgttttttttattttcgttagtcgaggagggaaaatcgggaggaggaggaggaataagagg

SEQ ID NO: 33122 - DNA, 931 bp, Artificial Sequence
  chemically treated genomic DNA (Homo sapiens) CpG-island No: 33122
cctcttattcctcctcctcctcccgattttccctcctcgactaacgaaaataaaaaaaacgaaaaaaaccgaaactcgccccgaacaaccacgatactcctaaacgccgacccccaatacccaacgatcgacgtaaccacctttaacgcgtcccgccaccactccgcgaacgacgtaaccgaacgaaacgtaaacctaaacatcaacccgttcgccgacgacataaacgccttcaaactcaaccccaattcgcacgaactaacttcgaccgaccaaacgaccttcacgtcgcaaacgccaaactacgcgactactacgaccctaaaccatcaccatcacccgaaccacgtcgactcctattccaacgcaaccttcaactccacgcgaaactttctattccgcaaccgaaattttaacgacgcgacgacgacaaccaacgcacaacacaacctctttactacatcgaccgaaaacttcgaaaacccacacgaccacacgaacgccgcgaaccacctcctcttccccgaacttcacgaacaaactaccgaccacgcgtcgcctaacgtaatcaacgaacaaataaaactcgacttctcgaaaaacatatacccgcgaccgaaacaatacgaccaaataaccaacccgcgttcgaaacactatactacgccgcaactacacgactacgaacccataaacgtaaacataaccgcgcatcacgacgccgacgccttcttccgctacatacgccaacccatcaaacaaaaactcatctacaaataaatcgaacccgaacaactaaccaaccccaaaaaatcgtacaacaaaactttcaacaccatacacgaactaattacgcacgtcaccgtaaaacacgtaaataacccgaaacaaaataatcacatctacttctaaaaaaaatatccgcgcgaaa

SEQ ID NO: 33123 - DNA, 931 bp, Artificial Sequence
  chemically treated genomic DNA (Homo sapiens) CpG-island No: 33123
ttttttgttttttttttttttttcgatttttttttttcggttggcgagggtggggggggcgggggaggtcggggttcgtttcgagtagttacgatgtttttggacgtcggtttttagtatttagcgatcggcgtgattatttttggcgcgtttcgttattatttcgcgggcgacgtggtcgaacgagacgtgggtttgggtattaattcgttcgtcgacggtatgggcgtttttaagtttaattttagttcgtacgagttggtttcggtcggttagacggtttttacgtcgtaggcgttaggttacgcggttgttgcggttttgggttattattattattcgggttacgtcggtttttattttagcgtagtttttaattttacgcgggattttttgtttcgtaatcggggttttggcgacgcggcggcggtagttagcgtatagtatagtttttttgttgtatcggtcgggggtttcgggggtttatacggttatacggacgtcgcgggttattttttttttttcgggttttacgagtaggttgtcggttacgcgtcgtttaacgtggttaacgggtagatgaggttcggtttttcgggggatatgtattcgcgatcggagtagtacggttaggtgattagttcgcgttcggagtattatgttgcgtcgtagttgtacggttacgggtttatgaacgtgaatatggtcgcgtattacggcgtcggcgttttttttcgttatatgcgttaatttattaagtaagagtttatttgtaagtggatcgagttcgagtagttggttaattttaaaaagtcgtgtaataaaatttttagtattatgtacgagttagttacgtacgttatcgtggagtacgtaggtggttcggagtagagtaattatatttgtttttgggaggagtgttcgcgcgagg

SEQ ID NO: 33124 - DNA, 931 bp, Artificial Sequence
  chemically treated genomic DNA (Homo sapiens) CpG-island No: 33124
cctcgcgcgaacactcctcccaaaaacaaatataattactctactccgaaccacctacgtactccacgataacgtacgtaactaactcgtacataatactaaaaattttattacacgactttttaaaattaaccaactactcgaactcgatccacttacaaataaactcttacttaataaattaacgcatataacgaaaaaaaacgccgacgccgtaatacgcgaccatattcacgttcataaacccgtaaccgtacaactacgacgcaacataatactccgaacgcgaactaatcacctaaccgtactactccgatcgcgaatacatatcccccgaaaaaccgaacctcatctacccgttaaccacgttaaacgacgcgtaaccgacaacctactcgtaaaacccgaaaaaaaaaaaataacccgcgacgtccgtataaccgtataaacccccgaaacccccgaccgatacaacaaaaaaactatactatacgctaactaccgccgccgcgtcgccaaaaccccgattacgaaacaaaaaatcccgcgtaaaattaaaaactacgctaaaataaaaaccgacgtaacccgaataataataataacccaaaaccgcaacaaccgcgtaacctaacgcctacgacgtaaaaaccgtctaaccgaccgaaaccaactcgtacgaactaaaattaaacttaaaaacgcccataccgtcgacgaacgaattaatacccaaacccacgtctcgttcgaccacgtcgcccgcgaaataataacgaaacgcgccaaaaataatcacgccgatcgctaaatactaaaaaccgacgtccaaaaacatcgtaactactcgaaacgaaccccgacctcccccgccccccccaccctcgccaaccgaaaaaaaaaaatcgaaaaaaaaaaaaaaaacaaaaaa

SEQ ID NO: 33125 - DNA, 592 bp, Artificial Sequence
  chemically treated genomic DNA (Homo sapiens) CpG-island No: 33125
tgttttcgttaggcgagaagttttttagatgcgagttcgagggttgcgagcggcgtttcgttaatagtagcgatcgtaagaagtattcgtacgtgtatattagcgataagttatatacgtgtaaggtgcggggttgcgataagtgttatacgtattttagttcgttgcgtaagtatatgaaggtgtacgggcgttcgtcgtcgtttagttttggttacgattcggttatatcgtttgttttcgtgtcgttttcgtcggattgcggttataagttttaggtggttttttcggcggcggtggcggcgcgtatcgtcgatttgagcgaatggtacgtgtgttagggtttgggttttatagcggttgttttcgtcgcgatttttagtttcgagttattatttggttttgttgttgtcgtcgtcgttttcggtattagggttgtttttgtgattgttgttttcgtatatatcgaatgtagagtaggttacgtttttgaggtatgaagagggcgagggcggaaggaaggaaggtcggtcggttatttgtaatagttgttggagtttattgaatacgttaatataatgtttattatttt

SEQ ID NO: 33126 - DNA, 592 bp, Artificial Sequence
  chemically treated genomic DNA (Homo sapiens) CpG-island No: 33126
aaaataataaacattatattaacgtattcaataaactccaacaactattacaaataaccgaccgaccttccttccttccgccctcgccctcttcatacctcaaaaacgtaacctactctacattcgatatatacgaaaacaacaatcacaaaaacaaccctaataccgaaaacgacgacgacaacaacaaaaccaaataataactcgaaactaaaaatcgcgacgaaaacaaccgctataaaacccaaaccctaacacacgtaccattcgctcaaatcgacgatacgcgccgccaccgccgccgaaaaaaccacctaaaacttataaccgcaatccgacgaaaacgacacgaaaacaaacgatataaccgaatcgtaaccaaaactaaacgacgacgaacgcccgtacaccttcatatacttacgcaacgaactaaaatacgtataacacttatcgcaaccccgcaccttacacgtatataacttatcgctaatatacacgtacgaatacttcttacgatcgctactattaacgaaacgccgctcgcaaccctcgaactcgcatctaaaaaacttctcgcctaacgaaaaca

SEQ ID NO: 33127 - DNA, 592 bp, Artificial Sequence
  chemically treated genomic DNA (Homo sapiens) CpG-island No: 33127
aaaataatggatattatattagcgtatttagtgagttttagtaattattataggtggtcggtcggtttttttttttttcgttttcgttttttttatgttttagaaacgtggtttattttgtattcggtgtgtgcggaagtagtaattatagaggtagttttaatatcggaggcggcggcggtagtagtagggttaggtggtagttcggggttgaggatcgcggcgggggtagtcgttatggggtttaagttttgatatacgtattattcgtttaagtcggcggtacgcgtcgttatcgtcgtcgaggaggttatttgggatttgtggtcgtagttcgacgagggcgatacgagggtagacggtgtagtcgaatcgtagttagagttgggcggcggcgagcgttcgtgtatttttatgtgtttacgtagcgagttggggtgcgtgtagtatttgtcgtagtttcgtattttgtacgtgtatggtttgtcgttagtgtgtacgtgcgaatgttttttacggtcgttgttgttggcgaagcgtcgttcgtagttttcgaattcgtatttgaagggtttttcgtttggcggaggta

SEQ ID NO: 33128 - DNA, 592 bp, Artificial Sequence
  chemically treated genomic DNA (Homo sapiens) CpG-island No: 33128
tacctccgccaaacgaaaaacccttcaaatacgaattcgaaaactacgaacgacgcttcgccaacaacaacgaccgtaaaaaacattcgcacgtacacactaacgacaaaccatacacgtacaaaatacgaaactacgacaaatactacacgcaccccaactcgctacgtaaacacataaaaatacacgaacgctcgccgccgcccaactctaactacgattcgactacaccgtctaccctcgtatcgccctcgtcgaactacgaccacaaatcccaaataacctcctcgacgacgataacgacgcgtaccgccgacttaaacgaataatacgtatatcaaaacttaaaccccataacgactacccccgccgcgatcctcaaccccgaactaccacctaaccctactactaccgccgccgcctccgatattaaaactacctctataattactacttccgcacacaccgaatacaaaataaaccacgtttctaaaacataaaaaaaacgaaaacgaaaaaaaaaaaaaccgaccgaccacctataataattactaaaactcactaaatacgctaatataatatccattatttt

SEQ ID NO: 33129 - DNA, 695 bp, Artificial Sequence
  chemically treated genomic DNA (Homo sapiens) CpG-island No: 33129
gtagttgcgcgtggggaagagaaggaagaggcgtttagggaagggaagggaggaagaaggaaggcggaggaaagagaaggggacgagcgggagcgcgggttcggtcgggtggcgtttcggggagtgtttgtcgcgcgggggtcgggcggggcggggtcgcgggcgtttagagttcggcgggggttgtcgggattggggcgtcgtagttagcgttggtttcggtggtagttttttcgcgtcgtaggattcggttttacgggatatgttcgtgtcgcgttcgtcgcgcgttcgggtttgttagtttttttgtgttttttgaacgcgcggcgtcgtatttggtagcggtttcggagttcggttcgggtaggagcgcgcggtcgtgcgtatcgcgtagcgatcgttgtcgttatggggttgtagtttttggagtttagcgattgttatttcgatagttcgtggtttcgggagaggattcgcgtttacgaagcggaattcgagaggattaataagtttattaaagagtttattaaggacgggaagaattttatcgttgcgacgaaaagtaagcggggacgcgggcgcggacgggttgcggcgtggcgaggcggttgggggagtttttttcggtaggagacggagggttttgtgttcggggttagtagttagaggaacggggaatttatttcggattagtt

SEQ ID NO: 33130 - DNA, 695 bp, Artificial Sequence
  chemically treated genomic DNA (Homo sapiens) CpG-island No: 33130
aactaatccgaaataaattccccgttcctctaactactaaccccgaacacaaaaccctccgtctcctaccgaaaaaaactcccccaaccgcctcgccacgccgcaacccgtccgcgcccgcgtccccgcttacttttcgtcgcaacgataaaattcttcccgtccttaataaactctttaataaacttattaatcctctcgaattccgcttcgtaaacgcgaatcctctcccgaaaccacgaactatcgaaataacaatcgctaaactccaaaaactacaaccccataacgacaacgatcgctacgcgatacgcacgaccgcgcgctcctacccgaaccgaactccgaaaccgctaccaaatacgacgccgcgcgttcaaaaaacacaaaaaaactaacaaacccgaacgcgcgacgaacgcgacacgaacatatcccgtaaaaccgaatcctacgacgcgaaaaaactaccaccgaaaccaacgctaactacgacgccccaatcccgacaacccccgccgaactctaaacgcccgcgaccccgccccgcccgacccccgcgcgacaaacactccccgaaacgccacccgaccgaacccgcgctcccgctcgtccccttctctttcctccgccttccttcttcctcccttcccttccctaaacgcctcttccttctcttccccacgcgcaactac

SEQ ID NO: 33131 - DNA, 695 bp, Artificial Sequence
  chemically treated genomic DNA (Homo sapiens) CpG-island No: 33131
ggttggttcggaatgaatttttcgtttttttggttgttggtttcggatataagatttttcgttttttgtcgagagaggtttttttagtcgtttcgttacgtcgtagttcgttcgcgttcgcgttttcgtttatttttcgtcgtagcgatgaggtttttttcgtttttaatgagttttttgatgaatttgttggttttttcgagtttcgtttcgtgagcgcggattttttttcggaattacgggttgtcgaggtagtagtcgttgaattttaggggttgtagttttatgacggtagcggtcgttgcgcggtgcgtacggtcgcgcgtttttgttcgagtcgagtttcgaggtcgttgttaggtgcggcgtcgcgcgtttagggagtatagaggagttagtaggttcgggcgcgcggcgagcgcggtacggatatgtttcgtagagtcgagttttgcggcgcggaggagttgttatcgagattagcgttagttgcggcgttttaatttcggtagttttcgtcgagttttgagcgttcgcggtttcgtttcgttcggttttcgcgcggtagatatttttcgaggcgttattcggtcgggttcgcgttttcgttcgtttttttttttttttttcgttttttttttttttttttttttttttttggacgtttttttttttttttttttacgcgtagttgt

SEQ ID NO: 33132 - DNA, 695 bp, Artificial Sequence
  chemically treated genomic DNA (Homo sapiens) CpG-island No: 33132
acaactacgcgtaaaaaaaaaaaaaaaaaaacgtccaaaaaaaaaaaaaaaaaaaaaaaaaaaacgaaaaaaaaaaaaaaaaacgaacgaaaacgcgaacccgaccgaataacgcctcgaaaaatatctaccgcgcgaaaaccgaacgaaacgaaaccgcgaacgctcaaaactcgacgaaaactaccgaaattaaaacgccgcaactaacgctaatctcgataacaactcctccgcgccgcaaaactcgactctacgaaacatatccgtaccgcgctcgccgcgcgcccgaacctactaactcctctatactccctaaacgcgcgacgccgcacctaacaacgacctcgaaactcgactcgaacaaaaacgcgcgaccgtacgcaccgcgcaacgaccgctaccgtcataaaactacaacccctaaaattcaacgactactacctcgacaacccgtaattccgaaaaaaaatccgcgctcacgaaacgaaactcgaaaaaaccaacaaattcatcaaaaaactcattaaaaacgaaaaaaacctcatcgctacgacgaaaaataaacgaaaacgcgaacgcgaacgaactacgacgtaacgaaacgactaaaaaaacctctctcgacaaaaaacgaaaaatcttatatccgaaaccaacaaccaaaaaaacgaaaaattcattccgaaccaacc

SEQ ID NO: 33133 - DNA, 530 bp, Artificial Sequence
  chemically treated genomic DNA (Homo sapiens) CpG-island No: 33133
tggttcgttttttttttattttcgttttagattttgtatattaggcgattggattggcgtaaattttcgtttatttgcgtcgtcgtttgggggtgttgtttcgtgacgttagggttgagttagggggcgttcgtttttggttgttcgtttttttcggttttgcggttttcgtttgttttttaaaagagcggggtttgcgtcggtcgcgttatatcgcggggattaggaggtacgttggtttttcggggtcgttttatcgcgttttttttttgcgtttcgttttttcggtttagtcgttattttttttttcgtataggggtcgtcgagcggggttatgtagttaacgttgttttttagttttttgggagtcgtggggttggcgggtgagtgggcgcggcgggtcggttagtatcgcggatagcgttagtttcgttttttttcgtcgttttcgtagttaggttggcggatttcgggagagagggagggttgaggggaaggtttattttttgtttcgtttttttttttttttg

SEQ ID NO: 33134 - DNA, 530 bp, Artificial Sequence
  chemically treated genomic DNA (Homo sapiens) CpG-island No: 33134
caaaaaaaaaaaaaaacgaaacaaaaaataaaccttcccctcaaccctccctctctcccgaaatccgccaacctaactacgaaaacgacgaaaaaaaacgaaactaacgctatccgcgatactaaccgacccgccgcgcccactcacccgccaaccccacgactcccaaaaaactaaaaaacaacgttaactacataaccccgctcgacgacccctatacgaaaaaaaaaataacgactaaaccgaaaaaacgaaacgcaaaaaaaaaacgcgataaaacgaccccgaaaaaccaacgtacctcctaatccccgcgatataacgcgaccgacgcaaaccccgctcttttaaaaaacaaacgaaaaccgcaaaaccgaaaaaaacgaacaaccaaaaacgaacgccccctaactcaaccctaacgtcacgaaacaacacccccaaacgacgacgcaaataaacgaaaatttacgccaatccaatcgcctaatatacaaaatctaaaacgaaaataaaaaaaaaacgaacca

SEQ ID NO: 33135 - DNA, 530 bp, Artificial Sequence
  chemically treated genomic DNA (Homo sapiens) CpG-island No: 33135
tagggaggagaagaaacgaagtaagaggtaaattttttttttaattttttttttttttcgggattcgttagtttggttgcgggagcggcggggaagagcgaggttggcgttgttcgcggtgttgatcggttcgtcgcgtttatttattcgttagttttacggtttttaggaggttgagaagtagcgttggttgtatggtttcgttcggcggtttttgtgcggaaaggaagatggcggttggatcggagaagcgaggcgtaggaggaaggcgcgatggagcggtttcggaaaattagcgtgttttttggttttcgcggtgtggcgcggtcggcgtaggtttcgtttttttaaagggtaggcgggggtcgtagggtcgggaggagcgggtagttaggagcgggcgttttttagtttagttttgacgttacgaagtagtatttttaggcggcgacgtaaatgggcggaaatttacgttagtttagtcgtttggtgtgtagggtttggagcgggggtgggggaaaggcgggtta

SEQ ID NO: 33136 - DNA, 530 bp, Artificial Sequence
  chemically treated genomic DNA (Homo sapiens) CpG-island No: 33136
taacccgcctttcccccacccccgctccaaaccctacacaccaaacgactaaactaacgtaaatttccgcccatttacgtcgccgcctaaaaatactacttcgtaacgtcaaaactaaactaaaaaacgcccgctcctaactacccgctcctcccgaccctacgacccccgcctaccctttaaaaaaacgaaacctacgccgaccgcgccacaccgcgaaaaccaaaaaacacgctaattttccgaaaccgctccatcgcgccttcctcctacgcctcgcttctccgatccaaccgccatcttcctttccgcacaaaaaccgccgaacgaaaccatacaaccaacgctacttctcaacctcctaaaaaccgtaaaactaacgaataaataaacgcgacgaaccgatcaacaccgcgaacaacgccaacctcgctcttccccgccgctcccgcaaccaaactaacgaatcccgaaaaaaaaaaaaaattaaaaaaaaaatttacctcttacttcgtttcttctcctcccta

SEQ ID NO: 33137 - DNA, 668 bp, Artificial Sequence
  chemically treated genomic DNA (Homo sapiens) CpG-island No: 33137
tgtatcgcgatgttggttatgttttcgttcgtagttgattcgtattcgtttttttcgttatcgttacgattatcggtatcgtcgttatttttttttttatcgttttttttttcggcgatttagatttgagtatacgaatattgttattattatttcggtcgtcgcgttcgttttagtgtggaattattttcgcgttcggttattaaaatggcgtcgggtcggcgtatgcgtacgacgttgattcggtcgggcggcgtagtcgttttcgttggagtttttatacgttcgagttacgagttcgcgtttcggttggggttgcggtcgcgtggtttcgttttgtcggcgtttggggtcgcgagggtgcggtttttaagttggtcggttttagtcggttttttcggtttttttcggcgttttcgtttttgtttaaattcgggtgttgtggtttgggtttttagcgttggtttttgatcgaaggttcgggcgtaatcgaacgggttttcgacgtcgtattcggttggaacgtcgttttgatttagttagattcggaattcggaggttgaacgtcgtgtttagcgtaggaaaacgttttttcggatttcggttcggtttatttttagttggtgtagttttagaaaatttattgtagtcgtttttgttttgtaata

SEQ ID NO: 33138 - DNA, 668 bp, Artificial Sequence
  chemically treated genomic DNA (Homo sapiens) CpG-island No: 33138
tattacaaaacaaaaacgactacaataaattttctaaaactacaccaactaaaaataaaccgaaccgaaatccgaaaaaacgttttcctacgctaaacacgacgttcaacctccgaattccgaatctaactaaatcaaaacgacgttccaaccgaatacgacgtcgaaaacccgttcgattacgcccgaaccttcgatcaaaaaccaacgctaaaaacccaaaccacaacacccgaatttaaacaaaaacgaaaacgccgaaaaaaaccgaaaaaaccgactaaaaccgaccaacttaaaaaccgcaccctcgcgaccccaaacgccgacaaaacgaaaccacgcgaccgcaaccccaaccgaaacgcgaactcgtaactcgaacgtataaaaactccaacgaaaacgactacgccgcccgaccgaatcaacgtcgtacgcatacgccgacccgacgccattttaataaccgaacgcgaaaataattccacactaaaacgaacgcgacgaccgaaataataataacaatattcgtatactcaaatctaaatcgccgaaaaaaaaaacgataaaaaaaaaaataacgacgataccgataatcgtaacgataacgaaaaaaacgaatacgaatcaactacgaacgaaaacataaccaacatcgcgataca

SEQ ID NO: 33139 - DNA, 668 bp, Artificial Sequence
  chemically treated genomic DNA (Homo sapiens) CpG-island No: 33139
tgttgtagaataaaaacgattgtagtagattttttggggttatattaattgaaaatgggtcggatcgagattcgggagagcgtttttttgcgttagatacggcgtttagttttcgggtttcgggtttagttgagttagggcggcgttttagtcgagtgcggcgtcggaaattcgttcggttgcgttcgaattttcggttagaggttagcgttggaagtttagattatagtattcgggtttaaataggagcggaggcgtcgggaagggtcgggggggtcggttagggtcggttagtttggaagtcgtattttcgcggttttagacgtcggtagggcggagttacgcggtcgtagttttagtcgagacgcgagttcgtggttcgggcgtatgggggttttaacgggagcggttgcgtcgttcggtcgggttaacgtcgtgcgtatgcgtcgattcggcgttattttggtggtcgggcgcggaggtgattttatattgaggcgagcgcggcggtcggggtggtagtggtagtgttcgtgtgtttaggtttgaatcgtcgagggaggaggcggtggaggaagaggtggcggcggtgtcggtggtcgtagcggtggcggaggaggcgggtacgaattagttgcgggcggagatatggttaatatcgcggtgta

SEQ ID NO: 33140 - DNA, 668 bp, Artificial Sequence
  chemically treated genomic DNA (Homo sapiens) CpG-island No: 33140
tacaccgcgatattaaccatatctccgcccgcaactaattcgtacccgcctcctccgccaccgctacgaccaccgacaccgccgccacctcttcctccaccgcctcctccctcgacgattcaaacctaaacacacgaacactaccactaccaccccgaccgccgcgctcgcctcaatataaaatcacctccgcgcccgaccaccaaaataacgccgaatcgacgcatacgcacgacgttaacccgaccgaacgacgcaaccgctcccgttaaaacccccatacgcccgaaccacgaactcgcgtctcgactaaaactacgaccgcgtaactccgccctaccgacgtctaaaaccgcgaaaatacgacttccaaactaaccgaccctaaccgacccccccgacccttcccgacgcctccgctcctatttaaacccgaatactataatctaaacttccaacgctaacctctaaccgaaaattcgaacgcaaccgaacgaatttccgacgccgcactcgactaaaacgccgccctaactcaactaaacccgaaacccgaaaactaaacgccgtatctaacgcaaaaaaacgctctcccgaatctcgatccgacccattttcaattaatataaccccaaaaaatctactacaatcgtttttattctacaaca

SEQ ID NO: 33141 - DNA, 589 bp, Artificial Sequence
  chemically treated genomic DNA (Homo sapiens) CpG-island No: 33141
gtggggagaaacgcgatgaaagcgtagtcggatattcgatatcggattaaggggatcgagaggataaaagggaaagagaaggaggtaaaaaggaagggatacgaagggaacgggaagaaatgaaggaggacggtaagagtattaaaggagtaggagaaggagggggggagattaacggggttcgcggagggagtcgggaaggaaaggggaggaagtagagaggcgacgaagtaatagaaagagaagacggacggggattcggaacgttaagggagaagcggcgcgaaaaatcgggcggaagcgcgacgagggagagcgaaagatcgcgggaaggggttagaggaaggggaaaaaaaggaggagaaaacgcgataagggaaagggaggagaaacgggcgcgggggggatacgagtcgagaaagagggtacgacgcggtagagagggcggagggcgaaggggatataattaaggagggacgaataaggaaaggtcgaaggaagcgaggggggagagacggacggggggaaaaggtaagtaggcggaggaaggggaggcgcgagagcgggcgtataaatagacggattggaa

SEQ ID NO: 33142 - DNA, 589 bp, Artificial Sequence
  chemically treated genomic DNA (Homo sapiens) CpG-island No: 33142
ttccaatccgtctatttatacgcccgctctcgcgcctccccttcctccgcctacttaccttttccccccgtccgtctctcccccctcgcttccttcgacctttccttattcgtccctccttaattatatccccttcgccctccgccctctctaccgcgtcgtaccctctttctcgactcgtatcccccccgcgcccgtttctcctccctttcccttatcgcgttttctcctcctttttttccccttcctctaaccccttcccgcgatctttcgctctccctcgtcgcgcttccgcccgatttttcgcgccgcttctcccttaacgttccgaatccccgtccgtcttctctttctattacttcgtcgcctctctacttcctcccctttccttcccgactccctccgcgaaccccgttaatctccccccctccttctcctactcctttaatactcttaccgtcctccttcatttcttcccgttcccttcgtatcccttcctttttacctccttctctttcccttttatcctctcgatccccttaatccgatatcgaatatccgactacgctttcatcgcgtttctccccac

SEQ ID NO: 33143 - DNA, 589 bp, Artificial Sequence
  chemically treated genomic DNA (Homo sapiens) CpG-island No: 33143
ttttagttcgtttgtttgtgcgttcgttttcgcgtttttttttttttcgtttgtttgtttttttttttcgttcgttttttttttttcgtttttttcggtttttttttgttcgtttttttttggttgtgtttttttcgtttttcgttttttttgtcgcgtcgtgttttttttttcggttcgtgtttttttcgcgttcgtttttttttttttttttttgtcgcgtttttttttttttttttttttttttttttggttttttttcgcgatttttcgttttttttcgtcgcgttttcgttcggtttttcgcgtcgttttttttttggcgtttcgggttttcgttcgttttttttttttgttgtttcgtcgtttttttgtttttttttttttttttttcggtttttttcgcgggtttcgttggttttttttttttttttttttgtttttttggtgtttttgtcgtttttttttattttttttcgtttttttcgtgtttttttttttttgttttttttttttttttttttgttttttcggtttttttggttcggtgtcggatgttcggttgcgtttttatcgcgtttttttttat

SEQ ID NO: 33144 - DNA, 589 bp, Artificial Sequence
  chemically treated genomic DNA (Homo sapiens) CpG-island No: 33144
ataaaaaaaaacgcgataaaaacgcaaccgaacatccgacaccgaaccaaaaaaaccgaaaaaacaaaaaaaaaaaaaaaaaaaacaaaaaaaaaaaaacacgaaaaaaacgaaaaaaaataaaaaaaaacgacaaaaacaccaaaaaaacaaaaaaaaaaaaaaaaaaaaccaacgaaacccgcgaaaaaaaccgaaaaaaaaaaaaaaaaaaacaaaaaaacgacgaaacaacaaaaaaaaaaaacgaacgaaaacccgaaacgccaaaaaaaaaacgacgcgaaaaaccgaacgaaaacgcgacgaaaaaaaacgaaaaatcgcgaaaaaaaaccaaaaaaaaaaaaaaaaaaaaaaaaaaaaacgcgacaaaaaaaaaaaaaaaaaaacgaacgcgaaaaaaacacgaaccgaaaaaaaaaacacgacgcgacaaaaaaaacgaaaaacgaaaaaaacacaaccaaaaaaaaacgaacaaaaaaaaaccgaaaaaaacgaaaaaaaaaaaacgaacgaaaaaaaaaaacaaacaaacgaaaaaaaaaaaaacgcgaaaacgaacgcacaaacaaacgaactaaaa

SEQ ID NO: 33145 - DNA, 529 bp, Artificial Sequence
  chemically treated genomic DNA (Homo sapiens) CpG-island No: 33145
tttcgtgagttcgtttaagttggagtcgcggcgcgttgagcgagtaggcggggcgggagcgtttatagttcggagttattaggcgttgacgaggagttcggttgagggaggatgcgtcgttgacgtttgcgggagtcgcgcgtttggggcgggaggatgttttagaggggtttttggtcgtggcgtacgcggttgttgtcgatttttggtatttggcgtttagcgcgttcgtggtcgttgtcgttttcgttttaggtaagagcgggtgtcgggttgtgggggttcggggtaggttggtgtaaagtttgcgttggataattttggcgggagtaaaagtcgagcggtcgagtagttaattgcgttttgttggttgtcgggtttcgcgcgtcgggcggtttcgataggtggtggtcgggcggtcgacgtgggttacggaggtttgggttgaggttaagatttcgggttcggggaaggtgaagttagagcgttgcggttggggggtgttttattcgggtcgagatagggtgcg

SEQ ID NO: 33146 - DNA, 529 bp, Artificial Sequence
  chemically treated genomic DNA (Homo sapiens) CpG-island No: 33146
cgcaccctatctcgacccgaataaaacaccccccaaccgcaacgctctaacttcaccttccccgaacccgaaatcttaacctcaacccaaacctccgtaacccacgtcgaccgcccgaccaccacctatcgaaaccgcccgacgcgcgaaacccgacaaccaacaaaacgcaattaactactcgaccgctcgacttttactcccgccaaaattatccaacgcaaactttacaccaacctaccccgaacccccacaacccgacacccgctcttacctaaaacgaaaacgacaacgaccacgaacgcgctaaacgccaaataccaaaaatcgacaacaaccgcgtacgccacgaccaaaaacccctctaaaacatcctcccgccccaaacgcgcgactcccgcaaacgtcaacgacgcatcctccctcaaccgaactcctcgtcaacgcctaataactccgaactataaacgctcccgccccgcctactcgctcaacgcgccgcgactccaacttaaacgaactcacgaaa

SEQ ID NO: 33147 - DNA, 529 bp, Artificial Sequence
  chemically treated genomic DNA (Homo sapiens) CpG-island No: 33147
cgtattttatttcggttcgggtgaggtattttttagtcgtagcgttttggttttatttttttcgggttcggagttttgattttagtttaggttttcgtgatttacgtcggtcgttcggttattatttgtcgggatcgttcggcgcgcggagttcggtagttagtaaaacgtagttgattgttcggtcgttcggtttttgttttcgttaaagttgtttaacgtaaattttgtattagtttatttcgaatttttatagttcggtattcgtttttatttggggcggaggcggtagcggttacgggcgcgttgggcgttaggtgttaggggtcggtagtagtcgcgtgcgttacggttagaggtttttttggagtattttttcgttttaggcgcgcggttttcgtaggcgttagcggcgtatttttttttagtcgggtttttcgttagcgtttggtggtttcgagttgtgggcgttttcgtttcgtttgttcgtttagcgcgtcgcggttttagtttgggcgggtttacggga

SEQ ID NO: 33148 - DNA, 529 bp, Artificial Sequence
  chemically treated genomic DNA (Homo sapiens) CpG-island No: 33148
tcccgtaaacccgcccaaactaaaaccgcgacgcgctaaacgaacaaacgaaacgaaaacgcccacaactcgaaaccaccaaacgctaacgaaaaacccgactaaaaaaaaatacgccgctaacgcctacgaaaaccgcgcgcctaaaacgaaaaaatactccaaaaaaacctctaaccgtaacgcacgcgactactaccgacccctaacacctaacgcccaacgcgcccgtaaccgctaccgcctccgccccaaataaaaacgaataccgaactataaaaattcgaaataaactaatacaaaatttacgttaaacaactttaacgaaaacaaaaaccgaacgaccgaacaatcaactacgttttactaactaccgaactccgcgcgccgaacgatcccgacaaataataaccgaacgaccgacgtaaatcacgaaaacctaaactaaaatcaaaactccgaacccgaaaaaaataaaaccaaaacgctacgactaaaaaatacctcacccgaaccgaaataaaatacg

SEQ ID NO: 33149 - DNA, 761 bp, Artificial Sequence
  chemically treated genomic DNA (Homo sapiens) CpG-island No: 33149
  misc_feature (240)..(240): n is either a, c, g or t
  misc_feature (244)..(244): n is either a, c, g or t
ggcgtagtgggaaacggcgaggttgttagttcggtatagttagcgggatcgcgtgggggaggggtcgagcgtcgggggcggtttgaagttaggaaaagaattgagggagaaaattttttcgttattgataggaagcgttaggaggttcgtttaaggttttaagtaagttgacggagaattgatacgattttggttacgagtattgggcggaggaggagaagggtgaatgaatgggaaatntcgngtttaaggtttggcgcgagtttagtcgggaaggatcggtttttttcgggttagagatcgaattagatgtttacgtaggcgcgcgattttttcgtcgtaggtcggagggattcgaaggggggcgggaaaaggaattgtacggcgagaaaatcgaagttacgatttagaattcgtttttaattttttataatttcgcgttatggaataaatcgtcggaaatttacggtttaagggagtacgatttttgtggttttttagatgtttgggtcgtcgtttttaagagatttttatttatcgagtcgatcggatgtttgcgtaatatttttcgtcgtcgttttggttgtatatgcgtatattaaagttttcgattacgtcggatttcgttattgggcgtttgcgtaagagggtggggttttttttcgtcgttttggttagttagaagagcggttacgggaatgaagttcgtggatgattttaaaaaatagggtgaattataaggttaagggtttagtatgatt

SEQ ID NO: 33150 - DNA, 761 bp, Artificial Sequence
  chemically treated genomic DNA (Homo sapiens) CpG-island No: 33150
  misc_feature (518)..(518): n is either a, c, g or t
  misc_feature (522)..(522): n is either a, c, g or t
aatcatactaaacccttaaccttataattcaccctattttttaaaatcatccacgaacttcattcccgtaaccgctcttctaactaaccaaaacgacgaaaaaaaaccccaccctcttacgcaaacgcccaataacgaaatccgacgtaatcgaaaactttaatatacgcatatacaaccaaaacgacgacgaaaaatattacgcaaacatccgatcgactcgataaataaaaatctcttaaaaacgacgacccaaacatctaaaaaaccacaaaaatcgtactcccttaaaccgtaaatttccgacgatttattccataacgcgaaattataaaaaattaaaaacgaattctaaatcgtaacttcgattttctcgccgtacaattccttttcccgccccccttcgaatccctccgacctacgacgaaaaaatcgcgcgcctacgtaaacatctaattcgatctctaacccgaaaaaaaccgatccttcccgactaaactcgcgccaaaccttaaacncganatttcccattcattcacccttctcctcctccgcccaatactcgtaaccaaaatcgtatcaattctccgtcaacttacttaaaaccttaaacgaacctcctaacgcttcctatcaataacgaaaaaattttctccctcaattcttttcctaacttcaaaccgcccccgacgctcgacccctcccccacgcgatcccgctaactataccgaactaacaacctcgccgtttcccactacgcc

SEQ ID NO: 33151 - DNA, 761 bp, Artificial Sequence
  chemically treated genomic DNA (Homo sapiens) CpG-island No: 33151
  misc_feature (518)..(518): n is either a, c, g or t
  misc_feature (522)..(522): n is either a, c, g or t
aattatgttgggtttttagttttatggtttattttgttttttaagattatttacgggttttattttcgtaatcgtttttttagttggttaaggcggcgggaagaaattttatttttttgcgtaaacgtttagtagcggaattcggcgtggtcgagggttttagtgtgcgtatgtgtaattagagcggcggcgggaagtgttgcgtaggtattcgatcgattcggtaggtggggattttttggagacggcgatttaggtatttggggagttatagaagtcgtatttttttaaatcgtgagttttcgacggtttgttttatggcgcgggattgtgagggattaggaacgaattttggatcgtgatttcggttttttcgtcgtgtagttttttttttcgttttttttcggattttttcgatttgcggcgggaaagtcgcgcgtttacgtaagtatttggttcggtttttggttcgagggaagtcggtttttttcggttgagttcgcgttaggttttgggtncggnattttttatttatttattttttttttttttcgtttagtattcgtggttagggtcgtattagtttttcgttaatttgtttggggttttggacgagttttttggcgttttttgttagtggcgaaaaggtttttttttttagttttttttttgattttaaatcgttttcggcgttcggttttttttttacgcggtttcgttggttgtgtcggattggtagtttcgtcgttttttattgcgtt

SEQ ID NO: 33152 - DNA, 761 bp, Artificial Sequence
  chemically treated genomic DNA (Homo sapiens) CpG-island No: 33152
  misc_feature (240)..(240): n is either a, c, g or t
  misc_feature (244)..(244): n is either a, c, g or t
aacgcaataaaaaacgacgaaactaccaatccgacacaaccaacgaaaccgcgtaaaaaaaaaaccgaacgccgaaaacgatttaaaatcaaaaaaaaaactaaaaaaaaaaaccttttcgccactaacaaaaaacgccaaaaaactcgtccaaaaccccaaacaaattaacgaaaaactaatacgaccctaaccacgaatactaaacgaaaaaaaaaaaaaataaataaataaaaaatnccgnacccaaaacctaacgcgaactcaaccgaaaaaaaccgacttccctcgaaccaaaaaccgaaccaaatacttacgtaaacgcgcgactttcccgccgcaaatcgaaaaaatccgaaaaaaaacgaaaaaaaaaactacacgacgaaaaaaccgaaatcacgatccaaaattcgttcctaatccctcacaatcccgcgccataaaacaaaccgtcgaaaactcacgatttaaaaaaatacgacttctataactccccaaatacctaaatcgccgtctccaaaaaatccccacctaccgaatcgatcgaatacctacgcaacacttcccgccgccgctctaattacacatacgcacactaaaaccctcgaccacgccgaattccgctactaaacgtttacgcaaaaaaataaaatttcttcccgccgccttaaccaactaaaaaaacgattacgaaaataaaacccgtaaataatcttaaaaaacaaaataaaccataaaactaaaaacccaacataatt

SEQ ID NO: 33153 - DNA, 572 bp, Artificial Sequence
  chemically treated genomic DNA (Homo sapiens) CpG-island No: 33153
gatcgtatcggcgtagtagggtcgttcggtcggtggtcgttttttgtagttcggtcggcgattcgcggttagtcgggggagcgtcgttcgcggggaatttcgggcgtacggggagttgggcggacggcggttttcgtttttttcggggacgcggtacgagacgcggggacgcgcggacgttacgtttagcggtcgttttcggtttcgcgtcgtttttttttcgggagtagtttcgacgcgcgcgggttcggatcgtcgggttgttatggtagtagttttatttttgatcgttattttttttcggtgtcgtttcggagcgagcgggttggcgggcggcgcggattgcgcgtttatttcgacggcgggcgtttattttaattttcgtcgcgtttatcgggttggggatgtttgcggggatgagttcgtatcgcgtttatttcgtttcgtttcgatattcgcgttagcggagagaacgcggcgtttttcgtagcggttttttttatagaggggcggggtggggggagcggggagggagaggggagggcgggagagggagttttggggaaagtagt

SEQ ID NO: 33154 - DNA, 572 bp, Artificial Sequence
  chemically treated genomic DNA (Homo sapiens) CpG-island No: 33154
actactttccccaaaactccctctcccgccctcccctctccctccccgctccccccaccccgcccctctataaaaaaaaccgctacgaaaaacgccgcgttctctccgctaacgcgaatatcgaaacgaaacgaaataaacgcgatacgaactcatccccgcaaacatccccaacccgataaacgcgacgaaaattaaaataaacgcccgccgtcgaaataaacgcgcaatccgcgccgcccgccaacccgctcgctccgaaacgacaccgaaaaaaaataacgatcaaaaataaaactactaccataacaacccgacgatccgaacccgcgcgcgtcgaaactactcccgaaaaaaaaacgacgcgaaaccgaaaacgaccgctaaacgtaacgtccgcgcgtccccgcgtctcgtaccgcgtccccgaaaaaaacgaaaaccgccgtccgcccaactccccgtacgcccgaaattccccgcgaacgacgctcccccgactaaccgcgaatcgccgaccgaactacaaaaaacgaccaccgaccgaacgaccctactacgccgatacgatc

SEQ ID NO: 33155 - DNA, 572 bp, Artificial Sequence
  chemically treated genomic DNA (Homo sapiens) CpG-island No: 33155
gttgttttttttagaattttttttttcgttttttttttttttttttcgttttttttatttcgtttttttgtaggggaagtcgttgcgaggggcgtcgcgtttttttcgttggcgcgggtgtcgggacggagcgaagtgggcgcggtgcgggtttattttcgtaggtatttttagttcggtgggcgcggcggaggttaaggtgggcgttcgtcgtcgggatgagcgcgtagttcgcgtcgttcgttagttcgttcgtttcgaggcggtatcgggagaaagtggcggttagggatggagttgttgttatgataattcggcggttcgggttcgcgcgcgtcggggttgttttcgggaggaaggcggcgcggagtcgggggcggtcgttgagcgtggcgttcgcgcgttttcgcgtttcgtgtcgcgttttcggaggaagcgggggtcgtcgttcgtttagtttttcgtgcgttcggagtttttcgcgggcggcgttttttcggttggtcgcgagtcgtcgatcgggttgtagaggacggttatcgatcggacgattttgttgcgtcggtgcggtt

SEQ ID NO: 33156 - DNA, 572 bp, Artificial Sequence
  chemically treated genomic DNA (Homo sapiens) CpG-island No: 33156
aaccgcaccgacgcaacaaaatcgtccgatcgataaccgtcctctacaacccgatcgacgactcgcgaccaaccgaaaaaacgccgcccgcgaaaaactccgaacgcacgaaaaactaaacgaacgacgacccccgcttcctccgaaaacgcgacacgaaacgcgaaaacgcgcgaacgccacgctcaacgaccgcccccgactccgcgccgccttcctcccgaaaacaaccccgacgcgcgcgaacccgaaccgccgaattatcataacaacaactccatccctaaccgccactttctcccgataccgcctcgaaacgaacgaactaacgaacgacgcgaactacgcgctcatcccgacgacgaacgcccaccttaacctccgccgcgcccaccgaactaaaaatacctacgaaaataaacccgcaccgcgcccacttcgctccgtcccgacacccgcgccaacgaaaaaaacgcgacgcccctcgcaacgacttcccctacaaaaaaacgaaataaaaaaaacgaaaaaaaaaaaaaaaaaacgaaaaaaaaaattctaaaaaaaacaac

SEQ ID NO: 33157 - DNA, 541 bp, Artificial Sequence
  chemically treated genomic DNA (Homo sapiens) CpG-island No: 33157
  misc_feature (412)..(412): n is either a, c, g or t
  misc_feature (430)..(430): n is either a, c, g or t
ttttttgattaaaacggaatgtgcgaggtgtggaaggaagaggggtcgttcgcggagttttgcgggatatcgcggcgttcgagtttacgagtttttcgtagttgggataaggaagttcgagttcgtcgtttgaggttttcgcgtcgtttagttgatacgcgtcgtcgataaaggttcgttatttttttacggttcgcgtttcgtatcgcggcggattcgcgtttttttatcggcgtacgtagatagcgagtgagttatttttttttatttttttagagtttattatacggcgggattagtttattttaggtaggttaaatttaaagtatataatttgcgttcgggcgttatttttatttttcgtcgttttttttttgtttcgtttcggttcggttttagttcggcgattttncgttgttgttttaagcgntagtagttatttattggcggcggcggggtttcgggtggggttcgcggagtcggtgttcgtgtagaagaggtggggtgagggtttttatttttagaaggcgggttttttggg

SEQ ID NO: 33158 - DNA, 541 bp, Artificial Sequence
  chemically treated genomic DNA (Homo sapiens) CpG-island No: 33158
  misc_feature (112)..(112): n is either a, c, g or t
  misc_feature (130)..(130): n is either a, c, g or t
cccaaaaaacccgccttctaaaaataaaaaccctcaccccacctcttctacacgaacaccgactccgcgaaccccacccgaaaccccgccgccgccaataaataactactancgcttaaaacaacaacgnaaaatcgccgaactaaaaccgaaccgaaacgaaacaaaaaaaaaacgacgaaaaataaaaataacgcccgaacgcaaattatatactttaaatttaacctacctaaaataaactaatcccgccgtataataaactctaaaaaaataaaaaaaaataactcactcgctatctacgtacgccgataaaaaaacgcgaatccgccgcgatacgaaacgcgaaccgtaaaaaaataacgaacctttatcgacgacgcgtatcaactaaacgacgcgaaaacctcaaacgacgaactcgaacttccttatcccaactacgaaaaactcgtaaactcgaacgccgcgatatcccgcaaaactccgcgaacgacccctcttccttccacacctcgcacattccgttttaatcaaaaaa

SEQ ID NO: 33159 - DNA, 541 bp, Artificial Sequence
  chemically treated genomic DNA (Homo sapiens) CpG-island No: 33159
  misc_feature (112)..(112): n is either a, c, g or t
  misc_feature (130)..(130): n is either a, c, g or t
tttagagagttcgttttttggaggtagagatttttattttattttttttgtacgggtatcggtttcgcggattttattcgagatttcgtcgtcgttagtgggtaattgttgncgtttagggtagtagcgnggggtcgtcgggttggggtcgggtcggggcggggtaggggaagggcggcggggagtggaggtggcgttcgagcgtaggttgtgtattttgggtttgatttgtttgagatgagttaatttcgtcgtataatagattttggggagatagggaaagatggtttattcgttatttgcgtgcgtcgatgggggagcgcgagttcgtcgcggtgcggggcgcgagtcgtggaaaaatgacgagtttttgtcggcggcgcgtgttagttagacggcgcggggattttaggcggcgggttcgggtttttttgttttagttgcgagaggttcgtgggttcggacgtcgcggtgtttcgtaaagtttcgcggacggttttttttttttttatatttcgtatatttcgttttggttaagaaa

SEQ ID NO: 33160 - DNA, 541 bp, Artificial Sequence
  chemically treated genomic DNA (Homo sapiens) CpG-island No: 33160
  misc_feature (412)..(412): n is either a, c, g or t
  misc_feature (430)..(430): n is either a, c, g or t
tttcttaaccaaaacgaaatatacgaaatataaaaaaaaaaaaaaccgtccgcgaaactttacgaaacaccgcgacgtccgaacccacgaacctctcgcaactaaaacaaaaaaacccgaacccgccgcctaaaatccccgcgccgtctaactaacacgcgccgccgacaaaaactcgtcatttttccacgactcgcgccccgcaccgcgacgaactcgcgctcccccatcgacgcacgcaaataacgaataaaccatctttccctatctccccaaaatctattatacgacgaaattaactcatctcaaacaaatcaaacccaaaatacacaacctacgctcgaacgccacctccactccccgccgcccttcccctaccccgccccgacccgaccccaacccgacgaccccncgctactaccctaaacgncaacaattacccactaacgacgacgaaatctcgaataaaatccgcgaaaccgatacccgtacaaaaaaaataaaataaaaatctctacctccaaaaaacgaactctctaaa

SEQ ID NO: 33161 - DNA, 1005 bp, Artificial Sequence
  chemically treated genomic DNA (Homo sapiens) CpG-island No: 33161
gcgtcgggggttgtggtttgggttcgagcgttttatattagcgtttttcggggaggttgtgggaggggttcgtgcgattatagacgttgtttcggagttagcgttttggacggaaggtgggagtcgcggatcggggagtcgcggagagggaggcgttaggaaatgtttcgcgttaggtcgtcggggttcggttggcgttggagatttcggtaattagcgtttgggacggagaggtcgtattttgaggattaagggagtcgagggcggtttggaacggggaaggcggcgttgacggagacggaatgtgggacgaaggatagcgggaggtatcgacgcgtaattgttttagtcgcgcggatggtacggatcgatcgttttgttatttttagttcgagacgtttcgtcgtttcgtttttgtagttgagagtcgagtagtttttagttttagttcgttcgtttcgtatttcgttcgcgttttcgtcggcgtttaaattatcgttcgttcgtttcgttcgggtaggtttggcgttcgcgggttacgtttcgttttatatttatttttttgttcgtttcgtttttcgtatcgttagcgaacgtacgttacgtcggcgcgtaaacgttattttcggggtttttgattttggacgggaggaagtgcgagtggatttaaagggtcgagcggagtggggtatcgttttgacgtttaagagtaaatggaagagggcggttttcggggtaaaggtggggcgttggggagtttcggagaaatcggcgttttttagtttgtcgtttagtttttgttttcggttttcgacgcgtaatagttggagggcgacgttgcgttcgcggcgatttttgggttgcggtcgcggtggtagcgcgaatgggaggtggagcggagttattgcgtcgagggacgttttagaaattttgttttagtttttcgcggattttaggatgtgataggtgttcgagttaaaaggttttaaggcgatcggttgattt

SEQ ID NO: 33162 - DNA, 1005 bp, Artificial Sequence
  chemically treated genomic DNA (Homo sapiens) CpG-island No: 33162
aaatcaaccgatcgccttaaaaccttttaactcgaacacctatcacatcctaaaatccgcgaaaaactaaaacaaaatttctaaaacgtccctcgacgcaataactccgctccacctcccattcgcgctaccaccgcgaccgcaacccaaaaatcgccgcgaacgcaacgtcgccctccaactattacgcgtcgaaaaccgaaaacaaaaactaaacgacaaactaaaaaacgccgatttctccgaaactccccaacgccccacctttaccccgaaaaccgccctcttccatttactcttaaacgtcaaaacgataccccactccgctcgaccctttaaatccactcgcacttcctcccgtccaaaatcaaaaaccccgaaaataacgtttacgcgccgacgtaacgtacgttcgctaacgatacgaaaaacgaaacgaacaaaaaaataaatataaaacgaaacgtaacccgcgaacgccaaacctacccgaacgaaacgaacgaacgataatttaaacgccgacgaaaacgcgaacgaaatacgaaacgaacgaactaaaactaaaaactactcgactctcaactacaaaaacgaaacgacgaaacgtctcgaactaaaaataacaaaacgatcgatccgtaccatccgcgcgactaaaacaattacgcgtcgatacctcccgctatccttcgtcccacattccgtctccgtcaacgccgccttccccgttccaaaccgccctcgactcccttaatcctcaaaatacgacctctccgtcccaaacgctaattaccgaaatctccaacgccaaccgaaccccgacgacctaacgcgaaacatttcctaacgcctccctctccgcgactccccgatccgcgactcccaccttccgtccaaaacgctaactccgaaacaacgtctataatcgcacgaacccctcccacaacctccccgaaaaacgctaatataaaacgctcgaacccaaaccacaacccccgacgc

SEQ ID NO: 33163 - DNA, 1005 bp, Artificial Sequence
  chemically treated genomic DNA (Homo sapiens) CpG-island No: 33163
ggattaatcgatcgttttaagattttttaattcgaatatttgttatattttaggattcgcgaaggattgaaatagagtttttgaagcgtttttcggcgtagtagtttcgttttattttttattcgcgttattatcgcggtcgtagtttaggagtcgtcgcggacgtagcgtcgttttttagttgttgcgcgtcggaagtcggaagtagggattgagcgatagattaggaaacgtcggttttttcggggttttttagcgttttatttttatttcggaggtcgtttttttttatttgtttttgggcgttagggcggtattttatttcgttcgattttttggatttattcgtattttttttcgtttagagttaaaggtttcggaagtgacgtttacgcgtcggcgtaacgtgcgttcgttggcggtgcggggggcggggcgagtaggagggtgggtgtgaggcgggacgtggttcgcggacgttagatttattcgggcgaagcgggcgagcggtggtttggacgtcggcggagacgcgggcgaggtacggagcggacggattggggttgagagttgttcggtttttagttataggagcggggcggcggggcgtttcgggttgggggtggtagggcggtcggttcgtgttattcgcgcggttggggtagttgcgcgtcggtgtttttcgttgtttttcgttttatatttcgttttcgttagcgtcgtttttttcgttttaggtcgttttcggtttttttaatttttagagtgcggttttttcgttttagacgttagttgtcgggatttttagcgttagtcgagtttcgacggtttgacgcggagtattttttggcgttttttttttcgcggtttttcggttcgcggtttttatttttcgtttaaggcgttggtttcgaagtagcgtttgtggtcgtacgggttttttttataattttttcggaaagcgttggtatgggacgttcggatttagattatagttttcggcgt

SEQ ID NO: 33164 - DNA, 1005 bp, Artificial Sequence
  chemically treated genomic DNA (Homo sapiens) CpG-island No: 33164
acgccgaaaactataatctaaatccgaacgtcccataccaacgctttccgaaaaaattataaaaaaaacccgtacgaccacaaacgctacttcgaaaccaacgccttaaacgaaaaataaaaaccgcgaaccgaaaaaccgcgaaaaaaaaaacgccaaaaaatactccgcgtcaaaccgtcgaaactcgactaacgctaaaaatcccgacaactaacgtctaaaacgaaaaaaccgcactctaaaaattaaaaaaaccgaaaacgacctaaaacgaaaaaaacgacgctaacgaaaacgaaatataaaacgaaaaacaacgaaaaacaccgacgcgcaactaccccaaccgcgcgaataacacgaaccgaccgccctaccacccccaacccgaaacgccccgccgccccgctcctataactaaaaaccgaacaactctcaaccccaatccgtccgctccgtacctcgcccgcgtctccgccgacgtccaaaccaccgctcgcccgcttcgcccgaataaatctaacgtccgcgaaccacgtcccgcctcacacccaccctcctactcgccccgccccccgcaccgccaacgaacgcacgttacgccgacgcgtaaacgtcacttccgaaacctttaactctaaacgaaaaaaaatacgaataaatccaaaaaatcgaacgaaataaaataccgccctaacgcccaaaaacaaataaaaaaaaacgacctccgaaataaaaataaaacgctaaaaaaccccgaaaaaaccgacgtttcctaatctatcgctcaatccctacttccgacttccgacgcgcaacaactaaaaaacgacgctacgtccgcgacgactcctaaactacgaccgcgataataacgcgaataaaaaataaaacgaaactactacgccgaaaaacgcttcaaaaactctatttcaatccttcgcgaatcctaaaatataacaaatattcgaattaaaaaatcttaaaacgatcgattaatcc

SEQ ID NO: 33165 - DNA, 521 bp, Artificial Sequence
  chemically treated genomic DNA (Homo sapiens) CpG-island No: 33165
cggttttcgtttaggaagttttatttagcgggagttatgacgtcgcggcgtcggtagagtttacgagcgattcggcgagggcgcgtgcggcgtgacgacgcgattcgcggcgcgtttcgtgacgttatcgcgttcgtttttgaaagttggcgttcggggtcgttttttatgttgttttgcgttaatttttttttttattttttttttttcgttttttattcgtcgttcggtcggtttttttattcgtttttttttttattagtattcgcggtttcggtagcgtcgacgtaggcgtattgtatcgcgtcgtcgttattttgtgtttgagtttgtggagcgattaaatcgtgcgcggagttgtttttttggcggtagcggcggcggcggttgtcggtgcggacgttcggagtttcgtcggaaacgtcgggtggttcgaatcgtggaacggcggttggatcggttttttttagggggggcggttgatatattttggcggttttttgtttgttttttattttttt

SEQ ID NO: 33166 - DNA, 521 bp, Artificial Sequence
  chemically treated genomic DNA (Homo sapiens) CpG-island No: 33166
aaaaaaataaaaaacaaacaaaaaaccgccaaaatatatcaaccgccccccctaaaaaaaaccgatccaaccgccgttccacgattcgaaccacccgacgtttccgacgaaactccgaacgtccgcaccgacaaccgccgccgccgctaccgccaaaaaaacaactccgcgcacgatttaatcgctccacaaactcaaacacaaaataacgacgacgcgatacaatacgcctacgtcgacgctaccgaaaccgcgaatactaataaaaaaaaaaacgaataaaaaaaccgaccgaacgacgaataaaaaacgaaaaaaaaaaaataaaaaaaaaaattaacgcaaaacaacataaaaaacgaccccgaacgccaactttcaaaaacgaacgcgataacgtcacgaaacgcgccgcgaatcgcgtcgtcacgccgcacgcgccctcgccgaatcgctcgtaaactctaccgacgccgcgacgtcataactcccgctaaataaaacttcctaaacgaaaaccg

SEQ ID NO: 33167 - DNA, 521 bp, Artificial Sequence
  chemically treated genomic DNA (Homo sapiens) CpG-island No: 33167
ggagagatgaggagtaggtagggggtcgttagagtatgttagtcgttttttttagagggagtcggtttagtcgtcgttttacggttcgggttattcggcgttttcggcgaagtttcgggcgttcgtatcggtaatcgtcgtcgtcgttgtcgttaaagaaatagtttcgcgtacggtttaatcgttttataggtttagatataaaatggcggcggcgcggtgtagtgcgtttgcgtcggcgttgtcggggtcgcgggtgttgataagggaagggacgggtggggggatcggtcgggcggcgagtagagggcgggggaggaaaggtgaggggaggggttggcgtagggtagtatgggaggcggtttcgggcgttaatttttaaaagcgggcgcgatggcgttacgggacgcgtcgcgagtcgcgtcgttacgtcgtacgcgttttcgtcgggtcgttcgtgggttttgtcggcgtcgcggcgttatggttttcgttgggtggggttttttgggcggaggtcg

SEQ ID NO: 33168 - DNA, 521 bp, Artificial Sequence
  chemically treated genomic DNA (Homo sapiens) CpG-island No: 33168
cgacctccgcccaaaaaaccccacccaacgaaaaccataacgccgcgacgccgacaaaacccacgaacgacccgacgaaaacgcgtacgacgtaacgacgcgactcgcgacgcgtcccgtaacgccatcgcgcccgcttttaaaaattaacgcccgaaaccgcctcccatactaccctacgccaacccctcccctcacctttcctcccccgccctctactcgccgcccgaccgatccccccacccgtcccttcccttatcaacacccgcgaccccgacaacgccgacgcaaacgcactacaccgcgccgccgccattttatatctaaacctataaaacgattaaaccgtacgcgaaactatttctttaacgacaacgacgacgacgattaccgatacgaacgcccgaaacttcgccgaaaacgccgaataacccgaaccgtaaaacgacgactaaaccgactccctctaaaaaaaacgactaacatactctaacgaccccctacctactcctcatctctcc

SEQ ID NO: 33169 - DNA, 613 bp, Artificial Sequence
  chemically treated genomic DNA (Homo sapiens) CpG-island No: 33169
  misc_feature (54)..(54): n is either a, c, g or t
tcgagtcgtcgcgtaaattggcgtgttttttagattcgtcgttcgttagcgagntaatcggaatcggaattcgtcgcggttattattattgagcgttgcggggagggggagtaaggatcggacgagacgttacgtttgaaaataggcggcgggcgagggacgaggtttattacggtattacgcgagtggaaagggtcgttttcgttagcggcggtttatattagtttatcgaggggcggtagcgcgcggttcggttgtcggatcgtattatttcgggcggtggagtcgtcgaggaggggcgcgcgcgatcgaaggcgtattcgggaggtttaggtagttcgggggtcggtgttggggcgtcggtaggtcgttttcgtttcgatttattcggagttagttttttttgcggatacgatattttatggggacggtggcgcgaaacgttttattttgtcgtatttaaattttgtagatttttagtttttttgggcggtcgcgatttttcgttttttcgtttgtcgttgagggttcgcggcgtatataataggttttttagaagggttaagaggtagaggtagaagaaatacggattttaatgaagagtttttttttt

SEQ ID NO: 33170 - DNA, 613 bp, Artificial Sequence
  chemically treated genomic DNA (Homo sapiens) CpG-island No: 33170
  misc_feature (560)..(560): n is either a, c, g or t
aaaaaaaaaactcttcattaaaatccgtatttcttctacctctacctcttaacccttctaaaaaacctattatatacgccgcgaaccctcaacgacaaacgaaaaaacgaaaaatcgcgaccgcccaaaaaaactaaaaatctacaaaatttaaatacgacaaaataaaacgtttcgcgccaccgtccccataaaatatcgtatccgcaaaaaaaactaactccgaataaatcgaaacgaaaacgacctaccgacgccccaacaccgacccccgaactacctaaacctcccgaatacgccttcgatcgcgcgcgcccctcctcgacgactccaccgcccgaaataatacgatccgacaaccgaaccgcgcgctaccgcccctcgataaactaatataaaccgccgctaacgaaaacgaccctttccactcgcgtaataccgtaataaacctcgtccctcgcccgccgcctattttcaaacgtaacgtctcgtccgatccttactccccctccccgcaacgctcaataataataaccgcgacgaattccgattccgattanctcgctaacgaacgacgaatctaaaaaacacgccaatttacgcgacgactcga

SEQ ID NO: 33171 - DNA, 613 bp, Artificial Sequence
  chemically treated genomic DNA (Homo sapiens) CpG-island No: 33171
  misc_feature (560)..(560): n is either a, c, g or t
aaagggaaaattttttattaaagttcgtattttttttatttttgttttttaatttttttgggaagtttattgtgtacgtcgcgggtttttagcggtagacggggaggcgggaggtcgcggtcgtttagggaagttgggggtttgtagagtttgggtgcggtagagtggggcgtttcgcgttatcgtttttatgggatgtcgtgttcgtagagggggttggtttcgggtgggtcgaggcgggaacggtttgtcggcgttttagtatcggttttcgggttatttgggtttttcgggtgcgttttcggtcgcgcgcgttttttttcggcggttttatcgttcgggatggtacggttcggtagtcgggtcgcgcgttgtcgtttttcggtgagttggtgtgggtcgtcgttagcggagacgattttttttattcgcgtggtgtcgtggtaagtttcgtttttcgttcgtcgtttgtttttaggcgtagcgtttcgttcggtttttgtttttttttttcgtagcgtttagtggtggtggtcgcgacgagtttcggtttcggttgnttcgttggcgggcggcgagtttggagagtacgttagtttgcgcggcggttcgg

SEQ ID NO: 33172 - DNA, 613 bp, Artificial Sequence
  chemically treated genomic DNA (Homo sapiens) CpG-island No: 33172
  misc_feature (54)..(54): n is either a, c, g or t
ccgaaccgccgcgcaaactaacgtactctccaaactcgccgcccgccaacgaancaaccgaaaccgaaactcgtcgcgaccaccaccactaaacgctacgaaaaaaaaaaacaaaaaccgaacgaaacgctacgcctaaaaacaaacgacgaacgaaaaacgaaacttaccacgacaccacgcgaataaaaaaaatcgtctccgctaacgacgacccacaccaactcaccgaaaaacgacaacgcgcgacccgactaccgaaccgtaccatcccgaacgataaaaccgccgaaaaaaaacgcgcgcgaccgaaaacgcacccgaaaaacccaaataacccgaaaaccgatactaaaacgccgacaaaccgttcccgcctcgacccacccgaaaccaaccccctctacgaacacgacatcccataaaaacgataacgcgaaacgccccactctaccgcacccaaactctacaaacccccaacttccctaaacgaccgcgacctcccgcctccccgtctaccgctaaaaacccgcgacgtacacaataaacttcccaaaaaaattaaaaaacaaaaataaaaaaaatacgaactttaataaaaaattttcccttt

SEQ ID NO: 33173 - DNA, 1532 bp, Artificial Sequence
  chemically treated genomic DNA (Homo sapiens) CpG-island No: 33173
atttatcgtttttggtaggacgtggagttgttcggaagttatttcgggttggtttttttattcgtgtgttacgatttttcggcgggtttttgtcgttcgagtgtttttatcgttagttttcggagcggcggagtttcggttttttcgagtacgagcggtttgttttgtttgtttagttttcgtttagttcgttgtcggtttcgttttttcgagcgttcgaggattgggaggggtggaatagggttttttcgattttcggggattttttgcggggcgttttaattaatttttagggtttaaggttacgcgttcggtagtcggttttttcggagcgttttcgacgcgagtttcggcgtcgtttcgttttggtttttttttcggattcgttggggttgattttgcgtttttggtcgcggggtttttttcggtttttcgtttttatttttcgcgatttaggagtcgttagtgtttcgaggttttttcggtttaaggcgttcgggggcggtgcggggcgttttttgcgcgattaattcggtttcgaagttggttaatttggtttcgggcggggcgcgcggagtttgtttaagttaggttggacgacgtttggggagggggcggcggggtacgcgggatagggttaggtcggcgggggtttcggggagtaggggtcgggtcgtatttatttggggggtcggcggcggcggcgagtttggcgttcgcgggcggcggcggcggcggtaggagcggcggcggtagtagtagtagtagtagtagtagcgcggggtagagtaggcggcgagcggttttcgtcggcggatttatggtagtcggattgtagtcggggtttcgtattcgtagtcggcgcgaaagtttttcgcgagtcgtttagtttatatttgggggtagttggagtcgttcgtagttgtagtatcgtagggcgcggggcggaggaggcgaggcgcggaggggcgggcgggggagcgcggagggaaggcggggagagggaaggagcgagcgagcgaagggaggtaggcgggagggagggaggcgagcgaggggggtagggtaggaggaacggagagagtagtttgcgagatatagatgatggattacgagtataataattagagaagtaggatcgagatagaacgaacgcgtacgattaattatatgacgtagacgataggtcgagatcgagcgaatttcgagcgagaaggaatcggtagaaatgcgtagaggacgtatagggtaatagtattagcggggtttagaaagaggagagcgatacgaggagagaaggagaaagatttatacgaagggggagaacgacgagtcgcgagagggtagaaaggtagtagggagacggaatagatacgaaattatataagggggagggtagaaagattcgtgtcgataagcgtatatagggggcgtacgcgtgacgtagaagagcgagtttatataataaatcgtgtacggatgaaagtgtttttatggtgcggcgtttggagatattgggagatgtatttata

SEQ ID NO: 33174 - DNA, 1532 bp, Artificial Sequence
  chemically treated genomic DNA (Homo sapiens) CpG-island No: 33174
tataaatacatctcccaatatctccaaacgccgcaccataaaaacactttcatccgtacacgatttattatataaactcgctcttctacgtcacgcgtacgccccctatatacgcttatcgacacgaatctttctaccctcccccttatataatttcgtatctattccgtctccctactacctttctaccctctcgcgactcgtcgttctcccccttcgtataaatctttctccttctctcctcgtatcgctctcctctttctaaaccccgctaatactattaccctatacgtcctctacgcatttctaccgattccttctcgctcgaaattcgctcgatctcgacctatcgtctacgtcatataattaatcgtacgcgttcgttctatctcgatcctacttctctaattattatactcgtaatccatcatctatatctcgcaaactactctctccgttcctcctaccctacccccctcgctcgcctccctccctcccgcctacctcccttcgctcgctcgctccttccctctccccgccttccctccgcgctcccccgcccgcccctccgcgcctcgcctcctccgccccgcgccctacgatactacaactacgaacgactccaactacccccaaatataaactaaacgactcgcgaaaaactttcgcgccgactacgaatacgaaaccccgactacaatccgactaccataaatccgccgacgaaaaccgctcgccgcctactctaccccgcgctactactactactactactactaccgccgccgctcctaccgccgccgccgccgcccgcgaacgccaaactcgccgccgccgccgaccccccaaataaatacgacccgacccctactccccgaaacccccgccgacctaaccctatcccgcgtaccccgccgccccctccccaaacgtcgtccaacctaacttaaacaaactccgcgcgccccgcccgaaaccaaattaaccaacttcgaaaccgaattaatcgcgcaaaaaacgccccgcaccgcccccgaacgccttaaaccgaaaaaacctcgaaacactaacgactcctaaatcgcgaaaaataaaaacgaaaaaccgaaaaaaaccccgcgaccaaaaacgcaaaatcaaccccaacgaatccgaaaaaaaaaccaaaacgaaacgacgccgaaactcgcgtcgaaaacgctccgaaaaaaccgactaccgaacgcgtaaccttaaaccctaaaaattaattaaaacgccccgcaaaaaatccccgaaaatcgaaaaaaccctattccacccctcccaatcctcgaacgctcgaaaaaacgaaaccgacaacgaactaaacgaaaactaaacaaacaaaacaaaccgctcgtactcgaaaaaaccgaaactccgccgctccgaaaactaacgataaaaacactcgaacgacaaaaacccgccgaaaaatcgtaacacacgaataaaaaaaccaacccgaaataacttccgaacaactccacgtcctaccaaaaacgataaat

SEQ ID NO: 33175 - DNA, 1532 bp, Artificial Sequence
  chemically treated genomic DNA (Homo sapiens) CpG-island No: 33175
tgtgggtgtattttttagtgtttttaagcgtcgtattataagggtatttttattcgtgtacggtttattgtgtgaattcgtttttttgcgttacgcgtgcgttttttgtgtacgtttatcggtacgagtttttttgtttttttttttgtgtggtttcgtgtttgtttcgtttttttgttgtttttttgttttttcgcggttcgtcgtttttttttttcgtgtgggttttttttttttttttttcgtgtcgtttttttttttttgagtttcgttggtattgttgttttatgcgttttttacgtatttttatcggttttttttcgttcgagattcgttcgatttcggtttatcgtttacgttatgtggttagtcgtgcgcgttcgttttgtttcggttttgtttttttaattattgtgttcgtggtttattatttatgtttcgtaggttgtttttttcgttttttttattttatttttttcgttcgtttttttttttttcgtttgttttttttcgttcgttcgtttttttttttttttcgtttttttttcgcgttttttcgttcgttttttcgcgtttcgtttttttcgtttcgcgttttgcggtgttgtagttgcgggcggttttagttgtttttagatgtgggttgggcggttcgcggggaattttcgcgtcggttgcgagtgcggggtttcggttgtagttcggttgttatggattcgtcggcgggagtcgttcgtcgtttgttttgtttcgcgttgttgttgttgttgttgttgttgtcgtcgtcgtttttgtcgtcgtcgtcgtcgttcgcgaacgttaggttcgtcgtcgtcgtcgattttttaggtaggtgcggttcggtttttatttttcgggattttcgtcggtttggttttgtttcgcgtgtttcgtcgttttttttttaggcgtcgtttagtttgatttgggtaaatttcgcgcgtttcgttcggggttaagttggttaatttcggggtcgggttggtcgcgtagggggcgtttcgtatcgttttcgagcgttttgggtcgggggagtttcggagtattggcggtttttgagtcgcggagggtggggacggagggtcgggaaaagtttcgcggttaagagcgtagagttagttttagcgggttcgaggggggagttagggcgaggcggcgtcggggttcgcgtcggggacgtttcggaggagtcggttgtcgagcgcgtagttttgggttttaaggattggttggggcgtttcgtagggaattttcggagatcggagggattttgttttattttttttagttttcgggcgttcggggagacggggtcggtagcgggttgagcgggagttggataggtaggataggtcgttcgtgttcggggaagtcgagatttcgtcgtttcggaggttggcggtgagggtattcgggcggtaggggttcgtcgaggggtcgtggtatacgggtaagggggttaattcggaatggttttcgagtagttttacgttttgttaaggacggtaggt

SEQ ID NO: 33176 - DNA, 1532 bp, Artificial Sequence
  chemically treated genomic DNA (Homo sapiens) CpG-island No: 33176
acctaccgtccttaacaaaacgtaaaactactcgaaaaccattccgaattaacccccttacccgtataccacgacccctcgacgaacccctaccgcccgaataccctcaccgccaacctccgaaacgacgaaatctcgacttccccgaacacgaacgacctatcctacctatccaactcccgctcaacccgctaccgaccccgtctccccgaacgcccgaaaactaaaaaaaataaaacaaaatccctccgatctccgaaaattccctacgaaacgccccaaccaatccttaaaacccaaaactacgcgctcgacaaccgactcctccgaaacgtccccgacgcgaaccccgacgccgcctcgccctaactcccccctcgaacccgctaaaactaactctacgctcttaaccgcgaaacttttcccgaccctccgtccccaccctccgcgactcaaaaaccgccaatactccgaaactcccccgacccaaaacgctcgaaaacgatacgaaacgccccctacgcgaccaacccgaccccgaaattaaccaacttaaccccgaacgaaacgcgcgaaatttacccaaatcaaactaaacgacgcctaaaaaaaaaacgacgaaacacgcgaaacaaaaccaaaccgacgaaaatcccgaaaaataaaaaccgaaccgcacctacctaaaaaatcgacgacgacgacgaacctaacgttcgcgaacgacgacgacgacgacaaaaacgacgacgacaacaacaacaacaacaacaacaacgcgaaacaaaacaaacgacgaacgactcccgccgacgaatccataacaaccgaactacaaccgaaaccccgcactcgcaaccgacgcgaaaattccccgcgaaccgcccaacccacatctaaaaacaactaaaaccgcccgcaactacaacaccgcaaaacgcgaaacgaaaaaaacgaaacgcgaaaaaacgaacgaaaaaacgcgaaaaaaaaacgaaaaaaaaaaaaaaacgaacgaacgaaaaaaaacaaacgaaaaaaaaaaaaacgaacgaaaaaaataaaataaaaaaaacgaaaaaaacaacctacgaaacataaataataaaccacgaacacaataattaaaaaaacaaaaccgaaacaaaacgaacgcgcacgactaaccacataacgtaaacgataaaccgaaatcgaacgaatctcgaacgaaaaaaaaccgataaaaatacgtaaaaaacgcataaaacaacaataccaacgaaactcaaaaaaaaaaaaacgacacgaaaaaaaaaaaaaaaaaacccacacgaaaaaaaaaaacgacgaaccgcgaaaaaacaaaaaaacaacaaaaaaacgaaacaaacacgaaaccacacaaaaaaaaaaacaaaaaaactcgtaccgataaacgtacacaaaaaacgcacgcgtaacgcaaaaaaacgaattcacacaataaaccgtacacgaataaaaatacccttataatacgacgcttaaaaacactaaaaaatacacccaca

SEQ ID NO: 33177 - DNA, 572 bp, Artificial Sequence
  chemically treated genomic DNA (Homo sapiens) CpG-island No: 33177
cggatggttttgatcgattatcgatgagtgatttgggttcgcggtaaattagtgggcgaatttaatttcgaagtttttcgtcgtgtcgttttcgcgttaacgaagcgggaaagatttagtattatgcgcgtcgacgtagtagataatttttatgcggcgtggtgtcgatgggaaattcgtattgcgtgatttaggtcgatgatgtcgatatcgcgggcggtagaagacgtttggttttgttttggaaaggtatcgagcgttgtttcggagttgcgttaatatcggttgtatgtaagtggttaggcgcgagtatatacgtttacgcgtttatgagcgtggggtaggagaaatttaggtttgcgtgtagttggcgcgatgtgcggcggtgtgtagtagggatttagtaaggttagtggtcgaagaagtacgcgtggaatttttcggcggtacgtcgttgatatcgtttggaaaggttcgggttattcgtatatatgattggtcggcggtatatgttacgacggatttatttatttatgaagtaattaggggaagaattgtaggaaatatttacg

SEQ ID NO: 33178 - DNA, 572 bp, Artificial Sequence
  chemically treated genomic DNA (Homo sapiens) CpG-island No: 33178
cgtaaatatttcctacaattcttcccctaattacttcataaataaataaatccgtcgtaacatataccgccgaccaatcatatatacgaataacccgaacctttccaaacgatatcaacgacgtaccgccgaaaaattccacgcgtacttcttcgaccactaaccttactaaatccctactacacaccgccgcacatcgcgccaactacacgcaaacctaaatttctcctaccccacgctcataaacgcgtaaacgtatatactcgcgcctaaccacttacatacaaccgatattaacgcaactccgaaacaacgctcgatacctttccaaaacaaaaccaaacgtcttctaccgcccgcgatatcgacatcatcgacctaaatcacgcaatacgaatttcccatcgacaccacgccgcataaaaattatctactacgtcgacgcgcataatactaaatctttcccgcttcgttaacgcgaaaacgacacgacgaaaaacttcgaaattaaattcgcccactaatttaccgcgaacccaaatcactcatcgataatcgatcaaaaccatccg

SEQ ID NO: 33179 - DNA, 572 bp, Artificial Sequence
  chemically treated genomic DNA (Homo sapiens) CpG-island No: 33179
cgtgagtgttttttgtagttttttttttggttgttttatagatgaataaattcgtcgtaatatgtatcgtcggttagttatatatacgggtgattcggatttttttaggcgatattaacgacgtatcgtcggggagttttacgcgtattttttcggttattaattttgttgaatttttattgtatatcgtcgtatatcgcgttagttgtacgtaggtttgggttttttttgttttacgtttataaacgcgtaaacgtatatgttcgcgtttaattatttgtatataatcgatattggcgtagtttcggaataacgttcgatgtttttttagaataggattaagcgttttttatcgttcgcggtatcgatattatcgatttgaattacgtaatgcggattttttatcgatattacgtcgtataagaattgtttgttacgtcggcgcgtataatattaggtttttttcgtttcgttagcgcgaaagcggtacgacggaaggtttcgaagttgggttcgtttattagtttatcgcggatttagattatttatcggtgatcggttagaattattcg

SEQ ID NO: 33180 - DNA, 572 bp, Artificial Sequence
  chemically treated genomic DNA (Homo sapiens) CpG-island No: 33180
cgaataattctaaccgatcaccgataaataatctaaatccgcgataaactaataaacgaacccaacttcgaaaccttccgtcgtaccgctttcgcgctaacgaaacgaaaaaaacctaatattatacgcgccgacgtaacaaacaattcttatacgacgtaatatcgataaaaaatccgcattacgtaattcaaatcgataatatcgataccgcgaacgataaaaaacgcttaatcctattctaaaaaaacatcgaacgttattccgaaactacgccaatatcgattatatacaaataattaaacgcgaacatatacgtttacgcgtttataaacgtaaaacaaaaaaaacccaaacctacgtacaactaacgcgatatacgacgatatacaataaaaattcaacaaaattaataaccgaaaaaatacgcgtaaaactccccgacgatacgtcgttaatatcgcctaaaaaaatccgaatcacccgtatatataactaaccgacgatacatattacgacgaatttattcatctataaaacaaccaaaaaaaaaactacaaaaaacactcacg

SEQ ID NO: 33181 - DNA, 951 bp, Artificial Sequence
  chemically treated genomic DNA (Homo sapiens) CpG-island No: 33181
  misc_feature (608)..(608): n is either a, c, g or t
  misc_feature (622)..(622): n is either a, c, g or t
  misc_feature (666)..(666): n is either a, c, g or t
cgtagttacgtaggtaatcgggttattcgtataggtgtcgtttagatcgtttggagcgacggtatttattattttcgcgcgttcggtgacgttcgttagcgggaagtcgttcgcgatcgatttcgtaaaggtggtaagattcggcgtaacgtttatttgttttatcgtaaatagcgtgtcggtacgtttcgcgtcgttttgtattttatcggtaattagtatgatttcgtgttcgttatatagagcgcgtaaacgttgtataaaggttggcgacgaggcgtagaaatcgttttcgttttgaatcggtttaattacgatggcggcgatatttttcggcgcggtattatttttgaagattcggtggatgttggcgatagcgttattttcgtttatgtcgtgtagcgggtaaggataaagcgcgcgataaatatgattcggtattagttttatgttcgtagagtacggatttattttgtcggttagcgtttagcgtgtaatgcgtgcgttcgtgatacgcgtcgttaaaagcgatggtgtcgttacgtttggtggtcggcgtcgggcgatttttatcgcgttttttatcgtttcggaatcggtcgtaatangtagcgttttttgngcgaaatcgttcggtattttttgattataatttcgtatagtttnagatacggttcgtaagttagtatttggaagtaggtgtgcgatagtttttttaattgcgtttttatcgcggttattattttcggatgtaggtgttcggtattgagtatcgtaatttcgttcgcgaaattaagatatttacggttttaacgttttatattcggtagtttttcgcgcggttagcgaaaatcgggtgaatttgtttaacgttacggggaatcgtttgattgcggcgttgtataatttttattgttgtttattcgtattttttagttaaagatcgatgta

SEQ ID NO: 33182 - DNA, 951 bp, Artificial Sequence
  chemically treated genomic DNA (Homo sapiens) CpG-island No: 33182
  misc_feature (286)..(286): n is either a, c, g or t
  misc_feature (330)..(330): n is either a, c, g or t
  misc_feature (344)..(344): n is either a, c, g or t
tacatcgatctttaactaaaaaatacgaataaacaacaataaaaattatacaacgccgcaatcaaacgattccccgtaacgttaaacaaattcacccgattttcgctaaccgcgcgaaaaactaccgaatataaaacgttaaaaccgtaaatatcttaatttcgcgaacgaaattacgatactcaataccgaacacctacatccgaaaataataaccgcgataaaaacgcaattaaaaaaactatcgcacacctacttccaaatactaacttacgaaccgtatctnaaactatacgaaattataatcaaaaaataccgaacgatttcgcncaaaaaacgctacntattacgaccgattccgaaacgataaaaaacgcgataaaaatcgcccgacgccgaccaccaaacgtaacgacaccatcgcttttaacgacgcgtatcacgaacgcacgcattacacgctaaacgctaaccgacaaaataaatccgtactctacgaacataaaactaataccgaatcatatttatcgcgcgctttatccttacccgctacacgacataaacgaaaataacgctatcgccaacatccaccgaatcttcaaaaataataccgcgccgaaaaatatcgccgccatcgtaattaaaccgattcaaaacgaaaacgatttctacgcctcgtcgccaacctttatacaacgtttacgcgctctatataacgaacacgaaatcatactaattaccgataaaatacaaaacgacgcgaaacgtaccgacacgctatttacgataaaacaaataaacgttacgccgaatcttaccacctttacgaaatcgatcgcgaacgacttcccgctaacgaacgtcaccgaacgcgcgaaaataataaataccgtcgctccaaacgatctaaacgacacctatacgaataacccgattacctacgtaactacg

SEQ ID NO: 33183 - DNA, 951 bp, Artificial Sequence
  chemically treated genomic DNA (Homo sapiens) CpG-island No: 33183
  misc_feature (286)..(286): n is either a, c, g or t
  misc_feature (330)..(330): n is either a, c, g or t
  misc_feature (344)..(344): n is either a, c, g or t
tgtatcggtttttaattggagaatgcgaatgaatagtaataagagttatgtagcgtcgtagttaggcgatttttcgtggcgttgggtaaatttattcgattttcgttgatcgcgcggaaaattgtcgggtgtgggacgttaaggtcgtgagtattttgatttcgcgggcgggattgcggtgtttaatatcgggtatttgtattcgaaggtggtggtcgcggtggaagcgtagttgaaaaaattgtcgtatatttgtttttaggtgttggtttacgagtcgtatttngagttgtgcgagattataattagaaggtgtcgggcgatttcgtntagaaaacgttgtntgttacgatcggtttcgaagcggtggaaaacgcggtaaaaatcgttcggcgtcggttattaaacgtagcggtattatcgtttttagcggcgcgtattacgggcgtacgtattatacgttgggcgttgatcggtaaggtgaattcgtattttgcgggtatggggttgatgtcgggttatgtttatcgcgcgttttatttttgttcgttgtacggtataagcgaggatgacgttatcgttagtatttatcggatttttaaaaatgatgtcgcgtcggaagatatcgtcgttatcgtgattgagtcggtttagggcgaaggcggtttttacgtttcgtcgttagtttttatgtagcgtttacgcgttttgtgtgacgagtacgggattatgttgattgtcgatgaagtgtagagcggcgcggggcgtatcggtacgttgtttgcgatggagtagatgggcgttgcgtcggattttattatttttgcgaaatcgatcgcgggcggtttttcgttggcgggcgttatcgggcgcgcggaagtaatggatgtcgtcgttttaggcggtttgggcggtatttatgcgggtaattcgattgtttgcgtggttgcg

SEQ ID NO: 33184 - DNA, 951 bp, Artificial Sequence
  chemically treated genomic DNA (Homo sapiens) CpG-island No: 33184
  misc_feature (608)..(608): n is either a, c, g or t
  misc_feature (622)..(622): n is either a, c, g or t
  misc_feature (666)..(666): n is either a, c, g or t
cgcaaccacgcaaacaatcgaattacccgcataaataccgcccaaaccgcctaaaacgacgacatccattacttccgcgcgcccgataacgcccgccaacgaaaaaccgcccgcgatcgatttcgcaaaaataataaaatccgacgcaacgcccatctactccatcgcaaacaacgtaccgatacgccccgcgccgctctacacttcatcgacaatcaacataatcccgtactcgtcacacaaaacgcgtaaacgctacataaaaactaacgacgaaacgtaaaaaccgccttcgccctaaaccgactcaatcacgataacgacgatatcttccgacgcgacatcatttttaaaaatccgataaatactaacgataacgtcatcctcgcttataccgtacaacgaacaaaaataaaacgcgcgataaacataacccgacatcaaccccatacccgcaaaatacgaattcaccttaccgatcaacgcccaacgtataatacgtacgcccgtaatacgcgccgctaaaaacgataataccgctacgtttaataaccgacgccgaacgatttttaccgcgttttccaccgcttcgaaaccgatcgtaacanacaacgttttctanacgaaatcgcccgacaccttctaattataatctcgcacaactcnaaatacgactcgtaaaccaacacctaaaaacaaatatacgacaattttttcaactacgcttccaccgcgaccaccaccttcgaatacaaatacccgatattaaacaccgcaatcccgcccgcgaaatcaaaatactcacgaccttaacgtcccacacccgacaattttccgcgcgatcaacgaaaatcgaataaatttacccaacgccacgaaaaatcgcctaactacgacgctacataactcttattactattcattcgcattctccaattaaaaaccgataca

SEQ ID NO: 33185 - DNA, 738 bp, Artificial Sequence
  chemically treated genomic DNA (Homo sapiens) CpG-island No: 33185
gtaggcggatgggggttcggcggtcgcggagatgtaatatttttatttcgggcgaagattttatagtttgcgggagatgggagttcgggacgcggataggacgggtatttatttacgaatagttagagggagtttttcgatacgaggaagaaggttagtatggcggttagcggggttcggttcggttcggttcggttttttcgattcgtagtttcgtagtttcgtagtttagtagttttagtagtagtcgcgtcgtcgtagtcgttgtcgggtatttttagtttttcgtttttcggtttcgtagttttcgcgtttcgtcgcgtcgttgcggagacggtttaagggggagggcgcggcgcgtattcgtaatcgagttttattttttgttttgtagtttggtcggtcgggtttggggtttgtttcgtattgatcgcggtgtcggaatcgttaagttttcgggcggggggaggggttcggtcgtagagcgaattagtttttttcggtttcgttttttaacgttagtatttggtattttgcggaaatcggttggaagggggagtacgggcgacgagcgttagagcgtgatattgagtttatttcgtcgttatttatttattaatacgcgattttgttttcgcgcgattcgtagatttgggttttatggttgggtaggttcgaatggtagtcgggtcgcggttatttgttttaggaggtgtatatttttgtgggttgttgttt

SEQ ID NO: 33186 - DNA, 738 bp, Artificial Sequence
  chemically treated genomic DNA (Homo sapiens) CpG-island No: 33186
aaacaacaacccacaaaaatatacacctcctaaaacaaataaccgcgacccgactaccattcgaacctacccaaccataaaacccaaatctacgaatcgcgcgaaaacaaaatcgcgtattaataaataaataacgacgaaataaactcaatatcacgctctaacgctcgtcgcccgtactcccccttccaaccgatttccgcaaaataccaaatactaacgttaaaaaacgaaaccgaaaaaaactaattcgctctacgaccgaacccctccccccgcccgaaaacttaacgattccgacaccgcgatcaatacgaaacaaaccccaaacccgaccgaccaaactacaaaacaaaaaataaaactcgattacgaatacgcgccgcgccctcccccttaaaccgtctccgcaacgacgcgacgaaacgcgaaaactacgaaaccgaaaaacgaaaaactaaaaatacccgacaacgactacgacgacgcgactactactaaaactactaaactacgaaactacgaaactacgaatcgaaaaaaccgaaccgaaccgaaccgaaccccgctaaccgccatactaaccttcttcctcgtatcgaaaaactccctctaactattcgtaaataaatacccgtcctatccgcgtcccgaactcccatctcccgcaaactataaaatcttcgcccgaaataaaaatattacatctccgcgaccgccgaacccccatccgcctac

SEQ ID NO: 33187 - DNA, 738 bp, Artificial Sequence
  chemically treated genomic DNA (Homo sapiens) CpG-island No: 33187
gggtaatagtttataggagtgtgtattttttaggataggtaatcgcgattcggttgttattcgagtttgtttagttataaaatttaggtttgcgagtcgcgcgggggtagggtcgcgtgttgatgggtgggtggcggcggggtgggtttaatgttacgttttggcgttcgtcgttcgtgtttttttttttagtcggttttcgtagaatgttaggtattgacgttggagagcggggtcggagagggttggttcgttttgcggtcgggttttttttttcgttcgggagtttggcggtttcgatatcgcggttagtgcggggtaagttttagattcggtcggttaggttgtagggtagggagtaaggttcggttgcgagtgcgcgtcgcgtttttttttttgagtcgttttcgtagcggcgcggcggagcgcgggagttgcggggtcggagggcggggggttaaaaatattcggtagcggttgcggcggcgcggttattgttggggttgttgggttgcggggttgcggggttgcgggtcggggaggtcgggtcgggtcgggtcgggtttcgttgatcgttatgttgattttttttttcgtgtcggggggttttttttggttattcgtaggtaagtgttcgttttgttcgcgtttcggatttttatttttcgtaggttatgaggttttcgttcgaggtggaggtgttatattttcgcggtcgtcgagtttttattcgtttgt

SEQ ID NO: 33188 - DNA, 738 bp, Artificial Sequence
  chemically treated genomic DNA (Homo sapiens) CpG-island No: 33188
acaaacgaataaaaactcgacgaccgcgaaaatataacacctccacctcgaacgaaaacctcataacctacgaaaaataaaaatccgaaacgcgaacaaaacgaacacttacctacgaataaccaaaaaaaaccccccgacacgaaaaaaaaaatcaacataacgatcaacgaaacccgacccgacccgacccgacctccccgacccgcaaccccgcaaccccgcaacccaacaaccccaacaataaccgcgccgccgcaaccgctaccgaatatttttaaccccccgccctccgaccccgcaactcccgcgctccgccgcgccgctacgaaaacgactcaaaaaaaaaaacgcgacgcgcactcgcaaccgaaccttactccctaccctacaacctaaccgaccgaatctaaaacttaccccgcactaaccgcgatatcgaaaccgccaaactcccgaacgaaaaaaaaaacccgaccgcaaaacgaaccaaccctctccgaccccgctctccaacgtcaatacctaacattctacgaaaaccgactaaaaaaaaaaacacgaacgacgaacgccaaaacgtaacattaaacccaccccgccgccacccacccatcaacacgcgaccctacccccgcgcgactcgcaaacctaaattttataactaaacaaactcgaataacaaccgaatcgcgattacctatcctaaaaaatacacactcctataaactattaccc

SEQ ID NO: 33189 - DNA, 582 bp, Artificial Sequence
  chemically treated genomic DNA (Homo sapiens) CpG-island No: 33189
tcgtcgcgggtcgggtcgggtcgggtaaggcggggcggggcggggcgggagaggtcgcggggttgggtcgggttaggtttgtagcgggtcggggttttgggatggttggggacgggcgcgggggcgtcgtatcgataggattcgggtcgaggggagagtaaggggcgaatagagagaaggtaggatgtcgttatttatattgggtcgtagtcgtcgtcgtcgtcgtttcgttgtgggtgaatttaaagtagttgtcggtcgttattttggtatttttttttagtcggttgggtattgcggcgggtacgaagagtcgggttttatggcgggataagagatatagaggagtcgagacgtcgagggagggtagggagagaaagagagaggcgtcgtgagagtagttttggcggggtttaggtcgcggtcgcgtcgtttttttttttcgtttcgtatttttttatttattcgtacgttcgggtggcggtcgtcgtttttttttcggagtttgttttaattttcgcggtttttcgttgttcggggttagggagggggtcgggtagaggtttcgcgggttatattaga

SEQ ID NO: 33190 - DNA, 582 bp, Artificial Sequence
  chemically treated genomic DNA (Homo sapiens) CpG-island No: 33190
tctaatataacccgcgaaacctctacccgaccccctccctaaccccgaacaacgaaaaaccgcgaaaattaaaacaaactccgaaaaaaaaacgacgaccgccacccgaacgtacgaataaataaaaaaatacgaaacgaaaaaaaaaaacgacgcgaccgcgacctaaaccccgccaaaactactctcacgacgcctctctctttctctccctaccctccctcgacgtctcgactcctctatatctcttatcccgccataaaacccgactcttcgtacccgccgcaatacccaaccgactaaaaaaaaataccaaaataacgaccgacaactactttaaattcacccacaacgaaacgacgacgacgacgactacgacccaatataaataacgacatcctaccttctctctattcgccccttactctcccctcgacccgaatcctatcgatacgacgcccccgcgcccgtccccaaccatcccaaaaccccgacccgctacaaacctaacccgacccaaccccgcgacctctcccgccccgccccgccccgccttacccgacccgacccgacccgcgacga

SEQ ID NO: 33191 - DNA, 582 bp, Artificial Sequence
  chemically treated genomic DNA (Homo sapiens) CpG-island No: 33191
tttaatgtggttcgcgaggtttttgttcggttttttttttggtttcgggtagcggggagtcgcgggggttggggtaggtttcggggaggaggcggcggtcgttattcgggcgtgcgagtgagtgagggagtgcgaggcgggagggggaggcggcgcggtcgcggtttgggtttcgttagggttgtttttacggcgtttttttttttttttttttgttttttttcggcgtttcggtttttttgtgttttttgtttcgttatgggattcgatttttcgtgttcgtcgtagtgtttagtcggttgggggaagatgttaaaatggcgatcggtaattattttggatttatttatagcggggcggcggcggcggcggttgcggtttaatataggtaacggtattttgttttttttttgttcgttttttgtttttttttcggttcggattttgtcgatgcgacgttttcgcgttcgtttttagttattttagagtttcggttcgttgtaggtttggttcggtttagtttcgcggtttttttcgtttcgtttcgtttcgttttgttcggttcggttcggttcgcggcgg

SEQ ID NO: 33192 - DNA, 582 bp, Artificial Sequence
  chemically treated genomic DNA (Homo sapiens) CpG-island No: 33192
ccgccgcgaaccgaaccgaaccgaacaaaacgaaacgaaacgaaacgaaaaaaaccgcgaaactaaaccgaaccaaacctacaacgaaccgaaactctaaaataactaaaaacgaacgcgaaaacgtcgcatcgacaaaatccgaaccgaaaaaaaaacaaaaaacgaacaaaaaaaaaacaaaataccgttacctatattaaaccgcaaccgccgccgccgccgccccgctataaataaatccaaaataattaccgatcgccattttaacatcttcccccaaccgactaaacactacgacgaacacgaaaaatcgaatcccataacgaaacaaaaaacacaaaaaaaccgaaacgccgaaaaaaaacaaaaaaaaaaaaaaaaaaacgccgtaaaaacaaccctaacgaaacccaaaccgcgaccgcgccgcctccccctcccgcctcgcactccctcactcactcgcacgcccgaataacgaccgccgcctcctccccgaaacctaccccaacccccgcgactccccgctacccgaaaccaaaaaaaaaaccgaacaaaaacctcgcgaaccacattaaa

SEQ ID NO: 33193 - DNA, 835 bp, Artificial Sequence
  chemically treated genomic DNA (Homo sapiens) CpG-island No: 33193
tttgattattacgttacgttaggtgttggagtgcgatgcgtttgcgttgttacgttacgattcgcggtagtttatttcgtttgttatcgacggtttggtaaaggatgtattcggtagacgttttgcgttggaagggtatttacggttggaagcgattgttcgcgtcggggatgtggtgcgttttttcgtagatagcgaattgttcgatttttatgacggtttgatttttgggtaggagagtttgaaggtttacgtttgcgttggtttgttattgtttgtcgggtaaaatttgatcggcgtattgacgttcgacgggatgtagttcgattagttcgatgtttttagcgacgaagagttacggttgattgttgcgttggcggcgggagcgttaagtaatgcgttgttgatttgaataattggaaagttataatatgttgttaggcgatgttacgtcgtttgaagcggtgaaatagacgtagatgattggtttgttttttggtatgacgtaattgaaaaaagagattgagattgtggcggcgttcgattttaacgttttgtattagtcggtgtacgacgtgggaatcgcgtaagggagttggtggcgaaagcgatttatgaagtttcgttacgggcggtgaattcgttggtttattttaattgtgttgtattgtcggaaagtgtggcggaaagtgagttgttcgggtatgtgaaaggagcgtttattggcgttattagtaatcgtagcgggaagtttgaaatggcggataacggtacgttgtttttggatgagatcggcgagttgtcgttggtattgtaggttaagttgttgagggtg

SEQ ID NO: 33194 - DNA, 835 bp, Artificial Sequence
  chemically treated genomic DNA (Homo sapiens) CpG-island No: 33194
caccctcaacaacttaacctacaataccaacgacaactcgccgatctcatccaaaaacaacgtaccgttatccgccatttcaaacttcccgctacgattactaataacgccaataaacgctcctttcacatacccgaacaactcactttccgccacactttccgacaatacaacacaattaaaataaaccaacgaattcaccgcccgtaacgaaacttcataaatcgctttcgccaccaactcccttacgcgattcccacgtcgtacaccgactaatacaaaacgttaaaatcgaacgccgccacaatctcaatctcttttttcaattacgtcataccaaaaaacaaaccaatcatctacgtctatttcaccgcttcaaacgacgtaacatcgcctaacaacatattataactttccaattattcaaatcaacaacgcattacttaacgctcccgccgccaacgcaacaatcaaccgtaactcttcgtcgctaaaaacatcgaactaatcgaactacatcccgtcgaacgtcaatacgccgatcaaattttacccgacaaacaataacaaaccaacgcaaacgtaaaccttcaaactctcctacccaaaaatcaaaccgtcataaaaatcgaacaattcgctatctacgaaaaaacgcaccacatccccgacgcgaacaatcgcttccaaccgtaaatacccttccaacgcaaaacgtctaccgaatacatcctttaccaaaccgtcgataacaaacgaaataaactaccgcgaatcgtaacgtaacaacgcaaacgcatcgcactccaacacctaacgtaacgtaataatcaaa

SEQ ID NO: 33195 - DNA, 835 bp, Artificial Sequence
  chemically treated genomic DNA (Homo sapiens) CpG-island No: 33195
tatttttagtagtttggtttgtaatgttaacgataattcgtcgattttatttagaaatagcgtgtcgttattcgttattttaaatttttcgttgcgattattgatagcgttagtaaacgttttttttatatgttcgaataatttatttttcgttatatttttcggtagtgtagtatagttgagatagattagcggatttatcgttcgtggcgaggttttatgaatcgttttcgttattagtttttttacgcggtttttacgtcgtgtatcggttgatgtaggacgttgagatcggacgtcgttataattttaatttttttttttagttgcgttatgttaggggataagttaattatttgcgtttgttttatcgttttaaacggcgtggtatcgtttggtagtatattgtggttttttagttgtttaagttagtaacgtattgtttaacgttttcgtcgttagcgtagtaattagtcgtagtttttcgtcgttgaaaatatcgaattgatcgggttgtatttcgtcgagcgttagtgcgtcgattaggttttgttcggtaaataatggtagattaacgtaggcgtgaatttttagatttttttgtttaggaattaaatcgttatagggatcgggtaattcgttgtttgcgggaaagcgtattatattttcggcgcgggtaatcgtttttagtcgtggatgtttttttagcgtaaagcgtttatcgagtatattttttgttagatcgtcgatggtaagcggaataaattgtcgcgaatcgtaacgtagtaacgtagacgtatcgtattttagtatttgacgtagcgtggtgattagg

SEQ ID NO: 33196 - DNA, 835 bp, Artificial Sequence
  chemically treated genomic DNA (Homo sapiens) CpG-island No: 33196
cctaatcaccacgctacgtcaaatactaaaatacgatacgtctacgttactacgttacgattcgcgacaatttattccgcttaccatcgacgatctaacaaaaaatatactcgataaacgctttacgctaaaaaaacatccacgactaaaaacgattacccgcgccgaaaatataatacgctttcccgcaaacaacgaattacccgatccctataacgatttaattcctaaacaaaaaaatctaaaaattcacgcctacgttaatctaccattatttaccgaacaaaacctaatcgacgcactaacgctcgacgaaatacaacccgatcaattcgatattttcaacgacgaaaaactacgactaattactacgctaacgacgaaaacgttaaacaatacgttactaacttaaacaactaaaaaaccacaatatactaccaaacgataccacgccgtttaaaacgataaaacaaacgcaaataattaacttatcccctaacataacgcaactaaaaaaaaaaattaaaattataacgacgtccgatctcaacgtcctacatcaaccgatacacgacgtaaaaaccgcgtaaaaaaactaataacgaaaacgattcataaaacctcgccacgaacgataaatccgctaatctatctcaactatactacactaccgaaaaatataacgaaaaataaattattcgaacatataaaaaaaacgtttactaacgctatcaataatcgcaacgaaaaatttaaaataacgaataacgacacgctatttctaaataaaatcgacgaattatcgttaacattacaaaccaaactactaaaaata

SEQ ID NO: 33197 - DNA, 581 bp, Artificial Sequence
  chemically treated genomic DNA (Homo sapiens) CpG-island No: 33197
ttcggaatcgtcgggcggcgcgttttttttcgtttagttttgtaatttatgtcgagaggaaggtagtgcgagttcgcgttagcgtttagttttcgggatagggtcggtaatgttgttgagtagaatttgatcgcgtttttttttcgttgttagtggaagcgatgttgtacggtatagttagcgttttttcggtttttttttaagttgaaggttatcgattcgcgtagttagttttagtattgtgagttgcgcgttttaggttcgggtttcggttgtttggcggcggcgtttagggtaataatcgggtcgttcgcgtcggggcgtattgtattagcggtttcggtttggtggatgtgtatgtatgagttttgtatcgaatgggcgtaaaaagcgttttagtcggtttattcgtttttcgattttttagattagtaagttttcgttgtagagcggagattgggagcgtaggggtagcggtttcgagagcgtttataaaatttaacgagttttggacgattgtaagatggtgggtgaaaattgcgtttttttttttttttttttaattgagagggggtgggggg

SEQ ID NO: 33198 - DNA, 581 bp, Artificial Sequence
  chemically treated genomic DNA (Homo sapiens) CpG-island No: 33198
ccccccaccccctctcaattaaaaaaaaaaaaaaaaaaacgcaattttcacccaccatcttacaatcgtccaaaactcgttaaattttataaacgctctcgaaaccgctacccctacgctcccaatctccgctctacaacgaaaacttactaatctaaaaaatcgaaaaacgaataaaccgactaaaacgctttttacgcccattcgatacaaaactcatacatacacatccaccaaaccgaaaccgctaatacaatacgccccgacgcgaacgacccgattattaccctaaacgccgccgccaaacaaccgaaacccgaacctaaaacgcgcaactcacaatactaaaactaactacgcgaatcgataaccttcaacttaaaaaaaaaccgaaaaaacgctaactataccgtacaacatcgcttccactaacaacgaaaaaaaaacgcgatcaaattctactcaacaacattaccgaccctatcccgaaaactaaacgctaacgcgaactcgcactaccttcctctcgacataaattacaaaactaaacgaaaaaaaacgcgccgcccgacgattccgaa

SEQ ID NO: 33199 - DNA, 581 bp, Artificial Sequence
  chemically treated genomic DNA (Homo sapiens) CpG-island No: 33199
ttttttatttttttttaattaaaaaaaaaaaaaaagaggcgtagtttttatttattattttgtagtcgtttagggttcgttgggttttgtgggcgttttcggagtcgttgtttttgcgtttttaattttcgttttgtagcgggggtttgttgatttggaagatcgaggagcgggtggatcggttggggcgttttttgcgtttattcggtgtagaatttatgtatatatatttattaagtcgaagtcgttggtgtagtgcgtttcggcgcgggcggttcggttgttgttttgggcgtcgtcgttaagtagtcggagttcggatttgaggcgcgtagtttatagtgttggggttggttgcgcgggtcggtaatttttagtttgaaggagagtcggggaagcgttagttgtgtcgtgtagtatcgtttttattagtagcgaggaaggagcgcgattaagttttgtttagtagtattgtcgattttgtttcgggagttgggcgttggcgcgggttcgtattgtttttttttcggtatggattgtaaggttgggcgagaaggaacgcgtcgttcggcggtttcgag

SEQ ID NO: 33200 - DNA, 581 bp, Artificial Sequence
  chemically treated genomic DNA (Homo sapiens) CpG-island No: 33200
ctcgaaaccgccgaacgacgcgttccttctcgcccaaccttacaatccataccgaaaaaaaaacaatacgaacccgcgccaacgcccaactcccgaaacaaaatcgacaatactactaaacaaaacttaatcgcgctccttcctcgctactaataaaaacgatactacacgacacaactaacgcttccccgactctccttcaaactaaaaattaccgacccgcgcaaccaaccccaacactataaactacgcgcctcaaatccgaactccgactacttaacgacgacgcccaaaacaacaaccgaaccgcccgcgccgaaacgcactacaccaacgacttcgacttaataaatatatatacataaattctacaccgaataaacgcaaaaaacgccccaaccgatccacccgctcctcgatcttccaaatcaacaaacccccgctacaaaacgaaaattaaaaacgcaaaaacaacgactccgaaaacgcccacaaaacccaacgaaccctaaacgactacaaaataataaataaaaactacgcctctttttttttttttttaattaaaaaaaaataaaaaa

SEQ ID NO: 33201 - DNA, 725 bp, Artificial Sequence
  chemically treated genomic DNA (Homo sapiens) CpG-island No: 33201
cgattcgcggggcgttgttcgtttaagattcgttttaaagagcgtaggaacgcgagtcgtagtagttttagggtttagtttaggtgatataaacgtagttaatgggaggtcgtcgtcgatttttttattcgtttttattagtattttcgcgttttttttcgttatttttgttcggcgcgtcggcgatgttttttgttcgcggggattcgagtttcgcgcgtttttcgttttttttattttggattttgtatttattatatttggggtattgtcgttcgtcgagtttgggcgcgcggtagcgagaaggtattggaggaggagtagtcggggcgtacgcgttttggtttttagtaggtcggggagggcgcgtatggcgttagagggttcgtttgggttttcgtggagattgtttttttagttcgtcgtcgcgggtgtttagagtttttgcgtatattcgtaggtggttcggcgttcgtagttagtgtcgcgggtaggacgttgaagaaaaggcggaatgggaggggttcggtcgttttgttttattttttcgagacgtttttatcgcgttcggttttttattagttatgtagtttttagtcggttgttggcgttttcggatgtgcggtggcggtgttatttttcggttgtagttttttcggttttcgttttttcggttttagtaggtcgggagagagtttgggtaggtgatgtttagttaatttcgt

SEQ ID NO: 33202 - DNA, 725 bp, Artificial Sequence
  chemically treated genomic DNA (Homo sapiens) CpG-island No: 33202
acgaaattaactaaacatcacctacccaaactctctcccgacctactaaaaccgaaaaaacgaaaaccgaaaaaactacaaccgaaaaataacaccgccaccgcacatccgaaaacgccaacaaccgactaaaaactacataactaataaaaaaccgaacgcgataaaaacgtctcgaaaaaataaaacaaaacgaccgaacccctcccattccgccttttcttcaacgtcctacccgcgacactaactacgaacgccgaaccacctacgaatatacgcaaaaactctaaacacccgcgacgacgaactaaaaaaacaatctccacgaaaacccaaacgaaccctctaacgccatacgcgccctccccgacctactaaaaaccaaaacgcgtacgccccgactactcctcctccaataccttctcgctaccgcgcgcccaaactcgacgaacgacaataccccaaatataataaatacaaaatccaaaataaaaaaaacgaaaaacgcgcgaaactcgaatccccgcgaacaaaaaacatcgccgacgcgccgaacaaaaataacgaaaaaaaacgcgaaaatactaataaaaacgaataaaaaaatcgacgacgacctcccattaactacgtttatatcacctaaactaaaccctaaaactactacgactcgcgttcctacgctctttaaaacgaatcttaaacgaacaacgccccgcgaatcg

SEQ ID NO: 33203 - DNA, 725 bp, Artificial Sequence
  chemically treated genomic DNA (Homo sapiens) CpG-island No: 33203
acgagattggttagatattatttgtttaagttttttttcgatttgttagagtcgagagggcggaggtcggagaggttgtagtcgggaagtagtatcgttatcgtatattcgggaacgttagtagtcggttgagggttgtataattgatggagggtcgggcgcggtaagagcgtttcgggggagtggggtaaggcggtcgggttttttttatttcgttttttttttagcgttttattcgcggtattggttgcgagcgtcgggttatttgcgagtgtgcgtagggattttggatattcgcggcggcgagttgagggagtagtttttacgaggatttaggcggattttttggcgttatgcgcgtttttttcggtttgttggaggttagggcgcgtacgtttcggttgttttttttttagtgttttttcgttgtcgcgcgtttaagttcggcggacggtagtgttttaggtgtgatgggtatagggtttagggtagggagggcggagggcgcgcgaggttcgggttttcgcgggtagagggtatcgtcggcgcgtcgggtaagggtggcggggagaggcgcggggatgttggtaagggcgggtgggagagtcggcggcggttttttattagttacgtttgtgttatttaagttgaattttgaaattgttgcggttcgcgtttttgcgttttttggggcgagttttgaacgaatagcgtttcgcgagtcg

SEQ ID NO: 33204 - DNA, 725 bp, Artificial Sequence
  chemically treated genomic DNA (Homo sapiens) CpG-island No: 33204
cgactcgcgaaacgctattcgttcaaaactcgccccaaaaaacgcaaaaacgcgaaccgcaacaatttcaaaattcaacttaaataacacaaacgtaactaataaaaaaccgccgccgactctcccacccgcccttaccaacatccccgcgcctctccccgccacccttacccgacgcgccgacgataccctctacccgcgaaaacccgaacctcgcgcgccctccgccctccctaccctaaaccctatacccatcacacctaaaacactaccgtccgccgaacttaaacgcgcgacaacgaaaaaacactaaaaaaaaaacaaccgaaacgtacgcgccctaacctccaacaaaccgaaaaaaacgcgcataacgccaaaaaatccgcctaaatcctcgtaaaaactactccctcaactcgccgccgcgaatatccaaaatccctacgcacactcgcaaataacccgacgctcgcaaccaataccgcgaataaaacgctaaaaaaaaaacgaaataaaaaaaacccgaccgccttaccccactcccccgaaacgctcttaccgcgcccgaccctccatcaattatacaaccctcaaccgactactaacgttcccgaatatacgataacgatactacttcccgactacaacctctccgacctccgccctctcgactctaacaaatcgaaaaaaaacttaaacaaataatatctaaccaatctcgt

SEQ ID NO: 33205 - DNA, 959 bp, Artificial Sequence
  chemically treated genomic DNA (Homo sapiens) CpG-island No: 33205
ggaacgggagtcgtttttacgtttcgttcggttgtcgagagtcgtatttttgggcggatgtcgtaggtcgggagggatgaggtcgacggcgttgattggttgatcgtcgcggtttggggtttttttggtttcgtttttgttgtatttttttcgttcgcgaattcgcgcgttgttcggttttgcgttgtttagcgggaggggttggatttcgcgttttttttttttgtcggtttttatttttaaagcgagagtttggacgtttcgtttgtgggagagagcgtcgggattcggacggggagtaatcggggtaggtcgtgtcggttgaggaggttttgaggttatagagttgtcgcggttggtatacgagcgtttcggtattaatcgagtgttcgcgggggttgtgaggggagggtttcgggcgttattgttggcggtgggagcgtcgttcggttttagttcgttttcggttgtttttttttttcggttgggaggggtcgtagttcggggtcgtcgttagtttcggttcgggttcgagaattaagggtttcggtcgtcgtttcgtagtttagtttatcgtttttgtcgggtagttcgggtagagattatgtttgataagacgcggttgtcgtacgtggttttcgatgtgttttgcgtgttgttgggtacgtacgcgtcgtcgggttcgaggggcgtgtgcggttgtttcgggagggttttagcgtagagtcgcgacgggtagcgggggtgtgttgtttgacgcgtgcgtagttgtggggcgatatacgggggcggtttttgtagtcgagggatttcgttttgtagtttgtatttcggttttcgcgtgttcgtcgttgtttgtcgttcgtcggtgcgatgagtttagttttgtttggacgttgtttacgtttttgcgttttatattttgtttttgttttttgtttgtagttttattttagtag

SEQ ID NO: 33206 - DNA, 959 bp, Artificial Sequence
  chemically treated genomic DNA (Homo sapiens) CpG-island No: 33206
ctactaaaataaaactacaaacaaaaaacaaaaacaaaatataaaacgcaaaaacgtaaacaacgtccaaacaaaactaaactcatcgcaccgacgaacgacaaacaacgacgaacacgcgaaaaccgaaatacaaactacaaaacgaaatccctcgactacaaaaaccgcccccgtatatcgccccacaactacgcacgcgtcaaacaacacacccccgctacccgtcgcgactctacgctaaaaccctcccgaaacaaccgcacacgcccctcgaacccgacgacgcgtacgtacccaacaacacgcaaaacacatcgaaaaccacgtacgacaaccgcgtcttatcaaacataatctctacccgaactacccgacaaaaacgataaactaaactacgaaacgacgaccgaaacccttaattctcgaacccgaaccgaaactaacgacgaccccgaactacgacccctcccaaccgaaaaaaaaaaacaaccgaaaacgaactaaaaccgaacgacgctcccaccgccaacaataacgcccgaaaccctcccctcacaacccccgcgaacactcgattaataccgaaacgctcgtataccaaccgcgacaactctataacctcaaaacctcctcaaccgacacgacctaccccgattactccccgtccgaatcccgacgctctctcccacaaacgaaacgtccaaactctcgctttaaaaataaaaaccgacaaaaaaaaaaaacgcgaaatccaacccctcccgctaaacaacgcaaaaccgaacaacgcgcgaattcgcgaacgaaaaaaatacaacaaaaacgaaaccaaaaaaaccccaaaccgcgacgatcaaccaatcaacgccgtcgacctcatccctcccgacctacgacatccgcccaaaaatacgactctcgacaaccgaacgaaacgtaaaaacgactcccgttcc

SEQ ID NO: 33207 - DNA, 959 bp, Artificial Sequence
  chemically treated genomic DNA (Homo sapiens) CpG-island No: 33207
ttgttagagtggaattgtaaatagaggataggagtaaggtatggagcgtagaggcgtgaatagcgtttaagtagggttgggtttatcgtatcggcgggcgatagatagcggcgggtacgcgggagtcggggtgtaggttgtaaagcggggtttttcggttgtagaagtcgttttcgtgtgtcgttttatagttgcgtacgcgttaggtaatatattttcgttgttcgtcgcggttttgcgttaaagttttttcgggatagtcgtatacgtttttcggattcggcggcgcgtacgtatttagtaatacgtagagtatatcgagggttacgtacggtagtcgcgttttgttaaatatggtttttgttcgggttgttcggtaagggcgatggattgagttgcgggacggcggtcgaggtttttgattttcgagttcgggtcggggttggcgacggtttcgagttacggttttttttagtcggaggaggagagtagtcgagggcgggttgagatcgggcggcgtttttatcgttagtaatggcgttcggggttttttttttatagttttcgcgaatattcggttagtgtcgaggcgttcgtgtgttagtcgcggtagttttgtagttttaggatttttttagtcggtacggtttgtttcggttgtttttcgttcggatttcggcgtttttttttataggcggggcgtttagattttcgttttaaggatggggatcggtagggaggaggaacgcggggtttagtttttttcgttgagtagcgtaggatcgggtagcgcgcgggttcgcgggcggggggagtgtagtaggggcggggttagggaaattttaggtcgcggcggttagttaattagcgtcgtcggttttatttttttcgatttgcggtattcgtttagaagtgcggttttcggtagtcgggcggggcgtgggggcggttttcgtttt

SEQ ID NO: 33208 - DNA, 959 bp, Artificial Sequence
  chemically treated genomic DNA (Homo sapiens) CpG-island No: 33208
aaaacgaaaaccgcccccacgccccgcccgactaccgaaaaccgcacttctaaacgaataccgcaaatcgaaaaaaataaaaccgacgacgctaattaactaaccgccgcgacctaaaatttccctaaccccgcccctactacactccccccgcccgcgaacccgcgcgctacccgatcctacgctactcaacgaaaaaaactaaaccccgcgttcctcctccctaccgatccccatccttaaaacgaaaatctaaacgccccgcctataaaaaaaaacgccgaaatccgaacgaaaaacaaccgaaacaaaccgtaccgactaaaaaaatcctaaaactacaaaactaccgcgactaacacacgaacgcctcgacactaaccgaatattcgcgaaaactataaaaaaaaaaccccgaacgccattactaacgataaaaacgccgcccgatctcaacccgccctcgactactctcctcctccgactaaaaaaaaccgtaactcgaaaccgtcgccaaccccgacccgaactcgaaaatcaaaaacctcgaccgccgtcccgcaactcaatccatcgcccttaccgaacaacccgaacaaaaaccatatttaacaaaacgcgactaccgtacgtaaccctcgatatactctacgtattactaaatacgtacgcgccgccgaatccgaaaaacgtatacgactatcccgaaaaaactttaacgcaaaaccgcgacgaacaacgaaaatatattacctaacgcgtacgcaactataaaacgacacacgaaaacgacttctacaaccgaaaaaccccgctttacaacctacaccccgactcccgcgtacccgccgctatctatcgcccgccgatacgataaacccaaccctacttaaacgctattcacgcctctacgctccataccttactcctatcctctatttacaattccactctaacaa

SEQ ID NO: 33209 - DNA, 706 bp, Artificial Sequence
  chemically treated genomic DNA (Homo sapiens) CpG-island No: 33209
attacgggtaaaggggcgtacgaggggtaaagggattggcgggagtagggtatcgttttttagtaaattcgtttcgcggggcgtggcggggacgacgggtcgcgtagtttgcgtatgcgcgtcggcgattacgtttaaatagtcgtagtttttgcgcgtcgttttttacggttatttcggtttttcgtttttttttttcgcggcgttcgagggattatggtcgattttcgcgtgagatagattaagattaagatcggcgtggtgaagcggtaaggagtcgggagcggcgttttgtatttttttttcgttattttatggcggttcgcgaggttgagcggagcgtaggttcgaggaggttcgaggcgggtttcgaattttaggtcgtattcggggtttcgtagttggttgggattggtagggatttagcggggcgcgttgacgttcgagttcgttagtttcgtacgtcgtttttcgttttttttcgtttattggtcgttttgatttgtcggaagagtcggcggtggttcggtttttcggcgttcgcggtgggaaggtggtgggtcgcggtttgcgagggcgggtcgggttttgatttcgtgttttttgtgtgcgcgcgtcggtttttttttgttgaatttggttcggggaagcgggattttagttgtgtttttaaatgggtttgaaagtaggttttgaagtttagggg

SEQ ID NO: 33210 - DNA, 706 bp, Artificial Sequence
  chemically treated genomic DNA (Homo sapiens) CpG-island No: 33210
cccctaaacttcaaaacctactttcaaacccatttaaaaacacaactaaaatcccgcttccccgaaccaaattcaacaaaaaaaaaccgacgcgcgcacacaaaaaacacgaaatcaaaacccgacccgccctcgcaaaccgcgacccaccaccttcccaccgcgaacgccgaaaaaccgaaccaccgccgactcttccgacaaatcaaaacgaccaataaacgaaaaaaaacgaaaaacgacgtacgaaactaacgaactcgaacgtcaacgcgccccgctaaatccctaccaatcccaaccaactacgaaaccccgaatacgacctaaaattcgaaacccgcctcgaacctcctcgaacctacgctccgctcaacctcgcgaaccgccataaaataacgaaaaaaaaatacaaaacgccgctcccgactccttaccgcttcaccacgccgatcttaatcttaatctatctcacgcgaaaatcgaccataatccctcgaacgccgcgaaaaaaaaaaacgaaaaaccgaaataaccgtaaaaaacgacgcgcaaaaactacgactatttaaacgtaatcgccgacgcgcatacgcaaactacgcgacccgtcgtccccgccacgccccgcgaaacgaatttactaaaaaacgataccctactcccgccaatccctttacccctcgtacgcccctttacccgtaat

SEQ ID NO: 33211 - DNA, 706 bp, Artificial Sequence
  chemically treated genomic DNA (Homo sapiens) CpG-island No: 33211
tttttaaattttagagtttgtttttaagtttatttgagagtatagttgggatttcgttttttcgggttaagtttagtaaggagaggtcggcgcgcgtatataggaggtacgggattagggttcggttcgttttcgtaggtcgcggtttattatttttttatcgcgggcgtcgagaaatcgggttatcgtcgattttttcggtaaattagagcggttagtgagcggagagggacgggaagcggcgtgcgaggttggcgggttcgggcgttagcgcgtttcgttgggtttttgttagttttagttaattgcggagtttcgggtgcggtttggagttcggagttcgtttcgggttttttcgggtttgcgtttcgtttagtttcgcgggtcgttatgaggtgacgaagaggaggtgtagggcgtcgttttcggttttttatcgttttattacgtcggttttgattttgatttgttttacgcgaggatcggttatggtttttcgagcgtcgcgagaaggaggggcggagagtcggggtaatcgtggagggcgacgcgtagaggttgcggttatttaggcgtggtcgtcggcgcgtatgcgtaggttgcgcggttcgtcgttttcgttacgtttcgcggggcgggtttattagagggcggtattttgttttcgttagtttttttatttttcgtgcgtttttttattcgtagt

SEQ ID NO: 33212 - DNA, 706 bp, Artificial Sequence
  chemically treated genomic DNA (Homo sapiens) CpG-island No: 33212
actacgaataaaaaaacgcacgaaaaataaaaaaactaacgaaaacaaaataccgccctctaataaacccgccccgcgaaacgtaacgaaaacgacgaaccgcgcaacctacgcatacgcgccgacgaccacgcctaaataaccgcaacctctacgcgtcgccctccacgattaccccgactctccgcccctccttctcgcgacgctcgaaaaaccataaccgatcctcgcgtaaaacaaatcaaaatcaaaaccgacgtaataaaacgataaaaaaccgaaaacgacgccctacacctcctcttcgtcacctcataacgacccgcgaaactaaacgaaacgcaaacccgaaaaaacccgaaacgaactccgaactccaaaccgcacccgaaactccgcaattaactaaaactaacaaaaacccaacgaaacgcgctaacgcccgaacccgccaacctcgcacgccgcttcccgtccctctccgctcactaaccgctctaatttaccgaaaaaatcgacgataacccgatttctcgacgcccgcgataaaaaaataataaaccgcgacctacgaaaacgaaccgaaccctaatcccgtacctcctatatacgcgcgccgacctctccttactaaacttaacccgaaaaaacgaaatcccaactatactctcaaataaacttaaaaacaaactctaaaatttaaaaa

SEQ ID NO: 33213 - DNA, 519 bp, Artificial Sequence
  chemically treated genomic DNA (Homo sapiens) CpG-island No: 33213
ggttttcggagcgtttttttttgtcgtttttttttttacgtggggtcgagaaagtcggagtttttagttgtacgcgcgttgttcgttcgatttcgggcgggaggtttgcgtgaatggtcgttgggtgtaaggaacggagtagagggttgagtcggttcgagagtttcgtttagatcggtggagtgtagtggtttttcgttgtttagtcgtacgggggtgtggtttagaggattcggtttttcggcgtttcgcgttaatttttgggagttttgtagtatttacggcgtgtttgtacgtagttacgtaggaagatttttttagcgcgtcgtaatcgttgaattttttttttttatttattcgttttacgtaagttgaggaggagaggtggaaatatgcgggattacgacgaggtgatcgttttcgtgggcgagtgggggtttttttagcgttttattttttttttgtttagcgttagtattatttttaatggttttaatggtatgttagtcgtgtttttgg

SEQ ID NO: 33214 - DNA, 519 bp, Artificial Sequence
  chemically treated genomic DNA (Homo sapiens) CpG-island No: 33214
ccaaaaacacgactaacataccattaaaaccattaaaaataatactaacgctaaacaaaaaaaaaataaaacgctaaaaaaacccccactcgcccacgaaaacgatcacctcgtcgtaatcccgcatatttccacctctcctcctcaacttacgtaaaacgaataaataaaaaaaaaaaattcaacgattacgacgcgctaaaaaaatcttcctacgtaactacgtacaaacacgccgtaaatactacaaaactcccaaaaattaacgcgaaacgccgaaaaaccgaatcctctaaaccacacccccgtacgactaaacaacgaaaaaccactacactccaccgatctaaacgaaactctcgaaccgactcaaccctctactccgttccttacacccaacgaccattcacgcaaacctcccgcccgaaatcgaacgaacaacgcgcgtacaactaaaaactccgactttctcgaccccacgtaaaaaaaaaaacgacaaaaaaaaacgctccgaaaacc

SEQ ID NO: 33215 - DNA, 519 bp, Artificial Sequence
  chemically treated genomic DNA (Homo sapiens) CpG-island No: 33215
ttaagaatacgattgatatattattgaagttattggggatgatgttggcgttgagtagaaagaagatgaggcgttggaagggtttttattcgtttacgaaggcgattatttcgtcgtagtttcgtatgtttttattttttttttttagtttgcgtgaggcgagtgggtggagagaaaggatttagcgattgcggcgcgttgaggggatttttttacgtggttgcgtgtaaatacgtcgtgggtgttgtaaaatttttaagggttggcgcggagcgtcgggaagtcgagttttttggattatattttcgtgcggttaggtagcgaaaggttattgtattttatcgatttgggcggaattttcgggtcggtttagttttttgtttcgttttttgtatttagcggttatttacgtaggtttttcgttcggaatcggacggataacgcgcgtgtagttaggagtttcggttttttcggttttacgtgggagggagagcgatagggaggagcgtttcgaaagtt

SEQ ID NO: 33216 - DNA, 519 bp, Artificial Sequence
  chemically treated genomic DNA (Homo sapiens) CpG-island No: 33216
aactttcgaaacgctcctccctatcgctctccctcccacgtaaaaccgaaaaaaccgaaactcctaactacacgcgcgttatccgtccgattccgaacgaaaaacctacgtaaataaccgctaaatacaaaaaacgaaacaaaaaactaaaccgacccgaaaattccgcccaaatcgataaaatacaataacctttcgctacctaaccgcacgaaaatataatccaaaaaactcgacttcccgacgctccgcgccaacccttaaaaattttacaacacccacgacgtatttacacgcaaccacgtaaaaaaatcccctcaacgcgccgcaatcgctaaatcctttctctccacccactcgcctcacgcaaactaaaaaaaaaaaataaaaacatacgaaactacgacgaaataatcgccttcgtaaacgaataaaaacccttccaacgcctcatcttctttctactcaacgccaacatcatccccaataacttcaataatatatcaatcgtattcttaa

SEQ ID NO: 33217 - DNA, 634 bp, Artificial Sequence
  chemically treated genomic DNA (Homo sapiens) CpG-island No: 33217
tttcgtcgttatttcgggtttcgatttcgcgtggttaggtatttcgggttattatttttcgatttagggcgagtttacgtcgtcgtttgcgcgttgaattgggagttgggagtagtcgatatcggtttttgaaattttgcgttgggaggttttcggttgggcgaggatttttgggcgttgaataagttttttcggcggtgtttgttcgagcgtagatagaagtcgcgcgagggaacgcggggtcgtgttttggggcggcggggaggggttgggagggcgggtgtgtaggggtttgggttgttcgtcggttaggggcggttattttggtcggagattcgacgcgcggggattttcggttcgcgtttttttagtaggtcggattcgcgcggtagttttgggtttcgttttttatttttttgtcgcggtcgcgtttcgttggggaaggtgcgaggtgcggcggacgaggacgatttttgacgttgagtttgtgggttaggttcgcgtttattataggaatttttttcgggaaagttcggaaagatgttagcggttttgaagtaggaagattttgcggcgtgcgttttgagtagatgtattaggaggtttttttgggcgagaggaaaggataatggag

SEQ ID NO: 33218 - DNA, 634 bp, Artificial Sequence
  chemically treated genomic DNA (Homo sapiens) CpG-island No: 33218
ctccattatcctttcctctcgcccaaaaaaacctcctaatacatctactcaaaacgcacgccgcaaaatcttcctacttcaaaaccgctaacatctttccgaactttcccgaaaaaaattcctataataaacgcgaacctaacccacaaactcaacgtcaaaaatcgtcctcgtccgccgcacctcgcaccttccccaacgaaacgcgaccgcgacaaaaaaataaaaaacgaaacccaaaactaccgcgcgaatccgacctactaaaaaaacgcgaaccgaaaatccccgcgcgtcgaatctccgaccaaaataaccgcccctaaccgacgaacaacccaaacccctacacacccgccctcccaacccctccccgccgccccaaaacacgaccccgcgttccctcgcgcgacttctatctacgctcgaacaaacaccgccgaaaaaacttattcaacgcccaaaaatcctcgcccaaccgaaaacctcccaacgcaaaatttcaaaaaccgatatcgactactcccaactcccaattcaacgcgcaaacgacgacgtaaactcgccctaaatcgaaaaataataacccgaaatacctaaccacgcgaaatcgaaacccgaaataacgacgaaa

SEQ ID NO: 33219 - DNA, 634 bp, Artificial Sequence
  chemically treated genomic DNA (Homo sapiens) CpG-island No: 33219
ttttattatttttttttttcgtttaggaaggttttttgatgtatttgtttaaagcgtacgtcgtagggtttttttgttttagggtcgttggtattttttcgggttttttcgggagagatttttgtggtgggcgcgggtttggtttataggtttagcgttaagaatcgttttcgttcgtcgtatttcgtattttttttagcggggcgcggtcgcggtaggaggatgaggagcggagtttaggattgtcgcgcggattcggtttgttggaggagcgcggatcgggagttttcgcgcgtcggattttcggttaaggtggtcgtttttagtcggcgggtagtttaggtttttgtatattcgtttttttagttttttttcgtcgttttaggatacgatttcgcgttttttcgcgcggtttttgtttgcgttcggatagatatcgtcgggaaaatttgtttagcgtttaggaattttcgtttagtcgagggttttttagcgtagggttttagagatcgatgtcggttgtttttagtttttagtttagcgcgtaggcggcggcgtgagttcgttttgggtcgagaggtggtgattcggggtgtttggttacgcggagtcgaaattcggagtggcgacgaag

SEQ ID NO: 33220 - DNA, 634 bp, Artificial Sequence
  chemically treated genomic DNA (Homo sapiens) CpG-island No: 33220
cttcgtcgccactccgaatttcgactccgcgtaaccaaacaccccgaatcaccacctctcgacccaaaacgaactcacgccgccgcctacgcgctaaactaaaaactaaaaacaaccgacatcgatctctaaaaccctacgctaaaaaaccctcgactaaacgaaaattcctaaacgctaaacaaattttcccgacgatatctatccgaacgcaaacaaaaaccgcgcgaaaaaacgcgaaatcgtatcctaaaacgacgaaaaaaaactaaaaaaacgaatatacaaaaacctaaactacccgccgactaaaaacgaccaccttaaccgaaaatccgacgcgcgaaaactcccgatccgcgctcctccaacaaaccgaatccgcgcgacaatcctaaactccgctcctcatcctcctaccgcgaccgcgccccgctaaaaaaaatacgaaatacgacgaacgaaaacgattcttaacgctaaacctataaaccaaacccgcgcccaccacaaaaatctctcccgaaaaaacccgaaaaaataccaacgaccctaaaacaaaaaaaccctacgacgtacgctttaaacaaatacatcaaaaaaccttcctaaacgaaaaaaaaaaataataaaa

SEQ ID NO: 33221 - DNA, 846 bp, Artificial Sequence
  chemically treated genomic DNA (Homo sapiens) CpG-island No: 33221
tcggtcgtcgaggcgtttttcgcgttgcgggttttttttttaggattttcggtaaagacggacgaggagttcgagtttttgcggaaggattggcgtattggcgagtcgcggttgggcggtttcgagtaggggttgtgcggtggcgggggattttcggggggtgttgttacgtcggttagtttttgcggtgacgaaggcggtaggcggaagtcgtagtcgtcgtcgtatagcgggtcgtcgtcgttcgtcgttttgtatagggagttttttagatcggattgtagcgcggcggtcgagtaggtgttgagcgagcgtatcgagtcgcgtttgtagaggtcgtcggcgttcgggtaggcgaacgggtcgtcggcggtcgcggttaggtttagacggttttcgtgtagtagttcgtaggggttagtatagaggttttcgttttttattagtattatgtcgttcgttttgttcgttaggttttcgttcggttttacgtcgcgtcgttttaggatggcgttggggttggggttgacgttttgggcggtcggggcgttttttagtttttcggtcgcgtggtgtatcgggttgtcggcgtacgaaggcgggcgtttttcggcgtacgataggcgcgaacgcgacggcgaatcggattgtagttcggacggtagtttcgacggtagttcgggcggcggcgagtcggatgttaggtgcggcgttggtgataggttgttgaggcgtcgcgtgggcgaggattttcgcgatgcgtatattatttttttttgcgtagaagatagttcggaattttacggggttggttattaaggatatttttgttttttgtttgaggag

SEQ ID NO: 33222 - DNA, 846 bp, Artificial Sequence
  chemically treated genomic DNA (Homo sapiens) CpG-island No: 33222
ctcctcaaacaaaaaacaaaaatatccttaataaccaaccccgtaaaattccgaactatcttctacgcaaaaaaaaataatatacgcatcgcgaaaatcctcgcccacgcgacgcctcaacaacctatcaccaacgccgcacctaacatccgactcgccgccgcccgaactaccgtcgaaactaccgtccgaactacaatccgattcgccgtcgcgttcgcgcctatcgtacgccgaaaaacgcccgccttcgtacgccgacaacccgatacaccacgcgaccgaaaaactaaaaaacgccccgaccgcccaaaacgtcaaccccaaccccaacgccatcctaaaacgacgcgacgtaaaaccgaacgaaaacctaacgaacaaaacgaacgacataatactaataaaaaacgaaaacctctatactaacccctacgaactactacacgaaaaccgtctaaacctaaccgcgaccgccgacgacccgttcgcctacccgaacgccgacgacctctacaaacgcgactcgatacgctcgctcaacacctactcgaccgccgcgctacaatccgatctaaaaaactccctatacaaaacgacgaacgacgacgacccgctatacgacgacgactacgacttccgcctaccgccttcgtcaccgcaaaaactaaccgacgtaacaacaccccccgaaaatcccccgccaccgcacaacccctactcgaaaccgcccaaccgcgactcgccaatacgccaatccttccgcaaaaactcgaactcctcgtccgtctttaccgaaaatcctaaaaaaaaaacccgcaacgcgaaaaacgcctcgacgaccga

SEQ ID NO: 33223 - DNA, 846 bp, Artificial Sequence
  chemically treated genomic DNA (Homo sapiens) CpG-island No: 33223
ttttttaagtaagggataggggtgtttttggtgattagtttcgtggggtttcgggttgttttttgcgtagagagagatggtgtacgtatcgcgggagttttcgtttacgcggcgttttaataatttgttattagcgtcgtatttggtattcggttcgtcgtcgttcgggttgtcgtcggggttgtcgttcgggttgtagttcggttcgtcgtcgcgttcgcgtttatcgtacgtcggggggcgttcgttttcgtacgtcggtagttcggtgtattacgcggtcgagaggttgggaggcgtttcggtcgtttagggcgttagttttagttttagcgttattttggagcggcgcgacgtgaagtcggacgaggatttggcgagtaaggcgggcggtatggtgttggtgaaaggcgagggtttttatgttgatttttacgggttgttgtacgagggtcgtttgagtttggtcgcggtcgtcggcgattcgttcgtttattcgggcgtcggcggtttttataagcgcggttcggtgcgttcgtttagtatttattcggtcgtcgcgttgtagttcgatttggaggattttttgtataaggcggcgggcggcggcggttcgttgtacggcgacggttacggttttcgtttgtcgttttcgttatcgtagaagttggtcgacgtggtagtatttttcggaggtttttcgttatcgtatagtttttattcggggtcgtttagtcgcggttcgttagtgcgttagttttttcgtaaggattcgggtttttcgttcgtttttgtcgagagttttggagggaagattcgtagcgcggggagcgtttcgacggtcgg

SEQ ID NO: 33224 - DNA, 846 bp, Artificial Sequence
  chemically treated genomic DNA (Homo sapiens) CpG-island No: 33224
ccgaccgtcgaaacgctccccgcgctacgaatcttccctccaaaactctcgacaaaaacgaacgaaaaacccgaatccttacgaaaaaactaacgcactaacgaaccgcgactaaacgaccccgaataaaaactatacgataacgaaaaacctccgaaaaatactaccacgtcgaccaacttctacgataacgaaaacgacaaacgaaaaccgtaaccgtcgccgtacaacgaaccgccgccgcccgccgccttatacaaaaaatcctccaaatcgaactacaacgcgacgaccgaataaatactaaacgaacgcaccgaaccgcgcttataaaaaccgccgacgcccgaataaacgaacgaatcgccgacgaccgcgaccaaactcaaacgaccctcgtacaacaacccgtaaaaatcaacataaaaaccctcgcctttcaccaacaccataccgcccgccttactcgccaaatcctcgtccgacttcacgtcgcgccgctccaaaataacgctaaaactaaaactaacgccctaaacgaccgaaacgcctcccaacctctcgaccgcgtaatacaccgaactaccgacgtacgaaaacgaacgccccccgacgtacgataaacgcgaacgcgacgacgaaccgaactacaacccgaacgacaaccccgacgacaacccgaacgacgacgaaccgaataccaaatacgacgctaataacaaattattaaaacgccgcgtaaacgaaaactcccgcgatacgtacaccatctctctctacgcaaaaaacaacccgaaaccccacgaaactaatcaccaaaaacacccctatcccttacttaaaaaa

SEQ ID NO: 33225 - DNA, 695 bp, Artificial Sequence
  chemically treated genomic DNA (Homo sapiens) CpG-island No: 33225
ggggttgcgcggtgcgcggagggggcgtcggtagtcggcgttttttggcggtttttcgagtcggttttttcgtaggcggtcgttttggttttcggcgtaaattcggagtgtttaaggcgaagtttttcgcgtaatattaaagtttcgatcggcggattagacgatcgaaatgtttttggcggagattttcgggtgcggtcggagtcgggttggtcgtcgaggggttggtcgttggagtttcgggggcggtcggcggggggtttttatcgatttcggtaggttggtcgggtaggaacggtcgcggcgtcgtttcgggattcgcgggttcggtggagaggttcgtaggtggcgacggaggtcgggaattgggtttttgaggcgggttggcggttgggttacgttgaggttcgagattcggggtcgggcgaggcggggtcgaggcgaagttggtcgtagattttcgagggtgcgggggcgtagggtagcggttcggaggtgtataggagcgaacgtcgaagtgcgggaaatcgttttcgttttttttttttttttcgcggcgggggtacgttgcgacgttcgtattttcgtcggcggcggtgttaggaacgtcgggtcgttcggtcggtgtttagaggtgttttaggttattcggggtttagtcgttagggcgtaggggggtttgagggtttcgtagt

SEQ ID NO: 33226 - DNA, 695 bp, Artificial Sequence
  chemically treated genomic DNA (Homo sapiens) CpG-island No: 33226
actacgaaaccctcaaacccccctacgccctaacgactaaaccccgaataacctaaaacacctctaaacaccgaccgaacgacccgacgttcctaacaccgccgccgacgaaaatacgaacgtcgcaacgtacccccgccgcgaaaaaaaaaaaaaaaacgaaaacgatttcccgcacttcgacgttcgctcctatacacctccgaaccgctaccctacgcccccgcaccctcgaaaatctacgaccaacttcgcctcgaccccgcctcgcccgaccccgaatctcgaacctcaacgtaacccaaccgccaacccgcctcaaaaacccaattcccgacctccgtcgccacctacgaacctctccaccgaacccgcgaatcccgaaacgacgccgcgaccgttcctacccgaccaacctaccgaaatcgataaaaaccccccgccgaccgcccccgaaactccaacgaccaacccctcgacgaccaacccgactccgaccgcacccgaaaatctccgccaaaaacatttcgatcgtctaatccgccgatcgaaactttaatattacgcgaaaaacttcgccttaaacactccgaatttacgccgaaaaccaaaacgaccgcctacgaaaaaaccgactcgaaaaaccgccaaaaaacgccgactaccgacgccccctccgcgcaccgcgcaacccc

SEQ ID NO: 33227 - DNA, 695 bp, Artificial Sequence
  chemically treated genomic DNA (Homo sapiens) CpG-island No: 33227
gttgcggggtttttaggtttttttgcgttttggcggttgggtttcggatggtttgaagtatttttgggtatcgatcgggcggttcggcgtttttaatatcgtcgtcggcgaggatgcggacgtcgtagcgtgttttcgtcgcggagaggaggaagagggcggaggcggtttttcgtatttcggcgttcgtttttgtgtattttcgggtcgttgttttgcgttttcgtattttcgggaatttacgattagtttcgtttcggtttcgtttcgttcggtttcgggtttcgagttttagcgtggtttagtcgttagttcgttttaggaatttagttttcggttttcgtcgttatttgcgggtttttttatcgagttcgcgggtttcgggacggcgtcgcggtcgtttttgttcggttagtttgtcgaagtcgatggaaatttttcgtcggtcgttttcgaggttttagcggttagtttttcgacggttagttcggtttcggtcgtattcggagattttcgttaggaatatttcgatcgtttgattcgtcggtcgaaattttggtgttacgcgaagggtttcgttttggatatttcgagtttgcgtcgggggttagagcggtcgtttgcgaaagggtcggttcggggagtcgttaagaaacgtcggttgtcggcgtttttttcgcgtatcgcgtagtttt

SEQ ID NO: 33228 - DNA, 695 bp, Artificial Sequence
  chemically treated genomic DNA (Homo sapiens) CpG-island No: 33228
aaaactacgcgatacgcgaaaaaaacgccgacaaccgacgtttcttaacgactccccgaaccgaccctttcgcaaacgaccgctctaacccccgacgcaaactcgaaatatccaaaacgaaacccttcgcgtaacaccaaaatttcgaccgacgaatcaaacgatcgaaatattcctaacgaaaatctccgaatacgaccgaaaccgaactaaccgtcgaaaaactaaccgctaaaacctcgaaaacgaccgacgaaaaatttccatcgacttcgacaaactaaccgaacaaaaacgaccgcgacgccgtcccgaaacccgcgaactcgataaaaaaacccgcaaataacgacgaaaaccgaaaactaaattcctaaaacgaactaacgactaaaccacgctaaaactcgaaacccgaaaccgaacgaaacgaaaccgaaacgaaactaatcgtaaattcccgaaaatacgaaaacgcaaaacaacgacccgaaaatacacaaaaacgaacgccgaaatacgaaaaaccgcctccgccctcttcctcctctccgcgacgaaaacacgctacgacgtccgcatcctcgccgacgacgatattaaaaacgccgaaccgcccgatcgatacccaaaaatacttcaaaccatccgaaacccaaccgccaaaacgcaaaaaaacctaaaaaccccgcaac

SEQ ID NO: 33229 - DNA, 699 bp, Artificial Sequence
  chemically treated genomic DNA (Homo sapiens) CpG-island No: 33229
gtcgacggggaggtttttgtttacgggcgttttcggttcgttattcggggtcgtagagttcgggtttttttttcgttttttttacgcggttttttcggcggtcggatttttgggtttttgtgagtttcggcggggtcggtcgtttttttgtcgtcgcgtttttttcgtaatttcggcgggagattttttcgagtcgttcgaagcgtagaggtaggggaaataaagcggtcggcggtcgcgggaggcgggaaggatttcgggttcggtattcggtgttcgggtttaggcggcggggagggcgtttttcgttcgttcggtttttttttttttcgttggttttcggagatcgcgttatagagaattgttttttcgttgttttaatattagcgtcggggtcgcgagttcgtcgttgattgggtcgtatcgttcgtgacgttagttcggattttattttttcggcggtatcgttttcgtttttatttcgtatatagatatatatacgtggattcggcgcggcggcggttgggagggagcgcgggagggagcgtgcgcgggtgggatcgcgagcggttagatgcgtcgtcgtacgtggttcggtggcgttttgggatttcgtcgtcgtaaagttattcgttttttttcgagtagttacggttttgtatttgtaaaatgggacggtttatatttgtttttttggga

SEQ ID NO: 33230 - DNA, 699 bp, Artificial Sequence
  chemically treated genomic DNA (Homo sapiens) CpG-island No: 33230
tcccaaaaaaacaaatataaaccgtcccattttacaaatacaaaaccgtaactactcgaaaaaaaacgaataactttacgacgacgaaatcccaaaacgccaccgaaccacgtacgacgacgcatctaaccgctcgcgatcccacccgcgcacgctccctcccgcgctccctcccaaccgccgccgcgccgaatccacgtatatatatctatatacgaaataaaaacgaaaacgataccgccgaaaaaataaaatccgaactaacgtcacgaacgatacgacccaatcaacgacgaactcgcgaccccgacgctaatattaaaacaacgaaaaaacaattctctataacgcgatctccgaaaaccaacgaaaaaaaaaaaaaccgaacgaacgaaaaacgccctccccgccgcctaaacccgaacaccgaataccgaacccgaaatccttcccgcctcccgcgaccgccgaccgctttatttcccctacctctacgcttcgaacgactcgaaaaaatctcccgccgaaattacgaaaaaaacgcgacgacaaaaaaacgaccgaccccgccgaaactcacaaaaacccaaaaatccgaccgccgaaaaaaccgcgtaaaaaaaacgaaaaaaaaacccgaactctacgaccccgaataacgaaccgaaaacgcccgtaaacaaaaacctccccgtcgac

SEQ ID NO: 33231 - DNA, 699 bp, Artificial Sequence
  chemically treated genomic DNA (Homo sapiens) CpG-island No: 33231
ttttaagagggtagatatgaatcgttttattttatagatgtaaaatcgtgattgttcgggaaaaaacgagtggttttgcgacgacgaaattttaggacgttatcgggttacgtgcggcggcgtatttggtcgttcgcgattttattcgcgtacgttttttttcgcgtttttttttagtcgtcgtcgcgtcgggtttacgtgtgtgtgtttgtgtgcggaatggggacgggggcggtgtcgtcggaggggtggggttcgggttaacgttacgggcggtgcggtttaattagcggcgggttcgcggtttcggcgttggtattggggtagcgagggggtagttttttataacgcggttttcgggagttagcggggaagaaagaaatcgagcgggcggaaggcgtttttttcgtcgtttgggttcgggtatcgggtgtcgggttcggggtttttttcgtttttcgcggtcgtcggtcgttttgttttttttgtttttgcgtttcgggcgattcgagagggtttttcgtcggggttgcgaaggggacgcggcggtagaagggcggtcgatttcgtcgggatttatagggatttaggagttcggtcgtcgggagggtcgcgtgaggagagcgaagagggagttcgagttttgcggtttcgggtggcgggtcgggggcgttcgtgagtagagattttttcgtcgat

SEQ ID NO: 33232 - DNA, 699 bp, Artificial Sequence
  chemically treated genomic DNA (Homo sapiens) CpG-island No: 33232
atcgacgaaaaaatctctactcacgaacgcccccgacccgccacccgaaaccgcaaaactcgaactccctcttcgctctcctcacgcgaccctcccgacgaccgaactcctaaatccctataaatcccgacgaaatcgaccgcccttctaccgccgcgtccccttcgcaaccccgacgaaaaaccctctcgaatcgcccgaaacgcaaaaacaaaaaaaacaaaacgaccgacgaccgcgaaaaacgaaaaaaaccccgaacccgacacccgatacccgaacccaaacgacgaaaaaaacgccttccgcccgctcgatttctttcttccccgctaactcccgaaaaccgcgttataaaaaactaccccctcgctaccccaataccaacgccgaaaccgcgaacccgccgctaattaaaccgcaccgcccgtaacgttaacccgaaccccacccctccgacgacaccgcccccgtccccattccgcacacaaacacacacacgtaaacccgacgcgacgacgactaaaaaaaaacgcgaaaaaaaacgtacgcgaataaaatcgcgaacgaccaaatacgccgccgcacgtaacccgataacgtcctaaaatttcgtcgtcgcaaaaccactcgttttttcccgaacaatcacgattttacatctataaaataaaacgattcatatctaccctcttaaaa

SEQ ID NO: 33233 - DNA, 587 bp, Artificial Sequence
  chemically treated genomic DNA (Homo sapiens) CpG-island No: 33233
ttcgagtcggttttcggttaatgtatttgtttttatcgtggcgcgaagattatttggggtgggacgaagtaggtggcgcgggaaggagagagtgagcgcgtttcgcgttcggtttcggtcgcgcgcgtgcgggattacgcggtgaagttggagggcgcgagaaggcgtagtgtttttttttttttttcgttttcgtcgtttcgggcggttttttgtaagtttcggtatacgcgcgcgttcgcgtcgcgcgcgcgttcgttcgtagtgatatattcgcgtcggttcgcgcgcgcgtagatatatatttaaatatatatatattcgttttcgtatattcggtgatacgttcgcgcgcgcgtttatttatacgttcggtcgtcggcgtttttttagttggtttatttcggcggggttcgcgttttcggttcgttcgtttgggtatcgcgtttcggggttggggtcgagcgaggagttcgcgaggcggcgagagggcgagcgttaggtaggtcggttcggggttttcgtttttcgcgttttcgttcgatggggaacgtttcgttttaaggtatgtttttgttttttttttt

SEQ ID NO: 33234 - DNA, 587 bp, Artificial Sequence
  chemically treated genomic DNA (Homo sapiens) CpG-island No: 33234
aaaaaaaaaaacaaaaacataccttaaaacgaaacgttccccatcgaacgaaaacgcgaaaaacgaaaaccccgaaccgacctacctaacgctcgccctctcgccgcctcgcgaactcctcgctcgaccccaaccccgaaacgcgatacccaaacgaacgaaccgaaaacgcgaaccccgccgaaataaaccaactaaaaaaacgccgacgaccgaacgtataaataaacgcgcgcgcgaacgtatcaccgaatatacgaaaacgaatatatatatatttaaatatatatctacgcgcgcgcgaaccgacgcgaatatatcactacgaacgaacgcgcgcgcgacgcgaacgcgcgcgtataccgaaacttacaaaaaaccgcccgaaacgacgaaaacgaaaaaaaaaaaaaaacactacgccttctcgcgccctccaacttcaccgcgtaatcccgcacgcgcgcgaccgaaaccgaacgcgaaacgcgctcactctctccttcccgcgccacctacttcgtcccaccccaaataatcttcgcgccacgataaaaacaaatacattaaccgaaaaccgactcgaa

SEQ ID NO: 33235 - DNA, 587 bp, Artificial Sequence
  chemically treated genomic DNA (Homo sapiens) CpG-island No: 33235
gaggagagagatagggatatgttttgggacggagcgttttttatcgggcgggggcgcggggggcgggggtttcgggtcggtttgtttggcgttcgttttttcgtcgtttcgcgggtttttcgttcggttttagtttcggggcgcggtgtttaggcgggcgggtcgggggcgcgggtttcgtcggggtggattagttgggagggcgtcggcggtcgggcgtgtgggtgagcgcgcgcgcgggcgtgttatcgagtgtgcgagagcgagtgtgtgtgtgtttgagtgtgtgtttgcgcgcgcgcgggtcggcgcgggtgtgttattgcgggcgggcgcgcgcgcggcgcgggcgcgcgcgtgtgtcggaatttataaagggtcgttcggggcggcgggggcgggggaggggagggggtattgcgttttttcgcgttttttagttttatcgcgtgatttcgtacgcgcgcggtcggggtcgggcgcggggcgcgtttattttttttttttcgcgttatttgtttcgttttattttaagtagttttcgcgttacgatagagataaatatattgatcgaggatcggttcgga

SEQ ID NO: 33236 - DNA, 587 bp, Artificial Sequence
  chemically treated genomic DNA (Homo sapiens) CpG-island No: 33236
tccgaaccgatcctcgatcaatatatttatctctatcgtaacgcgaaaactacttaaaataaaacgaaacaaataacgcgaaaaaaaaaaaataaacgcgccccgcgcccgaccccgaccgcgcgcgtacgaaatcacgcgataaaactaaaaaacgcgaaaaaacgcaataccccctcccctcccccgcccccgccgccccgaacgaccctttataaattccgacacacgcgcgcgcccgcgccgcgcgcgcgcccgcccgcaataacacacccgcgccgacccgcgcgcgcgcaaacacacactcaaacacacacacactcgctctcgcacactcgataacacgcccgcgcgcgcgctcacccacacgcccgaccgccgacgccctcccaactaatccaccccgacgaaacccgcgcccccgacccgcccgcctaaacaccgcgccccgaaactaaaaccgaacgaaaaacccgcgaaacgacgaaaaaacgaacgccaaacaaaccgacccgaaacccccgccccccgcgcccccgcccgataaaaaacgctccgtcccaaaacatatccctatctctctcctc

SEQ ID NO: 33237 - DNA, 641 bp, Artificial Sequence
  chemically treated genomic DNA (Homo sapiens) CpG-island No: 33237
tgcgcgttttcgaaggtggggcgcgagttcggtttttttcgtttttttagttagtgaattaacgggatttttattgggttttgtgagtggttagcggcggtttcgttttcggtagtggttattttttggcgcgtattcggggattaattttggttttattttttttttcggtttcgttttcgtttggtttcgtttttttagtcgcgttcggttcggtcgggttcgaatcgcggagttatagtgtgttttgagtagaagttgtattggggtcgggattcggaggcgcgttgcgtgagtcggtcgtagagttatggcgggcggggaagatcgcggggacggagagtcggtattagtggtgatcgtgagggtgtagtatttggaagatatcgattttttcgtatgtgttaatttttcggagtcgcgtcgggtttttatttgtagtttggacggggcgttgtttttgggcgcgtagatattcgcggtgtatcgtttgttgggagcgtcgtttaaggtgagggaggtcggagaaaggttggggcgatcgggggtttagggtgggcgttatgaaaattggtgggaggtgtttcgcgggaagaggttggagcgagtgttttttttcggaaaagttttgggttggggtt

SEQ ID NO: 33238 - DNA, 641 bp, Artificial Sequence
  chemically treated genomic DNA (Homo sapiens) CpG-island No: 33238
aaccccaacccaaaacttttccgaaaaaaaacactcgctccaacctcttcccgcgaaacacctcccaccaattttcataacgcccaccctaaacccccgatcgccccaacctttctccgacctccctcaccttaaacgacgctcccaacaaacgatacaccgcgaatatctacgcgcccaaaaacaacgccccgtccaaactacaaataaaaacccgacgcgactccgaaaaattaacacatacgaaaaaatcgatatcttccaaatactacaccctcacgatcaccactaataccgactctccgtccccgcgatcttccccgcccgccataactctacgaccgactcacgcaacgcgcctccgaatcccgaccccaatacaacttctactcaaaacacactataactccgcgattcgaacccgaccgaaccgaacgcgactaaaaaaacgaaaccaaacgaaaacgaaaccgaaaaaaaaaataaaaccaaaattaatccccgaatacgcgccaaaaaataaccactaccgaaaacgaaaccgccgctaaccactcacaaaacccaataaaaatcccgttaattcactaactaaaaaaacgaaaaaaaccgaactcgcgccccaccttcgaaaacgcgca

SEQ ID NO: 33239 - DNA, 641 bp, Artificial Sequence
  chemically treated genomic DNA (Homo sapiens) CpG-island No: 33239
gattttagtttaagattttttcggagaagaatattcgttttagttttttttcgcggagtattttttattagtttttatggcgtttattttgaattttcgatcgttttaattttttttcggttttttttattttgagcggcgtttttagtaggcggtgtatcgcgggtatttgcgcgtttaagggtagcgtttcgtttaggttgtaggtgggggttcggcgcggtttcggaaagttggtatatgcgaaggggtcggtgttttttaggtattgtatttttacggttattattgatatcggtttttcgttttcgcggtttttttcgttcgttatggttttgcggtcggtttacgtagcgcgttttcgagtttcggttttagtgtagtttttatttaaagtatattgtagtttcgcggttcgggttcggtcggatcggacgcggttggaggggcggggttagacggaggcggggtcgaggaagggggtggagttaagattagttttcgagtgcgcgttaggaggtaattattgtcggaggcggggtcgtcgttagttatttatagggtttaatgggaatttcgttagtttattggttaggagggcgggaaaaatcgagttcgcgttttattttcgagaacgcgta

SEQ ID NO: 33240 - DNA, 641 bp, Artificial Sequence
  chemically treated genomic DNA (Homo sapiens) CpG-island No: 33240
tacgcgttctcgaaaataaaacgcgaactcgatttttcccgccctcctaaccaataaactaacgaaattcccattaaaccctataaataactaacgacgaccccgcctccgacaataattacctcctaacgcgcactcgaaaactaatcttaactccacccccttcctcgaccccgcctccgtctaaccccgcccctccaaccgcgtccgatccgaccgaacccgaaccgcgaaactacaatatactttaaataaaaactacactaaaaccgaaactcgaaaacgcgctacgtaaaccgaccgcaaaaccataacgaacgaaaaaaaccgcgaaaacgaaaaaccgatatcaataataaccgtaaaaatacaatacctaaaaaacaccgaccccttcgcatataccaactttccgaaaccgcgccgaacccccacctacaacctaaacgaaacgctacccttaaacgcgcaaatacccgcgatacaccgcctactaaaaacgccgctcaaaataaaaaaaaccgaaaaaaaattaaaacgatcgaaaattcaaaataaacgccataaaaactaataaaaaatactccgcgaaaaaaaactaaaacgaatattcttctccgaaaaaatcttaaactaaaatc

SEQ ID NO: 33241 - DNA, 506 bp, Artificial Sequence
  chemically treated genomic DNA (Homo sapiens) CpG-island No: 33241
gtcgtacgcgttttagtagttgttcgcggtcgcgtacgaagttcgggtgttggaattcgacgtggtcgcgtttcggtttaagtaggtcgttttgttcgatgtttattatttttcgaaaatcgtttggggagtggggcgtgggggcgtgggtcgttttattttcggtatcgagttttttattttcgtttttcgttcggtcgtagggatttatatatgttgagttggcgtacgaagttcgttatgttgttatgtttgaaatattggggtagtatttttttggcgaaacggttttggtcgtttacgaggaaattggtttcgttttattaagaacgtcgttcgtttatcgtgcgggcggagattaggagggtgagcggtgttcgtttacggttagttttgcgttttagcgcgcgtatatatttatgtttatttttgggtttaggtttgtcgtttacggggatatgggtcgaggttaggttagaacgggtttcgaggtttagtttggagcg

SEQ ID NO: 33242 - DNA, 506 bp, Artificial Sequence
  chemically treated genomic DNA (Homo sapiens) CpG-island No: 33242
cgctccaaactaaacctcgaaacccgttctaacctaacctcgacccatatccccgtaaacgacaaacctaaacccaaaaataaacataaatatatacgcgcgctaaaacgcaaaactaaccgtaaacgaacaccgctcaccctcctaatctccgcccgcacgataaacgaacgacgttcttaataaaacgaaaccaatttcctcgtaaacgaccaaaaccgtttcgccaaaaaaatactaccccaatatttcaaacataacaacataacgaacttcgtacgccaactcaacatatataaatccctacgaccgaacgaaaaacgaaaataaaaaactcgataccgaaaataaaacgacccacgcccccacgccccactccccaaacgattttcgaaaaataataaacatcgaacaaaacgacctacttaaaccgaaacgcgaccacgtcgaattccaacacccgaacttcgtacgcgaccgcgaacaactactaaaacgcgtacgac

SEQ ID NO: 33243 - DNA, 506 bp, Artificial Sequence
  chemically treated genomic DNA (Homo sapiens) CpG-island No: 33243
cgttttaggttaggtttcggagttcgttttggtttggtttcgatttatattttcgtaagcggtaggtttggatttaagagtgagtatgagtgtgtgcgcgcgttggagcgtaggattggtcgtgagcgggtatcgtttatttttttggttttcgttcgtacggtgggcgggcggcgtttttggtagagcgggattagttttttcgtaagcgattagagtcgtttcgttaaggaagtgttgttttagtattttaagtatagtaatatggcgagtttcgtgcgttaatttaatatgtgtgagtttttacggtcgggcggggagcggggatgggggattcggtgtcggggatggggcgatttacgtttttacgttttattttttagacggttttcggaaggtggtgagtatcgagtagggcggtttgtttaggtcggagcgcgattacgtcgagttttagtattcgagtttcgtgcgcggtcgcgagtagttattggagcgcgtgcggt

SEQ ID NO: 33244 - DNA, 506 bp, Artificial Sequence
  chemically treated genomic DNA (Homo sapiens) CpG-island No: 33244
accgcacgcgctccaataactactcgcgaccgcgcacgaaactcgaatactaaaactcgacgtaatcgcgctccgacctaaacaaaccgccctactcgatactcaccaccttccgaaaaccgtctaaaaaataaaacgtaaaaacgtaaatcgccccatccccgacaccgaatcccccatccccgctccccgcccgaccgtaaaaactcacacatattaaattaacgcacgaaactcgccatattactatacttaaaatactaaaacaacacttccttaacgaaacgactctaatcgcttacgaaaaaactaatcccgctctaccaaaaacgccgcccgcccaccgtacgaacgaaaaccaaaaaaataaacgatacccgctcacgaccaatcctacgctccaacgcgcgcacacactcatactcactcttaaatccaaacctaccgcttacgaaaatataaatcgaaaccaaaccaaaacgaactccgaaacctaacctaaaacg

SEQ ID NO: 33245 - DNA, 723 bp, Artificial Sequence
  chemically treated genomic DNA (Homo sapiens) CpG-island No: 33245
ggggcgcgtttggatattttttttcgtttttttttagagcgtttacgtttacggggacgggggagagaagtcgtttaattacgttacgagcgtaggtttttagggatgcggttcgcgcgtgagtttgagggtataggtgcgtaggcgcgggtagtgcgcgcggaaggcgtttagtatcgagtggtttattacgtagaaataatgtatttcgcgtagggtcgcgtagcgcgtcgttagtttttttagcgcggcgtttagttcggtcgaagcggttgcgcgtatttcgagcgcgtatagggttgcggcgtagtggtgtgttgcgaagcgtattgggtttacggtgtcgtttgagaggttgaggcgtagcgtagttacggggacggttggttgtaggacgcgcgttacgtttttagcgggtagcgcgggttttagttttagttttattgttagtttagggtggcggcggcgtaacgcgatttaggtttcgttgggtagcggggacgcgcgtgtattttcggggtacgcgtattcgtagagttaagagcgcgaaaggcgttcggtttggcgtcgttagtgtttcgaggatggcgtgcgataaattggttaggtgtaggtcgagagcgcgtaggcgcgggtaggtttttagtagttcgagtattgagtcgggatttacgttgtttattagggtattgttgtttagaaaaaggttgtggagttcgggat

SEQ ID NO: 33246 - DNA, 723 bp, Artificial Sequence
  chemically treated genomic DNA (Homo sapiens) CpG-island No: 33246
atcccgaactccacaacctttttctaaacaacaataccctaataaacaacgtaaatcccgactcaatactcgaactactaaaaacctacccgcgcctacgcgctctcgacctacacctaaccaatttatcgcacgccatcctcgaaacactaacgacgccaaaccgaacgcctttcgcgctcttaactctacgaatacgcgtaccccgaaaatacacgcgcgtccccgctacccaacgaaacctaaatcgcgttacgccgccgccaccctaaactaacaataaaactaaaactaaaacccgcgctacccgctaaaaacgtaacgcgcgtcctacaaccaaccgtccccgtaactacgctacgcctcaacctctcaaacgacaccgtaaacccaatacgcttcgcaacacaccactacgccgcaaccctatacgcgctcgaaatacgcgcaaccgcttcgaccgaactaaacgccgcgctaaaaaaactaacgacgcgctacgcgaccctacgcgaaatacattatttctacgtaataaaccactcgatactaaacgccttccgcgcgcactacccgcgcctacgcacctataccctcaaactcacgcgcgaaccgcatccctaaaaacctacgctcgtaacgtaattaaacgacttctctcccccgtccccgtaaacgtaaacgctctaaaaaaaaacgaaaaaaaatatccaaacgcgcccc

SEQ ID NO: 33247 - DNA, 723 bp, Artificial Sequence
  chemically treated genomic DNA (Homo sapiens) CpG-island No: 33247
gtttcgagttttatagtttttttttggataatagtattttagtgggtagcgtgggtttcggtttagtgttcgagttattggaggtttgttcgcgtttgcgcgttttcggtttgtatttagttagtttgtcgtacgttattttcgaagtattggcggcgttagatcgagcgtttttcgcgtttttggttttgcgagtgcgcgtgtttcgaagatgtacgcgcgttttcgttgtttaacgaagtttgggtcgcgttgcgtcgtcgttattttgggttggtagtggagttggagttggagttcgcgttgttcgttgagagcgtgacgcgcgttttgtagttagtcgttttcgtggttgcgttgcgttttaattttttaggcgatatcgtaggtttagtgcgtttcgtagtatattattacgtcgtaattttgtgcgcgttcgaggtgcgcgtagtcgtttcggtcgagttgaacgtcgcgttggaggagttggcggcgcgttgcgcggttttgcgcgaggtgtattgtttttgcgtggtgagttattcggtgttggacgtttttcgcgcgtattgttcgcgtttgcgtatttatatttttaagtttacgcgcgagtcgtatttttggaggtttacgttcgtggcgtgattgggcgatttttttttttcgttttcgtggacgtaagcgttttgagagggaacgggggggggtgtttaggcgcgtttt

SEQ ID NO: 33248 - DNA, 723 bp, Artificial Sequence
  chemically treated genomic DNA (Homo sapiens) CpG-island No: 33248
aaaacgcgcctaaacacccccccccgttccctctcaaaacgcttacgtccacgaaaacgaaaaaaaaaaatcgcccaatcacgccacgaacgtaaacctccaaaaatacgactcgcgcgtaaacttaaaaatataaatacgcaaacgcgaacaatacgcgcgaaaaacgtccaacaccgaataactcaccacgcaaaaacaatacacctcgcgcaaaaccgcgcaacgcgccgccaactcctccaacgcgacgttcaactcgaccgaaacgactacgcgcacctcgaacgcgcacaaaattacgacgtaataatatactacgaaacgcactaaacctacgatatcgcctaaaaaattaaaacgcaacgcaaccacgaaaacgactaactacaaaacgcgcgtcacgctctcaacgaacaacgcgaactccaactccaactccactaccaacccaaaataacgacgacgcaacgcgacccaaacttcgttaaacaacgaaaacgcgcgtacatcttcgaaacacgcgcactcgcaaaaccaaaaacgcgaaaaacgctcgatctaacgccgccaatacttcgaaaataacgtacgacaaactaactaaatacaaaccgaaaacgcgcaaacgcgaacaaacctccaataactcgaacactaaaccgaaacccacgctacccactaaaatactattatccaaaaaaaaactataaaactcgaaac

SEQ ID NO: 33249 - DNA, 649 bp, Artificial Sequence
  chemically treated genomic DNA (Homo sapiens) CpG-island No: 33249
agaacggtcgagtttggggatcgttcggcgtttgatcgttcgttttcgtagagagcggcgggagttcggacgtgttgtagatgttgaagatttatcgtagcgattcgtagttgatcgtgtagttgcgattttgcgggcggtagttttgtggtcgtttttttcgcgtttatcgcgagggggcgttgcgcgtcgcgttgtagaggagtttggcggtcgcgttcgtttagtattcggtgtcgttgtaattggagttgcgcgtcggcgtcgagcggttggacgttttgttggcggacgaggagcgttgtttgagttgtattttagtttagtaggtgcggtcgggttagggttaggatggggtagggcggggattcgcggttaagtttttcgtgacggtacgttttatttttttagttcgatcggtttcgggatgaagaattggttgagttggaggatgcgttgcgaaatttgaagtgcggttcgggggttcggggtggcgacggggaggtcgtttcggtttttttgtagttttcggtgttttttttgtcggaggtgaagtcgtcgtcgtcgtcgttatttgtttagatttttttgttttagggttagtttgtaggtgaggcgtaggtggagaggcggggttattaggaggttg

SEQ ID NO: 33250 - DNA, 649 bp, Artificial Sequence
  chemically treated genomic DNA (Homo sapiens) CpG-island No: 33250
caacctcctaataaccccgcctctccacctacgcctcacctacaaactaaccctaaaacaaaaaaatctaaacaaataacgacgacgacgacgacttcacctccgacaaaaaaaacaccgaaaactacaaaaaaaccgaaacgacctccccgtcgccaccccgaacccccgaaccgcacttcaaatttcgcaacgcatcctccaactcaaccaattcttcatcccgaaaccgatcgaactaaaaaaataaaacgtaccgtcacgaaaaacttaaccgcgaatccccgccctaccccatcctaaccctaacccgaccgcacctactaaactaaaatacaactcaaacaacgctcctcgtccgccaacaaaacgtccaaccgctcgacgccgacgcgcaactccaattacaacgacaccgaatactaaacgaacgcgaccgccaaactcctctacaacgcgacgcgcaacgccccctcgcgataaacgcgaaaaaaacgaccacaaaactaccgcccgcaaaatcgcaactacacgatcaactacgaatcgctacgataaatcttcaacatctacaacacgtccgaactcccgccgctctctacgaaaacgaacgatcaaacgccgaacgatccccaaactcgaccgttct

SEQ ID NO: 33251 - DNA, 649 bp, Artificial Sequence
  chemically treated genomic DNA (Homo sapiens) CpG-island No: 33251
taattttttggtgatttcgtttttttatttgcgttttatttataggttgattttggaatagaaaagtttgggtaggtggcggcggcggcggcggttttattttcgatagagagggtatcgggggttgtaagggggtcgaagcgattttttcgtcgttatttcgggttttcgagtcgtattttagatttcgtagcgtattttttagtttagttagttttttatttcggagtcggtcgggttaggggaatggaacgtgtcgttacgggggatttaatcgcggattttcgttttattttattttgattttagttcggtcgtatttgttgggttaggatgtaatttaaatagcgtttttcgttcgttagtaaagcgtttagtcgttcggcgtcggcgcgtagttttagttgtagcggtatcgagtgttgggcgagcgcggtcgttaggtttttttgtagcgcggcgcgtagcgttttttcgcggtaggcgcggaggaagcggttatagggttgtcgttcgtagaatcgtagttgtacgattagttgcgggtcgttgcggtggatttttagtatttgtagtacgttcgggttttcgtcgttttttgcggaggcgggcggttaggcgtcgggcggtttttaagttcggtcgtttt

SEQ ID NO: 33252 - DNA, 649 bp, Artificial Sequence
  chemically treated genomic DNA (Homo sapiens) CpG-island No: 33252
aaaacgaccgaacttaaaaaccgcccgacgcctaaccgcccgcctccgcaaaaaacgacgaaaacccgaacgtactacaaatactaaaaatccaccgcaacgacccgcaactaatcgtacaactacgattctacgaacgacaaccctataaccgcttcctccgcgcctaccgcgaaaaaacgctacgcgccgcgctacaaaaaaacctaacgaccgcgctcgcccaacactcgataccgctacaactaaaactacgcgccgacgccgaacgactaaacgctttactaacgaacgaaaaacgctatttaaattacatcctaacccaacaaatacgaccgaactaaaatcaaaataaaataaaacgaaaatccgcgattaaatcccccgtaacgacacgttccattcccctaacccgaccgactccgaaataaaaaactaactaaactaaaaaatacgctacgaaatctaaaatacgactcgaaaacccgaaataacgacgaaaaaatcgcttcgacccccttacaacccccgataccctctctatcgaaaataaaaccgccgccgccgccgccacctacccaaacttttctattccaaaatcaacctataaataaaacgcaaataaaaaaacgaaatcaccaaaaaatta

SEQ ID NO: 33253 - DNA, 1204 bp, Artificial Sequence
  chemically treated genomic DNA (Homo sapiens) CpG-island No: 33253
cgcgcggagatgaggaggaggttgcgtttacgtagggacgtattgtttacgttgttttttggcgtttttttgggttttttattttatgcgtagcgcgacggcgcggtttcgacggcgagcgcgtcgcgagggcgagggagggcggtatcgaggtttattttcggatttcgcgcgttttagttattcgacgcgggtgtagtttcgtcggtttacgaaggggatatatcggcgtcgtttacgtttacgggattttttgatttcgttcgttatttgcgcgttaaggattagcggcggtttttattgtttattaattagtcgtataagtgtcgcggcgacggcgtattcggtggtcgttcggatttgtttattgttgttaagtcggtggtagaggatttcgagcggcgttaagtcgtgcgttagacgtggggcgcggagggtcgcgtgtagggggcgttggtgcgtcgcgtgtttttgttgggcgtgtttaggggcgtaggttcgggcggggtcgacgaagttggggagggcgcgcgaatttattggcgcgttttgttgcgggtcgagagttttgcgtatgcggatattttgttttgggttttcgacgatattttttttaatttaacgtttaaggagatttattttttagtttgggttttagttttttgtttcgacgtgcgtttcgtttttaagggcgacgtagatgtgttcgtgaacgtgggaaattttttggagtttttggcgtcgcgggattcggcgtaagatttgtttgttggtgacgtaattgtgtatgcgcggtttattcgtacgcgggttagtaagtattatattttcgaggtcgtgtacggtttgttcgtttattcggtttacgcgggcggcggtggttttgtgtttttcggggttacgttgtatcgtttggttggcgtttgtgcgtaggtcgagtttttttttatcgacgacgtttttttgggtatgtgtttgtagcgtttgcggtttacgttcgagttttattttgtttttcgtatttttggtattttttagtttttagtcgcgtcgtatttgagtattttcgatttttgtttttatcgtgagttggttgtagtgtacgggttttcggtcgttgatatttggtttatgtggcgtttgttgtacgggtcgtatgggttagtttgtgcgtatttatagtttgtcgttgtaggtttttttt

SEQ ID NO: 33254 - DNA, 1204 bp, Artificial Sequence
  chemically treated genomic DNA (Homo sapiens) CpG-island No: 33254
aaaaaaaacctacaacgacaaactataaatacgcacaaactaacccatacgacccgtacaacaaacgccacataaaccaaatatcaacgaccgaaaacccgtacactacaaccaactcacgataaaaacaaaaatcgaaaatactcaaatacgacgcgactaaaaactaaaaaataccaaaaatacgaaaaacaaaataaaactcgaacgtaaaccgcaaacgctacaaacacatacccaaaaaaacgtcgtcgataaaaaaaaactcgacctacgcacaaacgccaaccaaacgatacaacgtaaccccgaaaaacacaaaaccaccgccgcccgcgtaaaccgaataaacgaacaaaccgtacacgacctcgaaaatataatacttactaacccgcgtacgaataaaccgcgcatacacaattacgtcaccaacaaacaaatcttacgccgaatcccgcgacgccaaaaactccaaaaaatttcccacgttcacgaacacatctacgtcgcccttaaaaacgaaacgcacgtcgaaacaaaaaactaaaacccaaactaaaaaataaatctccttaaacgttaaattaaaaaaaatatcgtcgaaaacccaaaacaaaatatccgcatacgcaaaactctcgacccgcaacaaaacgcgccaataaattcgcgcgccctccccaacttcgtcgaccccgcccgaacctacgcccctaaacacgcccaacaaaaacacgcgacgcaccaacgccccctacacgcgaccctccgcgccccacgtctaacgcacgacttaacgccgctcgaaatcctctaccaccgacttaacaacaataaacaaatccgaacgaccaccgaatacgccgtcgccgcgacacttatacgactaattaataaacaataaaaaccgccgctaatccttaacgcgcaaataacgaacgaaatcaaaaaatcccgtaaacgtaaacgacgccgatatatccccttcgtaaaccgacgaaactacacccgcgtcgaataactaaaacgcgcgaaatccgaaaataaacctcgataccgccctccctcgccctcgcgacgcgctcgccgtcgaaaccgcgccgtcgcgctacgcataaaataaaaaacccaaaaaaacgccaaaaaacaacgtaaacaatacgtccctacgtaaacgcaacctcctcctcatctccgcgcg

SEQ ID NO: 33255 - DNA, 1204 bp, Artificial Sequence
  chemically treated genomic DNA (Homo sapiens) CpG-island No: 33255
ggaaggggtttgtagcgataggttgtggatgcgtataggttggtttatgcggttcgtgtagtaggcgttatataagttagatgttagcggtcgagagttcgtgtattataattagtttacggtaaaagtaggggtcgaaggtgtttaaatgcggcgcggttgaaggttgggggatgttaaaggtgcggaaggtagggtgaggttcgggcgtgagtcgtaggcgttgtagatatatgtttagaaagacgtcgtcgatggggaagagttcgatttgcgtataggcgttagttaggcggtgtagcgtggtttcggaaagtataaagttatcgtcgttcgcgtaggtcggataggcgggtaggtcgtatacggtttcggggatgtagtatttgttagttcgcgtgcggatgggtcgcgtatgtataattacgttattagtaagtaggttttgcgtcgggtttcgcggcgttaggaattttaggagattttttacgtttacgaatatatttgcgtcgtttttaaaaacgaagcgtacgtcggggtagaaagttgaggtttaggttagaaagtggatttttttgagcgttaggttaaaaaaggtgtcgtcgaaggtttagagtaggatgttcgtatacgtaaggttttcggttcgtagtagggcgcgttagtgggttcgcgcgttttttttaatttcgtcggtttcgttcgagtttgcgtttttgggtacgtttagtaagaatacgcggcgtattagcgttttttgtacgcgatttttcgcgttttacgtttggcgtacggtttggcgtcgttcgaagttttttgttatcgatttgatagtaataagtaggttcgggcggttatcgggtgcgtcgtcgtcgcggtatttgtgcggttggttaatgagtagtggaaatcgtcgttggtttttggcgcgtaaatagcgggcgaagttaaagggtttcgtaggcgtgggcggcgtcggtgtgtttttttcgtaggtcggcggggttgtattcgcgtcgggtaattggaacgcgcggggttcgggggtgggtttcggtgtcgttttttttcgttttcgcggcgcgttcgtcgtcggggtcgcgtcgtcgcgttgcgtatagagtaagaggtttagggaggcgttaaggagtagcgtgagtaatgcgtttttgcgtaggcgtagttttttttttattttcgcgcg

SEQ ID NO: 33256 - DNA, 1204 bp, Artificial Sequence
  chemically treated genomic DNA (Homo sapiens) CpG-island No: 33256
cgcgcgaaaataaaaaaaaaactacgcctacgcaaaaacgcattactcacgctactccttaacgcctccctaaacctcttactctatacgcaacgcgacgacgcgaccccgacgacgaacgcgccgcgaaaacgaaaaaaaacgacaccgaaacccacccccgaaccccgcgcgttccaattacccgacgcgaatacaaccccgccgacctacgaaaaaaacacaccgacgccgcccacgcctacgaaaccctttaacttcgcccgctatttacgcgccaaaaaccaacgacgatttccactactcattaaccaaccgcacaaataccgcgacgacgacgcacccgataaccgcccgaacctacttattactatcaaatcgataacaaaaaacttcgaacgacgccaaaccgtacgccaaacgtaaaacgcgaaaaatcgcgtacaaaaaacgctaatacgccgcgtattcttactaaacgtacccaaaaacgcaaactcgaacgaaaccgacgaaattaaaaaaaacgcgcgaacccactaacgcgccctactacgaaccgaaaaccttacgtatacgaacatcctactctaaaccttcgacgacaccttttttaacctaacgctcaaaaaaatccactttctaacctaaacctcaactttctaccccgacgtacgcttcgtttttaaaaacgacgcaaatatattcgtaaacgtaaaaaatctcctaaaattcctaacgccgcgaaacccgacgcaaaacctacttactaataacgtaattatacatacgcgacccatccgcacgcgaactaacaaatactacatccccgaaaccgtatacgacctacccgcctatccgacctacgcgaacgacgataactttatactttccgaaaccacgctacaccgcctaactaacgcctatacgcaaatcgaactcttccccatcgacgacgtctttctaaacatatatctacaacgcctacgactcacgcccgaacctcaccctaccttccgcacctttaacatcccccaaccttcaaccgcgccgcatttaaacaccttcgacccctacttttaccgtaaactaattataatacacgaactctcgaccgctaacatctaacttatataacgcctactacacgaaccgcataaaccaacctatacgcatccacaacctatcgctacaaaccccttcc

SEQ ID NO: 33257 - DNA, 714 bp, Artificial Sequence
  chemically treated genomic DNA (Homo sapiens) CpG-island No: 33257
ttcgtttttttatatagaaggtttttttttttcgtcggtttatttagtcgcggaagtttttgggagatttcgtttcgtttcgtttcgcggtgtttttcgcgtatttattttcgtttatttacgcggtttttttggcgggagagcgttttcggcgttttcgttaggttcggggagtgggtacggtggagttgtcgatcgttggtcgttgttttaatttacgtattgcgacgtcgcgggtgaggcgcgcggtttgcggggttcgggggtgcggcggggcggggttggcgggttgttcgggtttacggagaggacggcggcgggcgggggttgttgtagggttcgtattttgtttttcgcgtcggtagggttgtgtttcgtcgagatttgttcgggttgtggtttcgtttttcggtttttagggggcggcgcggcgttgcgcggcgtttcggcggtattgttttttttttttagcggttaggaggcggtgtttcgtgacgtcgcgcggtcgcgttgtagtggtcgtcgaggtcgtcgtttgttcgaaggttgttcgattttacggtttttcgcggttcggttcgggggcgtgagtgtcgttagcgggcgacgggggggcgcgcggtaggttttgtaataaggttagggtttgggggggtcggtaggagagcgaattcgaggtatcgtggtgttatggcggggtcgtttttacgggta

SEQ ID NO: 33258 - DNA, 714 bp, Artificial Sequence
  chemically treated genomic DNA (Homo sapiens) CpG-island No: 33258
tacccgtaaaaacgaccccgccataacaccacgatacctcgaattcgctctcctaccgacccccccaaaccctaaccttattacaaaacctaccgcgcgcccccccgtcgcccgctaacgacactcacgcccccgaaccgaaccgcgaaaaaccgtaaaatcgaacaaccttcgaacaaacgacgacctcgacgaccactacaacgcgaccgcgcgacgtcacgaaacaccgcctcctaaccgctaaaaaaaaaaaacaataccgccgaaacgccgcgcaacgccgcgccgccccctaaaaaccgaaaaacgaaaccacaacccgaacaaatctcgacgaaacacaaccctaccgacgcgaaaaacaaaatacgaaccctacaacaacccccgcccgccgccgtcctctccgtaaacccgaacaacccgccaaccccgccccgccgcacccccgaaccccgcaaaccgcgcgcctcacccgcgacgtcgcaatacgtaaattaaaacaacgaccaacgatcgacaactccaccgtacccactccccgaacctaacgaaaacgccgaaaacgctctcccgccaaaaaaaccgcgtaaataaacgaaaataaatacgcgaaaaacaccgcgaaacgaaacgaaacgaaatctcccaaaaacttccgcgactaaataaaccgacgaaaaaaaaaaaccttctatataaaaaaacgaa

SEQ ID NO: 33259 - DNA, 714 bp, Artificial Sequence
  chemically treated genomic DNA (Homo sapiens) CpG-island No: 33259
tgttcgtgggggcggtttcgttatggtattacgatgtttcgggttcgtttttttgtcggtttttttaggttttggttttgttgtagggtttatcgcgcgttttttcgtcgttcgttggcgatatttacgttttcgggtcgagtcgcggggaatcgtgaagtcggatagttttcgaatagacggcggtttcgacggttattatagcgcggtcgcgcggcgttacgggatatcgttttttggtcgttgggaagggagggtagtgtcgtcggggcgtcgcgtagcgtcgcgtcgttttttggaggtcggaggacggagttatagttcgagtaggtttcgacggggtatagttttgtcggcgcggaagataaggtgcgggttttgtagtaattttcgttcgtcgtcgtttttttcgtgggttcggatagttcgttagtttcgtttcgtcgtattttcgggtttcgtagatcgcgcgttttattcgcggcgtcgtagtgcgtgggttggggtagcgattaacggtcggtagttttatcgtgtttatttttcgggtttggcgaggacgtcggaagcgttttttcgttaggaaggtcgcgtgggtgagcgagggtgagtgcgcggggggtatcgcgggacggggcggggcggggttttttaggggttttcgcggttgaatgagtcgacgggaggggaaggttttttgtgtagggaagcggg

SEQ ID NO: 33260 - DNA, 714 bp, Artificial Sequence
  chemically treated genomic DNA (Homo sapiens) CpG-island No: 33260
cccgcttccctacacaaaaaaccttcccctcccgtcgactcattcaaccgcgaaaacccctaaaaaaccccgccccgccccgtcccgcgataccccccgcgcactcaccctcgctcacccacgcgaccttcctaacgaaaaaacgcttccgacgtcctcgccaaacccgaaaaataaacacgataaaactaccgaccgttaatcgctaccccaacccacgcactacgacgccgcgaataaaacgcgcgatctacgaaacccgaaaatacgacgaaacgaaactaacgaactatccgaacccacgaaaaaaacgacgacgaacgaaaattactacaaaacccgcaccttatcttccgcgccgacaaaactataccccgtcgaaacctactcgaactataactccgtcctccgacctccaaaaaacgacgcgacgctacgcgacgccccgacgacactaccctcccttcccaacgaccaaaaaacgatatcccgtaacgccgcgcgaccgcgctataataaccgtcgaaaccgccgtctattcgaaaactatccgacttcacgattccccgcgactcgacccgaaaacgtaaatatcgccaacgaacgacgaaaaaacgcgcgataaaccctacaacaaaaccaaaacctaaaaaaaccgacaaaaaaacgaacccgaaacatcgtaataccataacgaaaccgcccccacgaaca

SEQ ID NO: 33261 - DNA, 540 bp, Artificial Sequence
  chemically treated genomic DNA (Homo sapiens) CpG-island No: 33261
atttcgacgtgtttagggtttggaggagaacgcgtattgcgcgtcggtgttgttcgttttgagggagttgttaaattttcgcgatttcgcgttgttgggtttggaggtggttggtttgcggtaataatttttcgacgtgaggtgcggattgggggttagaagggaagagaagtcggagggcggggaggacggggttgacgcgtttttttggtgtttttgtagcgaggattacgttttcgtttttttgggtttgcgcggggatttgtttcgggagtagtatttggtcgcgtttagttttttgtaggttgcgttgtcgtcgtcgtttcgcgcgagtcgtcgcgttttttttagtttagtgttcgcgttcgcgttcgcgtcggttttttgtttgttttcggggttttgcgttcgagttttgttgttcgtagaataaattacggttgtcggacgtttgagtttgtgtgtgttggggaaggtgggatggaataaaagtgtttacgagggttgagggaatttttgtagagtgatacgtttaaagta

SEQ ID NO: 33262 - DNA, 540 bp, Artificial Sequence
  chemically treated genomic DNA (Homo sapiens) CpG-island No: 33262
tactttaaacgtatcactctacaaaaattccctcaaccctcgtaaacacttttattccatcccaccttccccaacacacacaaactcaaacgtccgacaaccgtaatttattctacgaacaacaaaactcgaacgcaaaaccccgaaaacaaacaaaaaaccgacgcgaacgcgaacgcgaacactaaactaaaaaaaacgcgacgactcgcgcgaaacgacgacgacaacgcaacctacaaaaaactaaacgcgaccaaatactactcccgaaacaaatccccgcgcaaacccaaaaaaacgaaaacgtaatcctcgctacaaaaacaccaaaaaaacgcgtcaaccccgtcctccccgccctccgacttctcttcccttctaacccccaatccgcacctcacgtcgaaaaattattaccgcaaaccaaccacctccaaacccaacaacgcgaaatcgcgaaaatttaacaactccctcaaaacgaacaacaccgacgcgcaatacgcgttctcctccaaaccctaaacacgtcgaaat

SEQ ID NO: 33263 - DNA, 540 bp, Artificial Sequence
  chemically treated genomic DNA (Homo sapiens) CpG-island No: 33263
tattttaagcgtgttattttgtaagaatttttttaattttcgtgggtatttttattttattttattttttttaatatatatagatttaggcgttcggtagtcgtggtttattttgcgagtagtagggttcgggcgtaggatttcgagggtaggtaggaggtcggcgcgagcgcgggcgcgggtattaggttgaagaggacgcggcggttcgcgcggggcgacggcggtagcgtagtttgtagggagttgagcgcggttaggtgttgttttcgggataagttttcgcgtaggtttaagagggcggagacgtggttttcgttgtaggggtattaaggaggcgcgttagtttcgtttttttcgtttttcggtttttttttttttttggtttttagttcgtattttacgtcgggaaattgttgtcgtaggttagttatttttaggtttagtagcgcggggtcgcggaggtttagtagtttttttagggcgagtagtatcggcgcgtagtgcgcgtttttttttaggttttgagtacgtcggggt

SEQ ID NO: 33264 - DNA, 540 bp, Artificial Sequence
  chemically treated genomic DNA (Homo sapiens) CpG-island No: 33264
accccgacgtactcaaaacctaaaaaaaaacgcgcactacgcgccgatactactcgccctaaaaaaactactaaacctccgcgaccccgcgctactaaacctaaaaataactaacctacgacaacaatttcccgacgtaaaatacgaactaaaaaccaaaaaaaaaaaaaaaccgaaaaacgaaaaaaacgaaactaacgcgcctccttaatacccctacaacgaaaaccacgtctccgccctcttaaacctacgcgaaaacttatcccgaaaacaacacctaaccgcgctcaactccctacaaactacgctaccgccgtcgccccgcgcgaaccgccgcgtcctcttcaacctaatacccgcgcccgcgctcgcgccgacctcctacctaccctcgaaatcctacgcccgaaccctactactcgcaaaataaaccacgactaccgaacgcctaaatctatatatattaaaaaaaataaaataaaataaaaatacccacgaaaattaaaaaaattcttacaaaataacacgcttaaaata

SEQ ID NO: 33265 - DNA, 551 bp, Artificial Sequence
  chemically treated genomic DNA (Homo sapiens) CpG-island No: 33265
tttcgcggatataggggcggggtcgtcgagggggattggttgcgggaggggtttaggttttcgtttttagttcggaatttttttttttcggttttggtaggtttcgggagtttcggttcgtgggtgtcggaagtggaggcggttggtggggttggcggggtttagcgacgttgcgcgggtggcggtttgcgaattgcgggtggattgtgtagtgatcggcgtttcgttgtttcgtttcgtggcgggtgagcgagggtgcgtggtgcgcggcggcggcggaacgaacgcggtgcgggcggggcgttcgtcgtagggtttatggttttttgcgcgagtatcgatatcgaggacgttacgtagtatttgcgggatatttttaagttggatcggttcgcgggcggtgagcgggggttgcgggggtgggttttaggcgagttgataaaagggcggcgcgcgtttgaatcgttattggggtttatagtttttttaggattagttttggattttttcggcgggtaagggtggacggggattgattgtgtttttcgaag

SEQ ID NO: 33266 - DNA, 551 bp, Artificial Sequence
  chemically treated genomic DNA (Homo sapiens) CpG-island No: 33266
cttcgaaaaacacaatcaatccccgtccacccttacccgccgaaaaaatccaaaactaatcctaaaaaaactataaaccccaataacgattcaaacgcgcgccgcccttttatcaactcgcctaaaacccacccccgcaacccccgctcaccgcccgcgaaccgatccaacttaaaaatatcccgcaaatactacgtaacgtcctcgatatcgatactcgcgcaaaaaaccataaaccctacgacgaacgccccgcccgcaccgcgttcgttccgccgccgccgcgcaccacgcaccctcgctcacccgccacgaaacgaaacaacgaaacgccgatcactacacaatccacccgcaattcgcaaaccgccacccgcgcaacgtcgctaaaccccgccaaccccaccaaccgcctccacttccgacacccacgaaccgaaactcccgaaacctaccaaaaccgaaaaaaaaaaattccgaactaaaaacgaaaacctaaacccctcccgcaaccaatccccctcgacgaccccgcccctatatccgcgaaa

SEQ ID NO: 33267 - DNA, 551 bp, Artificial Sequence
  chemically treated genomic DNA (Homo sapiens) CpG-island No: 33267
tttcgaggggtatagttaattttcgtttatttttattcgtcgggaggatttagagttagttttaagggagttgtgggttttaatggcggtttagacgcgcgtcgtttttttgttagttcgtttggggtttattttcgtaattttcgtttatcgttcgcgggtcggtttagtttgaggatgtttcgtaggtgttgcgtggcgttttcgatgtcgatgttcgcgtaggaggttatgggttttgcggcgggcgtttcgttcgtatcgcgttcgtttcgtcgtcgtcgcgtattacgtattttcgtttattcgttacggggcgagatagcgggacgtcggttattatatagtttattcgtagttcgtaaatcgttattcgcgtagcgtcgttgagtttcgttaattttattaatcgtttttattttcggtatttacgagtcgaggttttcggaatttgttagggtcggagaagaaaggtttcgggttgggggcggaagtttaaatttttttcgtagttagtttttttcggcggtttcgtttttgtgttcgcgagg

SEQ ID NO: 33268 - DNA, 551 bp, Artificial Sequence
  chemically treated genomic DNA (Homo sapiens) CpG-island No: 33268
cctcgcgaacacaaaaacgaaaccgccgaaaaaaactaactacgaaaaaaatttaaacttccgcccccaacccgaaacctttcttctccgaccctaacaaattccgaaaacctcgactcgtaaataccgaaaataaaaacgattaataaaattaacgaaactcaacgacgctacgcgaataacgatttacgaactacgaataaactatataataaccgacgtcccgctatctcgccccgtaacgaataaacgaaaatacgtaatacgcgacgacgacgaaacgaacgcgatacgaacgaaacgcccgccgcaaaacccataacctcctacgcgaacatcgacatcgaaaacgccacgcaacacctacgaaacatcctcaaactaaaccgacccgcgaacgataaacgaaaattacgaaaataaaccccaaacgaactaacaaaaaaacgacgcgcgtctaaaccgccattaaaacccacaactcccttaaaactaactctaaatcctcccgacgaataaaaataaacgaaaattaactatacccctcgaaa

SEQ ID NO: 33269 - DNA, 625 bp, Artificial Sequence
  chemically treated genomic DNA (Homo sapiens) CpG-island No: 33269
tatttttttaggagagtgttcgttttcgtttcgaagaggttgattggtaggttacgttcggagattcgttagtcgcgtagtttagtttcgggagagttcgttttcgattcgttttcgattcgtttcgtaggtttgttttggcgttagttgcgcgttgtgatgacgttacgacgttaacgttcgagaatggcggcggcggcggcggcggcggcggtcgttgttattgttcggagatggtcggtagagtcgtcgagacgtcgaagagttcgtcgttcgcgcgaggtgaggcggttcggtttaggacgacggttcgacgggcgggaggggtagtcgaattgtggtcgtggtcgttttttggcgtttcggggtttgtttttggttagtttgtagcgtcggttcgtgtttcgtgcgttagggtttatagggttggagagtaggtcgggcgatggttgttcgggttttcggcgttcgagtttggattggtttcggaacgtgttgtcgtgttggatagttcgtttttaggttcgtttgggtttggtggacgtggtcggttgttttgtttgtttgttgtttagtcgtttcgcgtttagagcgggttaggttgatttaatttggttgtttttgt

SEQ ID NO: 33270 - DNA, 625 bp, Artificial Sequence
  chemically treated genomic DNA (Homo sapiens) CpG-island No: 33270
acaaaaacaaccaaattaaatcaacctaacccgctctaaacgcgaaacgactaaacaacaaacaaacaaaacaaccgaccacgtccaccaaacccaaacgaacctaaaaacgaactatccaacacgacaacacgttccgaaaccaatccaaactcgaacgccgaaaacccgaacaaccatcgcccgacctactctccaaccctataaaccctaacgcacgaaacacgaaccgacgctacaaactaaccaaaaacaaaccccgaaacgccaaaaaacgaccacgaccacaattcgactacccctcccgcccgtcgaaccgtcgtcctaaaccgaaccgcctcacctcgcgcgaacgacgaactcttcgacgtctcgacgactctaccgaccatctccgaacaataacaacgaccgccgccgccgccgccgccgccgccattctcgaacgttaacgtcgtaacgtcatcacaacgcgcaactaacgccaaaacaaacctacgaaacgaatcgaaaacgaatcgaaaacgaactctcccgaaactaaactacgcgactaacgaatctccgaacgtaacctaccaatcaacctcttcgaaacgaaaacgaacactctcctaaaaaaata

SEQ ID NO: 33271 - DNA, 625 bp, Artificial Sequence
  chemically treated genomic DNA (Homo sapiens) CpG-island No: 33271
ataaggataattaggttggattaatttgattcgttttggacgcggggcggttgaatagtaagtaggtagggtaatcgattacgtttattaggtttaagcgggtttggagacgggttatttagtacgatagtacgtttcgaggttagtttagattcggacgtcgggaattcgagtagttatcgttcggtttgttttttaattttgtaggttttggcgtacggggtacgggtcgacgttgtaggttgattaggggtaggtttcggagcgttagaaagcgattacgattatagttcggttgtttttttcgttcgtcgggtcgtcgttttgggtcgggtcgttttatttcgcgcgggcggcgggtttttcggcgtttcggcggttttgtcggttattttcgggtaatggtagcggtcgtcgtcgtcgtcgtcgtcgtcgttattttcgggcgttagcgtcgtggcgttattatagcgcgtagttgacgttaaaataagtttacggggcgggtcgggggcgggtcgggggcggattttttcgaaattgggttacgcggttggcggattttcgagcgtggtttgttaattaattttttcggggcggggacgggtatttttttgaaggggtg

SEQ ID NO: 33272 - DNA, 625 bp, Artificial Sequence
  chemically treated genomic DNA (Homo sapiens) CpG-island No: 33272
caccccttcaaaaaaatacccgtccccgccccgaaaaaattaattaacaaaccacgctcgaaaatccgccaaccgcgtaacccaatttcgaaaaaatccgcccccgacccgcccccgacccgccccgtaaacttattttaacgtcaactacgcgctataataacgccacgacgctaacgcccgaaaataacgacgacgacgacgacgacgacgaccgctaccattacccgaaaataaccgacaaaaccgccgaaacgccgaaaaacccgccgcccgcgcgaaataaaacgacccgacccaaaacgacgacccgacgaacgaaaaaaacaaccgaactataatcgtaatcgctttctaacgctccgaaacctacccctaatcaacctacaacgtcgacccgtaccccgtacgccaaaacctacaaaattaaaaaacaaaccgaacgataactactcgaattcccgacgtccgaatctaaactaacctcgaaacgtactatcgtactaaataacccgtctccaaacccgcttaaacctaataaacgtaatcgattaccctacctacttactattcaaccgccccgcgtccaaaacgaatcaaattaatccaacctaattatccttat

SEQ ID NO: 33273 - DNA, 532 bp, Artificial Sequence
  chemically treated genomic DNA (Homo sapiens) CpG-island No: 33273
atttggttcgtcgcggtttcgtttttttttttgtttcgttttttaatggttttaatttcgtaattatttttgtcggggttttgttagttttgttttcgtatttgaagagcgtttggcgtaggatgcgagtgatcgtggttacgcggggttcgcggttcgtagataacgcgtgtagttttattttggacgttattattcgtgtggttatttcggcgttcgcggttattttagttttatagtagttgaggtaaaagggaggatcggtgtgggttagggttggacgtgcggggatcggagtgggaatcgagggggtcgtttttttttgcgtagcgggaattgggttcgggagtttataattagattttgggggtagatgaagtggattttttcgtagtttttgttcgttacgatcgaatcgttagtggttcgcgtatcggcgttttagaatgatttcgttttgaggagagggagggagtcgtagttttagtgtttgttcgatattttcggtttttttttagtttttcgttttttt

SEQ ID NO: 33274 - DNA, 532 bp, Artificial Sequence
  chemically treated genomic DNA (Homo sapiens) CpG-island No: 33274
aaaaaaacgaaaaactaaaaaaaaaccgaaaatatcgaacaaacactaaaactacgactccctccctctcctcaaaacgaaatcattctaaaacgccgatacgcgaaccactaacgattcgatcgtaacgaacaaaaactacgaaaaaatccacttcatctacccccaaaatctaattataaactcccgaacccaattcccgctacgcaaaaaaaaacgaccccctcgattcccactccgatccccgcacgtccaaccctaacccacaccgatcctcccttttacctcaactactataaaactaaaataaccgcgaacgccgaaataaccacacgaataataacgtccaaaataaaactacacgcgttatctacgaaccgcgaaccccgcgtaaccacgatcactcgcatcctacgccaaacgctcttcaaatacgaaaacaaaactaacaaaaccccgacaaaaataattacgaaattaaaaccattaaaaaacgaaacaaaaaaaaaaacgaaaccgcgacgaaccaaat

SEQ ID NO: 33275 - DNA, 532 bp, Artificial Sequence
  chemically treated genomic DNA (Homo sapiens) CpG-island No: 33275
ggagggacggggagttggaggggagtcgagagtatcgagtaggtattgaagttgcggttttttttttttttttaggacggggttattttggggcgtcgatacgcgagttattaacgattcggtcgtggcggataagagttgcgagaagatttattttatttgtttttaaaatttagttgtagattttcgagtttagttttcgttacgtaaaaaagaacggttttttcggtttttatttcggttttcgtacgtttagttttggtttatatcgatttttttttttgttttagttgttgtggggttggagtagtcgcggacgtcgagatgattatacggatggtggcgtttaagatggagttatacgcgttatttacgggtcgcgagtttcgcgtggttacggttattcgtattttgcgttagacgttttttaggtgcgggggtagggttaataggatttcggtaggggtagttacggggttggggttattggaaggcgggatagaaagaagggcgggatcgcgacgggttaggt

SEQ ID NO: 33276 - DNA, 532 bp, Artificial Sequence
  chemically treated genomic DNA (Homo sapiens) CpG-island No: 33276
acctaacccgtcgcgatcccgcccttctttctatcccgccttccaataaccccaaccccgtaactacccctaccgaaatcctattaaccctacccccgcacctaaaaaacgtctaacgcaaaatacgaataaccgtaaccacgcgaaactcgcgacccgtaaataacgcgtataactccatcttaaacgccaccatccgtataatcatctcgacgtccgcgactactccaaccccacaacaactaaaacaaaaaaaaaaatcgatataaaccaaaactaaacgtacgaaaaccgaaataaaaaccgaaaaaaccgttcttttttacgtaacgaaaactaaactcgaaaatctacaactaaattttaaaaacaaataaaataaatcttctcgcaactcttatccgccacgaccgaatcgttaataactcgcgtatcgacgccccaaaataaccccgtcctaaaaaaaaaaaaaaaaccgcaacttcaatacctactcgatactctcgactcccctccaactccccgtccctcc

SEQ ID NO: 33277 - DNA, 557 bp, Artificial Sequence
  chemically treated genomic DNA (Homo sapiens) CpG-island No: 33277
gtcgggcgcgggcgtcgggggtcgaggaaaatcgtgtttgcgcgcgtagggcggggagttagtggtagcggcgcggtttaaaaaaagttgagttcgtatcgacgtgtgcgcgtaaggtttcgggataggtgcgggcgcgggttcgggatggcggtttcgggtggtaggtttcgttgtttcgttacggttttttagaacgcgtttttatcgttcgagttatttagttcggcgcgtttttcgtagtttatttaattgagtttttcgaggttgttatagtcgtcgcgtttcggttcgtttattggtattacggtgaagtgaggtatcgtgcgggttcggtttcgtcgtattcgtcgttttagtcgttcgtcgttgttttcgtcgttgttttcgtcgtttcgggtcgatacgtttcgttcgttcgtattttttttcgttgcgtttatttttttcgttcgtttttcgggtcgtttttcgggggcggagagcgggaggggttcggtcggttttttttagagcgggggttttggtggcgggaagatttttgggcgggagtattt

SEQ ID NO: 33278 - DNA, 557 bp, Artificial Sequence
  chemically treated genomic DNA (Homo sapiens) CpG-island No: 33278
aaatactcccgcccaaaaatcttcccgccaccaaaacccccgctctaaaaaaaaccgaccgaacccctcccgctctccgcccccgaaaaacgacccgaaaaacgaacgaaaaaaataaacgcaacgaaaaaaaatacgaacgaacgaaacgtatcgacccgaaacgacgaaaacaacgacgaaaacaacgacgaacgactaaaacgacgaatacgacgaaaccgaacccgcacgatacctcacttcaccgtaataccaataaacgaaccgaaacgcgacgactataacaacctcgaaaaactcaattaaataaactacgaaaaacgcgccgaactaaataactcgaacgataaaaacgcgttctaaaaaaccgtaacgaaacaacgaaacctaccacccgaaaccgccatcccgaacccgcgcccgcacctatcccgaaaccttacgcgcacacgtcgatacgaactcaactttttttaaaccgcgccgctaccactaactccccgccctacgcgcgcaaacacgattttcctcgacccccgacgcccgcgcccgac

SEQ ID NO: 33279 - DNA, 557 bp, Artificial Sequence
  chemically treated genomic DNA (Homo sapiens) CpG-island No: 33279
gagtgttttcgtttaggggttttttcgttattagggttttcgttttgggaggagtcggtcgagtttttttcgtttttcgttttcgaggggcggttcggggggcgggcggaggaagtgagcgtagcggggaggaatgcgagcgggcggggcgtgtcggttcggggcggcggggatagcggcggggatagcggcgggcggttgggacggcgggtgcggcggggtcgagttcgtacgatgttttattttatcgtggtgttagtggacgggtcgaggcgcggcgattatgataatttcgaggggtttagttgggtggattacggggagcgcgtcgagttggatgattcggacggtgagggcgcgttttgaggggtcgtggcggggtagcggggtttgttattcggggtcgttatttcgggttcgcgttcgtatttatttcgggattttgcgcgtatacgtcggtgcggatttaattttttttggatcgcgtcgttgttattggtttttcgttttgcgcgcgtagatacgatttttttcggttttcggcgttcgcgttcggt

SEQ ID NO: 33280 - DNA, 557 bp, Artificial Sequence
  chemically treated genomic DNA (Homo sapiens) CpG-island No: 33280
accgaacgcgaacgccgaaaaccgaaaaaaatcgtatctacgcgcgcaaaacgaaaaaccaataacaacgacgcgatccaaaaaaaattaaatccgcaccgacgtatacgcgcaaaatcccgaaataaatacgaacgcgaacccgaaataacgaccccgaataacaaaccccgctaccccgccacgacccctcaaaacgcgccctcaccgtccgaatcatccaactcgacgcgctccccgtaatccacccaactaaacccctcgaaattatcataatcgccgcgcctcgacccgtccactaacaccacgataaaataaaacatcgtacgaactcgaccccgccgcacccgccgtcccaaccgcccgccgctatccccgccgctatccccgccgccccgaaccgacacgccccgcccgctcgcattcctccccgctacgctcacttcctccgcccgccccccgaaccgcccctcgaaaacgaaaaacgaaaaaaactcgaccgactcctcccaaaacgaaaaccctaataacgaaaaaacccctaaacgaaaacactc

SEQ ID NO: 33281 - DNA, 1063 bp, Artificial Sequence
  chemically treated genomic DNA (Homo sapiens) CpG-island No: 33281
tgtcgtcgatttaaaggggttcggggttggggaattggttttggtaaatagtataatttcgttcgaattttggttcgtagtaattcgattttttttttaggcggcgtttcggagggaaggcgtttagtttagcgcgaggtattacgggatttgtagttttcgtgggtatatatttatcgcgtttgcgtatcggtgaggcgcgtatcgtttcgttttacgtttttattaggattcgggttttcgtgaggagtagtttaggcgatagcgttttaatttaatacgtttttttcgttcgtcggggataagacgggttggggaaagaatttgtttttcggaggttatcgtagtgttttggaaggcggtaggaattcgtatatattcgtttcggaagtgagtcgtttttggcgcggggtattgtggggggcgtagttttttttttaggcggtttttcgcggcgttttcggggtttattttcgagcgtaggcgggtagttaggcgggcggcgcggcgcgggtcggtaggaagcgtattttgggtacggggcgtcgggcgggtcggttgcgtcgagcggtagtggtgggatattatttaaggtttcgcgcggcgtcgttcgtcgaggggcgggcggcggcgtagttattgggtcgtcgaagagcgtaggaggtcggtgggtcgggtcgggtcgcgcggcgtagttatgtttggttttacgtgttgcgtgttaggttgttataataattcgtatcgggataaggcgttgtatttttatacgtttttaaaggacgttgagttgcggcgtttttggtttaagaacgtgtcgcgtgtcggcgttagtgggtgtttttttattttttagtttattataggttatcgtttttgtagcgtttatttttagggcggtcgtaagatttatacggtacgcgtttttattattttttcgttgcgcggcgttaatgagcgtaaagtagcgcgtagattcgttggggtcgcggtcgttcgtcgtaggtagtagtagtaatagtagtagtagtagtaatagtagtaatagtagtagtagtagtaa

SEQ ID NO: 33282 - DNA, 1063 bp, Artificial Sequence
  chemically treated genomic DNA (Homo sapiens) CpG-island No: 33282
ttactactactactactattactactattactactactactactattactactactacctacgacgaacgaccgcgaccccaacgaatctacgcgctactttacgctcattaacgccgcgcaacgaaaaaataataaaaacgcgtaccgtataaatcttacgaccgccctaaaaataaacgctacaaaaacgataacctataataaactaaaaaataaaaaaacacccactaacgccgacacgcgacacgttcttaaaccaaaaacgccgcaactcaacgtcctttaaaaacgtataaaaatacaacgccttatcccgatacgaattattataacaacctaacacgcaacacgtaaaaccaaacataactacgccgcgcgacccgacccgacccaccgacctcctacgctcttcgacgacccaataactacgccgccgcccgcccctcgacgaacgacgccgcgcgaaaccttaaataatatcccaccactaccgctcgacgcaaccgacccgcccgacgccccgtacccaaaatacgcttcctaccgacccgcgccgcgccgcccgcctaactacccgcctacgctcgaaaataaaccccgaaaacgccgcgaaaaaccgcctaaaaaaaaaactacgccccccacaataccccgcgccaaaaacgactcacttccgaaacgaatatatacgaattcctaccgccttccaaaacactacgataacctccgaaaaacaaattctttccccaacccgtcttatccccgacgaacgaaaaaaacgtattaaattaaaacgctatcgcctaaactactcctcacgaaaacccgaatcctaataaaaacgtaaaacgaaacgatacgcgcctcaccgatacgcaaacgcgataaatatatacccacgaaaactacaaatcccgtaatacctcgcgctaaactaaacgccttccctccgaaacgccgcctaaaaaaaaaatcgaattactacgaaccaaaattcgaacgaaattatactatttaccaaaaccaattccccaaccccgaacccctttaaatcgacgaca

SEQ ID NO: 33283 - DNA, 1063 bp, Artificial Sequence
  chemically treated genomic DNA (Homo sapiens) CpG-island No: 33283
ttgttgttgttgttgttgttgttgttgttgttgttgttgttgttgttgttgttgttgtttgcggcgggcggtcgcggttttagcgggtttgcgcgttattttgcgtttattgacgtcgcgtagcgggaagatggtggggacgcgtatcgtgtaggttttgcggtcgttttggaagtgaacgttgtagagacggtggtttgtggtgggttggaaggtggagaagtatttattgacgtcggtacgcgatacgtttttgagttagaggcgtcgtaatttagcgttttttggaaacgtgtagaagtgtagcgttttgtttcggtgcgagttgttgtagtagtttggtacgtagtacgtaaagttaggtatggttgcgtcgcgcggttcggttcggtttatcggttttttgcgtttttcgacggtttagtggttacgtcgtcgttcgtttttcgacgggcggcgtcgcgcgaggttttgggtggtattttattattgtcgttcggcgtagtcggttcgttcggcgtttcgtgtttagaatacgttttttgtcggttcgcgtcgcgtcgttcgtttggttgttcgtttgcgttcgggagtgggtttcggggacgtcgcgaaggatcgtttgagaaagagattacgttttttataatgtttcgcgttagaagcggtttattttcggggcgggtgtgtgcggatttttgtcgttttttaaggtattgcgatagttttcgaagagtagattttttttttagttcgttttgttttcggcgggcgagagaggcgtattaggttggaacgttgtcgtttggattgttttttacgaggattcgaattttgataggggcgtggagcggggcggtgcgcgttttatcggtgcgtaagcgcggtgggtatatgtttacggagattataaatttcgtgatgtttcgcgttgaattaggcgtttttttttcgaagcgtcgtttaagggaaagatcgagttattgcggattaggattcgggcgaggttgtgttgtttgttagaattagttttttagtttcgagtttttttgagtcgacggta

SEQ ID NO: 33284 - DNA, 1063 bp, Artificial Sequence
  chemically treated genomic DNA (Homo sapiens) CpG-island No: 33284
taccgtcgactcaaaaaaactcgaaactaaaaaactaattctaacaaacaacacaacctcgcccgaatcctaatccgcaataactcgatctttcccttaaacgacgcttcgaaaaaaaaacgcctaattcaacgcgaaacatcacgaaatttataatctccgtaaacatatacccaccgcgcttacgcaccgataaaacgcgcaccgccccgctccacgcccctatcaaaattcgaatcctcgtaaaaaacaatccaaacgacaacgttccaacctaatacgcctctctcgcccgccgaaaacaaaacgaactaaaaaaaaaatctactcttcgaaaactatcgcaataccttaaaaaacgacaaaaatccgcacacacccgccccgaaaataaaccgcttctaacgcgaaacattataaaaaacgtaatctctttctcaaacgatccttcgcgacgtccccgaaacccactcccgaacgcaaacgaacaaccaaacgaacgacgcgacgcgaaccgacaaaaaacgtattctaaacacgaaacgccgaacgaaccgactacgccgaacgacaataataaaataccacccaaaacctcgcgcgacgccgcccgtcgaaaaacgaacgacgacgtaaccactaaaccgtcgaaaaacgcaaaaaaccgataaaccgaaccgaaccgcgcgacgcaaccatacctaactttacgtactacgtaccaaactactacaacaactcgcaccgaaacaaaacgctacacttctacacgtttccaaaaaacgctaaattacgacgcctctaactcaaaaacgtatcgcgtaccgacgtcaataaatacttctccaccttccaacccaccacaaaccaccgtctctacaacgttcacttccaaaacgaccgcaaaacctacacgatacgcgtccccaccatcttcccgctacgcgacgtcaataaacgcaaaataacgcgcaaacccgctaaaaccgcgaccgcccgccgcaaacaacaacaacaacaacaacaacaacaacaacaacaacaacaacaacaacaacaacaa

SEQ ID NO: 33285 - DNA, 887 bp, Artificial Sequence
  chemically treated genomic DNA (Homo sapiens) CpG-island No: 33285
gtttttagcggttttagcggtcgtgtcgagggcggtttcggggattgcgtcgtttgtttagtcgtttcgaaaaggttttggcgtagagtatgttaggggagcggtggggtttcgttattgcgatataattgttttcgtttaattttcgtcgttcgaacgttatatgttgttcgcggtcgtcgcgggtgggaggttttttcgttagttttttagataaggtcgggagggttttttttattcgcgttcgaggtaagaataagcgtcgttttcgttttttatttttcgaagcgggtacgttcgaattagcgtttgattaagttcgtcgagttatatttgtcggaggtaattcgcgtaggcgttttcgatttttatttggggtttttgtcgttaattattacggagggaaatgtcgggaggcgcgggtcgtaaaattatttcgggtcgcgtcgttcgtcgtttagcgcgggacgttatttgagtacgcggtcgcgtcggttttttttttttttttagggtaatgttaggcgcggtaattacggcgggagaagtcggtttcggttcgcgtggatatggtcgtttttttttaaatcgcgtattttttaaggtcgtcgaagcgattttaggtcgtagatttgtttttaattgaaagttgagggaattcgggttttattcgtggttggtgtttcggcggcggcgatagtttttaggttcggatgttagcgagcgtttcggggatttattttgggatagtgcgaagatttttagatttttggtttgcgtcgggttgttgtcgggagaattaaatttttagtagtttttcggttttttcgaaaaaatgtgtagtttttattatcgtgagattagcgaataattaataattatagaaa

SEQ ID NO: 33286 - DNA, 887 bp, Artificial Sequence
  chemically treated genomic DNA (Homo sapiens) CpG-island No: 33286
tttctataattattaattattcgctaatctcacgataataaaaactacacattttttcgaaaaaaccgaaaaactactaaaaatttaattctcccgacaacaacccgacgcaaaccaaaaatctaaaaatcttcgcactatcccaaaataaatccccgaaacgctcgctaacatccgaacctaaaaactatcgccgccgccgaaacaccaaccacgaataaaacccgaattccctcaactttcaattaaaaacaaatctacgacctaaaatcgcttcgacgaccttaaaaaatacgcgatttaaaaaaaaacgaccatatccacgcgaaccgaaaccgacttctcccgccgtaattaccgcgcctaacattaccctaaaaaaaaaaaaaaaaccgacgcgaccgcgtactcaaataacgtcccgcgctaaacgacgaacgacgcgacccgaaataattttacgacccgcgcctcccgacatttccctccgtaataattaacgacaaaaaccccaaataaaaatcgaaaacgcctacgcgaattacctccgacaaatataactcgacgaacttaatcaaacgctaattcgaacgtacccgcttcgaaaaataaaaaacgaaaacgacgcttattcttacctcgaacgcgaataaaaaaaaccctcccgaccttatctaaaaaactaacgaaaaaacctcccacccgcgacgaccgcgaacaacatataacgttcgaacgacgaaaattaaacgaaaacaattatatcgcaataacgaaaccccaccgctcccctaacatactctacgccaaaaccttttcgaaacgactaaacaaacgacgcaatccccgaaaccgccctcgacacgaccgctaaaaccgctaaaaac

SEQ ID NO: 33287 - DNA, 887 bp, Artificial Sequence
  chemically treated genomic DNA (Homo sapiens) CpG-island No: 33287
tttttgtggttgttggttgttcgttagttttacggtgatggaagttgtatattttttcgaagggatcgagaagttgttggaggtttggttttttcggtagtagttcgacgtaaattaaggatttggggattttcgtattattttaaggtgggttttcggggcgttcgttgatattcgggtttgggggttgtcgtcgtcgtcgaggtattagttacgggtggagttcgagtttttttagtttttagttgggggtaagtttgcggtttggggtcgtttcggcggttttggaaggtgcgcggtttgggggagagcggttatgtttacgcgggtcggagtcggtttttttcgtcgtggttgtcgcgtttggtattgttttgggggaggggaggaggtcggcgcggtcgcgtgtttaggtaacgtttcgcgttgggcggcgggcggcgcggttcggggtggttttgcggttcgcgtttttcgatattttttttcgtagtagttggcggtaggggttttaggtgggggtcgggggcgtttgcgcgggttgttttcggtaggtgtggttcggcgggtttagttaggcgttaattcgggcgtgttcgtttcggggaatggagggcgggagcggcgtttgtttttgtttcgggcgcggataggaggggttttttcggttttgtttgaggggttggcgaagaggttttttattcgcggcggtcgcgggtagtatgtggcgttcgggcggcggggattgggcgggagtagttatgtcgtagtggcggggttttatcgtttttttaatatgttttgcgttagagttttttcggggcggttgggtagacggcgtagttttcggggtcgttttcgatacggtcgttgaggtcgttgggggt

SEQ ID NO: 33288 - DNA, 887 bp, Artificial Sequence
  chemically treated genomic DNA (Homo sapiens) CpG-island No: 33288
acccccaacgacctcaacgaccgtatcgaaaacgaccccgaaaactacgccgtctacccaaccgccccgaaaaaactctaacgcaaaacatattaaaaaaacgataaaaccccgccactacgacataactactcccgcccaatccccgccgcccgaacgccacatactacccgcgaccgccgcgaataaaaaacctcttcgccaacccctcaaacaaaaccgaaaaaacccctcctatccgcgcccgaaacaaaaacaaacgccgctcccgccctccattccccgaaacgaacacgcccgaattaacgcctaactaaacccgccgaaccacacctaccgaaaacaacccgcgcaaacgcccccgacccccacctaaaacccctaccgccaactactacgaaaaaaaatatcgaaaaacgcgaaccgcaaaaccaccccgaaccgcgccgcccgccgcccaacgcgaaacgttacctaaacacgcgaccgcgccgacctcctcccctcccccaaaacaataccaaacgcgacaaccacgacgaaaaaaaccgactccgacccgcgtaaacataaccgctctcccccaaaccgcgcaccttccaaaaccgccgaaacgaccccaaaccgcaaacttacccccaactaaaaactaaaaaaactcgaactccacccgtaactaatacctcgacgacgacgacaacccccaaacccgaatatcaacgaacgccccgaaaacccaccttaaaataatacgaaaatccccaaatccttaatttacgtcgaactactaccgaaaaaaccaaacctccaacaacttctcgatcccttcgaaaaaatatacaacttccatcaccgtaaaactaacgaacaaccaacaaccacaaaaa

SEQ ID NO: 33289 - DNA, 858 bp, Artificial Sequence
  chemically treated genomic DNA (Homo sapiens) CpG-island No: 33289
gagagcggggcgtttaggtattagtcggcggaggaatttggaaatcgcgcgtcgggtagagtcgcggtcgttggaatttgggtcgtcgcgatgtagtcggtttttcgtttttagttcggatttcgtagatcgtttttttttttttagtttttatcgttaggtcgggaacggcgggggtcgtacgcgcggaggtcggaggcgcggtagcgttgggttttcggggtcgggttaggggaggtcggcgttcgtttttttttcggattttcgttcgggttttatcgcgtcgggttttattagaggtttcgcgtcgcgataggtggtatattcggcggagaggtcgcgttttgtcgttcgttttggcgatgtttagttttcgcgtcgttcggttttttttttttgcgagtttttcggagtcgtcgttagtttaggtttatattggcgcgggcggttttatacgtagaggcggttcgaagagcggtcgagagaggggagggcgcgaggagtcggttagtcgcggggttcggaaggcgtggtttacggtggagacggacgggttcgcgggttaattggaggtaggaatcggtcggaggggcgggtttcgtttggaggtttagttgtcggcgttggggtttttgtttttcgcgttttttttaatttagtttttggaggttacggttttgaggcggggcgggcggtttcgtggacgcgatgttgaggatgtgagaagtgtagtgcggaggaggaggtggagtttcgtcgttttatgaaggaagtcggggttggtcgatcgcgtttttagtatttttggttcgggggttttagttttcgaattcgcggaggttagggaagttgggagtt

SEQ ID NO: 33290 - DNA, 858 bp, Artificial Sequence
  chemically treated genomic DNA (Homo sapiens) CpG-island No: 33290
aactcccaacttccctaacctccgcgaattcgaaaactaaaacccccgaaccaaaaatactaaaaacgcgatcgaccaaccccgacttccttcataaaacgacgaaactccacctcctcctccgcactacacttctcacatcctcaacatcgcgtccacgaaaccgcccgccccgcctcaaaaccgtaacctccaaaaactaaattaaaaaaaacgcgaaaaacaaaaaccccaacgccgacaactaaacctccaaacgaaacccgcccctccgaccgattcctacctccaattaacccgcgaacccgtccgtctccaccgtaaaccacgccttccgaaccccgcgactaaccgactcctcgcgccctcccctctctcgaccgctcttcgaaccgcctctacgtataaaaccgcccgcgccaatataaacctaaactaacgacgactccgaaaaactcgcaaaaaaaaaaaaccgaacgacgcgaaaactaaacatcgccaaaacgaacgacaaaacgcgacctctccgccgaatataccacctatcgcgacgcgaaacctctaataaaacccgacgcgataaaacccgaacgaaaatccgaaaaaaaaacgaacgccgacctcccctaacccgaccccgaaaacccaacgctaccgcgcctccgacctccgcgcgtacgacccccgccgttcccgacctaacgataaaaactaaaaaaaaaaaaacgatctacgaaatccgaactaaaaacgaaaaaccgactacatcgcgacgacccaaattccaacgaccgcgactctacccgacgcgcgatttccaaattcctccgccgactaatacctaaacgccccgctctc

SEQ ID NO: 33291 - DNA, 858 bp, Artificial Sequence
  chemically treated genomic DNA (Homo sapiens) CpG-island No: 33291
aatttttagtttttttggttttcgcgggttcggagattgggattttcgggttaggagtgttgggggcgcggtcggttagtttcggttttttttatggagcggcggagttttattttttttttcgtattgtattttttatatttttagtatcgcgtttacgaggtcgttcgtttcgttttagaatcgtaatttttaggagttgggttgaggaaggcgcggaggataggaattttagcgtcggtagttaagtttttagacggagttcgttttttcggtcggtttttgtttttaattggttcgcgagttcgttcgtttttatcgtgggttacgtttttcgggtttcgcggttggtcggtttttcgcgtttttttttttttcggtcgtttttcgggtcgtttttgcgtgtggggtcgttcgcgttagtgtgagtttgagttgacggcggtttcgggaggttcgtagaaggggagggtcgggcggcgcgggagttgagtatcgttagggcgggcggtagggcgcggttttttcgtcgggtgtattatttgtcgcggcgcgagatttttggtaaggttcggcgcggtggggttcgggcgggggttcgggagaggagcgggcgtcggttttttttggttcggtttcgagagtttagcgttgtcgcgttttcggttttcgcgcgtgcggttttcgtcgttttcggtttggcggtgggggttgggggaagggaagcggtttgcggagttcgggttgagggcgagggatcggttatatcgcggcgatttaggttttagcggtcgcggttttattcggcgcgcgatttttaggttttttcgtcggttggtgtttgggcgtttcgttttt

SEQ ID NO: 33292 - DNA, 858 bp, Artificial Sequence
  chemically treated genomic DNA (Homo sapiens) CpG-island No: 33292
aaaaacgaaacgcccaaacaccaaccgacgaaaaaacctaaaaatcgcgcgccgaataaaaccgcgaccgctaaaacctaaatcgccgcgatataaccgatccctcgccctcaacccgaactccgcaaaccgcttcccttcccccaacccccaccgccaaaccgaaaacgacgaaaaccgcacgcgcgaaaaccgaaaacgcgacaacgctaaactctcgaaaccgaaccaaaaaaaaccgacgcccgctcctctcccgaacccccgcccgaaccccaccgcgccgaaccttaccaaaaatctcgcgccgcgacaaataatacacccgacgaaaaaaccgcgccctaccgcccgccctaacgatactcaactcccgcgccgcccgaccctccccttctacgaacctcccgaaaccgccgtcaactcaaactcacactaacgcgaacgaccccacacgcaaaaacgacccgaaaaacgaccgaaaaaaaaaaaaacgcgaaaaaccgaccaaccgcgaaacccgaaaaacgtaacccacgataaaaacgaacgaactcgcgaaccaattaaaaacaaaaaccgaccgaaaaaacgaactccgtctaaaaacttaactaccgacgctaaaattcctatcctccgcgccttcctcaacccaactcctaaaaattacgattctaaaacgaaacgaacgacctcgtaaacgcgatactaaaaatataaaaaatacaatacgaaaaaaaaaataaaactccgccgctccataaaaaaaaccgaaactaaccgaccgcgcccccaacactcctaacccgaaaatcccaatctccgaacccgcgaaaaccaaaaaaactaaaaatt

SEQ ID NO: 33293 - DNA, 526 bp, Artificial Sequence
  chemically treated genomic DNA (Homo sapiens) CpG-island No: 33293
  misc_feature (201)..(201): n is either a, c, g or t
gcggatatgttgcgggcgtagggttgtagttattagtagagagggagcgcggcgtttttttgttttcgtattttcgggttcgtgcgggagcgttagcgcgcgttttcggcgttgggagagcgcgattgcggaaacgtagcgttcgtcgcggagcggtttttacgtgatcggcggaggcgtcgcgtttttttaggtttatancgggggcgggagttgcggagggcgtcgggtgcggggtcgggggcgtttagcgcggggtcggttcgcgtttcggattatgttgggcggggaggtcgttttagcggcggatgtgggtttcggggtttttttggtgggttcgttcgcgtttggttttttgttggtttttagtttttaaggattttttttttttgttttttaatgcgtcggattcgtcggttttttttatttattttttatttgtttttttgtcgttcgttttgtatttacgtcgtagtggaattggtataattcgggggttttgggtattattatagaagtttaggat

SEQ ID NO: 33294 - DNA, 526 bp, Artificial Sequence
  chemically treated genomic DNA (Homo sapiens) CpG-island No: 33294
  misc_feature (326)..(326): n is either a, c, g or t
atcctaaacttctataataatacccaaaacccccgaattataccaattccactacgacgtaaatacaaaacgaacgacaaaaaaacaaataaaaaataaataaaaaaaaccgacgaatccgacgcattaaaaaacaaaaaaaaaaaatccttaaaaactaaaaaccaacaaaaaaccaaacgcgaacgaacccaccaaaaaaaccccgaaacccacatccgccgctaaaacgacctccccgcccaacataatccgaaacgcgaaccgaccccgcgctaaacgcccccgaccccgcacccgacgccctccgcaactcccgcccccgntataaacctaaaaaaacgcgacgcctccgccgatcacgtaaaaaccgctccgcgacgaacgctacgtttccgcaatcgcgctctcccaacgccgaaaacgcgcgctaacgctcccgcacgaacccgaaaatacgaaaacaaaaaaacgccgcgctccctctctactaataactacaaccctacgcccgcaacatatccgc

SEQ ID NO: 33295 - DNA, 526 bp, Artificial Sequence
  chemically treated genomic DNA (Homo sapiens) CpG-island No: 33295
  misc_feature (326)..(326): n is either a, c, g or t
gttttaagtttttatgatgatatttagggttttcgagttgtgttagttttattacggcgtggatgtaaggcgagcggtaggggagtaggtaaaggatgagtaagggaagtcggcggattcgacgtattagagaataagaaaaagaaatttttagagattgggggttaataaagagttaggcgcgggcgaatttattaggggggtttcggagtttatattcgtcgttgggacgattttttcgtttagtatggttcggggcgcggatcggtttcgcgttaggcgttttcggtttcgtattcggcgtttttcgtagttttcgttttcgntgtgaatttgggaaaacgcggcgttttcgtcggttacgtgggggtcgtttcgcggcgagcgttgcgttttcgtaatcgcgtttttttagcgtcggggacgcgcgttggcgttttcgtacgagttcggggatacggagataaggaggcgtcgcgttttttttttgttggtggttgtagttttgcgttcgtagtatgttcgt

SEQ ID NO: 33296 - DNA, 526 bp, Artificial Sequence
  chemically treated genomic DNA (Homo sapiens) CpG-island No: 33296
  misc_feature (201)..(201): n is either a, c, g or t
acgaacatactacgaacgcaaaactacaaccaccaacaaaaaaaaaacgcgacgcctccttatctccgtatccccgaactcgtacgaaaacgccaacgcgcgtccccgacgctaaaaaaacgcgattacgaaaacgcaacgctcgccgcgaaacgacccccacgtaaccgacgaaaacgccgcgttttcccaaattcacancgaaaacgaaaactacgaaaaacgccgaatacgaaaccgaaaacgcctaacgcgaaaccgatccgcgccccgaaccatactaaacgaaaaaatcgtcccaacgacgaatataaactccgaaacccccctaataaattcgcccgcgcctaactctttattaacccccaatctctaaaaatttctttttcttattctctaatacgtcgaatccgccgacttcccttactcatcctttacctactcccctaccgctcgccttacatccacgccgtaataaaactaacacaactcgaaaaccctaaatatcatcataaaaacttaaaac

SEQ ID NO: 33297 - DNA, 652 bp, Artificial Sequence
  chemically treated genomic DNA (Homo sapiens) CpG-island No: 33297
gaaggttcggtcgggcgttcgggaggaggggcggtcgcgggttataggttttaagtgtcgtttcgagagcggtcgggttcgttcgttttttgggttcgtttttttttagttttttcggatatagttaattcggggcgtcgcgttttcgtttcgtcgttcgtatagggttcgtatttgtattatgatggttattcggagcgagtttttggggatgttttcgttgtattttttgtaagaggcgcgttcgtttttggcgtattcgattcgatagagtttattcgaagatttcgttatttttttttagttgtcgttaaagtttcggaagttcgacgttacgatttagaaatacgttgtcgtttcgtcgtttcgcgtgcgtttatttagtcgtagtttttgagcggttagagtcgttatcgaatacgtcgtatcggttatcgtcgttttttgatagattgttgatgtttggtcgcgggaacgtttacggaattcgcgtttacggggcggggtcggcggcgcgcgttttttgtcggtcggggggcggagtttttcgggcgtttgtcgggtggagttttgcggtcgttgtttgggggtcgaggcggggtttgggttgagttagtagttttttggaggattcggcgttatttttttgatt

SEQ ID NO: 33298 - DNA, 652 bp, Artificial Sequence
  chemically treated genomic DNA (Homo sapiens) CpG-island No: 33298
aatcaaaaaaataacgccgaatcctccaaaaaactactaactcaacccaaaccccgcctcgacccccaaacaacgaccgcaaaactccacccgacaaacgcccgaaaaactccgccccccgaccgacaaaaaacgcgcgccgccgaccccgccccgtaaacgcgaattccgtaaacgttcccgcgaccaaacatcaacaatctatcaaaaaacgacgataaccgatacgacgtattcgataacgactctaaccgctcaaaaactacgactaaataaacgcacgcgaaacgacgaaacgacaacgtatttctaaatcgtaacgtcgaacttccgaaactttaacgacaactaaaaaaaaataacgaaatcttcgaataaactctatcgaatcgaatacgccaaaaacgaacgcgcctcttacaaaaaatacaacgaaaacatccccaaaaactcgctccgaataaccatcataatacaaatacgaaccctatacgaacgacgaaacgaaaacgcgacgccccgaattaactatatccgaaaaaactaaaaaaaaacgaacccaaaaaacgaacgaacccgaccgctctcgaaacgacacttaaaacctataacccgcgaccgcccctcctcccgaacgcccgaccgaaccttc

SEQ ID NO: 33299 - DNA, 652 bp, Artificial Sequence
  chemically treated genomic DNA (Homo sapiens) CpG-island No: 33299
aattaaaggggtggcgtcgggttttttaaagagttattagtttagtttaagtttcgtttcggtttttaggtagcggtcgtagagttttattcggtaggcgttcgggaaatttcgtttttcggtcggtagggggcgcgcgtcgtcggtttcgtttcgtggacgcgggtttcgtgggcgttttcgcggttaggtattagtaatttattagggaacggcggtggtcggtgcggcgtgttcggtggcggttttggtcgtttaagagttgcggttgggtgagcgtacgcgaggcggcgaggcggtagcgtgtttttaggtcgtggcgtcgggttttcggagttttggcggtagttaggggaggatggcggagttttcggataagttttatcgagtcgagtacgttaagagcgggcgcgttttttgtaagaaatgtagcgagagtatttttaaggattcgtttcggatggttattatggtgtaggtgcgggttttgtgcgggcggcggggcggggacgcggcgtttcgggttaattgtgttcgggaaggttgggggagggcgggtttagggagcgagcgggttcggtcgttttcggagcggtatttggggtttatggttcgcggtcgttttttttttcgagcgttcggtcgggttttt

SEQ ID NO: 33300 - DNA, 652 bp, Artificial Sequence
  chemically treated genomic DNA (Homo sapiens) CpG-island No: 33300
aaaaacccgaccgaacgctcgaaaaaaaaaacgaccgcgaaccataaaccccaaataccgctccgaaaacgaccgaacccgctcgctccctaaacccgccctcccccaaccttcccgaacacaattaacccgaaacgccgcgtccccgccccgccgcccgcacaaaacccgcacctacaccataataaccatccgaaacgaatccttaaaaatactctcgctacatttcttacaaaaaacgcgcccgctcttaacgtactcgactcgataaaacttatccgaaaactccgccatcctcccctaactaccgccaaaactccgaaaacccgacgccacgacctaaaaacacgctaccgcctcgccgcctcgcgtacgctcacccaaccgcaactcttaaacgaccaaaaccgccaccgaacacgccgcaccgaccaccgccgttccctaataaattactaatacctaaccgcgaaaacgcccacgaaacccgcgtccacgaaacgaaaccgacgacgcgcgccccctaccgaccgaaaaacgaaatttcccgaacgcctaccgaataaaactctacgaccgctacctaaaaaccgaaacgaaacttaaactaaactaataactctttaaaaaacccgacgccacccctttaatt

SEQ ID NO: 33301 - DNA, 751 bp, Artificial Sequence
  chemically treated genomic DNA (Homo sapiens) CpG-island No: 33301
  misc_feature (528)..(528): n is either a, c, g or t
ttaatattcgggaaaggcgtgttcggatcgcgaggggtcgttgggatcgagtttcggacgtcgcgacgcgtagggggttgttgcggtcggcggtttcgggaaaagtgaggggacggaggcgtttaagtaacgtgggtttcgggaattgtgagtattttattttgcgtagagttttttcgggtaatgcgatttagaatcgagggttttttttttttcgtcggggtttttttttcgttttttattcggaataaatagtttgtagttttcgtagttgtagcgcgggtcgcggaatatgcgtcgggagcggggttcgggcgggatttcggagttggtattgtttttttcgcgtttcggcgtcgggtttcgtcgtgcggttttttttttttttttttttcgttcggttcggcggaggcggcggcggaggggcgaggcgcggtttttttcggcggtatttttttttcgggtaggcgcgggcggagtcgggttcgttttagttagtcgcggcgggatagttacgcgcgtcgtttnagcgagtttcgtattcgaatttttttcgtaaagatagttttcgttttataatgtatcgcggcgggtagtttttgaaaaagcggcgcggttcgtttaagatggcggttcgattagttgtttgacgagagtgagtagtattttaaagtattttttttttttttcgtttgttgtttgtttagcggttgtatcggtcgggacggattcgtgtttttcgttgggtagg

SEQ ID NO: 33302 - DNA, 751 bp, Artificial Sequence
  chemically treated genomic DNA (Homo sapiens) CpG-island No: 33302
  misc_feature (224)..(224): n is either a, c, g or t
cctacccaacgaaaaacacgaatccgtcccgaccgatacaaccgctaaacaaacaacaaacgaaaaaaaaaaaaaatactttaaaatactactcactctcgtcaaacaactaatcgaaccgccatcttaaacgaaccgcgccgctttttcaaaaactacccgccgcgatacattataaaacgaaaactatctttacgaaaaaaattcgaatacgaaactcgctnaaacgacgcgcgtaactatcccgccgcgactaactaaaacgaacccgactccgcccgcgcctacccgaaaaaaaaataccgccgaaaaaaaccgcgcctcgcccctccgccgccgcctccgccgaaccgaacgaaaaaaaaaaaaaaaaaaaaccgcacgacgaaacccgacgccgaaacgcgaaaaaaacaataccaactccgaaatcccgcccgaaccccgctcccgacgcatattccgcgacccgcgctacaactacgaaaactacaaactatttattccgaataaaaaacgaaaaaaaaaccccgacgaaaaaaaaaaaaccctcgattctaaatcgcattacccgaaaaaactctacgcaaaataaaatactcacaattcccgaaacccacgttacttaaacgcctccgtcccctcacttttcccgaaaccgccgaccgcaacaaccccctacgcgtcgcgacgtccgaaactcgatcccaacgacccctcgcgatccgaacacgcctttcccgaatattaa

SEQ ID NO: 33303 - DNA, 751 bp, Artificial Sequence
  chemically treated genomic DNA (Homo sapiens) CpG-island No: 33303
  misc_feature (224)..(224): n is either a, c, g or t
tttgtttagcggagggtacgagttcgtttcggtcggtgtaatcgttgggtaagtagtaggcgggaaaaggggggggtgttttgaggtgttatttattttcgttaggtaattggtcgagtcgttattttgaacgagtcgcgtcgtttttttaaaggttgttcgtcgcggtgtattgtggggcggagattgtttttgcgagggaggttcgaatgcggagttcgttnagacggcgcgcgtggttgtttcgtcgcggttggttgaggcgggttcggtttcgttcgcgtttgttcggggaggaggtgtcgtcgaagggggtcgcgtttcgttttttcgtcgtcgttttcgtcgagtcgggcgggaggaagggaggaaggaggtcgtacggcgaggttcggcgtcggagcgcggggggagtagtattagtttcggagtttcgttcgggtttcgttttcggcgtatgtttcgcggttcgcgttgtagttgcgggaattgtaggttgtttgtttcgagtggagaacgggagggaggtttcggcggggggaaagaagttttcggttttgggtcgtattgttcgagggggttttacgtaaagtgaaatatttatagttttcgaaatttacgttgtttgggcgttttcgtttttttatttttttcgagatcgtcggtcgtagtagttttttgcgcgtcgcgacgttcgggattcggttttagcggtttttcgcgattcgggtacgtttttttcgaatgttgg

SEQ ID NO: 33304 - DNA, 751 bp, Artificial Sequence
  chemically treated genomic DNA (Homo sapiens) CpG-island No: 33304
  misc_feature (528)..(528): n is either a, c, g or t
ccaacattcgaaaaaaacgtacccgaatcgcgaaaaaccgctaaaaccgaatcccgaacgtcgcgacgcgcaaaaaactactacgaccgacgatctcgaaaaaaataaaaaaacgaaaacgcccaaacaacgtaaatttcgaaaactataaatatttcactttacgtaaaaccccctcgaacaatacgacccaaaaccgaaaacttctttccccccgccgaaacctccctcccgttctccactcgaaacaaacaacctacaattcccgcaactacaacgcgaaccgcgaaacatacgccgaaaacgaaacccgaacgaaactccgaaactaatactactccccccgcgctccgacgccgaacctcgccgtacgacctccttcctcccttcctcccgcccgactcgacgaaaacgacgacgaaaaaacgaaacgcgacccccttcgacgacacctcctccccgaacaaacgcgaacgaaaccgaacccgcctcaaccaaccgcgacgaaacaaccacgcgcgccgtctnaacgaactccgcattcgaacctccctcgcaaaaacaatctccgccccacaatacaccgcgacgaacaacctttaaaaaaacgacgcgactcgttcaaaataacgactcgaccaattacctaacgaaaataaataacacctcaaaacaccccccccttttcccgcctactacttacccaacgattacaccgaccgaaacgaactcgtaccctccgctaaacaaa

SEQ ID NO: 33305 - DNA, 533 bp, Artificial Sequence
  chemically treated genomic DNA (Homo sapiens) CpG-island No: 33305
tcgagtcgcgggcgtagatggtcggcggtcgttttttattcgatttgttgttgttgttgttgtagtcgtcgttttcggtgttgatgttgcgggagcgaagcggtttttagtagatcgtaaattagattgagtcggtcggtttttatttttcgtcgtattttcgcgtcgggatcggcggcgtttagggcggacgaggcgcggttagttagcgggggcggcgttcgcgggtatcgggggtatcgcgtcgtgggtgcgggggtttcggaacgtcgcggtttaggttgttattttcgcggggaatatttttgttttgtttagttggcgggagtattatttgttttttcgttatttagtcgggagttcgattcgatttacgattatattgatattattgcgagagatgttgggattatttttcgggggagggaaggaaagacgcgtgttagttttagtagtcgcggcgttttttgtaggttttggtaagtttttttgtattagtttggggggagcgggagagtgtggatgaggatgta

SEQ ID NO: 33306 - DNA, 533 bp, Artificial Sequence
  chemically treated genomic DNA (Homo sapiens) CpG-island No: 33306
tacatcctcatccacactctcccgctccccccaaactaatacaaaaaaacttaccaaaacctacaaaaaacgccgcgactactaaaactaacacgcgtctttccttccctcccccgaaaaataatcccaacatctctcgcaataatatcaatataatcgtaaatcgaatcgaactcccgactaaataacgaaaaaacaaataatactcccgccaactaaacaaaacaaaaatattccccgcgaaaataacaacctaaaccgcgacgttccgaaacccccgcacccacgacgcgatacccccgatacccgcgaacgccgcccccgctaactaaccgcgcctcgtccgccctaaacgccgccgatcccgacgcgaaaatacgacgaaaaataaaaaccgaccgactcaatctaatttacgatctactaaaaaccgcttcgctcccgcaacatcaacaccgaaaacgacgactacaacaacaacaacaacaaatcgaataaaaaacgaccgccgaccatctacgcccgcgactcga

SEQ ID NO: 33307 - DNA, 533 bp, Artificial Sequence
  chemically treated genomic DNA (Homo sapiens) CpG-island No: 33307
tgtatttttatttatattttttcgttttttttaaattagtgtaaaaaagtttgttagggtttgtagaaagcgtcgcgattgttgaggttgatacgcgtttttttttttttttttcggggaatgattttagtatttttcgtagtgatgttagtgtaatcgtgagtcggatcgggttttcggttgggtggcgggggggtagatgatgttttcgttagttgggtagagtaagggtgtttttcgcggaggtggtagtttgggtcgcggcgtttcggaattttcgtatttacggcgcggtgttttcggtgttcgcgagcgtcgttttcgttggttagtcgcgtttcgttcgttttggacgtcgtcggtttcggcgcggaggtgcggcggggagtgggagtcggtcggtttagtttgatttacggtttgttgaaaatcgtttcgttttcgtagtattagtatcggagacggcggttgtagtagtagtagtaataagtcgggtaagaggcggtcgtcggttatttgcgttcgcggttcgg

SEQ ID NO: 33308 - DNA, 533 bp, Artificial Sequence
  chemically treated genomic DNA (Homo sapiens) CpG-island No: 33308
ccgaaccgcgaacgcaaataaccgacgaccgcctcttacccgacttattactactactactacaaccgccgtctccgatactaatactacgaaaacgaaacgattttcaacaaaccgtaaatcaaactaaaccgaccgactcccactccccgccgcacctccgcgccgaaaccgacgacgtccaaaacgaacgaaacgcgactaaccaacgaaaacgacgctcgcgaacaccgaaaacaccgcgccgtaaatacgaaaattccgaaacgccgcgacccaaactaccacctccgcgaaaaacacccttactctacccaactaacgaaaacatcatctacccccccgccacccaaccgaaaacccgatccgactcacgattacactaacatcactacgaaaaatactaaaatcattccccgaaaaaaaaaaaaaaaaacgcgtatcaacctcaacaatcgcgacgctttctacaaaccctaacaaacttttttacactaatttaaaaaaaacgaaaaaatataaataaaaataca

SEQ ID NO: 33309 - DNA, 986 bp, Artificial Sequence
  chemically treated genomic DNA (Homo sapiens) CpG-island No: 33309
tgggttgggttggcggcgtgggttggtcgcggtgcgggttggcggttgttcgcgttgcgcgcgtcgtcggtcggcgtggcggtgtttttggggcgagcgttggttcgcgggtggcgcgttcgggcggtggtttttgtttcgtttcgcgggttcggggcgtttttcgtttcgttcgcgcgcgggtcgcgcgcgggcgcggtttcgcgttcgtcgtcgcgttcggttcgggttttcggttcgcggcgcgttttcgcgtttggtttcgggttggcgcgcgcgcgcgcgtcggtgtttggtttgttgtgtcgcgttggcgttcgcgtcgggttcgtttttggttcggttcgtgtgttcgtgtcgtcgtttagtggtggttggggcggtgcggttcgttttcgcgcggttgcggtgtgttttgtttgcgttcgcgttacgtcgtcgcgcgtggttcgtcggtttgttgtgggcgcgtgtgcgtgcgtttgcgtttcgcgcggttttgtcggtcgcgcgcgggttgttttgcgtcgcggtgttcggtttttttcggttcgcggtttgcgcgtttcgtttggttcgcgtggggtggcgggcgcgcggagtgcgggcgtgcgtcgtaggcgggcggcgggcggacgcgggtgggtgggtgggggtgggggcggcgtggggtcgttgcggtgtgcgcgtgtgcggggttggttggtcgaggtcggtggcgtttgtttgtcgtcgcgcgggcgcgtcggcgtttgcgcgtgggggggggcgggggggggggggagtggggggtgtggcgtgggcgcgtgggtcgggggtgggggcgcggtgcgttggcgcgttgtcgttgcgcggtgcgcgttgcgcgttgttcgtgtgcgttgtgtgcgtgtgtttgttgtttgttttgtcgttgttttgttttgcgcgtgtgtcgtgtgtatgtcgttgtttgtcgtttgtttgtttgttgttttttggtttgt

SEQ ID NO: 33310 - DNA, 986 bp, Artificial Sequence
  chemically treated genomic DNA (Homo sapiens) CpG-island No: 33310
acaaaccaaaaaacaacaaacaaacaaacgacaaacaacgacatacacacgacacacgcgcaaaacaaaacaacgacaaaacaaacaacaaacacacgcacacaacgcacacgaacaacgcgcaacgcgcaccgcgcaacgacaacgcgccaacgcaccgcgcccccacccccgacccacgcgcccacgccacaccccccactcccccccccccccgcccccccccacgcgcaaacgccgacgcgcccgcgcgacgacaaacaaacgccaccgacctcgaccaaccaaccccgcacacgcgcacaccgcaacgaccccacgccgcccccacccccacccacccacccgcgtccgcccgccgcccgcctacgacgcacgcccgcactccgcgcgcccgccaccccacgcgaaccaaacgaaacgcgcaaaccgcgaaccgaaaaaaaccgaacaccgcgacgcaaaacaacccgcgcgcgaccgacaaaaccgcgcgaaacgcaaacgcacgcacacgcgcccacaacaaaccgacgaaccacgcgcgacgacgtaacgcgaacgcaaacaaaacacaccgcaaccgcgcgaaaacgaaccgcaccgccccaaccaccactaaacgacgacacgaacacacgaaccgaaccaaaaacgaacccgacgcgaacgccaacgcgacacaacaaaccaaacaccgacgcgcgcgcgcgcgccaacccgaaaccaaacgcgaaaacgcgccgcgaaccgaaaacccgaaccgaacgcgacgacgaacgcgaaaccgcgcccgcgcgcgacccgcgcgcgaacgaaacgaaaaacgccccgaacccgcgaaacgaaacaaaaaccaccgcccgaacgcgccacccgcgaaccaacgctcgccccaaaaacaccgccacgccgaccgacgacgcgcgcaacgcgaacaaccgccaacccgcaccgcgaccaacccacgccgccaacccaaccca

SEQ ID NO: 33311 - DNA, 986 bp, Artificial Sequence
  chemically treated genomic DNA (Homo sapiens) CpG-island No: 33311
gtaagttaaggagtagtaagtaggtaagcggtaagtaacggtatgtatacggtatacgcgtagggtagggtaacggtaaggtaagtaataggtatacgtatatagcgtatacggatagcgcgtagcgcgtatcgcgtagcggtagcgcgttaacgtatcgcgtttttattttcggtttacgcgtttacgttatattttttattttttttttttttcgtttttttttacgcgtaggcgtcggcgcgttcgcgcgacggtaagtagacgttatcggtttcggttagttaatttcgtatacgcgtatatcgtaacggttttacgtcgtttttatttttatttatttattcgcgttcgttcgtcgttcgtttacggcgtacgttcgtatttcgcgcgttcgttattttacgcgagttaggcgagacgcgtaggtcgcgagtcgggaggagtcgagtatcgcggcgtaaggtagttcgcgcgcggtcggtagggtcgcgcgggacgtaggcgtacgtatacgcgtttatagtaggtcgacggattacgcgcggcggcgtggcgcgaacgtagataaagtatatcgtagtcgcgcggagacgagtcgtatcgttttagttattattgggcgacgatacgaatatacgggtcgagttagggacggattcggcgcggacgttagcgcgatatagtagattaggtatcgacgcgcgcgcgcgcgttagttcggagttaggcgcgggggcgcgtcgcgagtcgaaggttcgagtcggacgcggcggcgggcgcgaagtcgcgttcgcgcgcggttcgcgcgcggacggagcgaggagcgtttcgagttcgcgaggcggagtagaagttatcgttcgagcgcgttattcgcgagttagcgttcgttttaggagtatcgttacgtcgatcggcgacgcgcgtagcgcggatagtcgttagttcgtatcgcgattagtttacgtcgttagtttaattta

SEQ ID NO: 33312 - DNA, 986 bp, Artificial Sequence
  chemically treated genomic DNA (Homo sapiens) CpG-island No: 33312
taaattaaactaacgacgtaaactaatcgcgatacgaactaacgactatccgcgctacgcgcgtcgccgatcgacgtaacgatactcctaaaacgaacgctaactcgcgaataacgcgctcgaacgataacttctactccgcctcgcgaactcgaaacgctcctcgctccgtccgcgcgcgaaccgcgcgcgaacgcgacttcgcgcccgccgccgcgtccgactcgaaccttcgactcgcgacgcgcccccgcgcctaactccgaactaacgcgcgcgcgcgcgtcgatacctaatctactatatcgcgctaacgtccgcgccgaatccgtccctaactcgacccgtatattcgtatcgtcgcccaataataactaaaacgatacgactcgtctccgcgcgactacgatatactttatctacgttcgcgccacgccgccgcgcgtaatccgtcgacctactataaacgcgtatacgtacgcctacgtcccgcgcgaccctaccgaccgcgcgcgaactaccttacgccgcgatactcgactcctcccgactcgcgacctacgcgtctcgcctaactcgcgtaaaataacgaacgcgcgaaatacgaacgtacgccgtaaacgaacgacgaacgaacgcgaataaataaataaaaataaaaacgacgtaaaaccgttacgatatacgcgtatacgaaattaactaaccgaaaccgataacgtctacttaccgtcgcgcgaacgcgccgacgcctacgcgtaaaaaaaaacgaaaaaaaaaaaaaataaaaaatataacgtaaacgcgtaaaccgaaaataaaaacgcgatacgttaacgcgctaccgctacgcgatacgcgctacgcgctatccgtatacgctatatacgtatacctattacttaccttaccgttaccctaccctacgcgtataccgtatacataccgttacttaccgcttacctacttactactccttaacttac

SEQ ID NO: 33313 - DNA, 777 bp, Artificial Sequence
  chemically treated genomic DNA (Homo sapiens) CpG-island No: 33313
cggtcgcgtcgcgtcgtgcggttattttagtacgttatcgtattaagttgggtatttgtttatacgtttttatcgcgtattcgttgttagttttagcggtttttggtttttgtttgttattcgttatttgtagtttttttttgttcgcgttttcggagcgcgtcggggcgttttaagcgttgttttcgttagggggtatttcgcgtggtcgtagcgattcgttttaattatgaggtttcgtttagtgcgttgatacggtttttgtgcgtttttgtttcggcgtttggtggggtttcgtcgttgaacgggcgcgtcggtcgaagtttcgttttttcggagttttgtggcgtcgttttggggggttcgttttgttattcgttttggttttgtcgtgttagttttttcgtcgtttgcgcgtcgtggtgtagtcgcgtttcgcgttttcggttaggacgcgtgcgatattttgcgtgtcgttcgtcgtcgtcgttgttttcgtcgtttaggcgttttttcgtttcgttattagcgttggtagaggtcgtgttttttggcgtttttttttgcgcgttttcgtgtgtcgttcgtcgttttttattcgttgcgtgtgtcgcggcggcgtcggcgtttcgtttatattttttttcggttcgcgtgtagtacgcgcgtatgttttgcgtgtcgttttttcgttttttgggcgttatatggcgcggtcgttttttttttttcgtttcgcgggtcgttgattatcgttgtttgcgttcgtttgtattt

SEQ ID NO: 33314 - DNA, 777 bp, Artificial Sequence
  chemically treated genomic DNA (Homo sapiens) CpG-island No: 33314
aaatacaaacgaacgcaaacaacgataatcaacgacccgcgaaacgaaaaaaaaaaaacgaccgcgccatataacgcccaaaaaacgaaaaaacgacacgcaaaacatacgcgcgtactacacgcgaaccgaaaaaaaatataaacgaaacgccgacgccgccgcgacacacgcaacgaataaaaaacgacgaacgacacacgaaaacgcgcaaaaaaaaacgccaaaaaacacgacctctaccaacgctaataacgaaacgaaaaaacgcctaaacgacgaaaacaacgacgacgacgaacgacacgcaaaatatcgcacgcgtcctaaccgaaaacgcgaaacgcgactacaccacgacgcgcaaacgacgaaaaaactaacacgacaaaaccaaaacgaataacaaaacgaaccccccaaaacgacgccacaaaactccgaaaaaacgaaacttcgaccgacgcgcccgttcaacgacgaaaccccaccaaacgccgaaacaaaaacgcacaaaaaccgtatcaacgcactaaacgaaacctcataattaaaacgaatcgctacgaccacgcgaaataccccctaacgaaaacaacgcttaaaacgccccgacgcgctccgaaaacgcgaacaaaaaaaaactacaaataacgaataacaaacaaaaaccaaaaaccgctaaaactaacaacgaatacgcgataaaaacgtataaacaaatacccaacttaatacgataacgtactaaaataaccgcacgacgcgacgcgaccg

SEQ ID NO: 33315 - DNA, 777 bp, Artificial Sequence
  chemically treated genomic DNA (Homo sapiens) CpG-island No: 33315
gaatgtaaacgagcgtagatagcgatgattagcggttcgcgaggcgaaggaaaaggggcgatcgcgttatatggcgtttaaagaacgggggggcggtacgtagaatatacgcgcgtattgtacgcgagtcgaggagaggtgtggacgggacgtcggcgtcgtcgcggtatacgtaacggatagggggcggcgggcggtatacgggggcgcgtaggagggagcgttaggagatacggtttttattagcgttgatggcgaagcggagaggcgtttagacgacgggagtagcgacggcggcgggcggtacgtagagtgtcgtacgcgttttgatcgagggcgcgaaacgcggttgtattacggcgcgtaaacgacggaggggttgatacgatagggttaagacggatagtagagcgagttttttaaaacggcgttataaggtttcgggggagcggggtttcggtcggcgcgttcgtttaacggcgggattttattaagcgtcggagtaaaggcgtataaaggtcgtgttagcgtattgggcgagattttatggttggggcggatcgttgcggttacgcggggtgttttttagcgggggtagcgtttggagcgtttcgacgcgtttcgagaacgcgggtagggaagggttgtaggtggcgagtggtaggtagaggttaggggtcgttagagttggtagcgagtacgcggtaagagcgtgtgagtagatgtttagtttgatgcggtagcgtattggggtagtcgtacggcgcggcgcggtcg

SEQ ID NO: 33316 - DNA, 777 bp, Artificial Sequence
  chemically treated genomic DNA (Homo sapiens) CpG-island No: 33316
cgaccgcgccgcgccgtacgactaccccaatacgctaccgcatcaaactaaacatctactcacacgctcttaccgcgtactcgctaccaactctaacgacccctaacctctacctaccactcgccacctacaacccttccctacccgcgttctcgaaacgcgtcgaaacgctccaaacgctacccccgctaaaaaacaccccgcgtaaccgcaacgatccgccccaaccataaaatctcgcccaatacgctaacacgacctttatacgcctttactccgacgcttaataaaatcccgccgttaaacgaacgcgccgaccgaaaccccgctcccccgaaaccttataacgccgttttaaaaaactcgctctactatccgtcttaaccctatcgtatcaacccctccgtcgtttacgcgccgtaatacaaccgcgtttcgcgccctcgatcaaaacgcgtacgacactctacgtaccgcccgccgccgtcgctactcccgtcgtctaaacgcctctccgcttcgccatcaacgctaataaaaaccgtatctcctaacgctccctcctacgcgcccccgtataccgcccgccgccccctatccgttacgtataccgcgacgacgccgacgtcccgtccacacctctcctcgactcgcgtacaatacgcgcgtatattctacgtaccgcccccccgttctttaaacgccatataacgcgatcgccccttttccttcgcctcgcgaaccgctaatcatcgctatctacgctcgtttacattc

SEQ ID NO: 33317 - DNA, 572 bp, Artificial Sequence
  chemically treated genomic DNA (Homo sapiens) CpG-island No: 33317
atcgttatacgggtttttcgtataaatcgcggtttcgaaatcgggggggtagtatcgcggtttttcgcgaaaacgcgtttttttgttagtaagaagaacgtcgtcgcggtcgggcgagtattagtcggtcgcgattaaaaataagttggtcgtatcgcgttttttcgtcgcgttattatacgggcgtttttcgtttttttgaattatatattgtttcgtggtggcgatatgtttttttatagcgttggaggagaggtttatttatattggcggggggttgttacgaagataggggcgggtataaagaattacgagtttcgcgaaataaaaattatacgtttacgtttttttcgtcgtcggatgggggggtggggtgttgttggtgtgaggggggggtgggaggtgcgtttcggtaggttcggtcgtcggtcggtgcggggtatggaaggaacgggggaggtaggtttttttttcgattcggtcggcgttttcgttcgttttcgtcgtcgtttgagtgtaggaaaaataaaaatatattgagtatttatttttttttttattcgagtcggtgt

SEQ ID NO: 33318 - DNA, 572 bp, Artificial Sequence
  chemically treated genomic DNA (Homo sapiens) CpG-island No: 33318
acaccgactcgaataaaaaaaaaaataaatactcaatatatttttatttttcctacactcaaacgacgacgaaaacgaacgaaaacgccgaccgaatcgaaaaaaaaacctacctcccccgttccttccataccccgcaccgaccgacgaccgaacctaccgaaacgcacctcccacccccccctcacaccaacaacaccccacccccccatccgacgacgaaaaaaacgtaaacgtataatttttatttcgcgaaactcgtaattctttatacccgcccctatcttcgtaacaaccccccgccaatataaataaacctctcctccaacgctataaaaaaacatatcgccaccacgaaacaatatataattcaaaaaaacgaaaaacgcccgtataataacgcgacgaaaaaacgcgatacgaccaacttatttttaatcgcgaccgactaatactcgcccgaccgcgacgacgttcttcttactaacaaaaaaacgcgttttcgcgaaaaaccgcgatactacccccccgatttcgaaaccgcgatttatacgaaaaacccgtataacgat

SEQ ID NO: 33319 - DNA, 572 bp, Artificial Sequence
  chemically treated genomic DNA (Homo sapiens) CpG-island No: 33319
atatcgattcggatgaaaaagagagtaagtatttagtatgtttttgttttttttgtatttaggcggcggcgggggcgggcgaggacgtcggtcgagtcgaggaggaggtttgtttttttcgttttttttatatttcgtatcggtcggcggtcgagtttgtcgggacgtattttttattttttttttatattaataatattttatttttttattcggcggcgggaggggcgtggacgtatgatttttgtttcgcgaggttcgtagttttttatgttcgtttttgttttcgtgatagtttttcgttagtgtgggtaggttttttttttagcgttatgaaaagatatgtcgttattacgagatagtgtgtaatttagagaggcggggggcgttcgtgtggtggcgcgacgagagagcgcgatgcggttagtttgtttttggtcgcggtcgattggtgttcgttcggtcgcgacggcgttttttttattggtaaaaaaacgcgttttcgcggggggtcgcgatgttattttttcggtttcggggtcgcggtttgtgcggggggttcgtgtggcggt

SEQ ID NO: 33320 - DNA, 572 bp, Artificial Sequence
  chemically treated genomic DNA (Homo sapiens) CpG-island No: 33320
accgccacacgaaccccccgcacaaaccgcgaccccgaaaccgaaaaaataacatcgcgaccccccgcgaaaacgcgtttttttaccaataaaaaaaacgccgtcgcgaccgaacgaacaccaatcgaccgcgaccaaaaacaaactaaccgcatcgcgctctctcgtcgcgccaccacacgaacgccccccgcctctctaaattacacactatctcgtaataacgacatatcttttcataacgctaaaaaaaaaacctacccacactaacgaaaaactatcacgaaaacaaaaacgaacataaaaaactacgaacctcgcgaaacaaaaatcatacgtccacgcccctcccgccgccgaataaaaaaataaaatattattaatataaaaaaaaaataaaaaatacgtcccgacaaactcgaccgccgaccgatacgaaatataaaaaaaacgaaaaaaacaaacctcctcctcgactcgaccgacgtcctcgcccgcccccgccgccgcctaaatacaaaaaaaacaaaaacatactaaatacttactctctttttcatccgaatcgatat

SEQ ID NO: 33321 - DNA, 502 bp, Artificial Sequence
  chemically treated genomic DNA (Homo sapiens) CpG-island No: 33321
tagggttcgcgtcgtgtgagtggggggggtagcgttcgcgtcgtgtgagtagggggggtagcgttcgcgtcgtttgagtaggggagtagcgttcgcgtcgtttgagtagggggggtagcgttcgcgtcgtttgagtagggggggtagcgttcgcgtcgtttgagtagggggggtagcgttcgcgtcgtttgagtaggggggggtagcgttcgcgtcgtgtgagtagggggggtagcgttcgcgtcgtgtgagtaggggagtagcgttcgcgtcgtttgagtagggggggtagcgttcgcgtcgtttgagtagggggggtagcgttcgcgtcgtttgagtggggggggtagcgttcgcgtcgtgtgagtagggggggtagcgttcgcgtcgtttgagtagggggggtagcgttcgcgtcgtgtgagtagggaatagggtttggggtaaggaagtgggttcgtggtttttattttgtagttatggtaagaaaatcgaagagaat

SEQ ID NO: 33322 - DNA, 502 bp, Artificial Sequence
  chemically treated genomic DNA (Homo sapiens) CpG-island No: 33322
attctcttcgattttcttaccataactacaaaataaaaaccacgaacccacttccttaccccaaaccctattccctactcacacgacgcgaacgctaccccccctactcaaacgacgcgaacgctaccccccctactcacacgacgcgaacgctaccccccccactcaaacgacgcgaacgctaccccccctactcaaacgacgcgaacgctaccccccctactcaaacgacgcgaacgctactcccctactcacacgacgcgaacgctaccccccctactcacacgacgcgaacgctacccccccctactcaaacgacgcgaacgctaccccccctactcaaacgacgcgaacgctaccccccctactcaaacgacgcgaacgctaccccccctactcaaacgacgcgaacgctactcccctactcaaacgacgcgaacgctaccccccctactcacacgacgcgaacgctaccccccccactcacacgacgcgaacccta

SEQ ID NO: 33323 - DNA, 502 bp, Artificial Sequence
  chemically treated genomic DNA (Homo sapiens) CpG-island No: 33323
atttttttcggtttttttgttatgattgtagaatggaggttacgagtttatttttttgttttaagttttgttttttatttatacggcgcgagcgttgttttttttatttagacggcgcgagcgttgttttttttatttatacggcgcgagcgttgttttttttatttagacggcgcgagcgttgttttttttatttagacggcgcgagcgttgttttttttatttagacggcgcgagcgttgtttttttatttatacggcgcgagcgttgttttttttatttatacggcgcgagcgttgtttttttttatttagacggcgcgagcgttgttttttttatttagacggcgcgagcgttgttttttttatttagacggcgcgagcgttgttttttttatttagacggcgcgagcgttgtttttttatttagacggcgcgagcgttgttttttttatttatacggcgcgagcgttgttttttttatttatacggcgcgagttttg

SEQ ID NO: 33324 - DNA, 502 bp, Artificial Sequence
  chemically treated genomic DNA (Homo sapiens) CpG-island No: 33324
caaaactcgcgccgtataaataaaaaaaacaacgctcgcgccgtataaataaaaaaaacaacgctcgcgccgtctaaataaaaaaacaacgctcgcgccgtctaaataaaaaaaacaacgctcgcgccgtctaaataaaaaaaacaacgctcgcgccgtctaaataaaaaaaacaacgctcgcgccgtctaaataaaaaaaaacaacgctcgcgccgtataaataaaaaaaacaacgctcgcgccgtataaataaaaaaacaacgctcgcgccgtctaaataaaaaaaacaacgctcgcgccgtctaaataaaaaaaacaacgctcgcgccgtctaaataaaaaaaacaacgctcgcgccgtataaataaaaaaaacaacgctcgcgccgtctaaataaaaaaaacaacgctcgcgccgtataaataaaaaacaaaacttaaaacaaaaaaataaactcgtaacctccattctacaatcataacaaaaaaaccgaaaaaaat

SEQ ID NO: 33325 - DNA, 708 bp, Artificial Sequence
  chemically treated genomic DNA (Homo sapiens) CpG-island No: 33325
cgcgtcgtttgagtagggggggtagcgttcgcgtcgtgtgagtagggggggtagcgttcgcgtcgtttgagtagggggggtagcgttcgcgtcgtttgagtagggggggtagcgttcgcgtcgtttgagtggggggggtagcgttcgcgtcgtttgaggggggggtagcgttcgcgtcgtttgagtagggggggtagcgttcgcgtcgtttgagtagggggggtagcgttcgcgtcgtttgagtagggggggtagcgttcgcgtcgtttgagtagggggggtagcgttcgcgtcgtttgagtagggggggtagcgttcgcgtcgtttgagtaggggaggtagggttcgcgtcgtgtgagtagggggggtagcgttcgcgtcgtgtgagtaggggaggtagggttcgcgtcgtttgagtagggggggtagcgttcgcgtcgtttgagtagggggggtagcgttcgcgtcgtgtgagtagggggggtagcgttcgcgtcgtttgagtagggggggtagcgttcgcgtcggtgagtagggggggtagcgttcgcgtcgtttgagtagggggggtagacgttcgcgtcgtttgagtagggggggtagcgttcgcgtcgtttagagtggggggggtagcgttcgcgtcgtttgaggggggggtagcgttcgacgcgtttgagtagggggggtagagttcgcgtcgtttagagt

SEQ ID NO: 33326 - DNA, 708 bp, Artificial Sequence
  chemically treated genomic DNA (Homo sapiens) CpG-island No: 33326
actctaaacgacgcgaactctaccccccctactcaaacgcgtcgaacgctacccccccctcaaacgacgcgaacgctaccccccccactctaaacgacgcgaacgctaccccccctactcaaacgacgcgaacgtctaccccccctactcaaacgacgcgaacgctaccccccctactcaccgacgcgaacgctaccccccctactcaaacgacgcgaacgctaccccccctactcacacgacgcgaacgctaccccccctactcaaacgacgcgaacgctaccccccctactcaaacgacgcgaaccctacctcccctactcacacgacgcgaacgctaccccccctactcacacgacgcgaaccctacctcccctactcaaacgacgcgaacgctaccccccctactcaaacgacgcgaacgctaccccccctactcaaacgacgcgaacgctaccccccctactcaaacgacgcgaacgctaccccccctactcaaacgacgcgaacgctaccccccctactcaaacgacgcgaacgctacccccccctcaaacgacgcgaacgctaccccccccactcaaacgacgcgaacgctaccccccctactcaaacgacgcgaacgctaccccccctactcaaacgacgcgaacgctaccccccctactcacacgacgcgaacgctaccccccctactcaaacgacgcg

SEQ ID NO: 33327 - DNA, 708 bp, Artificial Sequence
  chemically treated genomic DNA (Homo sapiens) CpG-island No: 33327
attttagacggcgcgagttttgttttttttatttagacgcgtcgagcgttgttttttttttagacggcgcgagcgttgttttttttattttagacggcgcgagcgttgttttttttatttagacggcgcgagcgtttgttttttttatttagacggcgcgagcgttgttttttttatttatcggcgcgagcgttgttttttttatttagacggcgcgagcgttgttttttttatttatacggcgcgagcgttgttttttttatttagacggcgcgagcgttgttttttttatttagacggcgcgagttttgttttttttatttatacggcgcgagcgttgttttttttatttatacggcgcgagttttgttttttttatttagacggcgcgagcgttgttttttttatttagacggcgcgagcgttgttttttttatttagacggcgcgagcgttgttttttttatttagacggcgcgagcgttgttttttttatttagacggcgcgagcgttgttttttttatttagacggcgcgagcgttgttttttttttagacggcgcgagcgttgttttttttatttagacggcgcgagcgttgttttttttatttagacggcgcgagcgttgttttttttatttagacggcgcgagcgttgttttttttatttatacggcgcgagcgttgttttttttatttagacggcgcg

SEQ ID NO: 33328 - DNA, 708 bp, Artificial Sequence
  chemically treated genomic DNA (Homo sapiens) CpG-island No: 33328
cgcgccgtctaaataaaaaaaacaacgctcgcgccgtataaataaaaaaaacaacgctcgcgccgtctaaataaaaaaaacaacgctcgcgccgtctaaataaaaaaaacaacgctcgcgccgtctaaataaaaaaaacaacgctcgcgccgtctaaaaaaaaaacaacgctcgcgccgtctaaataaaaaaaacaacgctcgcgccgtctaaataaaaaaaacaacgctcgcgccgtctaaataaaaaaaacaacgctcgcgccgtctaaataaaaaaaacaacgctcgcgccgtctaaataaaaaaaacaacgctcgcgccgtctaaataaaaaaaacaaaactcgcgccgtataaataaaaaaaacaacgctcgcgccgtataaataaaaaaaacaaaactcgcgccgtctaaataaaaaaaacaacgctcgcgccgtctaaataaaaaaaacaacgctcgcgccgtataaataaaaaaaacaacgctcgcgccgtctaaataaaaaaaacaacgctcgcgccgataaataaaaaaaacaacgctcgcgccgtctaaataaaaaaaacaaacgctcgcgccgtctaaataaaaaaaacaacgctcgcgccgtctaaaataaaaaaaacaacgctcgcgccgtctaaaaaaaaaacaacgctcgacgcgtctaaataaaaaaaacaaaactcgcgccgtctaaaat

SEQ ID NO: 33329 - DNA, 608 bp, Artificial Sequence
  chemically treated genomic DNA (Homo sapiens) CpG-island No: 33329
ggcgtatcggcgacgcgtgcgtagtgtagtgcggcgttttttgtaggtagcgcgtaggagacggtagcggcgaaggggcgtttagtgcgtttgcgcgtttgtggagttggtggcggcgtttcgtaggggttcggttgtttttcgcgcggtaggcgcggttatggcgtagttgggaaagttgtttaaggagtagaagtacgatcggtagttgaggtgagtcgaggtttatcgagtcgagggcgggtcggcgggttttttagtattcgggtcgggtttaagggcgcgggcggcgcggtcgggttttttttaggtttttttttaggttgggtcgggtcgtgcggggcgcgggaagtcggcgttcggagttttcgttttgggttaaaggtgtttcgcgagggttgggattttttttttcgttacgcggtgtgtagttcgggggacggggtttttagcgttagtcgggtagttaaggcggttgtcggtttcgttgcgtttaggtttttcgtttttcgaatggggaggttcggggcgtatcgtatttcggtcgcgagggcggtatagagggttaggttttgtttttagttagcgttgtttaatggaaataaaat

SEQ ID NO: 33330 - DNA, 608 bp, Artificial Sequence
  chemically treated genomic DNA (Homo sapiens) CpG-island No: 33330
attttatttccattaaacaacgctaactaaaaacaaaacctaaccctctataccgccctcgcgaccgaaatacgatacgccccgaacctccccattcgaaaaacgaaaaacctaaacgcaacgaaaccgacaaccgccttaactacccgactaacgctaaaaaccccgtcccccgaactacacaccgcgtaacgaaaaaaaaaatcccaaccctcgcgaaacacctttaacccaaaacgaaaactccgaacgccgacttcccgcgccccgcacgacccgacccaacctaaaaaaaaacctaaaaaaaacccgaccgcgccgcccgcgcccttaaacccgacccgaatactaaaaaacccgccgacccgccctcgactcgataaacctcgactcacctcaactaccgatcgtacttctactccttaaacaactttcccaactacgccataaccgcgcctaccgcgcgaaaaacaaccgaacccctacgaaacgccgccaccaactccacaaacgcgcaaacgcactaaacgccccttcgccgctaccgtctcctacgcgctacctacaaaaaacgccgcactacactacgcacgcgtcgccgatacgcc

SEQ ID NO: 33331 - DNA, 608 bp, Artificial Sequence
  chemically treated genomic DNA (Homo sapiens) CpG-island No: 33331
attttatttttattggatagcgttggttgagaataaaatttaattttttgtgtcgttttcgcggtcgggatgcggtgcgtttcgggtttttttattcggaaaacgaggagtttgggcgtaacggggtcggtagtcgttttagttattcggttggcgttggggatttcgtttttcgaattgtatatcgcgtggcgggggaaggggttttagttttcgcggagtatttttggtttagggcgggagtttcgagcgtcggtttttcgcgtttcgtacggttcggtttagtttggaagaaggtttgaggaaggttcgatcgcgtcgttcgcgtttttaggttcggttcgaatgttggaaagttcgtcggttcgttttcggttcggtgagtttcggtttattttagttgtcggtcgtatttttgttttttgagtagtttttttagttgcgttatggtcgcgtttgtcgcgcggaaaatagtcgagtttttgcggagcgtcgttattagttttataagcgcgtaggcgtattgagcgttttttcgtcgttatcgttttttgcgcgttgtttgtagggggcgtcgtattgtattgcgtacgcgtcgtcggtacgtt

SEQ ID NO: 33332 - DNA, 608 bp, Artificial Sequence
  chemically treated genomic DNA (Homo sapiens) CpG-island No: 33332
aacgtaccgacgacgcgtacgcaatacaatacgacgccccctacaaacaacgcgcaaaaaacgataacgacgaaaaaacgctcaatacgcctacgcgcttataaaactaataacgacgctccgcaaaaactcgactattttccgcgcgacaaacgcgaccataacgcaactaaaaaaactactcaaaaaacaaaaatacgaccgacaactaaaataaaccgaaactcaccgaaccgaaaacgaaccgacgaactttccaacattcgaaccgaacctaaaaacgcgaacgacgcgatcgaaccttcctcaaaccttcttccaaactaaaccgaaccgtacgaaacgcgaaaaaccgacgctcgaaactcccgccctaaaccaaaaatactccgcgaaaactaaaaccccttcccccgccacgcgatatacaattcgaaaaacgaaatccccaacgccaaccgaataactaaaacgactaccgaccccgttacgcccaaactcctcgttttccgaataaaaaaacccgaaacgcaccgcatcccgaccgcgaaaacgacacaaaaaattaaattttattctcaaccaacgctatccaataaaaataaaat

SEQ ID NO: 33333 - DNA, 901 bp, Artificial Sequence
  chemically treated genomic DNA (Homo sapiens) CpG-island No: 33333
gttttttttatacgggggttttgtttataaggaggtcgtagtagttttcgagtgatttcggtgtaaatttgtagagaaaaattattttattttacggaagcgggtggaggagtcgcgtttttcggtaggttacgtggggcggaaagatttatttagttttttcgtattttcgtttcgatttaggaaaacgttttggggaattttagttttgaaaaggcgcgttttattttttacgtcgggtgttggcgataaggtttagtgaaaaagcgtttcggggtcgttcgcgcggaggggaaagtgttgagggaagttaaggaattcgcgtttgcggtcgtcggaaacgtggcggggatacgattttcgcgtcggggttattttgtttattgttgaggaggtttttcgttacgtttcgttttcgtttttttcgaggatcgggcgcggtggcgtttttggtttatagtaggaaggaaggggtagtaatttacgttattaattttgtttttttgagcggcgcgcgttcgtttatcggtttcgttgttgtcgtagtcgttatcgtcgttacgcgtattttcgggttggtgaacgcggtgacgttattaacgtatatgggttggcggcgaatgggaagtcgcggcggggcgagggcgagtgcgggggcggggttcggatcgaagggttttcgtttttcgtcgtttttttttatcgtgaggcgaattttagtcggttttttagtttcgtcgaggttcgttggggcgaagcggagtttcggggggttttgaggaaatcggcgcgggttcgtttaattacgtttttttcgttagatttttggttggttttgagttgtttagaagtttatttgcgcggtatgttcgtgcgatttgagataattggtagttgtttt

SEQ ID NO: 33334 - DNA, 901 bp, Artificial Sequence
  chemically treated genomic DNA (Homo sapiens) CpG-island No: 33334
aaaacaactaccaattatctcaaatcgcacgaacataccgcgcaaataaacttctaaacaactcaaaaccaaccaaaaatctaacgaaaaaaacgtaattaaacgaacccgcgccgatttcctcaaaaccccccgaaactccgcttcgccccaacgaacctcgacgaaactaaaaaaccgactaaaattcgcctcacgataaaaaaaaacgacgaaaaacgaaaacccttcgatccgaaccccgcccccgcactcgccctcgccccgccgcgacttcccattcgccgccaacccatatacgttaataacgtcaccgcgttcaccaacccgaaaatacgcgtaacgacgataacgactacgacaacaacgaaaccgataaacgaacgcgcgccgctcaaaaaaacaaaattaataacgtaaattactaccccttccttcctactataaaccaaaaacgccaccgcgcccgatcctcgaaaaaaacgaaaacgaaacgtaacgaaaaacctcctcaacaataaacaaaataaccccgacgcgaaaatcgtatccccgccacgtttccgacgaccgcaaacgcgaattccttaacttccctcaacactttcccctccgcgcgaacgaccccgaaacgctttttcactaaaccttatcgccaacacccgacgtaaaaaataaaacgcgccttttcaaaactaaaattccccaaaacgttttcctaaatcgaaacgaaaatacgaaaaaactaaataaatctttccgccccacgtaacctaccgaaaaacgcgactcctccacccgcttccgtaaaataaaataatttttctctacaaatttacaccgaaatcactcgaaaactactacgacctccttataaacaaaacccccgtataaaaaaaac

SEQ ID NO: 33335 - DNA, 901 bp, Artificial Sequence
  chemically treated genomic DNA (Homo sapiens) CpG-island No: 33335
aagatagttgttagttgttttagatcgtacgggtatgtcgcgtagatgggtttttgagtagtttagggttagttagaggtttggcgagaagggcgtaattaaacgaattcgcgtcggtttttttagggtttttcggggtttcgtttcgttttagcgggtttcggcggggttgggaaatcggttgaggttcgttttacggtggggaggagcgacgggaggcggaagtttttcggttcgggtttcgttttcgtattcgttttcgtttcgtcgcgattttttattcgtcgttaatttatgtgcgttggtgacgttatcgcgtttattagttcggaagtgcgcgtggcggcggtggcggttgcggtaatagcggggtcggtaagcgggcgcgcgtcgtttagaggggtagagttggtggcgtgagttgttgtttttttttttttgttgtgggttagaggcgttatcgcgttcggttttcgaggaagacgggagcgggacgtggcgagaggtttttttagtagtgggtaaaatagtttcgacgcggaggtcgtgttttcgttacgttttcggcgatcgtaggcgcggattttttggttttttttagtattttttttttcgcgcggacggtttcgagacgtttttttattgggttttgtcgttagtattcggcgtggggggtgagacgcgtttttttagggttggggttttttagagcgtttttttaagtcgaggcggaggtgcgaggaaattgagtgggttttttcgttttacgtggtttgtcgggaagcgcggtttttttattcgttttcgtggaatggaatggtttttttttgtaggtttatatcggggttattcgagagttgttgcggtttttttatgggtaggattttcgtatggggagaat

SEQ ID NO: 33336 - DNA, 901 bp, Artificial Sequence
  chemically treated genomic DNA (Homo sapiens) CpG-island No: 33336
attctccccatacgaaaatcctacccataaaaaaaccgcaacaactctcgaataaccccgatataaacctacaaaaaaaaaccattccattccacgaaaacgaataaaaaaaccgcgcttcccgacaaaccacgtaaaacgaaaaaacccactcaatttcctcgcacctccgcctcgacttaaaaaaacgctctaaaaaaccccaaccctaaaaaaacgcgtctcaccccccacgccgaatactaacgacaaaacccaataaaaaaacgtctcgaaaccgtccgcgcgaaaaaaaaaatactaaaaaaaaccaaaaaatccgcgcctacgatcgccgaaaacgtaacgaaaacacgacctccgcgtcgaaactattttacccactactaaaaaaacctctcgccacgtcccgctcccgtcttcctcgaaaaccgaacgcgataacgcctctaacccacaacaaaaaaaaaaaaacaacaactcacgccaccaactctacccctctaaacgacgcgcgcccgcttaccgaccccgctattaccgcaaccgccaccgccgccacgcgcacttccgaactaataaacgcgataacgtcaccaacgcacataaattaacgacgaataaaaaatcgcgacgaaacgaaaacgaatacgaaaacgaaacccgaaccgaaaaacttccgcctcccgtcgctcctccccaccgtaaaacgaacctcaaccgatttcccaaccccgccgaaacccgctaaaacgaaacgaaaccccgaaaaaccctaaaaaaaccgacgcgaattcgtttaattacgcccttctcgccaaacctctaactaaccctaaactactcaaaaacccatctacgcgacatacccgtacgatctaaaacaactaacaactatctt

SEQ ID NO: 33337 - DNA, 804 bp, Artificial Sequence
  chemically treated genomic DNA (Homo sapiens) CpG-island No: 33337
  misc_feature (536)..(536): n is either a, c, g or t
  misc_feature (598)..(598): n is either a, c, g or t
tcggttatacgtaagcggcggcgggtgtggttggtgtgattaagatggtgatggcgatgcggtacgggtagttgttacgtacgttgtacgtggaatcgtcgtcgtcggaggtggattggtcggcggggacggtttaattttttacggagaatacgttttggtttaggagtggtcgtgttcgtcgggtgggggtgtcgtcgttcgggattagtggtattaacgcgtacgttattttcgaatagttttcgggagtgtcgagttagtttgcggggtcgggttcgggttttgtcgtggatgtttcggtggtgtcgtggatggtgtcgggtaaaatattcgaagcgttattcgcgtaggcgacggcgttgatgatttatttggacgagcgatttgatgttttttcgttggatgttgggtattcgttggcgttgatacggtcggcgttgtatgagcgagcggtggtgtttgggtcggatcgtgaaacgtttgtgtgtcggtgtaaaagcgttgtttgtcggttatgaaggtttttgggtggngattcgattttgtgggggttgggggtcgtattagtttttggtttttcggttagggtggaaantggttgggttgtggcgggggtttgacgcgggtttgggggggtgggggcgggtgtgtgaggattttggggggagcggttcgggtgtgttggagaggcgggagggtggttattgggatcggaggtagcggagattggcggggcgggtggcgttcgtgttaattatcgtgggggtgtacggtgacggcggttattattaatatgagcgg

SEQ ID NO: 33338 - DNA, 804 bp, Artificial Sequence
  chemically treated genomic DNA (Homo sapiens) CpG-island No: 33338
  misc_feature (207)..(207): n is either a, c, g or t
  misc_feature (269)..(269): n is either a, c, g or t
ccgctcatattaataataaccgccgtcaccgtacacccccacgataattaacacgaacgccacccgccccgccaatctccgctacctccgatcccaataaccaccctcccgcctctccaacacacccgaaccgctccccccaaaatcctcacacacccgcccccacccccccaaacccgcgtcaaacccccgccacaacccaaccantttccaccctaaccgaaaaaccaaaaactaatacgacccccaacccccacaaaatcgaatcnccacccaaaaaccttcataaccgacaaacaacgcttttacaccgacacacaaacgtttcacgatccgacccaaacaccaccgctcgctcatacaacgccgaccgtatcaacgccaacgaatacccaacatccaacgaaaaaacatcaaatcgctcgtccaaataaatcatcaacgccgtcgcctacgcgaataacgcttcgaatattttacccgacaccatccacgacaccaccgaaacatccacgacaaaacccgaacccgaccccgcaaactaactcgacactcccgaaaactattcgaaaataacgtacgcgttaataccactaatcccgaacgacgacacccccacccgacgaacacgaccactcctaaaccaaaacgtattctccgtaaaaaattaaaccgtccccgccgaccaatccacctccgacgacgacgattccacgtacaacgtacgtaacaactacccgtaccgcatcgccatcaccatcttaatcacaccaaccacacccgccgccgcttacgtataaccga

SEQ ID NO: 33339 - DNA, 804 bp, Artificial Sequence
  chemically treated genomic DNA (Homo sapiens) CpG-island No: 33339
  misc_feature (207)..(207): n is either a, c, g or t
  misc_feature (269)..(269): n is either a, c, g or t
tcgtttatattaatagtagtcgtcgttatcgtatatttttacgatggttaatacgagcgttattcgtttcgttaattttcgttgttttcgattttagtaattattttttcgtttttttaatatattcgaatcgttttttttaaaatttttatatattcgtttttatttttttaaattcgcgttaagttttcgttataatttaattantttttattttgatcgaaaaattaaaaattaatgcggtttttagtttttataaaatcgggttnttatttagaaatttttatgatcggtagatagcgtttttatatcggtatataaacgttttacggttcgatttaagtattatcgttcgtttatatagcgtcggtcgtgttaacgttagcgagtatttaatatttagcgaggagatattaggtcgttcgtttagataggttattaacgtcgtcgtttgcgcggatagcgtttcgggtgttttgttcgatattatttacggtattatcggaatatttacgatagaattcgaattcggtttcgtagattgattcggtattttcgggggttgttcgaggatgacgtgcgcgttagtattattgatttcgaacgacgatatttttattcgacgaatacgattatttttgggttagggcgtgtttttcgtaaggagttgaatcgttttcgtcgattaatttattttcggcgacggcgattttacgtgtaacgtgcgtggtagttgttcgtgtcgtatcgttattattattttgattatattagttatattcgtcgtcgtttgcgtatgatcga

SEQ ID NO: 33340 - DNA, 804 bp, Artificial Sequence
  chemically treated genomic DNA (Homo sapiens) CpG-island No: 33340
  misc_feature (536)..(536): n is either a, c, g or t
  misc_feature (598)..(598): n is either a, c, g or t
tcgatcatacgcaaacgacgacgaatataactaatataatcaaaataataataacgatacgacacgaacaactaccacgcacgttacacgtaaaatcgccgtcgccgaaaataaattaatcgacgaaaacgattcaactccttacgaaaaacacgccctaacccaaaaataatcgtattcgtcgaataaaaatatcgtcgttcgaaatcaataatactaacgcgcacgtcatcctcgaacaacccccgaaaataccgaatcaatctacgaaaccgaattcgaattctatcgtaaatattccgataataccgtaaataatatcgaacaaaacacccgaaacgctatccgcgcaaacgacgacgttaataacctatctaaacgaacgacctaatatctcctcgctaaatattaaatactcgctaacgttaacacgaccgacgctatataaacgaacgataatacttaaatcgaaccgtaaaacgtttatataccgatataaaaacgctatctaccgatcataaaaatttctaaataanaacccgattttataaaaactaaaaaccgcattaatttttaatttttcgatcaaaataaaaantaattaaattataacgaaaacttaacgcgaatttaaaaaaataaaaacgaatatataaaaattttaaaaaaaacgattcgaatatattaaaaaaacgaaaaaataattactaaaatcgaaaacaacgaaaattaacgaaacgaataacgctcgtattaaccatcgtaaaaatatacgataacgacgactactattaatataaacga

SEQ ID NO: 33341 - DNA, 572 bp, Artificial Sequence
  chemically treated genomic DNA (Homo sapiens) CpG-island No: 33341
gggtgtggttggtgtgattaagatggtgatggcgatgcggtacgggtagttgttacgtacgttgtacgtggaatcgtcgtcgtcggaggtggattggtcggcggggacggtttaattttttacggagaatacgttttggtttaggagtggtcgtgttcgtcgggtgggggtgtcgtcgttcgggattagtggtattaacgcgtacgttattttcgaatagttttcgggagtgtcgagttagtttgcggggtcgggttcgggttttgtcgtggatgtttcggtggtgtcgtggatggtgtcgggtaaaatattcgaagcgttattcgcgtaggtaacggcgttgatgatttatttggacgagcgatttgatgttttttcgttggatgttgggtattcgttggcgttgatacggtcggcgttggatgagcgagcggtggtgttggggtcggatcgtgaaacgttgttgtgcggtgtgaaagcgttgtttgtcggttatgaggtttttgggtttgggatacgatttgtgggggttgtgggtcgtattggatttgtgtttatcggataagtgttta

SEQ ID NO: 33342 - DNA, 572 bp, Artificial Sequence
  chemically treated genomic DNA (Homo sapiens) CpG-island No: 33342
taaacacttatccgataaacacaaatccaatacgacccacaacccccacaaatcgtatcccaaacccaaaaacctcataaccgacaaacaacgctttcacaccgcacaacaacgtttcacgatccgaccccaacaccaccgctcgctcatccaacgccgaccgtatcaacgccaacgaatacccaacatccaacgaaaaaacatcaaatcgctcgtccaaataaatcatcaacgccgttacctacgcgaataacgcttcgaatattttacccgacaccatccacgacaccaccgaaacatccacgacaaaacccgaacccgaccccgcaaactaactcgacactcccgaaaactattcgaaaataacgtacgcgttaataccactaatcccgaacgacgacacccccacccgacgaacacgaccactcctaaaccaaaacgtattctccgtaaaaaattaaaccgtccccgccgaccaatccacctccgacgacgacgattccacgtacaacgtacgtaacaactacccgtaccgcatcgccatcaccatcttaatcacaccaaccacaccc

SEQ ID NO: 33343 - DNA, 572 bp, Artificial Sequence
  chemically treated genomic DNA (Homo sapiens) CpG-island No: 33343
tgggtatttgttcggtaaatataaatttaatgcggtttatagtttttatagatcgtgttttaaatttagaagttttatgatcggtagatagcgtttttatatcgtataataacgttttacggttcgattttagtattatcgttcgtttatttagcgtcgatcgtgttaacgttagcgagtatttaatatttagcgaggagatattaggtcgttcgtttagataggttattaacgtcgttgtttgcgcggatagcgtttcgggtgttttgttcgatattatttacggtattatcggaatatttacgatagaattcgaattcggtttcgtagattgattcggtattttcgggggttgttcgaggatgacgtgcgcgttagtattattgatttcgaacgacgatatttttattcgacgaatacgattatttttgggttagggcgtgtttttcgtaaggagttgaatcgttttcgtcgattaatttattttcggcgacggcgattttacgtgtaacgtgcgtggtagttgttcgtgtcgtatcgttattattattttgattatattagttatattt

SEQ ID NO: 33344 - DNA, 572 bp, Artificial Sequence
  chemically treated genomic DNA (Homo sapiens) CpG-island No: 33344
aaatataactaatataatcaaaataataataacgatacgacacgaacaactaccacgcacgttacacgtaaaatcgccgtcgccgaaaataaattaatcgacgaaaacgattcaactccttacgaaaaacacgccctaacccaaaaataatcgtattcgtcgaataaaaatatcgtcgttcgaaatcaataatactaacgcgcacgtcatcctcgaacaacccccgaaaataccgaatcaatctacgaaaccgaattcgaattctatcgtaaatattccgataataccgtaaataatatcgaacaaaacacccgaaacgctatccgcgcaaacaacgacgttaataacctatctaaacgaacgacctaatatctcctcgctaaatattaaatactcgctaacgttaacacgatcgacgctaaataaacgaacgataatactaaaatcgaaccgtaaaacgttattatacgatataaaaacgctatctaccgatcataaaacttctaaatttaaaacacgatctataaaaactataaaccgcattaaatttatatttaccgaacaaataccca

SEQ ID NO: 33345 - DNA, 721 bp, Artificial Sequence
  chemically treated genomic DNA (Homo sapiens) CpG-island No: 33345
atttcgcgcgttattcgcggtttttttcgttcggggttttcgttcggtttttgttggttttcgcgatttcgcggtgttcgttttcgttgagtttaaaaggacgcgcggagcggcgtcggttttttattagtagttcgttcgattggaaaggtgagtacgagggaagggcgggggcgtcggagagtcgggtcgtttatattcgtcgtagttatttcggtcgtggtaggaatcgaaattcggagcggtcgaagtttagcgtttcgttggggtagagggtcgcggcggttgggaacgtcgtttttcgacgtatcggtcgtttttagcgtagcgcgtttcgcggggtgttggtaacgcggggggttcggggcgggggcggggacgggggcggggtcgcggggcgaggattaatttagttcgtcgcgtttatttcgcgttcgtaggggcgtcgaggattttcggggcgcggggcgcgggttggggtttagtgaggtttggtaggttgtgcgcggatcgcgttttggacggcgaaagtaggttcggagggggcggttagttcggcgttttagcgttcgaggcgagttagaaggcggtttacggtcgtcgtttttcggtttcggttcggttattgcgttgcgtttatttcgttttggagtttgggcgcgggttttgattttttcggtttttttttgatatttggtggatggcgttattagaattttta

SEQ ID NO: 33346 - DNA, 721 bp, Artificial Sequence
  chemically treated genomic DNA (Homo sapiens) CpG-island No: 33346
taaaaattctaataacgccatccaccaaatatcaaaaaaaaaccgaaaaaatcaaaacccgcgcccaaactccaaaacgaaataaacgcaacgcaataaccgaaccgaaaccgaaaaacgacgaccgtaaaccgccttctaactcgcctcgaacgctaaaacgccgaactaaccgccccctccgaacctactttcgccgtccaaaacgcgatccgcgcacaacctaccaaacctcactaaaccccaacccgcgccccgcgccccgaaaatcctcgacgcccctacgaacgcgaaataaacgcgacgaactaaattaatcctcgccccgcgaccccgcccccgtccccgcccccgccccgaaccccccgcgttaccaacaccccgcgaaacgcgctacgctaaaaacgaccgatacgtcgaaaaacgacgttcccaaccgccgcgaccctctaccccaacgaaacgctaaacttcgaccgctccgaatttcgattcctaccacgaccgaaataactacgacgaatataaacgacccgactctccgacgcccccgcccttccctcgtactcacctttccaatcgaacgaactactaataaaaaaccgacgccgctccgcgcgtccttttaaactcaacgaaaacgaacaccgcgaaatcgcgaaaaccaacaaaaaccgaacgaaaaccccgaacgaaaaaaaccgcgaataacgcgcgaaat

SEQ ID NO: 33347 - DNA, 721 bp, Artificial Sequence
  chemically treated genomic DNA (Homo sapiens) CpG-island No: 33347
taggagttttggtgacgttatttattaggtgttaggagagggtcgggaaggttaggattcgcgtttaggttttagagcggagtgggcgtagcgtagtagtcgggtcgggatcgggaggcgacggtcgtgggtcgttttttggttcgtttcggacgttgggacgtcggattggtcgtttttttcgggtttgttttcgtcgtttagggcgcggttcgcgtatagtttgttaagttttattgggttttagttcgcgtttcgcgtttcggagattttcgacgtttttgcgaacgcggggtggacgcgacgggttgggttggttttcgtttcgcggtttcgttttcgttttcgttttcgtttcgagtttttcgcgttattagtatttcgcggagcgcgttgcgttgggggcggtcggtgcgtcggggagcggcgtttttagtcgtcgcgattttttgttttagcggagcgttgagtttcggtcgtttcgggtttcggtttttgttacggtcgaggtggttgcggcgaatgtgggcgattcggtttttcggcgttttcgtttttttttcgtgtttatttttttagtcggacgggttgttggtgaagggtcggcgtcgtttcgcgcgtttttttgaatttaacgggggcgggtatcgcggagtcgcggaggttagtagaggtcgaacgaggatttcgagcggaggaagtcgcgggtggcgcgcggggt

SEQ ID NO: 33348 - DNA, 721 bp, Artificial Sequence
  chemically treated genomic DNA (Homo sapiens) CpG-island No: 33348
accccgcgcgccacccgcgacttcctccgctcgaaatcctcgttcgacctctactaacctccgcgactccgcgatacccgcccccgttaaattcaaaaaaacgcgcgaaacgacgccgacccttcaccaacaacccgtccgactaaaaaaataaacacgaaaaaaaaacgaaaacgccgaaaaaccgaatcgcccacattcgccgcaaccacctcgaccgtaacaaaaaccgaaacccgaaacgaccgaaactcaacgctccgctaaaacaaaaaatcgcgacgactaaaaacgccgctccccgacgcaccgaccgcccccaacgcaacgcgctccgcgaaatactaataacgcgaaaaactcgaaacgaaaacgaaaacgaaaacgaaaccgcgaaacgaaaaccaacccaacccgtcgcgtccaccccgcgttcgcaaaaacgtcgaaaatctccgaaacgcgaaacgcgaactaaaacccaataaaacttaacaaactatacgcgaaccgcgccctaaacgacgaaaacaaacccgaaaaaaacgaccaatccgacgtcccaacgtccgaaacgaaccaaaaaacgacccacgaccgtcgcctcccgatcccgacccgactactacgctacgcccactccgctctaaaacctaaacgcgaatcctaaccttcccgaccctctcctaacacctaataaataacgtcaccaaaactccta

SEQ ID NO: 33349 - DNA, 524 bp, Artificial Sequence
  chemically treated genomic DNA (Homo sapiens) CpG-island No: 33349
cgaaggagggcgtcgtgagggtagagtcgcggttatttttatcgtagtagttcgtcgggtcggatattagtcgtagtcgttagttcggtagacgttggaagcgcgtataggggtgttttcgttttcggtcgttagagggcgcggtcggcgatggcgcggcggagacggagggaggaggggagtcggtagagaagggttagtcgcggcggtagggcggcggcgttagcggcgtagtttcgtttttcgcgcgtttttttttttcgcgtttaggtagggcgtttagttttcgtcgttaggatgcgttcgttcgtttgttggtggttgttcgcgtcgtcggcgttgttcgcgttttttaaaagatttttgggtaagtagcgggcggttaggcgcgtaagggcgaggcgtggggttcgcgggtatagtcgttcgtgtttcggtcggcgcggggagggaggcgtagggcggtttagttttgtttcgtcggcgcgcgcgtttcgtcgttcggtttttatcgcgtcgcgtcg

SEQ ID NO: 33350 - DNA, 524 bp, Artificial Sequence
  chemically treated genomic DNA (Homo sapiens) CpG-island No: 33350
cgacgcgacgcgataaaaaccgaacgacgaaacgcgcgcgccgacgaaacaaaactaaaccgccctacgcctccctccccgcgccgaccgaaacacgaacgactatacccgcgaaccccacgcctcgcccttacgcgcctaaccgcccgctacttacccaaaaatcttttaaaaaacgcgaacaacgccgacgacgcgaacaaccaccaacaaacgaacgaacgcatcctaacgacgaaaactaaacgccctacctaaacgcgaaaaaaaaaaacgcgcgaaaaacgaaactacgccgctaacgccgccgccctaccgccgcgactaacccttctctaccgactcccctcctccctccgtctccgccgcgccatcgccgaccgcgccctctaacgaccgaaaacgaaaacacccctatacgcgcttccaacgtctaccgaactaacgactacgactaatatccgacccgacgaactactacgataaaaataaccgcgactctaccctcacgacgccctccttcg

SEQ ID NO: 33351 - DNA, 524 bp, Artificial Sequence
  chemically treated genomic DNA (Homo sapiens) CpG-island No: 33351
cggcgcggcgcggtggggatcggacggcgggacgcgcgcgtcggcggggtagggttgggtcgttttgcgttttttttttcgcgtcgatcggggtacgggcgattgtgttcgcgaattttacgtttcgtttttgcgcgtttggtcgttcgttatttatttagggattttttgaggagcgcgagtagcgtcggcggcgcgagtagttattagtaggcgggcgggcgtattttggcggcggaggttgagcgttttatttgggcgcggggaagggagacgcgcggggagcggagttgcgtcgttggcgtcgtcgttttgtcgtcgcggttgatttttttttgtcggtttttttttttttttcgttttcgtcgcgttatcgtcggtcgcgttttttggcggtcgggagcgggagtatttttgtgcgcgtttttagcgtttgtcgggttggcggttgcggttggtgttcggttcgacgggttgttgcggtagaggtggtcgcggttttgtttttacggcgttttttttcg

SEQ ID NO: 33352 - DNA, 524 bp, Artificial Sequence
  chemically treated genomic DNA (Homo sapiens) CpG-island No: 33352
cgaaaaaaaacgccgtaaaaacaaaaccgcgaccacctctaccgcaacaacccgtcgaaccgaacaccaaccgcaaccgccaacccgacaaacgctaaaaacgcgcacaaaaatactcccgctcccgaccgccaaaaaacgcgaccgacgataacgcgacgaaaacgaaaaaaaaaaaaaaaccgacaaaaaaaaatcaaccgcgacgacaaaacgacgacgccaacgacgcaactccgctccccgcgcgtctcccttccccgcgcccaaataaaacgctcaacctccgccgccaaaatacgcccgcccgcctactaataactactcgcgccgccgacgctactcgcgctcctcaaaaaatccctaaataaataacgaacgaccaaacgcgcaaaaacgaaacgtaaaattcgcgaacacaatcgcccgtaccccgatcgacgcgaaaaaaaaaacgcaaaacgacccaaccctaccccgccgacgcgcgcgtcccgccgtccgatccccaccgcgccgcgccg

SEQ ID NO: 33353 - DNA, 580 bp, Artificial Sequence
  chemically treated genomic DNA (Homo sapiens) CpG-island No: 33353
gaatcgcgaagttatcgtttatggtacgcgttttattattgtcgtattcggttttagcgtttaaattcgtagtatcgtaatttttatggtcgattaatgttgacgcgaggttttattcgtatgtgtcgtttcgttttacgcgataatcgttcgttatcgcgttaaatcgttattaatcgttttagttattcgtcgttttcgtttttttttttcgtgtttttcgcgattgtttttttttattttttttatatggtatgtcgatttcgagttttcgcgattttgttcgtcgttttcgatttcgtattttatcgtcgattaatttcgttattttcggtattatttcgtcgtttcgattttcggttgttcggttttcgcgcgcgtcgtatgtttttcgtaaatacgttatcgcgcgtttcgtgatgttcgcgtttttttttattttttatttttattcgcgtcgtaatatgatggatttattcgttatttatcgcgcgtttttagttagtttcgtagtcgacgattttttcggttatatattttttttcgttttatacggttggtcgcgtcgcgggatatttcg

SEQ ID NO: 33354 - DNA, 580 bp, Artificial Sequence
  chemically treated genomic DNA (Homo sapiens) CpG-island No: 33354
cgaaatatcccgcgacgcgaccaaccgtataaaacgaaaaaaaatatataaccgaaaaaatcgtcgactacgaaactaactaaaaacgcgcgataaataacgaataaatccatcatattacgacgcgaataaaaataaaaaataaaaaaaaacgcgaacatcacgaaacgcgcgataacgtatttacgaaaaacatacgacgcgcgcgaaaaccgaacaaccgaaaatcgaaacgacgaaataataccgaaaataacgaaattaatcgacgataaaatacgaaatcgaaaacgacgaacaaaatcgcgaaaactcgaaatcgacataccatataaaaaaaataaaaaaaaacaatcgcgaaaaacacgaaaaaaaaaaacgaaaacgacgaataactaaaacgattaataacgatttaacgcgataacgaacgattatcgcgtaaaacgaaacgacacatacgaataaaacctcgcgtcaacattaatcgaccataaaaattacgatactacgaatttaaacgctaaaaccgaatacgacaataataaaacgcgtaccataaacgataacttcgcgattc

SEQ ID NO: 33355 - DNA, 580 bp, Artificial Sequence
  chemically treated genomic DNA (Homo sapiens) CpG-island No: 33355
cgaaatatttcgcggcgcggttaatcgtatggggcgggaggggatatatgatcggggggatcgtcggttgcgggattaattgagagcgcgcgatggatagcgggtggatttattatattacggcgcgggtggggatgggggataagagggggcgcgagtattacggggcgcgcggtggcgtgtttacggggaatatacggcgcgcgcggaaatcggatagtcggggatcggaacggcgggataatgtcgaagatagcgaaattggtcggcggtagggtgcggaatcgggggcggcgggtaaaatcgcggggattcggaatcggtatattatgtgggggagatggaaagggataatcgcgggggatacggaggggaaaagcgggggcgacgaatgattaaaacggttaatggcggtttaacgcggtaacggacggttatcgcgtggggcggggcggtatatacgaataaaatttcgcgttagtattggtcggttatgggggttgcgatattgcgggtttgggcgttggaatcgggtgcggtaatagtggggcgcgtattatagacgatagtttcgcggttt

SEQ ID NO: 33356 - DNA, 580 bp, Artificial Sequence
  chemically treated genomic DNA (Homo sapiens) CpG-island No: 33356
aaaccgcgaaactatcgtctataatacgcgccccactattaccgcacccgattccaacgcccaaacccgcaatatcgcaacccccataaccgaccaatactaacgcgaaattttattcgtatataccgccccgccccacgcgataaccgtccgttaccgcgttaaaccgccattaaccgttttaatcattcgtcgcccccgcttttcccctccgtatcccccgcgattatccctttccatctcccccacataatataccgattccgaatccccgcgattttacccgccgcccccgattccgcaccctaccgccgaccaatttcgctatcttcgacattatcccgccgttccgatccccgactatccgatttccgcgcgcgccgtatattccccgtaaacacgccaccgcgcgccccgtaatactcgcgccccctcttatcccccatccccacccgcgccgtaatataataaatccacccgctatccatcgcgcgctctcaattaatcccgcaaccgacgatccccccgatcatatatcccctcccgccccatacgattaaccgcgccgcgaaatatttcg

SEQ ID NO: 33357 - DNA, 688 bp, Artificial Sequence
  chemically treated genomic DNA (Homo sapiens) CpG-island No: 33357
cgcggtgtggcggaggaggcggcggtttttttttgtaggtttcgggagttcggcggcgttgagagataggcgggtcgtttggagcgcggcgttcgggttttagcgcggcgtagttttcgggttcgtgtttcgttggtttcgggtaggggttgcggtttagtttagagtcgtcggatcgcggaggagtcgtttcgttttcgcgtttttcgtttttcgtttttagtttcggtgcgattttcgtgttgttcggcgtattcgtttgtttacggtttggttagttagttgttttatgcggttgaattgtttttttatggcggcggtggcggcggcggttcgcggggttcgggtcgggtagggcgggggatagtttggtagttattatatcgtttttcggtttaaacggcggcgcggcggtggtttttcgggtcggcggtttcgttttcgtttcgttatttttagtggtatcgttcgttcgttttttaggtttggtcgagtcgagttgagttcgagtagagtcgagtcgaatcgagtcgaggttaatagtgttttatttgatacgggcgaagagttagaaggtttcgggcgagaagattattaggtttttttcgtttggttttttcgattttaacgttgttcggttattttttcgtttattttaacgtatgaaaagttgtttttagtagggcgt

SEQ ID NO: 33358 - DNA, 688 bp, Artificial Sequence
  chemically treated genomic DNA (Homo sapiens) CpG-island No: 33358
acgccctactaaaaacaacttttcatacgttaaaataaacgaaaaaataaccgaacaacgttaaaatcgaaaaaaccaaacgaaaaaaacctaataatcttctcgcccgaaaccttctaactcttcgcccgtatcaaataaaacactattaacctcgactcgattcgactcgactctactcgaactcaactcgactcgaccaaacctaaaaaacgaacgaacgataccactaaaaataacgaaacgaaaacgaaaccgccgacccgaaaaaccaccgccgcgccgccgtttaaaccgaaaaacgatataataactaccaaactatcccccgccctacccgacccgaaccccgcgaaccgccgccgccaccgccgccataaaaaaacaattcaaccgcataaaacaactaactaaccaaaccgtaaacaaacgaatacgccgaacaacacgaaaatcgcaccgaaactaaaaacgaaaaacgaaaaacgcgaaaacgaaacgactcctccgcgatccgacgactctaaactaaaccgcaacccctacccgaaaccaacgaaacacgaacccgaaaactacgccgcgctaaaacccgaacgccgcgctccaaacgacccgcctatctctcaacgccgccgaactcccgaaacctacaaaaaaaaaccgccgcctcctccgccacaccgcg

SEQ ID NO: 33359 - DNA, 688 bp, Artificial Sequence
  chemically treated genomic DNA (Homo sapiens) CpG-island No: 33359
gcgttttgttagaaatagttttttatacgttgaaataaacgagagggtgatcgggtagcgttggggtcggggaggttaggcggaggaggtttagtggttttttcgttcggggttttttagtttttcgttcgtgttaggtaaggtattgttagtttcggttcggttcgattcggttttattcgggtttagttcggttcggttagatttagagggcgggcgggcggtgttattggaagtgacgaggcgagggcggggtcgtcggttcggggagttatcgtcgcgtcgtcgtttgggtcgggaagcgatgtagtagttgttaggttgtttttcgttttgttcggttcgagtttcgcgggtcgtcgtcgttatcgtcgttatgaagaagtagtttaatcgtatgaagtagttggttaattagatcgtgggtaggcgagtgcgtcgggtagtacgggggtcgtatcggggttgggggcggagggcggagggcgcgggggcgggacggttttttcgcggttcggcggttttgagttgggtcgtagtttttgttcgagattagcggggtacgggttcgggggttgcgtcgcgttgaggttcgagcgtcgcgttttaggcggttcgtttgttttttagcgtcgtcgggttttcgagatttgtaggggagggtcgtcgtttttttcgttatatcgcg

SEQ ID NO: 33360 - DNA, 688 bp, Artificial Sequence
  chemically treated genomic DNA (Homo sapiens) CpG-island No: 33360
cgcgatataacgaaaaaaacgacgaccctcccctacaaatctcgaaaacccgacgacgctaaaaaacaaacgaaccgcctaaaacgcgacgctcgaacctcaacgcgacgcaacccccgaacccgtaccccgctaatctcgaacaaaaactacgacccaactcaaaaccgccgaaccgcgaaaaaaccgtcccgcccccgcgccctccgccctccgcccccaaccccgatacgacccccgtactacccgacgcactcgcctacccacgatctaattaaccaactacttcatacgattaaactacttcttcataacgacgataacgacgacgacccgcgaaactcgaaccgaacaaaacgaaaaacaacctaacaactactacatcgcttcccgacccaaacgacgacgcgacgataactccccgaaccgacgaccccgccctcgcctcgtcacttccaataacaccgcccgcccgccctctaaatctaaccgaaccgaactaaacccgaataaaaccgaatcgaaccgaaccgaaactaacaataccttacctaacacgaacgaaaaactaaaaaaccccgaacgaaaaaaccactaaacctcctccgcctaacctccccgaccccaacgctacccgatcaccctctcgtttatttcaacgtataaaaaactatttctaacaaaacgc

SEQ ID NO: 33361 - DNA, 508 bp, Artificial Sequence
  chemically treated genomic DNA (Homo sapiens) CpG-island No: 33361
gtcgtatacggacgggaaagggttaatttcggtttgtttttggcgaattttggagaggcggtgttatggtaatcggtataatttaagttgttgacgattttcggatcgtcgcgcgtttatttatcgtggaagtagttattttcgtcgtttttttggattagacgcgttatattcgggtttttataattttagtatgttatcggtagcggattatttttagcgtttttcggcgtatcggtacgtagggttttacgtatatcggttatagtaaaagtatgtttacgcggtttgttgtaatcgcgcgagaagggatatttcgtttataggattattagtcgtggatttttcgttagggcgttaatacgttttgattgtttcgaggtggttttttaggagagatattgatcgggatgttgcggggtataggatttatttttcgttttatagatataggttttgcgggagtatacgtttgtttagcgtgaattgaagtgtaaaaaggttgaga

SEQ ID NO: 33362 - DNA, 508 bp, Artificial Sequence
  chemically treated genomic DNA (Homo sapiens) CpG-island No: 33362
tctcaacctttttacacttcaattcacgctaaacaaacgtatactcccgcaaaacctatatctataaaacgaaaaataaatcctataccccgcaacatcccgatcaatatctctcctaaaaaaccacctcgaaacaatcaaaacgtattaacgccctaacgaaaaatccacgactaataatcctataaacgaaatatcccttctcgcgcgattacaacaaaccgcgtaaacatacttttactataaccgatatacgtaaaaccctacgtaccgatacgccgaaaaacgctaaaaataatccgctaccgataacatactaaaattataaaaacccgaatataacgcgtctaatccaaaaaaacgacgaaaataactacttccacgataaataaacgcgcgacgatccgaaaatcgtcaacaacttaaattataccgattaccataacaccgcctctccaaaattcgccaaaaacaaaccgaaattaaccctttcccgtccgtatacgac

SEQ ID NO: 33363 - DNA, 508 bp, Artificial Sequence
  chemically treated genomic DNA (Homo sapiens) CpG-island No: 33363
ttttagtttttttatattttagtttacgttgaataagcgtgtgttttcgtaaaatttgtatttgtgaagcgaagaatgaattttgtgtttcgtagtatttcgattaatattttttttggaaagttatttcggaatagttagagcgtgttgacgttttggcggaagatttacggttggtgattttgtgggcggggtattttttttcgcgcgattataataagtcgcgtggatatgtttttgttgtgatcgatgtgcgtgaaattttgcgtatcggtgcgtcgaaaaacgttgaagatggttcgttatcgatggtatgttggagttgtaaaagttcggatgtggcgcgtttgatttagaaagacggcgaagatggttatttttacggtaaatgggcgcgcggcggttcggaaatcgttaataatttaggttgtgtcgattgttataatatcgtttttttagagttcgttaaaggtaaatcggagttaattttttttcgttcgtatgcggt

SEQ ID NO: 33364 - DNA, 508 bp, Artificial Sequence
  chemically treated genomic DNA (Homo sapiens) CpG-island No: 33364
accgcatacgaacgaaaaaaaattaactccgatttacctttaacgaactctaaaaaaacgatattataacaatcgacacaacctaaattattaacgatttccgaaccgccgcgcgcccatttaccgtaaaaataaccatcttcgccgtctttctaaatcaaacgcgccacatccgaacttttacaactccaacataccatcgataacgaaccatcttcaacgtttttcgacgcaccgatacgcaaaatttcacgcacatcgatcacaacaaaaacatatccacgcgacttattataatcgcgcgaaaaaaaataccccgcccacaaaatcaccaaccgtaaatcttccgccaaaacgtcaacacgctctaactattccgaaataactttccaaaaaaaatattaatcgaaatactacgaaacacaaaattcattcttcgcttcacaaatacaaattttacgaaaacacacgcttattcaacgtaaactaaaatataaaaaaactaaaa

SEQ ID NO: 33365 - DNA, 659 bp, Artificial Sequence
  chemically treated genomic DNA (Homo sapiens) CpG-island No: 33365
attaatcgtcggaattttcgcgcggggcggggtatatgtagggtttgagggcgcggaggtgggttcggcgcggagttgagtcgggcgtcgtgacgttggcgggtgggcggagatttagttcgggttagggtttgaagggaattttttggtgagttagggaggcggggtcgggcgggaggcggggtcgggcgggaggcggggtcgggcgcggcgacggcgttgttattttagtattaggaagtaagtggtttagtcggttagtagtagcgtttcgatgagtatcgtgtagttgaggagtacgaaggcgagtagttttcgtagtagttgtagtacgtggacggtggacgaggtcggtatcgcgttgcgcgggagttttaggacggtcggcggtttgtcgggttggcgtcgttttagaggggcggacgggaatatacgaggttttggttttcgaaatagtaaacgaaggttaggaagtttatagtgtcgatttttttaatagttttttggacgttcgtttttcggttatattggagaattttttttaatttaaattgttttcgtttttcggttttgatgtcgggttgaggaggtagaagttcggttttttttcgcgtttcgtagttgtatgagtttttttttttggttcgttttttttatta

SEQ ID NO: 33366 - DNA, 659 bp, Artificial Sequence
  chemically treated genomic DNA (Homo sapiens) CpG-island No: 33366
taataaaaaaaacgaaccaaaaaaaaaaactcatacaactacgaaacgcgaaaaaaaaccgaacttctacctcctcaacccgacatcaaaaccgaaaaacgaaaacaatttaaattaaaaaaaattctccaatataaccgaaaaacgaacgtccaaaaaactattaaaaaaatcgacactataaacttcctaaccttcgtttactatttcgaaaaccaaaacctcgtatattcccgtccgcccctctaaaacgacgccaacccgacaaaccgccgaccgtcctaaaactcccgcgcaacgcgataccgacctcgtccaccgtccacgtactacaactactacgaaaactactcgccttcgtactcctcaactacacgatactcatcgaaacgctactactaaccgactaaaccacttacttcctaatactaaaataacaacgccgtcgccgcgcccgaccccgcctcccgcccgaccccgcctcccgcccgaccccgcctccctaactcaccaaaaaattcccttcaaaccctaacccgaactaaatctccgcccacccgccaacgtcacgacgcccgactcaactccgcgccgaacccacctccgcgccctcaaaccctacatataccccgccccgcgcgaaaattccgacgattaat

SEQ ID NO: 33367 - DNA, 659 bp, Artificial Sequence
  chemically treated genomic DNA (Homo sapiens) CpG-island No: 33367
tggtgggaggagcgggttagggaggaaaatttatgtagttgcggggcgcggggaagagtcgggtttttgtttttttagttcggtattagagtcgaagaacgagggtagtttgggttgagaaggattttttagtgtaatcgagaagcgagcgtttaggaggttgttggggaggtcggtattgtgggttttttggttttcgtttgttgtttcgagggttaggatttcgtgtgttttcgttcgtttttttgggacggcgttagttcggtaggtcgtcgatcgttttggggttttcgcgtagcgcgatgtcggtttcgtttatcgtttacgtgttgtagttgttgcgggagttgttcgttttcgtgttttttagttatacggtgtttatcggggcgttgttgttggtcggttggattatttattttttggtgttgaagtgatagcgtcgtcgtcgcgttcggtttcgtttttcgttcggtttcgtttttcgttcggtttcgtttttttaatttattaggaaattttttttaagttttggttcgaattgagttttcgtttattcgttagcgttacggcgttcgatttagtttcgcgtcggatttattttcgcgtttttaggttttgtatatgtttcgtttcgcgcggaagtttcggcggttggt

SEQ ID NO: 33368 - DNA, 659 bp, Artificial Sequence
  chemically treated genomic DNA (Homo sapiens) CpG-island No: 33368
accaaccgccgaaacttccgcgcgaaacgaaacatatacaaaacctaaaaacgcgaaaataaatccgacgcgaaactaaatcgaacgccgtaacgctaacgaataaacgaaaactcaattcgaaccaaaacttaaaaaaaatttcctaataaattaaaaaaacgaaaccgaacgaaaaacgaaaccgaacgaaaaacgaaaccgaacgcgacgacgacgctatcacttcaacaccaaaaaataaataatccaaccgaccaacaacaacgccccgataaacaccgtataactaaaaaacacgaaaacgaacaactcccgcaacaactacaacacgtaaacgataaacgaaaccgacatcgcgctacgcgaaaaccccaaaacgatcgacgacctaccgaactaacgccgtcccaaaaaaacgaacgaaaacacacgaaatcctaaccctcgaaacaacaaacgaaaaccaaaaaacccacaataccgacctccccaacaacctcctaaacgctcgcttctcgattacactaaaaaatccttctcaacccaaactaccctcgttcttcgactctaataccgaactaaaaaaacaaaaacccgactcttccccgcgccccgcaactacataaattttcctccctaacccgctcctcccacca

SEQ ID NO: 33369 - DNA, 1374 bp, Artificial Sequence
  chemically treated genomic DNA (Homo sapiens) CpG-island No: 33369
ttcgtatttaaatttttttagaaaagtcgaaagtcgtgatttcgatttacgaaggcgattattattttgagtttttgatcgtagaggtgtagatttagttgaattagtgtcgttcggcggaggaggttttgcgtatgttcgtcgtgtagggcgtgggtagtaaaggttgtttttagtattttcgttttcgtttttgtttcgtcgtacgcgtcggggggcgggtgtggcgtcggcgttttggggaggaggagtagtttttgttcgattcggttcgtgcggattttaggatcgggcgcgggacgcgtgcgtttagttttcggcgttgcggagattcgcggttgggttcggggaggttttaaattcgttttcgttagaatttcgttttaaatttttattttttttagaagtttcgtttattttcgagtttcgagagtttcgcgtatttgggcgttattcgttttggtttcgttgtacgagttttacgttcgtatttcggcgttacgtttaggtaggttgggggtcgggacgtcgttgttgtgagggaggttgggttatcgtgtagggaggggcgtcgttagggcggtcgtgtttttgtatttcgcggttcgtttttcggttttttagggttttcgcgaggacgtcggtttcgttcgggtgcggcgcgagtttggtttcggcgggtacggttcggggtttacgggtcgttcggtttcggttttttaggttggggatagaggttggagtcgggcgcggtagatttcgttagtttgggtcgttcgcgttcgacgcgtagcgttgttgttaatttcggttcgggggttttcgtagagtgggtttttgttgtcgttagtttttcggagattgtcgcgttgaaagaatgaattagagttcgttttttgttcgcgttagggcgttttgggttatcgagttttgtggggattcgaggcggttgtcgtttaaggtcgagcgtagttttaggattcgcgttttattagacggggtcgtgcgtttcgcggcgggtggagagtcgggttttggggttttcgcggttcggagggcggcggggcgaggtcgtgcggttagcgtttggggacgttcgcggcgggataggggttattcgggtcgcggcgtagtttgggttgaaattttttgggacggaattaagttatttgttgtgcgtttttttcggtgaatggtatcgtcgttcgttcgggtttttcgtttatagttcgcggtgttcgtatatttgagatttatttcgtttcgatttcgtcgtcgtcgtcgttcggtattttgagtacggagatagtttttagttgtcgtttatgttttttttttagtttttcgtagtttattagggaaggggcggtagga

SEQ ID NO: 33370 - DNA, 1374 bp, Artificial Sequence
  chemically treated genomic DNA (Homo sapiens) CpG-island No: 33370
tcctaccgccccttccctaataaactacgaaaaactaaaaaaaaaacataaacgacaactaaaaactatctccgtactcaaaataccgaacgacgacgacgacgaaatcgaaacgaaataaatctcaaatatacgaacaccgcgaactataaacgaaaaacccgaacgaacgacgataccattcaccgaaaaaaacgcacaacaaataacttaattccgtcccaaaaaatttcaacccaaactacgccgcgacccgaataacccctatcccgccgcgaacgtccccaaacgctaaccgcacgacctcgccccgccgccctccgaaccgcgaaaaccccaaaacccgactctccacccgccgcgaaacgcacgaccccgtctaataaaacgcgaatcctaaaactacgctcgaccttaaacgacaaccgcctcgaatccccacaaaactcgataacccaaaacgccctaacgcgaacaaaaaacgaactctaattcattctttcaacgcgacaatctccgaaaaactaacgacaacaaaaacccactctacgaaaacccccgaaccgaaattaacaacaacgctacgcgtcgaacgcgaacgacccaaactaacgaaatctaccgcgcccgactccaacctctatccccaacctaaaaaaccgaaaccgaacgacccgtaaaccccgaaccgtacccgccgaaaccaaactcgcgccgcacccgaacgaaaccgacgtcctcgcgaaaaccctaaaaaaccgaaaaacgaaccgcgaaatacaaaaacacgaccgccctaacgacgcccctccctacacgataacccaacctccctcacaacaacgacgtcccgacccccaacctacctaaacgtaacgccgaaatacgaacgtaaaactcgtacaacgaaaccaaaacgaataacgcccaaatacgcgaaactctcgaaactcgaaaataaacgaaacttctaaaaaaaataaaaatttaaaacgaaattctaacgaaaacgaatttaaaacctccccgaacccaaccgcgaatctccgcaacgccgaaaactaaacgcacgcgtcccgcgcccgatcctaaaatccgcacgaaccgaatcgaacaaaaactactcctcctccccaaaacgccgacgccacacccgccccccgacgcgtacgacgaaacaaaaacgaaaacgaaaatactaaaaacaacctttactacccacgccctacacgacgaacatacgcaaaacctcctccgccgaacgacactaattcaactaaatctacacctctacgatcaaaaactcaaaataataatcgccttcgtaaatcgaaatcacgactttcgacttttctaaaaaaatttaaatacgaa

SEQ ID NO: 33371 - DNA, 1374 bp, Artificial Sequence
  chemically treated genomic DNA (Homo sapiens) CpG-island No: 33371
ttttatcgttttttttttggtgggttgcggaaggttggggaggaagtatgaacggtagttggagattgttttcgtgtttaggatgtcgggcggcggcggcggcggggtcgaagcgagatgagttttaggtgtgcgagtatcgcgggttgtggacgagaggttcgggcgggcggcggtgttatttatcgagaagggcgtatagtaggtggtttggtttcgttttaggaggttttagtttaggttgcgtcgcggttcgggtggtttttgtttcgtcgcgggcgtttttaggcgttggtcgtacggtttcgtttcgtcgtttttcgagtcgcggagattttagagttcggttttttattcgtcgcggagcgtacgatttcgtttggtggggcgcgggttttgaggttgcgttcggttttgggcggtagtcgtttcggatttttataggattcggtgatttaaaacgttttggcgcgggtagggggcgaattttggtttatttttttaacgcgatagttttcgaagggttgacggtagtagagatttattttgcggggattttcgggtcggggttggtagtagcgttgcgcgtcgggcgcgggcggtttaggttggcggggtttatcgcgttcggttttagtttttgtttttagtttggagaatcgaagtcgagcggttcgtgggtttcgagtcgtgttcgtcgaggttagattcgcgtcgtattcgggcggggtcggcgttttcgcggggattttgggggatcggggagcgggtcgcggggtgtaaaggtacggtcgttttggcgacgtttttttttgtacggtgatttagttttttttatagtagcggcgtttcggtttttaatttatttgagcgtgacgtcggggtacgggcgtggagttcgtgtagcggagttagggcggatggcgtttaggtgcgcggagttttcggggttcgggagtgggcggggtttttggaggaggtgggaatttggggcggggttttggcgggggcgggtttggggttttttcggatttagtcgcgggttttcgtagcgtcggaggttggacgtacgcgtttcgcgttcggttttggggttcgtacgagtcgggtcgggtagaggttgttttttttttttaggacgtcggcgttatattcgtttttcgacgcgtgcggcgggatagaagcggaggcgggagtgttgggaatagtttttattgtttacgttttatacggcgaatatgcgtagagtttttttcgtcgagcggtattggtttagttggatttgtatttttacggttaggggtttagggtggtaatcgttttcgtagatcggaattacggttttcggtttttttgagaaaatttaagtgcgag

SEQ ID NO: 33372 - DNA, 1374 bp, Artificial Sequence
  chemically treated genomic DNA (Homo sapiens) CpG-island No: 33372
ctcgcacttaaattttctcaaaaaaaccgaaaaccgtaattccgatctacgaaaacgattaccaccctaaacccctaaccgtaaaaatacaaatccaactaaaccaataccgctcgacgaaaaaaactctacgcatattcgccgtataaaacgtaaacaataaaaactattcccaacactcccgcctccgcttctatcccgccgcacgcgtcgaaaaacgaatataacgccgacgtcctaaaaaaaaaaaacaacctctacccgacccgactcgtacgaaccccaaaaccgaacgcgaaacgcgtacgtccaacctccgacgctacgaaaacccgcgactaaatccgaaaaaaccccaaacccgcccccgccaaaaccccgccccaaattcccacctcctccaaaaaccccgcccactcccgaaccccgaaaactccgcgcacctaaacgccatccgccctaactccgctacacgaactccacgcccgtaccccgacgtcacgctcaaataaattaaaaaccgaaacgccgctactataaaaaaaactaaatcaccgtacaaaaaaaaacgtcgccaaaacgaccgtacctttacaccccgcgacccgctccccgatcccccaaaatccccgcgaaaacgccgaccccgcccgaatacgacgcgaatctaacctcgacgaacacgactcgaaacccacgaaccgctcgacttcgattctccaaactaaaaacaaaaactaaaaccgaacgcgataaaccccgccaacctaaaccgcccgcgcccgacgcgcaacgctactaccaaccccgacccgaaaatccccgcaaaataaatctctactaccgtcaacccttcgaaaactatcgcgttaaaaaaataaaccaaaattcgccccctacccgcgccaaaacgttttaaatcaccgaatcctataaaaatccgaaacgactaccgcccaaaaccgaacgcaacctcaaaacccgcgccccaccaaacgaaatcgtacgctccgcgacgaataaaaaaccgaactctaaaatctccgcgactcgaaaaacgacgaaacgaaaccgtacgaccaacgcctaaaaacgcccgcgacgaaacaaaaaccacccgaaccgcgacgcaacctaaactaaaacctcctaaaacgaaaccaaaccacctactatacgcccttctcgataaataacaccgccgcccgcccgaacctctcgtccacaacccgcgatactcgcacacctaaaactcatctcgcttcgaccccgccgccgccgccgcccgacatcctaaacacgaaaacaatctccaactaccgttcatacttcctccccaaccttccgcaacccaccaaaaaaaaaacgataaaa

SEQ ID NO: 33373 - DNA, 547 bp, Artificial Sequence
  chemically treated genomic DNA (Homo sapiens) CpG-island No: 33373
gcgattcgggttttatcgttatttttaagttttattcgtttttatgtcggcggtttttagaatgcgtagattttaggttttagggattagttcgtttcgttcgttcgggttcgtgttttttcgtagtcggtttaggtttttagagtttcggtttcggcgttcgtatttagttgtcggtatcgtacgggaattcgcgtagatatagttttcgtaagtgttcgcgtacggtcgcgtttacggtttcggtttcgggtcgttgagttttaggttcggttttagattcggagttcggattcggattcgtacgacgtttttatggttcgggtcgcgttgttcggtaatcgttaggacgcgtgcgcgggggtaggggtttttttaggcgtttttatttgcgtcgagggaaaagttttttattcggattagatagtcgggtttaaaaaatttgcgttttttttcgagtttttatttataaaaatgggataatagttggtggttttaagtgcggtagttttcgtaggtagtaagcgttatagttgatttgtttttt

SEQ ID NO: 33374 - DNA, 547 bp, Artificial Sequence
  chemically treated genomic DNA (Homo sapiens) CpG-island No: 33374
aaaaaacaaatcaactataacgcttactacctacgaaaactaccgcacttaaaaccaccaactattatcccatttttataaataaaaactcgaaaaaaaacgcaaattttttaaacccgactatctaatccgaataaaaaacttttccctcgacgcaaataaaaacgcctaaaaaaacccctacccccgcgcacgcgtcctaacgattaccgaacaacgcgacccgaaccataaaaacgtcgtacgaatccgaatccgaactccgaatctaaaaccgaacctaaaactcaacgacccgaaaccgaaaccgtaaacgcgaccgtacgcgaacacttacgaaaactatatctacgcgaattcccgtacgataccgacaactaaatacgaacgccgaaaccgaaactctaaaaacctaaaccgactacgaaaaaacacgaacccgaacgaacgaaacgaactaatccctaaaacctaaaatctacgcattctaaaaaccgccgacataaaaacgaataaaacttaaaaataacgataaaacccgaatcgc

SEQ ID NO: 33375 - DNA, 547 bp, Artificial Sequence
  chemically treated genomic DNA (Homo sapiens) CpG-island No: 33375
aagaaataggttagttatggcgtttattgtttgcgggagttgtcgtatttagaattattagttgttattttatttttatagatgagggttcgagagaaaacgtaggttttttgggttcggttgtttgattcgggtgggggatttttttttcggcgtaggtgagagcgtttggagaggtttttgttttcgcgtacgcgttttagcggttgtcgggtaacgcggttcgggttatggaggcgtcgtacgagttcgagttcgagtttcgagtttgaggtcgggtttgggatttagcggttcgggatcgggatcgtgagcgcggtcgtgcgcgagtatttgcggaagttgtgtttgcgcgagttttcgtgcggtgtcggtagttgggtgcgggcgtcggggtcggaattttgggggtttggatcggttgcggggaggtacgggttcgggcgagcggagcgggttggtttttggggtttgggatttgcgtattttgggggtcgtcgatatgggggcgggtggggtttgagggtgacggtggggttcgagtcgt

SEQ ID NO: 33376 - DNA, 547 bp, Artificial Sequence
  chemically treated genomic DNA (Homo sapiens) CpG-island No: 33376
acgactcgaaccccaccgtcaccctcaaaccccacccgcccccatatcgacgacccccaaaatacgcaaatcccaaaccccaaaaaccaacccgctccgctcgcccgaacccgtacctccccgcaaccgatccaaacccccaaaattccgaccccgacgcccgcacccaactaccgacaccgcacgaaaactcgcgcaaacacaacttccgcaaatactcgcgcacgaccgcgctcacgatcccgatcccgaaccgctaaatcccaaacccgacctcaaactcgaaactcgaactcgaactcgtacgacgcctccataacccgaaccgcgttacccgacaaccgctaaaacgcgtacgcgaaaacaaaaacctctccaaacgctctcacctacgccgaaaaaaaaatcccccacccgaatcaaacaaccgaacccaaaaaacctacgttttctctcgaaccctcatctataaaaataaaataacaactaataattctaaatacgacaactcccgcaaacaataaacgccataactaacctatttctt

SEQ ID NO: 33377 - DNA, 1020 bp, Artificial Sequence
  chemically treated genomic DNA (Homo sapiens) CpG-island No: 33377
gtcgtttttgtttcggatgtaagatggcggcgcggggggcggtttggcggggcggttacgtggtgaggagtagcgcgcgagtttttttaagtgatttttaaggttcgttcggacgtataggagtagcggagcgcgagacgggttttgtgttcgtacgcgtcgagtcgtcgtagtcgttattcgggttatcgtcgggttcggttttattgttaaggggttttcgtttgtttcgttttcgttttttgtagagttgaacgggaatttttcgaagggtgttggggaacgggtggtttggggatttttcggttatgttttggttgttgtttggcggagtcggcggtagtttttgcgggatgttcgtcggcgattatcggcgtcgagagcgggtcggcggcgggttcgatagcgcggcgcgggtgggggttcgggtatcggattcggtcgtagtttagtttttatcggggattcggagtagggaggggcgcgagcggcgtagttcgggacgtggcggtagtttttagcgggcgaagcgcgggagcgttgttcgttgtttttcgggggtagtttagaattagttggtgtttgattgcgtttttgtcgtttattttttgttttcgagcggttgaggcgacgcgtttttttcgggtagtggagggagcggtttttttcgtaggatatcgtcgtttttttttttttagagcggtggttgacgtatagaacgtcggttgtattattcgggcgtcggcgtcgttttttattttcgtagttttcggggcgcgtcgggagtagtcgagtcgttgggtgttgggcggggttttcgggcgcggcgcgggggaaaggtaaaggaaaagaaggggcggcgggtcgacgtcggcggcgaggaaggacggaggagcgtcggagtcgttttgttgtttttcgcgtggtttcgtgttttttcgatattatggttttggttgaggtagtagtttgtgttgttggtcgggttgtgatattgttcgttgtggagataattgcgta

SEQ ID NO: 33378 - DNA, 1020 bp, Artificial Sequence
  chemically treated genomic DNA (Homo sapiens) CpG-island No: 33378
tacgcaattatctccacaacgaacaatatcacaacccgaccaacaacacaaactactacctcaaccaaaaccataatatcgaaaaaacacgaaaccacgcgaaaaacaacaaaacgactccgacgctcctccgtccttcctcgccgccgacgtcgacccgccgccccttcttttcctttacctttcccccgcgccgcgcccgaaaaccccgcccaacacccaacgactcgactactcccgacgcgccccgaaaactacgaaaataaaaaacgacgccgacgcccgaataatacaaccgacgttctatacgtcaaccaccgctctaaaaaaaaaaaaacgacgatatcctacgaaaaaaaccgctccctccactacccgaaaaaaacgcgtcgcctcaaccgctcgaaaacaaaaaataaacgacaaaaacgcaatcaaacaccaactaattctaaactacccccgaaaaacaacgaacaacgctcccgcgcttcgcccgctaaaaactaccgccacgtcccgaactacgccgctcgcgcccctccctactccgaatccccgataaaaactaaactacgaccgaatccgatacccgaacccccacccgcgccgcgctatcgaacccgccgccgacccgctctcgacgccgataatcgccgacgaacatcccgcaaaaactaccgccgactccgccaaacaacaaccaaaacataaccgaaaaatccccaaaccacccgttccccaacacccttcgaaaaattcccgttcaactctacaaaaaacgaaaacgaaacaaacgaaaaccccttaacaataaaaccgaacccgacgataacccgaataacgactacgacgactcgacgcgtacgaacacaaaacccgtctcgcgctccgctactcctatacgtccgaacgaaccttaaaaatcacttaaaaaaactcgcgcgctactcctcaccacgtaaccgccccgccaaaccgccccccgcgccgccatcttacatccgaaacaaaaacgac

SEQ ID NO: 33379 - DNA, 1020 bp, Artificial Sequence
  chemically treated genomic DNA (Homo sapiens) CpG-island No: 33379
tgcgtagttatttttatagcgggtaatgttataattcgattaatagtataaattattattttagttagggttatggtgtcggggaggtacgggattacgcggagggtagtaaagcggtttcggcgttttttcgttttttttcgtcgtcgacgtcggttcgtcgttttttttttttttttgtttttttttcgcgtcgcgttcggagatttcgtttagtatttagcggttcggttattttcggcgcgtttcgagagttacggggatgagaggcggcgtcggcgttcgggtgatatagtcggcgttttgtacgttagttatcgttttgaagagagaaaagcggcggtgttttgcggagagagtcgttttttttattgttcgaggggagcgcgtcgttttagtcgttcgaaagtaggaaatgggcggtaaaagcgtagttagatattaattggttttggattgttttcgagaggtagcgagtagcgttttcgcgtttcgttcgttaggagttgtcgttacgtttcgagttgcgtcgttcgcgtttttttttgtttcgagttttcggtgggggttgggttgcggtcgagttcggtattcgggtttttattcgcgtcgcgttgtcgaattcgtcgtcggttcgttttcggcgtcgataatcgtcggcgggtatttcgtagaggttgtcgtcggtttcgttaaatagtagttaaggtatagtcgggaagtttttaggttattcgttttttagtatttttcggggaattttcgtttagttttataggaggcgaaaacggaataaacgaaaattttttaatagtgaaatcgggttcggcgatggttcgggtggcgattgcgacgattcgacgcgtgcggatataagattcgtttcgcgtttcgttgtttttgtgcgttcggacgaattttagagattatttaaggaggttcgcgcgttattttttattacgtgatcgtttcgttaggtcgtttttcgcgtcgttattttatattcgggatagaggcggt

SEQ ID NO: 33380 - DNA, 1020 bp, Artificial Sequence
  chemically treated genomic DNA (Homo sapiens) CpG-island No: 33380
accgcctctatcccgaatataaaataacgacgcgaaaaacgacctaacgaaacgatcacgtaataaaaaataacgcgcgaacctccttaaataatctctaaaattcgtccgaacgcacaaaaacaacgaaacgcgaaacgaatcttatatccgcacgcgtcgaatcgtcgcaatcgccacccgaaccatcgccgaacccgatttcactattaaaaaattttcgtttattccgttttcgcctcctataaaactaaacgaaaattccccgaaaaatactaaaaaacgaataacctaaaaacttcccgactataccttaactactatttaacgaaaccgacgacaacctctacgaaatacccgccgacgattatcgacgccgaaaacgaaccgacgacgaattcgacaacgcgacgcgaataaaaacccgaataccgaactcgaccgcaacccaacccccaccgaaaactcgaaacaaaaaaaaacgcgaacgacgcaactcgaaacgtaacgacaactcctaacgaacgaaacgcgaaaacgctactcgctacctctcgaaaacaatccaaaaccaattaatatctaactacgcttttaccgcccatttcctactttcgaacgactaaaacgacgcgctcccctcgaacaataaaaaaaacgactctctccgcaaaacaccgccgcttttctctcttcaaaacgataactaacgtacaaaacgccgactatatcacccgaacgccgacgccgcctctcatccccgtaactctcgaaacgcgccgaaaataaccgaaccgctaaatactaaacgaaatctccgaacgcgacgcgaaaaaaaaacaaaaaaaaaaaaaaaacgacgaaccgacgtcgacgacgaaaaaaaacgaaaaaacgccgaaaccgctttactaccctccgcgtaatcccgtacctccccgacaccataaccctaactaaaataataatttatactattaatcgaattataacattacccgctataaaaataactacgca

SEQ ID NO: 33381 - DNA, 538 bp, Artificial Sequence
  chemically treated genomic DNA (Homo sapiens) CpG-island No: 33381
aattatggattggggggtttaatggcggaggttagcggttatgaatcgggagaaaaggggcgggggggaggggggaaagtcggtaaggcggcgaggggggggaagggggggaacgtcgaaaaaatcggagggacgtaataaagttcgggcgcgcgatcggaaagggaaaacggggaaggcggggggagcgaagcgagaaaagggagataagggggggggggggtggaaagaagaaattggtggggaatggggtttacgggaaggcgaagcggggacggcgaaagggaataacggaaggggggggaaataggggggaaaagggggggggataaaaacgcgggggaaagggaggagcgggggatggaaaggaattacggggaggggaaaaagggcggggatttggggacggagtcggatggggaaagggcggaaaaattcgggtaaggaataggatagacggggaaggggtggggggaggtaacgaatttttggttcgacgagggtatggtgggtaatcggtatttttttttgtgagcga

SEQ ID NO: 33382 - DNA, 538 bp, Artificial Sequence
  chemically treated genomic DNA (Homo sapiens) CpG-island No: 33382
tcgctcacaaaaaaaaataccgattacccaccataccctcgtcgaaccaaaaattcgttacctccccccaccccttccccgtctatcctattccttacccgaatttttccgccctttccccatccgactccgtccccaaatccccgccctttttcccctccccgtaattcctttccatcccccgctcctccctttcccccgcgtttttatcccccccccttttcccccctatttccccccccttccgttattccctttcgccgtccccgcttcgccttcccgtaaaccccattccccaccaatttcttctttccacccccccccccccttatctcccttttctcgcttcgctccccccgccttccccgttttccctttccgatcgcgcgcccgaactttattacgtccctccgattttttcgacgttcccccccttcccccccctcgccgccttaccgactttcccccctcccccccgccccttttctcccgattcataaccgctaacctccgccattaaaccccccaatccataatt

SEQ ID NO: 33383 - DNA, 538 bp, Artificial Sequence
  chemically treated genomic DNA (Homo sapiens) CpG-island No: 33383
tcgtttatagagggggatgtcgattgtttattatattttcgtcgggttaggggttcgttatttttttttatttttttttcgtttgttttattttttgttcggattttttcgttttttttttattcggtttcgtttttaagttttcgttttttttttttttttcgtggtttttttttatttttcgtttttttttttttttcgcgtttttatttttttttttttttttttttgttttttttttttttcgttattttttttcgtcgttttcgtttcgttttttcgtggattttattttttattagttttttttttttatttttttttttttttgttttttttttttcgtttcgtttttttcgtttttttcgtttttttttttcggtcgcgcgttcggattttattgcgttttttcgattttttcggcgttttttttttttttttttttcgtcgttttatcggtttttttttttttttttcgttttttttttttcgatttatggtcgttagttttcgttattaagttttttagtttataatt

SEQ ID NO: 33384 - DNA, 538 bp, Artificial Sequence
  chemically treated genomic DNA (Homo sapiens) CpG-island No: 33384
aattataaactaaaaaacttaataacgaaaactaacgaccataaatcgaaaaaaaaaaaacgaaaaaaaaaaaaaaaaaccgataaaacgacgaaaaaaaaaaaaaaaaaaaacgccgaaaaaatcgaaaaaacgcaataaaatccgaacgcgcgaccgaaaaaaaaaaacgaaaaaaacgaaaaaaacgaaacgaaaaaaaaaaaacaaaaaaaaaaaaaaataaaaaaaaaaaactaataaaaaataaaatccacgaaaaaacgaaacgaaaacgacgaaaaaaaataacgaaaaaaaaaaaaaacaaaaaaaaaaaaaaaaaaaaataaaaacgcgaaaaaaaaaaaaaaacgaaaaataaaaaaaaaccacgaaaaaaaaaaaaaaaacgaaaacttaaaaacgaaaccgaataaaaaaaaaacgaaaaaatccgaacaaaaaataaaacaaacgaaaaaaaaataaaaaaaaataacgaacccctaacccgacgaaaatataataaacaatcgacatccccctctataaacga

SEQ ID NO: 33385 - DNA, 806 bp, Artificial Sequence
  chemically treated genomic DNA (Homo sapiens) CpG-island No: 33385
ttttcgttttttttgcgtttttcgtttgcgcggtttggtttcgtgtattgtttcgttgtcgtttttttcgtttcgcgttgtcggtttttcggtttgtttttgttttcgcgttttttggttttttgtcgttttttgttttttcgttttttttcgtgcggtttttttggttcgttgttttgttgtttttttttgtgtgcggcgtttttgcgttgtttcggttttgtttcgtttcggtttcgtgtttcgcgtcggtttgggtttgttgtcgcggttcgatcgttttttgtcgtcgtttttgtttcgtttcggcgtcgcgttgtcgcgttcgcgcgagcgggttttttgtcgttgcgcgtcgcgtgtggtttgtgtcgttcgtgttgcgcgttgtgcgggtgttcgttgtttttttcggtgggcgggcgttttgcgtttttttttcgttcggcgttcgttgcggttttttggcgcgtgggttcgtcgttcgcggcggtttggttcgttttcggtttcgtttggcggcgtttgttttgtgttcgtggggttcgcgtcgcggtttcggtttttcgtcgggtttcggtcgttgcggtgttcgttcggtcgttttgttttttggtttgtttcgcgtcggtggttgcgtggcgtgttcggtcgttcgcggtcgttcgtttcgcgtggttttgcgttttgtttgcgtcgtttttgtttttttttcgtttttgtttgttttcgtgttttttcgcgttttttcgtttcgtttcgttcgtcggttcgttttttcgttttcgttttcggtcgtcgtcgtt

SEQ ID NO: 33386 - DNA, 806 bp, Artificial Sequence
  chemically treated genomic DNA (Homo sapiens) CpG-island No: 33386
aacgacgacgaccgaaaacgaaaacgaaaaaacgaaccgacgaacgaaacgaaacgaaaaaacgcgaaaaaacacgaaaacaaacaaaaacgaaaaaaaaacaaaaacgacgcaaacaaaacgcaaaaccacgcgaaacgaacgaccgcgaacgaccgaacacgccacgcaaccaccgacgcgaaacaaaccaaaaaacaaaacgaccgaacgaacaccgcaacgaccgaaacccgacgaaaaaccgaaaccgcgacgcgaaccccacgaacacaaaacaaacgccgccaaacgaaaccgaaaacgaaccaaaccgccgcgaacgacgaacccacgcgccaaaaaaccgcaacgaacgccgaacgaaaaaaaaacgcaaaacgcccgcccaccgaaaaaaacaacgaacacccgcacaacgcgcaacacgaacgacacaaaccacacgcgacgcgcaacgacaaaaaacccgctcgcgcgaacgcgacaacgcgacgccgaaacgaaacaaaaacgacgacaaaaaacgatcgaaccgcgacaacaaacccaaaccgacgcgaaacacgaaaccgaaacgaaacaaaaccgaaacaacgcaaaaacgccgcacacaaaaaaaaacaacaaaacaacgaaccaaaaaaaccgcacgaaaaaaaacgaaaaaacaaaaaacgacaaaaaaccaaaaaacgcgaaaacaaaaacaaaccgaaaaaccgacaacgcgaaacgaaaaaaacgacaacgaaacaatacacgaaaccaaaccgcgcaaacgaaaaacgcaaaaaaaacgaaaa

SEQ ID NO: 33387 - DNA, 806 bp, Artificial Sequence
  chemically treated genomic DNA (Homo sapiens) CpG-island No: 33387
gacgacgacggtcgggagcggaagcggggaggcggatcgacgggcgggacggggcgagaaggcgcgaaggagtacgaggataggtaggaacgagagggaagtaggggcggcgtagataggacgtagaattacgcgaggcgaacggtcgcggacgatcggatacgttacgtagttatcgacgcgagataaattaggaaatagagcgatcgggcgaatatcgtagcgatcggaattcggcgaaggatcgaggtcgcggcgcgggttttacgggtatagagtagacgtcgttaggcgaagtcggaggcgagttagatcgtcgcggacgacggatttacgcgttaggaggtcgtaacgggcgtcgagcgagaagagaacgtaaagcgttcgtttatcgaggaggatagcgggtattcgtataacgcgtaatacggacgatatagattatacgcggcgcgtagcggtaagggattcgttcgcgcggacgcggtagcgcggcgtcgggacggagtagagacgacggtagaggacggtcgagtcgcgatagtagatttaggtcggcgcggaatacggggtcgagacggaatagggtcgaagtagcgtagaagcgtcgtatatagggagagataataagatagcgagttaagagaatcgtacggaaaggagcgaggagatagaaagcgataagagattagggagcgcggaagtagaggtagatcgagggatcgatagcgcggagcggagagggcggtagcgaagtagtgtacgagattaggtcgcgtaagcggagagcgtagagaggacggagg

SEQ ID NO: 33388 - DNA, 806 bp, Artificial Sequence
  chemically treated genomic DNA (Homo sapiens) CpG-island No: 33388
cctccgtcctctctacgctctccgcttacgcgacctaatctcgtacactacttcgctaccgccctctccgctccgcgctatcgatccctcgatctacctctacttccgcgctccctaatctcttatcgctttctatctcctcgctcctttccgtacgattctcttaactcgctatcttattatctctccctatatacgacgcttctacgctacttcgaccctattccgtctcgaccccgtattccgcgccgacctaaatctactatcgcgactcgaccgtcctctaccgtcgtctctactccgtcccgacgccgcgctaccgcgtccgcgcgaacgaatcccttaccgctacgcgccgcgtataatctatatcgtccgtattacgcgttatacgaatacccgctatcctcctcgataaacgaacgctttacgttctcttctcgctcgacgcccgttacgacctcctaacgcgtaaatccgtcgtccgcgacgatctaactcgcctccgacttcgcctaacgacgtctactctatacccgtaaaacccgcgccgcgacctcgatccttcgccgaattccgatcgctacgatattcgcccgatcgctctatttcctaatttatctcgcgtcgataactacgtaacgtatccgatcgtccgcgaccgttcgcctcgcgtaattctacgtcctatctacgccgcccctacttccctctcgttcctacctatcctcgtactccttcgcgccttctcgccccgtcccgcccgtcgatccgcctccccgcttccgctcccgaccgtcgtcgtc

SEQ ID NO: 33389 - DNA, 686 bp, Artificial Sequence
  chemically treated genomic DNA (Homo sapiens) CpG-island No: 33389
  misc_feature (35)..(35): n is either a, c, g or t
  misc_feature (524)..(525): n is either a, c, g or t
  misc_feature (535)..(535): n is either a, c, g or t
  misc_feature (557)..(557): n is either a, c, g or t
gggtagttcggacgttcgttttgcgagcggcgtanaaacgttagtttttggaattttggggtttttcgattttcggagtagtgttaatttagagtattataaaaatagcgggacgggagagagtagtagcgggacgggaggagtcgggtcgttttcgcggtcgcgtatttgtgagtattaggagttgcgggcgtcgtaggtagggtttaggtttgagtaaagcgcgttatcggcgtttgaggttttcggttagttgataggtcgaaagcgtgtcggcggggttgaggggcgtgtcgatttcggagattttaaggggaaggttcgggtttcgattttaattataattcggttagattcgttttatttattagaatttagcgtcgtagtcgtttaattcggcgattgcggttggttttcggttaataatattttttattttcgcgaatcggaatttcgggggttagatattttattttcggtcgcgggcgcggcgtgggtcgtattaagtgcgttttgttttgtgnnttttatttgncgttttacgtgggttcgatagntaattgtgttatcgatcgtatttggggtgatgtttacggggaagggttgggtaagaggttcgagaggtggtcggaaggtaataaggtaataggggggagtcggaggtttttttattatttattagttat

SEQ ID NO: 33390 - DNA, 686 bp, Artificial Sequence
  chemically treated genomic DNA (Homo sapiens) CpG-island No: 33390
  misc_feature (130)..(130): n is either a, c, g or t
  misc_feature (152)..(152): n is either a, c, g or t
  misc_feature (162)..(163): n is either a, c, g or t
  misc_feature (652)..(652): n is either a, c, g or t
ataactaataaataataaaaaaacctccgactcccccctattaccttattaccttccgaccacctctcgaacctcttacccaacccttccccgtaaacatcaccccaaatacgatcgataacacaattanctatcgaacccacgtaaaacgncaaataaaanncacaaaacaaaacgcacttaatacgacccacgccgcgcccgcgaccgaaaataaaatatctaacccccgaaattccgattcgcgaaaataaaaaatattattaaccgaaaaccaaccgcaatcgccgaattaaacgactacgacgctaaattctaataaataaaacgaatctaaccgaattataattaaaatcgaaacccgaaccttccccttaaaatctccgaaatcgacacgcccctcaaccccgccgacacgctttcgacctatcaactaaccgaaaacctcaaacgccgataacgcgctttactcaaacctaaaccctacctacgacgcccgcaactcctaatactcacaaatacgcgaccgcgaaaacgacccgactcctcccgtcccgctactactctctcccgtcccgctatttttataatactctaaattaacactactccgaaaatcgaaaaaccccaaaattccaaaaactaacgtttntacgccgctcgcaaaacgaacgtccgaactaccc

SEQ ID NO: 33391 - DNA, 686 bp, Artificial Sequence
  chemically treated genomic DNA (Homo sapiens) CpG-island No: 33391
  misc_feature (130)..(130): n is either a, c, g or t
  misc_feature (152)..(152): n is either a, c, g or t
  misc_feature (162)..(163): n is either a, c, g or t
  misc_feature (652)..(652): n is either a, c, g or t
gtgattaataaataatagggggattttcgatttttttttgttgttttattatttttcgattatttttcggattttttgtttagttttttttcgtagatattattttagatacggtcggtgatataattgnttatcgggtttacgtagggcgntagatggagnntatagggtaggacgtatttggtacgatttacgtcgcgttcgcgatcggaagtgaggtgtttgattttcgaagtttcggttcgcgggggtggggagtgttgttaatcggaggttagtcgtagtcgtcggattgagcggttgcggcgttgggttttggtgagtggggcgaatttggtcgagttgtggttggggtcgggattcgaattttttttttgaggttttcggagtcggtacgttttttagtttcgtcgatacgttttcggtttgttagttggtcggagattttagacgtcggtggcgcgttttgtttaagtttgggttttgtttgcgacgttcgtaatttttggtgtttataggtgcgcggtcgcgagggcgattcggtttttttcgtttcgttgttgttttttttcgtttcgttgtttttgtggtgttttgagttgatattatttcgggggtcgggggattttaggattttaaaggttgacgtttntacgtcgttcgtagggcgggcgttcgaattgttt

SEQ ID NO: 33392 - DNA, 686 bp, Artificial Sequence
  chemically treated genomic DNA (Homo sapiens) CpG-island No: 33392
  misc_feature (35)..(35): n is either a, c, g or t
  misc_feature (524)..(525): n is either a, c, g or t
  misc_feature (535)..(535): n is either a, c, g or t
  misc_feature (557)..(557): n is either a, c, g or t
aaacaattcgaacgcccgccctacgaacgacgtanaaacgtcaacctttaaaatcctaaaatcccccgacccccgaaataatatcaactcaaaacaccacaaaaacaacgaaacgaaaaaaaacaacaacgaaacgaaaaaaaccgaatcgccctcgcgaccgcgcacctataaacaccaaaaattacgaacgtcgcaaacaaaacccaaacttaaacaaaacgcgccaccgacgtctaaaatctccgaccaactaacaaaccgaaaacgtatcgacgaaactaaaaaacgtaccgactccgaaaacctcaaaaaaaaaattcgaatcccgaccccaaccacaactcgaccaaattcgccccactcaccaaaacccaacgccgcaaccgctcaatccgacgactacgactaacctccgattaacaacactccccacccccgcgaaccgaaacttcgaaaatcaaacacctcacttccgatcgcgaacgcgacgtaaatcgtaccaaatacgtcctaccctatannctccatctancgccctacgtaaacccgataancaattatatcaccgaccgtatctaaaataatatctacgaaaaaaaactaaacaaaaaatccgaaaaataatcgaaaaataataaaacaacaaaaaaaaatcgaaaatccccctattatttattaatcac

SEQ ID NO: 33393 - DNA, 568 bp, Artificial Sequence
  chemically treated genomic DNA (Homo sapiens) CpG-island No: 33393
acggggtgcggaggcgtattttgggaatgtcgagagggtttcgtagagacgttatgggcgcgtgcgggtcggcggggagttggggggttagggcggacgttcgacgtgatggtttttttcgtaggcgtcgcggttttgttattgttgttgttcgttattatgttttatttgtttttggcggttcgttcgggtttcgcgcgtttgttgggtttattcgcgtttttgtcggggttggaggtgttgtggagtttacgggcgttgttgttgtggttcgtttggttcggtttgtaggcggcgttttatttattgtcggcgcgtaaggtgcgggtttcgttcgcggacgttcgggggagggaagcgaatgggttcggcgagggaaaggacgtttcgggttttattagagtttttttggattcgtaggtggtcgaggggtaggaattgaaggataagagtcgtttgcgttattttattaacggtgtttaggggacgggttttcgcgttggagttaagcggtcgggggtggagttttaggtttagcggggaggtttacggagattggtttttattt

SEQ ID NO: 33394 - DNA, 568 bp, Artificial Sequence
  chemically treated genomic DNA (Homo sapiens) CpG-island No: 33394
aaataaaaaccaatctccgtaaacctccccgctaaacctaaaactccacccccgaccgcttaactccaacgcgaaaacccgtcccctaaacaccgttaataaaataacgcaaacgactcttatccttcaattcctacccctcgaccacctacgaatccaaaaaaactctaataaaacccgaaacgtcctttccctcgccgaacccattcgcttccctcccccgaacgtccgcgaacgaaacccgcaccttacgcgccgacaataaataaaacgccgcctacaaaccgaaccaaacgaaccacaacaacaacgcccgtaaactccacaacacctccaaccccgacaaaaacgcgaataaacccaacaaacgcgcgaaacccgaacgaaccgccaaaaacaaataaaacataataacgaacaacaacaataacaaaaccgcgacgcctacgaaaaaaaccatcacgtcgaacgtccgccctaaccccccaactccccgccgacccgcacgcgcccataacgtctctacgaaaccctctcgacattcccaaaatacgcctccgcaccccgt

SEQ ID NO: 33395 - DNA, 568 bp, Artificial Sequence
  chemically treated genomic DNA (Homo sapiens) CpG-island No: 33395
gggtgggggttaattttcgtggattttttcgttaggtttggagttttattttcggtcgtttaattttagcgcgagggttcgttttttaggtatcgttaataggatagcgtaggcgatttttgttttttaatttttgtttttcggttatttgcgggtttaagggggttttgataaggttcggggcgttttttttttcgtcgagtttattcgtttttttttttcgagcgttcgcgagcggggttcgtattttgcgcgtcggtagtaggtagagcgtcgtttgtaggtcgagttaggcgagttatagtagtagcgttcgtgggttttatagtatttttagtttcggtagggacgcgggtggatttagtaggcgcgcggggttcgaacgggtcgttaggagtaggtggaatatggtggcgggtagtagtagtagtagagtcgcggcgtttgcgggaagggttattacgtcgggcgttcgttttagttttttagtttttcgtcggttcgtacgcgtttatgacgtttttgcgggattttttcggtatttttagagtgcgttttcgtatttcgt

SEQ ID NO: 33396 - DNA, 568 bp, Artificial Sequence
  chemically treated genomic DNA (Homo sapiens) CpG-island No: 33396
acgaaatacgaaaacgcactctaaaaataccgaaaaaatcccgcaaaaacgtcataaacgcgtacgaaccgacgaaaaactaaaaaactaaaacgaacgcccgacgtaataacccttcccgcaaacgccgcgactctactactactactacccgccaccatattccacctactcctaacgacccgttcgaaccccgcgcgcctactaaatccacccgcgtccctaccgaaactaaaaatactataaaacccacgaacgctactactataactcgcctaactcgacctacaaacgacgctctacctactaccgacgcgcaaaatacgaaccccgctcgcgaacgctcgaaaaaaaaaaacgaataaactcgacgaaaaaaaaaacgccccgaaccttatcaaaacccccttaaacccgcaaataaccgaaaaacaaaaattaaaaaacaaaaatcgcctacgctatcctattaacgatacctaaaaaacgaaccctcgcgctaaaattaaacgaccgaaaataaaactccaaacctaacgaaaaaatccacgaaaattaacccccaccc

SEQ ID NO: 33397 - DNA, 979 bp, Artificial Sequence
  chemically treated genomic DNA (Homo sapiens) CpG-island No: 33397
  misc_feature (3)..(3): n is either a, c, g or t
ttncggtagggattatatcggtgtattatgggagcggttcgggttatacgttaaaaatattaaggggagcgcgcgacgtgaatttggcgttcgatgggggtcgttagtcgttttagagcgcgcggagcgagagaggcgtagttggattataacgtagtgtatttcgggaggttaattcgattggattgggtgagaggatagaggtggttcgatgggcggttcgaaggtcggggattatggcgggaaggcgggtttagataggtttagtttcgtttcgattcgtcgttttttatttttcggtcggtttcgcgtgttttttcgtagtattgtcgttttcgggatgttgagcgtttatcgttttttcgtagtttttttatgttcggttgcgagttgttcgtgtatttgttcggatatgtgttcggtcgtcgaggcgtttagtaaatgggagtatcgtttgtatcgtttggaggtggtgtcgggttgtcgttagattcgtttcggtcgagttcgtagagtcggtggaaggagtatagtcgattcgtcgtcggtaagtttcggttttcgtttagttagttgcgttcgtttttcgtgttgttggttatcgtgcgttatttggtcggtgaggtggcggagagcgtcgatatcgttcgcgtcgaggtggttagtttcgtggtagatcgtttgcgagttgtgtttttggatttggcgttgtagggagcgggcgacgtcgaggtagttgtggtgttggaggcggcgttggttacgttgttgatcgtagtggcgcggttcgggttcgacgcggcgcggggattcgcggattcggtgttgttgtaggtttaggtgtaggagggtttcggttcgttgcggcgttgttatcgcggggcgtcgggtcgtattttcgttaattcgttttttagggtttttttttgttttataatttgggtgagtcgggattttggcggttgggtagagcgtgggg

SEQ ID NO: 33398 - DNA, 979 bp, Artificial Sequence
  chemically treated genomic DNA (Homo sapiens) CpG-island No: 33398
  misc_feature (977)..(977): n is either a, c, g or t
ccccacgctctacccaaccgccaaaatcccgactcacccaaattataaaacaaaaaaaaaccctaaaaaacgaattaacgaaaatacgacccgacgccccgcgataacaacgccgcaacgaaccgaaaccctcctacacctaaacctacaacaacaccgaatccgcgaatccccgcgccgcgtcgaacccgaaccgcgccactacgatcaacaacgtaaccaacgccgcctccaacaccacaactacctcgacgtcgcccgctccctacaacgccaaatccaaaaacacaactcgcaaacgatctaccacgaaactaaccacctcgacgcgaacgatatcgacgctctccgccacctcaccgaccaaataacgcacgataaccaacaacacgaaaaacgaacgcaactaactaaacgaaaaccgaaacttaccgacgacgaatcgactatactccttccaccgactctacgaactcgaccgaaacgaatctaacgacaacccgacaccacctccaaacgatacaaacgatactcccatttactaaacgcctcgacgaccgaacacatatccgaacaaatacacgaacaactcgcaaccgaacataaaaaaactacgaaaaaacgataaacgctcaacatcccgaaaacgacaatactacgaaaaaacacgcgaaaccgaccgaaaaataaaaaacgacgaatcgaaacgaaactaaacctatctaaacccgccttcccgccataatccccgaccttcgaaccgcccatcgaaccacctctatcctctcacccaatccaatcgaattaacctcccgaaatacactacgttataatccaactacgcctctctcgctccgcgcgctctaaaacgactaacgacccccatcgaacgccaaattcacgtcgcgcgctccccttaatatttttaacgtataacccgaaccgctcccataatacaccgatataatccctaccgnaa

SEQ ID NO: 33399 - DNA, 979 bp, Artificial Sequence
  chemically treated genomic DNA (Homo sapiens) CpG-island No: 33399
  misc_feature (977)..(977): n is either a, c, g or t
ttttacgttttgtttagtcgttaggatttcgatttatttaggttatagagtagaaagaggttttggaaggcgggttggcgggggtgcggttcggcgtttcgcggtagtagcgtcgtagcgagtcgaagtttttttgtatttgggtttgtagtagtatcgggttcgcgggttttcgcgtcgcgtcgggttcgagtcgcgttattacggttagtagcgtggttagcgtcgtttttagtattatagttgtttcggcgtcgttcgttttttgtagcgttaggtttaggagtatagttcgtaagcggtttgttacgaagttggttatttcggcgcgggcgatgtcggcgtttttcgttattttatcggttaggtagcgtacggtggttagtagtacggagggcggacgtaattggttgggcgggggtcggggtttgtcggcggcgggtcggttgtattttttttatcggttttgcggattcggtcggggcgggtttggcggtaattcggtattatttttaagcggtgtaggcggtgtttttatttgttgggcgtttcggcggtcgggtatatgttcgggtaggtgtacgggtagttcgtagtcgggtatgagggggttgcggggagacggtgggcgtttagtatttcggggacggtagtgttgcgggaaggtacgcgaggtcggtcggggggtggggagcggcgggtcggggcggggttgaatttgtttgggttcgttttttcgttatgattttcggttttcgggtcgtttatcgagttatttttgtttttttatttagtttagtcgagttggtttttcgagatgtattgcgttgtagtttagttacgtttttttcgtttcgcgcgttttagggcggttaacggtttttatcgagcgttaagtttacgtcgcgcgttttttttagtgtttttaacgtgtagttcgggtcgtttttatgatatatcggtgtagtttttgtcgnaa

SEQ ID NO: 33400 - DNA, 979 bp, Artificial Sequence
  chemically treated genomic DNA (Homo sapiens) CpG-island No: 33400
  misc_feature (3)..(3): n is either a, c, g or t
ttncgacaaaaactacaccgatatatcataaaaacgacccgaactacacgttaaaaacactaaaaaaaacgcgcgacgtaaacttaacgctcgataaaaaccgttaaccgccctaaaacgcgcgaaacgaaaaaaacgtaactaaactacaacgcaatacatctcgaaaaaccaactcgactaaactaaataaaaaaacaaaaataactcgataaacgacccgaaaaccgaaaatcataacgaaaaaacgaacccaaacaaattcaaccccgccccgacccgccgctccccaccccccgaccgacctcgcgtaccttcccgcaacactaccgtccccgaaatactaaacgcccaccgtctccccgcaaccccctcatacccgactacgaactacccgtacacctacccgaacatatacccgaccgccgaaacgcccaacaaataaaaacaccgcctacaccgcttaaaaataataccgaattaccgccaaacccgccccgaccgaatccgcaaaaccgataaaaaaaatacaaccgacccgccgccgacaaaccccgacccccgcccaaccaattacgtccgccctccgtactactaaccaccgtacgctacctaaccgataaaataacgaaaaacgccgacatcgcccgcgccgaaataaccaacttcgtaacaaaccgcttacgaactatactcctaaacctaacgctacaaaaaacgaacgacgccgaaacaactataatactaaaaacgacgctaaccacgctactaaccgtaataacgcgactcgaacccgacgcgacgcgaaaacccgcgaacccgatactactacaaacccaaatacaaaaaaacttcgactcgctacgacgctactaccgcgaaacgccgaaccgcacccccgccaacccgccttccaaaacctctttctactctataacctaaataaatcgaaatcctaacgactaaacaaaacgtaaaa

SEQ ID NO: 33401 - DNA, 567 bp, Artificial Sequence
  chemically treated genomic DNA (Homo sapiens) CpG-island No: 33401
  misc_feature (28)..(28): n is either a, c, g or t
  misc_feature (477)..(477): n is either a, c, g or t
agcggtagggaagaggtaatttttttanttatgttttttttaaacggttcgattttatttttttcgcgcgtttttttttatcggagttttgagcggtttttcggacgcggttcgttttttagatataatttaggttttttttcgagttttttttacggttcgtttcggcgcgcgttaatcgggaaggttattcgttgtaaaaaacgttcgaattttatcgttgcgggaaaggaagcggaagtgacgtagggttagcggtttgcggttttcggaatttcgagttttttttattcgtttttatttttagcggtagcggaggcgtggtttaggggcgcgatggcgttattagcgcgcgtcgtattcggaagagacgtggtagcggagggataatcggggcggtcggggttgaagggagaggcgtaggagttttggggagagtggtttttgttttttcgcgtttcgagttattcgtatcgnttttcggaattagtgtagcggtcgattagtaaatatagagattggggtttgtagagaaggggcgggatttggagggggtggggtttagga

SEQ ID NO: 33402 - DNA, 567 bp, Artificial Sequence
  chemically treated genomic DNA (Homo sapiens) CpG-island No: 33402
  misc_feature (91)..(91): n is either a, c, g or t
  misc_feature (540)..(540): n is either a, c, g or t
tcctaaaccccaccccctccaaatcccgccccttctctacaaaccccaatctctatatttactaatcgaccgctacactaattccgaaaancgatacgaataactcgaaacgcgaaaaaacaaaaaccactctccccaaaactcctacgcctctcccttcaaccccgaccgccccgattatccctccgctaccacgtctcttccgaatacgacgcgcgctaataacgccatcgcgcccctaaaccacgcctccgctaccgctaaaaataaaaacgaataaaaaaaactcgaaattccgaaaaccgcaaaccgctaaccctacgtcacttccgcttcctttcccgcaacgataaaattcgaacgttttttacaacgaataaccttcccgattaacgcgcgccgaaacgaaccgtaaaaaaaactcgaaaaaaaacctaaattatatctaaaaaacgaaccgcgtccgaaaaaccgctcaaaactccgataaaaaaaaacgcgcgaaaaaaataaaatcgaaccgtttaaaaaaaacataantaaaaaaattacctcttccctaccgct

SEQ ID NO: 33403 - DNA, 567 bp, Artificial Sequence
  chemically treated genomic DNA (Homo sapiens) CpG-island No: 33403
  misc_feature (91)..(91): n is either a, c, g or t
  misc_feature (540)..(540): n is either a, c, g or t
ttttgagttttattttttttaagtttcgttttttttttatagattttagtttttgtgtttattgatcggtcgttgtattggtttcgaaggncggtacggatggttcgaggcgcggaagggtagggattattttttttagggtttttgcgtttttttttttagtttcggtcgtttcgattattttttcgttgttacgtttttttcgggtgcggcgcgcgttgatgacgttatcgcgtttttgggttacgttttcgttgtcgttagaggtgaagacgggtggaaaagattcggggtttcgagggtcgtagatcgttagttttacgttattttcgttttttttttcgtagcggtgagattcgaacgttttttgtagcgagtggttttttcggttggcgcgcgtcggggcgggtcgtaggaggagttcgagaaggagtttaagttatgtttgggaggcgaatcgcgttcggagaatcgtttagagtttcggtgagagagggcgcgcgggaaaagtgaggtcgagtcgtttgggggaagtatggntggaaagattgttttttttttatcgtt

SEQ ID NO: 33404 - DNA, 567 bp, Artificial Sequence
  chemically treated genomic DNA (Homo sapiens) CpG-island No: 33404
  misc_feature (28)..(28): n is either a, c, g or t
  misc_feature (477)..(477): n is either a, c, g or t
aacgataaaaaaaaaacaatctttccanccatacttcccccaaacgactcgacctcacttttcccgcgcgccctctctcaccgaaactctaaacgattctccgaacgcgattcgcctcccaaacataacttaaactccttctcgaactcctcctacgacccgccccgacgcgcgccaaccgaaaaaaccactcgctacaaaaaacgttcgaatctcaccgctacgaaaaaaaaaacgaaaataacgtaaaactaacgatctacgaccctcgaaaccccgaatcttttccacccgtcttcacctctaacgacaacgaaaacgtaacccaaaaacgcgataacgtcatcaacgcgcgccgcacccgaaaaaaacgtaacaacgaaaaaataatcgaaacgaccgaaactaaaaaaaaaaacgcaaaaaccctaaaaaaaataatccctacccttccgcgcctcgaaccatccgtaccgnccttcgaaaccaatacaacgaccgatcaataaacacaaaaactaaaatctataaaaaaaaaacgaaacttaaaaaaaataaaactcaaaa

SEQ ID NO: 33405 - DNA, 973 bp, Artificial Sequence
  chemically treated genomic DNA (Homo sapiens) CpG-island No: 33405
acgcgacgggcgaacggcgtcgcgtagagcgagcgaggtcgcggcgatcggcggcgagcgggagcgcgcggggagagaaggattcgcggggatagcgagcgggaagcgcgcgagaacgagggacgagggggcgggagggagggacggtcgtcggcgcgaggggcggcggagagagttagcgaagtcgggggcggcgagcggacggcggcggcgagcgcggaggcggcggggggcgttacggcgggtaggcggcggaataggagcggtaggcggagggcgaggacgaggacgggcgaggacgggaggagggcggtagtagggcgggcgcgcgtcgaaggcgcgagcgggggagagagcgggagcgagtcggcggcgtagcggaggtacgcgaagggacggggcgcggagtagagagggaggcgcgaagcgtaggggtagcgcgtcgtcggaggcgatcgcgggagaggcggtaggcgaggcgggagcggggagaggggcggaaggtaggcggggcggcgcgtagacgcgtaggagcgagagggggcgaggacgggggtacggggcggggggtcggaggcggcgggtcgcggtcgcggggtagggcgggcgacgggagggcgagatcggggcggcgcggagcgtcgtagcgtagcgagcggggtcgcgggcgcggtaggtcgcgcgcgtaggggatcggcggggaggattagtcgcggtaaggtcgcgtcggcgacgtagatcgagcgtagtcgggtcgtagcgggcggattagcgtcggggtcgtggggcggggcgcgcgcgcggagcgaggaggagaggggggggagagagaggtagcgaggggaggagggggaggggcggggagagggggcgggggcgggagaggggcggcgacggggggggagtgtcggggagcgtcggttagacggggggcgggtaggagggcggagttttgtttttttttttgtttttt

SEQ ID NO: 33406 - DNA, 973 bp, Artificial Sequence
  chemically treated genomic DNA (Homo sapiens) CpG-island No: 33406
aaaaaacaaaaaaaaaaacaaaactccgccctcctacccgccccccgtctaaccgacgctccccgacactccccccccgtcgccgcccctctcccgcccccgccccctctccccgcccctccccctcctcccctcgctacctctctctcccccccctctcctcctcgctccgcgcgcgcgccccgccccacgaccccgacgctaatccgcccgctacgacccgactacgctcgatctacgtcgccgacgcgaccttaccgcgactaatcctccccgccgatcccctacgcgcgcgacctaccgcgcccgcgaccccgctcgctacgctacgacgctccgcgccgccccgatctcgccctcccgtcgcccgccctaccccgcgaccgcgacccgccgcctccgaccccccgccccgtacccccgtcctcgccccctctcgctcctacgcgtctacgcgccgccccgcctaccttccgcccctctccccgctcccgcctcgcctaccgcctctcccgcgatcgcctccgacgacgcgctacccctacgcttcgcgcctccctctctactccgcgccccgtcccttcgcgtacctccgctacgccgccgactcgctcccgctctctcccccgctcgcgccttcgacgcgcgcccgccctactaccgccctcctcccgtcctcgcccgtcctcgtcctcgccctccgcctaccgctcctattccgccgcctacccgccgtaacgccccccgccgcctccgcgctcgccgccgccgtccgctcgccgcccccgacttcgctaactctctccgccgcccctcgcgccgacgaccgtccctccctcccgccccctcgtccctcgttctcgcgcgcttcccgctcgctatccccgcgaatccttctctccccgcgcgctcccgctcgccgccgatcgccgcgacctcgctcgctctacgcgacgccgttcgcccgtcgcgt

SEQ ID NO: 33407 - DNA, 973 bp, Artificial Sequence
  chemically treated genomic DNA (Homo sapiens) CpG-island No: 33407
agggggtaggggggagggtagagtttcgtttttttgttcgtttttcgtttagtcggcgtttttcggtatttttttttcgtcgtcgtttttttttcgttttcgtttttttttttcgtttttttttttttttttttcgttgttttttttttttttttttttttttttcgtttcgcgcgcgcgtttcgttttacggtttcggcgttggttcgttcgttgcggttcggttgcgttcggtttgcgtcgtcggcgcggttttgtcgcggttggtttttttcgtcggttttttgcgcgcgcggtttgtcgcgttcgcggtttcgttcgttgcgttgcggcgtttcgcgtcgtttcggtttcgttttttcgtcgttcgttttgtttcgcggtcgcggttcgtcgttttcggtttttcgtttcgtattttcgttttcgttttttttcgtttttgcgcgtttgcgcgtcgtttcgtttgtttttcgttttttttttcgttttcgtttcgtttgtcgtttttttcgcggtcgttttcggcggcgcgttgtttttgcgtttcgcgtttttttttttgtttcgcgtttcgttttttcgcgtgttttcgttgcgtcgtcggttcgttttcgttttttttttcgttcgcgttttcggcgcgcgttcgttttgttgtcgtttttttttcgttttcgttcgttttcgttttcgtttttcgtttgtcgtttttgtttcgtcgtttgttcgtcgtggcgtttttcgtcgttttcgcgttcgtcgtcgtcgttcgttcgtcgttttcggtttcgttggtttttttcgtcgtttttcgcgtcggcggtcgtttttttttttcgttttttcgtttttcgttttcgcgcgtttttcgttcgttgttttcgcggattttttttttttcgcgcgttttcgttcgtcgtcggtcgtcgcggtttcgttcgttttgcgcggcgtcgttcgttcgtcgcgt

SEQ ID NO: 33408 - DNA, 973 bp, Artificial Sequence
  chemically treated genomic DNA (Homo sapiens) CpG-island No: 33408
acgcgacgaacgaacgacgccgcgcaaaacgaacgaaaccgcgacgaccgacgacgaacgaaaacgcgcgaaaaaaaaaaaatccgcgaaaacaacgaacgaaaaacgcgcgaaaacgaaaaacgaaaaaacgaaaaaaaaaaacgaccgccgacgcgaaaaacgacgaaaaaaaccaacgaaaccgaaaacgacgaacgaacgacgacgacgaacgcgaaaacgacgaaaaacgccacgacgaacaaacgacgaaacaaaaacgacaaacgaaaaacgaaaacgaaaacgaacgaaaacgaaaaaaaaacgacaacaaaacgaacgcgcgccgaaaacgcgaacgaaaaaaaaaacgaaaacgaaccgacgacgcaacgaaaacacgcgaaaaaacgaaacgcgaaacaaaaaaaaaaacgcgaaacgcaaaaacaacgcgccgccgaaaacgaccgcgaaaaaaacgacaaacgaaacgaaaacgaaaaaaaaaacgaaaaacaaacgaaacgacgcgcaaacgcgcaaaaacgaaaaaaaacgaaaacgaaaatacgaaacgaaaaaccgaaaacgacgaaccgcgaccgcgaaacaaaacgaacgacgaaaaaacgaaaccgaaacgacgcgaaacgccgcaacgcaacgaacgaaaccgcgaacgcgacaaaccgcgcgcgcaaaaaaccgacgaaaaaaaccaaccgcgacaaaaccgcgccgacgacgcaaaccgaacgcaaccgaaccgcaacgaacgaaccaacgccgaaaccgtaaaacgaaacgcgcgcgcgaaacgaaaaaaaaaaaaaaaaaaaaaaaaaacaacgaaaaaaaaaaaaaaaaaaacgaaaaaaaaaaacgaaaacgaaaaaaaaacgacgacgaaaaaaaaataccgaaaaacgccgactaaacgaaaaacgaacaaaaaaacgaaactctaccctcccccctaccccct

SEQ ID NO: 33409 - DNA, 563 bp, Artificial Sequence
  chemically treated genomic DNA (Homo sapiens) CpG-island No: 33409
tttttttcggttttttcgtatttttgttttttattttttttttttttcgtcggatcgatcgaagtagaggtgagcgagggtagcgtaagtagcgtagcgagttaggtgaaggcggagttaagaattgcgagagttgttattagagtttatcgggcgttttgtttgttttttttcggatttacgcgatttaggtttagggagtcgcggattcgggcgtttttaggatgttgggtttgatgtttgcgaggggtaggacgaggcgaaggttatttcgttgtttttttagttttagaattatttaatgtacgggttttaatcgtagtcggtaagttgttttttttcggtttttcgaggttttggagtttgtataattgttttataaaaggcggtggtttcgtttaacgttagatggacgtttgttttgcgtggtgatattagagcgagagtcgattgtttttgtgtcgtagtcgggtggtgtgtttgtttttaagtttggaggcgggtggttcgagttcgttttatggaacgttttttgtattttaaaaatgtttaaatcgttggta

SEQ ID NO: 33410 - DNA, 563 bp, Artificial Sequence
  chemically treated genomic DNA (Homo sapiens) CpG-island No: 33410
taccaacgatttaaacatttttaaaatacaaaaaacgttccataaaacgaactcgaaccacccgcctccaaacttaaaaacaaacacaccacccgactacgacacaaaaacaatcgactctcgctctaatatcaccacgcaaaacaaacgtccatctaacgttaaacgaaaccaccgccttttataaaacaattatacaaactccaaaacctcgaaaaaccgaaaaaaaacaacttaccgactacgattaaaacccgtacattaaataattctaaaactaaaaaaacaacgaaataaccttcgcctcgtcctacccctcgcaaacatcaaacccaacatcctaaaaacgcccgaatccgcgactccctaaacctaaatcgcgtaaatccgaaaaaaaacaaacaaaacgcccgataaactctaataacaactctcgcaattcttaactccgccttcacctaactcgctacgctacttacgctaccctcgctcacctctacttcgatcgatccgacgaaaaaaaaaaaaaataaaaaacaaaaatacgaaaaaaccgaaaaaaa

SEQ ID NO: 33411 - DNA, 563 bp, Artificial Sequence
  chemically treated genomic DNA (Homo sapiens) CpG-island No: 33411
tgttagcggtttaagtatttttaaaatgtaggaaacgttttatagaacgagttcgaattattcgtttttagatttggaagtaagtatattattcgattgcgatataggaatagtcgattttcgttttggtattattacgtagagtaagcgtttatttaacgttaggcggagttatcgttttttgtagaataattgtgtaggttttaaagtttcggaaaatcggagaggggtagtttgtcggttacggttgaaattcgtgtattgggtgattttgaagttggaagggtagcggaatggttttcgtttcgttttgtttttcgtaggtattagatttagtattttggaaacgttcgggttcgcgattttttgagtttgaatcgcgtgggttcgaagggaagtaagtagaacgttcggtgggttttagtgatagttttcgtagtttttggtttcgtttttatttgattcgttacgttgtttgcgttattttcgtttatttttgtttcggtcggttcggcgggagagaggaagggtgaaaagtagaaatacggagaggtcggagagaa

SEQ ID NO: 33412 - DNA, 563 bp, Artificial Sequence
  chemically treated genomic DNA (Homo sapiens) CpG-island No: 33412
ttctctccgacctctccgtatttctacttttcacccttcctctctcccgccgaaccgaccgaaacaaaaataaacgaaaataacgcaaacaacgtaacgaatcaaataaaaacgaaaccaaaaactacgaaaactatcactaaaacccaccgaacgttctacttacttcccttcgaacccacgcgattcaaactcaaaaaatcgcgaacccgaacgtttccaaaatactaaatctaatacctacgaaaaacaaaacgaaacgaaaaccattccgctacccttccaacttcaaaatcacccaatacacgaatttcaaccgtaaccgacaaactacccctctccgattttccgaaactttaaaacctacacaattattctacaaaaaacgataactccgcctaacgttaaataaacgcttactctacgtaataataccaaaacgaaaatcgactattcctatatcgcaatcgaataatatacttacttccaaatctaaaaacgaataattcgaactcgttctataaaacgtttcctacattttaaaaatacttaaaccgctaaca

SEQ ID NO: 33413 - DNA, 505 bp, Artificial Sequence
  chemically treated genomic DNA (Homo sapiens) CpG-island No: 33413
tcgtaagcgaggaatttagcgtagggaaagtagtttcggtggggttcggcgcgttagtttattcgcgtggtaaaatttgcggggttttcgcgtgtcgcgttttagtttagttgtgcgttcgtaggttttagattcgtcgttcgtttgatttggcgcggcgtttttatttcggaacgttgggtggatttcgtagtaaattttaattttttatttaggcggtagcggcgcggtgtttcggtttcgtttttggtatcgtaggtcgttcgtttcgcgtttttaaaagtattaggtttatttagaagtttaggtagtttcgcgatttttatttattttttttagtatcgtcgttgtttttatcgtcgtttagcgtaggcgtagtagagatttaaaaggatacggtcgtttttatcgtataacgggttggagtaggttaggggtcgtaggggttgagaaaacgagtaacggaggatagagtgtagtggggacggggaaatttttttttttt

SEQ ID NO: 33414 - DNA, 505 bp, Artificial Sequence
  chemically treated genomic DNA (Homo sapiens) CpG-island No: 33414
aaaaaaaaaaaatttccccgtccccactacactctatcctccgttactcgttttctcaacccctacgacccctaacctactccaacccgttatacgataaaaacgaccgtatccttttaaatctctactacgcctacgctaaacgacgataaaaacaacgacgatactaaaaaaaataaataaaaatcgcgaaactacctaaacttctaaataaacctaatacttttaaaaacgcgaaacgaacgacctacgataccaaaaacgaaaccgaaacaccgcgccgctaccgcctaaataaaaaattaaaatttactacgaaatccacccaacgttccgaaataaaaacgccgcgccaaatcaaacgaacgacgaatctaaaacctacgaacgcacaactaaactaaaacgcgacacgcgaaaaccccgcaaattttaccacgcgaataaactaacgcgccgaaccccaccgaaactactttccctacgctaaattcctcgcttacga

SEQ ID NO: 33415 - DNA, 505 bp, Artificial Sequence
  chemically treated genomic DNA (Homo sapiens) CpG-island No: 33415
ggaggagagggattttttcgtttttattgtattttgtttttcgttattcgtttttttagtttttgcggtttttaatttgttttaattcgttgtgcggtagaggcggtcgtgtttttttaagtttttgttacgtttgcgttgggcggcggtagagatagcggcggtgttgggaggggtaggtgagggtcgcgaggttgtttgagtttttaagtgagtttgatgtttttgggaacgcggaacgggcgatttgcggtgttaggagcgaagtcgaggtatcgcgtcgttgtcgtttggatgggaagttaaggtttattgcgaagtttatttagcgtttcgaggtgagggcgtcgcgttaggttaggcgggcggcgagtttgggatttgcgggcgtatagttgggttgaggcgcggtacgcggagatttcgtaagttttgttacgcgagtgggttgacgcgtcgggttttatcggggttattttttttgcgttggatttttcgtttgcgg

SEQ ID NO: 33416 - DNA, 505 bp, Artificial Sequence
  chemically treated genomic DNA (Homo sapiens) CpG-island No: 33416
ccgcaaacgaaaaatccaacgcaaaaaaaataaccccgataaaacccgacgcgtcaacccactcgcgtaacaaaacttacgaaatctccgcgtaccgcgcctcaacccaactatacgcccgcaaatcccaaactcgccgcccgcctaacctaacgcgacgccctcacctcgaaacgctaaataaacttcgcaataaaccttaacttcccatccaaacgacaacgacgcgatacctcgacttcgctcctaacaccgcaaatcgcccgttccgcgttcccaaaaacatcaaactcacttaaaaactcaaacaacctcgcgaccctcacctacccctcccaacaccgccgctatctctaccgccgcccaacgcaaacgtaacaaaaacttaaaaaaacacgaccgcctctaccgcacaacgaattaaaacaaattaaaaaccgcaaaaactaaaaaaacgaataacgaaaaacaaaatacaataaaaacgaaaaaatccctctcctcc

SEQ ID NO: 33417 - DNA, 550 bp, Artificial Sequence
  chemically treated genomic DNA (Homo sapiens) CpG-island No: 33417
cggcggtcgtcgaggagtcggttttaggtaagtgagggtcggttcggagggcgggcggggtcgggggtttttttttgttcgtcgttatcgttttttttttttgcgttttttttgcgtagcgcgggttagtgtttaagaataacgtgttattttttcggcggtttggtcgcgagggggggagggggcggcggttcggttgtcgtcgtttttgttttcgggggttcgtttttttgttttttcggcgcggcgtgcgcgttggtgcggcgtggcggttgggttgtcgggggtgggggtttggtcggcgtgcgtggtgtttttttcgttcgttggtcggggttgtgtcgtttttcgtttgtgcggttggtggcggggtggggtgcgtttgtcgtcgcggggggttggcggtttttggggcgtcgggcgggggggtcgttcggcgtcgggtttgtcgcgggtgttggttgcgttttgcgggggggtgcgtttcggcgcgttggcggtcggtgcggggcgttcgtgtgtgtgcgtgcgtcgcggtcgcgtgtgtgtg

SEQ ID NO: 33418 - DNA, 550 bp, Artificial Sequence
  chemically treated genomic DNA (Homo sapiens) CpG-island No: 33418
cacacacacgcgaccgcgacgcacgcacacacacgaacgccccgcaccgaccgccaacgcgccgaaacgcacccccccgcaaaacgcaaccaacacccgcgacaaacccgacgccgaacgacccccccgcccgacgccccaaaaaccgccaaccccccgcgacgacaaacgcaccccaccccgccaccaaccgcacaaacgaaaaacgacacaaccccgaccaacgaacgaaaaaaacaccacgcacgccgaccaaacccccacccccgacaacccaaccgccacgccgcaccaacgcgcacgccgcgccgaaaaaacaaaaaaacgaacccccgaaaacaaaaacgacgacaaccgaaccgccgccccctccccccctcgcgaccaaaccgccgaaaaaataacacgttattcttaaacactaacccgcgctacgcaaaaaaaacgcaaaaaaaaaaaacgataacgacgaacaaaaaaaaacccccgaccccgcccgccctccgaaccgaccctcacttacctaaaaccgactcctcgacgaccgccg

SEQ ID NO: 33419 - DNA, 550 bp, Artificial Sequence
  chemically treated genomic DNA (Homo sapiens) CpG-island No: 33419
tatatatacgcgatcgcgacgtacgtatatatacgggcgtttcgtatcggtcgttagcgcgtcgggacgtattttttcgtagggcgtaattaatattcgcggtagattcggcgtcgggcgattttttcgttcggcgttttagaggtcgttagtttttcgcggcggtaaacgtattttatttcgttattagtcgtatagacggggggcgatatagtttcggttaacgggcggaggggatattacgtacgtcgattaggtttttattttcggtagtttaatcgttacgtcgtattagcgcgtacgtcgcgtcgagaaagtaggaaggcgagttttcgggagtaggaacgacggtaatcgggtcgtcgttttttttttttttcgcggttaggtcgtcgggaaagtaatacgttgtttttgggtattggttcgcgttgcgtagggagggcgtaggggagggaggcggtggcggcgggtagggaggagttttcggtttcgttcgtttttcgggtcgatttttatttgtttgaaatcggtttttcgacggtcgtcg

SEQ ID NO: 33420 - DNA, 550 bp, Artificial Sequence
  chemically treated genomic DNA (Homo sapiens) CpG-island No: 33420
cgacgaccgtcgaaaaaccgatttcaaacaaataaaaatcgacccgaaaaacgaacgaaaccgaaaactcctccctacccgccgccaccgcctccctcccctacgccctccctacgcaacgcgaaccaatacccaaaaacaacgtattactttcccgacgacctaaccgcgaaaaaaaaaaaaaacgacgacccgattaccgtcgttcctactcccgaaaactcgccttcctactttctcgacgcgacgtacgcgctaatacgacgtaacgattaaactaccgaaaataaaaacctaatcgacgtacgtaatatcccctccgcccgttaaccgaaactatatcgccccccgtctatacgactaataacgaaataaaatacgtttaccgccgcgaaaaactaacgacctctaaaacgccgaacgaaaaaatcgcccgacgccgaatctaccgcgaatattaattacgccctacgaaaaaatacgtcccgacgcgctaacgaccgatacgaaacgcccgtatatatacgtacgtcgcgatcgcgtatatata

SEQ ID NO: 33421 - DNA, 922 bp, Artificial Sequence
  chemically treated genomic DNA (Homo sapiens) CpG-island No: 33421
  misc_feature (426)..(426): n is either a, c, g or t
ttatcgaggttacggagatattgggttttgatatcgattacggcgatatcgttatcgatatcgatcgcggtattttttatacgcgggcgcgcgcgatcgattcgggcgttgttgcgtagttttacgtcgtttttttagaaatcgaatttgttttgcgcgcggcgcgaatgtaggaatagtattgcgtagcggttagggtgcggtacgcggtatgtataacgatattggttttgtattcggcgtatcgatcgttacgcgtcggaacgttttgttttcggttagtagatttatgtcggggcgtatgaaatttttgtcgttggcgggatagagttttagtcggagtaggttagtgcggttttttaagttcgaaacgttgatttgaatggcgggttcgcgtttcgaagcgtagtggttggcgttcgtttntattatattattcgcgagagtcgcgttcgggtacgtcgcgagcgcgattagcgttagaaagaaagtcgataatattatttttatgatcggttttgaaatcgtttcggtacgcggtttcgtacgaaacgaattatcgaatttatgggttgcgcgaaacgcgtttggggcggatggttaaatcggcgtataatttaacgacgtcgttttcgggggaattttttcgtcgtttgggtcgtgggataagcgtttcgttttgaggtcgaacgggaatttttttttttggggggcgtaagttcggttagttatacgggtatgtaatttcgattaggtaatgttcggattttgttcggggggacgtttcggtttatgggtttgtttcggagggtcgggtataatcgggttcgttcgtgtttagagaagaatgttttttttttttggttatataaaattttcgggaggttttggttttttttttatacgtgcggcgttatataaa

SEQ ID NO: 33422 - DNA, 922 bp, Artificial Sequence
  chemically treated genomic DNA (Homo sapiens) CpG-island No: 33422
  misc_feature (497)..(497): n is either a, c, g or t
tttatataacgccgcacgtataaaaaaaaaaccaaaacctcccgaaaattttatataaccaaaaaaaaaaaacattcttctctaaacacgaacgaacccgattatacccgaccctccgaaacaaacccataaaccgaaacgtccccccgaacaaaatccgaacattacctaatcgaaattacatacccgtataactaaccgaacttacgccccccaaaaaaaaaaattcccgttcgacctcaaaacgaaacgcttatcccacgacccaaacgacgaaaaaattcccccgaaaacgacgtcgttaaattatacgccgatttaaccatccgccccaaacgcgtttcgcgcaacccataaattcgataattcgtttcgtacgaaaccgcgtaccgaaacgatttcaaaaccgatcataaaaataatattatcgactttctttctaacgctaatcgcgctcgcgacgtacccgaacgcgactctcgcgaataatataatanaaacgaacgccaaccactacgcttcgaaacgcgaacccgccattcaaatcaacgtttcgaacttaaaaaaccgcactaacctactccgactaaaactctatcccgccaacgacaaaaatttcatacgccccgacataaatctactaaccgaaaacaaaacgttccgacgcgtaacgatcgatacgccgaatacaaaaccaatatcgttatacataccgcgtaccgcaccctaaccgctacgcaatactattcctacattcgcgccgcgcgcaaaacaaattcgatttctaaaaaaacgacgtaaaactacgcaacaacgcccgaatcgatcgcgcgcgcccgcgtataaaaaataccgcgatcgatatcgataacgatatcgccgtaatcgatatcaaaacccaatatctccgtaacctcgataa

SEQ ID NO: 33423 - DNA, 922 bp, Artificial Sequence
  chemically treated genomic DNA (Homo sapiens) CpG-island No: 33423
  misc_feature (497)..(497): n is either a, c, g or t
tttgtgtggcgtcgtacgtataagaggagggttaaagtttttcgaaggttttgtataattaaaaagaaagggtatttttttttaaatacgggcgggttcggttatattcgatttttcggaataagtttatgagtcgaaacgttttttcgggtaaggttcggatattgtttggtcggaattgtatattcgtgtaattgatcgagtttacgttttttaaaagaaggggttttcgttcgattttaaaacggaacgtttgttttacggtttaggcggcgaaggggttttttcggggacggcgtcgttgaattatacgtcggtttaattattcgttttaggcgcgtttcgcgtagtttatgggttcggtggttcgtttcgtacggggtcgcgtgtcgaagcgattttaggatcggttataaaagtgatgttatcggttttttttttaacgttggtcgcgttcgcggcgtgttcgggcgcggttttcgcgggtggtgtgatgngggcggacgttagttattgcgtttcgggacgcggattcgttatttaagttaacgtttcggatttgaaagatcgtattggtttgtttcggttggagttttatttcgttaacgataaggattttatgcgtttcgatatggatttgttggtcgagggtaagacgtttcggcgcgtgacgatcgatgcgtcgagtgtagggttagtgtcgttgtgtatatcgcgtgtcgtattttggtcgttacgtagtgttgtttttgtattcgcgtcgcgcgtaggataaattcgatttttggaaagacggcgtggggttgcgtagtaacgttcggatcggtcgcgcgcgttcgcgtgtggaggatgtcgcgatcgatgtcggtagcggtgtcgtcgtggtcgatattaagatttaatattttcgtggtttcggtgg

SEQ ID NO: 33424 - DNA, 922 bp, Artificial Sequence
  chemically treated genomic DNA (Homo sapiens) CpG-island No: 33424
  misc_feature (426)..(426): n is either a, c, g or t
ccaccgaaaccacgaaaatattaaatcttaatatcgaccacgacgacaccgctaccgacatcgatcgcgacatcctccacacgcgaacgcgcgcgaccgatccgaacgttactacgcaaccccacgccgtctttccaaaaatcgaatttatcctacgcgcgacgcgaatacaaaaacaacactacgtaacgaccaaaatacgacacgcgatatacacaacgacactaaccctacactcgacgcatcgatcgtcacgcgccgaaacgtcttaccctcgaccaacaaatccatatcgaaacgcataaaatccttatcgttaacgaaataaaactccaaccgaaacaaaccaatacgatctttcaaatccgaaacgttaacttaaataacgaatccgcgtcccgaaacgcaataactaacgtccgcccncatcacaccacccgcgaaaaccgcgcccgaacacgccgcgaacgcgaccaacgttaaaaaaaaaaccgataacatcacttttataaccgatcctaaaatcgcttcgacacgcgaccccgtacgaaacgaaccaccgaacccataaactacgcgaaacgcgcctaaaacgaataattaaaccgacgtataattcaacgacgccgtccccgaaaaaaccccttcgccgcctaaaccgtaaaacaaacgttccgttttaaaatcgaacgaaaaccccttcttttaaaaaacgtaaactcgatcaattacacgaatatacaattccgaccaaacaatatccgaaccttacccgaaaaaacgtttcgactcataaacttattccgaaaaatcgaatataaccgaacccgcccgtatttaaaaaaaaataccctttctttttaattatacaaaaccttcgaaaaactttaaccctcctcttatacgtacgacgccacacaaa

SEQ ID NO: 33425 - DNA, 786 bp, Artificial Sequence
  chemically treated genomic DNA (Homo sapiens) CpG-island No: 33425
attcgaggacggagagaaggcgttggagttttgcgaggcgtaggatttgggcgagttgttgtcgttgagagggtaggggaagattatcgaggggtcgatgtattttgaggcggcggcgtttagattttgtaggtataagttggaggtggagtagacgttgtggtcgcgggcggggttcgggttgtcgttgtttttgcgcgtagtttggtaggaggttagtttttttgagacgagtttggcggcggtcgagaagtcgttttatatatagttttggatgatgatgtttttgatgaaggtttcgtcgttcgggtcgtagatgaaattttggtttattatgtttttttttagtagttcggttattatttatagttggtcggtcgtggagaagttttcgttatcgtcgtcgttgttttttcgaagggagaagggtgtgatcgtaacgtaggagggcgagtagagttcggagcggcggttaggggataggggcggggtgggtagtagttcgaattttttttagatattttcgttgggcgtcgggggttgtagttcgttttgttgttgttgttggtagaagttttttttttcgtcgtagtagaaatacggttgtatcgagtcgtagtcgaggttatagtttttgtggtgaagttaacgtaaggggtatcgtcgcgggaggttgttgttttttattattcgaaaaaaatttagcgtttaagtagttgtaaggagagttttttagagaagcgggttttggtagcggcggggaagtgtttttaaatgggtagaata

SEQ ID NO: 33426 - DNA, 786 bp, Artificial Sequence
  chemically treated genomic DNA (Homo sapiens) CpG-island No: 33426
tattctacccatttaaaaacacttccccgccgctaccaaaacccgcttctctaaaaaactctccttacaactacttaaacgctaaatttttttcgaataataaaaaacaacaacctcccgcgacgataccccttacgttaacttcaccacaaaaactataacctcgactacgactcgatacaaccgtatttctactacgacgaaaaaaaaaacttctaccaacaacaacaacaaaacgaactacaacccccgacgcccaacgaaaatatctaaaaaaaattcgaactactacccaccccgcccctatcccctaaccgccgctccgaactctactcgccctcctacgttacgatcacacccttctcccttcgaaaaaacaacgacgacgataacgaaaacttctccacgaccgaccaactataaataataaccgaactactaaaaaaaaacataataaaccaaaatttcatctacgacccgaacgacgaaaccttcatcaaaaacatcatcatccaaaactatatataaaacgacttctcgaccgccgccaaactcgtctcaaaaaaactaacctcctaccaaactacgcgcaaaaacaacgacaacccgaaccccgcccgcgaccacaacgtctactccacctccaacttatacctacaaaatctaaacgccgccgcctcaaaatacatcgacccctcgataatcttcccctaccctctcaacgacaacaactcgcccaaatcctacgcctcgcaaaactccaacgccttctctccgtcctcgaat

SEQ ID NO: 33427 - DNA, 786 bp, Artificial Sequence
  chemically treated genomic DNA (Homo sapiens) CpG-island No: 33427
tattttgtttatttggggatattttttcgtcgttgttaggattcgtttttttgaaaggttttttttgtagttgtttagacgttggatttttttcgggtagtggaaaatagtagtttttcgcgacgatgttttttacgttagttttattataggagttatgatttcgattacgattcggtgtagtcgtatttttattgcgacgaggaggagaatttttattagtagtaatagtagaacgagttgtagttttcggcgtttagcgaggatatttggaagaaattcgagttgttgtttatttcgtttttgttttttagtcgtcgtttcgggttttgttcgtttttttacgttgcggttatattttttttttttcggggagataacgacggcggtggcgggagtttttttacggtcgattagttgtagatggtgatcgagttgttgggaggagatatggtgaattagagttttatttgcgattcggacgacgagatttttattaaaaatattattatttaggattgtatgtggagcggtttttcggtcgtcgttaagttcgttttagagaagttggttttttattaggttgcgcgtaaagatagcggtagttcgaatttcgttcgcggttatagcgtttgttttatttttagtttgtatttgtaggatttgagcgtcgtcgttttagagtgtatcgatttttcggtggtttttttttatttttttaacgatagtagttcgtttaagttttgcgtttcgtaagattttagcgtttttttttcgttttcggat

SEQ ID NO: 33428 - DNA, 786 bp, Artificial Sequence
  chemically treated genomic DNA (Homo sapiens) CpG-island No: 33428
atccgaaaacgaaaaaaaaacgctaaaatcttacgaaacgcaaaacttaaacgaactactatcgttaaaaaaataaaaaaaaaccaccgaaaaatcgatacactctaaaacgacgacgctcaaatcctacaaatacaaactaaaaataaaacaaacgctataaccgcgaacgaaattcgaactaccgctatctttacgcgcaacctaataaaaaaccaacttctctaaaacgaacttaacgacgaccgaaaaaccgctccacatacaatcctaaataataatatttttaataaaaatctcgtcgtccgaatcgcaaataaaactctaattcaccatatctcctcccaacaactcgatcaccatctacaactaatcgaccgtaaaaaaactcccgccaccgccgtcgttatctccccgaaaaaaaaaaaatataaccgcaacgtaaaaaaacgaacaaaacccgaaacgacgactaaaaaacaaaaacgaaataaacaacaactcgaatttcttccaaatatcctcgctaaacgccgaaaactacaactcgttctactattactactaataaaaattctcctcctcgtcgcaataaaaatacgactacaccgaatcgtaatcgaaatcataactcctataataaaactaacgtaaaaaacatcgtcgcgaaaaactactattttccactacccgaaaaaaatccaacgtctaaacaactacaaaaaaaacctttcaaaaaaacgaatcctaacaacgacgaaaaaatatccccaaataaacaaaata

SEQ ID NO: 33429 - DNA, 559 bp, Artificial Sequence
  chemically treated genomic DNA (Homo sapiens) CpG-island No: 33429
gttttgttcgattgtgacggggtgttgtggaacggcgagcgcgtcgtgtcgggcgtttcggagttgttggagcggttggcgcgggtcggtaaggcgggtgtgtttgtgagtaataatagtcggcgcgcgcggttcgagttggttttgcgtttcgcgcgtttcggtttcggggggttgcgcgtcgagtagttttttagtttcgcgttgtgcgtcgcgcgtttgttgcgttagcgtttgttcgggttttcggacgcgtcgggcgtcgtgttcgtgttgggcggcgaggggttgcgcgtcgagttgcgcgtcgcggggttgcgtttgggtcgggattcgagcgcgggggacggcgcggtttcgcgcgtgcgcgtcgtgtttgtgggttacgacgagtatttttttttcgtaagttgagggagcgtgcgcgtatttgggcgattcgagtgttatttttggttatcgacgggatttttggtttcgttgagggaaggagtcggattttggtatcggagtttggtcgttgatggagatcgtttcgggacgttagttttgggggtgg

SEQ ID NO: 33430 - DNA, 559 bp, Artificial Sequence
  chemically treated genomic DNA (Homo sapiens) CpG-island No: 33430
ccacccccaaaactaacgtcccgaaacgatctccatcaacgaccaaactccgataccaaaatccgactccttccctcaacgaaaccaaaaatcccgtcgataaccaaaaataacactcgaatcgcccaaatacgcgcacgctccctcaacttacgaaaaaaaaatactcgtcgtaacccacaaacacgacgcgcacgcgcgaaaccgcgccgtcccccgcgctcgaatcccgacccaaacgcaaccccgcgacgcgcaactcgacgcgcaacccctcgccgcccaacacgaacacgacgcccgacgcgtccgaaaacccgaacaaacgctaacgcaacaaacgcgcgacgcacaacgcgaaactaaaaaactactcgacgcgcaaccccccgaaaccgaaacgcgcgaaacgcaaaaccaactcgaaccgcgcgcgccgactattattactcacaaacacacccgccttaccgacccgcgccaaccgctccaacaactccgaaacgcccgacacgacgcgctcgccgttccacaacaccccgtcacaatcgaacaaaac

SEQ ID NO: 33431 - DNA, 559 bp, Artificial Sequence
  chemically treated genomic DNA (Homo sapiens) CpG-island No: 33431
ttatttttagggttggcgtttcgaggcggtttttattaacggttaggtttcggtgttagggttcggtttttttttttaacggggttaagggtttcgtcggtggttagaggtagtattcgggtcgtttaggtgcgcgtacgtttttttagtttgcgaaggagaagtgttcgtcgtagtttataagtacggcgcgtacgcgcggggtcgcgtcgtttttcgcgttcgggtttcggtttaggcgtagtttcgcggcgcgtagttcggcgcgtagtttttcgtcgtttagtacgaatacggcgttcggcgcgttcggaggttcgggtaggcgttggcgtagtaggcgcgcggcgtatagcgcggagttgaagagttgttcggcgcgtagtttttcgaagtcgaggcgcgcgaagcgtagggttagttcgggtcgcgcgcgtcggttgttgttgtttataaatatattcgttttgtcggttcgcgttagtcgttttagtagtttcggggcgttcggtacggcgcgttcgtcgttttatagtatttcgttatagtcgaataggat

SEQ ID NO: 33432 - DNA, 559 bp, Artificial Sequence
  chemically treated genomic DNA (Homo sapiens) CpG-island No: 33432
atcctattcgactataacgaaatactataaaacgacgaacgcgccgtaccgaacgccccgaaactactaaaacgactaacgcgaaccgacaaaacgaatatatttataaacaacaacaaccgacgcgcgcgacccgaactaaccctacgcttcgcgcgcctcgacttcgaaaaactacgcgccgaacaactcttcaactccgcgctatacgccgcgcgcctactacgccaacgcctacccgaacctccgaacgcgccgaacgccgtattcgtactaaacgacgaaaaactacgcgccgaactacgcgccgcgaaactacgcctaaaccgaaacccgaacgcgaaaaacgacgcgaccccgcgcgtacgcgccgtacttataaactacgacgaacacttctccttcgcaaactaaaaaaacgtacgcgcacctaaacgacccgaatactacctctaaccaccgacgaaacccttaaccccgttaaaaaaaaaaaccgaaccctaacaccgaaacctaaccgttaataaaaaccgcctcgaaacgccaaccctaaaaataa

SEQ ID NO: 33433 - DNA, 535 bp, Artificial Sequence
  chemically treated genomic DNA (Homo sapiens) CpG-island No: 33433
cgggtatcgcggcgtttgggttaggggatagagggagtttgagcgtatcgaattatagtatatttcgttttatttttttcgacgttcgttagaaataaattacgtatagtttaatcgtttttttagaagtaggattattgtttttcgtgtaggggcgggagtagcggcgggttcgtttcggttttgcgtttatatttgttatttttaggcgttttcgtttttacgggtgtttgtagtgtttgcgtttagttttgtttgcgtaaggtaggaggtcgtaggaattttatcgttagcgttatcgttattttttaatgtgacgcggaattggggaagttaacgttgggattgtttcgtcgggagtgtaattattgagattgtagcgttaggtatagtcgcgacgttaacggttgcgttttcgttaagatttttttaaaggtttttatcgttacgttttaattttaagtttcgtggtcgacgtttttattttaacgcgaagattttatttttatcgttaagatttaggttttaaagttta

SEQ ID NO: 33434 - DNA, 535 bp, Artificial Sequence
  chemically treated genomic DNA (Homo sapiens) CpG-island No: 33434
taaactttaaaacctaaatcttaacgataaaaataaaatcttcgcgttaaaataaaaacgtcgaccacgaaacttaaaattaaaacgtaacgataaaaacctttaaaaaaatcttaacgaaaacgcaaccgttaacgtcgcgactatacctaacgctacaatctcaataattacactcccgacgaaacaatcccaacgttaacttccccaattccgcgtcacattaaaaaataacgataacgctaacgataaaattcctacgacctcctaccttacgcaaacaaaactaaacgcaaacactacaaacacccgtaaaaacgaaaacgcctaaaaataacaaatataaacgcaaaaccgaaacgaacccgccgctactcccgcccctacacgaaaaacaataatcctacttctaaaaaaacgattaaactatacgtaatttatttctaacgaacgtcgaaaaaaataaaacgaaatatactataattcgatacgctcaaactccctctatcccctaacccaaacgccgcgatacccg

SEQ ID NO: 33435 - DNA, 535 bp, Artificial Sequence
  chemically treated genomic DNA (Homo sapiens) CpG-island No: 33435
tgagttttagaatttgaattttagcgatagaaatgggattttcgcgttggaatgaggacgtcggttacggagtttggagttagaacgtggcgatggggatttttgggggagttttggcggggacgtaatcgttagcgtcgcggttgtgtttggcgttgtaattttaatggttgtattttcggcgaggtagttttagcgttggtttttttagtttcgcgttatattgaagggtggcggtggcgttggcgatggggtttttacggttttttgttttgcgtaagtagaattgggcgtaggtattataggtattcgtgggggcgaggacgtttagaggtgataggtgtggacgtagagtcggggcgaattcgtcgttgttttcgtttttgtacgaggggtagtggttttgtttttgggagggcggttgaattgtgcgtggtttgtttttggcgggcgtcgggggagatggagcgggatgtgttgtgattcggtgcgtttaggttttttttgttttttaatttagacgtcgcgatgttcg

SEQ ID NO: 33436 - DNA, 535 bp, Artificial Sequence
  chemically treated genomic DNA (Homo sapiens) CpG-island No: 33436
cgaacatcgcgacgtctaaattaaaaaacaaaaaaaacctaaacgcaccgaatcacaacacatcccgctccatctcccccgacgcccgccaaaaacaaaccacgcacaattcaaccgccctcccaaaaacaaaaccactacccctcgtacaaaaacgaaaacaacgacgaattcgccccgactctacgtccacacctatcacctctaaacgtcctcgcccccacgaatacctataatacctacgcccaattctacttacgcaaaacaaaaaaccgtaaaaaccccatcgccaacgccaccgccacccttcaatataacgcgaaactaaaaaaaccaacgctaaaactacctcgccgaaaatacaaccattaaaattacaacgccaaacacaaccgcgacgctaacgattacgtccccgccaaaactcccccaaaaatccccatcgccacgttctaactccaaactccgtaaccgacgtcctcattccaacgcgaaaatcccatttctatcgctaaaattcaaattctaaaactca

SEQ ID NO: 33437 - DNA, 583 bp, Artificial Sequence
  chemically treated genomic DNA (Homo sapiens) CpG-island No: 33437
attcgggattcgtagtcggtaggttaggagtttgtagcgttgaggatttcgggcgtttgtcgagttttttttagatgggtcgtcgtttatatttgcgttaggcggcggttcgagtgaggttagcggggaggggtcgcggtcgtcgggaaggggcgttgacggtagtcggtttcgcgggatttcgttcgtttgttttttcggaaatttggggcggggacggtggggatcggagtcggggcgcggaggtattggtcgtaggatggggcgtcggcgcggggtcgtttttgtattatttttggagatttgttgacgagaatacgcgtgtagggggtaaagggagggatagagagattgagagaagcgtacgattaaatataggcgtacgagagagttagagggcgagataaagatcgagatttatacggagacgacggagaaatatagggtagatatatacgaaagggatacggtcgtagaattaatgtagaacgtagacgggcgagagtagagtaagagagagagagagagaaagagagagagagagagaatggggggtaagtgggagcggagttttatttttttt

SEQ ID NO: 33438 - DNA, 583 bp, Artificial Sequence
  chemically treated genomic DNA (Homo sapiens) CpG-island No: 33438
aaaaaaaataaaactccgctcccacttaccccccattctctctctctctctctttctctctctctctctcttactctactctcgcccgtctacgttctacattaattctacgaccgtatccctttcgtatatatctaccctatatttctccgtcgtctccgtataaatctcgatctttatctcgccctctaactctctcgtacgcctatatttaatcgtacgcttctctcaatctctctatccctccctttaccccctacacgcgtattctcgtcaacaaatctccaaaaataatacaaaaacgaccccgcgccgacgccccatcctacgaccaatacctccgcgccccgactccgatccccaccgtccccgccccaaatttccgaaaaaacaaacgaacgaaatcccgcgaaaccgactaccgtcaacgccccttcccgacgaccgcgacccctccccgctaacctcactcgaaccgccgcctaacgcaaatataaacgacgacccatctaaaaaaaactcgacaaacgcccgaaatcctcaacgctacaaactcctaacctaccgactacgaatcccgaat

SEQ ID NO: 33439 - DNA, 583 bp, Artificial Sequence
  chemically treated genomic DNA (Homo sapiens) CpG-island No: 33439
aaaaaaagtagagtttcgtttttatttgttttttatttttttttttttttttttttttttttttttttttttgttttattttcgttcgtttgcgttttatattggttttgcggtcgtgtttttttcgtgtgtgtttgttttgtgttttttcgtcgttttcgtgtggatttcggtttttgtttcgttttttagttttttcgtgcgtttgtgtttaatcgtgcgttttttttaatttttttgtttttttttttgttttttatacgcgtgttttcgttaatagatttttagaggtggtgtagaaacgatttcgcgtcggcgttttattttgcggttagtgttttcgcgtttcggtttcggtttttatcgttttcgttttagattttcggaggagtaggcgggcggggtttcgcggggtcggttgtcgttagcgttttttttcggcggtcgcgattttttttcgttgattttattcgagtcgtcgtttggcgtagatataagcggcggtttatttgaagagggttcggtaggcgttcggggtttttagcgttgtagatttttgatttgtcgattgcggatttcgagt

SEQ ID NO: 33440 - DNA, 583 bp, Artificial Sequence
  chemically treated genomic DNA (Homo sapiens) CpG-island No: 33440
actcgaaatccgcaatcgacaaatcaaaaatctacaacgctaaaaaccccgaacgcctaccgaaccctcttcaaataaaccgccgcttatatctacgccaaacgacgactcgaataaaatcaacgaaaaaaaatcgcgaccgccgaaaaaaaacgctaacgacaaccgaccccgcgaaaccccgcccgcctactcctccgaaaatctaaaacgaaaacgataaaaaccgaaaccgaaacgcgaaaacactaaccgcaaaataaaacgccgacgcgaaatcgtttctacaccacctctaaaaatctattaacgaaaacacgcgtataaaaaacaaaaaaaaaaacaaaaaaattaaaaaaaacgcacgattaaacacaaacgcacgaaaaaactaaaaaacgaaacaaaaaccgaaatccacacgaaaacgacgaaaaaacacaaaacaaacacacacgaaaaaaacacgaccgcaaaaccaatataaaacgcaaacgaacgaaaataaaacaaaaaaaaaaaaaaaaaaaaaaaaaaaaaaaaaaaaataaaaaacaaataaaaacgaaactctacttttttt

SEQ ID NO: 33441 - DNA, 711 bp, Artificial Sequence
  chemically treated genomic DNA (Homo sapiens) CpG-island No: 33441
tttttttggtagcggtggatggggtatagcgcgatttcgtagcggcggcggcggttgtttttattatcgggaggatgttcgggcggatagcgtaggtaattttcgtcgtttcgtagttttcgattggattaaaggatttcgaatatatagttttaggtaaggaaatttaggtgtgtagtattgttcgattcgatttaattcgttttcggtattagcgtttttggttaacgaggtatttaagtaaagaaagatttcgtcgtagtcgtcgtcgtcgcgcgaaagcggcgtttaggaggatgttgttattcgattttttttacgtcgggcgttcgtaacgcgttcggattagtttttgcgcggtttttgttagtcggcgttcggttggtgcgcgtcgtcgtttgtcgtcgcggtttttttttttcgtcgcgtagtttttttttttcgtcggtttcgttttcgtttttaacgtcgagtcggtttttatcgtcgttgcgtttcgggggttggagacgcgattcgttttatcgcgacgcgcgggggttgttgtttttgtttcgaaggtttagttttgcgcgtaaagcgtcgggatgcgaacgcgggatttggagttcgtcggtgtcgagagttgttagagagttggattttgcgtgtagttgtcggattcggttttatgtttttgtttttagaaagagttggtgatgaagtttgggt

SEQ ID NO: 33442 - DNA, 711 bp, Artificial Sequence
  chemically treated genomic DNA (Homo sapiens) CpG-island No: 33442
acccaaacttcatcaccaactctttctaaaaacaaaaacataaaaccgaatccgacaactacacgcaaaatccaactctctaacaactctcgacaccgacgaactccaaatcccgcgttcgcatcccgacgctttacgcgcaaaactaaaccttcgaaacaaaaacaacaacccccgcgcgtcgcgataaaacgaatcgcgtctccaacccccgaaacgcaacgacgataaaaaccgactcgacgttaaaaacgaaaacgaaaccgacgaaaaaaaaaaactacgcgacgaaaaaaaaaaaccgcgacgacaaacgacgacgcgcaccaaccgaacgccgactaacaaaaaccgcgcaaaaactaatccgaacgcgttacgaacgcccgacgtaaaaaaaatcgaataacaacatcctcctaaacgccgctttcgcgcgacgacgacgactacgacgaaatctttctttacttaaatacctcgttaaccaaaaacgctaataccgaaaacgaattaaatcgaatcgaacaatactacacacctaaatttccttacctaaaactatatattcgaaatcctttaatccaatcgaaaactacgaaacgacgaaaattacctacgctatccgcccgaacatcctcccgataataaaaacaaccgccgccgccgctacgaaatcgcgctataccccatccaccgctaccaaaaaaa

SEQ ID NO: 33443 - DNA, 711 bp, Artificial Sequence
  chemically treated genomic DNA (Homo sapiens) CpG-island No: 33443
gtttaaattttattattaattttttttgagagtaaaaatatggggtcgagttcggtagttgtacgtagaatttaattttttggtagttttcggtatcgacgagttttagatttcgcgttcgtatttcggcgttttgcgcgtagagttaagttttcggaataagaataatagttttcgcgcgtcgcggtaaagcgggtcgcgtttttagttttcgaggcgtagcgacggtgggagtcggttcggcgttgggggcgggggcggggtcggcgaagggggagggttgcgcggcggaggggaggagtcgcggcgatagacggcggcgcgtattaatcgggcgtcggttggtaggagtcgcgtagaggttggttcgagcgcgttgcgggcgttcggcgtaaggggagtcgggtagtagtatttttttgggcgtcgttttcgcgcggcggcggcggttgcggcggggtttttttttgtttaaatatttcgttggttagaagcgttggtatcgggggcgggttgggtcgggtcgggtagtgttgtatatttgggtttttttgtttagagttgtgtgttcggggttttttggtttagtcggaggttgcggagcggcgggggttgtttgcgttgttcgttcgggtattttttcggtgatggaagtagtcgtcgtcgtcgttgcggggtcgcgttgtgttttatttatcgttgttagagagg

SEQ ID NO: 33444 - DNA, 711 bp, Artificial Sequence
  chemically treated genomic DNA (Homo sapiens) CpG-island No: 33444
cctctctaacaacgataaataaaacacaacgcgaccccgcaacgacgacgacgactacttccatcaccgaaaaaatacccgaacgaacaacgcaaacaacccccgccgctccgcaacctccgactaaaccaaaaaaccccgaacacacaactctaaacaaaaaaacccaaatatacaacactacccgacccgacccaacccgcccccgataccaacgcttctaaccaacgaaatatttaaacaaaaaaaaaccccgccgcaaccgccgccgccgcgcgaaaacgacgcccaaaaaaatactactacccgactccccttacgccgaacgcccgcaacgcgctcgaaccaacctctacgcgactcctaccaaccgacgcccgattaatacgcgccgccgtctatcgccgcgactcctcccctccgccgcgcaaccctcccccttcgccgaccccgcccccgcccccaacgccgaaccgactcccaccgtcgctacgcctcgaaaactaaaaacgcgacccgctttaccgcgacgcgcgaaaactattattcttattccgaaaacttaactctacgcgcaaaacgccgaaatacgaacgcgaaatctaaaactcgtcgataccgaaaactaccaaaaaattaaattctacgtacaactaccgaactcgaccccatatttttactctcaaaaaaaattaataataaaatttaaac

SEQ ID NO: 33445 - DNA, 815 bp, Artificial Sequence
  chemically treated genomic DNA (Homo sapiens) CpG-island No: 33445
  misc_feature (594)..(594): n is either a, c, g or t
  misc_feature (757)..(757): n is either a, c, g or t
tcggttatacgtaagcggcggcgggtgtggttggtgtgattaagatggtgatggcgatgcggtacgggtagttgttacgttcgttgtacgtggaatcgtcgtcgtcggaggtggattggtcggcggggacggtttaattttttacggagaatacgttttggtttaggagtggtcgtgttcgtcgggtgggggtgtcgtcgttcgggattagtggtattaacgcgtacgttattttcgaatagttttcgggagtgtcgagttagtttgcggggtcgggttcgggttttgtcgtggatgtttcggtggtgtcgtggatggtgtcgggtaaaatattcgaagcgttattcgcgtaggtaacggcgttgatgatttatttggacgagcgatttgatgttttttcgttggatgttgggtattcgttggcgttgatacggtcggcgttggatgagcgagcggtggtgttggggtcggatcgtgaaacgttgttgtgcggggtgaaagcgttgtttgtcggatatgaggtttttgggttggtgatcggatttgttggggtttggggtcgtatcgtatttgtgtttttcggttcgtagattncggattggattggatacgcgttttatgtcgcgtttttttttgtttcgtgtggcgtttcgttgtgtttgttggttgtgttgtgggcggttttttgttgttgtgttgtgtcgtgtgcgcgtcgcggtttatttcgattttttttttttcgtggcgtcgcgcggtnttcggtgtgcgttttgcggttttttgggtcgtcgttgttgttcgtgcgtgtgtggcgt

SEQ ID NO: 33446 - DNA, 815 bp, Artificial Sequence
  chemically treated genomic DNA (Homo sapiens) CpG-island No: 33446
  misc_feature (59)..(59): n is either a, c, g or t
  misc_feature (222)..(222): n is either a, c, g or t
acgccacacacgcacgaacaacaacgacgacccaaaaaaccgcaaaacgcacaccgaanaccgcgcgacgccacgaaaaaaaaaaaatcgaaataaaccgcgacgcgcacacgacacaacacaacaacaaaaaaccgcccacaacacaaccaacaaacacaacgaaacgccacacgaaacaaaaaaaaacgcgacataaaacgcgtatccaatccaatccgnaatctacgaaccgaaaaacacaaatacgatacgaccccaaaccccaacaaatccgatcaccaacccaaaaacctcatatccgacaaacaacgctttcaccccgcacaacaacgtttcacgatccgaccccaacaccaccgctcgctcatccaacgccgaccgtatcaacgccaacgaatacccaacatccaacgaaaaaacatcaaatcgctcgtccaaataaatcatcaacgccgttacctacgcgaataacgcttcgaatattttacccgacaccatccacgacaccaccgaaacatccacgacaaaacccgaacccgaccccgcaaactaactcgacactcccgaaaactattcgaaaataacgtacgcgttaataccactaatcccgaacgacgacacccccacccgacgaacacgaccactcctaaaccaaaacgtattctccgtaaaaaattaaaccgtccccgccgaccaatccacctccgacgacgacgattccacgtacaacgaacgtaacaactacccgtaccgcatcgccatcaccatcttaatcacaccaaccacacccgccgccgcttacgtataaccga

SEQ ID NO: 33447 - DNA, 815 bp, Artificial Sequence
  chemically treated genomic DNA (Homo sapiens) CpG-island No: 33447
  misc_feature (59)..(59): n is either a, c, g or t
  misc_feature (222)..(222): n is either a, c, g or t
gcgttatatacgtacgagtagtagcgacgatttaggaggtcgtagagcgtatatcgaanatcgcgcgacgttacgaagagaaaaaaatcgaggtgaatcgcgacgcgtatacgatatagtataataatagaagatcgtttatagtataattaatagatataacgaagcgttatacgggataaaaaaaagcgcggtataaagcgcgtgtttagtttaattcgngatttgcggatcgaaaaatataaatgcgatgcggttttaggttttaatagattcggttattaatttagaagttttatgttcggtagatagcgtttttatttcgtataataacgttttacggttcgattttagtattatcgttcgtttatttagcgtcgatcgtgttaacgttagcgagtatttaatatttagcgaggagatattaggtcgttcgtttagataggttattaacgtcgttgtttgcgcggatagcgtttcgggtgttttgttcgatattatttacggtattatcggaatatttacgatagaattcgaattcggtttcgtagattgattcggtattttcgggggttgttcgaggatgacgtgcgcgttagtattattgatttcgaacgacgatatttttattcgacgaatacgattatttttgggttagggcgtgtttttcgtaaggagttgaatcgttttcgtcgattaatttattttcggcgacggcgattttacgtgtaacgagcgtggtagttgttcgtgtcgtatcgttattattattttgattatattagttatattcgtcgtcgtttgcgtatgatcga

SEQ ID NO: 33448 - DNA, 815 bp, Artificial Sequence
  chemically treated genomic DNA (Homo sapiens) CpG-island No: 33448
  misc_feature (594)..(594): n is either a, c, g or t
  misc_feature (757)..(757): n is either a, c, g or t
tcgatcatacgcaaacgacgacgaatataactaatataatcaaaataataataacgatacgacacgaacaactaccacgctcgttacacgtaaaatcgccgtcgccgaaaataaattaatcgacgaaaacgattcaactccttacgaaaaacacgccctaacccaaaaataatcgtattcgtcgaataaaaatatcgtcgttcgaaatcaataatactaacgcgcacgtcatcctcgaacaacccccgaaaataccgaatcaatctacgaaaccgaattcgaattctatcgtaaatattccgataataccgtaaataatatcgaacaaaacacccgaaacgctatccgcgcaaacaacgacgttaataacctatctaaacgaacgacctaatatctcctcgctaaatattaaatactcgctaacgttaacacgatcgacgctaaataaacgaacgataatactaaaatcgaaccgtaaaacgttattatacgaaataaaaacgctatctaccgaacataaaacttctaaattaataaccgaatctattaaaacctaaaaccgcatcgcatttatatttttcgatccgcaaatcncgaattaaactaaacacgcgctttataccgcgcttttttttatcccgtataacgcttcgttatatctattaattatactataaacgatcttctattattatactatatcgtatacgcgtcgcgattcacctcgatttttttctcttcgtaacgtcgcgcgatnttcgatatacgctctacgacctcctaaatcgtcgctactactcgtacgtatataacgc

SEQ ID NO: 33449 - DNA, 527 bp, Artificial Sequence
  chemically treated genomic DNA (Homo sapiens) CpG-island No: 33449
  misc_feature (310)..(310): n is either a, c, g or t
  misc_feature (404)..(404): n is either a, c, g or t
gttaggattttagtttcggtaggtgagcggtgtaaaatacgtatttagttgtttttagtttttttcgttttcgttgagttggttgtttttatttcgtattacggtattcgagtttgtgagttttcgatttcggttttagtcgtagtcgttaataattttataataaataagaggataggattgagcgttcgcgtttcggagcgtattggttgggggtaattttttattttcggcgcgtcgttcgttgtttcgattcgagagtatcgggagagtcgagggaagggaaggcggcgaggggaaggtaggcggngatggagggaggtacggcgcggcgcggagcgaggaggtgggttgtaggggacgtcgagaagcggtggggttggcgtaaagggcgggcgttcggngcgcgcgttattttcgttttgttttcgtagtggtagtatacggtttataggtatttgagcgttcgttagagtaagatgatgaagaggttttcgaagaaagttattatgcgaggaggtaggaaa

SEQ ID NO: 33450 - DNA, 527 bp, Artificial Sequence
  chemically treated genomic DNA (Homo sapiens) CpG-island No: 33450
  misc_feature (124)..(124): n is either a, c, g or t
  misc_feature (218)..(218): n is either a, c, g or t
tttcctacctcctcgcataataactttcttcgaaaacctcttcatcatcttactctaacgaacgctcaaatacctataaaccgtatactaccactacgaaaacaaaacgaaaataacgcgcgcnccgaacgcccgccctttacgccaaccccaccgcttctcgacgtcccctacaacccacctcctcgctccgcgccgcgccgtacctccctccatcnccgcctaccttcccctcgccgccttcccttccctcgactctcccgatactctcgaatcgaaacaacgaacgacgcgccgaaaataaaaaattacccccaaccaatacgctccgaaacgcgaacgctcaatcctatcctcttatttattataaaattattaacgactacgactaaaaccgaaatcgaaaactcacaaactcgaataccgtaatacgaaataaaaacaaccaactcaacgaaaacgaaaaaaactaaaaacaactaaatacgtattttacaccgctcacctaccgaaactaaaatcctaac

SEQ ID NO: 33451 - DNA, 527 bp, Artificial Sequence
  chemically treated genomic DNA (Homo sapiens) CpG-island No: 33451
  misc_feature (124)..(124): n is either a, c, g or t
  misc_feature (218)..(218): n is either a, c, g or t
ttttttgttttttcgtatggtgatttttttcgggggtttttttattattttgttttggcggacgtttaagtatttgtggatcgtgtgttgttattgcgggggtaagacgaaggtaacgcgcgtntcgggcgttcgttttttgcgttagttttatcgtttttcggcgttttttgtagtttattttttcgtttcgcgtcgcgtcgtgtttttttttattntcgtttgtttttttttcgtcgtttttttttttttcggttttttcggtgttttcggatcggggtagcgggcggcgcgtcgggggtgaggagttgtttttagttagtgcgtttcgggacgcggacgtttaattttgtttttttgtttattgtagggttgttggcggttgcggttggggtcggggtcggggatttataggttcgggtgtcgtggtgcggggtggggatagttaatttagcggggacggaggaagttgggggtagttgggtgcgtgttttgtatcgtttatttgtcggggttaaaattttggt

SEQ ID NO: 33452 - DNA, 527 bp, Artificial Sequence
  chemically treated genomic DNA (Homo sapiens) CpG-island No: 33452
  misc_feature (310)..(310): n is either a, c, g or t
  misc_feature (404)..(404): n is either a, c, g or t
accaaaattttaaccccgacaaataaacgatacaaaacacgcacccaactacccccaacttcctccgtccccgctaaattaactatccccaccccgcaccacgacacccgaacctataaatccccgaccccgaccccaaccgcaaccgccaacaaccctacaataaacaaaaaaacaaaattaaacgtccgcgtcccgaaacgcactaactaaaaacaactcctcacccccgacgcgccgcccgctaccccgatccgaaaacaccgaaaaaaccgaaaaaaaaaaaaacgacgaaaaaaaaacaaacganaataaaaaaaaacacgacgcgacgcgaaacgaaaaaataaactacaaaaaacgccgaaaaacgataaaactaacgcaaaaaacgaacgcccganacgcgcgttaccttcgtcttacccccgcaataacaacacacgatccacaaatacttaaacgtccgccaaaacaaaataataaaaaaacccccgaaaaaaatcaccatacgaaaaaacaaaaaa

SEQ ID NO: 33453 - DNA, 807 bp, Artificial Sequence
  chemically treated genomic DNA (Homo sapiens) CpG-island No: 33453
  misc_feature (762)..(762): n is either a, c, g or t
tatatgcgttggtttcggttgtcgtacggtatttttatggttatcgggatgatgagcgtatttattttgggttcgtggatcgaggacgaggaggaagaggaggaggaagaagaagaagaggaagaggaggaggaggaggaggaggacgcgtttaggttgagatggttcgcgtggatattgttatttattttaagattgttgttttcgtcgtcgtcgtcgtcgtcgttgttgtcgtcgtcgtcgtcgttattatttgttatagttagtaacgggtagtcggcgtaggggttcgggggagtttttttcgtcgttagcgttattttaaatatttattaatagttatattgttgttattgttgtcgtcgtcgtcgtcgtcgcggagcgcgggaggggggcggggaggcgtttgggttcggggcgttgtgcgcgatttggcggggtgcgcgagatatatatagcgagtcgtcgtcgttcgttcgggggggagggggatggagtgcgcgggtagtttttttttttcggttcgcgttttattcgtttcgggttgcgttggtttcgagcgtcgagagttagggggcgtcgcgggtcgttcgcgttcggggtttgcgtcgttttcgggttcgtttcggtttcgcgcgcggtttcgggtgttttttgcgtcgcgtttttcgtcgtgcgttacgggtgtgcgttgcgttcggtcggggattttttttttcggggcgtttttcgcgttgttttcggttcgtttttttttttttngggggtatttcggtgttttggggtgtgggttttttttgttcgggt

SEQ ID NO: 33454 - DNA, 807 bp, Artificial Sequence
  chemically treated genomic DNA (Homo sapiens) CpG-island No: 33454
  misc_feature (46)..(46): n is either a, c, g or t
acccgaacaaaaaaaacccacaccccaaaacaccgaaatacccccnaaaaaaaaaaaaacgaaccgaaaacaacgcgaaaaacgccccgaaaaaaaaaatccccgaccgaacgcaacgcacacccgtaacgcacgacgaaaaacgcgacgcaaaaaacacccgaaaccgcgcgcgaaaccgaaacgaacccgaaaacgacgcaaaccccgaacgcgaacgacccgcgacgccccctaactctcgacgctcgaaaccaacgcaacccgaaacgaataaaacgcgaaccgaaaaaaaaaaactacccgcgcactccatccccctcccccccgaacgaacgacgacgactcgctatatatatctcgcgcaccccgccaaatcgcgcacaacgccccgaacccaaacgcctccccgcccccctcccgcgctccgcgacgacgacgacgacgacaacaataacaacaatataactattaataaatatttaaaataacgctaacgacgaaaaaaactcccccgaacccctacgccgactacccgttactaactataacaaataataacgacgacgacgacgacaacaacgacgacgacgacgacgacgaaaacaacaatcttaaaataaataacaatatccacgcgaaccatctcaacctaaacgcgtcctcctcctcctcctcctcctcttcctcttcttcttcttcctcctcctcttcctcctcgtcctcgatccacgaacccaaaataaatacgctcatcatcccgataaccataaaaataccgtacgacaaccgaaaccaacgcatata

SEQ ID NO: 33455 - DNA, 807 bp, Artificial Sequence
  chemically treated genomic DNA (Homo sapiens) CpG-island No: 33455
  misc_feature (46)..(46): n is either a, c, g or t
gttcgggtagagggggtttatattttaaaatatcgaggtgtttttnagaaaggggagagcgggtcgagaatagcgcggaaggcgtttcggggaagggggttttcggtcgagcgtagcgtatattcgtggcgtacggcggggggcgcggcgtagaggatattcgggatcgcgcgcggagtcggggcgggttcgggggcggcgtagatttcgggcgcgggcggttcgcggcgttttttggttttcggcgttcggggttagcgtagttcggggcgagtggggcgcgggtcggggagggggagttgttcgcgtattttatttttttttttttcgggcgggcggcggcggttcgttgtatatatttcgcgtatttcgttaggtcgcgtatagcgtttcgagtttaggcgttttttcgtttttttttcgcgtttcgcggcggcggcggcggcggtagtagtagtagtaatatggttgttgatgggtgtttggggtggcgttggcggcgggaggagttttttcgagtttttgcgtcggttgttcgttgttagttatggtaaatggtggcggcggcggcggcggtagtagcggcggcggcggcggcggcggaggtagtagttttagaatgagtagtaatatttacgcgaattattttagtttagacgcgttttttttttttttttttttttttttttttttttttttttttttttttttttttttttcgttttcggtttacgagtttaagatggatgcgtttattatttcggtgattatggaggtgtcgtgcgatagtcggggttaacgtatgtg

SEQ ID NO: 33456 - DNA, 807 bp, Artificial Sequence
  chemically treated genomic DNA (Homo sapiens) CpG-island No: 33456
  misc_feature (762)..(762): n is either a, c, g or t
cacatacgttaaccccgactatcgcacgacacctccataatcaccgaaataataaacgcatccatcttaaactcgtaaaccgaaaacgaaaaaaaaaaaaaaaaaaaaaaaaaaaaaaaaaaaaaaaaaaaaaaaaaaaaaaaaaacgcgtctaaactaaaataattcgcgtaaatattactactcattctaaaactactacctccgccgccgccgccgccgccgctactaccgccgccgccgccgccaccatttaccataactaacaacgaacaaccgacgcaaaaactcgaaaaaactcctcccgccgccaacgccaccccaaacacccatcaacaaccatattactactactactaccgccgccgccgccgccgcgaaacgcgaaaaaaaaacgaaaaaacgcctaaactcgaaacgctatacgcgacctaacgaaatacgcgaaatatatacaacgaaccgccgccgcccgcccgaaaaaaaaaaaaataaaatacgcgaacaactccccctccccgacccgcgccccactcgccccgaactacgctaaccccgaacgccgaaaaccaaaaaacgccgcgaaccgcccgcgcccgaaatctacgccgcccccgaacccgccccgactccgcgcgcgatcccgaatatcctctacgccgcgccccccgccgtacgccacgaatatacgctacgctcgaccgaaaacccccttccccgaaacgccttccgcgctattctcgacccgctctcccctttctnaaaaacacctcgatattttaaaatataaaccccctctacccgaac

SEQ ID NO: 33457 - DNA, 564 bp, Artificial Sequence
  chemically treated genomic DNA (Homo sapiens) CpG-island No: 33457
cgttgttcgttgcggcggttttgttggttcgattttgttttttttcgtttcgcggttttcggtgttttttttcggtgtttatttcggtgatattttcgcgcgtaaagtcgcgtttttcgaggtcggttttttttttttttatttttttttttttgcgtttttttttcgttatattcgtttttttatttacggtagcgttttttcgttatagttcgatttttttttttttttttttcgacggcgatacgttttttcgcgttttcgtttgcgttcgtttggggtttttttttttcgcgttttttttttcgtgttattcgcgttttatcgtacgtcggtcgttcggtcggcgttttttttcggatcgacgatgggagttttgttattgttcgtattttagttttcgttttttagtttttttttttttttttatatttgcgcgcgtatttttatttcgttcgttttttttttttttttttttcgaattagcgggcggtcgtcgatttttagttttttttaacgttaacgtttgtcgatttatcggtcgtattatatttcggtagtatt

SEQ ID NO: 33458 - DNA, 564 bp, Artificial Sequence
  chemically treated genomic DNA (Homo sapiens) CpG-island No: 33458
aatactaccgaaatataatacgaccgataaatcgacaaacgttaacgttaaaaaaaactaaaaatcgacgaccgcccgctaattcgaaaaaaaaaaaaaaaaaaaacgaacgaaataaaaatacgcgcgcaaatataaaaaaaaaaaaaaaaactaaaaaacgaaaactaaaatacgaacaataacaaaactcccatcgtcgatccgaaaaaaaacgccgaccgaacgaccgacgtacgataaaacgcgaataacacgaaaaaaaaaacgcgaaaaaaaaaaaccccaaacgaacgcaaacgaaaacgcgaaaaaacgtatcgccgtcgaaaaaaaaaaaaaaaaaaatcgaactataacgaaaaaacgctaccgtaaataaaaaaacgaatataacgaaaaaaaaacgcaaaaaaaaaaaaataaaaaaaaaaaaaaccgacctcgaaaaacgcgactttacgcgcgaaaatatcaccgaaataaacaccgaaaaaaaacaccgaaaaccgcgaaacgaaaaaaaacaaaatcgaaccaacaaaaccgccgcaacgaacaacg

SEQ ID NO: 33459 - DNA, 564 bp, Artificial Sequence
  chemically treated genomic DNA (Homo sapiens) CpG-island No: 33459
ggtattgtcggaatataatgcggtcgataaatcggtagacgttggcgttggagggggttggaagtcggcggtcgttcgttggttcgaaaaggggaaggggggggggcgggcgaggtgggaatacgcgcgtagatataagaggagaaggaggaattagggggcgggagttaaagtgcggataataataaaatttttatcgtcgattcgggaggaagcgtcggtcggacggtcgacgtgcgatgggacgcgggtgatacgggggggagagcgcgaggggagggggttttagacggacgtaaacgggggcgcggggggacgtatcgtcgtcgggaaagaagggaagaggggtcgaattgtgacggggaggcgttgtcgtagatagaggggcggatataacggggggaaaacgtaaaagagggggagtgggggggggggaggtcggtttcggggagcgcgattttgcgcgcggaaatattatcgaggtggatatcggggggggatatcgggggtcgcggggcgaaaaggggtagagtcgggttagtagggtcgtcgtagcgggtagcg

SEQ ID NO: 33460 - DNA, 564 bp, Artificial Sequence
  chemically treated genomic DNA (Homo sapiens) CpG-island No: 33460
cgctacccgctacgacgaccctactaacccgactctaccccttttcgccccgcgacccccgatatccccccccgatatccacctcgataatatttccgcgcgcaaaatcgcgctccccgaaaccgacctcccccccccccactccccctcttttacgttttccccccgttatatccgcccctctatctacgacaacgcctccccgtcacaattcgacccctcttcccttctttcccgacgacgatacgtccccccgcgcccccgtttacgtccgtctaaaaccccctcccctcgcgctctcccccccgtatcacccgcgtcccatcgcacgtcgaccgtccgaccgacgcttcctcccgaatcgacgataaaaattttattattatccgcactttaactcccgccccctaattcctccttctcctcttatatctacgcgcgtattcccacctcgcccgccccccccccttccccttttcgaaccaacgaacgaccgccgacttccaaccccctccaacgccaacgtctaccgatttatcgaccgcattatattccgacaatacc

SEQ ID NO: 33461 - DNA, 510 bp, Artificial Sequence
  chemically treated genomic DNA (Homo sapiens) CpG-island No: 33461
agtatgatcgtatggtagtagttgatagttttatttttgtatttgttattttattttttttcggttttgttatttgttcgtcgtatggatttcgggtttttttttatgcgattcgtcgttcgagttttattgcgagtatatatgatatcggtttcgttgcgcgtttttttagtcgtatcgtcggttcggtatacggttttttatagtggtacggggtattgtgcggcggttggttcgggaagacggcgttcgtagttgggatgggtcgttttatatttaaatttcgtcgttacgtgtcgttattttgttttattttgtcggttattagtcggttattttttatattcgttattttttttttcgcgcggtttcgatatttcgtttattcgttttttttttcgtttattttgttttgcgattgtacgttttcgtttataatagggcgagtttattagggtcgttattacgggagaaaatggtcgtttagaatattattatataagatatcgt

SEQ ID NO: 33462 - DNA, 510 bp, Artificial Sequence
  chemically treated genomic DNA (Homo sapiens) CpG-island No: 33462
acgatatcttatataataatattctaaacgaccattttctcccgtaataacgaccctaataaactcgccctattataaacgaaaacgtacaatcgcaaaacaaaataaacgaaaaaaaaaacgaataaacgaaatatcgaaaccgcgcgaaaaaaaaaataacgaatataaaaaataaccgactaataaccgacaaaataaaacaaaataacgacacgtaacgacgaaatttaaatataaaacgacccatcccaactacgaacgccgtcttcccgaaccaaccgccgcacaataccccgtaccactataaaaaaccgtataccgaaccgacgatacgactaaaaaaacgcgcaacgaaaccgatatcatatatactcgcaataaaactcgaacgacgaatcgcataaaaaaaaacccgaaatccatacgacgaacaaataacaaaaccgaaaaaaaataaaataacaaatacaaaaataaaactatcaactactaccatacgatcatact

SEQ ID NO: 33463 - DNA, 510 bp, Artificial Sequence
  chemically treated genomic DNA (Homo sapiens) CpG-island No: 33463
gcgatgttttatgtggtaatattttaggcggttattttttttcgtgatgacggttttgatgggttcgttttattatgggcggggacgtgtagtcgtaaaataggataaacggaggagaaggcggatggacggaatatcggggtcgcgcgaaaaggggaataacgggtgtaaaaagtggtcggttgatgatcggtagagtaaaataaggtggcggtacgtagcggcgagatttggatgtagagcggtttattttaattgcggacgtcgttttttcggattagtcgtcgtatagtgtttcgtattattgtgagagatcgtatatcgagtcggcggtgcggttggaagggcgcgtagcgggatcgatattatatatattcgtagtagggttcgggcggcggatcgtatagaaggaagttcgagatttatgcggcggataggtaataaaatcgggaagaggtgggatagtaggtataagggtagagttattaattgttgttatgcggttatatt

SEQ ID NO: 33464 - DNA, 510 bp, Artificial Sequence
  chemically treated genomic DNA (Homo sapiens) CpG-island No: 33464
aatataaccgcataacaacaattaataactctacccttatacctactatcccacctcttcccgattttattacctatccgccgcataaatctcgaacttccttctatacgatccgccgcccgaaccctactacgaatatatataatatcgatcccgctacgcgcccttccaaccgcaccgccgactcgatatacgatctctcacaataatacgaaacactatacgacgactaatccgaaaaaacgacgtccgcaattaaaataaaccgctctacatccaaatctcgccgctacgtaccgccaccttattttactctaccgatcatcaaccgaccactttttacacccgttattccccttttcgcgcgaccccgatattccgtccatccgccttctcctccgtttatcctattttacgactacacgtccccgcccataataaaacgaacccatcaaaaccgtcatcacgaaaaaaaataaccgcctaaaatattaccacataaaacatcgc

SEQ ID NO: 33465 - DNA, 708 bp, Artificial Sequence
  chemically treated genomic DNA (Homo sapiens) CpG-island No: 33465
  misc_feature (129)..(129): n is either a, c, g or t
cgttagagtttttcggggttcgcgttttgggagacgtgcgggtgatcgcgttttcgtttcgtttttatcggttacggtttcgttttcgcgagcggattatattttttagtagttttagcgggtagcggnggcggtagcgcgggcgggaggggcggtggtgagaggcggagggggcggcgcgcgtcgggtacgcgcgtcggcgattatggcgttcgtcgggttggagcgagtatattaatttttggaggcggcggcggcggcgagggagcgagtttcgagcgggcgggttttagtttgagggaagggaggaaggggcggggagagcgttagagggaggtcggtcggtcgcgggcgggcgggtagcgtagcgtcgagcggggttcgcgggtttatgaggaggtttggggattatgggttttaggattaagtgagtgcggtcgggtcgggcggagtcgggtcgggcgcggggcggcgaggttcggttagggttgtaggtcgcgggtcgcgcgggggatttgttgtcgagattagaggggcgtttcgcgtgacgtcggtacgcggggagggggacggttgttatggcgatttagggaggcgcgggggcggggtgcgcgcggggtggtagggcgtcggggtttaggtgttttttttttatttgggggtcggaatagttgagattatagggcggtttttttttcgggtttacgg

SEQ ID NO: 33466 - DNA, 708 bp, Artificial Sequence
  chemically treated genomic DNA (Homo sapiens) CpG-island No: 33466
  misc_feature (580)..(580): n is either a, c, g or t
ccgtaaacccgaaaaaaaaaccgccctataatctcaactattccgacccccaaataaaaaaaaaacacctaaaccccgacgccctaccaccccgcgcgcaccccgcccccgcgcctccctaaatcgccataacaaccgtccccctccccgcgtaccgacgtcacgcgaaacgcccctctaatctcgacaacaaatcccccgcgcgacccgcgacctacaaccctaaccgaacctcgccgccccgcgcccgacccgactccgcccgacccgaccgcactcacttaatcctaaaacccataatccccaaacctcctcataaacccgcgaaccccgctcgacgctacgctacccgcccgcccgcgaccgaccgacctccctctaacgctctccccgccccttcctcccttccctcaaactaaaacccgcccgctcgaaactcgctccctcgccgccgccgccgcctccaaaaattaatatactcgctccaacccgacgaacgccataatcgccgacgcgcgtacccgacgcgcgccgccccctccgcctctcaccaccgcccctcccgcccgcgctaccgccnccgctacccgctaaaactactaaaaaatataatccgctcgcgaaaacgaaaccgtaaccgataaaaacgaaacgaaaacgcgatcacccgcacgtctcccaaaacgcgaaccccgaaaaactctaacg

SEQ ID NO: 33467 - DNA, 708 bp, Artificial Sequence
  chemically treated genomic DNA (Homo sapiens) CpG-island No: 33467
  misc_feature (580)..(580): n is either a, c, g or t
tcgtaaattcggggagggggtcgttttgtaattttagttgtttcgatttttaggtgaggaggggatatttgaatttcggcgttttgttatttcgcgcgtatttcgttttcgcgtttttttggatcgttatagtaatcgttttttttttcgcgtgtcggcgttacgcggggcgtttttttggtttcggtaataagtttttcgcgcggttcgcggtttgtagttttggtcgggtttcgtcgtttcgcgttcggttcggtttcgttcggttcggtcgtatttatttgattttggagtttatggtttttaggtttttttatgggttcgcgggtttcgttcggcgttgcgttgttcgttcgttcgcggtcgatcggtttttttttggcgtttttttcgtttttttttttttttttttaggttggggttcgttcgttcgaggttcgttttttcgtcgtcgtcgtcgtttttaggggttaatgtattcgttttagttcggcgaacgttatggtcgtcggcgcgcgtgttcggcgcgcgtcgtttttttcgttttttattatcgtttttttcgttcgcgttatcgttntcgttgttcgttggggttgttgggaagtgtagttcgttcgcgggggcggggtcgtggtcggtgggggcggggcgggagcgcggttattcgtacgttttttagggcgcgggtttcggaggattttggcg

SEQ ID NO: 33468 - DNA, 708 bp, Artificial Sequence
  chemically treated genomic DNA (Homo sapiens) CpG-island No: 33468
  misc_feature (129)..(129): n is either a, c, g or t
cgccaaaatcctccgaaacccgcgccctaaaaaacgtacgaataaccgcgctcccgccccgcccccaccgaccacgaccccgcccccgcgaacgaactacacttcccaacaaccccaacgaacaacganaacgataacgcgaacgaaaaaaacgataataaaaaacgaaaaaaacgacgcgcgccgaacacgcgcgccgacgaccataacgttcgccgaactaaaacgaatacattaacccctaaaaacgacgacgacgacgaaaaaacgaacctcgaacgaacgaaccccaacctaaaaaaaaaaaaaaaaaaacgaaaaaaacgccaaaaaaaaaccgatcgaccgcgaacgaacgaacaacgcaacgccgaacgaaacccgcgaacccataaaaaaacctaaaaaccataaactccaaaatcaaataaatacgaccgaaccgaacgaaaccgaaccgaacgcgaaacgacgaaacccgaccaaaactacaaaccgcgaaccgcgcgaaaaacttattaccgaaaccaaaaaaacgccccgcgtaacgccgacacgcgaaaaaaaaaacgattactataacgatccaaaaaaacgcgaaaacgaaatacgcgcgaaataacaaaacgccgaaattcaaatatcccctcctcacctaaaaatcgaaacaactaaaattacaaaacgaccccctccccgaatttacga

SEQ ID NO: 33469 - DNA, 599 bp, Artificial Sequence
  chemically treated genomic DNA (Homo sapiens) CpG-island No: 33469
  misc_feature (221)..(222): n is either a, c, g or t
  misc_feature (261)..(261): n is either a, c, g or t
  misc_feature (460)..(460): n is either a, c, g or t
  misc_feature (508)..(508): n is either a, c, g or t
  misc_feature (539)..(539): n is either a, c, g or t
  misc_feature (570)..(570): n is either a, c, g or t
ggcgattaagatattttcgcgagggtttagggcgcgtttttttcgttaggttttagatttcggttttgcgttatttttttttacgtttcggcgcgggcgtagttagttcggttttttttaggtttttaagtttcggatcgagtgtggggtcgtttttttttttcggaaggagttatcgtcgttttaagtggaagaggagaggaagggggcggcggagcggnngggcgggagcggaggcggaggaggggaagggggattttnttgttttttacgtgggttcgggcgcgtgtgaatcgcgtttatcggatggttttatagcgaaatataaaagtatttgggaagtcgtcgtgtattcgtaatttttatcggtcggtcggatcgttcggatagagtttcgtagcgtttcggggtcgggatgggtttcgaagttttttaagtttcggagtttattaatttgcgngtgtcgtttttttcgttgtgattcggcggtttgtgttcgtttttgaantgggaggcgcgtttttgtttttttcgggtgntgttttttttgtttgagtcgtcgcgttgcgntcggcgtcgtacggttgttgttttcgacg

SEQ ID NO: 33470 - DNA, 599 bp, Artificial Sequence
  chemically treated genomic DNA (Homo sapiens) CpG-island No: 33470
  misc_feature (30)..(30): n is either a, c, g or t
  misc_feature (61)..(61): n is either a, c, g or t
  misc_feature (92)..(92): n is either a, c, g or t
  misc_feature (140)..(140): n is either a, c, g or t
  misc_feature (339)..(339): n is either a, c, g or t
  misc_feature (378)..(379): n is either a, c, g or t
cgtcgaaaacaacaaccgtacgacgccgancgcaacgcgacgactcaaacaaaaaaaacancacccgaaaaaaacaaaaacgcgcctcccanttcaaaaacgaacacaaaccgccgaatcacaacgaaaaaaacgacacncgcaaattaataaactccgaaacttaaaaaacttcgaaacccatcccgaccccgaaacgctacgaaactctatccgaacgatccgaccgaccgataaaaattacgaatacacgacgacttcccaaatacttttatatttcgctataaaaccatccgataaacgcgattcacacgcgcccgaacccacgtaaaaaacaanaaaatcccccttcccctcctccgcctccgctcccgcccnnccgctccgccgcccccttcctctcctcttccacttaaaacgacgataactccttccgaaaaaaaaaaacgaccccacactcgatccgaaacttaaaaacctaaaaaaaaccgaactaactacgcccgcgccgaaacgtaaaaaaaaataacgcaaaaccgaaatctaaaacctaacgaaaaaaacgcgccctaaaccctcgcgaaaatatcttaatcgcc

SEQ ID NO: 33471 - DNA, 599 bp, Artificial Sequence
  chemically treated genomic DNA (Homo sapiens) CpG-island No: 33471
  misc_feature (30)..(30): n is either a, c, g or t
  misc_feature (61)..(61): n is either a, c, g or t
  misc_feature (92)..(92): n is either a, c, g or t
  misc_feature (140)..(140): n is either a, c, g or t
  misc_feature (339)..(339): n is either a, c, g or t
  misc_feature (378)..(379): n is either a, c, g or t
cgtcgggaataataatcgtgcggcgtcggncgtaacgcggcggtttaaataaagggagtantattcgagaaaaataaagacgcgttttttantttaaaaacgagtataggtcgtcgggttataacggaaaaggcggtatncgtaagttagtggatttcgggatttgaggggtttcggggtttatttcggtttcggggcgttgcggggttttgttcggacggttcgatcggtcgataggaattgcgagtatacggcgattttttagatgtttttgtatttcgttgtaaaattattcggtgggcgcgatttatacgcgttcgggtttacgtgggaggtagnaggatttttttttttttttttcgttttcgttttcgtttnntcgtttcgtcgttttttttttttttttttttatttaaagcggcgatggtttttttcgagagggagaggcggttttatattcggttcgggatttgggggtttggaggaagtcggattggttgcgttcgcgtcggggcgtaggagggggtggcgtagagtcggagtttggggtttggcgggagggacgcgttttgggttttcgcgggggtgttttggtcgtt

SEQ ID NO: 33472 - DNA, 599 bp, Artificial Sequence
  chemically treated genomic DNA (Homo sapiens) CpG-island No: 33472
  misc_feature (221)..(222): n is either a, c, g or t
  misc_feature (261)..(261): n is either a, c, g or t
  misc_feature (460)..(460): n is either a, c, g or t
  misc_feature (508)..(508): n is either a, c, g or t
  misc_feature (539)..(539): n is either a, c, g or t
  misc_feature (570)..(570): n is either a, c, g or t
aacgaccaaaacacccccgcgaaaacccaaaacgcgtccctcccgccaaaccccaaactccgactctacgccaccccctcctacgccccgacgcgaacgcaaccaatccgacttcctccaaacccccaaatcccgaaccgaatataaaaccgcctctccctctcgaaaaaaaccatcgccgctttaaataaaaaaaaaaaaaaaaaaaacgacgaaacgannaaacgaaaacgaaaacgaaaaaaaaaaaaaaaaatcctnctacctcccacgtaaacccgaacgcgtataaatcgcgcccaccgaataattttacaacgaaatacaaaaacatctaaaaaatcgccgtatactcgcaattcctatcgaccgatcgaaccgtccgaacaaaaccccgcaacgccccgaaaccgaaataaaccccgaaacccctcaaatcccgaaatccactaacttacgnataccgccttttccgttataacccgacgacctatactcgtttttaaantaaaaaacgcgtctttatttttctcgaatantactccctttatttaaaccgccgcgttacgnccgacgccgcacgattattattcccgacg

SEQ ID NO: 33473 - DNA, 819 bp, Artificial Sequence
  chemically treated genomic DNA (Homo sapiens) CpG-island No: 33473
  misc_feature (536)..(536): n is either a, c, g or t
  misc_feature (543)..(544): n is either a, c, g or t
  misc_feature (779)..(779): n is either a, c, g or t
  misc_feature (804)..(804): n is either a, c, g or t
tatacgtaagcggcggcgggtgtggttggtgtgattaagatggtgatggcgatgcggtacgggtagttgttacgtacgttgtacgtggaatcgtcgtcgtcggaggtggattggtcggcggggacggtttaattttttacggagaatacgttttggtttaggagtggtcgtgttcgtcgggtgggggtgtcgtcgttcgggattagtggtattaacgcgtacgttattttcgaatagttttcgggagtgtcgagttagtttgcggggtcgggttcgggttttgtcgtggatgtttcggtggtgtcgtggatggtgtcgggtaaaatattcgaagcgttattcgcgtaggtaacggcgttgatgatttatttggacgagcgatttgatgttttttcgttggatgttgggtattcgttggcgttgatacggtcggcgttggatgagcgagcggtggtgttggggtcggatcgtgaaacgttgttgtgcggtgtgaaagcgttgtttgtcggttatgaggtttttgggtttgtgatcgnatttgtnnggggttggggtcgtatcgggtttgtgtttttcggttagggtggttagtggttggggatgggttcggggttttatcgggttttttcggtggtcgttgttggttttgacgaattttgtgtcgagttggatgttatttgggttagaaatcggggttgggaggggttgttcgtttcgttttttttttttgtcggtttttggttttttttcgttgttgtcgcgttcgcggtcgttcgtgnttgttttcgcgcgtttgttttcgtncgtgttttttttttt

SEQ ID NO: 33474 - DNA, 819 bp, Artificial Sequence
  chemically treated genomic DNA (Homo sapiens) CpG-island No: 33474
  misc_feature (16)..(16): n is either a, c, g or t
  misc_feature (41)..(41): n is either a, c, g or t
  misc_feature (276)..(277): n is either a, c, g or t
  misc_feature (284)..(284): n is either a, c, g or t
aaaaaaaaaaacacgnacgaaaacaaacgcgcgaaaacaancacgaacgaccgcgaacgcgacaacaacgaaaaaaaaccaaaaaccgacaaaaaaaaaaaacgaaacgaacaacccctcccaaccccgatttctaacccaaataacatccaactcgacacaaaattcgtcaaaaccaacaacgaccaccgaaaaaacccgataaaaccccgaacccatccccaaccactaaccaccctaaccgaaaaacacaaacccgatacgaccccaaccccnnacaaatncgatcacaaacccaaaaacctcataaccgacaaacaacgctttcacaccgcacaacaacgtttcacgatccgaccccaacaccaccgctcgctcatccaacgccgaccgtatcaacgccaacgaatacccaacatccaacgaaaaaacatcaaatcgctcgtccaaataaatcatcaacgccgttacctacgcgaataacgcttcgaatattttacccgacaccatccacgacaccaccgaaacatccacgacaaaacccgaacccgaccccgcaaactaactcgacactcccgaaaactattcgaaaataacgtacgcgttaataccactaatcccgaacgacgacacccccacccgacgaacacgaccactcctaaaccaaaacgtattctccgtaaaaaattaaaccgtccccgccgaccaatccacctccgacgacgacgattccacgtacaacgtacgtaacaactacccgtaccgcatcgccatcaccatcttaatcacaccaaccacacccgccgccgcttacgtata

SEQ ID NO: 33475 - DNA, 819 bp, Artificial Sequence
  chemically treated genomic DNA (Homo sapiens) CpG-island No: 33475
  misc_feature (16)..(16): n is either a, c, g or t
  misc_feature (41)..(41): n is either a, c, g or t
  misc_feature (276)..(277): n is either a, c, g or t
  misc_feature (284)..(284): n is either a, c, g or t
gggagaggagatacgngcgaaagtaggcgcgcgaagataantacgaacggtcgcgagcgcggtaataacggagggggattaagggtcgataagagaggggagcgaaacggataattttttttaatttcgatttttggtttagatggtatttagttcggtataaggttcgttaaagttagtagcgattatcggaaaagttcggtaaagtttcgggtttatttttagttattgattattttgatcggaaaatataaattcgatgcggttttagttttnnatagatncggttataaatttagaagttttatgatcggtagatagcgtttttatatcgtataataacgttttacggttcgattttagtattatcgttcgtttatttagcgtcgatcgtgttaacgttagcgagtatttaatatttagcgaggagatattaggtcgttcgtttagataggttattaacgtcgttgtttgcgcggatagcgtttcgggtgttttgttcgatattatttacggtattatcggaatatttacgatagaattcgaattcggtttcgtagattgattcggtattttcgggggttgttcgaggatgacgtgcgcgttagtattattgatttcgaacgacgatatttttattcgacgaatacgattatttttgggttagggcgtgtttttcgtaaggagttgaatcgttttcgtcgattaatttattttcggcgacggcgattttacgtgtaacgtgcgtggtagttgttcgtgtcgtatcgttattattattttgattatattagttatattcgtcgtcgtttgcgtatg

SEQ ID NO: 33476 - DNA, 819 bp, Artificial Sequence
  chemically treated genomic DNA (Homo sapiens) CpG-island No: 33476
  misc_feature (536)..(536): n is either a, c, g or t
  misc_feature (543)..(544): n is either a, c, g or t
  misc_feature (779)..(779): n is either a, c, g or t
  misc_feature (804)..(804): n is either a, c, g or t
catacgcaaacgacgacgaatataactaatataatcaaaataataataacgatacgacacgaacaactaccacgcacgttacacgtaaaatcgccgtcgccgaaaataaattaatcgacgaaaacgattcaactccttacgaaaaacacgccctaacccaaaaataatcgtattcgtcgaataaaaatatcgtcgttcgaaatcaataatactaacgcgcacgtcatcctcgaacaacccccgaaaataccgaatcaatctacgaaaccgaattcgaattctatcgtaaatattccgataataccgtaaataatatcgaacaaaacacccgaaacgctatccgcgcaaacaacgacgttaataacctatctaaacgaacgacctaatatctcctcgctaaatattaaatactcgctaacgttaacacgatcgacgctaaataaacgaacgataatactaaaatcgaaccgtaaaacgttattatacgatataaaaacgctatctaccgatcataaaacttctaaatttataaccgnatctatnnaaaactaaaaccgcatcgaatttatattttccgatcaaaataatcaataactaaaaataaacccgaaactttaccgaacttttccgataatcgctactaactttaacgaaccttataccgaactaaataccatctaaaccaaaaatcgaaattaaaaaaaattatccgtttcgctcccctctcttatcgacccttaatccccctccgttattaccgcgctcgcgaccgttcgtanttatcttcgcgcgcctactttcgcncgtatctcctctccc

SEQ ID NO: 33477 - DNA, 813 bp, Artificial Sequence
  chemically treated genomic DNA (Homo sapiens) CpG-island No: 33477
  misc_feature (342)..(342): n is either a, c, g or t
  misc_feature (370)..(370): n is either a, c, g or t
  misc_feature (590)..(590): n is either a, c, g or t
  misc_feature (593)..(593): n is either a, c, g or t
  misc_feature (595)..(595): n is either a, c, g or t
  misc_feature (686)..(686): n is either a, c, g or t
  misc_feature (751)..(751): n is either a, c, g or t
  misc_feature (794)..(794): n is either a, c, g or t
ggttaagtcgaatatcggttatacgtaagcggcggcgggtgtggttggtgtgattaagatggtgatggcgatgcggtacgggtagttgttattttcgttgtacgtggaatcgtcgtcgtcggaggtggattggtcggtggggacggtttaattgtttacggagaatacgttttggtttacgtagtggtcgagttcgtcgggtgggggtgtcgtcgttcgggattagtggtattaacgcgtacgttattttcgaatagttttcgggagtgtcgagttattttgcggcgtcgggtttcggttttgtcgcggatgtttcggtggtgtcgggatggggtcgggtanatattcgaagtcgttttcgcgtaggttncggcgttgttgatttatttgggcgagcgatttggcgttttttcgttggatgttgggtatttcgtttgtttttgttcgggtcgcgttggttgatcgatcggtggggcgggggcggttcgtgaacgtgttgcgcggtgtgaagttttgttttttttatgtcgttttttggtggtatcgtgtttgtgcggtcgggttttttcggtttggggttttcgttacgnggntntcgttcgggtcggtcgggcgttttcggtttttttcggttgttgttttttgcgatttttgtcgagttggtttttttcgtttcgatttttcgntttttcggcgtttttttcgttttatcgttggttttttttttggcgtcgcgggtttttttttttgncgtcgttcgttcgtttttttttcggtggcgcggtcgtcggcgngtgttttttttacgcgtgt

SEQ ID NO: 33478 - DNA, 813 bp, Artificial Sequence
  chemically treated genomic DNA (Homo sapiens) CpG-island No: 33478
  misc_feature (20)..(20): n is either a, c, g or t
  misc_feature (63)..(63): n is either a, c, g or t
  misc_feature (128)..(128): n is either a, c, g or t
  misc_feature (219)..(219): n is either a, c, g or t
  misc_feature (221)..(221): n is either a, c, g or t
  misc_feature (224)..(224): n is either a, c, g or t
  misc_feature (444)..(444): n is either a, c, g or t
  misc_feature (472)..(472): n is either a, c, g or t
acacgcgtaaaaaaaacacncgccgacgaccgcgccaccgaaaaaaaaacgaacgaacgacgncaaaaaaaaaaacccgcgacgccaaaaaaaaaaccaacgataaaacgaaaaaaacgccgaaaaancgaaaaatcgaaacgaaaaaaaccaactcgacaaaaatcgcaaaaaacaacaaccgaaaaaaaccgaaaacgcccgaccgacccgaacgananccncgtaacgaaaaccccaaaccgaaaaaacccgaccgcacaaacacgataccaccaaaaaacgacataaaaaaaacaaaacttcacaccgcgcaacacgttcacgaaccgcccccgccccaccgatcgatcaaccaacgcgacccgaacaaaaacaaacgaaatacccaacatccaacgaaaaaacgccaaatcgctcgcccaaataaatcaacaacgccgnaacctacgcgaaaacgacttcgaatatntacccgaccccatcccgacaccaccgaaacatccgcgacaaaaccgaaacccgacgccgcaaaataactcgacactcccgaaaactattcgaaaataacgtacgcgttaataccactaatcccgaacgacgacacccccacccgacgaactcgaccactacgtaaaccaaaacgtattctccgtaaacaattaaaccgtccccaccgaccaatccacctccgacgacgacgattccacgtacaacgaaaataacaactacccgtaccgcatcgccatcaccatcttaatcacaccaaccacacccgccgccgcttacgtataaccgatattcgacttaacc

SEQ ID NO: 33479 - DNA, 813 bp, Artificial Sequence
  chemically treated genomic DNA (Homo sapiens) CpG-island No: 33479
  misc_feature (20)..(20): n is either a, c, g or t
  misc_feature (63)..(63): n is either a, c, g or t
  misc_feature (128)..(128): n is either a, c, g or t
  misc_feature (219)..(219): n is either a, c, g or t
  misc_feature (221)..(221): n is either a, c, g or t
  misc_feature (224)..(224): n is either a, c, g or t
  misc_feature (444)..(444): n is either a, c, g or t
  misc_feature (472)..(472): n is either a, c, g or t
gtacgcgtaagaagagtatncgtcgacggtcgcgttatcgagaaggagacgaacgagcggcgntaagagagaaaattcgcggcgttaaagggagggttagcggtggaacggggagggcgtcgagaggncgagagatcggggcgagaggaattagttcggtaaagatcgtaaagagtagtaatcgggaagggtcgaaagcgttcggtcgattcgggcggngnttncgtggcggaaattttaaatcgaaggggttcggtcgtatagatacggtattattaaaaagcggtataaaggaaatagggttttatatcgcgtaatacgtttacgggtcgttttcgttttatcggtcggttagttagcgcggttcgggtaagggtaagcgaggtatttaatatttagcgaggagacgttaggtcgttcgtttagataggttaataacgtcgnagtttgcgcggaagcggtttcgggtgtntgttcgattttatttcggtattatcggaatattcgcgatagaatcggaattcggcgtcgtagagtgattcggtattttcgggggttgttcgaggatgacgtgcgcgttagtattattgatttcgaacgacgatatttttattcgacgaattcgattattgcgtgggttagggcgtgtttttcgtaagtagttgaatcgtttttatcgattaatttattttcggcgacggcgattttacgtgtaacgaagatggtagttgttcgtgtcgtatcgttattattattttgattatattagttatattcgtcgtcgtttgcgtatgatcgatgttcgatttgatt

SEQ ID NO: 33480 - DNA, 813 bp, Artificial Sequence
  chemically treated genomic DNA (Homo sapiens) CpG-island No: 33480
  misc_feature (342)..(342): n is either a, c, g or t
  misc_feature (370)..(370): n is either a, c, g or t
  misc_feature (590)..(590): n is either a, c, g or t
  misc_feature (593)..(593): n is either a, c, g or t
  misc_feature (595)..(595): n is either a, c, g or t
  misc_feature (686)..(686): n is either a, c, g or t
  misc_feature (751)..(751): n is either a, c, g or t
  misc_feature (794)..(794): n is either a, c, g or t
aatcaaatcgaacatcgatcatacgcaaacgacgacgaatataactaatataatcaaaataataataacgatacgacacgaacaactaccatcttcgttacacgtaaaatcgccgtcgccgaaaataaattaatcgataaaaacgattcaactacttacgaaaaacacgccctaacccacgcaataatcgaattcgtcgaataaaaatatcgtcgttcgaaatcaataatactaacgcgcacgtcatcctcgaacaacccccgaaaataccgaatcactctacgacgccgaattccgattctatcgcgaatattccgataataccgaaataaaatcgaacanacacccgaaaccgcttccgcgcaaactncgacgttattaacctatctaaacgaacgacctaacgtctcctcgctaaatattaaatacctcgcttacccttacccgaaccgcgctaactaaccgaccgataaaacgaaaacgacccgtaaacgtattacgcgatataaaaccctatttcctttataccgctttttaataataccgtatctatacgaccgaaccccttcgatttaaaatttccgccacgnaancnccgcccgaatcgaccgaacgctttcgacccttcccgattactactctttacgatctttaccgaactaattcctctcgccccgatctctcgncctctcgacgccctccccgttccaccgctaaccctccctttaacgccgcgaattttctctcttancgccgctcgttcgtctccttctcgataacgcgaccgtcgacgnatactcttcttacgcgtac

SEQ ID NO: 33481 - DNA, 582 bp, Artificial Sequence
  chemically treated genomic DNA (Homo sapiens) CpG-island No: 33481
agtcgtttcggaatcggatatttggcgcgtacgtttcgggaaaggcggagggtgtattgtttttttttacgttttttgttttttgtatttgcggcggcggcgtgtttggcgggatttagtagcgcggggcgtgtttcgattatttaaaagttataaagtgaaatttcggcgttttttgtatatgcgtagagttgcggttattttttttttaatttggagttttggttcgcggcggcgtaagtttgtacgtagttgattgcgtttttcgcggtggttttcggcggttttttgtttcggtttggttttttggtcgtcgtttagtttcgtagtttttttcggaggtttgtaagtttcggatcggttagtttacgtttaggttttaagaagggattcgtcggggcgtattttttttcgtttttcggtacgagtttagtttttggacgttttcgggagaattgggttaagtatagggtggtcgcggcgtagggagagtatttgtaaacgttggtttttgtagtgttttgaattttttcgaagagtttttagattcgtttcgggagagtggggttgcgggggtggtag

SEQ ID NO: 33482 - DNA, 582 bp, Artificial Sequence
  chemically treated genomic DNA (Homo sapiens) CpG-island No: 33482
ctaccacccccgcaaccccactctcccgaaacgaatctaaaaactcttcgaaaaaattcaaaacactacaaaaaccaacgtttacaaatactctccctacgccgcgaccaccctatacttaacccaattctcccgaaaacgtccaaaaactaaactcgtaccgaaaaacgaaaaaaaatacgccccgacgaatcccttcttaaaacctaaacgtaaactaaccgatccgaaacttacaaacctccgaaaaaaactacgaaactaaacgacgaccaaaaaaccaaaccgaaacaaaaaaccgccgaaaaccaccgcgaaaaacgcaatcaactacgtacaaacttacgccgccgcgaaccaaaactccaaattaaaaaaaaaataaccgcaactctacgcatatacaaaaaacgccgaaatttcactttataacttttaaataatcgaaacacgccccgcgctactaaatcccgccaaacacgccgccgccgcaaatacaaaaaacaaaaaacgtaaaaaaaaacaatacaccctccgcctttcccgaaacgtacgcgccaaatatccgattccgaaacgact

SEQ ID NO: 33483 - DNA, 582 bp, Artificial Sequence
  chemically treated genomic DNA (Homo sapiens) CpG-island No: 33483
ttattattttcgtaattttattttttcggggcgggtttaagagtttttcggggaaatttaaagtattatagggattaacgtttgtagatgttttttttgcgtcgcgattattttgtgtttggtttagttttttcggaggcgtttagagattgggttcgtgtcgggggacggaagagggtgcgtttcggcggatttttttttggagtttggacgtgagttggtcggttcggggtttgtagattttcgggaggagttgcggggttgagcggcgattaggaggttaggtcggggtagaggatcgtcgagggttatcgcgggaggcgtagttagttgcgtataggtttgcgtcgtcgcgggttaagattttaaattgggaaaggggtggtcgtagttttgcgtatgtgtaggaggcgtcggagttttattttgtaatttttaagtggtcggaatacgtttcgcgttgttgggtttcgttagatacgtcgtcgtcgtaggtataggggatagggggcgtgaggaggggtaatgtatttttcgtttttttcgggacgtgcgcgttaggtgttcggtttcggaacggtt

SEQ ID NO: 33484 - DNA, 582 bp, Artificial Sequence
  chemically treated genomic DNA (Homo sapiens) CpG-island No: 33484
aaccgttccgaaaccgaacacctaacgcgcacgtcccgaaaaaaacgaaaaatacattacccctcctcacgccccctatcccctatacctacgacgacgacgtatctaacgaaacccaacaacgcgaaacgtattccgaccacttaaaaattacaaaataaaactccgacgcctcctacacatacgcaaaactacgaccacccctttcccaatttaaaatcttaacccgcgacgacgcaaacctatacgcaactaactacgcctcccgcgataaccctcgacgatcctctaccccgacctaacctcctaatcgccgctcaaccccgcaactcctcccgaaaatctacaaaccccgaaccgaccaactcacgtccaaactccaaaaaaaaatccgccgaaacgcaccctcttccgtcccccgacacgaacccaatctctaaacgcctccgaaaaaactaaaccaaacacaaaataatcgcgacgcaaaaaaaacatctacaaacgttaatccctataatactttaaatttccccgaaaaactcttaaacccgccccgaaaaaataaaattacgaaaataataa

SEQ ID NO: 33485 - DNA, 1003 bp, Artificial Sequence
  chemically treated genomic DNA (Homo sapiens) CpG-island No: 33485
tcggtagtcgcgtttcgtcgttttttttttagtttggttttaacggttcgtaatggcggaatagggagttaggggtatcgtcgtttggggaattttattcgtcggtttagggtttagttcgtcgtgtgatagtttcgggtattttgtttagcggggtgtaagttcggatcgcggtaagcgttattttcgggtagtcgcggttataattgttttcgggtgagtgggtcgtcgattttgtggtttcgtttatttttcgtttttttagtcggtcgtttaggttgcggtttttttcggggtcggttttcgttgttttagtcgcggcgtagagggtatatcggtttgatcgattagtcggttgttagtgtcgggagtcgtcgcgtttattttcgttcgtttggtcggggatttaggattgagtcgtttagttgcgtttttcgtttatagttttagcgggcgtcgggcgggcgagtagtttttcggtttttttcggatagcgacgtagtcgtagcgcgcgttttaatataggtaagggtcgtttttttcgttagttcggtgggagtagggagcggggagttgggaatttttttttcggttttcgtagtttcgtgggattcgcgtcgttttcgatttcggttagggggtcgggtttttttggggattggtcggttcgcggcgggttttcgggttggggtcgttttttgtttgcggcgtttttagatatttcgtttgatttttaacgtttatttttttatcgcgttggggaaaaggtacgtgttatttttattgtgggagaaattaaattgggtagttgttttttcgtttcgggtgttttaggcgttttttttttttttttagacgttatattacggttttgttttaggacgagtatttttagggaacggtgttaggacggtgtagggcgtagtattttttgggaattttatttttttttttttgatttgagttggatcgcgcgggtttaataggcgttagttgggttaat

SEQ ID NO: 33486 - DNA, 1003 bp, Artificial Sequence
  chemically treated genomic DNA (Homo sapiens) CpG-island No: 33486
attaacccaactaacgcctattaaacccgcgcgatccaactcaaatcaaaaaaaaaaaaataaaattcccaaaaaatactacgccctacaccgtcctaacaccgttccctaaaaatactcgtcctaaaacaaaaccgtaatataacgtctaaaaaaaaaaaaaaaacgcctaaaacacccgaaacgaaaaaacaactacccaatttaatttctcccacaataaaaataacacgtaccttttccccaacgcgataaaaaaataaacgttaaaaatcaaacgaaatatctaaaaacgccgcaaacaaaaaacgaccccaacccgaaaacccgccgcgaaccgaccaatccccaaaaaaacccgaccccctaaccgaaatcgaaaacgacgcgaatcccacgaaactacgaaaaccgaaaaaaaaattcccaactccccgctccctactcccaccgaactaacgaaaaaaacgacccttacctatattaaaacgcgcgctacgactacgtcgctatccgaaaaaaaccgaaaaactactcgcccgcccgacgcccgctaaaactataaacgaaaaacgcaactaaacgactcaatcctaaatccccgaccaaacgaacgaaaataaacgcgacgactcccgacactaacaaccgactaatcgatcaaaccgatataccctctacgccgcgactaaaacaacgaaaaccgaccccgaaaaaaaccgcaacctaaacgaccgactaaaaaaacgaaaaataaacgaaaccacaaaatcgacgacccactcacccgaaaacaattataaccgcgactacccgaaaataacgcttaccgcgatccgaacttacaccccgctaaacaaaatacccgaaactatcacacgacgaactaaaccctaaaccgacgaataaaattccccaaacgacgatacccctaactccctattccgccattacgaaccgttaaaaccaaactaaaaaaaaaacgacgaaacgcgactaccga

SEQ ID NO: 33487 - DNA, 1003 bp, Artificial Sequence
  chemically treated genomic DNA (Homo sapiens) CpG-island No: 33487
attaatttagttagcgtttgttaaattcgcgcgatttagtttaggttaaggaggaagaagtaaaatttttaaaaaatgttacgttttatatcgttttgatatcgttttttgggggtgttcgttttgggatagaatcgtagtgtggcgtttaaggaggaagagaaggcgtttagggtattcgaaacggagggatagttgtttaatttaattttttttatagtgggaataatacgtattttttttttagcgcggtggaagggtgagcgttagaaattagacgggatgtttgagaacgtcgtaggtagggggcgattttagttcgggagttcgtcgcgggtcggttagtttttagggaagttcggttttttagtcgaggtcggaggcggcgcggattttacgggattgcggaggtcgggaaaaaggtttttaatttttcgttttttgtttttatcgggttggcgggaggagcggtttttatttgtgttagggcgcgcgttgcgattgcgtcgttgttcgggaagggtcgaagagttgttcgttcgttcggcgttcgttggggttatgggcgaggggcgtagttggacgatttagttttgggttttcggttaggcgggcggggatggacgcggcggttttcggtattggtagtcggttagtcggttaggtcgatgtgttttttgcgtcgcggttgagatagcgggaatcggtttcgggaggagtcgtagtttgagcggtcgattgaggaggcgaaggatgggcggggttatagggtcgacgatttatttattcggaagtagttgtggtcgcgattgttcgggagtggcgtttgtcgcggttcgggtttgtatttcgttgggtaaagtattcggggttgttatacggcgagttgagttttgggtcggcgggtgaggttttttaagcggcgatgtttttggttttttgtttcgttattgcgagtcgttagggttaagttggagggagggcggcgaggcgcggttgtcgg

SEQ ID NO: 33488 - DNA, 1003 bp, Artificial Sequence
  chemically treated genomic DNA (Homo sapiens) CpG-island No: 33488
ccgacaaccgcgcctcgccgccctccctccaacttaaccctaacgactcgcaataacgaaacaaaaaaccaaaaacatcgccgcttaaaaaacctcacccgccgacccaaaactcaactcgccgtataacaaccccgaatactttacccaacgaaatacaaacccgaaccgcgacaaacgccactcccgaacaatcgcgaccacaactacttccgaataaataaatcgtcgaccctataaccccgcccatccttcgcctcctcaatcgaccgctcaaactacgactcctcccgaaaccgattcccgctatctcaaccgcgacgcaaaaaacacatcgacctaaccgactaaccgactaccaataccgaaaaccgccgcgtccatccccgcccgcctaaccgaaaacccaaaactaaatcgtccaactacgcccctcgcccataaccccaacgaacgccgaacgaacgaacaactcttcgacccttcccgaacaacgacgcaatcgcaacgcgcgccctaacacaaataaaaaccgctcctcccgccaacccgataaaaacaaaaaacgaaaaattaaaaacctttttcccgacctccgcaatcccgtaaaatccgcgccgcctccgacctcgactaaaaaaccgaacttccctaaaaactaaccgacccgcgacgaactcccgaactaaaatcgccccctacctacgacgttctcaaacatcccgtctaatttctaacgctcacccttccaccgcgctaaaaaaaaaatacgtattattcccactataaaaaaaattaaattaaacaactatccctccgtttcgaataccctaaacgccttctcttcctccttaaacgccacactacgattctatcccaaaacgaacacccccaaaaaacgatatcaaaacgatataaaacgtaacattttttaaaaattttacttcttcctccttaacctaaactaaatcgcgcgaatttaacaaacgctaactaaattaat

SEQ ID NO: 33489 - DNA, 969 bp, Artificial Sequence
  chemically treated genomic DNA (Homo sapiens) CpG-island No: 33489
ttagaagttattaatataaaatttcgatattgtatttagtttacgagtagatcggtttgggaggcgtcgtagtcgtattcgtttggcggagtaggagtcgtagttttaatttgtcgttcgtttcgtttttcggcggtttatttgtgataggtgtgtaggtgttttatacgttttcggtcgtttttcgttttcggtttttcgcggtttcgggttcgagttttttagtttgtcgttttttcgggagtttttcgttttttcgtaggtttcggagcgtttttcgttcgtttttgggcggtcgcgttcgtatttatatagcgttttaattttttttcgggaggcgatttttttagttagtcggtgtatattacgtcgtcgtcgtcgtttatgttgtcggtttggagtttttcgtcgggtcgcgcggacgagggcgcgggttcgggtagttggggtagcggtcggcggtgcgtagttcgcgggaggttaggggcgggggcgggcggttcggcggggattaggcggcgcgggcgcggcgcgagttcggtagtttcgcgcgcgttcgttttttcgtttcgagcgcgcgtaattcgtatttttcgttcggtcgtcgggggagtagttgtagtaggaaggtcggttcgttcgttacgttcgttttcgtcgcgttttcgaggtcgtcgcgtacgcggacgcggggttagggattcgcgaggatatagaaagttatcgtcgtcggcgcgtttcggagtttcgtttttttttgaggttttaagtcgcgggcgcggaggttagggaggcgatcgcgtttttggcgttggcgggtgtgaggggaagggattgcgcgttttcggtcgtcgatcgattttttatcgagcgtcgacggggaagggatattagggttgtttatattttcgatatattttgcgggttaggtttcggttgaaaggagggatttttttttagtaagaagtt

SEQ ID NO: 33490 - DNA, 969 bp, Artificial Sequence
  chemically treated genomic DNA (Homo sapiens) CpG-island No: 33490
aacttcttactaaaaaaaaatccctcctttcaaccgaaacctaacccgcaaaatatatcgaaaatataaacaaccctaatatcccttccccgtcgacgctcgataaaaaatcgatcgacgaccgaaaacgcgcaatcccttcccctcacacccgccaacgccaaaaacgcgatcgcctccctaacctccgcgcccgcgacttaaaacctcaaaaaaaaacgaaactccgaaacgcgccgacgacgataactttctatatcctcgcgaatccctaaccccgcgtccgcgtacgcgacgacctcgaaaacgcgacgaaaacgaacgtaacgaacgaaccgaccttcctactacaactactcccccgacgaccgaacgaaaaatacgaattacgcgcgctcgaaacgaaaaaacgaacgcgcgcgaaactaccgaactcgcgccgcgcccgcgccgcctaatccccgccgaaccgcccgcccccgcccctaacctcccgcgaactacgcaccgccgaccgctaccccaactacccgaacccgcgccctcgtccgcgcgacccgacgaaaaactccaaaccgacaacataaacgacgacgacgacgtaatatacaccgactaactaaaaaaatcgcctcccgaaaaaaaattaaaacgctatataaatacgaacgcgaccgcccaaaaacgaacgaaaaacgctccgaaacctacgaaaaaacgaaaaactcccgaaaaaacgacaaactaaaaaactcgaacccgaaaccgcgaaaaaccgaaaacgaaaaacgaccgaaaacgtataaaacacctacacacctatcacaaataaaccgccgaaaaacgaaacgaacgacaaattaaaactacgactcctactccgccaaacgaatacgactacgacgcctcccaaaccgatctactcgtaaactaaatacaatatcgaaattttatattaataacttctaa

SEQ ID NO: 33491 - DNA, 969 bp, Artificial Sequence
  chemically treated genomic DNA (Homo sapiens) CpG-island No: 33491
agttttttgttgggaaggggtttttttttttagtcggaatttgattcgtagaatgtatcggaaatgtgagtagttttagtatttttttttcgtcgacgttcggtgaaaaatcgatcgacgatcgagggcgcgtagttttttttttttatattcgttagcgttaggggcgcggtcgtttttttggttttcgcgttcgcggtttggggttttaggagaaagcgagatttcggggcgcgtcggcggcggtggttttttgtattttcgcgggtttttagtttcgcgttcgcgtgcgcggcggtttcgggggcgcggcgggagcgggcgtggcgagcgagtcggtttttttgttgtagttgttttttcggcggtcgggcggagagtgcggattgcgcgcgttcggggcgggggagcgggcgcgcgcgaggttgtcgggttcgcgtcgcgttcgcgtcgtttagttttcgtcgggtcgttcgttttcgtttttggtttttcgcgagttgcgtatcgtcggtcgttgttttagttgttcgagttcgcgttttcgttcgcgcgattcggcggggggttttaggtcggtagtatgagcggcggcggcgacgtggtgtgtatcggttggttgaggaaatcgtttttcgagaagaagttgaggcgttatgtgagtgcgggcgcggtcgtttaggggcgggcggggggcgtttcggggtttgcggaggggcgggggattttcggaggggcggtaggttggggagttcgggttcggagtcgcggggggtcgggggcgaggagcggtcgggggcgtgtggggtatttgtatatttgttataggtgggtcgtcgaggggcggggcgggcggtaggttgaggttgcggtttttgtttcgttaggcgggtgcggttgcggcgttttttaagtcggtttgttcgtgaattaaatatagtgtcgaagttttgtattgatggtttttgg

SEQ ID NO: 33492 - DNA, 969 bp, Artificial Sequence
  chemically treated genomic DNA (Homo sapiens) CpG-island No: 33492
ccaaaaaccatcaatacaaaacttcgacactatatttaattcacgaacaaaccgacttaaaaaacgccgcaaccgcacccgcctaacgaaacaaaaaccgcaacctcaacctaccgcccgccccgcccctcgacgacccacctataacaaatatacaaataccccacacgcccccgaccgctcctcgcccccgaccccccgcgactccgaacccgaactccccaacctaccgcccctccgaaaatcccccgcccctccgcaaaccccgaaacgccccccgcccgcccctaaacgaccgcgcccgcactcacataacgcctcaacttcttctcgaaaaacgatttcctcaaccaaccgatacacaccacgtcgccgccgccgctcatactaccgacctaaaaccccccgccgaatcgcgcgaacgaaaacgcgaactcgaacaactaaaacaacgaccgacgatacgcaactcgcgaaaaaccaaaaacgaaaacgaacgacccgacgaaaactaaacgacgcgaacgcgacgcgaacccgacaacctcgcgcgcgcccgctcccccgccccgaacgcgcgcaatccgcactctccgcccgaccgccgaaaaaacaactacaacaaaaaaaccgactcgctcgccacgcccgctcccgccgcgcccccgaaaccgccgcgcacgcgaacgcgaaactaaaaacccgcgaaaatacaaaaaaccaccgccgccgacgcgccccgaaatctcgctttctcctaaaaccccaaaccgcgaacgcgaaaaccaaaaaaacgaccgcgcccctaacgctaacgaatataaaaaaaaaaaactacgcgccctcgatcgtcgatcgatttttcaccgaacgtcgacgaaaaaaaaatactaaaactactcacatttccgatacattctacgaatcaaattccgactaaaaaaaaaaaccccttcccaacaaaaaact

SEQ ID NO: 33493 - DNA, 532 bp, Artificial Sequence
  chemically treated genomic DNA (Homo sapiens) CpG-island No: 33493
ggtagcgcgttttgaaagtttatgatcgtcgtagttaatttttggtcggagttggagacgtagcgagcgatcggtcggtttcgaatttttatagttggagggcgaggttagttgtattcggttttagtgttttttcgcggttataagcggtcgtttttttggttcggtgtttcggcgtttgatttaggtttatggagtcggggttgtggttttttttcgggtttatagtgattttcgtcgtaggtaagcgtacggggcggcgcgttttttttggcgcgagcgtatataaaaggatttagggcgggggattcgaggcgcggagaagatgtgcgtcgcggggagtaaatttttgtttgggttttgtatttgtgaagacgtttgggggagggttggggagtagaagcggcgcgtaacgattattcgtacgggtttcgggagttgtagttcgcgtattggttggagatttgttgtttgggtcgatttggttaattttttatgaaattggggattttttagaaagtttgcgaattat

SEQ ID NO: 33494 - DNA, 532 bp, Artificial Sequence
  chemically treated genomic DNA (Homo sapiens) CpG-island No: 33494
ataattcgcaaactttctaaaaaatccccaatttcataaaaaattaaccaaatcgacccaaacaacaaatctccaaccaatacgcgaactacaactcccgaaacccgtacgaataatcgttacgcgccgcttctactccccaaccctcccccaaacgtcttcacaaatacaaaacccaaacaaaaatttactccccgcgacgcacatcttctccgcgcctcgaatcccccgccctaaatccttttatatacgctcgcgccaaaaaaaacgcgccgccccgtacgcttacctacgacgaaaatcactataaacccgaaaaaaaaccacaaccccgactccataaacctaaatcaaacgccgaaacaccgaaccaaaaaaacgaccgcttataaccgcgaaaaaacactaaaaccgaatacaactaacctcgccctccaactataaaaattcgaaaccgaccgatcgctcgctacgtctccaactccgaccaaaaattaactacgacgatcataaactttcaaaacgcgctacc

SEQ ID NO: 33495 - DNA, 532 bp, Artificial Sequence
  chemically treated genomic DNA (Homo sapiens) CpG-island No: 33495
atagttcgtaaattttttgaaaagtttttagttttatgaaaaattgattaagtcggtttaggtagtaggtttttagttagtgcgcgggttgtaattttcggagttcgtgcgggtagtcgttgcgcgtcgtttttgttttttagtttttttttaggcgtttttataagtgtagagtttaggtaagagtttgtttttcgcgacgtatatttttttcgcgtttcgggtttttcgttttgggtttttttgtgtgcgttcgcgttaggagaggcgcgtcgtttcgtgcgtttatttgcggcggaggttattgtgagttcgaaaaggagttatagtttcggttttatgaatttagattaggcgtcggagtatcggattaggaggacggtcgtttgtggtcgcgaaagggtattggggtcgggtatagttggtttcgttttttagttgtgggggttcgaggtcggtcgatcgttcgttgcgtttttagtttcggttaggagttggttgcggcggttataaatttttagagcgcgttgtt

SEQ ID NO: 33496 - DNA, 532 bp, Artificial Sequence
  chemically treated genomic DNA (Homo sapiens) CpG-island No: 33496
aacaacgcgctctaaaaatttataaccgccgcaaccaactcctaaccgaaactaaaaacgcaacgaacgatcgaccgacctcgaacccccacaactaaaaaacgaaaccaactatacccgaccccaataccctttcgcgaccacaaacgaccgtcctcctaatccgatactccgacgcctaatctaaattcataaaaccgaaactataactccttttcgaactcacaataacctccgccgcaaataaacgcacgaaacgacgcgcctctcctaacgcgaacgcacacaaaaaaacccaaaacgaaaaacccgaaacgcgaaaaaaatatacgtcgcgaaaaacaaactcttacctaaactctacacttataaaaacgcctaaaaaaaaactaaaaaacaaaaacgacgcgcaacgactacccgcacgaactccgaaaattacaacccgcgcactaactaaaaacctactacctaaaccgacttaatcaatttttcataaaactaaaaacttttcaaaaaatttacgaactat

SEQ ID NO: 33497 - DNA, 762 bp, Artificial Sequence
  chemically treated genomic DNA (Homo sapiens) CpG-island No: 33497
ttttcgttggtttacgcggacgtttcgcgattttcgtagtttggcgggtagcgcgttacgggagcggattagaatatagttcgtttcgttttatcgttcgcggtttcgttttttttggtcgataaggggcgggtattatcggagtgggtttcgtgggtgttggggtaggagtttttttatttttcgtttggtcgtcgttttttcgttgatttcgcgtttttttacgggtcgttttttattttttgagcggacgtagggagtcgatgtcgggcgaatcgggcgttatgaagggtagttgtttaacgggcgtcgcggcggaggggttggtcggttgagggttcgcgttgggtcgaggtatgcggagttcgggcgggattttgttttaggcgttgtttcggttgttgaaatacgtcgttttttcgggttttatcgatttgtcggttcgttgggttttgtcgttgggtgcgggcggggaaggttcggcggacgttttttcgagggggcggggtaatcgcggcggtgaatataacgtcggtttcgggcgtttttgttcggggtttatttggagcggttttcgttcggttcgaggttttcgaatttgtcgaattcgggggggggttttggcgggtcgttttcggaattggcggcggaggatttgtggttcggcgttggtttaaggtgaaaaaattgggcgttggttgttggtttcggaaagtatttgtttgttgtcggaagttttttgttgggttttgggtgtttggt

SEQ ID NO: 33498 - DNA, 762 bp, Artificial Sequence
  chemically treated genomic DNA (Homo sapiens) CpG-island No: 33498
accaaacacccaaaacccaacaaaaaacttccgacaacaaacaaatactttccgaaaccaacaaccaacgcccaattttttcaccttaaaccaacgccgaaccacaaatcctccgccgccaattccgaaaacgacccgccaaaacccccccccgaattcgacaaattcgaaaacctcgaaccgaacgaaaaccgctccaaataaaccccgaacaaaaacgcccgaaaccgacgttatattcaccgccgcgattaccccgccccctcgaaaaaacgtccgccgaaccttccccgcccgcacccaacgacaaaacccaacgaaccgacaaatcgataaaacccgaaaaaacgacgtatttcaacaaccgaaacaacgcctaaaacaaaatcccgcccgaactccgcatacctcgacccaacgcgaaccctcaaccgaccaacccctccgccgcgacgcccgttaaacaactacccttcataacgcccgattcgcccgacatcgactccctacgtccgctcaaaaaataaaaaacgacccgtaaaaaaacgcgaaatcaacgaaaaaacgacgaccaaacgaaaaataaaaaaactcctaccccaacacccacgaaacccactccgataatacccgccccttatcgaccaaaaaaaacgaaaccgcgaacgataaaacgaaacgaactatattctaatccgctcccgtaacgcgctacccgccaaactacgaaaatcgcgaaacgtccgcgtaaaccaacgaaaa

SEQ ID NO: 33499 - DNA, 762 bp, Artificial Sequence
  chemically treated genomic DNA (Homo sapiens) CpG-island No: 33499
gttaaatatttaaaatttagtaggaggttttcggtaataaataggtgtttttcgaggttagtaattagcgtttagtttttttattttaagttaacgtcgaattataaatttttcgtcgttaatttcgggggcggttcgttaaagttttttttcgggttcggtaagttcgaaagtttcgggtcggacgggggtcgttttagataggtttcggataagggcgttcgaggtcggcgttgtgtttatcgtcgcggttgtttcgttttttcgggaagacgttcgtcgggtttttttcgttcgtatttaacggtagggtttaacgggtcggtagatcggtgaggttcgggagggcggcgtgttttagtagtcggggtagcgtttggagtaggatttcgttcgggtttcgtatgtttcggtttagcgcgggtttttagtcggttagttttttcgtcgcggcgttcgttaggtagttgttttttatggcgttcggttcgttcggtatcgattttttgcgttcgtttagagggtgggagacggttcgtagaagggcgcggagttagcggaggagcgacggttaggcggggagtgaggaaatttttgttttagtatttacggagtttatttcggtggtgttcgttttttgtcggttagagggggcggggtcgcgggcgatggggcggagcgggttgtgttttggttcgttttcgtgacgcgttgttcgttaggttgcgggggtcgcggggcgttcgcgtgggttagcggagg

SEQ ID NO: 33500 - DNA, 762 bp, Artificial Sequence
  chemically treated genomic DNA (Homo sapiens) CpG-island No: 33500
cctccgctaacccacgcgaacgccccgcgacccccgcaacctaacgaacaacgcgtcacgaaaacgaaccaaaacacaacccgctccgccccatcgcccgcgaccccgccccctctaaccgacaaaaaacgaacaccaccgaaataaactccgtaaatactaaaacaaaaatttcctcactccccgcctaaccgtcgctcctccgctaactccgcgcccttctacgaaccgtctcccaccctctaaacgaacgcaaaaaatcgataccgaacgaaccgaacgccataaaaaacaactacctaacgaacgccgcgacgaaaaaactaaccgactaaaaacccgcgctaaaccgaaacatacgaaacccgaacgaaatcctactccaaacgctaccccgactactaaaacacgccgccctcccgaacctcaccgatctaccgacccgttaaaccctaccgttaaatacgaacgaaaaaaacccgacgaacgtcttcccgaaaaaacgaaacaaccgcgacgataaacacaacgccgacctcgaacgcccttatccgaaacctatctaaaacgacccccgtccgacccgaaactttcgaacttaccgaacccgaaaaaaaactttaacgaaccgcccccgaaattaacgacgaaaaatttataattcgacgttaacttaaaataaaaaaactaaacgctaattactaacctcgaaaaacacctatttattaccgaaaacctcctactaaattttaaatatttaac

SEQ ID NO: 33501 - DNA, 865 bp, Artificial Sequence
  chemically treated genomic DNA (Homo sapiens) CpG-island No: 33501
cgggagtgtttgggtcgtggcggggtcgttttaatcgcgttgcgttttcggcggtcgcgatttcggttttttgttaggagttagttgttttcggtggcgcgggaacggcgtttcgtagagagtggcgttgcggtttttttcggatacggttttgcggtttttttttttttcggttgggtttcgcgatcgttttcgttcgtttcgttcggtcgcgttacgttttttttcgttcggtttgggatagtttttttttttttttcgcgttttttatttattcggtcgggggtcgttgtttcggggttcgtcggggcgtcggcgagttttgcgcggggaaacggcgtaattagggttcgcgatttcgggatttagcggtagtcgaggtcgtcgttttcggaaaagttcgcggttcgggaggggaggagagcgggcgggacgcggggttttagaggcgttcgcgcggtcgatttcgggagcggggcgggaattaggggaaggggcgggggttttcgaggttggggttcgggggtcggacggggcgggcgttcggtcgtcgggttgacgtggagttcgtttagaaaggtttttcggggttatttgcgaaagtcgacgttttgtattttatttatggaggagcgagttcgttagcgtttaggagggttcgaggtcggtgcgcgtcgttggaggtcggatttcggttgttcgtttttcgtttagtttagtcgtcgaggttttcggttcgtttcgattttgcggtcgtcggcgtgtttcgcgggtgaattttgggggttggtattttgggggacggtagtcgggttttaattgttcgtaggtttttgtttagttcggcgtttagttcggttagttt

SEQ ID NO: 33502 - DNA, 865 bp, Artificial Sequence
  chemically treated genomic DNA (Homo sapiens) CpG-island No: 33502
aaactaaccgaactaaacgccgaactaaacaaaaacctacgaacaattaaaacccgactaccgtcccccaaaataccaacccccaaaattcacccgcgaaacacgccgacgaccgcaaaatcgaaacgaaccgaaaacctcgacgactaaactaaacgaaaaacgaacaaccgaaatccgacctccaacgacgcgcaccgacctcgaaccctcctaaacgctaacgaactcgctcctccataaataaaatacaaaacgtcgactttcgcaaataaccccgaaaaacctttctaaacgaactccacgtcaacccgacgaccgaacgcccgccccgtccgacccccgaaccccaacctcgaaaacccccgccccttcccctaattcccgccccgctcccgaaatcgaccgcgcgaacgcctctaaaaccccgcgtcccgcccgctctcctcccctcccgaaccgcgaacttttccgaaaacgacgacctcgactaccgctaaatcccgaaatcgcgaaccctaattacgccgtttccccgcgcaaaactcgccgacgccccgacgaaccccgaaacaacgacccccgaccgaataaataaaaaacgcgaaaaaaaaaaaaaaactatcccaaaccgaacgaaaaaaaacgtaacgcgaccgaacgaaacgaacgaaaacgatcgcgaaacccaaccgaaaaaaaaaaaaaccgcaaaaccgtatccgaaaaaaaccgcaacgccactctctacgaaacgccgttcccgcgccaccgaaaacaactaactcctaacaaaaaaccgaaatcgcgaccgccgaaaacgcaacgcgattaaaacgaccccgccacgacccaaacactcccg

SEQ ID NO: 33503 - DNA, 865 bp, Artificial Sequence
  chemically treated genomic DNA (Homo sapiens) CpG-island No: 33503
gagttggtcgagttgagcgtcgagttggataaggatttgcgggtaattgagattcgattgtcgttttttaaggtattagtttttagggtttattcgcggggtacgtcggcgatcgtagggtcggggcgagtcgggagtttcggcggttgggttgggcggaggacgggtagtcgaggttcggtttttagcggcgcgtatcggtttcgggtttttttgggcgttggcgggttcgtttttttataaataaaatatagggcgtcgattttcgtaagtgatttcgaggagtttttttaagcggattttacgttagttcgacgatcgggcgttcgtttcgttcggttttcgggttttagtttcggggattttcgtttttttttttagttttcgtttcgttttcgggatcggtcgcgcgggcgtttttaggatttcgcgtttcgttcgttttttttttttttcgagtcgcgaattttttcggaggcggcggtttcggttgtcgttgggtttcggggtcgcgggttttgattgcgtcgttttttcgcgtagagttcgtcggcgtttcgacgggtttcggagtagcggttttcggtcgggtgagtgggagacgcgggaggaggaagggggttgttttaggtcgggcgggagggaacgtggcgcggtcgggcggggcggacgggggcgatcgcggggtttagtcgggggaggaaggaatcgtagagtcgtgttcgggagggatcgtagcgttattttttgcggggcgtcgttttcgcgttatcgagggtagttaatttttagtagaggatcggggtcgcggtcgtcgggggcgtagcgcggttagggcggtttcgttacggtttaggtattttcg

SEQ ID NO: 33504 - DNA, 865 bp, Artificial Sequence
  chemically treated genomic DNA (Homo sapiens) CpG-island No: 33504
cgaaaatacctaaaccgtaacgaaaccgccctaaccgcgctacgcccccgacgaccgcgaccccgatcctctactaaaaattaactaccctcgataacgcgaaaacgacgccccgcaaaaaataacgctacgatccctcccgaacacgactctacgattccttcctcccccgactaaaccccgcgatcgcccccgtccgccccgcccgaccgcgccacgttccctcccgcccgacctaaaacaacccccttcctcctcccgcgtctcccactcacccgaccgaaaaccgctactccgaaacccgtcgaaacgccgacgaactctacgcgaaaaaacgacgcaatcaaaacccgcgaccccgaaacccaacgacaaccgaaaccgccgcctccgaaaaaattcgcgactcgaaaaaaaaaaaaaacgaacgaaacgcgaaatcctaaaaacgcccgcgcgaccgatcccgaaaacgaaacgaaaactaaaaaaaaaaacgaaaatccccgaaactaaaacccgaaaaccgaacgaaacgaacgcccgatcgtcgaactaacgtaaaatccgcttaaaaaaactcctcgaaatcacttacgaaaatcgacgccctatattttatttataaaaaaacgaacccgccaacgcccaaaaaaacccgaaaccgatacgcgccgctaaaaaccgaacctcgactacccgtcctccgcccaacccaaccgccgaaactcccgactcgccccgaccctacgatcgccgacgtaccccgcgaataaaccctaaaaactaataccttaaaaaacgacaatcgaatctcaattacccgcaaatccttatccaactcgacgctcaactcgaccaactc

SEQ ID NO: 33505 - DNA, 828 bp, Artificial Sequence
  chemically treated genomic DNA (Homo sapiens) CpG-island No: 33505
ttagcgttttagtcgcggttcgcgttttttcgtttcgttttttttttttttttttttttttttttttttttttaggtattttcgttttttttttttagcggttgtagtttttagttttaatttttcgcgtttatttttgggacgcgcgttttcgttttattttttgttttttttttttttttttttttttttttttttttggttttcgttttttttttttaggtcgttttttcggggttcgattgtttcggtgtttcgttttcggttcgcgttttgtttcgttttttttttgtattttttgagtcgttcgtcgtcgtcgtcgtagattcgtcgcgggagttttagtttaattcgagttcgatagttattgtttcggttttagttttagttttatagttcgcggcgttcgttcgagggagtttcggcgttcggggaaggttttagtgggttagcgcgttttcgtttagtttcgcgttttagttttgttcggttcggcgaggaaggatcgggaagatgaataacggcggtaaagtcgagaaggagaatatttcgagcgaggttaatttttaggaggaggaggtattgggcggttcggtgtggtggcgggggcgacgcgggatttagtgcgggcggtcggcggggcgcgggttcggggcgcggcggtggaagaaggtttaggtatggttcgtgtttcggacgtagttttatagtgtggttcggggagggtggatttcgggagcgtgtgtttttgtgtttacgcgcgtttgcgggttttaaattgcgtaattttaaggatttttcggagatttttgtaagtataatgtttag

SEQ ID NO: 33506 - DNA, 828 bp, Artificial Sequence
  chemically treated genomic DNA (Homo sapiens) CpG-island No: 33506
ctaaacattatacttacaaaaatctccgaaaaatccttaaaattacgcaatttaaaacccgcaaacgcgcgtaaacacaaaaacacacgctcccgaaatccaccctccccgaaccacactataaaactacgtccgaaacacgaaccatacctaaaccttcttccaccgccgcgccccgaacccgcgccccgccgaccgcccgcactaaatcccgcgtcgcccccgccaccacaccgaaccgcccaatacctcctcctcctaaaaattaacctcgctcgaaatattctccttctcgactttaccgccgttattcatcttcccgatccttcctcgccgaaccgaacaaaactaaaacgcgaaactaaacgaaaacgcgctaacccactaaaaccttccccgaacgccgaaactccctcgaacgaacgccgcgaactataaaactaaaactaaaaccgaaacaataactatcgaactcgaattaaactaaaactcccgcgacgaatctacgacgacgacgacgaacgactcaaaaaatacaaaaaaaaaacgaaacaaaacgcgaaccgaaaacgaaacaccgaaacaatcgaaccccgaaaaaacgacctaaaaaaaaaaaacgaaaaccaaaaaaaaaaaaaaaaaaaaaaaaaaaaaaaaaacaaaaaataaaacgaaaacgcgcgtcccaaaaataaacgcgaaaaattaaaactaaaaactacaaccgctaaaaaaaaaaaacgaaaatacctaaaaaaaaaaaaaaaaaaaaaaaaaaaaaaaaaaaacgaaacgaaaaaacgcgaaccgcgactaaaacgctaa

SEQ ID NO: 33507 - DNA, 828 bp, Artificial Sequence
  chemically treated genomic DNA (Homo sapiens) CpG-island No: 33507
ttgagtattatatttataaaagttttcgaaaagtttttggagttacgtaatttggggttcgtagacgcgcgtggatataaaaatatacgttttcgagatttatttttttcgggttatattgtggggttgcgttcggggtacgggttatgtttgaatttttttttatcgtcgcgtttcgggttcgcgtttcgtcggtcgttcgtattgggtttcgcgtcgttttcgttattatatcgagtcgtttagtattttttttttttgaaggttggtttcgttcggggtgttttttttttcggttttgtcgtcgttgtttattttttcggttttttttcgtcgggtcgggtagggttggggcgcggggttgggcgagggcgcgttagtttattggagtttttttcgggcgtcggggttttttcgggcgggcgtcgcgggttgtggggttggagttggagtcggggtagtggttgtcgggttcgggttgggttggggttttcgcggcgagtttgcgacggcggcggcgggcgatttaggaagtgtaagggagagacggggtagggcgcgggtcgggagcggggtatcgagataatcgggtttcgggagggcgatttggagagggagggcgggagttaggggaggaaggaagaaggaaggaaggaaggaagtaaaggatggggcgaggacgcgcgttttaggagtaagcgcggagagttggggttgggggttgtagtcgttggaaggaggggacgggggtgtttagagaggaggaggaggaggaagaggaggaggaggagcggggcggaggagcgcgggtcgcggttgggacgttgg

SEQ ID NO: 33508 - DNA, 828 bp, Artificial Sequence
  chemically treated genomic DNA (Homo sapiens) CpG-island No: 33508
ccaacgtcccaaccgcgacccgcgctcctccgccccgctcctcctcctcctcttcctcctcctcctcctctctaaacacccccgtcccctccttccaacgactacaacccccaaccccaactctccgcgcttactcctaaaacgcgcgtcctcgccccatcctttacttccttccttccttccttcttccttcctcccctaactcccgccctccctctccaaatcgccctcccgaaacccgattatctcgataccccgctcccgacccgcgccctaccccgtctctcccttacacttcctaaatcgcccgccgccgccgtcgcaaactcgccgcgaaaaccccaacccaacccgaacccgacaaccactaccccgactccaactccaaccccacaacccgcgacgcccgcccgaaaaaaccccgacgcccgaaaaaaactccaataaactaacgcgccctcgcccaaccccgcgccccaaccctacccgacccgacgaaaaaaaaccgaaaaaataaacaacgacgacaaaaccgaaaaaaaaaacaccccgaacgaaaccaaccttcaaaaaaaaaaaatactaaacgactcgatataataacgaaaacgacgcgaaacccaatacgaacgaccgacgaaacgcgaacccgaaacgcgacgataaaaaaaaattcaaacataacccgtaccccgaacgcaaccccacaatataacccgaaaaaaataaatctcgaaaacgtatatttttatatccacgcgcgtctacgaaccccaaattacgtaactccaaaaacttttcgaaaacttttataaatataatactcaa

SEQ ID NO: 33509 - DNA, 742 bp, Artificial Sequence
  chemically treated genomic DNA (Homo sapiens) CpG-island No: 33509
cggcgtcggatttattataaattttagtaggtatcgcgcgttcgtaatatgttagtttacgtttagtcgtcgttgggttttttggggtttgtagtttttacgtttttcgttttcggtaagtatttgaaagcgataaaggaaggtttcgggttagaggaagaggtaggtcgggttgatgaggtcgagtttgtcgattaagggtacggcgacggtggcggcgaattaatagcgcgtgatcgtcgggatgtttttgaattagttttcgatgttcgatattttcgatttataggtagttaagatgtataagatcgttcgatttttcgtgtcgatttttttacgacgcggtcggtttcgcgattgttaggtgtttaggtggaagtcgtcgaagtcgcgatgtagaaggcggagacgggcggacgtggcgttatcgaattcggattagcgaggtagttttttgaggcgaaattttttttttcggcgatcgcggacgacgtgattagaagtttcgtcgtttaaagggtaagcgtcgattttatcgttcggtcgaggttcggcgttttggggggcggagttaggtagagcgattatacgattggtgggaaaatagtggttgtttggattaacggtaaacgtttcggttagtggcgaggttaaatgttatttatttagtttttagagttttaatgcggttgggtttatttggagggtatttaaaggggacgaaggtaaacgaagtgtttag

SEQ ID NO: 33510 - DNA, 742 bp, Artificial Sequence
  chemically treated genomic DNA (Homo sapiens) CpG-island No: 33510
ctaaacacttcgtttaccttcgtcccctttaaataccctccaaataaacccaaccgcattaaaactctaaaaactaaataaataacatttaacctcgccactaaccgaaacgtttaccgttaatccaaacaaccactattttcccaccaatcgtataatcgctctacctaactccgccccccaaaacgccgaacctcgaccgaacgataaaatcgacgcttaccctttaaacgacgaaacttctaatcacgtcgtccgcgatcgccgaaaaaaaaaatttcgcctcaaaaaactacctcgctaatccgaattcgataacgccacgtccgcccgtctccgccttctacatcgcgacttcgacgacttccacctaaacacctaacaatcgcgaaaccgaccgcgtcgtaaaaaaatcgacacgaaaaatcgaacgatcttatacatcttaactacctataaatcgaaaatatcgaacatcgaaaactaattcaaaaacatcccgacgatcacgcgctattaattcgccgccaccgtcgccgtacccttaatcgacaaactcgacctcatcaacccgacctacctcttcctctaacccgaaaccttcctttatcgctttcaaatacttaccgaaaacgaaaaacgtaaaaactacaaaccccaaaaaacccaacgacgactaaacgtaaactaacatattacgaacgcgcgatacctactaaaatttataataaatccgacgccg

SEQ ID NO: 33511 - DNA, 742 bp, Artificial Sequence
  chemically treated genomic DNA (Homo sapiens) CpG-island No: 33511
ttagatatttcgtttgttttcgttttttttaaatattttttaggtggatttagtcgtattaaaattttgagaattaggtgaatggtatttggtttcgttattggtcggagcgtttgtcgttgatttaggtaattattgtttttttattagtcgtgtagtcgttttatttggtttcgttttttaggacgtcgagtttcggtcgggcggtaaaatcggcgtttattttttaagcggcgggatttttggttacgtcgttcgcggtcgtcggaaggggaagtttcgttttagaaggttgtttcgttggttcgaattcggtggcgttacgttcgttcgttttcgttttttgtatcgcggtttcggcggtttttatttagatatttaatagtcgcggagtcggtcgcgtcgtgagggggtcggtacggggagtcgggcggttttgtgtattttggttatttgtgggtcgaagatgtcggatatcggagattggtttaggagtatttcggcgattacgcgttattggttcgtcgttatcgtcgtcgtgtttttggtcggtaaattcggttttattagttcggtttatttttttttttggttcgaagtttttttttatcgtttttaggtatttatcggagacggggggcgtggagattataggttttaggaggtttagcggcggttaagcgtaggttggtatgttgcgggcgcgcggtgtttgttgggatttgtagtgggttcggcgtcg

SEQ ID NO: 33512 - DNA, 742 bp, Artificial Sequence
  chemically treated genomic DNA (Homo sapiens) CpG-island No: 33512
cgacgccgaacccactacaaatcccaacaaacaccgcgcgcccgcaacataccaacctacgcttaaccgccgctaaacctcctaaaacctataatctccacgccccccgtctccgataaatacctaaaaacgataaaaaaaaacttcgaaccaaaaaaaaaaataaaccgaactaataaaaccgaatttaccgaccaaaaacacgacgacgataacgacgaaccaataacgcgtaatcgccgaaatactcctaaaccaatctccgatatccgacatcttcgacccacaaataaccaaaatacacaaaaccgcccgactccccgtaccgaccccctcacgacgcgaccgactccgcgactattaaatatctaaataaaaaccgccgaaaccgcgatacaaaaaacgaaaacgaacgaacgtaacgccaccgaattcgaaccaacgaaacaaccttctaaaacgaaacttccccttccgacgaccgcgaacgacgtaaccaaaaatcccgccgcttaaaaaataaacgccgattttaccgcccgaccgaaactcgacgtcctaaaaaacgaaaccaaataaaacgactacacgactaataaaaaaacaataattacctaaatcaacgacaaacgctccgaccaataacgaaaccaaataccattcacctaattctcaaaattttaatacgactaaatccacctaaaaaatatttaaaaaaaacgaaaacaaacgaaatatctaa

SEQ ID NO: 33513 - DNA, 577 bp, Artificial Sequence
  chemically treated genomic DNA (Homo sapiens) CpG-island No: 33513
acggtgatgttggatcgaaaagataagcgtagttaggtaggttatcgcggttagttttaagttgattcggtattttcgcggtcggatcgtcggttttagagggagatatagagcggacgagttatcgagataacgcggaaaaaatcgtttcgtacgtcggaggataacgagagttgtcgggttgacgttatttttatttattgggtcgcgacgtttttatcggttgggcgaatttgtagtcgggcgtgtaggtattgttgtaggagcgttcgggtttgaggaattcggttatttttagttatggtttaagttagcgtcgcggtcggatagttattaggttatgtgtcgttggtttttttttcgacgcgttggcggggtagacgaggcggggtacgacgaagggtttgcgtcgattgtttagtggtttcgtttttaggagggcggggtttcggattgattttcgaatgtttcggatgtgcggttttggaggtcggcgtagcgttaagtttttcggtagtatttgtttaattttgtagaaggcgtttagtgtatatttttattaaacgattgaaaagat

SEQ ID NO: 33514 - DNA, 577 bp, Artificial Sequence
  chemically treated genomic DNA (Homo sapiens) CpG-island No: 33514
atcttttcaatcgtttaataaaaatatacactaaacgccttctacaaaattaaacaaatactaccgaaaaacttaacgctacgccgacctccaaaaccgcacatccgaaacattcgaaaatcaatccgaaaccccgccctcctaaaaacgaaaccactaaacaatcgacgcaaacccttcgtcgtaccccgcctcgtctaccccgccaacgcgtcgaaaaaaaaaccaacgacacataacctaataactatccgaccgcgacgctaacttaaaccataactaaaaataaccgaattcctcaaacccgaacgctcctacaacaatacctacacgcccgactacaaattcgcccaaccgataaaaacgtcgcgacccaataaataaaaataacgtcaacccgacaactctcgttatcctccgacgtacgaaacgattttttccgcgttatctcgataactcgtccgctctatatctccctctaaaaccgacgatccgaccgcgaaaataccgaatcaacttaaaactaaccgcgataacctacctaactacgcttatcttttcgatccaacatcaccgt

SEQ ID NO: 33515 - DNA, 577 bp, Artificial Sequence
  chemically treated genomic DNA (Homo sapiens) CpG-island No: 33515
gtttttttaatcgtttaataaaagtatatattgagcgttttttatagagttgggtaggtgttgtcgagaagtttagcgttacgtcggtttttaagatcgtatattcgggatattcgagagttagttcgaggtttcgtttttttaagggcggggttattgggtaatcggcgtaggtttttcgtcgtgtttcgtttcgtttgtttcgttagcgcgtcgagggaggggttagcgatatatggtttagtaattgttcggtcgcggcgttggtttaagttatggttgagggtagtcggattttttaggttcgggcgtttttatagtagtgtttgtacgttcggttgtaaattcgtttagtcgatggggacgtcgcggtttagtgggtggaggtaacgttagttcggtagttttcgttatttttcggcgtgcggggcggtttttttcgcgttgtttcggtgattcgttcgttttgtgtttttttttgagatcggcggttcggtcgcggggatatcgggttagtttgaagttggtcgcggtggtttgtttggttgcgtttgttttttcggtttagtattatcgt

SEQ ID NO: 33516 - DNA, 577 bp, Artificial Sequence
  chemically treated genomic DNA (Homo sapiens) CpG-island No: 33516
acgataatactaaaccgaaaaaacaaacgcaaccaaacaaaccaccgcgaccaacttcaaactaacccgatatccccgcgaccgaaccgccgatctcaaaaaaaaacacaaaacgaacgaatcaccgaaacaacgcgaaaaaaaccgccccgcacgccgaaaaataacgaaaactaccgaactaacgttacctccacccactaaaccgcgacgtccccatcgactaaacgaatttacaaccgaacgtacaaacactactataaaaacgcccgaacctaaaaaatccgactaccctcaaccataacttaaaccaacgccgcgaccgaacaattactaaaccatatatcgctaacccctccctcgacgcgctaacgaaacaaacgaaacgaaacacgacgaaaaacctacgccgattacccaataaccccgcccttaaaaaaacgaaacctcgaactaactctcgaatatcccgaatatacgatcttaaaaaccgacgtaacgctaaacttctcgacaacacctacccaactctataaaaaacgctcaatatatacttttattaaacgattaaaaaaac

SEQ ID NO: 33517 - DNA, 856 bp, Artificial Sequence
  chemically treated genomic DNA (Homo sapiens) CpG-island No: 33517
tcgtttttttagtttcgtatgttttatcgtatttatttatttacgcgtttagttatttaagttggcgcgggtttatttattttttgtttttttgttatttttcgtttgtatttcgcgtacgtcgtattttcgcgtttttgttcggttttgcgtttattatttgcgtttcggtcgggcgttgtcgggaggacgcgcgggtttagtcgcggttgcgcggggtcggggttggcggggagtcgggttgggggcggggggcgggcgttttttgcgggaagtcgggcggggtgggggagtttcggtcgcgtcgttttcggtcgtttcgcgtttcggaggggagggggcggcggtagcggcggcggcggtgagcggcgcggttgttttggggttatgtggattggcggtcgtcggtcgggtcggttgcgtcgggcggtgagtatttgcgagtcgggagggtagggcgcgggcgcgggcgcggaggcggggcgggcgttatttacgtttggggcggtttttgtttagcgcgggaggtggtcggtttttcgtttcgttttttttcgcgttgcgttttcgtcgtggaggttttattggttcgggaggagtcgggtcgggttttttgggaattgggtattttcgggtggggcggggatgtttagttttcgcgcgtcgtcgggagcgttcgggttttatcgcggggtttttgcgttttgatacgcgcgtttttgcggcggaaggaaaggagggacgggtgattaagggcgcggtcggaggattggggattcgtcgttgtttcgggcgggtggcgagggtgcgggtaggtttggattcgtttgcgtttgggggtagggttagtttttgt

SEQ ID NO: 33518 - DNA, 856 bp, Artificial Sequence
  chemically treated genomic DNA (Homo sapiens) CpG-island No: 33518
acaaaaactaaccctacccccaaacgcaaacgaatccaaacctacccgcaccctcgccacccgcccgaaacaacgacgaatccccaatcctccgaccgcgcccttaatcacccgtccctcctttccttccgccgcaaaaacgcgcgtatcaaaacgcaaaaaccccgcgataaaacccgaacgctcccgacgacgcgcgaaaactaaacatccccgccccacccgaaaatacccaattcccaaaaaacccgacccgactcctcccgaaccaataaaacctccacgacgaaaacgcaacgcgaaaaaaaacgaaacgaaaaaccgaccacctcccgcgctaaacaaaaaccgccccaaacgtaaataacgcccgccccgcctccgcgcccgcgcccgcgccctaccctcccgactcgcaaatactcaccgcccgacgcaaccgacccgaccgacgaccgccaatccacataaccccaaaacaaccgcgccgctcaccgccgccgccgctaccgccgccccctcccctccgaaacgcgaaacgaccgaaaacgacgcgaccgaaactcccccaccccgcccgacttcccgcaaaaaacgcccgccccccgcccccaacccgactccccgccaaccccgaccccgcgcaaccgcgactaaacccgcgcgtcctcccgacaacgcccgaccgaaacgcaaataataaacgcaaaaccgaacaaaaacgcgaaaatacgacgtacgcgaaatacaaacgaaaaataacaaaaaaacaaaaaataaataaacccgcgccaacttaaataactaaacgcgtaaataaataaatacgataaaacatacgaaactaaaaaaacga

SEQ ID NO: 33519 - DNA, 856 bp, Artificial Sequence
  chemically treated genomic DNA (Homo sapiens) CpG-island No: 33519
gtaggggttggttttgtttttagacgtaggcgggtttaggtttgttcgtattttcgttattcgttcgggatagcggcgggtttttagtttttcggtcgcgtttttggttattcgtttttttttttttttcgtcgtaggggcgcgcgtgttagggcgtaaggatttcgcgataggattcgggcgttttcggcggcgcgcggaggttgggtattttcgttttattcgagagtgtttagtttttaggagattcggttcggtttttttcgggttagtgaagtttttacggcgggggcgtagcgcggaggggagcggggcggggggtcggttatttttcgcgttgagtagggatcgttttaggcgtgggtggcgttcgtttcgttttcgcgttcgcgttcgcgttttgttttttcggttcgtaggtatttatcgttcggcgtagtcggttcggtcggcgatcgttagtttatatggttttagggtagtcgcgtcgtttatcgtcgtcgtcgttatcgtcgttttttttttttcgaggcgcgaagcggtcgggagcggcgcggtcggggtttttttatttcgttcggtttttcgtagggagcgttcgtttttcgtttttagttcggtttttcgttagtttcggtttcgcgtagtcgcggttgagttcgcgcgttttttcggtagcgttcggtcggggcgtaagtggtgggcgtagggtcgggtaggggcgcgggggtgcggcgtgcgcggggtataggcgaggaatggtagaggggtagggaatgaatgaattcgcgttagtttgaatggttgagcgcgtgaatgaatgagtgcggtagagtatgcggggttgggggggcgg

SEQ ID NO: 33520 - DNA, 856 bp, Artificial Sequence
  chemically treated genomic DNA (Homo sapiens) CpG-island No: 33520
ccgcccccccaaccccgcatactctaccgcactcattcattcacgcgctcaaccattcaaactaacgcgaattcattcattccctacccctctaccattcctcgcctataccccgcgcacgccgcacccccgcgcccctacccgaccctacgcccaccacttacgccccgaccgaacgctaccgaaaaaacgcgcgaactcaaccgcgactacgcgaaaccgaaactaacgaaaaaccgaactaaaaacgaaaaacgaacgctccctacgaaaaaccgaacgaaataaaaaaaccccgaccgcgccgctcccgaccgcttcgcgcctcgaaaaaaaaaaaacgacgataacgacgacgacgataaacgacgcgactaccctaaaaccatataaactaacgatcgccgaccgaaccgactacgccgaacgataaatacctacgaaccgaaaaaacaaaacgcgaacgcgaacgcgaaaacgaaacgaacgccacccacgcctaaaacgatccctactcaacgcgaaaaataaccgaccccccgccccgctcccctccgcgctacgcccccgccgtaaaaacttcactaacccgaaaaaaaccgaaccgaatctcctaaaaactaaacactctcgaataaaacgaaaatacccaacctccgcgcgccgccgaaaacgcccgaatcctatcgcgaaatccttacgccctaacacgcgcgcccctacgacgaaaaaaaaaaaaaaacgaataaccaaaaacgcgaccgaaaaactaaaaacccgccgctatcccgaacgaataacgaaaatacgaacaaacctaaacccgcctacgtctaaaaacaaaaccaacccctac

SEQ ID NO: 33521 - DNA, 635 bp, Artificial Sequence
  chemically treated genomic DNA (Homo sapiens) CpG-island No: 33521
cgcggcggttgtcggttggggcggggtattttacgattttttcggttagatacggtcgtttttttaggtgttttggtttgcgaggtattcgtagttcgttttttttttaggtgacgtatattggagacgtcgtcgtttagcgattcgggttcgagttttcgtttcggtcgttatggcggatgcggagtcggaggttgggggcggtagcgaggatggcggcggcggcggcggttcggttttttcgggttagagcggtagcgtcgtacgtgtggtttcgttgggtttcgagtagttgcggtaggttttggagtaggtgacgaaggcgtagtcgtcgtcgtcgtcgttttttttcgtgttgcgggacgcggcgcggcggttgcgggacgcggtttaataggtcgttttgtagcggggtcggggtatcgagttttcgcgtttgtcgcgtttgttttcgttttaggtgaggcgtcgggagggacgtggggaaattgaggttcgaagggggtcgacgtttcgcggcggggtagttgtttgttcggggaggttagtattcgttcgggttaagatttagggcgtttttaggttgagttttttagggacggcgttcggtttttatttgttattattttggtatt

SEQ ID NO: 33522 - DNA, 635 bp, Artificial Sequence
  chemically treated genomic DNA (Homo sapiens) CpG-island No: 33522
aataccaaaataataacaaataaaaaccgaacgccgtccctaaaaaactcaacctaaaaacgccctaaatcttaacccgaacgaatactaacctccccgaacaaacaactaccccgccgcgaaacgtcgacccccttcgaacctcaatttccccacgtccctcccgacgcctcacctaaaacgaaaacaaacgcgacaaacgcgaaaactcgataccccgaccccgctacaaaacgacctattaaaccgcgtcccgcaaccgccgcgccgcgtcccgcaacacgaaaaaaaacgacgacgacgacgactacgccttcgtcacctactccaaaacctaccgcaactactcgaaacccaacgaaaccacacgtacgacgctaccgctctaacccgaaaaaaccgaaccgccgccgccgccgccatcctcgctaccgcccccaacctccgactccgcatccgccataacgaccgaaacgaaaactcgaacccgaatcgctaaacgacgacgtctccaatatacgtcacctaaaaaaaaaacgaactacgaatacctcgcaaaccaaaacacctaaaaaaacgaccgtatctaaccgaaaaaatcgtaaaataccccgccccaaccgacaaccgccgcg

SEQ ID NO: 33523 - DNA, 635 bp, Artificial Sequence
  chemically treated genomic DNA (Homo sapiens) CpG-island No: 33523
aatgttagggtggtgataggtgggggtcgaacgtcgtttttaagaagtttagtttggggacgttttgagttttaattcgggcggatattggttttttcggataagtagttatttcgtcgcggggcgtcggtttttttcgggttttagtttttttacgtttttttcgacgttttatttggggcgggagtaggcgcggtaggcgcgggggttcggtgtttcggtttcgttgtagggcggtttgttgggtcgcgtttcgtagtcgtcgcgtcgcgtttcgtagtacgaaggggggcggcggcggcggcggttgcgttttcgttatttgttttaggatttgtcgtagttgttcggggtttagcggggttatacgtgcgacgttgtcgttttggttcggaggagtcgggtcgtcgtcgtcgtcgttattttcgttgtcgtttttagttttcggtttcgtattcgttatggcggtcgaggcggggattcgaattcgggtcgttgagcgacggcgtttttaatgtacgttatttaggagaggggcgggttacgagtgtttcgtaggttaagatatttaggaaggcgatcgtgtttggtcgggaaagtcgtggagtgtttcgttttagtcgataatcgtcgcg

SEQ ID NO: 33524 - DNA, 635 bp, Artificial Sequence
  chemically treated genomic DNA (Homo sapiens) CpG-island No: 33524
cgcgacgattatcgactaaaacgaaacactccacgactttcccgaccaaacacgatcgccttcctaaatatcttaacctacgaaacactcgtaacccgcccctctcctaaataacgtacattaaaaacgccgtcgctcaacgacccgaattcgaatccccgcctcgaccgccataacgaatacgaaaccgaaaactaaaaacgacaacgaaaataacgacgacgacgacgacccgactcctccgaaccaaaacgacaacgtcgcacgtataaccccgctaaaccccgaacaactacgacaaatcctaaaacaaataacgaaaacgcaaccgccgccgccgccgccccccttcgtactacgaaacgcgacgcgacgactacgaaacgcgacccaacaaaccgccctacaacgaaaccgaaacaccgaacccccgcgcctaccgcgcctactcccgccccaaataaaacgtcgaaaaaaacgtaaaaaaactaaaacccgaaaaaaaccgacgccccgcgacgaaataactacttatccgaaaaaaccaatatccgcccgaattaaaactcaaaacgtccccaaactaaacttcttaaaaacgacgttcgacccccacctatcaccaccctaacatt

SEQ ID NO: 33525 - DNA, 1113 bp, Artificial Sequence
  chemically treated genomic DNA (Homo sapiens) CpG-island No: 33525
gttttagacgtttcgtcggttattagcgtttcgggaaaggtcgttcgcgttttttcgttttttttttttagggttcgtcgtttagagttcggatgttggatttaatttttgagtcgggttttttatttttataaaagggtagcgtttcgcggggtcgagattgtcgtttcgtcgcgtttttcgttattttcgcgtcgtttcgttttacgtcgtttcgtttcgttcgggattcgtagttttttttttcgagcgcggcgtcgggagggcgggggtagaggcgaggtcggtcggattcgtttagggtagttttgcgggcggcgaaggagggagttagcgcgtttagtttagttaggttcggatagagggggcggggagagggtggagcgcggggagttaggcgaggggtcgcgacgacgggattttattagtcgtttcggttataggtagcgttcgttagtcgaggaatcggacgcggatatcgtcgtttcgcgagtttttagtttttcgtttgttgtcgcgcgagtttcgggttcggagcgttaggagcgcgcggtgagggagcgggatttcgtcgggattcgagggggcgcggcggggaggggtacggggcgttagttcgcgttgtgtttcggggtcggtcggtaggtgaagtttttcgcggttcgttaggcggggacggtgtggggcgggcggcgtcgggatcgaggaacgttgcggggcgagcggggcgtagggttttttcgtagtttcggtcgtcgtcgttttttcgagtttttgtcgaaagtttcgggttttttattattttttagttcgtggtcggcgttgcgaattcggtgggattcgtttttttttgggggagtgacgtttacgagagttatttttttcgcgttcgtaggaaggagttatggttttggacgggataaggatgttagatggttgttacgcggacgggacgtgggaattgagtgtttatgtgacggatttgaatcgcgatgttattttgagagtgatcggcgaggtgtatattggaggcgtgatgtttaagttggtggagaaattcggtgagtagtattttagtcgcgtttaattaatgattttttagaattggtaggg

SEQ ID NO: 33526 - DNA, 1113 bp, Artificial Sequence
  chemically treated genomic DNA (Homo sapiens) CpG-island No: 33526
ccctaccaattctaaaaaatcattaattaaacgcgactaaaatactactcaccgaatttctccaccaacttaaacatcacgcctccaatatacacctcgccgatcactctcaaaataacatcgcgattcaaatccgtcacataaacactcaattcccacgtcccgtccgcgtaacaaccatctaacatccttatcccgtccaaaaccataactccttcctacgaacgcgaaaaaaataactctcgtaaacgtcactcccccaaaaaaaaacgaatcccaccgaattcgcaacgccgaccacgaactaaaaaataataaaaaacccgaaactttcgacaaaaactcgaaaaaacgacgacgaccgaaactacgaaaaaaccctacgccccgctcgccccgcaacgttcctcgatcccgacgccgcccgccccacaccgtccccgcctaacgaaccgcgaaaaacttcacctaccgaccgaccccgaaacacaacgcgaactaacgccccgtacccctccccgccgcgccccctcgaatcccgacgaaatcccgctccctcaccgcgcgctcctaacgctccgaacccgaaactcgcgcgacaacaaacgaaaaactaaaaactcgcgaaacgacgatatccgcgtccgattcctcgactaacgaacgctacctataaccgaaacgactaataaaatcccgtcgtcgcgacccctcgcctaactccccgcgctccaccctctccccgccccctctatccgaacctaactaaactaaacgcgctaactccctccttcgccgcccgcaaaactaccctaaacgaatccgaccgacctcgcctctacccccgccctcccgacgccgcgctcgaaaaaaaaaactacgaatcccgaacgaaacgaaacgacgtaaaacgaaacgacgcgaaaataacgaaaaacgcgacgaaacgacaatctcgaccccgcgaaacgctacccttttataaaaataaaaaacccgactcaaaaattaaatccaacatccgaactctaaacgacgaaccctaaaaaaaaaaaacgaaaaaacgcgaacgacctttcccgaaacgctaataaccgacgaaacgtctaaaac

SEQ ID NO: 33527 - DNA, 1113 bp, Artificial Sequence
  chemically treated genomic DNA (Homo sapiens) CpG-island No: 33527
ttttattaattttgggaagttattagttggacgcggttgggatgttatttatcgagtttttttattagtttaagtattacgtttttaatgtgtatttcgtcggttatttttagggtgatatcgcggtttaggttcgttatatggatatttagtttttacgtttcgttcgcgtagtagttatttggtatttttatttcgtttagagttatggtttttttttgcgagcgcggaggaaatggttttcgtaagcgttatttttttaaagaaaggcgaattttatcgaattcgtagcgtcggttacgggttgggaggtggtggaggattcggggttttcggtagaaattcgggagggcggcggcggtcggggttgcgggaggattttacgtttcgttcgtttcgtagcgtttttcggtttcggcgtcgttcgttttatatcgttttcgtttagcggatcgcggagggttttatttgtcggtcggtttcgagatatagcgcgggttgacgtttcgtgttttttttcgtcgcgttttttcgggtttcggcggggtttcgtttttttatcgcgcgtttttagcgtttcgggttcgggattcgcgcggtaataggcgaggggttggaggttcgcggggcggcggtgttcgcgttcggtttttcggttggcgaacgttgtttgtggtcggagcggttaatggagtttcgtcgtcgcggtttttcgtttggtttttcgcgttttatttttttttcgttttttttgttcgagtttggttgggttgggcgcgttggttttttttttcgtcgttcgtagagttgttttgagcgggttcggtcggtttcgtttttgttttcgttttttcggcgtcgcgttcgggggagggggttgcgggtttcgggcggggcggggcggcgtggggcggggcggcgcgggggtggcggggggcgcggcggggcggtaatttcggtttcgcggagcgttgtttttttatggaaatgaaggattcggtttaggaattgaatttaatattcgggttttaggcggcgggttttgaggagggggagcgggggagcgcgggcggtttttttcggggcgttggtggtcggcggggcgtttagagt

SEQ ID NO: 33528 - DNA, 1113 bp, Artificial Sequence
  chemically treated genomic DNA (Homo sapiens) CpG-island No: 33528
actctaaacgccccgccgaccaccaacgccccgaaaaaaaccgcccgcgctcccccgctccccctcctcaaaacccgccgcctaaaacccgaatattaaattcaattcctaaaccgaatccttcatttccataaaaaaacaacgctccgcgaaaccgaaattaccgccccgccgcgccccccgccacccccgcgccgccccgccccacgccgccccgccccgcccgaaacccgcaaccccctcccccgaacgcgacgccgaaaaaacgaaaacaaaaacgaaaccgaccgaacccgctcaaaacaactctacgaacgacgaaaaaaaaaaccaacgcgcccaacccaaccaaactcgaacaaaaaaaacgaaaaaaaaataaaacgcgaaaaaccaaacgaaaaaccgcgacgacgaaactccattaaccgctccgaccacaaacaacgttcgccaaccgaaaaaccgaacgcgaacaccgccgccccgcgaacctccaacccctcgcctattaccgcgcgaatcccgaacccgaaacgctaaaaacgcgcgataaaaaaacgaaaccccgccgaaacccgaaaaaacgcgacgaaaaaaaacacgaaacgtcaacccgcgctatatctcgaaaccgaccgacaaataaaaccctccgcgatccgctaaacgaaaacgatataaaacgaacgacgccgaaaccgaaaaacgctacgaaacgaacgaaacgtaaaatcctcccgcaaccccgaccgccgccgccctcccgaatttctaccgaaaaccccgaatcctccaccacctcccaacccgtaaccgacgctacgaattcgataaaattcgcctttctttaaaaaaataacgcttacgaaaaccatttcctccgcgctcgcaaaaaaaaaccataactctaaacgaaataaaaataccaaataactactacgcgaacgaaacgtaaaaactaaatatccatataacgaacctaaaccgcgatatcaccctaaaaataaccgacgaaatacacattaaaaacgtaatacttaaactaataaaaaaactcgataaataacatcccaaccgcgtccaactaataacttcccaaaattaataaaa

SEQ ID NO: 33529 - DNA, 709 bp, Artificial Sequence
  chemically treated genomic DNA (Homo sapiens) CpG-island No: 33529
  misc_feature (209)..(209): n is either a, c, g or t
ttcggaattcgtttttcgttattaggcgtcggagttgtcgttttcgaggtttttaggagatgtagaagatattgttttgaatgtttatagtcggttggtaatgtcgttttagagtagagcggcgggtgtcgtttcgtttttttataggttcgtagtatttttagtcgcgcgcgaggttttttgggaagtgaagttcggagattaggggnggtcggtttttagcgcgttaagttgttaattttttaattttcgttttttttcggcgttttttttttaagttcgaagttagggtttaggattgttgcgatgtattagtttcgttttttattttttatttagaggaggcggaaatgtttaggtgaacgcgaagttttttattacgagtcggtttttagtaaggtcgtgcgtagtgtgggcgggagttttaagttagttagcggcgacgttgggagggttcggagtaggtcgggtttcgaatagcgaaagttttaatatggcggttagattggttatagagcgggaagagaaagtcggggattagtaggtcgtacggcgtagacggggttcgttttttttatttattttcggaatttaaagtcggttttcggaagtcgggacgatgttcgtatgataatcgacgttggagtttggaggtgagagtgattgacgaggagtgggttaagtgattagaagttagaatttttggtgt

SEQ ID NO: 33530 - DNA, 709 bp, Artificial Sequence
  chemically treated genomic DNA (Homo sapiens) CpG-island No: 33530
  misc_feature (501)..(501): n is either a, c, g or t
acaccaaaaattctaacttctaatcacttaacccactcctcgtcaatcactctcacctccaaactccaacgtcgattatcatacgaacatcgtcccgacttccgaaaaccgactttaaattccgaaaataaataaaaaaaacgaaccccgtctacgccgtacgacctactaatccccgactttctcttcccgctctataaccaatctaaccgccatattaaaactttcgctattcgaaacccgacctactccgaaccctcccaacgtcgccgctaactaacttaaaactcccgcccacactacgcacgaccttactaaaaaccgactcgtaataaaaaacttcgcgttcacctaaacatttccgcctcctctaaataaaaaataaaaaacgaaactaatacatcgcaacaatcctaaaccctaacttcgaacttaaaaaaaaaacgccgaaaaaaaacgaaaattaaaaaattaacaacttaacgcgctaaaaaccgaccncccctaatctccgaacttcacttcccaaaaaacctcgcgcgcgactaaaaatactacgaacctataaaaaaacgaaacgacacccgccgctctactctaaaacgacattaccaaccgactataaacattcaaaacaatatcttctacatctcctaaaaacctcgaaaacgacaactccgacgcctaataacgaaaaacgaattccgaa

SEQ ID NO: 33531 - DNA, 709 bp, Artificial Sequence
  chemically treated genomic DNA (Homo sapiens) CpG-island No: 33531
  misc_feature (501)..(501): n is either a, c, g or t
gtattaaaaattttgatttttggttatttaatttatttttcgttaattatttttatttttaaattttaacgtcggttgttatgcggatatcgtttcggttttcggaagtcggttttaaatttcggaagtaaatggaggaggcgggtttcgtttgcgtcgtgcggtttgttagttttcggtttttttttttcgttttatggttagtttggtcgttatgttggagttttcgttgttcggggttcggtttgtttcgggtttttttagcgtcgtcgttagttgatttagggttttcgtttatattgcgtacggttttgttgagggtcggttcgtagtgggaggtttcgcgtttatttgaatattttcgttttttttggatgggggatgagaggcggggttgatgtatcgtagtagttttggattttgatttcggatttggagaagaaacgtcgaggaggaacgggagttagggggttagtagtttggcgcgttgggagtcggttntttttggttttcggattttattttttaggaggtttcgcgcgcgattggaagtgttgcgagtttataagaaggcgaggcggtattcgtcgttttgttttggggcggtattgttagtcggttgtaggtatttagggtagtgttttttgtattttttaggaatttcgggagcggtagtttcggcgtttggtagcgagaggcgggtttcgga

SEQ ID NO: 33532 - DNA, 709 bp, Artificial Sequence
  chemically treated genomic DNA (Homo sapiens) CpG-island No: 33532
  misc_feature (209)..(209): n is either a, c, g or t
tccgaaacccgcctctcgctaccaaacgccgaaactaccgctcccgaaattcctaaaaaatacaaaaaacactaccctaaatacctacaaccgactaacaataccgccccaaaacaaaacgacgaataccgcctcgccttcttataaactcgcaacacttccaatcgcgcgcgaaacctcctaaaaaataaaatccgaaaaccaaaaanaaccgactcccaacgcgccaaactactaaccccctaactcccgttcctcctcgacgtttcttctccaaatccgaaatcaaaatccaaaactactacgatacatcaaccccgcctctcatcccccatccaaaaaaaacgaaaatattcaaataaacgcgaaacctcccactacgaaccgaccctcaacaaaaccgtacgcaatataaacgaaaaccctaaatcaactaacgacgacgctaaaaaaacccgaaacaaaccgaaccccgaacaacgaaaactccaacataacgaccaaactaaccataaaacgaaaaaaaaaaaccgaaaactaacaaaccgcacgacgcaaacgaaacccgcctcctccatttacttccgaaatttaaaaccgacttccgaaaaccgaaacgatatccgcataacaaccgacgttaaaatttaaaaataaaaataattaacgaaaaataaattaaataaccaaaaatcaaaatttttaatac

SEQ ID NO: 33533 - DNA, 741 bp, Artificial Sequence
  chemically treated genomic DNA (Homo sapiens) CpG-island No: 33533
  misc_feature (160)..(160): n is either a, c, g or t
  misc_feature (170)..(173): n is either a, c, g or t
gttcgtcgcgagttaggtttagtatatatagtttcgtcgggtggagtagagcgcgcgatttagttagttttattcgggatatttttcgcgtcgggaattttattgggggttgggcggtcggtttaggggcggggcgtagtagaagggttttcgacggttngttattattnnnnttatttaaaagttttcgttttcggtcgatttttttcgtttgtttaagcgtggtttcgtttagtatgcgggtgttaattggttgtcggaggtgttttttataatttttcggttgtcgtagcgcgcggagagcgtgataggattttacggagtttgcgcggaagggcgggattaattgtggcgagggttgaggtgggaggtcgggggcgttttcgcgggttaagcgtgcgagagagcgaggtgtattagcgggtatggatggtttgtgtagagtttagttttgtgagggcggcgaattaggtagcgaatcgcgggagttttttattggtagtagttcgagttttagacgttaatttgtaataaaagtagcgatggttaagtttataaagggggtatttcggaaagtcgttcgtatgtacggaagagatgaaagtttcgtgcgcgttagaaaacggtttcgtaatttatttcgggaagtaaatgcgttgttttttaaaatataaagttggcgaattgtgtttgatttcgttggggttttggaatgtttcgtttttataggaaaaaaattta

SEQ ID NO: 33534 - DNA, 741 bp, Artificial Sequence
  chemically treated genomic DNA (Homo sapiens) CpG-island No: 33534
  misc_feature (569)..(572): n is either a, c, g or t
  misc_feature (582)..(582): n is either a, c, g or t
taaatttttttcctataaaaacgaaacattccaaaaccccaacgaaatcaaacacaattcgccaactttatattttaaaaaacaacgcatttacttcccgaaataaattacgaaaccgttttctaacgcgcacgaaactttcatctcttccgtacatacgaacgactttccgaaataccccctttataaacttaaccatcgctacttttattacaaattaacgtctaaaactcgaactactaccaataaaaaactcccgcgattcgctacctaattcgccgccctcacaaaactaaactctacacaaaccatccatacccgctaatacacctcgctctctcgcacgcttaacccgcgaaaacgcccccgacctcccacctcaaccctcgccacaattaatcccgcccttccgcgcaaactccgtaaaatcctatcacgctctccgcgcgctacgacaaccgaaaaattataaaaaacacctccgacaaccaattaacacccgcatactaaacgaaaccacgcttaaacaaacgaaaaaaatcgaccgaaaacgaaaacttttaaataannnnaataataacnaaccgtcgaaaacccttctactacgccccgcccctaaaccgaccgcccaacccccaataaaattcccgacgcgaaaaatatcccgaataaaactaactaaatcgcgcgctctactccacccgacgaaactatatatactaaacctaactcgcgacgaac

SEQ ID NO: 33535 - DNA, 741 bp, Artificial Sequence
  chemically treated genomic DNA (Homo sapiens) CpG-island No: 33535
  misc_feature (569)..(572): n is either a, c, g or t
  misc_feature (582)..(582): n is either a, c, g or t
tggattttttttttgtgaggacgaggtattttaaaattttagcggggttaggtatagttcgttaattttatgttttggggggtagcgtatttgtttttcgaagtgagttgcgaaatcgttttttagcgcgtacggggtttttatttttttcgtgtatgcgaacggtttttcgagatgttttttttatgggtttggttatcgttatttttgttataaattaacgtttgggattcggattgttgttaataggaaattttcgcgattcgttgtttagttcgtcgtttttataagattggattttgtataggttatttatgttcgttggtgtatttcgttttttcgtacgtttaattcgcggggacgttttcgattttttattttagttttcgttatagttagtttcgttttttcgcgtagatttcgtggagttttgttacgtttttcgcgcgttgcggtagtcgggagattgtgaagggtattttcggtagttaattaatattcgtatattgggcgggattacgtttgggtaggcggagggggtcgatcgaaggcggggatttttgagtgannnngatgatggtnaatcgtcggaggtttttttattgcgtttcgtttttgagtcggtcgtttagtttttagtggggttttcggcgcggggaatgtttcgggtggagttggttgagtcgcgcgttttgttttattcgacggggttgtgtgtgttgggtttggttcgcggcgaat

SEQ ID NO: 33536 - DNA, 741 bp, Artificial Sequence
  chemically treated genomic DNA (Homo sapiens) CpG-island No: 33536
  misc_feature (160)..(160): n is either a, c, g or t
  misc_feature (170)..(173): n is either a, c, g or t
attcgccgcgaaccaaacccaacacacacaaccccgtcgaataaaacaaaacgcgcgactcaaccaactccacccgaaacattccccgcgccgaaaaccccactaaaaactaaacgaccgactcaaaaacgaaacgcaataaaaaaacctccgacgattnaccatcatcnnnntcactcaaaaatccccgccttcgatcgaccccctccgcctacccaaacgtaatcccgcccaatatacgaatattaattaactaccgaaaatacccttcacaatctcccgactaccgcaacgcgcgaaaaacgtaacaaaactccacgaaatctacgcgaaaaaacgaaactaactataacgaaaactaaaataaaaaatcgaaaacgtccccgcgaattaaacgtacgaaaaaacgaaatacaccaacgaacataaataacctatacaaaatccaatcttataaaaacgacgaactaaacaacgaatcgcgaaaatttcctattaacaacaatccgaatcccaaacgttaatttataacaaaaataacgataaccaaacccataaaaaaaacatctcgaaaaaccgttcgcatacacgaaaaaaataaaaaccccgtacgcgctaaaaaacgatttcgcaactcacttcgaaaaacaaatacgctaccccccaaaacataaaattaacgaactatacctaaccccgctaaaattttaaaatacctcgtcctcacaaaaaaaaaatcca

SEQ ID NO: 33537 - DNA, 802 bp, Artificial Sequence
  chemically treated genomic DNA (Homo sapiens) CpG-island No: 33537
gtcgcgcgttttcggttttttcgggtagcgtcggggttttgttaggcgcgcgttgttgtttgtttggattgcgtttattttgattttgaagttagcggttttattgatacgttttgaaaagtgggagttatacgcgggattcggagatcgcgttaaagttttacgtacgacggcgttcggcggatgatttacgttcgtacgtcggcgtatgcgcggttaagtcggtgttcgcgtttattagcgttatgcgttcgtttttttttttttttcgtgttttgtttcgatggttcggttcgcgtcggggggggtttagggcgttcgcgggaaatttggcgggaatcgcgttcgttttttttttttttttttttttttttgttttcgtcgcgtatttcgtcgttatggagtagcgtcgcgttatcgattttttcgcgcgtcgtcgtttcgggttttttcgtatcgcggcgtttaagttggtttgtcgtatttttagtttcgttaggttcgtatttcgcgtttcggttttcgttattagtggtagtcgtaagcgcgttcgttcgttcgtcgttttcggacgcgattaggttagtatatcggttcgtaggagattgcggttgttagtggacgaggtgaggggcgtggggagattgaggtcggggagttgggggcggggagattgaggttcgggggtagggttcggggaaattgaggcggagggacgggggcggggaaataggcgggggggacggggcgtagggaattttgggataggtcgggggattttgggggcgttttgttattattg

SEQ ID NO: 33538 - DNA, 802 bp, Artificial Sequence
  chemically treated genomic DNA (Homo sapiens) CpG-island No: 33538
caataataacaaaacgcccccaaaatcccccgacctatcccaaaattccctacgccccgtcccccccgcctatttccccgcccccgtccctccgcctcaatttccccgaaccctacccccgaacctcaatctccccgcccccaactccccgacctcaatctccccacgcccctcacctcgtccactaacaaccgcaatctcctacgaaccgatatactaacctaatcgcgtccgaaaacgacgaacgaacgaacgcgcttacgactaccactaataacgaaaaccgaaacgcgaaatacgaacctaacgaaactaaaaatacgacaaaccaacttaaacgccgcgatacgaaaaaacccgaaacgacgacgcgcgaaaaaatcgataacgcgacgctactccataacgacgaaatacgcgacgaaaacaaaaaaaaaaaaaaaaaaaaaaaaaacgaacgcgattcccgccaaatttcccgcgaacgccctaaaccccccccgacgcgaaccgaaccatcgaaacaaaacacgaaaaaaaaaaaaaaacgaacgcataacgctaataaacgcgaacaccgacttaaccgcgcatacgccgacgtacgaacgtaaatcatccgccgaacgccgtcgtacgtaaaactttaacgcgatctccgaatcccgcgtataactcccacttttcaaaacgtatcaataaaaccgctaacttcaaaatcaaaataaacgcaatccaaacaaacaacaacgcgcgcctaacaaaaccccgacgctacccgaaaaaaccgaaaacgcgcgac

SEQ ID NO: 33539 - DNA, 802 bp, Artificial Sequence
  chemically treated genomic DNA (Homo sapiens) CpG-island No: 33539
tagtggtggtagggcgtttttaggatttttcggtttgttttagagttttttgcgtttcgtttttttcgtttgttttttcgttttcgttttttcgttttagttttttcgagttttgttttcgggttttagttttttcgtttttaatttttcggttttagtttttttacgttttttatttcgtttattgatagtcgtagttttttgcgggtcggtatgttggtttggtcgcgttcgggggcggcgggcgggcgggcgcgtttgcggttgttattggtagcggaggtcggggcgcggagtgcgggtttggcggggttgggggtgcggtaggttagtttgggcgtcgcgatgcgggggggttcggggcggcggcgcgcgaagaagtcggtgacgcggcgttgttttatggcggcggagtgcgcggcgaaagtaaggaaagaaggaagggaggaagaggcgggcgcggttttcgttaaatttttcgcgggcgttttggatttttttcggcgcggatcgaattatcggggtagagtacggggggagggaagggacgggcgtatggcgttggtgggcgcgggtatcggtttggtcgcgtatgcgtcgacgtgcgggcgtggattattcgtcgggcgtcgtcgtgcgtgggattttagcgcggttttcggatttcgcgtgtggtttttattttttagggcgtgttagtggggtcgttggttttagggttagaatgagcgtaatttaggtaaatagtagcgcgcgtttgataaaatttcggcgttgttcgggggagtcgaggacgcgcggt

SEQ ID NO: 33540 - DNA, 802 bp, Artificial Sequence
  chemically treated genomic DNA (Homo sapiens) CpG-island No: 33540
accgcgcgtcctcgactcccccgaacaacgccgaaattttatcaaacgcgcgctactatttacctaaattacgctcattctaaccctaaaaccaacgaccccactaacacgccctaaaaaataaaaaccacacgcgaaatccgaaaaccgcgctaaaatcccacgcacgacgacgcccgacgaataatccacgcccgcacgtcgacgcatacgcgaccaaaccgatacccgcgcccaccaacgccatacgcccgtcccttccctccccccgtactctaccccgataattcgatccgcgccgaaaaaaatccaaaacgcccgcgaaaaatttaacgaaaaccgcgcccgcctcttcctcccttccttctttccttactttcgccgcgcactccgccgccataaaacaacgccgcgtcaccgacttcttcgcgcgccgccgccccgaacccccccgcatcgcgacgcccaaactaacctaccgcacccccaaccccgccaaacccgcactccgcgccccgacctccgctaccaataacaaccgcaaacgcgcccgcccgcccgccgcccccgaacgcgaccaaaccaacataccgacccgcaaaaaactacgactatcaataaacgaaataaaaaacgtaaaaaaactaaaaccgaaaaattaaaaacgaaaaaactaaaacccgaaaacaaaactcgaaaaaactaaaacgaaaaaacgaaaacgaaaaaacaaacgaaaaaaacgaaacgcaaaaaactctaaaacaaaccgaaaaatcctaaaaacgccctaccaccacta

SEQ ID NO: 33541 - DNA, 646 bp, Artificial Sequence
  chemically treated genomic DNA (Homo sapiens) CpG-island No: 33541
tggtagtgcgggtggcgatggtagtgcgggtggcgatggtagtgcgggtggggatggtagtgcgggtggcgatggtagtgcgggtggggatggtattgtgggtggcgatggtagttagggtggcgatggtagtgcgggtggggatggtagtgtgggtggcgatggtagttagggtggcgatggtagtgcgggtggcgatggtagtgcgggtggcgatggtagtgcgggtggggatggtagttagagtggcgatggtagtgcgggtggcgatggtagtgtgggtggcgatggtagtgcgggtggggatggtagtgtgggtggcgatggtagtgcgggtggcgatggtagttagggtggcgatggtagtgcgggtggggatggtagttagagtggcgatggtagtgcgggtggcgatggtagtgcgggtggcgatggtagtgcgggtggcgatggtagtgtgggtggggatggtagtgcgggtggggatggtagtgcgggtggcgatggtagttagggtggcgatggtagttagggtggcgatggtagtgcgggtggggatggtagtgcgggtggcgatggtagttagggtggcgatggttgttgaggtattttgcggtttgtttggaagttgttgtagtgaggcggt

SEQ ID NO: 33542 - DNA, 646 bp, Artificial Sequence
  chemically treated genomic DNA (Homo sapiens) CpG-island No: 33542
accgcctcactacaacaacttccaaacaaaccgcaaaatacctcaacaaccatcgccaccctaactaccatcgccacccgcactaccatccccacccgcactaccatcgccaccctaactaccatcgccaccctaactaccatcgccacccgcactaccatccccacccgcactaccatccccacccacactaccatcgccacccgcactaccatcgccacccgcactaccatcgccacccgcactaccatcgccactctaactaccatccccacccgcactaccatcgccaccctaactaccatcgccacccgcactaccatcgccacccacactaccatccccacccgcactaccatcgccacccacactaccatcgccacccgcactaccatcgccactctaactaccatccccacccgcactaccatcgccacccgcactaccatcgccacccgcactaccatcgccaccctaactaccatcgccacccacactaccatccccacccgcactaccatcgccaccctaactaccatcgccacccacaataccatccccacccgcactaccatcgccacccgcactaccatccccacccgcactaccatcgccacccgcactaccatcgccacccgcactacca

SEQ ID NO: 33543 - DNA, 646 bp, Artificial Sequence
  chemically treated genomic DNA (Homo sapiens) CpG-island No: 33543
gtcgttttattgtagtagtttttaaataagtcgtagggtattttagtagttatcgttattttgattgttatcgttattcgtattgttatttttattcgtattgttatcgttattttgattgttatcgttattttgattgttatcgttattcgtattgttatttttattcgtattgttatttttatttatattgttatcgttattcgtattgttatcgttattcgtattgttatcgttattcgtattgttatcgttattttgattgttatttttattcgtattgttatcgttattttgattgttatcgttattcgtattgttatcgttatttatattgttatttttattcgtattgttatcgttatttatattgttatcgttattcgtattgttatcgttattttgattgttatttttattcgtattgttatcgttattcgtattgttatcgttattcgtattgttatcgttattttgattgttatcgttatttatattgttatttttattcgtattgttatcgttattttgattgttatcgttatttataatgttatttttattcgtattgttatcgttattcgtattgttatttttattcgtattgttatcgttattcgtattgttatcgttattcgtattgtta

SEQ ID NO: 33544 - DNA, 646 bp, Artificial Sequence
  chemically treated genomic DNA (Homo sapiens) CpG-island No: 33544
taacaatacgaataacgataacaatacgaataacgataacaatacgaataaaaataacaatacgaataacgataacaatacgaataaaaataacattataaataacgataacaatcaaaataacgataacaatacgaataaaaataacaatataaataacgataacaatcaaaataacgataacaatacgaataacgataacaatacgaataacgataacaatacgaataaaaataacaatcaaaataacgataacaatacgaataacgataacaatataaataacgataacaatacgaataaaaataacaatataaataacgataacaatacgaataacgataacaatcaaaataacgataacaatacgaataaaaataacaatcaaaataacgataacaatacgaataacgataacaatacgaataacgataacaatacgaataacgataacaatataaataaaaataacaatacgaataaaaataacaatacgaataacgataacaatcaaaataacgataacaatcaaaataacgataacaatacgaataaaaataacaatacgaataacgataacaatcaaaataacgataactactaaaataccctacgacttatttaaaaactactacaataaaacgac

SEQ ID NO: 33545 - DNA, 1073 bp, Artificial Sequence
  chemically treated genomic DNA (Homo sapiens) CpG-island No: 33545
ttcgtgtcgtttttcgcggaaacgtcggggtcgtacgtagttaacggtgttttgagttgttgttgttgtatgtggggtgttttttacggtttttaaagacggaagcggggcgggacgagggggtagacggatggtttttatagttagttagcggtgggaggagggttaggcgcggtagatcggttttcggtttcggtgggttttgaattttgaaaggtgggcgcgggtaggtggggtgtgggggggcgtcggggtagaaggggaggggtaggtgggtgcgggataggggtcggagtgagaatcgggggtcggggtagggggtagggagtgagagttcgggggtcggggtagcgggtgagagtcgggggtcggggtagggggtgagagtcgggggtcggggtagcgggtgagagtcggggtcggggtaggaggtgagagtcgggggtcggggtagcgggtgagagtcggggtcggggtaggaggtgagagtcgggggtcggggtagcgggtgagagtcgggggtcggggtagggggtgagagtcgggggtcggggtagcgggtgagagtcgggggtaggggtagggggtgagagtcggggtcggggtagggggtgagagtcgaggtcggggtaggaggtgagagtcgggggtcggggtagcgggtgagagtcgggggtcggggtaggaggtgagagtcgggggtcggggtagcgggtgagagtcggggtcggggtaggaggtgagagtcgggggtcggggtagcgggtgagagtcgggggtcggggtagggggtgagagtcggggtcggggtaggaggtgagagtcgggggtcggggtagcgggtgagagtcgggggtaggggtagcgggtgagagtcgggggtaggggtagcgggtgagagtcgggggtcggggtaggaggtgagagtcgggggtcggggtagcgggtgagagtcgggggtcggggtagcgggtgagagtcgggggtcggggtagcgggtgagagtcgggggtcggggtagggggtgagtgtcgggggtttggttaggttgcgattgattgcgagtttttatt

SEQ ID NO: 33546 - DNA, 1073 bp, Artificial Sequence
  chemically treated genomic DNA (Homo sapiens) CpG-island No: 33546
aataaaaactcgcaatcaatcgcaacctaaccaaacccccgacactcaccccctaccccgacccccgactctcacccgctaccccgacccccgactctcacccgctaccccgacccccgactctcacccgctaccccgacccccgactctcacctcctaccccgacccccgactctcacccgctacccctacccccgactctcacccgctacccctacccccgactctcacccgctaccccgacccccgactctcacctcctaccccgaccccgactctcaccccctaccccgacccccgactctcacccgctaccccgacccccgactctcacctcctaccccgaccccgactctcacccgctaccccgacccccgactctcacctcctaccccgacccccgactctcacccgctaccccgacccccgactctcacctcctaccccgacctcgactctcaccccctaccccgaccccgactctcaccccctacccctacccccgactctcacccgctaccccgacccccgactctcaccccctaccccgacccccgactctcacccgctaccccgacccccgactctcacctcctaccccgaccccgactctcacccgctaccccgacccccgactctcacctcctaccccgaccccgactctcacccgctaccccgacccccgactctcaccccctaccccgacccccgactctcacccgctaccccgacccccgaactctcactccctaccccctaccccgacccccgattctcactccgacccctatcccgcacccacctacccctccccttctaccccgacgcccccccacaccccacctacccgcgcccacctttcaaaattcaaaacccaccgaaaccgaaaaccgatctaccgcgcctaaccctcctcccaccgctaactaactataaaaaccatccgtctaccccctcgtcccgccccgcttccgtctttaaaaaccgtaaaaaacaccccacatacaacaacaacaactcaaaacaccgttaactacgtacgaccccgacgtttccgcgaaaaacgacacgaa

SEQ ID NO: 33547 - DNA, 1073 bp, Artificial Sequence
  chemically treated genomic DNA (Homo sapiens) CpG-island No: 33547
ggtgggggttcgtagttagtcgtagtttggttaggttttcggtatttattttttatttcggttttcgatttttattcgttatttcggttttcggtttttattcgttatttcggttttcggtttttattcgttatttcggttttcggtttttattttttatttcggttttcggtttttattcgttatttttgttttcggtttttattcgttatttttgttttcggtttttattcgttatttcggttttcggtttttattttttatttcggtttcggtttttattttttatttcggttttcggtttttattcgttatttcggttttcggtttttattttttatttcggtttcggtttttattcgttatttcggttttcggtttttattttttatttcggttttcggtttttattcgttatttcggttttcggtttttattttttatttcggtttcggtttttattttttatttcggtttcggtttttattttttatttttgttttcggtttttattcgttatttcggttttcggtttttattttttatttcggttttcggtttttattcgttatttcggttttcggtttttattttttatttcggtttcggtttttattcgttatttcggttttcggtttttattttttatttcggtttcggtttttattcgttatttcggttttcggtttttattttttatttcggttttcggtttttattcgttatttcggttttcgggtttttattttttattttttatttcggttttcggtttttatttcggtttttgtttcgtatttatttgtttttttttttttgtttcggcgtttttttatattttatttgttcgcgtttattttttagggtttagagtttatcggaatcggaagtcgatttgtcgcgtttggttttttttttatcgttgattggttgtaaaagttattcgtttattttttcgtttcgtttcgttttcgtttttagggatcgtaaaaaatattttatatatagtagtagtagtttaaggtatcgttagttacgtgcggtttcggcgttttcgcgaagggcggtacggg

SEQ ID NO: 33548 - DNA, 1073 bp, Artificial Sequence
  chemically treated genomic DNA (Homo sapiens) CpG-island No: 33548
cccgtaccgcccttcgcgaaaacgccgaaaccgcacgtaactaacgataccttaaactactactactatatataaaatattttttacgatccctaaaaacgaaaacgaaacgaaacgaaaaaataaacgaataacttttacaaccaatcaacgataaaaaaaaaaccaaacgcgacaaatcgacttccgattccgataaactctaaaccctaaaaaataaacgcgaacaaataaaatataaaaaaacgccgaaacaaaaaaaaaaaaacaaataaatacgaaacaaaaaccgaaataaaaaccgaaaaccgaaataaaaaataaaaaataaaaacccgaaaaccgaaataacgaataaaaaccgaaaaccgaaataaaaaataaaaaccgaaaaccgaaataacgaataaaaaccgaaaccgaaataaaaaataaaaaccgaaaaccgaaataacgaataaaaaccgaaaccgaaataaaaaataaaaaccgaaaaccgaaataacgaataaaaaccgaaaaccgaaataaaaaataaaaaccgaaaaccgaaataacgaataaaaaccgaaaacaaaaataaaaaataaaaaccgaaaccgaaataaaaaataaaaaccgaaaccgaaataaaaaataaaaaccgaaaaccgaaataacgaataaaaaccgaaaaccgaaataaaaaataaaaaccgaaaaccgaaataacgaataaaaaccgaaaccgaaataaaaaataaaaaccgaaaaccgaaataacgaataaaaaccgaaaaccgaaataaaaaataaaaaccgaaaccgaaataaaaaataaaaaccgaaaaccgaaataacgaataaaaaccgaaaacaaaaataacgaataaaaaccgaaaacaaaaataacgaataaaaaccgaaaaccgaaataaaaaataaaaaccgaaaaccgaaataacgaataaaaaccgaaaaccgaaataacgaataaaaaccgaaaaccgaaataacgaataaaaatcgaaaaccgaaataaaaaataaataccgaaaacctaaccaaactacgactaactacgaacccccacc

SEQ ID NO: 33549 - DNA, 1199 bp, Artificial Sequence
  chemically treated genomic DNA (Homo sapiens) CpG-island No: 33549
gttttcggttcgttcggttcgttcggtttcgggtcgggtttcggcggtttcgagttcgggggcgaggtcggcggggtcgacgttatgttttcgagaggttagtggtgcggagggcgcgggcggtagataaaggcgtttagggcgcggcggcgggcgcgggtattttttcggcggcgcgggcgggcgcgcgcggggcgttcgggttgttggggttggcgttcgggttttgttttgttttcgtttattttcgtatcgcgttttagttgttttcggttcggcggcgcggcgggcgtaggtttatggcggcggggcggtttagggagggcggcgaggattcgggcggcggatggcgggggacgggggtcgaggaggtcgggggacgggggtcgaggaggtcggaggtcgcggagtttgtgaagtaggatgaggagattaaggaggttgaggcgtttgaggtattcggagaattaacgtcgtcgtcgtttaggtttcgtttttcgtcgggtttgacgttagtacgtttcggcggggttttagtttttcgtcggtttgttgtagaggtaggcgtcgggtgtgtcgcggtagtgtagcggtcgcgaaggggtgttttgttgtatgttatatttttcgtttcgttagagcgggggtttcgagtttcgggcgtgggacgcgggggtgtttcgaggttgcgagtggaggcgtgacgtgacgtttttggtaagaggcgcgcggagttaggttttatttagaacgtgttttcgtcgtatagttattagcgggcgcgatcgttatttacgtatggtgcggtcgagtaaacggtatcgtttggcgagcgagagacgtaaagggatatagttttttaggagttgagtttttcgggggtaaagcgtttttacgttgatgagattaggaggcggcgtacgtttggtttcgcggtttaggggttgtaggtgttttagggttcgcggggcgtagacgtcgtagagggcgacgttttgttcgggtttcgcgcggattcgggggacgtagggtttgatacggagtgcggaggggttttagatacgtagtttatgttttttgaaattagaggtacgcgcggttacgcgttaggttttttttttaagtttgtgattaagattttcgggatttttagcgttgggacgggcgcgttggtttacgtttaagcgggaggatcgttt

SEQ ID NO: 33550 - DNA, 1199 bp, Artificial Sequence
  chemically treated genomic DNA (Homo sapiens) CpG-island No: 33550
aaacgatcctcccgcttaaacgtaaaccaacgcgcccgtcccaacgctaaaaatcccgaaaatcttaatcacaaacttaaaaaaaaaacctaacgcgtaaccgcgcgtacctctaatttcaaaaaacataaactacgtatctaaaacccctccgcactccgtatcaaaccctacgtcccccgaatccgcgcgaaacccgaacaaaacgtcgccctctacgacgtctacgccccgcgaaccctaaaacacctacaacccctaaaccgcgaaaccaaacgtacgccgcctcctaatctcatcaacgtaaaaacgctttacccccgaaaaactcaactcctaaaaaactatatccctttacgtctctcgctcgccaaacgataccgtttactcgaccgcaccatacgtaaataacgatcgcgcccgctaataactatacgacgaaaacacgttctaaataaaacctaactccgcgcgcctcttaccaaaaacgtcacgtcacgcctccactcgcaacctcgaaacacccccgcgtcccacgcccgaaactcgaaacccccgctctaacgaaacgaaaaatataacatacaacaaaacaccccttcgcgaccgctacactaccgcgacacacccgacgcctacctctacaacaaaccgacgaaaaactaaaaccccgccgaaacgtactaacgtcaaacccgacgaaaaacgaaacctaaacgacgacgacgttaattctccgaatacctcaaacgcctcaacctccttaatctcctcatcctacttcacaaactccgcgacctccgacctcctcgacccccgtcccccgacctcctcgacccccgtcccccgccatccgccgcccgaatcctcgccgccctccctaaaccgccccgccgccataaacctacgcccgccgcgccgccgaaccgaaaacaactaaaacgcgatacgaaaataaacgaaaacaaaacaaaacccgaacgccaaccccaacaacccgaacgccccgcgcgcgcccgcccgcgccgccgaaaaaatacccgcgcccgccgccgcgccctaaacgcctttatctaccgcccgcgccctccgcaccactaacctctcgaaaacataacgtcgaccccgccgacctcgcccccgaactcgaaaccgccgaaacccgacccgaaaccgaacgaaccgaacgaaccgaaaac

SEQ ID NO: 33551 - DNA, 1199 bp, Artificial Sequence
  chemically treated genomic DNA (Homo sapiens) CpG-island No: 33551
aagcgattttttcgtttgggcgtgggttagcgcgttcgttttaacgttgggagtttcggagattttggttataggtttaagggaaaggtttagcgcgtggtcgcgcgtgtttttggttttaagggatatggattgcgtgtttggggttttttcgtatttcgtgttagattttgcgtttttcgggttcgcgcgggattcgggtagggcgtcgttttttgcggcgtttgcgtttcgcgaattttggggtatttgtaatttttgggtcgcggagttaggcgtgcgtcgttttttggttttattaacgtgagaacgttttattttcgaagagtttagtttttagggggttatgtttttttgcgtttttcgttcgttaggcggtgtcgtttattcgatcgtattatgcgtgggtagcggtcgcgttcgttggtagttgtgcggcgggaatacgttttaagtaaggtttgatttcgcgcgttttttgttagggacgttacgttacgtttttattcgtagtttcggagtattttcgcgttttacgttcgaagttcgggattttcgttttggcgaaacgaggaatatgatatatagtaaaatattttttcgcggtcgttgtattgtcgcgatatattcggcgtttgtttttatagtaagtcggcgaggggttgggatttcgtcgggacgtgttgacgttaggttcgacggggggcggggtttgggcggcggcggcgttagtttttcgggtattttaggcgttttagtttttttagtttttttattttgttttataggtttcgcggttttcggttttttcggttttcgtttttcggttttttcggttttcgtttttcgttattcgtcgttcggattttcgtcgttttttttaggtcgtttcgtcgttatgggtttgcgttcgtcgcgtcgtcgggtcgagggtagttgaggcgcggtgcgaagatgggcgaggatagagtagggttcgagcgttagttttagtagttcgggcgtttcgcgcgcgttcgttcgcgtcgtcgaggggatgttcgcgttcgtcgtcgcgttttgagcgtttttgtttgtcgttcgcgtttttcgtattattagtttttcgggagtatggcgtcggtttcgtcggtttcgttttcgggttcggagtcgtcggggttcgattcggagtcgggcgggtcggacgggtcgggggt

SEQ ID NO: 33552 - DNA, 1199 bp, Artificial Sequence
  chemically treated genomic DNA (Homo sapiens) CpG-island No: 33552
acccccgacccgtccgacccgcccgactccgaatcgaaccccgacgactccgaacccgaaaacgaaaccgacgaaaccgacgccatactcccgaaaaactaataatacgaaaaacgcgaacgacaaacaaaaacgctcaaaacgcgacgacgaacgcgaacatcccctcgacgacgcgaacgaacgcgcgcgaaacgcccgaactactaaaactaacgctcgaaccctactctatcctcgcccatcttcgcaccgcgcctcaactaccctcgacccgacgacgcgacgaacgcaaacccataacgacgaaacgacctaaaaaaaacgacgaaaatccgaacgacgaataacgaaaaacgaaaaccgaaaaaaccgaaaaacgaaaaccgaaaaaaccgaaaaccgcgaaacctataaaacaaaataaaaaaactaaaaaaactaaaacgcctaaaatacccgaaaaactaacgccgccgccgcccaaaccccgccccccgtcgaacctaacgtcaacacgtcccgacgaaatcccaacccctcgccgacttactataaaaacaaacgccgaatatatcgcgacaatacaacgaccgcgaaaaaatattttactatatatcatattcctcgtttcgccaaaacgaaaatcccgaacttcgaacgtaaaacgcgaaaatactccgaaactacgaataaaaacgtaacgtaacgtccctaacaaaaaacgcgcgaaatcaaaccttacttaaaacgtattcccgccgcacaactaccaacgaacgcgaccgctacccacgcataatacgatcgaataaacgacaccgcctaacgaacgaaaaacgcaaaaaaacataaccccctaaaaactaaactcttcgaaaataaaacgttctcacgttaataaaaccaaaaaacgacgcacgcctaactccgcgacccaaaaattacaaataccccaaaattcgcgaaacgcaaacgccgcaaaaaacgacgccctacccgaatcccgcgcgaacccgaaaaacgcaaaatctaacacgaaatacgaaaaaaccccaaacacgcaatccatatcccttaaaaccaaaaacacgcgcgaccacgcgctaaacctttcccttaaacctataaccaaaatctccgaaactcccaacgttaaaacgaacgcgctaacccacgcccaaacgaaaaaatcgctt

SEQ ID NO: 33553 - DNA, 1145 bp, Artificial Sequence
  chemically treated genomic DNA (Homo sapiens) CpG-island No: 33553
tcgcgagtacgcggagttcgttgttcggttaattatttcgttttattttcgttatttttagcggttttttattttaggcggtttttcgggtttcgcggttgtaaattaggttttatcgtacgttttttacgcggtttcggttttgtgaagggcggcggcggggtaaagaggggtagagattattcggggtgaggcgggcgtttttatttttgggcgtattcgggcggggggcggggggcgggacggttggtcggcgttttcgtttcggttaggtttgtagttcgagttttcgtaattatttttcgagttaggcgaggaggagttcgtagttcggtcgttttcgttggcgtattttttttttatttagacgtagaggtttaggtttcgtttttttattggtcgtttagtaatagttgcgtcgtcgtcgtcgtcgtcgtcgcgttttttttattcgtttttttatcgttcgcgatcggttgttgaagagcggacgggtagtggtacgtttattggttgaggttcgtagtcgcgttagtcggtttcgatcgtatttcgcgacgtgattggttggagcggcgttttttttcgatattcgtttttgattggttttcgcgtatatttttattcgtaggattagttatttttttttttgttttagttttttatttttaattcggttttttttcgggcgggagtggggcgggagcggacgttcgcggaacgcgaacggttaatgggggcgcggagagagggtcgggaggtgggttttgcggtcgggaggttcgcgggggaatgtttagttaatgggttcgcgttttatatttcgagttttggagcgttttcgtcggttgttggcgttttgtcgggtcgcgtttagggttacgttcggttgttcgtcgcgcgggaggggcgttaatttttaaggttgggagtacgtagcgaggttcgcgcgggagatagcggggttgttattgtggcgtgtttagcgttattatggtggggttcgggggtttttcggttattgttgggcgtgagggattcgttcggagaattattagtttggcgggtgtggttcgggtcggtgagagcgaagagttttacggatttttggagtttttacgggtttcgtttagttttaggggatt

SEQ ID NO: 33554 - DNA, 1145 bp, Artificial Sequence
  chemically treated genomic DNA (Homo sapiens) CpG-island No: 33554
aatcccctaaaactaaacgaaacccgtaaaaactccaaaaatccgtaaaactcttcgctctcaccgacccgaaccacacccgccaaactaataattctccgaacgaatccctcacgcccaacaataaccgaaaaacccccgaaccccaccataataacgctaaacacgccacaataacaaccccgctatctcccgcgcgaacctcgctacgtactcccaaccttaaaaattaacgcccctcccgcgcgacgaacaaccgaacgtaaccctaaacgcgacccgacaaaacgccaacaaccgacgaaaacgctccaaaactcgaaatataaaacgcgaacccattaactaaacattcccccgcgaacctcccgaccgcaaaacccacctcccgaccctctctccgcgcccccattaaccgttcgcgttccgcgaacgtccgctcccgccccactcccgcccgaaaaaaaaccgaattaaaaataaaaaactaaaacaaaaaaaaaaataactaatcctacgaataaaaatatacgcgaaaaccaatcaaaaacgaatatcgaaaaaaaacgccgctccaaccaatcacgtcgcgaaatacgatcgaaaccgactaacgcgactacgaacctcaaccaataaacgtaccactacccgtccgctcttcaacaaccgatcgcgaacgataaaaaaacgaataaaaaaaacgcgacgacgacgacgacgacgacgcaactattactaaacgaccaataaaaaaacgaaacctaaacctctacgtctaaataaaaaaaaaatacgccaacgaaaacgaccgaactacgaactcctcctcgcctaactcgaaaaataattacgaaaactcgaactacaaacctaaccgaaacgaaaacgccgaccaaccgtcccgccccccgccccccgcccgaatacgcccaaaaataaaaacgcccgcctcaccccgaataatctctacccctctttaccccgccgccgcccttcacaaaaccgaaaccgcgtaaaaaacgtacgataaaacctaatttacaaccgcgaaacccgaaaaaccgcctaaaataaaaaaccgctaaaaataacgaaaataaaacgaaataattaaccgaacaacgaactccgcgtactcgcga

SEQ ID NO: 33555 - DNA, 1145 bp, Artificial Sequence
  chemically treated genomic DNA (Homo sapiens) CpG-island No: 33555
agttttttgggattgggcgagattcgtggaggttttaggggttcgtagagtttttcgtttttatcgattcgggttatattcgttaagttggtagtttttcgaacggattttttacgtttagtaatggtcggagggttttcgggttttattataatagcgttaagtacgttataatggtagtttcgttgtttttcgcgcgggtttcgttgcgtgtttttaattttgggagttggcgtttttttcgcgcgacggatagtcgggcgtggttttgggcgcgattcgataggacgttagtagtcggcgggggcgttttaggattcgagatgtggggcgcgggtttattggttgagtattttttcgcgagtttttcggtcgtagggtttatttttcggtttttttttcgcgtttttattggtcgttcgcgtttcgcgggcgttcgttttcgttttattttcgttcggagggaaatcgggttgggggtgagaggttaaagtaaggaggaggatgattggttttgcggataagggtgtgcgcgagagttaattaaaagcggatgtcgaaaagaggcgtcgttttagttagttacgtcgcgaggtgcggtcggggtcggttgacgcgattgcgggttttagttaatgggcgtgttattgttcgttcgttttttagtagtcggtcgcgggcggtggaaaagcgagtgaagagagcgcgacggcggcggcggcggcggcgtagttattgttggacggttagtgggagagcgaggtttgagtttttgcgtttaggtgagaagggggtgcgttagcgggagcggtcgggttgcgggttttttttcgtttggttcgggaagtggttgcgggagttcgggttgtaggtttggtcgaggcgggggcgtcgattagtcgtttcgtttttcgtttttcgttcgggtacgtttagaagtgagggcgttcgttttatttcgggtggtttttgtttttttttgtttcgtcgtcgttttttatagggtcgggatcgcgtgggggacgtacggtggggtttggtttgtagtcgcggagttcggggagtcgtttggggtgggaggtcgttagaggtggcgaaggtggggcggggtggttagtcgagtagcgggtttcgcgtgttcgcgg

SEQ ID NO: 33556 - DNA, 1145 bp, Artificial Sequence
  chemically treated genomic DNA (Homo sapiens) CpG-island No: 33556
ccgcgaacacgcgaaacccgctactcgactaaccaccccgccccaccttcgccacctctaacgacctcccaccccaaacgactccccgaactccgcgactacaaaccaaaccccaccgtacgtcccccacgcgatcccgaccctataaaaaacgacgacgaaacaaaaaaaaacaaaaaccacccgaaataaaacgaacgccctcacttctaaacgtacccgaacgaaaaacgaaaaacgaaacgactaatcgacgcccccgcctcgaccaaacctacaacccgaactcccgcaaccacttcccgaaccaaacgaaaaaaaacccgcaacccgaccgctcccgctaacgcacccccttctcacctaaacgcaaaaactcaaacctcgctctcccactaaccgtccaacaataactacgccgccgccgccgccgccgtcgcgctctcttcactcgcttttccaccgcccgcgaccgactactaaaaaacgaacgaacaataacacgcccattaactaaaacccgcaatcgcgtcaaccgaccccgaccgcacctcgcgacgtaactaactaaaacgacgcctcttttcgacatccgcttttaattaactctcgcgcacacccttatccgcaaaaccaatcatcctcctccttactttaacctctcacccccaacccgatttccctccgaacgaaaataaaacgaaaacgaacgcccgcgaaacgcgaacgaccaataaaaacgcgaaaaaaaaaccgaaaaataaaccctacgaccgaaaaactcgcgaaaaaatactcaaccaataaacccgcgccccacatctcgaatcctaaaacgcccccgccgactactaacgtcctatcgaatcgcgcccaaaaccacgcccgactatccgtcgcgcgaaaaaaacgccaactcccaaaattaaaaacacgcaacgaaacccgcgcgaaaaacaacgaaactaccattataacgtacttaacgctattataataaaacccgaaaaccctccgaccattactaaacgtaaaaaatccgttcgaaaaactaccaacttaacgaatataacccgaatcgataaaaacgaaaaactctacgaacccctaaaacctccacgaatctcgcccaatcccaaaaaact

SEQ ID NO: 33557 - DNA, 1504 bp, Artificial Sequence
  chemically treated genomic DNA (Homo sapiens) CpG-island No: 33557
cgataattcgatttttcgttaggagagattcgatttaggtttgcgtcgcgaggtttttagttcgtttttttttgcgattttaaatttgggttttgatttttcgtcggtcgcggtggttcgggttattcggcggcggttgatagttgagcgtaaaggcgtcgcggttaaggttttcgcggagtagttcgggatgcgtacgtcgagggttaaggaggaggtcgttcggtttggagttgggatcgtaggttgggggtcgggatattcgggtttcgtcgggtcgggggtagggtcgcgggtttgatagttgttgcggttcgcgcggacgcgcgttttttgtagttcgttttttttatgtttgatttattattttttgttttttttttttttgttgttttaaaatatttttcgacgttagtaaaatataatgcgtttcggtcgtcgtaaatagtcgggagggagagtatatattcggcgcggcgcggtcgtcggttcggtttttatttttttttcgtttttagaaaatgttataaaagcgggtagggcgcggggagggcggttgcgcgttcggcggtcggggtttttttttcgcgtcgtttttttacgttttttcgttcgtttcgcgcgttcgtttttttcgtaaatttgtttcgttatttcgtttagcggcggggttcggggttcggggttcgggatttatttcgtcggagaattttgcgttttttttcgttttttttttttcgcgttttttcggttcgtagttttttttcggtagtcggcgaggtgggtagttcgtgggttatcgaaagttcgcggaggggacgcgtattatatggtagttcgtttttagtttttcgagtgcgtcgggaagggggaggggaaggggcgaggggaggtcggggggaaagcgagagcggggcggcggcgggagtgggtaggcggggtggcgagggcggcggtcgtttacgttagcgttgtgcgatcgtagttcgggcgtgtacggtcgttgttgtcgttgttgttgttgttgttgttgttgaggcggcggcggttcggcgttgtttgtttcgcgtcgcgcggtttgcgtttttttcggaacgtttatatttttaatcgttatattgttgatattcggcgttgacgttattcgttttttatttataataattttacgggagtcgggtagcgtattttttcggtcgttggggcgcggtacgttcggcgattagcgtaagtcgtttcgcgaatggcgtttcgggggttggggcggggggcgggggacgggggcgggcgcgcgcgtttcgttggttcgcgggagggggcgcgtttttatgtcgtcgtagtagtagattttttcgttttgtgcggtcgcgcggttcggagagttttttttttttcggttcggttgatcgtttcgttcggtttggttttttcggttacgaaagacgagggttgggggtatagtagggtgagagtagtggtgagggttggtgtggtacgtggggag

SEQ ID NO: 33558 - DNA, 1504 bp, Artificial Sequence
  chemically treated genomic DNA (Homo sapiens) CpG-island No: 33558
ctccccacgtaccacaccaaccctcaccactactctcaccctactatacccccaaccctcgtctttcgtaaccgaaaaaaccaaaccgaacgaaacgatcaaccgaaccgaaaaaaaaaaaactctccgaaccgcgcgaccgcacaaaacgaaaaaatctactactacgacgacataaaaacgcgccccctcccgcgaaccaacgaaacgcgcgcgcccgcccccgtcccccgccccccgccccaacccccgaaacgccattcgcgaaacgacttacgctaatcgccgaacgtaccgcgccccaacgaccgaaaaaatacgctacccgactcccgtaaaattattataaataaaaaacgaataacgtcaacgccgaatatcaacaatataacgattaaaaatataaacgttccgaaaaaaacgcaaaccgcgcgacgcgaaacaaacaacgccgaaccgccgccgcctcaacaacaacaacaacaacaacaacgacaacaacgaccgtacacgcccgaactacgatcgcacaacgctaacgtaaacgaccgccgccctcgccaccccgcctacccactcccgccgccgccccgctctcgctttccccccgacctcccctcgccccttcccctcccccttcccgacgcactcgaaaaactaaaaacgaactaccatataatacgcgtcccctccgcgaactttcgataacccacgaactacccacctcgccgactaccgaaaaaaaactacgaaccgaaaaaacgcgaaaaaaaaaaaacgaaaaaaaacgcaaaattctccgacgaaataaatcccgaaccccgaaccccgaaccccgccgctaaacgaaataacgaaacaaatttacgaaaaaaacgaacgcgcgaaacgaacgaaaaaacgtaaaaaaacgacgcgaaaaaaaaaccccgaccgccgaacgcgcaaccgccctccccgcgccctacccgcttttataacattttctaaaaacgaaaaaaaaataaaaaccgaaccgacgaccgcgccgcgccgaatatatactctccctcccgactatttacgacgaccgaaacgcattatattttactaacgtcgaaaaatattttaaaacaacaaaaaaaaaaaaaacaaaaaataataaatcaaacataaaaaaaacgaactacaaaaaacgcgcgtccgcgcgaaccgcaacaactatcaaacccgcgaccctacccccgacccgacgaaacccgaatatcccgacccccaacctacgatcccaactccaaaccgaacgacctcctccttaaccctcgacgtacgcatcccgaactactccgcgaaaaccttaaccgcgacgcctttacgctcaactatcaaccgccgccgaataacccgaaccaccgcgaccgacgaaaaatcaaaacccaaatttaaaatcgcaaaaaaaaacgaactaaaaacctcgcgacgcaaacctaaatcgaatctctcctaacgaaaaatcgaattatcg

SEQ ID NO: 33559 - DNA, 1504 bp, Artificial Sequence
  chemically treated genomic DNA (Homo sapiens) CpG-island No: 33559
ttttttacgtgttatattagtttttattattatttttattttgttatgtttttaattttcgtttttcgtggtcgggaaggttaggtcgagcggggcggttagtcgggtcgggagggagggggtttttcgggtcgcgcggtcgtataaagcggggagatttgttgttgcggcggtatggaggcgcgttttttttcgcgagttagcggagcgcgcgcgttcgttttcgtttttcgtttttcgttttagttttcggagcgttattcgcggagcggtttacgttagtcgtcgggcgtatcgcgttttagcggtcggggaggtgcgttgttcggttttcgtaaagttattgtgaatggggagcgggtgacgttagcgtcgaatgttaataatgtagcgattgagagtgtgggcgtttcggggagagcgtaagtcgcgcggcgcggagtaaatagcgtcgagtcgtcgtcgttttagtagtagtagtagtagtagtagcggtagtagcggtcgtgtacgttcgggttgcggtcgtatagcgttaacgtgagcggtcgtcgttttcgttatttcgtttgtttattttcgtcgtcgtttcgttttcgtttttttttcggttttttttcgttttttttttttttttttttcggcgtattcggggggttgggaacgagttgttatgtgatgcgcgtttttttcgcgagttttcggtgatttacgaattgtttatttcgtcggttgtcgggagggggttgcgagtcgggaagacgcggggaagaggaggcggaaaaggacgtaaagtttttcggcgaggtgagtttcgggtttcgggtttcgggtttcgtcgttgggcggggtggcggggtaagtttgcggggggagcgggcgcgcggggcgggcggggaggcgtggggaaacggcgcgggaagggagtttcggtcgtcgggcgcgtagtcgtttttttcgcgttttgttcgtttttatggtattttttaggaacgggaagggggtgggagtcgagtcggcggtcgcgtcgcgtcgaatgtgtgttttttttttcggttgtttacggcggtcgaggcgtattgtattttgttggcgtcgaagggtgttttggaatagtagagggaggaggagtagagagtaataagttaggtatggggagggcgggttgtaggaggcgcgcgttcgcgcgagtcgtagtagttgttagattcgcggttttgttttcggttcggcgaggttcgggtgtttcggtttttagtttgcgattttagttttaggtcgggcggttttttttttaattttcggcgtgcgtatttcgggttgtttcgcgaggattttggtcgcggcgtttttgcgtttagttgttagtcgtcgtcgggtggttcggattatcgcgatcggcggggaattaaagtttaagtttagggtcgtaggaagaggcgagttgggggtttcgcggcgtagatttggatcgaattttttttagcgaaagatcgggttgtcg

SEQ ID NO: 33560 - DNA, 1504 bp, Artificial Sequence
  chemically treated genomic DNA (Homo sapiens) CpG-island No: 33560
cgacaacccgatctttcgctaaaaaaaattcgatccaaatctacgccgcgaaacccccaactcgcctcttcctacgaccctaaacttaaactttaattccccgccgatcgcgataatccgaaccacccgacgacgactaacaactaaacgcaaaaacgccgcgaccaaaatcctcgcgaaacaacccgaaatacgcacgccgaaaattaaaaaaaaaaccgcccgacctaaaactaaaatcgcaaactaaaaaccgaaacacccgaacctcgccgaaccgaaaacaaaaccgcgaatctaacaactactacgactcgcgcgaacgcgcgcctcctacaacccgccctccccatacctaacttattactctctactcctcctccctctactattccaaaacacccttcgacgccaacaaaatacaatacgcctcgaccgccgtaaacaaccgaaaaaaaaaacacacattcgacgcgacgcgaccgccgactcgactcccacccccttcccgttcctaaaaaataccataaaaacgaacaaaacgcgaaaaaaacgactacgcgcccgacgaccgaaactcccttcccgcgccgtttccccacgcctccccgcccgccccgcgcgcccgctccccccgcaaacttaccccgccaccccgcccaacgacgaaacccgaaacccgaaacccgaaactcacctcgccgaaaaactttacgtccttttccgcctcctcttccccgcgtcttcccgactcgcaaccccctcccgacaaccgacgaaataaacaattcgtaaatcaccgaaaactcgcgaaaaaaacgcgcatcacataacaactcgttcccaaccccccgaatacgccgaaaaaaaaaaaaaaaaaaaacgaaaaaaaaccgaaaaaaaaacgaaaacgaaacgacgacgaaaataaacaaacgaaataacgaaaacgacgaccgctcacgttaacgctatacgaccgcaacccgaacgtacacgaccgctactaccgctactactactactactactactaaaacgacgacgactcgacgctatttactccgcgccgcgcgacttacgctctccccgaaacgcccacactctcaatcgctacattattaacattcgacgctaacgtcacccgctccccattcacaataactttacgaaaaccgaacaacgcacctccccgaccgctaaaacgcgatacgcccgacgactaacgtaaaccgctccgcgaataacgctccgaaaactaaaacgaaaaacgaaaaacgaaaacgaacgcgcgcgctccgctaactcgcgaaaaaaaacgcgcctccataccgccgcaacaacaaatctccccgctttatacgaccgcgcgacccgaaaaaccccctccctcccgacccgactaaccgccccgctcgacctaaccttcccgaccacgaaaaacgaaaattaaaaacataacaaaataaaaataataataaaaactaatataacacgtaaaaaa

SEQ ID NO: 33561 - DNA, 625 bp, Artificial Sequence
  chemically treated genomic DNA (Homo sapiens) CpG-island No: 33561
ttttttcgttttgtttttaggtagtcgatcggggatatacgggttaaaattgcgtttgggcggcgcggcgatgcgcggtttcgggtagtcgcgtaggggcgtttcgagtttcgggagtcgtaggttcgtttaaggattcgtcgcgcggcgggcgtttgggtttttcgggggtttttttggggtcgtttggattcgtaggtttttcgcgttattttttattttatttttcgtttgcgttttttgttgcgttcggcgcgcgttttgttgtagtttgttggggatagcgtacgtagtgatcgggcgcggtagtcgttttttttttttatcgatttcgttgttttttggttttttttaaagttttttttttagagttagatagtagacgtttcggcgatgttttcgtcgtttatttggtcgaggtagtttaggtttgtttttgttgttttcgtcggtcgtttcgtcgcggtttaaagtcggggaagcgttttaagttcgcgcggtttgtttcggagtttcggaggattcgaatatttagcggaatgttattttggtcgggttttttggattttttttcggggttattttacggaatttagtcgtttttataagttattttatgtaattg

SEQ ID NO: 33562 - DNA, 625 bp, Artificial Sequence
  chemically treated genomic DNA (Homo sapiens) CpG-island No: 33562
caattacataaaataacttataaaaacgactaaattccgtaaaataaccccgaaaaaaaatccaaaaaacccgaccaaaataacattccgctaaatattcgaatcctccgaaactccgaaacaaaccgcgcgaacttaaaacgcttccccgactttaaaccgcgacgaaacgaccgacgaaaacaacaaaaacaaacctaaactacctcgaccaaataaacgacgaaaacatcgccgaaacgtctactatctaactctaaaaaaaaaactttaaaaaaaaccaaaaaacaacgaaatcgataaaaaaaaaaaacgactaccgcgcccgatcactacgtacgctatccccaacaaactacaacaaaacgcgcgccgaacgcaacaaaaaacgcaaacgaaaaataaaataaaaaataacgcgaaaaacctacgaatccaaacgaccccaaaaaaacccccgaaaaacccaaacgcccgccgcgcgacgaatccttaaacgaacctacgactcccgaaactcgaaacgcccctacgcgactacccgaaaccgcgcatcgccgcgccgcccaaacgcaattttaacccgtatatccccgatcgactacctaaaaacaaaacgaaaaaa

SEQ ID NO: 33563 - DNA, 625 bp, Artificial Sequence
  chemically treated genomic DNA (Homo sapiens) CpG-island No: 33563
tagttatatgaggtagtttgtggggacggttggatttcgtaggatggtttcggaggggaatttaaagaattcggttagggtgatatttcgttgagtattcgggtttttcggggtttcggggtagatcgcgcgggtttgggacgttttttcggttttgggtcgcggcggagcggtcggcggaggtagtaagggtaggtttgggttatttcggttaaatgggcggcgaaggtatcgtcggggcgtttgttgtttggttttggagaaaaggttttgagaaaagttagaaggtagcgaggtcgatgggaaagggaagcggttgtcgcgttcggttattgcgtgcgttgtttttagtaggttgtagtaggacgcgcgtcgagcgtagtagggggcgtaggcggggaatggggtagggggtggcgcgggagatttgcgagtttaggcggttttagaggggttttcggagggtttaggcgttcgtcgcgcggcggatttttggacgagtttgcggttttcggggttcgggacgtttttgcgcggttgttcgagatcgcgtatcgtcgcgtcgtttaaacgtaattttgattcgtgtgttttcggtcggttgtttgagggtaaggcgaggagg

SEQ ID NO: 33564 - DNA, 625 bp, Artificial Sequence
  chemically treated genomic DNA (Homo sapiens) CpG-island No: 33564
cctcctcgccttaccctcaaacaaccgaccgaaaacacacgaatcaaaattacgtttaaacgacgcgacgatacgcgatctcgaacaaccgcgcaaaaacgtcccgaaccccgaaaaccgcaaactcgtccaaaaatccgccgcgcgacgaacgcctaaaccctccgaaaacccctctaaaaccgcctaaactcgcaaatctcccgcgccaccccctaccccattccccgcctacgccccctactacgctcgacgcgcgtcctactacaacctactaaaaacaacgcacgcaataaccgaacgcgacaaccgcttccctttcccatcgacctcgctaccttctaacttttctcaaaaccttttctccaaaaccaaacaacaaacgccccgacgataccttcgccgcccatttaaccgaaataacccaaacctacccttactacctccgccgaccgctccgccgcgacccaaaaccgaaaaaacgtcccaaacccgcgcgatctaccccgaaaccccgaaaaacccgaatactcaacgaaatatcaccctaaccgaattctttaaattcccctccgaaaccatcctacgaaatccaaccgtccccacaaactacctcatataacta

SEQ ID NO: 33565 - DNA, 538 bp, Artificial Sequence
  chemically treated genomic DNA (Homo sapiens) CpG-island No: 33565
ttattcgtcgtcgttttcggattttgtacgtttgatttcggttacgcgttttttcgtcgtttttgttgttagtttgaacggatgtttgatttcgtttgtcgttagttgtagatttcggtattcgaaattgttttcgtttttcgcggtcggcgagttatattttttttttttcgcgtttattttcgcgtttttcgttttttttttttttttttttttcgcgcgttttcgtttttttttgttaggaaacgtcggtttttgttcggtttttcgcgttgttttttttttttttttattttttttaggtttgagttttttttgtttttttagtattcgtttcgcgtttttttatcgcgtttttcgtcgttttttttttgttttcgttcgtgttttgttgtcgtcgttttttcgtagcgtttcgcggttgttatttataatcgcgtttttatttaattttatttaaatggttaggttcgcgttttagtcgtcgggtagtgtttatttaaggattagtttttagtttttttcgttttttttgtcg

SEQ ID NO: 33566 - DNA, 538 bp, Artificial Sequence
  chemically treated genomic DNA (Homo sapiens) CpG-island No: 33566
cgacaaaaaaaacgaaaaaaactaaaaactaatccttaaataaacactacccgacgactaaaacgcgaacctaaccatttaaataaaattaaataaaaacgcgattataaataacaaccgcgaaacgctacgaaaaaacgacgacaacaaaacacgaacgaaaacaaaaaaaaaacgacgaaaaacgcgataaaaaaacgcgaaacgaatactaaaaaaacaaaaaaaactcaaacctaaaaaaaataaaaaaaaaaaaaaaacaacgcgaaaaaccgaacaaaaaccgacgtttcctaacaaaaaaaaacgaaaacgcgcgaaaaaaaaaaaaaaaaaaaaaacgaaaaacgcgaaaataaacgcgaaaaaaaaaaaatataactcgccgaccgcgaaaaacgaaaacaatttcgaataccgaaatctacaactaacgacaaacgaaatcaaacatccgttcaaactaacaacaaaaacgacgaaaaaacgcgtaaccgaaatcaaacgtacaaaatccgaaaacgacgacgaataa

SEQ ID NO: 33567 - DNA, 538 bp, Artificial Sequence
  chemically treated genomic DNA (Homo sapiens) CpG-island No: 33567
cggtagaagaagcgggaggggttggaggttggtttttaggtaggtattgttcggcgattggagcgcggatttggttatttgggtggggttgagtgggggcgcgattgtgagtagtagtcgcgggacgttgcgaaggggcggcggtaatagagtacgggcgggggtagaaaagaggcggcggagggcgcggtgggggagcgcgaggcgagtgttgagagagtagaaaggatttaagtttgaggggagtagagaggaagaaggggtaacgcgagaaatcgaataggagtcggcgttttttggtaagggagggcggaggcgcgcgggagagagggagagagggagggcggggggcgcgggggtaggcgcggggagaggggagtataattcgtcggtcgcgaggagcgggggtagtttcgggtgtcgaggtttgtagttagcggtaagcggagttaggtattcgtttagattgatagtagaggcggcgaaggagcgcgtagtcgagattaggcgtatagagttcggaggcggcggcgggtga

SEQ ID NO: 33568 - DNA, 538 bp, Artificial Sequence
  chemically treated genomic DNA (Homo sapiens) CpG-island No: 33568
tcacccgccgccgcctccgaactctatacgcctaatctcgactacgcgctccttcgccgcctctactatcaatctaaacgaatacctaactccgcttaccgctaactacaaacctcgacacccgaaactacccccgctcctcgcgaccgacgaattatactcccctctccccgcgcctacccccgcgccccccgccctccctctctccctctctcccgcgcgcctccgccctcccttaccaaaaaacgccgactcctattcgatttctcgcgttaccccttcttcctctctactcccctcaaacttaaatcctttctactctctcaacactcgcctcgcgctcccccaccgcgccctccgccgcctcttttctacccccgcccgtactctattaccgccgccccttcgcaacgtcccgcgactactactcacaatcgcgcccccactcaaccccacccaaataaccaaatccgcgctccaatcgccgaacaatacctacctaaaaaccaacctccaacccctcccgcttcttctaccg

SEQ ID NO: 33569 - DNA, 701 bp, Artificial Sequence
  chemically treated genomic DNA (Homo sapiens) CpG-island No: 33569
  misc_feature (362)..(362): n is either a, c, g or t
  misc_feature (430)..(430): n is either a, c, g or t
  misc_feature (444)..(444): n is either a, c, g or t
  misc_feature (463)..(463): n is either a, c, g or t
  misc_feature (517)..(517): n is either a, c, g or t
  misc_feature (529)..(529): n is either a, c, g or t
  misc_feature (605)..(605): n is either a, c, g or t
  misc_feature (648)..(648): n is either a, c, g or t
gtggtcgtttttttttttttgtttttttgttttgttttttttttcgtgttttttgtgttgcgtttcgttttttttttcgttgttgttttttcgtttttttttgttttttttttttggcgcgggcgtttttttgtttcgtttttttcgttttttttcgttcgtgttttttgtttttcgttttttcgtttttggttttttggtgttggtgcgtttcgtcgtttttcgttgcggtcgtttttcggttttttttgttcggtgttttttttcgcgtcgggtgtcggttttgtggttgttggtgcgcgcgcgttgtttgttttttttgtgtttttcgcgttttgtgtgtcgtttcgtttcgttttttncgttttcgtgtgttttgagtgttcggcgttttttcgtcgttggtgcgcgcgtttttttcgtttgttantgttcgtcgtattngtcggggcgtcgttgcgtncggcgtttttgcgtgtcgtttttgtttttttttttttttttttcgttttttttnttttttttcggntttttttcgattcgcgtttattttatttgtgcggttttttgcgcgtttttcgttgtttcgtcgtttttgtcgttangttttttggcgcgtcgtcgcgattgtttttcgcgcgtttcgtnttcgcgttcggagaatgttcgttggcgttttttgtcgttacgtcgtgtcgata

SEQ ID NO: 33570 - DNA, 701 bp, Artificial Sequence
  chemically treated genomic DNA (Homo sapiens) CpG-island No: 33570
  misc_feature (54)..(54): n is either a, c, g or t
  misc_feature (97)..(97): n is either a, c, g or t
  misc_feature (173)..(173): n is either a, c, g or t
  misc_feature (185)..(185): n is either a, c, g or t
  misc_feature (239)..(239): n is either a, c, g or t
  misc_feature (258)..(258): n is either a, c, g or t
  misc_feature (272)..(272): n is either a, c, g or t
  misc_feature (340)..(340): n is either a, c, g or t
tatcgacacgacgtaacgacaaaaaacgccaacgaacattctccgaacgcgaanacgaaacgcgcgaaaaacaatcgcgacgacgcgccaaaaaacntaacgacaaaaacgacgaaacaacgaaaaacgcgcaaaaaaccgcacaaataaaataaacgcgaatcgaaaaaaanccgaaaaaaaanaaaaaaaacgaaaaaaaaaaaaaaaaaaacaaaaacgacacgcaaaaacgccgnacgcaacgacgccccgacnaatacgacgaacantaacaaacgaaaaaaacgcgcgcaccaacgacgaaaaaacgccgaacactcaaaacacacgaaaacgnaaaaaacgaaacgaaacgacacacaaaacgcgaaaaacacaaaaaaaacaaacaacgcgcgcgcaccaacaaccacaaaaccgacacccgacgcgaaaaaaaacaccgaacaaaaaaaaccgaaaaacgaccgcaacgaaaaacgacgaaacgcaccaacaccaaaaaaccaaaaacgaaaaaacgaaaaacaaaaaacacgaacgaaaaaaaacgaaaaaaacgaaacaaaaaaacgcccgcgccaaaaaaaaaaaacaaaaaaaaacgaaaaaacaacaacgaaaaaaaaaacgaaacgcaacacaaaaaacacgaaaaaaaaaacaaaacaaaaaaacaaaaaaaaaaaaacgaccac

SEQ ID NO: 33571 - DNA, 701 bp, Artificial Sequence
  chemically treated genomic DNA (Homo sapiens) CpG-island No: 33571
  misc_feature (54)..(54): n is either a, c, g or t
  misc_feature (97)..(97): n is either a, c, g or t
  misc_feature (173)..(173): n is either a, c, g or t
  misc_feature (185)..(185): n is either a, c, g or t
  misc_feature (239)..(239): n is either a, c, g or t
  misc_feature (258)..(258): n is either a, c, g or t
  misc_feature (272)..(272): n is either a, c, g or t
  misc_feature (340)..(340): n is either a, c, g or t
tgtcgatacggcgtgacgatagagggcgttagcgagtatttttcgggcgcgganacgaagcgcgcgaaagatagtcgcggcggcgcgttaggggatntaacggtaagggcgacggagtaacgaaagacgcgtaagagatcgtatagatagaataggcgcggatcgaaggagantcgagagagganaagaaagacggagagaaaaggagaggagatagggacgatacgtaagagcgtcgngcgtagcggcgtttcgatngatgcggcgaatantggtaaacgagagaggcgcgcgtattaacgacgaggaagcgtcggatatttagaatatacgagagcgngagagacgaggcgaagcggtatataaagcgcggaaagtatagagaaaataggtagcgcgcgcgtattagtagttataaggtcgatattcggcgcggaggggagtatcgggtagagaggatcgagggacgatcgtagcgaggggcgacggagcgtattaatattaaagggttaagagcgggagggcggggaataagaaatacgaacggagaggggcgggaaaggcgagataaaagagcgttcgcgttaaaaagaaggaataaaaagaggcgggggagtaatagcgggaaggagggcgaagcgtagtatagaggatacggggaagaaaatagaataagaaaataaagaaaaaaagacgattat

SEQ ID NO: 33572 - DNA, 701 bp, Artificial Sequence
  chemically treated genomic DNA (Homo sapiens) CpG-island No: 33572
  misc_feature (362)..(362): n is either a, c, g or t
  misc_feature (430)..(430): n is either a, c, g or t
  misc_feature (444)..(444): n is either a, c, g or t
  misc_feature (463)..(463): n is either a, c, g or t
  misc_feature (517)..(517): n is either a, c, g or t
  misc_feature (529)..(529): n is either a, c, g or t
  misc_feature (605)..(605): n is either a, c, g or t
  misc_feature (648)..(648): n is either a, c, g or t
ataatcgtctttttttctttattttcttattctattttcttccccgtatcctctatactacgcttcgccctccttcccgctattactcccccgcctctttttattccttctttttaacgcgaacgctcttttatctcgcctttcccgcccctctccgttcgtatttcttattccccgccctcccgctcttaaccctttaatattaatacgctccgtcgcccctcgctacgatcgtccctcgatcctctctacccgatactcccctccgcgccgaatatcgaccttataactactaatacgcgcgcgctacctattttctctatactttccgcgctttatataccgcttcgcctcgtctctcncgctctcgtatattctaaatatccgacgcttcctcgtcgttaatacgcgcgcctctctcgtttaccantattcgccgcatcnatcgaaacgccgctacgcncgacgctcttacgtatcgtccctatctcctctccttttctctccgtctttcttntcctctctcgantctccttcgatccgcgcctattctatctatacgatctcttacgcgtctttcgttactccgtcgcccttaccgttanatcccctaacgcgccgccgcgactatctttcgcgcgcttcgtntccgcgcccgaaaaatactcgctaacgccctctatcgtcacgccgtatcgaca

SEQ ID NO: 33573 - DNA, 604 bp, Artificial Sequence
  chemically treated genomic DNA (Homo sapiens) CpG-island No: 33573
  misc_feature (292)..(292): n is either a, c, g or t
  misc_feature (312)..(312): n is either a, c, g or t
  misc_feature (410)..(410): n is either a, c, g or t
  misc_feature (435)..(435): n is either a, c, g or t
  misc_feature (563)..(563): n is either a, c, g or t
gggggggcgcggtttggtggttgcgcgtttgttcggttggtgcgcgtcgttcgcgtgtcgtgcgtgtttgtttttcgcgcggttgtgtttggttgttcgcgttttcgtcgttttggttcgggttggtgtttttgggcgttcgcgtttcgtcgttttcgttgcggttttttcgtcgtcgtttcgtgtgtgtgtgcggtgtgggcgtttttcggtcgttcgcgcgttcggttgtttttcggtgggttcgttttttttgcgtcgtattttttttgttcgttcgttcgtttttttngagtgtttcggtgcgggttntgtcgttttcgttgtcgtcgggtcgtgcgcgcgtgttcgtgttttcgttcgtttgtttgtttgtgtgcggtgtgcgttcgtggtttgcgttcgggcgntcgcgtttggcgcgcgtttttggtnttttttacgtttttttcgtttgtggttggttttgtttcgtcgtcgtgtcgtcgttcgcgtttcgttgcgggggtcgtgttgcgcgcgtttttttgttcgtttttttgttgtttgtttggttcgtttgnttttgggtttgcgtgttcgtcgtgtcggtttttcgtcgttg

SEQ ID NO: 33574 - DNA, 604 bp, Artificial Sequence
  chemically treated genomic DNA (Homo sapiens) CpG-island No: 33574
  misc_feature (42)..(42): n is either a, c, g or t
  misc_feature (170)..(170): n is either a, c, g or t
  misc_feature (195)..(195): n is either a, c, g or t
  misc_feature (293)..(293): n is either a, c, g or t
  misc_feature (313)..(313): n is either a, c, g or t
caacgacgaaaaaccgacacgacgaacacgcaaacccaaaancaaacgaaccaaacaaacaacaaaaaaacgaacaaaaaaacgcgcgcaacacgacccccgcaacgaaacgcgaacgacgacacgacgacgaaacaaaaccaaccacaaacgaaaaaaacgtaaaaaanaccaaaaacgcgcgccaaacgcgancgcccgaacgcaaaccacgaacgcacaccgcacacaaacaaacaaacgaacgaaaacacgaacacgcgcgcacgacccgacgacaacgaaaacgacanaacccgcaccgaaacactcnaaaaaaacgaacgaacgaacaaaaaaaatacgacgcaaaaaaaacgaacccaccgaaaaacaaccgaacgcgcgaacgaccgaaaaacgcccacaccgcacacacacacgaaacgacgacgaaaaaaccgcaacgaaaacgacgaaacgcgaacgcccaaaaacaccaacccgaaccaaaacgacgaaaacgcgaacaaccaaacacaaccgcgcgaaaaacaaacacgcacgacacgcgaacgacgcgcaccaaccgaacaaacgcgcaaccaccaaaccgcgccccccc

SEQ ID NO: 33575 - DNA, 604 bp, Artificial Sequence
  chemically treated genomic DNA (Homo sapiens) CpG-island No: 33575
  misc_feature (42)..(42): n is either a, c, g or t
  misc_feature (170)..(170): n is either a, c, g or t
  misc_feature (195)..(195): n is either a, c, g or t
  misc_feature (293)..(293): n is either a, c, g or t
  misc_feature (313)..(313): n is either a, c, g or t
tagcgacggagagtcggtacggcgaatacgtagatttaggantaggcgaattaaatagatagtaagggaacggataggaagacgcgcgtagtacgattttcgtagcgagacgcgggcgacgatacgacgacgaagtaagattaattatagacgaaagggacgtaaggggngttaggagcgcgcgttagacgcgancgttcggacgtaggttacgggcgtatatcgtatatagatagataggcgaacgaaagtacggatacgcgcgtacggttcgacgataacgggggcggtangattcgtatcggggtatttnaagagggcgggcgagcgggtaggaggagtgcgacgtaagggagacgaatttatcggggaataatcgagcgcgcgagcggtcgagggacgtttatatcgtatatatatacgggacggcgacgggggagtcgtagcggaagcggcggaacgcggacgtttaggggtattagttcgggttagggcgacggaggcgcgagtagttagatataatcgcgcgggggataagtacgtacggtacgcgggcgacgcgtattaatcgaataggcgcgtagttattaaatcgcgttttttt

SEQ ID NO: 33576 - DNA, 604 bp, Artificial Sequence
  chemically treated genomic DNA (Homo sapiens) CpG-island No: 33576
  misc_feature (292)..(292): n is either a, c, g or t
  misc_feature (312)..(312): n is either a, c, g or t
  misc_feature (410)..(410): n is either a, c, g or t
  misc_feature (435)..(435): n is either a, c, g or t
  misc_feature (563)..(563): n is either a, c, g or t
aaaaaaacgcgatttaataactacgcgcctattcgattaatacgcgtcgcccgcgtaccgtacgtacttatcccccgcgcgattatatctaactactcgcgcctccgtcgccctaacccgaactaatacccctaaacgtccgcgttccgccgcttccgctacgactcccccgtcgccgtcccgtatatatatacgatataaacgtccctcgaccgctcgcgcgctcgattattccccgataaattcgtctcccttacgtcgcactcctcctacccgctcgcccgccctcttnaaataccccgatacgaatcntaccgcccccgttatcgtcgaaccgtacgcgcgtatccgtactttcgttcgcctatctatctatatacgatatacgcccgtaacctacgtccgaacgntcgcgtctaacgcgcgctcctaacnccccttacgtccctttcgtctataattaatcttacttcgtcgtcgtatcgtcgcccgcgtctcgctacgaaaatcgtactacgcgcgtcttcctatccgttcccttactatctatttaattcgcctantcctaaatctacgtattcgccgtaccgactctccgtcgcta

SEQ ID NO: 33577 - DNA, 555 bp, Artificial Sequence
  chemically treated genomic DNA (Homo sapiens) CpG-island No: 33577
gttgcggcggtttcgtttttgtcgtcgcgggtcgggtcgcggttggcgtttgttgggtcgtcggattgtttgggttttttttttcgtgtgcgtcgcgtacgtcgttttttgttttttttgttcgcgtttttcgttttggttttttggttttcgtcgggttttttttttgttgttttttgcgggcgtttgtttttttttcgcggagtgttgcggggttcgtttcgtgtcgcgcgttcgttggttttcgtgtgtttttcgtttcgtttgttggtcgggtttgggcgtttagcgcgtttcggtgcggcggcgtgtggtcgttttaggaggcgtgttttcgttcgcgtcgtcggggtgttgtgtcgcgtgtttttgttcgtgttcgtttttttacgttcgcgtgcgcgttttacgcgtttgtaggttggcgcgcggtttttattgatgtgttaggcgcgggtttttacggtggttttttgtttgcgtgggcgtggtttggtcgtgttttcgtttgttcgttgtggttgtcgcggttaggtcgcggtgttttcgttttag

SEQ ID NO: 33578 - DNA, 555 bp, Artificial Sequence
  chemically treated genomic DNA (Homo sapiens) CpG-island No: 33578
ctaaaacgaaaacaccgcgacctaaccgcgacaaccacaacgaacaaacgaaaacacgaccaaaccacgcccacgcaaacaaaaaaccaccgtaaaaacccgcgcctaacacatcaataaaaaccgcgcgccaacctacaaacgcgtaaaacgcgcacgcgaacgtaaaaaaacgaacacgaacaaaaacacgcgacacaacaccccgacgacgcgaacgaaaacacgcctcctaaaacgaccacacgccgccgcaccgaaacgcgctaaacgcccaaacccgaccaacaaacgaaacgaaaaacacacgaaaaccaacgaacgcgcgacacgaaacgaaccccgcaacactccgcgaaaaaaaaacaaacgcccgcaaaaaacaacaaaaaaaaaacccgacgaaaaccaaaaaaccaaaacgaaaaacgcgaacaaaaaaaacaaaaaacgacgtacgcgacgcacacgaaaaaaaaaacccaaacaatccgacgacccaacaaacgccaaccgcgacccgacccgcgacgacaaaaacgaaaccgccgcaac

SEQ ID NO: 33579 - DNA, 555 bp, Artificial Sequence
  chemically treated genomic DNA (Homo sapiens) CpG-island No: 33579
ttgaggcggagatatcgcggtttaatcgcggtagttatagcggatagacgggggtacggttaagttacgtttacgtaggtaggagattatcgtgaaggttcgcgtttgatatattaataagaatcgcgcgttagtttatagacgcgtagaacgcgtacgcgaacgtggggaggcgaatacggataagagtacgcgatataatatttcggcgacgcgggcgggagtacgttttttaggacggttatacgtcgtcgtatcgagacgcgttaagcgtttagattcgattaataaacgagacgggggatatacgagggttagcgagcgcgcggtacgaggcgagtttcgtagtatttcgcgggagggggatagacgttcgtaaagagtaataggaaaggggttcggcgaaagttaggaaattagggcggggggcgcgagtaagaaagatagagagcggcgtacgcgacgtatacgaggggagggatttaagtaattcggcgatttagtaagcgttagtcgcggttcgattcgcggcggtaagaacggggtcgtcgtagt

SEQ ID NO: 33580 - DNA, 555 bp, Artificial Sequence
  chemically treated genomic DNA (Homo sapiens) CpG-island No: 33580
actacgacgaccccgttcttaccgccgcgaatcgaaccgcgactaacgcttactaaatcgccgaattacttaaatccctcccctcgtatacgtcgcgtacgccgctctctatctttcttactcgcgccccccgccctaatttcctaactttcgccgaacccctttcctattactctttacgaacgtctatccccctcccgcgaaatactacgaaactcgcctcgtaccgcgcgctcgctaaccctcgtatatcccccgtctcgtttattaatcgaatctaaacgcttaacgcgtctcgatacgacgacgtataaccgtcctaaaaaacgtactcccgcccgcgtcgccgaaatattatatcgcgtactcttatccgtattcgcctccccacgttcgcgtacgcgttctacgcgtctataaactaacgcgcgattcttattaatatatcaaacgcgaaccttcacgataatctcctacctacgtaaacgtaacttaaccgtacccccgtctatccgctataactaccgcgattaaaccgcgatatctccgcctcaa

SEQ ID NO: 33581 - DNA, 594 bp, Artificial Sequence
  chemically treated genomic DNA (Homo sapiens) CpG-island No: 33581
tgtattattcgattatatttacgtattgcggtttttttatatgtttcgtttatcggtatttttaacgttttattttatagggttttagtatcgacgcgttgattttcgattttttttttatttttattattttcgtcgttttattttatttatttcgtcgtattttttttttttattttttttaattttttttttatattttttttatttttttattttttcgtttttttttttttcgatttcgtttatttcgttttttttttttattttttatttttttttttttttttttattttttttagtttatatttattttttttttttcgttttttattatttttttttatttatttcgttttttttcgtttttttttcgtttttttatttttttttattttttttttttttttttttttttttttcgttagttttcgtttcgtcgtttatttttttacgtttttcgttttttttttgtttttcgtttttcgttatttttcgttattgtaatttttcgcgtttaatattgtttttagtttttttcgtagttttttttcgatttcgcggtcggttttttcgttcgatttttttttatt

SEQ ID NO: 33582 - DNA, 594 bp, Artificial Sequence
  chemically treated genomic DNA (Homo sapiens) CpG-island No: 33582
aataaaaaaaaatcgaacgaaaaaaccgaccgcgaaatcgaaaaaaaactacgaaaaaaactaaaaacaatattaaacgcgaaaaattacaataacgaaaaataacgaaaaacgaaaaacaaaaaaaaaacgaaaaacgtaaaaaaataaacgacgaaacgaaaactaacgaaaaaaaaaaaaaaaaaaaaaaaaaaaataaaaaaaaataaaaaaacgaaaaaaaaacgaaaaaaaacgaaataaataaaaaaaaataataaaaaacgaaaaaaaaaaaataaatataaactaaaaaaaataaaaaaaaaaaaaaaaaaataaaaaataaaaaaaaaaaacgaaataaacgaaatcgaaaaaaaaaaaaacgaaaaaataaaaaaataaaaaaaatataaaaaaaaaattaaaaaaaataaaaaaaaaaaatacgacgaaataaataaaataaaacgacgaaaataataaaaataaaaaaaaaatcgaaaatcaacgcgtcgatactaaaaccctataaaataaaacgttaaaaataccgataaacgaaacatataaaaaaaccgcaatacgtaaatataatcgaataataca

SEQ ID NO: 33583 - DNA, 594 bp, Artificial Sequence
  chemically treated genomic DNA (Homo sapiens) CpG-island No: 33583
ggtggggaaaaatcggacgggagagtcgatcgcgagatcgggggggggttacggggaggattgggaatagtattgggcgcgggggattgtaatggcgagaaatggcggggggcgaaaagtaaaaaaggagcgggggacgtgggaaggtaaacggcggggcggggattggcgaaaaagggggggggggggggggggaaggtgggggggaatgggggggcgggaaaggggcgggggggggcggaataaatggaggggggtggtggggggcgaagagggaagggtgggtatggattagaggaaatggggggggggaggggggaatggggggtgaaaggggggggcgaaatgagcggggtcggggaaagaaaaggcgaaaaaataggggggtgggggggatataggggggaagttggaaagggtggggggggggggtacgacggaatggatggggtggggcggcggggatggtggggataaaaaggaaatcggggattagcgcgtcggtgttggggttttataggatgggacgttgggaatgtcgatggacggaatatgtggggaagtcgtagtgcgtaggtgtagtcggatggtgta

SEQ ID NO: 33584 - DNA, 594 bp, Artificial Sequence
  chemically treated genomic DNA (Homo sapiens) CpG-island No: 33584
tacaccatccgactacacctacgcactacgacttccccacatattccgtccatcgacattcccaacgtcccatcctataaaaccccaacaccgacgcgctaatccccgatttcctttttatccccaccatccccgccgccccaccccatccattccgtcgtaccccccccccccaccctttccaacttcccccctatatcccccccacccccctattttttcgccttttctttccccgaccccgctcatttcgcccccccctttcaccccccattcccccctccccccccccatttcctctaatccatacccacccttccctcttcgccccccaccacccccctccatttattccgcccccccccgcccctttcccgcccccccattcccccccaccttccccccccccccccccccctttttcgccaatccccgccccgccgtttaccttcccacgtcccccgctccttttttacttttcgccccccgccatttctcgccattacaatcccccgcgcccaatactattcccaatcctccccgtaacccccccccgatctcgcgatcgactctcccgtccgatttttccccacc

SEQ ID NO: 33585 - DNA, 576 bp, Artificial Sequence
  chemically treated genomic DNA (Homo sapiens) CpG-island No: 33585
gggtttcggggcgtatggttttatacggaggatttttcggtggttttttttcgggtggagagtgcgggggagggcgtgcgggtgggtgttatggcggaaggttttgttacggtggtcgttagtttttcggttcgttcgtcgttcgtgtgacgttcggttttttgatattatttttcggatcgtgcgcgcgggtcggttttcggtgcggtcgagttgtgtgtgtggggggggttcgttcgtatcgttttttcgtttcggttttttagtcgttttatatttagtttgattcgtttatcgtttttttttttattttcgtacggtatgttttttttttttagtatggttattcgtttttattcgtggggtcggattatcgtgtttttagtatattaggcgatttcgtgttttcgcggatcgagtttcgatacgcggtcgcggattgttttttatcgcgtttttttgtcgatttggatcgttgcgcggtgcgcgttatcgattcggtagcgcgcggcggtgggtcgggttattcgttttcgtagttattatattcgcgattacgtcgcgaagtttttattt

SEQ ID NO: 33586 - DNA, 576 bp, Artificial Sequence
  chemically treated genomic DNA (Homo sapiens) CpG-island No: 33586
aaataaaaacttcgcgacgtaatcgcgaatataataactacgaaaacgaataacccgacccaccgccgcgcgctaccgaatcgataacgcgcaccgcgcaacgatccaaatcgacaaaaaaacgcgataaaaaacaatccgcgaccgcgtatcgaaactcgatccgcgaaaacacgaaatcgcctaatatactaaaaacacgataatccgaccccacgaataaaaacgaataaccatactaaaaaaaaaaaacataccgtacgaaaataaaaaaaaaaacgataaacgaatcaaactaaatataaaacgactaaaaaaccgaaacgaaaaaacgatacgaacgaaccccccccacacacacaactcgaccgcaccgaaaaccgacccgcgcgcacgatccgaaaaataatatcaaaaaaccgaacgtcacacgaacgacgaacgaaccgaaaaactaacgaccaccgtaacaaaaccttccgccataacacccacccgcacgccctcccccgcactctccacccgaaaaaaaaccaccgaaaaatcctccgtataaaaccatacgccccgaaaccc

SEQ ID NO: 33587 - DNA, 576 bp, Artificial Sequence
  chemically treated genomic DNA (Homo sapiens) CpG-island No: 33587
aaatggggatttcgcggcgtggtcgcgggtatgatggttgcgggaacgagtggttcggtttatcgtcgcgcgttgtcgggtcggtaacgcgtatcgcgtaacggtttaaatcgataggggagcgcggtgggggataattcgcggtcgcgtgtcggggttcgattcgcggggatacggaatcgtttggtgtattagaggtacggtggttcggttttacggatggaggcggataattatgttggggagggaggatatatcgtgcggaaatgggggggggggcggtggacgagttaggttgggtatgggacggttgaggggtcggggcgggggggcggtgcggacgggttttttttatatatataattcggtcgtatcgggggtcggttcgcgcgtacggttcggggggtagtgttaggggatcgggcgttatacgagcggcgggcggatcgggaggttgacgattatcgtgatagggtttttcgttatagtatttattcgtacgttttttttcgtattttttattcggaagaaggttatcggggggtttttcgtgtagagttatgcgtttcggggttt

SEQ ID NO: 33588 - DNA, 576 bp, Artificial Sequence
  chemically treated genomic DNA (Homo sapiens) CpG-island No: 33588
aaaccccgaaacgcataactctacacgaaaaaccccccgataaccttcttccgaataaaaaatacgaaaaaaaacgtacgaataaatactataacgaaaaaccctatcacgataatcgtcaacctcccgatccgcccgccgctcgtataacgcccgatcccctaacactaccccccgaaccgtacgcgcgaaccgacccccgatacgaccgaattatatatataaaaaaaacccgtccgcaccgcccccccgccccgacccctcaaccgtcccatacccaacctaactcgtccaccgcccccccccccatttccgcacgatatatcctccctccccaacataattatccgcctccatccgtaaaaccgaaccaccgtacctctaatacaccaaacgattccgtatccccgcgaatcgaaccccgacacgcgaccgcgaattatcccccaccgcgctcccctatcgatttaaaccgttacgcgatacgcgttaccgacccgacaacgcgcgacgataaaccgaaccactcgttcccgcaaccatcatacccgcgaccacgccgcgaaatccccattt

SEQ ID NO: 33589 - DNA, 716 bp, Artificial Sequence
  chemically treated genomic DNA (Homo sapiens) CpG-island No: 33589
ttggtcggtcgttgtggttggggtcggttaagtcgaatatcggttatacgtaagcggcggcgggtgtggttggtgtgattaagatggtgatggcgatgcggtacgggtagttgttacgtacgttgtacgtggaatcgtcgtcgtcggaggtggattggtcggcggggacggtttaattttttacggagaatacgttttggtttaggagtggtcgtgttcgtcgggtgggggtgtcgtcgttcgggattagtggtattaacgcgtacgttattttcgaatagttttcgggagtgtcgagttagtttgcggggtcgggttcgggttttgtcgtggatgtttcggtggtgtcgtggatggtgtcgggtaaaatattcgaagcgttattcgcgtaggtaacggcgttgatgatttatttggacgagcgatttgatgttttttcgttggatgttgggtattcgttggcgttgatacggtcggcgttggatgagcgagcggtggtgttggggtcggatcgtgaaacgttgttgtgcggtgtgaaagcgttgtttgtcggttatgaggtttttgggttggtgatcggatttgtgggggttgggggtcgtatcggttttggttttttcggttcggcgggtattggtttgggatggtttcggggtttatcgggtttttcggtgttcgttggtgtttttgttaaatttgggttatttggggtttat

SEQ ID NO: 33590 - DNA, 716 bp, Artificial Sequence
  chemically treated genomic DNA (Homo sapiens) CpG-island No: 33590
ataaaccccaaataacccaaatttaacaaaaacaccaacgaacaccgaaaaacccgataaaccccgaaaccatcccaaaccaatacccgccgaaccgaaaaaaccaaaaccgatacgacccccaacccccacaaatccgatcaccaacccaaaaacctcataaccgacaaacaacgctttcacaccgcacaacaacgtttcacgatccgaccccaacaccaccgctcgctcatccaacgccgaccgtatcaacgccaacgaatacccaacatccaacgaaaaaacatcaaatcgctcgtccaaataaatcatcaacgccgttacctacgcgaataacgcttcgaatattttacccgacaccatccacgacaccaccgaaacatccacgacaaaacccgaacccgaccccgcaaactaactcgacactcccgaaaactattcgaaaataacgtacgcgttaataccactaatcccgaacgacgacacccccacccgacgaacacgaccactcctaaaccaaaacgtattctccgtaaaaaattaaaccgtccccgccgaccaatccacctccgacgacgacgattccacgtacaacgtacgtaacaactacccgtaccgcatcgccatcaccatcttaatcacaccaaccacacccgccgccgcttacgtataaccgatattcgacttaaccgaccccaaccacaacgaccgaccaa

SEQ ID NO: 33591 - DNA, 716 bp, Artificial Sequence
  chemically treated genomic DNA (Homo sapiens) CpG-island No: 33591
atgggttttaggtggtttaagtttggtaagagtattaacgaatatcggaaagttcggtaagtttcggggttattttaagttaatgttcgtcgggtcggaaaaattaaaatcgatgcggtttttagtttttatagattcggttattaatttagaagttttatgatcggtagatagcgtttttatatcgtataataacgttttacggttcgattttagtattatcgttcgtttatttagcgtcgatcgtgttaacgttagcgagtatttaatatttagcgaggagatattaggtcgttcgtttagataggttattaacgtcgttgtttgcgcggatagcgtttcgggtgttttgttcgatattatttacggtattatcggaatatttacgatagaattcgaattcggtttcgtagattgattcggtattttcgggggttgttcgaggatgacgtgcgcgttagtattattgatttcgaacgacgatatttttattcgacgaatacgattatttttgggttagggcgtgtttttcgtaaggagttgaatcgttttcgtcgattaatttattttcggcgacggcgattttacgtgtaacgtgcgtggtagttgttcgtgtcgtatcgttattattattttgattatattagttatattcgtcgtcgtttgcgtatgatcgatgttcgatttgatcgattttaattataacggtcggttag

SEQ ID NO: 33592 - DNA, 716 bp, Artificial Sequence
  chemically treated genomic DNA (Homo sapiens) CpG-island No: 33592
ctaaccgaccgttataattaaaatcgatcaaatcgaacatcgatcatacgcaaacgacgacgaatataactaatataatcaaaataataataacgatacgacacgaacaactaccacgcacgttacacgtaaaatcgccgtcgccgaaaataaattaatcgacgaaaacgattcaactccttacgaaaaacacgccctaacccaaaaataatcgtattcgtcgaataaaaatatcgtcgttcgaaatcaataatactaacgcgcacgtcatcctcgaacaacccccgaaaataccgaatcaatctacgaaaccgaattcgaattctatcgtaaatattccgataataccgtaaataatatcgaacaaaacacccgaaacgctatccgcgcaaacaacgacgttaataacctatctaaacgaacgacctaatatctcctcgctaaatattaaatactcgctaacgttaacacgatcgacgctaaataaacgaacgataatactaaaatcgaaccgtaaaacgttattatacgatataaaaacgctatctaccgatcataaaacttctaaattaataaccgaatctataaaaactaaaaaccgcatcgattttaatttttccgacccgacgaacattaacttaaaataaccccgaaacttaccgaactttccgatattcgttaatactcttaccaaacttaaaccacctaaaacccat

SEQ ID NO: 33593 - DNA, 601 bp, Artificial Sequence
  chemically treated genomic DNA (Homo sapiens) CpG-island No: 33593
tatacgtaagcggcggcgggtgtggttggtgtgattaagatggtgatggcgatgcggtacgggtagttgttacgtacgttgtacgtggaatcgtcgtcgtcggaggtggattggtcggcggggacggtttaattttttacggagaatacgttttggtttaggagtggtcgtgttcgtcgggtgggggtgtcgtcgttcgggattagtggtattaacgcgtacgttattttcgaatagttttcgggagtgtcgagttagtttgcggggtcgggttcgggttttgtcgtggatgtttcggtggtgtcgtggatggtgtcgggtaaaatattcgaagcgttattcgcgtaggtaacggcgttgatgatttatttggacgagcgatttgatgttttttcgttggatgttgggtattcgttggcgttgatacggtcggcgttggatgagcgagcggtggggttggggtcggatcgtgaaacgttgttgtgcggtgtgaaagggatgtttgtcggttatgaggtttttgggtggggatcgatatgggggggttgggggtcggaatggttttgggttttaggagaggggggaagtggttgggttaggg

SEQ ID NO: 33594 - DNA, 601 bp, Artificial Sequence
  chemically treated genomic DNA (Homo sapiens) CpG-island No: 33594
ccctaacccaaccacttcccccctctcctaaaacccaaaaccattccgacccccaacccccccatatcgatccccacccaaaaacctcataaccgacaaacatccctttcacaccgcacaacaacgtttcacgatccgaccccaaccccaccgctcgctcatccaacgccgaccgtatcaacgccaacgaatacccaacatccaacgaaaaaacatcaaatcgctcgtccaaataaatcatcaacgccgttacctacgcgaataacgcttcgaatattttacccgacaccatccacgacaccaccgaaacatccacgacaaaacccgaacccgaccccgcaaactaactcgacactcccgaaaactattcgaaaataacgtacgcgttaataccactaatcccgaacgacgacacccccacccgacgaacacgaccactcctaaaccaaaacgtattctccgtaaaaaattaaaccgtccccgccgaccaatccacctccgacgacgacgattccacgtacaacgtacgtaacaactacccgtaccgcatcgccatcaccatcttaatcacaccaaccacacccgccgccgcttacgtata

SEQ ID NO: 33595 - DNA, 601 bp, Artificial Sequence
  chemically treated genomic DNA (Homo sapiens) CpG-island No: 33595
ttttaatttaattatttttttttttttttaaaatttaaaattatttcggtttttagtttttttatatcggtttttatttaaaagttttatgatcggtaaatattttttttatatcgtataataacgttttacggttcgattttagttttatcgttcgtttatttagcgtcgatcgtgttaacgttagcgagtatttaatatttagcgaggagatattaggtcgttcgtttagataggttattaacgtcgttgtttgcgcggatagcgtttcgggtgttttgttcgatattatttacggtattatcggaatatttacgatagaattcgaattcggtttcgtagattgattcggtattttcgggggttgttcgaggatgacgtgcgcgttagtattattgatttcgaacgacgatatttttattcgacgaatacgattatttttgggttagggcgtgtttttcgtaaggagttgaatcgttttcgtcgattaatttattttcggcgacggcgattttacgtgtaacgtgcgtggtagttgttcgtgtcgtatcgttattattattttgattatattagttatattcgtcgtcgtttgcgtatg

SEQ ID NO: 33596 - DNA, 601 bp, Artificial Sequence
  chemically treated genomic DNA (Homo sapiens) CpG-island No: 33596
catacgcaaacgacgacgaatataactaatataatcaaaataataataacgatacgacacgaacaactaccacgcacgttacacgtaaaatcgccgtcgccgaaaataaattaatcgacgaaaacgattcaactccttacgaaaaacacgccctaacccaaaaataatcgtattcgtcgaataaaaatatcgtcgttcgaaatcaataatactaacgcgcacgtcatcctcgaacaacccccgaaaataccgaatcaatctacgaaaccgaattcgaattctatcgtaaatattccgataataccgtaaataatatcgaacaaaacacccgaaacgctatccgcgcaaacaacgacgttaataacctatctaaacgaacgacctaatatctcctcgctaaatattaaatactcgctaacgttaacacgatcgacgctaaataaacgaacgataaaactaaaatcgaaccgtaaaacgttattatacgatataaaaaaaatatttaccgatcataaaacttttaaataaaaaccgatataaaaaaactaaaaaccgaaataattttaaattttaaaaaaaaaaaaaaataattaaattaaaa

SEQ ID NO: 33597 - DNA, 537 bp, Artificial Sequence
  chemically treated genomic DNA (Homo sapiens) CpG-island No: 33597
  misc_feature (226)..(226): n is either a, c, g or t
tttttttttttttttttttttttttttttttttttttttttttttttttaatcggtcgttgtttgcgttgtttttgttttttttcgttttttttttttcgcgttgtgttttttttgttcgtcggtttcgttcgcggtttttgcgcgtttttgcggttcgtttcgcggttcgtcgttcgttttttttgttttgttttttgttttcgcgttttgttttcgggcgcggnggttttttcgttgttttttgtttttcgtcgggggggttttcgggtgtttttgtcgggtttcgtgtcgttgttttttttttcgtcgttttcgcgcgtgtttgggtcgtcggcgcgttcgggtttttcgtgttttcgggcgtttcgttttttcgtttcgcgcgtggtcggttgtcgttttgcgcgttttttttttcggtcgcgttgcggtcgttttcgcgcgttgtttcgtttttttcgttttttttttttttcgcgtcgtgggtcggtgtcggtttgttgtttttcgttggtcggtttcggcgggtgcgttg

SEQ ID NO: 33598 - DNA, 537 bp, Artificial Sequence
  chemically treated genomic DNA (Homo sapiens) CpG-island No: 33598
  misc_feature (312)..(312): n is either a, c, g or t
caacgcacccgccgaaaccgaccaacgaaaaacaacaaaccgacaccgacccacgacgcgaaaaaaaaaaaaaacgaaaaaaacgaaacaacgcgcgaaaacgaccgcaacgcgaccgaaaaaaaaaacgcgcaaaacgacaaccgaccacgcgcgaaacgaaaaaacgaaacgcccgaaaacacgaaaaacccgaacgcgccgacgacccaaacacgcgcgaaaacgacgaaaaaaaaaacaacgacacgaaacccgacaaaaacacccgaaaacccccccgacgaaaaacaaaaaacaacgaaaaaaccnccgcgcccgaaaacaaaacgcgaaaacaaaaaacaaaacaaaaaaaacgaacgacgaaccgcgaaacgaaccgcaaaaacgcgcaaaaaccgcgaacgaaaccgacgaacaaaaaaaacacaacgcgaaaaaaaaaaaacgaaaaaaaacaaaaacaacgcaaacaacgaccgattaaaaaaaaaaaaaaaaaaaaaaaaaaaaaaaaaaaaaaaaaaaaaaaaa

SEQ ID NO: 33599 - DNA, 537 bp, Artificial Sequence
  chemically treated genomic DNA (Homo sapiens) CpG-island No: 33599
  misc_feature (312)..(312): n is either a, c, g or t
tagcgtattcgtcgagatcggttaacgggaggtagtaggtcgatatcggtttacgacgcggggaaagggagagacgaggggaacgagatagcgcgcgagggcggtcgtagcgcgatcgagggaaaaaacgcgtagagcgataatcgattacgcgcggggcgggagagcgagacgttcgagggtacgaagagttcgggcgcgtcgacggtttaggtacgcgcgagggcgacgggagggagggtagcggtacggagttcggtagaagtattcgagggttttttcggcgggaaataggggataacgaggaggttntcgcgttcgaggatagagcgcgggagtaagagataaggtagaggggacgggcggcggatcgcggggcgggtcgtaagggcgcgtaggggtcgcgggcgaggtcggcgagtaaggagggtataacgcggggggaaagaaacgagggaaggtaagggtagcgtaggtaacggtcggttaaggggaaggggaaggggaaggggaaggggaagggaaaggggaagggaa

SEQ ID NO: 33600 - DNA, 537 bp, Artificial Sequence
  chemically treated genomic DNA (Homo sapiens) CpG-island No: 33600
  misc_feature (226)..(226): n is either a, c, g or t
ttcccttcccctttcccttccccttccccttccccttccccttccccttaaccgaccgttacctacgctacccttaccttccctcgtttctttccccccgcgttataccctccttactcgccgacctcgcccgcgacccctacgcgcccttacgacccgccccgcgatccgccgcccgtcccctctaccttatctcttactcccgcgctctatcctcgaacgcganaacctcctcgttatcccctatttcccgccgaaaaaaccctcgaatacttctaccgaactccgtaccgctaccctccctcccgtcgccctcgcgcgtacctaaaccgtcgacgcgcccgaactcttcgtaccctcgaacgtctcgctctcccgccccgcgcgtaatcgattatcgctctacgcgttttttccctcgatcgcgctacgaccgccctcgcgcgctatctcgttcccctcgtctctccctttccccgcgtcgtaaaccgatatcgacctactacctcccgttaaccgatctcgacgaatacgcta

SEQ ID NO: 33601 - DNA, 560 bp, Artificial Sequence
  chemically treated genomic DNA (Homo sapiens) CpG-island No: 33601
cgttatttttttgatttgttttcgacgcgcgttgacgttagcggcgagatgttaatggattttgtattttttttgtttatatgatgttttatatcgttattcgtttttattttttattttcgcgtttcgtcgcgcgtttttttttttttttcgtgtgttttcgggcgttcgatcgtcgtcgttcgatttcgttttttttttttttcggtatgttttcggttcgtttcgtttttgtggttatttggtagtatcgtgtagtgttgtttgcgattgaacggttcgttttgcgtcgcgcgtttcgtttttattttttcgttaattttggtacgtttttcgtcgtattttacgattttcgttttcgcgcgtttcgcgtttttttttttattcgattagattttcgttgttcgttttttcgttttcgtaatattcgttattttttttcgcgttttttttttatttttttatacgtatttttttcgtttatgttcgcgcgtgtttagtttattttttcgtttttcgtcgggtttgtatatgaaggttttgttattggtttacgttaa

SEQ ID NO: 33602 - DNA, 560 bp, Artificial Sequence
  chemically treated genomic DNA (Homo sapiens) CpG-island No: 33602
ttaacgtaaaccaataacaaaaccttcatatacaaacccgacgaaaaacgaaaaaataaactaaacacgcgcgaacataaacgaaaaaaatacgtataaaaaaataaaaaaaaaacgcgaaaaaaaataacgaatattacgaaaacgaaaaaacgaacaacgaaaatctaatcgaataaaaaaaaaaacgcgaaacgcgcgaaaacgaaaatcgtaaaatacgacgaaaaacgtaccaaaattaacgaaaaaataaaaacgaaacgcgcgacgcaaaacgaaccgttcaatcgcaaacaacactacacgatactaccaaataaccacaaaaacgaaacgaaccgaaaacataccgaaaaaaaaaaaaaacgaaatcgaacgacgacgatcgaacgcccgaaaacacacgaaaaaaaaaaaaaaacgcgcgacgaaacgcgaaaataaaaaataaaaacgaataacgatataaaacatcatataaacaaaaaaaatacaaaatccattaacatctcgccgctaacgtcaacgcgcgtcgaaaacaaatcaaaaaaataacg

SEQ ID NO: 33603 - DNA, 560 bp, Artificial Sequence
  chemically treated genomic DNA (Homo sapiens) CpG-island No: 33603
ttggcgtgaattagtgatagggtttttatgtgtagattcggcgaggggcgggggggtgagttggatacgcgcgggtatgggcgagggggatacgtatagaggagtaaagggggagcgcgggggggggtagcgagtattgcgagggcgagagggcggatagcgggggtttggtcgggtggggggggggacgcggggcgcgcgggagcgggggtcgtggggtgcggcgaggggcgtgttagggttggcggaagggtgggggcgaggcgcgcgacgtagggcgggtcgtttaatcgtaggtaatattgtacggtgttgttaggtggttataggggcggaacgggtcgggggtatgtcggggagggggggggacggggtcgggcgacggcggtcgggcgttcgagggtatacggggaaggaaggggagcgcgcggcgggacgcggaagtgaggggtaggagcgggtgacgatataaggtattatgtgggtaggaggggtgtaaggtttattggtatttcgtcgttagcgttaacgcgcgtcggagataaattaagaaagtggcg

SEQ ID NO: 33604 - DNA, 560 bp, Artificial Sequence
  chemically treated genomic DNA (Homo sapiens) CpG-island No: 33604
cgccactttcttaatttatctccgacgcgcgttaacgctaacgacgaaataccaataaaccttacacccctcctacccacataataccttatatcgtcacccgctcctacccctcacttccgcgtcccgccgcgcgctccccttccttccccgtataccctcgaacgcccgaccgccgtcgcccgaccccgtccccccccctccccgacatacccccgacccgttccgcccctataaccacctaacaacaccgtacaatattacctacgattaaacgacccgccctacgtcgcgcgcctcgcccccacccttccgccaaccctaacacgcccctcgccgcaccccacgacccccgctcccgcgcgccccgcgtccccccccccacccgaccaaacccccgctatccgccctctcgccctcgcaatactcgctacccccccccgcgctccccctttactcctctatacgtatccccctcgcccatacccgcgcgtatccaactcacccccccgcccctcgccgaatctacacataaaaaccctatcactaattcacgccaa

SEQ ID NO: 33605 - DNA, 785 bp, Artificial Sequence
  chemically treated genomic DNA (Homo sapiens) CpG-island No: 33605
  misc_feature (547)..(547): n is either a, c, g or t
  misc_feature (649)..(649): n is either a, c, g or t
  misc_feature (660)..(660): n is either a, c, g or t
attcggttggtgggagttacggcgattttttcgtcgtcgtcgaaggttcgtagtaatgaaaatttcgataaaatagatatgtttttgggtgaggggtcgagttggatcgagttggagtgcgggggagggcgcgggtggaagtcggcggcgcggtttgtgggggtaggggcggtcggtagtagttgtcggcggagttttttcgttggtgggcggattcgagcggaggttcggaggatagtcgggagcgtaggttcgacgttaggtgttcggttggatcgcgagggattcgggcgttttttcggtcgcggtagtcggaggaggggttgtggaggcgggggtaggggcgttgcgggttcgaaggttcgtagggtcgcggggggcgtttttttttttcggaggggttacggttcgtcgttcgtcggttttttgtgaggaaagatttgtcggttttttcggagcgcgttcgcggtgggcgttatcggggagcgaggggaatggttcgatcgagtcgttttttttgaagaaaggtttggagagttcggtcggngttgcggtcggttaaattagcgttttcggagttttttttggtcgtcgggcgttttaggtcggcgtcggttatggttgtcggtcgcgattttcggggttattnttcgtcgcggnttcggagcgtttgttaaaaagaagtagcgttcggtcgttgtggatgtcgttgggtatgagcgttgttagaaaatatagttttttttttaggtttagattagttaatggggagaaagaaatatttt

SEQ ID NO: 33606 - DNA, 785 bp, Artificial Sequence
  chemically treated genomic DNA (Homo sapiens) CpG-island No: 33606
  misc_feature (126)..(126): n is either a, c, g or t
  misc_feature (137)..(137): n is either a, c, g or t
  misc_feature (239)..(239): n is either a, c, g or t
aaaatatttctttctccccattaactaatctaaacctaaaaaaaaaactatattttctaacaacgctcatacccaacgacatccacaacgaccgaacgctacttctttttaacaaacgctccgaanccgcgacgaanaataaccccgaaaatcgcgaccgacaaccataaccgacgccgacctaaaacgcccgacgaccaaaaaaaactccgaaaacgctaatttaaccgaccgcaacnccgaccgaactctccaaacctttcttcaaaaaaaacgactcgatcgaaccattcccctcgctccccgataacgcccaccgcgaacgcgctccgaaaaaaccgacaaatctttcctcacaaaaaaccgacgaacgacgaaccgtaacccctccgaaaaaaaaaaacgccccccgcgaccctacgaaccttcgaacccgcaacgcccctacccccgcctccacaacccctcctccgactaccgcgaccgaaaaaacgcccgaatccctcgcgatccaaccgaacacctaacgtcgaacctacgctcccgactatcctccgaacctccgctcgaatccgcccaccaacgaaaaaactccgccgacaactactaccgaccgcccctacccccacaaaccgcgccgccgacttccacccgcgccctcccccgcactccaactcgatccaactcgacccctcacccaaaaacatatctattttatcgaaattttcattactacgaaccttcgacgacgacgaaaaaatcgccgtaactcccaccaaccgaat

SEQ ID NO: 33607 - DNA, 785 bp, Artificial Sequence
  chemically treated genomic DNA (Homo sapiens) CpG-island No: 33607
  misc_feature (126)..(126): n is either a, c, g or t
  misc_feature (137)..(137): n is either a, c, g or t
  misc_feature (239)..(239): n is either a, c, g or t
agaatgtttttttttttttattagttagtttgagtttggagaggagattgtgttttttagtagcgtttatatttaacgatatttatagcggtcgagcgttgtttttttttgatagacgtttcgggntcgcggcgganggtggtttcgagagtcgcggtcggtagttatggtcggcgtcggtttgaaacgttcggcgattagggaaagtttcggaagcgttggtttaatcgatcgtagtntcggtcgggttttttagatttttttttagagagaacggttcggtcggattatttttttcgtttttcgataacgtttatcgcgaacgcgtttcggggaaatcggtagatttttttttataaagagtcggcgagcggcgagtcgtagttttttcggggagaagagacgtttttcgcgattttgcgaattttcgggttcgtagcgtttttgttttcgtttttatagtttttttttcgattgtcgcggtcgaggggacgttcgggtttttcgcggtttagtcgggtatttggcgtcgagtttgcgttttcggttgtttttcgggttttcgttcgggttcgtttattagcgagaaaatttcgtcggtaattgttgtcgatcgtttttgtttttataaatcgcgtcgtcggtttttattcgcgttttttttcgtattttaattcggtttaattcggttttttatttaaagatatatttattttgtcgaggtttttattgttgcgggttttcggcggcggcgaagaagtcgtcgtggtttttattaatcgggt

SEQ ID NO: 33608 - DNA, 785 bp, Artificial Sequence
  chemically treated genomic DNA (Homo sapiens) CpG-island No: 33608
  misc_feature (547)..(547): n is either a, c, g or t
  misc_feature (649)..(649): n is either a, c, g or t
  misc_feature (660)..(660): n is either a, c, g or t
acccgattaataaaaaccacgacgacttcttcgccgccgccgaaaacccgcaacaataaaaacctcgacaaaataaatatatctttaaataaaaaaccgaattaaaccgaattaaaatacgaaaaaaaacgcgaataaaaaccgacgacgcgatttataaaaacaaaaacgatcgacaacaattaccgacgaaattttctcgctaataaacgaacccgaacgaaaacccgaaaaacaaccgaaaacgcaaactcgacgccaaatacccgactaaaccgcgaaaaacccgaacgtcccctcgaccgcgacaatcgaaaaaaaaactataaaaacgaaaacaaaaacgctacgaacccgaaaattcgcaaaatcgcgaaaaacgtctcttctccccgaaaaaactacgactcgccgctcgccgactctttataaaaaaaaatctaccgatttccccgaaacgcgttcgcgataaacgttatcgaaaaacgaaaaaaataatccgaccgaaccgttctctctaaaaaaaaatctaaaaaacccgaccganactacgatcgattaaaccaacgcttccgaaactttccctaatcgccgaacgtttcaaaccgacgccgaccataactaccgaccgcgactctcgaaaccaccntccgccgcgancccgaaacgtctatcaaaaaaaaacaacgctcgaccgctataaatatcgttaaatataaacgctactaaaaaacacaatctcctctccaaactcaaactaactaataaaaaaaaaaaaacattct

SEQ ID NO: 33609 - DNA, 506 bp, Artificial Sequence
  chemically treated genomic DNA (Homo sapiens) CpG-island No: 33609
  misc_feature (219)..(219): n is either a, c, g or t
  misc_feature (275)..(275): n is either a, c, g or t
  misc_feature (327)..(328): n is either a, c, g or t
  misc_feature (389)..(389): n is either a, c, g or t
  misc_feature (433)..(433): n is either a, c, g or t
ggacgaggaagaggaggaggaggaataggagaaggaggaggagaaggacgaagaggaggaggaggtttatatttcgtttagttttttgtgcgcgggcgcgcgagtcgtttcggtattttcgagcggttcggcggtgcgtgtcgggattcgcgagcgtgtattttcgaatttgcgcggttgagtattttatatttcgcgtttcgcgcgtcgcgtcgaggncgttcgataggtcggtgttatttcggtcgcgtcgtcgcgttatgatgcgtagtttnatgtacgtaacgtttcggtgagcgcgcggacggtacggcggttgcggtcgtnntttcgaggtggggttggcgttagagcgttcgatcgatcggtcgcgtatcgtaggggagagngtcgatcggtatgagattcggagatgttggtaggtcgagttgtnttgtcgatagaatatatgtttcggacgcgggaggcggcgggtcgttttttgtttcgtgtgtattattggggtt

SEQ ID NO: 33610 - DNA, 506 bp, Artificial Sequence
  chemically treated genomic DNA (Homo sapiens) CpG-island No: 33610
  misc_feature (74)..(74): n is either a, c, g or t
  misc_feature (118)..(118): n is either a, c, g or t
  misc_feature (179)..(180): n is either a, c, g or t
  misc_feature (232)..(232): n is either a, c, g or t
  misc_feature (288)..(288): n is either a, c, g or t
aaccccaataatacacacgaaacaaaaaacgacccgccgcctcccgcgtccgaaacatatattctatcgacaanacaactcgacctaccaacatctccgaatctcataccgatcgacnctctcccctacgatacgcgaccgatcgatcgaacgctctaacgccaaccccacctcgaaannacgaccgcaaccgccgtaccgtccgcgcgctcaccgaaacgttacgtacatnaaactacgcatcataacgcgacgacgcgaccgaaataacaccgacctatcgaacgncctcgacgcgacgcgcgaaacgcgaaatataaaatactcaaccgcgcaaattcgaaaatacacgctcgcgaatcccgacacgcaccgccgaaccgctcgaaaataccgaaacgactcgcgcgcccgcgcacaaaaaactaaacgaaatataaacctcctcctcctcttcgtccttctcctcctccttctcctattcctcctcctcctcttcctcgtcc

SEQ ID NO: 33611 - DNA, 506 bp, Artificial Sequence
  chemically treated genomic DNA (Homo sapiens) CpG-island No: 33611
  misc_feature (74)..(74): n is either a, c, g or t
  misc_feature (118)..(118): n is either a, c, g or t
  misc_feature (179)..(180): n is either a, c, g or t
  misc_feature (232)..(232): n is either a, c, g or t
  misc_feature (288)..(288): n is either a, c, g or t
ggttttaatgatgtatacggggtagggggcggttcgtcgtttttcgcgttcggaatatatattttgtcggtaangtaattcggtttgttaatattttcgagttttatgtcgatcggtntttttttttgcggtgcgcgatcggtcgatcgggcgttttggcgttagttttatttcgaaanngcggtcgtagtcgtcgtgtcgttcgcgcgtttatcggggcgttgcgtatatngggttacgtattataacgcgacggcgcggtcggggtagtatcggtttgtcgggcgntttcggcgcggcgcgcggagcgcggaatgtgaaatgtttagtcgcgtaaattcgggggtgtacgttcgcgaatttcggtacgtatcgtcggatcgttcggggatatcggggcggttcgcgcgttcgcgtataaagaattaagcggggtatgaatttttttttttttttcgttttttttttttttttttttttgttttttttttttttttttttcgttt

SEQ ID NO: 33612 - DNA, 506 bp, Artificial Sequence
  chemically treated genomic DNA (Homo sapiens) CpG-island No: 33612
  misc_feature (219)..(219): n is either a, c, g or t
  misc_feature (275)..(275): n is either a, c, g or t
  misc_feature (327)..(328): n is either a, c, g or t
  misc_feature (389)..(389): n is either a, c, g or t
  misc_feature (433)..(433): n is either a, c, g or t
aaacgaaaaaaaaaaaaaaaaaaaacaaaaaaaaaaaaaaaaaaaaaacgaaaaaaaaaaaaaaattcataccccgcttaattctttatacgcgaacgcgcgaaccgccccgatatccccgaacgatccgacgatacgtaccgaaattcgcgaacgtacacccccgaatttacgcgactaaacatttcacattccgcgctccgcgcgccgcgccgaaancgcccgacaaaccgatactaccccgaccgcgccgtcgcgttataatacgtaacccnatatacgcaacgccccgataaacgcgcgaacgacacgacgactacgaccgcnntttcgaaataaaactaacgccaaaacgcccgatcgaccgatcgcgcaccgcaaaaaaaaanaccgatcgacataaaactcgaaaatattaacaaaccgaattacnttaccgacaaaatatatattccgaacgcgaaaaacgacgaaccgccccctaccccgtatacatcattaaaacc

SEQ ID NO: 33613 - DNA, 619 bp, Artificial Sequence
  chemically treated genomic DNA (Homo sapiens) CpG-island No: 33613
ggtcgcggcgtttacgtgagcggcgtcgttttttttttatcggttcggggttttcggtcgttcgtcgtttttcgggtcgcggaggggaagggcggggggtttcggttcgggagagcgtcgtcggagggcgtggggggcgcggcgaggaaggggtttcggtcgggagggaggtcgcgtttattttttttatcgatagcgagatgttttttaggattcggttttttatttttttcggttttatggcgttgttatcgtcgtcgttatcgttatcgttatcgtcgtcgtcgtttcgtcgtcgtttttcgcgtcgggggtcgggggtcgtcgttaatcgttgtcgtcggtcgtacgggggtttcgtcgtgtcggtcgcggggttcggcgttcgtcgttcggttttcgtttcgtttgggttttcgttttatcgcggttcggaggtttcggagcgcggtcggcggggaaggaggtcgcgggttgtgcgtcgcggcggcggcggcggtaggaattgatgttaggcggcgtcggcgttagggttcgtttgcgtttggagatttcggggattcggagattcgtatagatttttggtcgcggttttttttagagatttttagatttattt

SEQ ID NO: 33614 - DNA, 619 bp, Artificial Sequence
  chemically treated genomic DNA (Homo sapiens) CpG-island No: 33614
aaataaatctaaaaatctctaaaaaaaaccgcgaccaaaaatctatacgaatctccgaatccccgaaatctccaaacgcaaacgaaccctaacgccgacgccgcctaacatcaattcctaccgccgccgccgccgcgacgcacaacccgcgacctccttccccgccgaccgcgctccgaaacctccgaaccgcgataaaacgaaaacccaaacgaaacgaaaaccgaacgacgaacgccgaaccccgcgaccgacacgacgaaacccccgtacgaccgacgacaacgattaacgacgacccccgacccccgacgcgaaaaacgacgacgaaacgacgacgacgataacgataacgataacgacgacgataacaacgccataaaaccgaaaaaaataaaaaaccgaatcctaaaaaacatctcgctatcgataaaaaaaataaacgcgacctccctcccgaccgaaaccccttcctcgccgcgccccccacgccctccgacgacgctctcccgaaccgaaaccccccgcccttcccctccgcgacccgaaaaacgacgaacgaccgaaaaccccgaaccgataaaaaaaaaacgacgccgctcacgtaaacgccgcgacc

SEQ ID NO: 33615 - DNA, 619 bp, Artificial Sequence
  chemically treated genomic DNA (Homo sapiens) CpG-island No: 33615
gggtgggtttgggggtttttggggagggtcgcgattaagggtttgtgcgggttttcgggttttcggagtttttaggcgtaggcgggttttggcgtcggcgtcgtttggtattagtttttgtcgtcgtcgtcgtcgcggcgtatagttcgcggttttttttttcgtcggtcgcgtttcggagttttcgggtcgcggtggagcgagggtttaggcgaggcgagggtcgggcggcgggcgtcgggtttcgcggtcggtacgacggagttttcgtacggtcggcggtagcggttggcggcggttttcggttttcggcgcgggaagcggcggcggggcggcggcggcggtggcggtggcggtggcggcgacggtggtagcgttatggagtcgggggaggtgaaggatcggattttggagaatatttcgttgtcggtgaagaaggtgagcgcggtttttttttcggtcggggtttttttttcgtcgcgttttttacgtttttcggcggcgttttttcgggtcggggtttttcgtttttttttttcgcgattcggggggcgacgagcggtcgggagtttcgggtcggtagaggggaagcggcgtcgtttacgtgagcgtcgcggtt

SEQ ID NO: 33616 - DNA, 619 bp, Artificial Sequence
  chemically treated genomic DNA (Homo sapiens) CpG-island No: 33616
aaccgcgacgctcacgtaaacgacgccgcttcccctctaccgacccgaaactcccgaccgctcgtcgccccccgaatcgcgaaaaaaaaaaacgaaaaaccccgacccgaaaaaacgccgccgaaaaacgtaaaaaacgcgacgaaaaaaaaaccccgaccgaaaaaaaaaccgcgctcaccttcttcaccgacaacgaaatattctccaaaatccgatccttcacctcccccgactccataacgctaccaccgtcgccgccaccgccaccgccaccgccgccgccgccccgccgccgcttcccgcgccgaaaaccgaaaaccgccgccaaccgctaccgccgaccgtacgaaaactccgtcgtaccgaccgcgaaacccgacgcccgccgcccgaccctcgcctcgcctaaaccctcgctccaccgcgacccgaaaactccgaaacgcgaccgacgaaaaaaaaaaccgcgaactatacgccgcgacgacgacgacgacaaaaactaataccaaacgacgccgacgccaaaacccgcctacgcctaaaaactccgaaaacccgaaaacccgcacaaacccttaatcgcgaccctccccaaaaacccccaaacccaccc

SEQ ID NO: 33617 - DNA, 721 bp, Artificial Sequence
  chemically treated genomic DNA (Homo sapiens) CpG-island No: 33617
cggcgtttcggcggggtttgcggagggggagggggtcgcggtttttcggcgggtcgcgtggatgcgtataggaggggtcgcggtttgaaaagtgggggttattgttttttttcgtttttcgttcggtttcgttacgtcgcggcgattatggtcgcgcgggtagtagcggcggcggcggcggcggcggcgcgggcgcgggcgcgggtaggtagcggcgaacggcgggcgtttttcgggtcgcggtcggcgttcggagttcgggatttggaggcgggggcgcgcggcgcggcggcggcggcggcggtatcgggatttatgttggggggcggcggcgacggcggcggcggtttgaatagtgtgtattattattttttgttttttcgttacgaatttaatatggtttataacgcgggcgtcgcggtcgtcgtcggtatttatagcgttaagagcggcggtttcgaggcggtttttaaggagggtggaagcgtcgtcgcgttgttttttttttttttttttttcgcggcggtagcggcggtatttttttttttttcgtcgggttcgggttcggttatggagacggggttgttttttaattataaattgaaaatcgttggcgaagttttcgtcgcgtcgttttattagtagtattattattattattatgtttattattattattattatgtttattatttttattattattacgtattatagtagt

SEQ ID NO: 33618 - DNA, 721 bp, Artificial Sequence
  chemically treated genomic DNA (Homo sapiens) CpG-island No: 33618
actactataatacgtaataataataaaaataataaacataataataataataataaacataataataataataatactactaataaaacgacgcgacgaaaacttcgccaacgattttcaatttataattaaaaaacaaccccgtctccataaccgaacccgaacccgacgaaaaaaaaaaaaataccgccgctaccgccgcgaaaaaaaaaaaaaaaaaaaacaacgcgacgacgcttccaccctccttaaaaaccgcctcgaaaccgccgctcttaacgctataaataccgacgacgaccgcgacgcccgcgttataaaccatattaaattcgtaacgaaaaaacaaaaaataataatacacactattcaaaccgccgccgccgtcgccgccgccccccaacataaatcccgataccgccgccgccgccgccgcgccgcgcgcccccgcctccaaatcccgaactccgaacgccgaccgcgacccgaaaaacgcccgccgttcgccgctacctacccgcgcccgcgcccgcgccgccgccgccgccgccgccgctactacccgcgcgaccataatcgccgcgacgtaacgaaaccgaacgaaaaacgaaaaaaaacaataacccccacttttcaaaccgcgacccctcctatacgcatccacgcgacccgccgaaaaaccgcgaccccctccccctccgcaaaccccgccgaaacgccg

SEQ ID NO: 33619 - DNA, 721 bp, Artificial Sequence
  chemically treated genomic DNA (Homo sapiens) CpG-island No: 33619
gttgttgtagtgcgtggtggtggtggaggtggtgggtatggtggtggtggtggtgggtatggtggtggtggtggtgttgttggtggggcggcgcggcgggggtttcgttaacggtttttagtttgtggttggggagtagtttcgtttttatggtcgagttcgggttcgacgaggaggaagaggatgtcgtcgttgtcgtcgcggaggaggaggaggaggaggatagcgcggcggcgtttttattttttttgagagtcgtttcggagtcgtcgtttttggcgttgtgggtgtcggcggcggtcgcggcgttcgcgttatgggttatgttgagttcgtgacgggggagtagggggtggtggtgtatattgtttaggtcgtcgtcgtcgtcgtcgtcgttttttagtatgggtttcggtgtcgtcgtcgtcgtcgtcgcgtcgcgcgttttcgtttttaggtttcgggtttcgggcgtcggtcgcggttcggggggcgttcgtcgttcgtcgttgtttgttcgcgttcgcgttcgcgtcgtcgtcgtcgtcgtcgtcgttgttgttcgcgcggttatgatcgtcgcggcgtggcgaggtcgggcggggggcggggggagataataatttttattttttaggtcgcggttttttttgtgcgtatttacgcggttcgtcgggaagtcgcgatttttttttttttcgtaggtttcgtcggagcgtcg

SEQ ID NO: 33620 - DNA, 721 bp, Artificial Sequence
  chemically treated genomic DNA (Homo sapiens) CpG-island No: 33620
cgacgctccgacgaaacctacgaaaaaaaaaaaaatcgcgacttcccgacgaaccgcgtaaatacgcacaaaaaaaaccgcgacctaaaaaataaaaattattatctccccccgccccccgcccgacctcgccacgccgcgacgatcataaccgcgcgaacaacaacgacgacgacgacgacgacgacgcgaacgcgaacgcgaacaaacaacgacgaacgacgaacgccccccgaaccgcgaccgacgcccgaaacccgaaacctaaaaacgaaaacgcgcgacgcgacgacgacgacgacgacaccgaaacccatactaaaaaacgacgacgacgacgacgacgacctaaacaatatacaccaccaccccctactcccccgtcacgaactcaacataacccataacgcgaacgccgcgaccgccgccgacacccacaacgccaaaaacgacgactccgaaacgactctcaaaaaaaataaaaacgccgccgcgctatcctcctcctcctcctcctccgcgacgacaacgacgacatcctcttcctcctcgtcgaacccgaactcgaccataaaaacgaaactactccccaaccacaaactaaaaaccgttaacgaaacccccgccgcgccgccccaccaacaacaccaccaccaccaccatacccaccaccaccaccaccatacccaccacctccaccaccaccacgcactacaacaac

SEQ ID NO: 33621 - DNA, 1168 bp, Artificial Sequence
  chemically treated genomic DNA (Homo sapiens) CpG-island No: 33621
ggcgcgttttagttcggtttcgatatggagtagtcgtaatatggaggcgttaaggatagtgttgcgggcggttaggtcgatttttcgggttcgtcgttgttgagtaagtcgggcgacgaggacgacgcgtcgtttaagatgggggagtcggcgggcggtcgttacgagtattcgggtttgggcgttttgggtacgtagtagtcgtcggtcgtcgtgttcgggggcggcggcggttcggcggtcgtttcggagtttaataattattatggtagcgttgtttttgcgagcggcggtttcggcggtcgcgttgggttttgttttgattaatatggcggataataaagtttcgggatggggatgatgtatttcgttttcgtcgtcgtcgtcggggttttcggtagtatggattttttgtagaatttttacgaagggtattttaatagttagtgtaattattattcgggttatagtcggttcggcgcgggcggcggcggcggcggcggcggcggaggaggaggaggtagcggaggaggaggaggaggaggaggagtaggagtaggaggagtaggagcgggagttgtggcggcggcggtcgcggcggcggcggtagtagtaggaggcggcggcggcggcggttatgggggttcgttcgcggggtacggggtgttgagtttttttcggtagtagggcggcggtatgatgatgggtttcgggggcggcggggtcgcgagttttagtaaggcggtcgtcggttcggcggcggggggtttttagcgtttcgtcggttagaattagtattcgtcgggggttatttcgatttttaattagttgtttatttcgtttagttttatgatgcggagttacggcggtagttatttcgagtatagtagttttagcgcgtcgtcgtcgtcgtcgtcgtagttttagttttaggcggcggcggcgggggcggcggcgggcggttagtaggcggtcgcgggtatgggtttgggtaaggatatgggcgtttagtacgtcgttgttagttcggtttgggcggtcgcgtaataaaggagttattcggcgatgagtttcggtattttcggatcgattatgggtagattttaggtaattttcgcgttagtcgggtttgttttcgttcggcggtttcgtcgcgtcgcgagtttga

SEQ ID NO: 33622 - DNA, 1168 bp, Artificial Sequence
  chemically treated genomic DNA (Homo sapiens) CpG-island No: 33622
tcaaactcgcgacgcgacgaaaccgccgaacgaaaacaaacccgactaacgcgaaaattacctaaaatctacccataatcgatccgaaaataccgaaactcatcgccgaataactcctttattacgcgaccgcccaaaccgaactaacaacgacgtactaaacgcccatatccttacccaaacccatacccgcgaccgcctactaaccgcccgccgccgcccccgccgccgccgcctaaaactaaaactacgacgacgacgacgacgacgcgctaaaactactatactcgaaataactaccgccgtaactccgcatcataaaactaaacgaaataaacaactaattaaaaatcgaaataacccccgacgaatactaattctaaccgacgaaacgctaaaaaccccccgccgccgaaccgacgaccgccttactaaaactcgcgaccccgccgcccccgaaacccatcatcataccgccgccctactaccgaaaaaaactcaacaccccgtaccccgcgaacgaacccccataaccgccgccgccgccgcctcctactactaccgccgccgccgcgaccgccgccgccacaactcccgctcctactcctcctactcctactcctcctcctcctcctcctcctccgctacctcctcctcctccgccgccgccgccgccgccgccgcccgcgccgaaccgactataacccgaataataattacactaactattaaaatacccttcgtaaaaattctacaaaaaatccatactaccgaaaaccccgacgacgacgacgaaaacgaaatacatcatccccatcccgaaactttattatccgccatattaatcaaaacaaaacccaacgcgaccgccgaaaccgccgctcgcaaaaacaacgctaccataataattattaaactccgaaacgaccgccgaaccgccgccgcccccgaacacgacgaccgacgactactacgtacccaaaacgcccaaacccgaatactcgtaacgaccgcccgccgactcccccatcttaaacgacgcgtcgtcctcgtcgcccgacttactcaacaacgacgaacccgaaaaatcgacctaaccgcccgcaacactatccttaacgcctccatattacgactactccatatcgaaaccgaactaaaacgcgcc

SEQ ID NO: 33623 - DNA, 1168 bp, Artificial Sequence
  chemically treated genomic DNA (Homo sapiens) CpG-island No: 33623
ttaggttcgcggcgcggcgaggtcgtcgggcggaagtaggttcggttggcgcgagggttatttgggatttgtttatggtcggttcgggggtgtcggggtttatcgtcgggtgatttttttgttgcgcggtcgtttaggtcgggttggtagcggcgtattgggcgtttatgtttttgtttaagtttatgttcgcggtcgtttgttggtcgttcgtcgtcgttttcgtcgtcgtcgtttgggattggggttgcgacggcggcggcggcggcgcgttggggttgttgtattcggggtagttgtcgtcgtagtttcgtattatggggttgggcgaggtgagtagttgattgagggtcggggtggttttcgacgggtgttggttttggtcggcgaagcgttggaagtttttcgtcgtcgagtcggcggtcgttttgttgaggttcgcggtttcgtcgttttcggggtttattattatgtcgtcgttttgttgtcggggggagtttagtatttcgtatttcgcggacgagtttttatagtcgtcgtcgtcgtcgttttttgttgttgtcgtcgtcgtcgcggtcgtcgtcgttatagttttcgtttttgttttttttgtttttgttttttttttttttttttttttttcgttgtttttttttttttcgtcgtcgtcgtcgtcgtcgtcgttcgcgtcgggtcggttgtagttcggataatggttgtattggttgttggggtatttttcgtgggagttttgtagggggtttatgttgtcgggggtttcggcggcggcggcggaggcggagtgtattatttttatttcggggttttgttgttcgttatgttgattaaagtaaggtttagcgcggtcgtcggggtcgtcgttcgtaggggtagcgttgttatagtaattattaaatttcgggacggtcgtcgggtcgtcgtcgttttcgggtacggcgatcggcggttgttgcgtgtttagggcgtttaagttcgggtgttcgtagcggtcgttcgtcggtttttttattttgggcggcgcgtcgttttcgtcgttcggtttgtttagtagcggcgggttcggggggtcggtttggtcgttcgtagtattgtttttggcgtttttatgttgcggttgttttatgtcggggtcgggttgaggcgcgtt

SEQ ID NO: 33624 - DNA, 1168 bp, Artificial Sequence
  chemically treated genomic DNA (Homo sapiens) CpG-island No: 33624
aacgcgcctcaacccgaccccgacataaaacaaccgcaacataaaaacgccaaaaacaatactacgaacgaccaaaccgaccccccgaacccgccgctactaaacaaaccgaacgacgaaaacgacgcgccgcccaaaataaaaaaaccgacgaacgaccgctacgaacacccgaacttaaacgccctaaacacgcaacaaccgccgatcgccgtacccgaaaacgacgacgacccgacgaccgtcccgaaatttaataattactataacaacgctacccctacgaacgacgaccccgacgaccgcgctaaaccttactttaatcaacataacgaacaacaaaaccccgaaataaaaataatacactccgcctccgccgccgccgccgaaacccccgacaacataaaccccctacaaaactcccacgaaaaataccccaacaaccaatacaaccattatccgaactacaaccgacccgacgcgaacgacgacgacgacgacgacgacgaaaaaaaaaaaaacaacgaaaaaaaaaaaaaaaaaaaaaaaacaaaaacaaaaaaaacaaaaacgaaaactataacgacgacgaccgcgacgacgacgacaacaacaaaaaacgacgacgacgacgactataaaaactcgtccgcgaaatacgaaatactaaactccccccgacaacaaaacgacgacataataataaaccccgaaaacgacgaaaccgcgaacctcaacaaaacgaccgccgactcgacgacgaaaaacttccaacgcttcgccgaccaaaaccaacacccgtcgaaaaccaccccgaccctcaatcaactactcacctcgcccaaccccataatacgaaactacgacgacaactaccccgaatacaacaaccccaacgcgccgccgccgccgccgtcgcaaccccaatcccaaacgacgacgacgaaaacgacgacgaacgaccaacaaacgaccgcgaacataaacttaaacaaaaacataaacgcccaatacgccgctaccaacccgacctaaacgaccgcgcaacaaaaaaatcacccgacgataaaccccgacacccccgaaccgaccataaacaaatcccaaataaccctcgcgccaaccgaacctacttccgcccgacgacctcgccgcgccgcgaacctaa

SEQ ID NO: 33625 - DNA, 556 bp, Artificial Sequence
  chemically treated genomic DNA (Homo sapiens) CpG-island No: 33625
tcgtagcgttttcgttgttttttttcggcggcggggagattttaaatttggtttaggcgcggggcgtatagaggcgttcgggatgtgttcgggattttacggaggagtggagggcggggaggtagtggttttatcgtgtaggagcgacgcggttagcgttagttagacgtttttcggcgagtagcgtatgttgagtttcggagttgtagcgagtcggcgcgttttacgtttcggttgtcgttcgggtttgcgtttgcggttatagaggtatttcgtcgttcggttcgcgcgtttttaaggagtcgggcgcgcgttttcgtttcgttcgttttcgcgcgtttttttacgtgacgagtttcgttttcgttttcgttttcgtttttttatttttttagttcgggttagcgtttcggcggttatttagggaattgtagttcgaggtgtgagcgggaggtattttcggcgttgggtacgtttcgggtatttttatttttagtttttatcgagcgggttttcggtttcgcgtttttggttaggttaggggttgtttaaggtt

SEQ ID NO: 33626 - DNA, 556 bp, Artificial Sequence
  chemically treated genomic DNA (Homo sapiens) CpG-island No: 33626
aaccttaaacaacccctaacctaaccaaaaacgcgaaaccgaaaacccgctcgataaaaactaaaaataaaaatacccgaaacgtacccaacgccgaaaatacctcccgctcacacctcgaactacaattccctaaataaccgccgaaacgctaacccgaactaaaaaaataaaaaaacgaaaacgaaaacgaaaacgaaactcgtcacgtaaaaaaacgcgcgaaaacgaacgaaacgaaaacgcgcgcccgactccttaaaaacgcgcgaaccgaacgacgaaatacctctataaccgcaaacgcaaacccgaacgacaaccgaaacgtaaaacgcgccgactcgctacaactccgaaactcaacatacgctactcgccgaaaaacgtctaactaacgctaaccgcgtcgctcctacacgataaaaccactacctccccgccctccactcctccgtaaaatcccgaacacatcccgaacgcctctatacgccccgcgcctaaaccaaatttaaaatctccccgccgccgaaaaaaaacaacgaaaacgctacga

SEQ ID NO: 33627 - DNA, 556 bp, Artificial Sequence
  chemically treated genomic DNA (Homo sapiens) CpG-island No: 33627
ggttttgggtagtttttggtttggttagaggcgcgaggtcgagagttcgttcggtggagattgggggtggaggtgttcggagcgtatttagcgtcgggagtatttttcgtttatatttcgggttgtagttttttgggtggtcgtcgagacgttggttcgggttggagggatgggggggcggggacgggggcgggggcggggttcgttacgtggagaggcgcgcgggggcgggcggggcgggggcgcgcgttcggttttttaaaggcgcgcgagtcgagcggcgaggtgtttttgtggtcgtaggcgtaggttcgggcgatagtcgagacgtggagcgcgtcggttcgttgtagtttcgggatttaatatgcgttgttcgtcgggaggcgtttggttggcgttggtcgcgtcgtttttgtacggtaaagttattgttttttcgttttttattttttcgtgggatttcgggtatatttcgggcgtttttgtgcgtttcgcgtttgggttaggtttgggattttttcgtcgtcggggaggggtagcgggggcgttgcgg

SEQ ID NO: 33628 - DNA, 556 bp, Artificial Sequence
  chemically treated genomic DNA (Homo sapiens) CpG-island No: 33628
ccgcaacgcccccgctacccctccccgacgacgaaaaaatcccaaacctaacccaaacgcgaaacgcacaaaaacgcccgaaatatacccgaaatcccacgaaaaaataaaaaacgaaaaaacaataactttaccgtacaaaaacgacgcgaccaacgccaaccaaacgcctcccgacgaacaacgcatattaaatcccgaaactacaacgaaccgacgcgctccacgtctcgactatcgcccgaacctacgcctacgaccacaaaaacacctcgccgctcgactcgcgcgcctttaaaaaaccgaacgcgcgcccccgccccgcccgcccccgcgcgcctctccacgtaacgaaccccgcccccgcccccgtccccgcccccccatccctccaacccgaaccaacgtctcgacgaccacccaaaaaactacaacccgaaatataaacgaaaaatactcccgacgctaaatacgctccgaacacctccacccccaatctccaccgaacgaactctcgacctcgcgcctctaaccaaaccaaaaactacccaaaacc

SEQ ID NO: 33629 - DNA, 505 bp, Artificial Sequence
  chemically treated genomic DNA (Homo sapiens) CpG-island No: 33629
cgattacggatttgtattgtcgaggacgggattttagggtagcgaagtaggtaattttgtagcggtcggggttcggcgaggcggggaggggtcggggtgtaggtgcggggggcgtttggcggcgggcgttggtaagttgagttcgatgggtggggtagggaagcggtcgggacgttgcggttgtggtagtagcgcgaggggaataaaggcggcgcgggcgcgggggtcggggcgcggcgattcgggcgcggggcgcgggcgcgggcggatttttatttgggttagcggagcggcgcgttttgttttcgtttttttagtttcggcgttttggtcgttcggaaggcggggtgcgggtaggagttgttcggggttggcgggcggtcgcggtttttttattttagcgtcgtcgttcgttcggtcgttttaattttggggggtttcgtttatcgggttgtgagttttttaggggggtgggggtgggagttattgcgtcggttttgattag

SEQ ID NO: 33630 - DNA, 505 bp, Artificial Sequence
  chemically treated genomic DNA (Homo sapiens) CpG-island No: 33630
ctaatcaaaaccgacgcaataactcccacccccacccccctaaaaaactcacaacccgataaacgaaaccccccaaaattaaaacgaccgaacgaacgacgacgctaaaataaaaaaaccgcgaccgcccgccaaccccgaacaactcctacccgcaccccgccttccgaacgaccaaaacgccgaaactaaaaaaacgaaaacaaaacgcgccgctccgctaacccaaataaaaatccgcccgcgcccgcgccccgcgcccgaatcgccgcgccccgacccccgcgcccgcgccgcctttattcccctcgcgctactaccacaaccgcaacgtcccgaccgcttccctaccccacccatcgaactcaacttaccaacgcccgccgccaaacgccccccgcacctacaccccgacccctccccgcctcgccgaaccccgaccgctacaaaattacctacttcgctaccctaaaatcccgtcctcgacaatacaaatccgtaatcg

SEQ ID NO: 33631 - DNA, 505 bp, Artificial Sequence
  chemically treated genomic DNA (Homo sapiens) CpG-island No: 33631
ttggttagagtcggcgtaatgatttttatttttatttttttggaagatttatagttcggtggacgagattttttaaagttagagcggtcgggcgggcggcggcgttggggtggggaggtcgcggtcgttcgttaatttcgggtagtttttgttcgtatttcgtttttcgagcggttaggacgtcggagttggggaggcgggggtagggcgcgtcgtttcgttgatttagatgggagttcgttcgcgttcgcgtttcgcgttcgggtcgtcgcgtttcggttttcgcgttcgcgtcgtttttatttttttcgcgttgttgttatagtcgtagcgtttcggtcgtttttttattttatttatcgggtttaatttgttagcgttcgtcgttaggcgtttttcgtatttgtatttcgattttttttcgtttcgtcgggtttcgatcgttgtaggattatttgtttcgttgttttggggtttcgttttcggtaatgtaaattcgtggtcg

SEQ ID NO: 33632 - DNA, 505 bp, Artificial Sequence
  chemically treated genomic DNA (Homo sapiens) CpG-island No: 33632
cgaccacgaatttacattaccgaaaacgaaaccccaaaacaacgaaacaaataatcctacaacgatcgaaacccgacgaaacgaaaaaaaatcgaaatacaaatacgaaaaacgcctaacgacgaacgctaacaaattaaacccgataaataaaataaaaaaacgaccgaaacgctacgactataacaacaacgcgaaaaaaataaaaacgacgcgaacgcgaaaaccgaaacgcgacgacccgaacgcgaaacgcgaacgcgaacgaactcccatctaaatcaacgaaacgacgcgccctacccccgcctccccaactccgacgtcctaaccgctcgaaaaacgaaatacgaacaaaaactacccgaaattaacgaacgaccgcgacctccccaccccaacgccgccgcccgcccgaccgctctaactttaaaaaatctcgtccaccgaactataaatcttccaaaaaaataaaaataaaaatcattacgccgactctaaccaa

SEQ ID NO: 33633 - DNA, 572 bp, Artificial Sequence
  chemically treated genomic DNA (Homo sapiens) CpG-island No: 33633
taacgttaaggatttttacgattttttttgttcggcgggagattaaaggtcggaaaagtatagttcgtttaggggtgggagtcgagttagttttatttttcggtggtttttcgcgatcgtggagacgtagcgagtttatgtaattttcggtcgcgatttattagtttttcggcgattggttcgtttttacggtcggttgggtgacgttatcgtcgggttttggggttgtacgtgtggtgaggtttatagaagcggtttttagttggattttggttttttcgtcggatttcgagggtgttatcgtcgtttttgttgggggtgagcgtcgcgcggttgtagtatggtgagtaagttttgtttgtttcggcggtcgagcgttgtggttttgtagaggttaggttgttttcggtaatattttggttattgcggttcgggtttgggttatgttagaggttgtttgcggtacggtatttcgaaatgggttaacgttattatcgtgggtattttttgtaagttatagttttttatcgtcgagtttttttgggatgtggttcggagaggagaatggtttt

SEQ ID NO: 33634 - DNA, 572 bp, Artificial Sequence
  chemically treated genomic DNA (Homo sapiens) CpG-island No: 33634
aaaaccattctcctctccgaaccacatcccaaaaaaactcgacgataaaaaactataacttacaaaaaatacccacgataataacgttaacccatttcgaaataccgtaccgcaaacaacctctaacataacccaaacccgaaccgcaataaccaaaatattaccgaaaacaacctaacctctacaaaaccacaacgctcgaccgccgaaacaaacaaaacttactcaccatactacaaccgcgcgacgctcacccccaacaaaaacgacgataacaccctcgaaatccgacgaaaaaaccaaaatccaactaaaaaccgcttctataaacctcaccacacgtacaaccccaaaacccgacgataacgtcacccaaccgaccgtaaaaacgaaccaatcgccgaaaaactaataaatcgcgaccgaaaattacataaactcgctacgtctccacgatcgcgaaaaaccaccgaaaaataaaactaactcgactcccacccctaaacgaactatacttttccgacctttaatctcccgccgaacaaaaaaaatcgtaaaaatccttaacgtta

SEQ ID NO: 33635 - DNA, 572 bp, Artificial Sequence
  chemically treated genomic DNA (Homo sapiens) CpG-island No: 33635
aaggttattttttttttcgggttatattttagggaggttcggcggtgggagattgtaatttgtaaagaatgtttacggtggtgacgttggtttatttcggggtatcgtgtcgtaagtagtttttggtatgatttagattcgggtcgtagtagttaaggtattatcggaagtagtttggtttttgtaaaattatagcgttcggtcgtcgaaataagtaaggtttgtttattatgttgtagtcgcgcggcgtttatttttaataggggcggcgatgatattttcgaagttcggcggggagattaaggtttagttgaaggtcgtttttgtaggttttattatacgtgtagttttaggattcggcgataacgttatttagtcggtcgtggaaacggattaatcgtcgaggagttgatgggtcgcgatcggaagttatataggttcgttgcgtttttacgatcgcgagaagttatcgggaggtggggttagttcggtttttatttttgggcgggttgtattttttcggtttttagtttttcgtcgggtaaagggaatcgtgggggtttttaacgttg

SEQ ID NO: 33636 - DNA, 572 bp, Artificial Sequence
  chemically treated genomic DNA (Homo sapiens) CpG-island No: 33636
caacgttaaaaacccccacgattccctttacccgacgaaaaactaaaaaccgaaaaaatacaacccgcccaaaaataaaaaccgaactaaccccacctcccgataacttctcgcgatcgtaaaaacgcaacgaacctatataacttccgatcgcgacccatcaactcctcgacgattaatccgtttccacgaccgactaaataacgttatcgccgaatcctaaaactacacgtataataaaacctacaaaaacgaccttcaactaaaccttaatctccccgccgaacttcgaaaatatcatcgccgcccctattaaaaataaacgccgcgcgactacaacataataaacaaaccttacttatttcgacgaccgaacgctataattttacaaaaaccaaactacttccgataataccttaactactacgacccgaatctaaatcataccaaaaactacttacgacacgataccccgaaataaaccaacgtcaccaccgtaaacattctttacaaattacaatctcccaccgccgaacctccctaaaatataacccgaaaaaaaaaataacctt

SEQ ID NO: 33637 - DNA, 600 bp, Artificial Sequence
  chemically treated genomic DNA (Homo sapiens) CpG-island No: 33637
tagagcgttttttttgtgtcgcgatgaggtaggtgtattcgttattttatttttttttttttatttgattcggaatgggaggaacgtaatgcgtttcgcgcggcgatttgggatagttgcgtaggcgtagttttcggttttgtgtttcgggaattatttgacgttatcggtttagtttcgtagaaagttttgattaggcgtatcgcgtacgcgtagtggtttatttggttggggagttatttgacgtcgtcgtttttggtagtcggaagttgtttgagtagattttagtcggttggttcgagtggttttcgtcgttttttggcgttttgggagagtcgttgacgggtggattgacggatcgtttgaggacggtcggttagggcggtgaaagcgttagttttatggcgcgggtcgcgtgaggcggaaggtcgaggacggtcggcggcggcgttcgtttcggcgatgcgggtttcgttcgtcgttttaggtaatcgggtagtcggtttcgtcgcggtcggattttttttttttttttttttttttttttatttggcggttaagggacggttgaggtttgtttttcggttttgggtgttttag

SEQ ID NO: 33638 - DNA, 600 bp, Artificial Sequence
  chemically treated genomic DNA (Homo sapiens) CpG-island No: 33638
ctaaaacacccaaaaccgaaaaacaaacctcaaccgtcccttaaccgccaaataaaaaaaaaaaaaaaaaaaaaaaaaaaatccgaccgcgacgaaaccgactacccgattacctaaaacgacgaacgaaacccgcatcgccgaaacgaacgccgccgccgaccgtcctcgaccttccgcctcacgcgacccgcgccataaaactaacgctttcaccgccctaaccgaccgtcctcaaacgatccgtcaatccacccgtcaacgactctcccaaaacgccaaaaaacgacgaaaaccactcgaaccaaccgactaaaatctactcaaacaacttccgactaccaaaaacgacgacgtcaaataactccccaaccaaataaaccactacgcgtacgcgatacgcctaatcaaaactttctacgaaactaaaccgataacgtcaaataattcccgaaacacaaaaccgaaaactacgcctacgcaactatcccaaatcgccgcgcgaaacgcattacgttcctcccattccgaatcaaataaaaaaaaaaaaataaaataacgaatacacctacctcatcgcgacacaaaaaaaacgctcta

SEQ ID NO: 33639 - DNA, 600 bp, Artificial Sequence
  chemically treated genomic DNA (Homo sapiens) CpG-island No: 33639
ttggagtatttagagtcgagaaataagttttagtcgttttttgatcgttaggtggggaagagagggaaggagaggggagggttcggtcgcggcggggtcggttgttcggttatttgaggcgacgggcggggttcgtatcgtcggggcgggcgtcgtcgtcggtcgttttcggtttttcgttttacgcgattcgcgttatagggttggcgtttttatcgttttggtcggtcgtttttaggcggttcgttagtttattcgttagcgatttttttagggcgttaagggacgacgaaggttattcgagttagtcggttgggatttgtttaggtaattttcgattgttaggggcggcggcgttaaataattttttagttaagtgggttattgcgcgtgcgcggtgcgtttaattagagttttttacggggttgaatcggtggcgttaaataattttcgagatatagagtcggaagttgcgtttgcgtagttattttagatcgtcgcgcgggacgtattgcgttttttttatttcggattaagtggagagggaggagtgaagtgacggatgtatttattttatcgcggtatagaggaggcgtttta

SEQ ID NO: 33640 - DNA, 600 bp, Artificial Sequence
  chemically treated genomic DNA (Homo sapiens) CpG-island No: 33640
taaaacgcctcctctataccgcgataaaataaatacatccgtcacttcactcctccctctccacttaatccgaaataaaaaaaacgcaatacgtcccgcgcgacgatctaaaataactacgcaaacgcaacttccgactctatatctcgaaaattatttaacgccaccgattcaaccccgtaaaaaactctaattaaacgcaccgcgcacgcgcaataacccacttaactaaaaaattatttaacgccgccgcccctaacaatcgaaaattacctaaacaaatcccaaccgactaactcgaataaccttcgtcgtcccttaacgccctaaaaaaatcgctaacgaataaactaacgaaccgcctaaaaacgaccgaccaaaacgataaaaacgccaaccctataacgcgaatcgcgtaaaacgaaaaaccgaaaacgaccgacgacgacgcccgccccgacgatacgaaccccgcccgtcgcctcaaataaccgaacaaccgaccccgccgcgaccgaaccctcccctctccttccctctcttccccacctaacgatcaaaaaacgactaaaacttatttctcgactctaaatactccaa

SEQ ID NO: 33641 - DNA, 639 bp, Artificial Sequence
  chemically treated genomic DNA (Homo sapiens) CpG-island No: 33641
attgcgttttttttattgtaaaggataatgtcgttggattttacgtgttaaacgattgcgttttttttattgtaaaggatagtgtcgtttgattttacgtgttaaacgattgcgttttttttattgtaaaggatagtgtcgttagattttacgtgttaaacgattgcgttttttttattgtaaaggatagtgtcgttggattttacgtgttaaacgattgcgttttttttattgtaaaggatagtgtcgtttgattttacgtgttaaacgattgcgttttttttattgtaaaggatagtgtcgtttgattttacgtgttaaacgattgcgttttttttattgtaaaggatagtgtcgttagattttacgtgttaaacgattgcgttttttttattgtaaaggatagtgtcgttggattttacgtgttaaacgattgcgttttttttattgtaaaggatagtgtcgtttgattttacgtgttaaacgattgcgttttttttattgtaaaggatagtgtcgtttgattttacgtgttaaacgattgcgttttttttattgtaaaggatagtgtcgttggattttatttgtgtttttaaacgattgtattttttttattgcgaaggacggtgttattggatt

SEQ ID NO: 33642 - DNA, 639 bp, Artificial Sequence
  chemically treated genomic DNA (Homo sapiens) CpG-island No: 33642
aatccaataacaccgtccttcgcaataaaaaaaatacaatcgtttaaaaacacaaataaaatccaacgacactatcctttacaataaaaaaaacgcaatcgtttaacacgtaaaatcaaacgacactatcctttacaataaaaaaaacgcaatcgtttaacacgtaaaatcaaacgacactatcctttacaataaaaaaaacgcaatcgtttaacacgtaaaatccaacgacactatcctttacaataaaaaaaacgcaatcgtttaacacgtaaaatctaacgacactatcctttacaataaaaaaaacgcaatcgtttaacacgtaaaatcaaacgacactatcctttacaataaaaaaaacgcaatcgtttaacacgtaaaatcaaacgacactatcctttacaataaaaaaaacgcaatcgtttaacacgtaaaatccaacgacactatcctttacaataaaaaaaacgcaatcgtttaacacgtaaaatctaacgacactatcctttacaataaaaaaaacgcaatcgtttaacacgtaaaatcaaacgacactatcctttacaataaaaaaaacgcaatcgtttaacacgtaaaatccaacgacattatcctttacaataaaaaaaacgcaat

SEQ ID NO: 33643 - DNA, 639 bp, Artificial Sequence
  chemically treated genomic DNA (Homo sapiens) CpG-island No: 33643
gatttagtgatatcgtttttcgtagtgagggagatgtagtcgtttaagagtataggtgggatttagcgatattgttttttgtagtgagggagacgtagtcgtttaatacgtgggattaagcgatattgttttttgtagtgagggagacgtagtcgtttaatacgtgggattaagcgatattgttttttgtagtgagggagacgtagtcgtttaatacgtgggatttagcgatattgttttttgtagtgagggagacgtagtcgtttaatacgtgggatttggcgatattgttttttgtagtgagggagacgtagtcgtttaatacgtgggattaagcgatattgttttttgtagtgagggagacgtagtcgtttaatacgtgggattaagcgatattgttttttgtagtgagggagacgtagtcgtttaatacgtgggatttagcgatattgttttttgtagtgagggagacgtagtcgtttaatacgtgggatttggcgatattgttttttgtagtgagggagacgtagtcgtttaatacgtgggattaagcgatattgttttttgtagtgagggagacgtagtcgtttaatacgtgggatttagcgatattgttttttgtagtgagggagacgtagt

SEQ ID NO: 33644 - DNA, 639 bp, Artificial Sequence
  chemically treated genomic DNA (Homo sapiens) CpG-island No: 33644
actacgtctccctcactacaaaaaacaatatcgctaaatcccacgtattaaacgactacgtctccctcactacaaaaaacaatatcgcttaatcccacgtattaaacgactacgtctccctcactacaaaaaacaatatcgccaaatcccacgtattaaacgactacgtctccctcactacaaaaaacaatatcgctaaatcccacgtattaaacgactacgtctccctcactacaaaaaacaatatcgcttaatcccacgtattaaacgactacgtctccctcactacaaaaaacaatatcgcttaatcccacgtattaaacgactacgtctccctcactacaaaaaacaatatcgccaaatcccacgtattaaacgactacgtctccctcactacaaaaaacaatatcgctaaatcccacgtattaaacgactacgtctccctcactacaaaaaacaatatcgcttaatcccacgtattaaacgactacgtctccctcactacaaaaaacaatatcgcttaatcccacgtattaaacgactacgtctccctcactacaaaaaacaatatcgctaaatcccacctatactcttaaacgactacatctccctcactacgaaaaacgatatcactaaatc

SEQ ID NO: 33645 - DNA, 589 bp, Artificial Sequence
  chemically treated genomic DNA (Homo sapiens) CpG-island No: 33645
ggggcgtcgggaggggaagagggttcgcggttaggttcgtatttatttcgttttcgaagcgtattattttttggttcgtgggttcgcgtaagtcggggaagcgcgtgagttttttcgagttttcggggtttcggggcgtcggggcgcgcggttttattaggtatcggtcgatgatttcgttttgttgcgcgggcggtagtcgcgtttattcgggttcgtatttttcgcggattttttttttgttttgtatgatttttttggttatggggtttagcgacgagaagtaagtgaagcgttttcgttttcggtcgtgtagaggtcggtttttgtttatgatcgtcgagcgcgaagtcgcgatcgtcgtcgttatggacgttatgttcggtttgttcgtcgttttcggttcgcgtttcgtttttcgttgtgttcgttttagtttcgtatcgcgttattcggagtttcgtttttttcgggaatttcgttttgtatcgtcgcgtattcgggtttttaagttaatttagttttttaagtttcgggatttcggtttttcgtggtttttttttcgggagttttttttttcgggtttttt

SEQ ID NO: 33646 - DNA, 589 bp, Artificial Sequence
  chemically treated genomic DNA (Homo sapiens) CpG-island No: 33646
aaaaaacccgaaaaaaaaaactcccgaaaaaaaaaccacgaaaaaccgaaatcccgaaacttaaaaaactaaattaacttaaaaacccgaatacgcgacgatacaaaacgaaattcccgaaaaaaacgaaactccgaataacgcgatacgaaactaaaacgaacacaacgaaaaacgaaacgcgaaccgaaaacgacgaacaaaccgaacataacgtccataacgacgacgatcgcgacttcgcgctcgacgatcataaacaaaaaccgacctctacacgaccgaaaacgaaaacgcttcacttacttctcgtcgctaaaccccataaccaaaaaaatcatacaaaacaaaaaaaaaatccgcgaaaaatacgaacccgaataaacgcgactaccgcccgcgcaacaaaacgaaatcatcgaccgatacctaataaaaccgcgcgccccgacgccccgaaaccccgaaaactcgaaaaaactcacgcgcttccccgacttacgcgaacccacgaaccaaaaaataatacgcttcgaaaacgaaataaatacgaacctaaccgcgaaccctcttcccctcccgacgcccc

SEQ ID NO: 33647 - DNA, 589 bp, Artificial Sequence
  chemically treated genomic DNA (Homo sapiens) CpG-island No: 33647
ggggggttcggagggaggagttttcggggagggggttacggagggtcggggtttcggggtttggggagttgggttggtttggagattcgggtacgcggcggtgtagggcggggttttcggagggggcggagtttcgggtggcgcggtgcggggttagggcgggtatagcgaggggcggggcgcgggtcgggagcggcgggtaggtcgggtatggcgtttatggcggcggcgatcgcggtttcgcgttcggcggttatgagtaggaatcggtttttgtacgatcgggagcgaaagcgttttatttatttttcgtcgttgagttttatggttaggaagattatgtaggataaggagaagattcgcgagaagtacgggttcgagtgggcgcggttgtcgttcgcgtagtaggacgagattatcgatcggtgtttggtggggtcgcgcgtttcggcgtttcgagatttcggggattcggaggagtttacgcgttttttcggtttgcgcgggtttacgggttagaaggtggtgcgtttcggggacgaggtaggtgcgggtttggtcgcggattttttttttttttcggcgtttt

SEQ ID NO: 33648 - DNA, 589 bp, Artificial Sequence
  chemically treated genomic DNA (Homo sapiens) CpG-island No: 33648
aaaacgccgaaaaaaaaaaaaaatccgcgaccaaacccgcacctacctcgtccccgaaacgcaccaccttctaacccgtaaacccgcgcaaaccgaaaaaacgcgtaaactcctccgaatccccgaaatctcgaaacgccgaaacgcgcgaccccaccaaacaccgatcgataatctcgtcctactacgcgaacgacaaccgcgcccactcgaacccgtacttctcgcgaatcttctccttatcctacataatcttcctaaccataaaactcaacgacgaaaaataaataaaacgctttcgctcccgatcgtacaaaaaccgattcctactcataaccgccgaacgcgaaaccgcgatcgccgccgccataaacgccatacccgacctacccgccgctcccgacccgcgccccgcccctcgctatacccgccctaaccccgcaccgcgccacccgaaactccgccccctccgaaaaccccgccctacaccgccgcgtacccgaatctccaaaccaacccaactccccaaaccccgaaaccccgaccctccgtaaccccctccccgaaaactcctccctccgaacccccc

SEQ ID NO: 33649 - DNA, 639 bp, Artificial Sequence
  chemically treated genomic DNA (Homo sapiens) CpG-island No: 33649
gtaagtttaggaacgggggtgggtagagtatttttcgggtattgtcgttcgtttttaaaagaagattatcgggggttttagggttacggcgaggacgggtattggttagatttcggataggcggttttggtttcgggcgtacgaaaggtggagacgaagaaaagtcggatttattggtttttgatttttttgtagtgggtttcgcgttttcgttttagtcggtttttcgtgttaaattgtagggtagtgttttgtttttgaggacgcgcgtggtcggtattttttatttcggtgatttcgagatttcgtagttttgcggagagtttacgatggtcgtttgtagaggagttggatcgcgggcgtaggaagatttcggggaaggttttttttaagtaggagtttgtgttatttatttgggaattggacgtcgtcgtcggttgtttcgaagtttgaggaatttgttttttaaatgttttttggtttttttttttcgtcgttattcgttgtttgggacgttcgcggggtggagttggatggaaatcgttttgcggtttttttgtttcggggggttgcgtggaggagggtttttatagttcgcgttttatttaattttgacggttaggggagggtttcgtttag

SEQ ID NO: 33650 - DNA, 639 bp, Artificial Sequence
  chemically treated genomic DNA (Homo sapiens) CpG-island No: 33650
ctaaacgaaaccctcccctaaccgtcaaaattaaataaaacgcgaactataaaaaccctcctccacgcaaccccccgaaacaaaaaaaccgcaaaacgatttccatccaactccaccccgcgaacgtcccaaacaacgaataacgacgaaaaaaaaaaaccaaaaaacatttaaaaaacaaattcctcaaacttcgaaacaaccgacgacgacgtccaattcccaaataaataacacaaactcctacttaaaaaaaaccttccccgaaatcttcctacgcccgcgatccaactcctctacaaacgaccatcgtaaactctccgcaaaactacgaaatctcgaaatcaccgaaataaaaaataccgaccacgcgcgtcctcaaaaacaaaacactaccctacaatttaacacgaaaaaccgactaaaacgaaaacgcgaaacccactacaaaaaaatcaaaaaccaataaatccgacttttcttcgtctccacctttcgtacgcccgaaaccaaaaccgcctatccgaaatctaaccaatacccgtcctcgccgtaaccctaaaacccccgataatcttcttttaaaaacgaacgacaatacccgaaaaatactctacccacccccgttcctaaacttac

SEQ ID NO: 33651 - DNA, 639 bp, Artificial Sequence
  chemically treated genomic DNA (Homo sapiens) CpG-island No: 33651
ttagacggggtttttttttgatcgttaaggttaagtagggcgcgggttgtgaggatttttttttacgtagtttttcgaggtagaggggtcgtaaagcggtttttatttaattttatttcgcggacgttttaggtagcggatggcggcgggggggggaggttaggggatatttaggggataaattttttagatttcgaggtagtcggcgacggcgtttaatttttaaataaatagtataaatttttatttggaaaaggtttttttcggggtttttttgcgttcgcggtttagtttttttgtagacggttatcgtgggtttttcgtagggttgcggagtttcggagttatcgaggtgggaggtgtcggttacgcgcgtttttaggaatagagtattgttttgtagtttagtacgaagggtcggttggagcgggagcgcgaggtttattgtaagaggattaggagttagtaagttcggttttttttcgtttttatttttcgtgcgttcggggttaggatcgtttgttcggaatttgattagtgttcgttttcgtcgtggttttgggattttcggtggtttttttttggggacgaacggtagtgttcgaaggatgttttatttattttcgtttttagatttgt

SEQ ID NO: 33652 - DNA, 639 bp, Artificial Sequence
  chemically treated genomic DNA (Homo sapiens) CpG-island No: 33652
acaaatctaaaaacgaaaataaataaaacatccttcgaacactaccgttcgtccccaaaaaaaaaccaccgaaaatcccaaaaccacgacgaaaacgaacactaatcaaattccgaacaaacgatcctaaccccgaacgcacgaaaaataaaaacgaaaaaaaaccgaacttactaactcctaatcctcttacaataaacctcgcgctcccgctccaaccgacccttcgtactaaactacaaaacaatactctattcctaaaaacgcgcgtaaccgacacctcccacctcgataactccgaaactccgcaaccctacgaaaaacccacgataaccgtctacaaaaaaactaaaccgcgaacgcaaaaaaaccccgaaaaaaaccttttccaaataaaaatttatactatttatttaaaaattaaacgccgtcgccgactacctcgaaatctaaaaaatttatcccctaaatatcccctaacctcccccccccgccgccatccgctacctaaaacgtccgcgaaataaaattaaataaaaaccgctttacgacccctctacctcgaaaaactacgtaaaaaaaaatcctcacaacccgcgccctacttaaccttaacgatcaaaaaaaaaccccgtctaa

SEQ ID NO: 33653 - DNA, 519 bp, Artificial Sequence
  chemically treated genomic DNA (Homo sapiens) CpG-island No: 33653
gcggtaggtataggtcgcggttgtttaaataaaatttacgaagaagtattcgggtcgtgtagtttcggagtttcggtgttttttgtaggtgatattcggtaagggttagttcgggaagttgggtaaagagataaacgttttcggagacgtaattttcgacgcgtttgttttcggtacgttattttcggcgtattgatttcgtttggggtcggttgagtggtatttaagcgggttatgttatgtaattttgggcgttgttaatcgtgggcgagttttgggtgtgcgggcggtttggcgcggcgtttcggtaaggcgtgtgtgcggtagggcggggatagaatcgttttttcgggttttgggcgtgttcgagatcgcgtttttcgtcgaaattaagtttcgagttattcgtgtggggtattcgttttttttggtatagttggtttttttttagaagttcgttttgtttgttttacgtttaaattcgcgtcggtttttatttttttttttggtaaggtttga

SEQ ID NO: 33654 - DNA, 519 bp, Artificial Sequence
  chemically treated genomic DNA (Homo sapiens) CpG-island No: 33654
tcaaaccttaccaaaaaaaaaaataaaaaccgacgcgaatttaaacgtaaaacaaacaaaacgaacttctaaaaaaaaaccaactataccaaaaaaaacgaataccccacacgaataactcgaaacttaatttcgacgaaaaacgcgatctcgaacacgcccaaaacccgaaaaaacgattctatccccgccctaccgcacacacgccttaccgaaacgccgcgccaaaccgcccgcacacccaaaactcgcccacgattaacaacgcccaaaattacataacataacccgcttaaataccactcaaccgaccccaaacgaaatcaatacgccgaaaataacgtaccgaaaacaaacgcgtcgaaaattacgtctccgaaaacgtttatctctttacccaacttcccgaactaacccttaccgaatatcacctacaaaaaacaccgaaactccgaaactacacgacccgaatacttcttcgtaaattttatttaaacaaccgcgacctatacctaccgc

SEQ ID NO: 33655 - DNA, 519 bp, Artificial Sequence
  chemically treated genomic DNA (Homo sapiens) CpG-island No: 33655
ttagattttgttagggagagaaataagaatcgacgcgaatttagacgtaaaataaataaaacgggtttttggaaagaggttaattgtgttaggggggacgaatgttttatacggatgattcggagtttgatttcggcggggagcgcggtttcggatacgtttagagttcgagaggacggttttgttttcgttttgtcgtatatacgttttatcggagcgtcgcgttaggtcgttcgtatatttagagttcgtttacggttggtagcgtttaaggttgtatggtatggttcgtttaagtgttatttagtcggttttaggcgggattagtgcgtcggaagtggcgtgtcggaaataggcgcgtcggaagttgcgttttcggaagcgtttgtttttttatttagtttttcgggttaatttttatcgagtgttatttgtaggaggtatcgggatttcggggttgtacggttcgaatgttttttcgtgggttttgtttaagtagtcgcgatttgtgtttgtcgt

SEQ ID NO: 33656 - DNA, 519 bp, Artificial Sequence
  chemically treated genomic DNA (Homo sapiens) CpG-island No: 33656
acgacaaacacaaatcgcgactacttaaacaaaacccacgaaaaaacattcgaaccgtacaaccccgaaatcccgatacctcctacaaataacactcgataaaaattaacccgaaaaactaaataaaaaaacaaacgcttccgaaaacgcaacttccgacgcgcctatttccgacacgccacttccgacgcactaatcccgcctaaaaccgactaaataacacttaaacgaaccataccatacaaccttaaacgctaccaaccgtaaacgaactctaaatatacgaacgacctaacgcgacgctccgataaaacgtatatacgacaaaacgaaaacaaaaccgtcctctcgaactctaaacgtatccgaaaccgcgctccccgccgaaatcaaactccgaatcatccgtataaaacattcgtcccccctaacacaattaacctctttccaaaaacccgttttatttattttacgtctaaattcgcgtcgattcttatttctctccctaacaaaatctaa

SEQ ID NO: 33657 - DNA, 557 bp, Artificial Sequence
  chemically treated genomic DNA (Homo sapiens) CpG-island No: 33657
cgcgtttttcgttcggggtttcgtcggttttttagcggttagtcgttttttttttttttgttttcgagttttttttttcgttttcgtttttcggttttagagttcgagttgtcgtttcgtagttttaatttgtttaggttacggagtatgtttagtgcggcgcgtcgggttgggttgggggtgggtaggggtcgggtcggtcgtttagttgtcgcgagttcgtagggcgaggagtgggcgtcgattgggtcgggggcgtagtttcgcgagtcgggggtcgagtagtcgaggtaggtggtgggtagcgttaagaggaggtgggtggggtattcggggaagtcggttcgcggcgcgtttttttggggtttttttggcggtttttcgcggtatgtgttttatgtttaagggtcgggggcgtacgggatggcgttgggcgtagaatttagggagcgggggtagaaaagcggtatttttttcggatgggagattcgtagttcgtcgtgggtcgtgtggaggggtttaggattggttagaacggggtttttaaagtcgttggt

SEQ ID NO: 33658 - DNA, 557 bp, Artificial Sequence
  chemically treated genomic DNA (Homo sapiens) CpG-island No: 33658
accaacgactttaaaaaccccgttctaaccaatcctaaacccctccacacgacccacgacgaactacgaatctcccatccgaaaaaaataccgcttttctacccccgctccctaaattctacgcccaacgccatcccgtacgcccccgacccttaaacataaaacacataccgcgaaaaaccgccaaaaaaaccccaaaaaaacgcgccgcgaaccgacttccccgaataccccacccacctcctcttaacgctacccaccacctacctcgactactcgacccccgactcgcgaaactacgcccccgacccaatcgacgcccactcctcgccctacgaactcgcgacaactaaacgaccgacccgacccctacccacccccaacccaacccgacgcgccgcactaaacatactccgtaacctaaacaaattaaaactacgaaacgacaactcgaactctaaaaccgaaaaacgaaaacgaaaaaaaaaactcgaaaacaaaaaaaaaaaaaacgactaaccgctaaaaaaccgacgaaaccccgaacgaaaaacgcg

SEQ ID NO: 33659 - DNA, 557 bp, Artificial Sequence
  chemically treated genomic DNA (Homo sapiens) CpG-island No: 33659
gttaacggttttgggggtttcgttttggttagttttgagtttttttatacggtttacggcgggttgcgggttttttattcgaggagggtgtcgtttttttgttttcgttttttgggttttgcgtttagcgttatttcgtgcgttttcgatttttgggtatggggtatatgtcgcggggagtcgttagggagattttagaggagcgcgtcgcgggtcggttttttcggatgttttatttatttttttttggcgttgtttattatttgtttcggttgttcggttttcggttcgcgaggttgcgttttcgatttagtcggcgtttatttttcgttttgcgggttcgcggtaattgggcggtcggttcggtttttgtttatttttagtttagttcggcgcgtcgtattgggtatgtttcgtagtttgggtaggttggggttgcgaggcgatagttcgggttttggagtcgggaggcgagaacgaggagggaggttcgggggtaggggaggaggaagcggttggtcgttgaagggtcggcggggtttcgagcggaggacgcg

SEQ ID NO: 33660 - DNA, 557 bp, Artificial Sequence
  chemically treated genomic DNA (Homo sapiens) CpG-island No: 33660
cgcgtcctccgctcgaaaccccgccgacccttcaacgaccaaccgcttcctcctcccctacccccgaacctccctcctcgttctcgcctcccgactccaaaacccgaactatcgcctcgcaaccccaacctacccaaactacgaaacatacccaatacgacgcgccgaactaaactaaaaataaacaaaaaccgaaccgaccgcccaattaccgcgaacccgcaaaacgaaaaataaacgccgactaaatcgaaaacgcaacctcgcgaaccgaaaaccgaacaaccgaaacaaataataaacaacgccaaaaaaaaataaataaaacatccgaaaaaaccgacccgcgacgcgctcctctaaaatctccctaacgactccccgcgacatataccccatacccaaaaatcgaaaacgcacgaaataacgctaaacgcaaaacccaaaaaacgaaaacaaaaaaacgacaccctcctcgaataaaaaacccgcaacccgccgtaaaccgtataaaaaaactcaaaactaaccaaaacgaaacccccaaaaccgttaac

SEQ ID NO: 33661 - DNA, 557 bp, Artificial Sequence
  chemically treated genomic DNA (Homo sapiens) CpG-island No: 33661
taacgtttttagggtatttttggaaggttcgggtacggcgttgaggttttcgttttcgttttcgttcgttcgggcgaggttgcggtttcgggcgggttaaggtcgtagcggagtttttcggagttttcgttcggcggagaggtcggtttcgcgtggcggcgtcgttttcggttttggtttcggtttcgtttcgtcggcgttttttcgcggtttcggtttcgtttcgcggtttttcggcgggatgcgtggtcgtggcggggggcgcgttcgttgttttgcgtttttgcgttcgttgttgggcgttttcggggttcgggacgttgtcgtcgtcgttcgagattttgcgtaaggtaagcgcgcgttgcggggaggggacgcgggacgtggggttcggggtgttcgtcgggtacgaggcgttgggggacgattttttttgaattttttgtttttggtcgttgcgggtggtcgggaggttcgttgcgtttttagttatagaggtgggcgtttcgggtttcgggtttatcgttttttttttttttttcgtagtaaagttatta

SEQ ID NO: 33662 - DNA, 557 bp, Artificial Sequence
  chemically treated genomic DNA (Homo sapiens) CpG-island No: 33662
taataactttactacgaaaaaaaaaaaaaaaacgataaacccgaaacccgaaacgcccacctctataactaaaaacgcaacgaacctcccgaccacccgcaacgaccaaaaacaaaaaattcaaaaaaaatcgtcccccaacgcctcgtacccgacgaacaccccgaaccccacgtcccgcgtcccctccccgcaacgcgcgcttaccttacgcaaaatctcgaacgacgacgacaacgtcccgaaccccgaaaacgcccaacaacgaacgcaaaaacgcaaaacaacgaacgcgccccccgccacgaccacgcatcccgccgaaaaaccgcgaaacgaaaccgaaaccgcgaaaaaacgccgacgaaacgaaaccgaaaccaaaaccgaaaacgacgccgccacgcgaaaccgacctctccgccgaacgaaaactccgaaaaactccgctacgaccttaacccgcccgaaaccgcaacctcgcccgaacgaacgaaaacgaaaacgaaaacctcaacgccgtacccgaaccttccaaaaataccctaaaaacgtta

SEQ ID NO: 33663 - DNA, 557 bp, Artificial Sequence
  chemically treated genomic DNA (Homo sapiens) CpG-island No: 33663
tggtgattttgttgcgagggggaggaggggggcggtaagttcgagattcggggcgtttatttttgtggttgggggcgtagcgggtttttcggttattcgtaacggttaagggtaagggatttaggaggagtcgttttttagcgtttcgtgttcggcgggtatttcgggttttacgtttcgcgtttttttttcgtagcgcgcgtttattttgcgtaggatttcgggcggcggcggtagcgtttcgggtttcgaaggcgtttagtagcgagcgtaggggcgtaggatagcgggcgcgtttttcgttacggttacgtatttcgtcggagggtcgcggagcggagtcggggtcgcggggaggcgtcggcggggcgggatcgggattagggtcgggggcggcgtcgttacgcgaggtcggttttttcgtcgggcgggggtttcgaggggtttcgttgcgattttgattcgttcggagtcgtagtttcgttcgggcgagcgggagcgggagcggagattttagcgtcgtgttcgggttttttagggatgttttagaaacgtta

SEQ ID NO: 33664 - DNA, 557 bp, Artificial Sequence
  chemically treated genomic DNA (Homo sapiens) CpG-island No: 33664
taacgtttctaaaacatccctaaaaaacccgaacacgacgctaaaatctccgctcccgctcccgctcgcccgaacgaaactacgactccgaacgaatcaaaatcgcaacgaaacccctcgaaacccccgcccgacgaaaaaaccgacctcgcgtaacgacgccgcccccgaccctaatcccgatcccgccccgccgacgcctccccgcgaccccgactccgctccgcgaccctccgacgaaatacgtaaccgtaacgaaaaacgcgcccgctatcctacgcccctacgctcgctactaaacgccttcgaaacccgaaacgctaccgccgccgcccgaaatcctacgcaaaataaacgcgcgctacgaaaaaaaaacgcgaaacgtaaaacccgaaatacccgccgaacacgaaacgctaaaaaacgactcctcctaaatcccttacccttaaccgttacgaataaccgaaaaacccgctacgcccccaaccacaaaaataaacgccccgaatctcgaacttaccgcccccctcctccccctcgcaacaaaatcacca

SEQ ID NO: 33665 - DNA, 660 bp, Artificial Sequence
  chemically treated genomic DNA (Homo sapiens) CpG-island No: 33665
ttcgagtcggttcgggtgggggcggggtgggggcggcgcggagggtacggagattacggcggcgttattcgggatatttagggtttcgaggttttgggcggtttttacgcgagatcgtaaattatgataataggtagttattcgaggttaaataaaaacggagtgggtttttcgcgcgtcgtcgtttttcgcgtttttggcggtttttttcgaggttttcggcggttttacgagttcgtagtagtcggtggcgacgtcgttttcgttttatttttttgcgtaagtgcgaggttgtcggtagcgcggcgtacgtttcggtcgttttcggttttcgcgtaaaatttttattttgtttacgtgaagttgtcgttgttttagagagggggaaagagttgcgggaaaagtcggggagtgacgattgcggcggttgggcgcgtttttttattttttttttttttttttttttttttgtcgtagttcggagttttggttttttttttttttttttttttttcggagtcggttttttttttcgtttcgtttttttttcgtttgtgtacgttatttgttgtggggtggtcgaaggggatgttttgtttttattagaggtatagcgcgaaggggaaatttcgatattggaaggaacgagaataaatattt

SEQ ID NO: 33666 - DNA, 660 bp, Artificial Sequence
  chemically treated genomic DNA (Homo sapiens) CpG-island No: 33666
aaatatttattctcgttccttccaatatcgaaatttccccttcgcgctatacctctaataaaaacaaaacatccccttcgaccaccccacaacaaataacgtacacaaacgaaaaaaaaacgaaacgaaaaaaaaaaccgactccgaaaaaaaaaaaaaaaaaaaaaaaaccaaaactccgaactacgacaaaaaaaaaaaaaaaaaaaaaaaaaataaaaaaacgcgcccaaccgccgcaatcgtcactccccgacttttcccgcaactctttccccctctctaaaacaacgacaacttcacgtaaacaaaataaaaattttacgcgaaaaccgaaaacgaccgaaacgtacgccgcgctaccgacaacctcgcacttacgcaaaaaaataaaacgaaaacgacgtcgccaccgactactacgaactcgtaaaaccgccgaaaacctcgaaaaaaaccgccaaaaacgcgaaaaacgacgacgcgcgaaaaacccactccgtttttatttaacctcgaataactacctattatcataatttacgatctcgcgtaaaaaccgcccaaaacctcgaaaccctaaatatcccgaataacgccgccgtaatctccgtaccctccgcgccgcccccaccccgcccccacccgaaccgactcgaa

SEQ ID NO: 33667 - DNA, 660 bp, Artificial Sequence
  chemically treated genomic DNA (Homo sapiens) CpG-island No: 33667
aagtatttattttcgttttttttagtgtcgaagtttttttttcgcgttgtgtttttggtgaaaataggatatttttttcggttattttataataaatagcgtatataagcgggggagaagcggggcggagggagaagtcggtttcgagggggaggaggaaaggagaggagttaaaatttcggattgcgataggggggaaaggagaagaaaagaaaatgagagagcgcgtttagtcgtcgtagtcgttatttttcggtttttttcgtagttttttttttttttttaaggtagcgataattttacgtggataggatggaagttttgcgcggaagtcgggaacggtcggagcgtgcgtcgcgttgtcggtagtttcgtatttgcgtagggaggtggggcgggggcgacgtcgttatcggttattgcgggttcgtgaggtcgtcgggggtttcgggggaggtcgttagggacgcggggggcggcggcgcgcgggggatttatttcgtttttatttgatttcgggtgattgtttattgttatggtttgcgatttcgcgtggggatcgtttagggtttcggggttttggatgtttcgggtggcgtcgtcgtaattttcgtgtttttcgcgtcgtttttatttcgtttttattcgggtcgattcgag

SEQ ID NO: 33668 - DNA, 660 bp, Artificial Sequence
  chemically treated genomic DNA (Homo sapiens) CpG-island No: 33668
ctcgaatcgacccgaataaaaacgaaataaaaacgacgcgaaaaacacgaaaattacgacgacgccacccgaaacatccaaaaccccgaaaccctaaacgatccccacgcgaaatcgcaaaccataacaataaacaatcacccgaaatcaaataaaaacgaaataaatcccccgcgcgccgccgccccccgcgtccctaacgacctcccccgaaacccccgacgacctcacgaacccgcaataaccgataacgacgtcgcccccgccccacctccctacgcaaatacgaaactaccgacaacgcgacgcacgctccgaccgttcccgacttccgcgcaaaacttccatcctatccacgtaaaattatcgctaccttaaaaaaaaaaaaaaaactacgaaaaaaaccgaaaaataacgactacgacgactaaacgcgctctctcattttcttttcttctcctttcccccctatcgcaatccgaaattttaactcctctcctttcctcctccccctcgaaaccgacttctccctccgccccgcttctcccccgcttatatacgctatttattataaaataaccgaaaaaaatatcctattttcaccaaaaacacaacgcgaaaaaaaaacttcgacactaaaaaaaacgaaaataaatactt

SEQ ID NO: 33669 - DNA, 551 bp, Artificial Sequence
  chemically treated genomic DNA (Homo sapiens) CpG-island No: 33669
attacggacgtattgaatcgcggttgggatagatatttcgggaattcgaggcggatcgggcgacgaggtgagtgatttttttttttaattttcgttttagggttttcgggggagtttgagttgagagaatttttaaatttttcgggaaagtgcgcgaggtttcgtcggggacgtcgagcgttgggtattgaggacgcgtagttggacggtgcgtgggcgtttgcgttttcggggggcgtttggaggtcgggtgttttacgtttgagggttcgggtcgttcggatcgtagcggtgttttttgttttagaagacgtttttaagttttaagggtttttttcgagtttgtttgtttttttcggggtcggcgcggagtttgcgcgtaacggagtttatttagtagtttagcgcgcggtttttatttgtatttcgtttttatttggtagaggcgcgagtatcggggttttttttatattttttttatgacgtgtattattttttgatgattttttagatggtttaggcgcgaggatgttgatttagagtttttcgga

SEQ ID NO: 33670 - DNA, 551 bp, Artificial Sequence
  chemically treated genomic DNA (Homo sapiens) CpG-island No: 33670
tccgaaaaactctaaatcaacatcctcgcgcctaaaccatctaaaaaatcatcaaaaaataatacacgtcataaaaaaaatataaaaaaaaccccgatactcgcgcctctaccaaataaaaacgaaatacaaataaaaaccgcgcgctaaactactaaataaactccgttacgcgcaaactccgcgccgaccccgaaaaaaacaaacaaactcgaaaaaaacccttaaaacttaaaaacgtcttctaaaacaaaaaacaccgctacgatccgaacgacccgaaccctcaaacgtaaaacacccgacctccaaacgccccccgaaaacgcaaacgcccacgcaccgtccaactacgcgtcctcaatacccaacgctcgacgtccccgacgaaacctcgcgcactttcccgaaaaatttaaaaattctctcaactcaaactcccccgaaaaccctaaaacgaaaattaaaaaaaaaaatcactcacctcgtcgcccgatccgcctcgaattcccgaaatatctatcccaaccgcgattcaatacgtccgtaat

SEQ ID NO: 33671 - DNA, 551 bp, Artificial Sequence
  chemically treated genomic DNA (Homo sapiens) CpG-island No: 33671
ttcgaaggattttgggttagtattttcgcgtttggattatttagggggttattagaaagtaatatacgttataagaaagatgtgggggagatttcgatgttcgcgtttttgttaggtggaggcggggtgtaggtagaagtcgcgcgttggattgttggatgaatttcgttacgcgtaggtttcgcgtcgatttcggaagggataggtaggttcggaagggatttttggggtttggggacgttttttagggtagagagtatcgttgcggttcgagcggttcgggtttttaggcgtggggtattcggtttttaagcgtttttcggggacgtaggcgtttacgtatcgtttagttgcgcgtttttagtatttagcgttcggcgttttcggcggagtttcgcgtattttttcggaaagtttgggggtttttttaatttaggttttttcgggagttttggggcgggggttggaagaaggggttatttatttcgtcgttcggttcgtttcgggttttcgaagtgtttgttttagtcgcggtttagtgcgttcgtaat

SEQ ID NO: 33672 - DNA, 551 bp, Artificial Sequence
  chemically treated genomic DNA (Homo sapiens) CpG-island No: 33672
attacgaacgcactaaaccgcgactaaaacaaacacttcgaaaacccgaaacgaaccgaacgacgaaataaataaccccttcttccaacccccgccccaaaactcccgaaaaaacctaaattaaaaaaacccccaaactttccgaaaaaatacgcgaaactccgccgaaaacgccgaacgctaaatactaaaaacgcgcaactaaacgatacgtaaacgcctacgtccccgaaaaacgcttaaaaaccgaataccccacgcctaaaaacccgaaccgctcgaaccgcaacgatactctctaccctaaaaaacgtccccaaaccccaaaaatcccttccgaacctacctatcccttccgaaatcgacgcgaaacctacgcgtaacgaaattcatccaacaatccaacgcgcgacttctacctacaccccgcctccacctaacaaaaacgcgaacatcgaaatctcccccacatctttcttataacgtatattactttctaataaccccctaaataatccaaacgcgaaaatactaacccaaaatccttcgaa

SEQ ID NO: 33673 - DNA, 593 bp, Artificial Sequence
  chemically treated genomic DNA (Homo sapiens) CpG-island No: 33673
tttttttttttgcgtatgtgtattttcgtttttcgttttaggcgagtttttttttggattttagttttttgtgggaaataatttttcgttttcggaggcggcgaggagcggcgggtgagtttcggagtattgggcgagggttagggggttttcgcgttgttttgaaggcgggcgggcggcggttagatttcggcggtggggagggatttttggcgtttgcggcgacggtgggacgagggcgtttttgttagaaggggatgaggtttggcgtgggaacgcgagtttcggggttttcgggggttcgtatgcgtttagtttttgcgtttggcgtttagcgaagttttgtagtacggggtaggtaatgcgtattggttcgaaggggagggaattggttgcggggaggggatagtacgcgcgtgcgtagcgtgtgacgtttgttgtgcgcgtgcgtatggcgtttgatgtgtgcgtgtgcgttttttgtgttttgagttcgcggggaggaggcggggttgcgggggagagcgattgcgttaggttcgcgataaatgaattagatataattatttacgggagattcggttttttttttt

SEQ ID NO: 33674 - DNA, 593 bp, Artificial Sequence
  chemically treated genomic DNA (Homo sapiens) CpG-island No: 33674
aaaaaaaaaaaccgaatctcccgtaaataattatatctaattcatttatcgcgaacctaacgcaatcgctctcccccgcaaccccgcctcctccccgcgaactcaaaacacaaaaaacgcacacgcacacatcaaacgccatacgcacgcgcacaacaaacgtcacacgctacgcacgcgcgtactatcccctccccgcaaccaattccctccccttcgaaccaatacgcattacctaccccgtactacaaaacttcgctaaacgccaaacgcaaaaactaaacgcatacgaacccccgaaaaccccgaaactcgcgttcccacgccaaacctcatccccttctaacaaaaacgccctcgtcccaccgtcgccgcaaacgccaaaaatccctccccaccgccgaaatctaaccgccgcccgcccgccttcaaaacaacgcgaaaaccccctaaccctcgcccaatactccgaaactcacccgccgctcctcgccgcctccgaaaacgaaaaattatttcccacaaaaaactaaaatccaaaaaaaaactcgcctaaaacgaaaaacgaaaatacacatacgcaaaaaaaaaaa

SEQ ID NO: 33675 - DNA, 593 bp, Artificial Sequence
  chemically treated genomic DNA (Homo sapiens) CpG-island No: 33675
agagaggaaaatcgagtttttcgtggataattgtgtttaatttatttgtcgcggatttggcgtagtcgttttttttcgtagtttcgtttttttttcgcgggtttagggtataaaaagcgtatacgtatatattaaacgttatgcgtacgcgtataataaacgttatacgttacgtacgcgcgtgttgtttttttttcgtagttagttttttttttttcgggttagtgcgtattgtttatttcgtgttataggatttcgttgagcgttaggcgtagggattggacgtatacggattttcgggagtttcggaattcgcgtttttacgttagattttatttttttttgatagagacgttttcgttttatcgtcgtcgtaggcgttaggggtttttttttatcgtcgaggtttagtcgtcgttcgttcgtttttagggtagcgcggggattttttggttttcgtttagtgtttcggggtttattcgtcgtttttcgtcgttttcggaggcgagggattgttttttataagggattggagtttagggaaggattcgtttggagcgggaggcggggatgtatatgcgtagagggagagg

SEQ ID NO: 33676 - DNA, 593 bp, Artificial Sequence
  chemically treated genomic DNA (Homo sapiens) CpG-island No: 33676
cctctccctctacgcatatacatccccgcctcccgctccaaacgaatccttccctaaactccaatcccttataaaaaacaatccctcgcctccgaaaacgacgaaaaacgacgaataaaccccgaaacactaaacgaaaaccaaaaaatccccgcgctaccctaaaaacgaacgaacgacgactaaacctcgacgataaaaaaaaacccctaacgcctacgacgacgataaaacgaaaacgtctctatcaaaaaaaaataaaatctaacgtaaaaacgcgaattccgaaactcccgaaaatccgtatacgtccaatccctacgcctaacgctcaacgaaatcctataacacgaaataaacaatacgcactaacccgaaaaaaaaaaaactaactacgaaaaaaaaacaacacgcgcgtacgtaacgtataacgtttattatacgcgtacgcataacgtttaatatatacgtatacgctttttataccctaaacccgcgaaaaaaaaacgaaactacgaaaaaaaacgactacgccaaatccgcgacaaataaattaaacacaattatccacgaaaaactcgattttcctctct

SEQ ID NO: 33677 - DNA, 936 bp, Artificial Sequence
  chemically treated genomic DNA (Homo sapiens) CpG-island No: 33677
tttcggttcgttgattagggattcgttagcgggtgtcgttgagttatattttcgtagttggcgttagtatttaggtatcgcgcgttatagtatttgtttgggcgttttcgcgtttggggcggggtttttcgcgttttttttaagaggtcgtattattcgtttttgacgttagagtgttttttcgtaagagttcgtgtttcgttaggtttcgcgttttcgcgtttatagtttcggcggcggtacgattagaggcggttaggggagcgcgtcgtttcgttcggttttttagttttttttcgttttttttttttcgtatagtagtcgttagcgcggttttttgtattatgtcggtggtcggttttaagaagtagttttataaagttatttaggtaaggcgcgcggtaggtgcgtttcggggtagttcggggcgaagttgcgaggggcgcgttcggcgttggtcgttcggcggtagtttggggagttcggtatcgagtttcgttcgcgtcggtcgcgtttcgtttcgtaagttaaggcggcggttcggggtattttcggtttgggcgtttattttcggtttttcgttttcggtttggtgcgcgttgttttttcgcgggttttcggcgttttgtttggtagcgttgttcgtcgttttcgtattatttcgcgttcgtgttgtaggaaggggatcgcggttgtattgttgtcgcggcgcgtaggtgttttggcggcgcggtgggagattatgtaaagtcgtttttttacgggtgattttgcggagtcggtgtattcggttttttcgggatgtgttggtatgagcggtggtcgtattgggggtggcggggcggaggtcggcggtttgcgttttttttttttattttgttgttagaatttttttttttcgtcgttcgtaggttttaggggaatggaaggttgggg

SEQ ID NO: 33678 - DNA, 936 bp, Artificial Sequence
  chemically treated genomic DNA (Homo sapiens) CpG-island No: 33678
ccccaaccttccattcccctaaaacctacgaacgacgaaaaaaaaaaattctaacaacaaaataaaaaaaaaaaacgcaaaccgccgacctccgccccgccacccccaatacgaccaccgctcataccaacacatcccgaaaaaaccgaatacaccgactccgcaaaatcacccgtaaaaaaacgactttacataatctcccaccgcgccgccaaaacacctacgcgccgcgacaacaatacaaccgcgatccccttcctacaacacgaacgcgaaataatacgaaaacgacgaacaacgctaccaaacaaaacgccgaaaacccgcgaaaaaacaacgcgcaccaaaccgaaaacgaaaaaccgaaaataaacgcccaaaccgaaaataccccgaaccgccgccttaacttacgaaacgaaacgcgaccgacgcgaacgaaactcgataccgaactccccaaactaccgccgaacgaccaacgccgaacgcgcccctcgcaacttcgccccgaactaccccgaaacgcacctaccgcgcgccttacctaaataactttataaaactacttcttaaaaccgaccaccgacataatacaaaaaaccgcgctaacgactactatacgaaaaaaaaaaaacgaaaaaaaactaaaaaaccgaacgaaacgacgcgctcccctaaccgcctctaatcgtaccgccgccgaaactataaacgcgaaaacgcgaaacctaacgaaacacgaactcttacgaaaaaacactctaacgtcaaaaacgaataatacgacctcttaaaaaaaacgcgaaaaaccccgccccaaacgcgaaaacgcccaaacaaatactataacgcgcgatacctaaatactaacgccaactacgaaaatataactcaacgacacccgctaacgaatccctaatcaacgaaccgaaa

SEQ ID NO: 33679 - DNA, 936 bp, Artificial Sequence
  chemically treated genomic DNA (Homo sapiens) CpG-island No: 33679
ttttagttttttatttttttggagtttgcgggcggcggggaaggagggttttgataatagggtaagggagaggagcgtaaatcgtcggttttcgtttcgttatttttagtgcggttatcgtttatgttaatatatttcgggaaagtcgggtgtatcgatttcgtaaggttattcgtgaagaggcgattttatataattttttatcgcgtcgttaaggtatttgcgcgtcgcggtagtagtgtagtcgcggttttttttttgtagtacgggcgcgagatgatgcgggggcggcgagtagcgttattaggtaggacgtcggggattcgcgggaaggtagcgcgtattaagtcgggggcgggggatcgagggtggacgtttagatcggggatgtttcgagtcgtcgttttggtttgcgaggcggggcgcggtcggcgcgggcgaggttcggtgtcgaattttttaagttgtcgtcggacggttagcgtcgagcgcgtttttcgtagtttcgtttcggattgtttcgggacgtatttgtcgcgcgttttatttgagtggttttatggaattgttttttgaggtcggttatcgatatggtgtaggaggtcgcgttggcggttgttgtgcgggagggaggaggcggagggggattggagggtcgagcggggcggcgcgtttttttggtcgtttttggtcgtgtcgtcgtcggggttatgggcgcgagggcgcggagtttagcgggatacgggtttttgcggagaaatattttgacgttaagggcgggtgatgcggttttttaaaggggacgcgggaagtttcgttttaagcgcgggaacgtttaggtaggtgttgtggcgcgcggtatttggatgttggcgttaattgcggggatgtggtttagcggtattcgttggcggatttttagttagcgggtcgagg

SEQ ID NO: 33680 - DNA, 936 bp, Artificial Sequence
  chemically treated genomic DNA (Homo sapiens) CpG-island No: 33680
cctcgacccgctaactaaaaatccgccaacgaataccgctaaaccacatccccgcaattaacgccaacatccaaataccgcgcgccacaacacctacctaaacgttcccgcgcttaaaacgaaacttcccgcgtcccctttaaaaaaccgcatcacccgcccttaacgtcaaaatatttctccgcaaaaacccgtatcccgctaaactccgcgccctcgcgcccataaccccgacgacgacacgaccaaaaacgaccaaaaaaacgcgccgccccgctcgaccctccaatccccctccgcctcctccctcccgcacaacaaccgccaacgcgacctcctacaccatatcgataaccgacctcaaaaaacaattccataaaaccactcaaataaaacgcgcgacaaatacgtcccgaaacaatccgaaacgaaactacgaaaaacgcgctcgacgctaaccgtccgacgacaacttaaaaaattcgacaccgaacctcgcccgcgccgaccgcgccccgcctcgcaaaccaaaacgacgactcgaaacatccccgatctaaacgtccaccctcgatcccccgcccccgacttaatacgcgctaccttcccgcgaatccccgacgtcctacctaataacgctactcgccgcccccgcatcatctcgcgcccgtactacaaaaaaaaaaccgcgactacactactaccgcgacgcgcaaataccttaacgacgcgataaaaaattatataaaatcgcctcttcacgaataaccttacgaaatcgatacacccgactttcccgaaatatattaacataaacgataaccgcactaaaaataacgaaacgaaaaccgacgatttacgctcctctcccttaccctattatcaaaaccctccttccccgccgcccgcaaactccaaaaaaataaaaaactaaaa

SEQ ID NO: 33681 - DNA, 694 bp, Artificial Sequence
  chemically treated genomic DNA (Homo sapiens) CpG-island No: 33681
agcgttttagtgacgtagtcgaatattcgcgtttgtgattcgttaaaggtttatttttatggtgtcggcgaaggcgcgtttttgcggcgtcggggaaggcgcgttcgtgcggcgtcggggaaggcgcgttcgtgcggcgtcggggaaggcgcgtttttgcggcgtcggggaaggcgcgtttttgcggcgtcgcggaaggcgcgtttttgcggcgtcgcggaaggcgcgtttttgcggcgtcgcggaaggcgcgtttttgcggcgtcgcggaaggcgcgtttttgcgacgttataggggatcgttatttacgcggagttaatcggaatttatggcggggttgttgggttttttaggagcgcgtatgagcggacgttgtttatgggttgtcgggcgagatgtaatcggttgttgagttggtagttttgtgtcgttaggtttcggttcggtcgtcgttatatataagttgcgatgaggagttttacgatttttcggttttcggggtcgggcgtagtaagggttagattttgcgttagtaggcgttgcgcgttaatcggtcggtatttgtcgtagaaggtgtaatcgatcgtattgtcgcgtagaagttttttaatggttagtattagttgtagtttcggtcgtttattcgttttatttgagtttgtgtacgtgcgttttataacgttttttttagtt

SEQ ID NO: 33682 - DNA, 694 bp, Artificial Sequence
  chemically treated genomic DNA (Homo sapiens) CpG-island No: 33682
aactaaaaaaaacgttataaaacgcacgtacacaaactcaaataaaacgaataaacgaccgaaactacaactaatactaaccattaaaaaacttctacgcgacaatacgatcgattacaccttctacgacaaataccgaccgattaacgcgcaacgcctactaacgcaaaatctaacccttactacgcccgaccccgaaaaccgaaaaatcgtaaaactcctcatcgcaacttatatataacgacgaccgaaccgaaacctaacgacacaaaactaccaactcaacaaccgattacatctcgcccgacaacccataaacaacgtccgctcatacgcgctcctaaaaaacccaacaaccccgccataaattccgattaactccgcgtaaataacgatcccctataacgtcgcaaaaacgcgccttccgcgacgccgcaaaaacgcgccttccgcgacgccgcaaaaacgcgccttccgcgacgccgcaaaaacgcgccttccgcgacgccgcaaaaacgcgccttccccgacgccgcaaaaacgcgccttccccgacgccgcacgaacgcgccttccccgacgccgcacgaacgcgccttccccgacgccgcaaaaacgcgccttcgccgacaccataaaaataaacctttaacgaatcacaaacgcgaatattcgactacgtcactaaaacgct

SEQ ID NO: 33683 - DNA, 694 bp, Artificial Sequence
  chemically treated genomic DNA (Homo sapiens) CpG-island No: 33683
ggttgggggaggcgttgtggggcgtacgtatataggtttaagtgaggcgagtgggcggtcggggttgtagttggtgttggttattgaggagtttttgcgcgatagtgcgatcggttgtattttttgcgataggtgtcggtcggttggcgcgtagcgtttgttagcgtagagtttggtttttgttgcgttcggtttcgaagatcgggaagtcgtaaagttttttatcgtagtttatgtgtggcggcggtcgggtcgaagtttagcgatatagaattgttagtttagtagtcggttatatttcgttcggtaatttataggtagcgttcgtttatgcgcgtttttggaagatttagtagtttcgttatgagtttcgattggtttcgcgtgagtggcggttttttgtgacgtcgtaagggcgcgtttttcgcggcgtcgtaagggcgcgtttttcgcggcgtcgtaagggcgcgtttttcgcggcgtcgtaagggcgcgtttttcgcggcgtcgtaagggcgcgtttttttcggcgtcgtaagggcgcgtttttttcggcgtcgtacgggcgcgtttttttcggcgtcgtacgggcgcgtttttttcggcgtcgtaagggcgcgttttcgtcgatattatagaggtgggtttttggcgagttataggcgcgggtgttcggttacgttattggggcgtt

SEQ ID NO: 33684 - DNA, 694 bp, Artificial Sequence
  chemically treated genomic DNA (Homo sapiens) CpG-island No: 33684
aacgccccaataacgtaaccgaacacccgcgcctataactcgccaaaaacccacctctataatatcgacgaaaacgcgcccttacgacgccgaaaaaaacgcgcccgtacgacgccgaaaaaaacgcgcccgtacgacgccgaaaaaaacgcgcccttacgacgccgaaaaaaacgcgcccttacgacgccgcgaaaaacgcgcccttacgacgccgcgaaaaacgcgcccttacgacgccgcgaaaaacgcgcccttacgacgccgcgaaaaacgcgcccttacgacgtcacaaaaaaccgccactcacgcgaaaccaatcgaaactcataacgaaactactaaatcttccaaaaacgcgcataaacgaacgctacctataaattaccgaacgaaatataaccgactactaaactaacaattctatatcgctaaacttcgacccgaccgccgccacacataaactacgataaaaaactttacgacttcccgatcttcgaaaccgaacgcaacaaaaaccaaactctacgctaacaaacgctacgcgccaaccgaccgacacctatcgcaaaaaatacaaccgatcgcactatcgcgcaaaaactcctcaataaccaacaccaactacaaccccgaccgcccactcgcctcacttaaacctatatacgtacgccccacaacgcctcccccaacc

SEQ ID NO: 33685 - DNA, 506 bp, Artificial Sequence
  chemically treated genomic DNA (Homo sapiens) CpG-island No: 33685
gtcggtcggagtttcgcgtagggagcggatttttgttataggttcgttcgttaggtcggtttcgttgttcgggtcgcgcgcgttagtcgttcgttttttttagttttcgtttaattttgttcggttttaattttggtagttaaagtttagggagtcggcgtcgcgtcgtcgtcgtcgttcgtttttttttcgcggtttgggtcgtcgtcgtttcggttttatttgtaattggtgagtacgtttttatttattattacgattaggaaggagtttacgtcgtaaaagtcggcggttagtagttttagaaatacggttagcgtttcggtcgacgttatttttagtttttttttatttcggagtgtggaggatttcgcgggggttttttttttaattcgagtatgttgacgtttatgaattttcgttatggttgtcgtagtagcggtggtttggcggcggggtttagcggttcgggggtttgtagcggtagtttttaggggattttagga

SEQ ID NO: 33686 - DNA, 506 bp, Artificial Sequence
  chemically treated genomic DNA (Homo sapiens) CpG-island No: 33686
tcctaaaatcccctaaaaactaccgctacaaacccccgaaccgctaaaccccgccgccaaaccaccgctactacgacaaccataacgaaaattcataaacgtcaacatactcgaattaaaaaaaaaacccccgcgaaatcctccacactccgaaataaaaaaaaactaaaaataacgtcgaccgaaacgctaaccgtatttctaaaactactaaccgccgacttttacgacgtaaactccttcctaatcgtaataataaataaaaacgtactcaccaattacaaataaaaccgaaacgacgacgacccaaaccgcgaaaaaaaaacgaacgacgacgacgacgcgacgccgactccctaaactttaactaccaaaattaaaaccgaacaaaattaaacgaaaactaaaaaaaacgaacgactaacgcgcgcgacccgaacaacgaaaccgacctaacgaacgaacctataacaaaaatccgctccctacgcgaaactccgaccgac

SEQ ID NO: 33687 - DNA, 506 bp, Artificial Sequence
  chemically treated genomic DNA (Homo sapiens) CpG-island No: 33687
ttttggagttttttgggagttgtcgttgtaggttttcgagtcgttaggtttcgtcgttaggttatcgttgttgcggtagttatggcggaagtttatagacgttagtatgttcgggttaaaggagaagttttcgcgaaattttttatatttcgagatgaggaggagttggggatggcgtcggtcgaaacgttgatcgtgtttttgaagttgttggtcgtcggtttttacggcgtgagtttttttttgatcgtggtggtgaataagagcgtgtttattaattataggtagggtcgaggcggcggcggtttaggtcgcggaggaggagcgggcggcggcggcggcgcggcgtcggttttttggattttgattgttaaagttaaagtcgaataaagttgggcgggagttggggagggcgggcggttgacgcgcgcggttcgggtagcggagtcggtttggcgagcgggtttgtggtaggggttcgttttttgcgcggagtttcggtcggt

SEQ ID NO: 33688 - DNA, 506 bp, Artificial Sequence
  chemically treated genomic DNA (Homo sapiens) CpG-island No: 33688
accgaccgaaactccgcgcaaaaaacgaacccctaccacaaacccgctcgccaaaccgactccgctacccgaaccgcgcgcgtcaaccgcccgccctccccaactcccgcccaactttattcgactttaactttaacaatcaaaatccaaaaaaccgacgccgcgccgccgccgccgcccgctcctcctccgcgacctaaaccgccgccgcctcgaccctacctataattaataaacacgctcttattcaccaccacgatcaaaaaaaaactcacgccgtaaaaaccgacgaccaacaacttcaaaaacacgatcaacgtttcgaccgacgccatccccaactcctcctcatctcgaaatataaaaaatttcgcgaaaacttctcctttaacccgaacatactaacgtctataaacttccgccataactaccgcaacaacgataacctaacgacgaaacctaacgactcgaaaacctacaacgacaactcccaaaaaactccaaaa

SEQ ID NO: 33689 - DNA, 1034 bp, Artificial Sequence
  chemically treated genomic DNA (Homo sapiens) CpG-island No: 33689
gtatgcgcgttagtatcgcgtgttagggttttgaaagttaggtttcgcgtcggtgcggtagcgcgaggtttgtagttttaagttcggggtcgtttcgggttttcgagggggtgtgttttttatcgttttaatatggaaggggcggttttagtggtcggggaagtcggcgatttgtaggattgaaggttggtgttttgaaagagaggcggagggcgagagcgattttttcgttttttttgtatttcgtttaattttttcgttttttttttttttcggtcggttcgttcggtttttaatttgttttaatttattttgcggtagaggttgtcgggtttttttaaggttttttcgcgtttgcgttttgggtttttttgacgcggtcgggtcggatttcggaggaattagttggttagttggtaaggggttggttgtagtttcgatagcggcggtgtcgggaggggtaggtgagggtcgcgaggcggttttgagtttttgagtgagcgtggtgtttttgggaattcgggacgggcgattcgtggagttaggagcggggtcgaggcgttgagacgcggcggcgcggttgtcggttggatgggaagttaatgtttacggcgaagtttatttaacgtttttaaggtgaggggcgttgcgttaggtcgggcgggtcgggaggtcgggcgggcggtgagttcgtgtttcgttggcgtatagttgggtcgaggcgcggcgggcgggggtcgtcgtaagttttgttgtgggagcggggcgggcgcgtttggtttcgttagggtttaagttttttgtattcgttttttcgtttgtcgtcgtcgtcgtcgttcgtagttttttttttcgtgggcgttggggaagaaattcgtcggcgggtttaattgtggcgttttagggcggtggagggacggagtagtttcgggggtacgttttcgtaaatttcgtggaggatattgattttgtattttattttcgaggttagaagtcggttttttttggggatttgaggggcgagagtattcgtt

SEQ ID NO: 33690 - DNA, 1034 bp, Artificial Sequence
  chemically treated genomic DNA (Homo sapiens) CpG-island No: 33690
aacgaatactctcgcccctcaaatccccaaaaaaaaccgacttctaacctcgaaaataaaatacaaaatcaatatcctccacgaaatttacgaaaacgtacccccgaaactactccgtccctccaccgccctaaaacgccacaattaaacccgccgacgaatttcttccccaacgcccacgaaaaaaaaaactacgaacgacgacgacgacgacaaacgaaaaaacgaatacaaaaaacttaaaccctaacgaaaccaaacgcgcccgccccgctcccacaacaaaacttacgacgacccccgcccgccgcgcctcgacccaactatacgccaacgaaacacgaactcaccgcccgcccgacctcccgacccgcccgacctaacgcaacgcccctcaccttaaaaacgttaaataaacttcgccgtaaacattaacttcccatccaaccgacaaccgcgccgccgcgtctcaacgcctcgaccccgctcctaactccacgaatcgcccgtcccgaattcccaaaaacaccacgctcactcaaaaactcaaaaccgcctcgcgaccctcacctacccctcccgacaccgccgctatcgaaactacaaccaaccccttaccaactaaccaactaattcctccgaaatccgacccgaccgcgtcaaaaaaacccaaaacgcaaacgcgaaaaaaccttaaaaaaacccgacaacctctaccgcaaaataaattaaaacaaattaaaaaccgaacgaaccgaccgaaaaaaaaaaaaaacgaaaaaattaaacgaaatacaaaaaaaacgaaaaaatcgctctcgccctccgcctctctttcaaaacaccaaccttcaatcctacaaatcgccgacttccccgaccactaaaaccgccccttccatattaaaacgataaaaaacacaccccctcgaaaacccgaaacgaccccgaacttaaaactacaaacctcgcgctaccgcaccgacgcgaaacctaactttcaaaaccctaacacgcgatactaacgcgcatac

SEQ ID NO: 33691 - DNA, 1034 bp, Artificial Sequence
  chemically treated genomic DNA (Homo sapiens) CpG-island No: 33691
ggcgagtgttttcgttttttaggtttttaaagggaatcgatttttggtttcgagggtggggtgtagggttagtgttttttacgggatttacgaggacgtgttttcgaagttgtttcgtttttttatcgttttgggacgttatagttagattcgtcgacgagttttttttttagcgtttacgagaaggagggttgcgggcggcggcggcggcgataggcgaggaagcgagtgtagggaatttaggttttggcggggttaggcgcgttcgtttcgtttttatagtaaaatttgcggcggttttcgttcgtcgcgtttcggtttagttgtgcgttagcggaatacggatttatcgttcgttcggtttttcggttcgttcggtttggcgtagcgttttttattttggaaacgttgagtagatttcgtcgtaaatattaattttttatttagtcggtagtcgcgtcgtcgcgttttagcgtttcggtttcgtttttggttttacgggtcgttcgtttcgagtttttaaaagtattacgtttatttagaagtttagggtcgtttcgcgatttttatttatttttttcggtatcgtcgttgtcggaattgtagttagttttttgttagttggttagttggttttttcggggttcggttcggtcgcgttaggagagtttaaggcgtaggcgcgggagggttttaaagagattcggtagtttttatcgtagaatgggttggagtaggttaggggtcgggcgggtcggtcgagaaaaggagaaggcgaagggattggacggagtgtagaggaggcggggaaatcgttttcgtttttcgttttttttttaaagtattagtttttagttttgtaagtcgtcgattttttcggttattggaatcgttttttttatgttaaaacggtagaagatatattttttcgggggttcgaagcgatttcgagtttaggattgtaggtttcgcgttgtcgtatcgacgcggagtttgatttttagggttttggtacgcggtgttgacgcgtatgt

SEQ ID NO: 33692 - DNA, 1034 bp, Artificial Sequence
  chemically treated genomic DNA (Homo sapiens) CpG-island No: 33692
acatacgcgtcaacaccgcgtaccaaaaccctaaaaatcaaactccgcgtcgatacgacaacgcgaaacctacaatcctaaactcgaaatcgcttcgaacccccgaaaaaatatatcttctaccgttttaacataaaaaaaacgattccaataaccgaaaaaatcgacgacttacaaaactaaaaactaatactttaaaaaaaaaacgaaaaacgaaaacgatttccccgcctcctctacactccgtccaatcccttcgccttctccttttctcgaccgacccgcccgacccctaacctactccaacccattctacgataaaaactaccgaatctctttaaaaccctcccgcgcctacgccttaaactctcctaacgcgaccgaaccgaaccccgaaaaaaccaactaaccaactaacaaaaaactaactacaattccgacaacgacgataccgaaaaaaataaataaaaatcgcgaaacgaccctaaacttctaaataaacgtaatacttttaaaaactcgaaacgaacgacccgtaaaaccaaaaacgaaaccgaaacgctaaaacgcgacgacgcgactaccgactaaataaaaaattaatatttacgacgaaatctactcaacgtttccaaaataaaaaacgctacgccaaaccgaacgaaccgaaaaaccgaacgaacgataaatccgtattccgctaacgcacaactaaaccgaaacgcgacgaacgaaaaccgccgcaaattttactataaaaacgaaacgaacgcgcctaaccccgccaaaacctaaattccctacactcgcttcctcgcctatcgccgccgccgccgcccgcaaccctccttctcgtaaacgctaaaaaaaaaactcgtcgacgaatctaactataacgtcccaaaacgataaaaaaacgaaacaacttcgaaaacacgtcctcgtaaatcccgtaaaaaacactaaccctacaccccaccctcgaaaccaaaaatcgattccctttaaaaacctaaaaaacgaaaacactcgcc

SEQ ID NO: 33693 - DNA, 755 bp, Artificial Sequence
  chemically treated genomic DNA (Homo sapiens) CpG-island No: 33693
gtaggtttggttcgttgcgggtagttagggtaaagtggagcgtttcgttttcgttttggggcgtattttcgtcgtcgtcgggatttttcgtttttgttttttcgaatttagcggattagaggttggaggcgggaggcggagcggcgcgcgtacgcgggcggggtagagggttcggagtcgacgagtcgacgtgtcgacgttggcgttgtagcggggcggtgacgtgtaggtcggcgttagttttattttgttttttttcgtcgggtttgtgcgtttttgcgtttgtttgtttgattgatggtttttatacgcggttttttgtgattgggcgcgatttcggtaagcgcggtttggagggcggacggggcgcggcgatatagttgttcgttcgtatttttggttttgcgtttagttttttattcggcgtgggaagttaaagtaaaatcgaaagggaagaaggcgcggtggtaggagttgatagagtgatgggaaacgcgtgagttaggtcgagaggtgagtaggtgaaggtggaggtgggaggacgagaagggttttcgcgtttagggaagttggttgaagtcggggacggcgaggcgggttacgcgattcgttagagattttttttttgttttcggggtaagtttcgatttgttattttttttagtggtatgaggtcgagttcggggtttcgtaataatatcgtttatttttagagtttgtaggtggggttggggatagaaaatttaatttaagtt

SEQ ID NO: 33694 - DNA, 755 bp, Artificial Sequence
  chemically treated genomic DNA (Homo sapiens) CpG-island No: 33694
aacttaaattaaattttctatccccaaccccacctacaaactctaaaaataaacgatattattacgaaaccccgaactcgacctcataccactaaaaaaaataacaaatcgaaacttaccccgaaaacaaaaaaaaaatctctaacgaatcgcgtaacccgcctcgccgtccccgacttcaaccaacttccctaaacgcgaaaacccttctcgtcctcccacctccaccttcacctactcacctctcgacctaactcacgcgtttcccatcactctatcaactcctaccaccgcgccttcttccctttcgattttactttaacttcccacgccgaataaaaaactaaacgcaaaaccaaaaatacgaacgaacaactatatcgccgcgccccgtccgccctccaaaccgcgcttaccgaaatcgcgcccaatcacaaaaaaccgcgtataaaaaccatcaatcaaacaaacaaacgcaaaaacgcacaaacccgacgaaaaaaaacaaaataaaactaacgccgacctacacgtcaccgccccgctacaacgccaacgtcgacacgtcgactcgtcgactccgaaccctctaccccgcccgcgtacgcgcgccgctccgcctcccgcctccaacctctaatccgctaaattcgaaaaaacaaaaacgaaaaatcccgacgacgacgaaaatacgccccaaaacgaaaacgaaacgctccactttaccctaactacccgcaacgaaccaaacctac

SEQ ID NO: 33695 - DNA, 755 bp, Artificial Sequence
  chemically treated genomic DNA (Homo sapiens) CpG-island No: 33695
agtttaggttaagttttttatttttaattttatttataaattttaggaatgggcggtattgttgcgagatttcggattcgattttatgttattgaaaaggatgataggtcgggatttgtttcggaggtaggaagagaatttttggcgggtcgcgtagttcgtttcgtcgttttcggttttagttagtttttttgggcgcggggatttttttcgtttttttatttttatttttatttatttatttttcggtttggtttacgcgttttttattattttgttagtttttgttatcgcgtttttttttttttcggttttattttaattttttacgtcgggtgaggagttgagcgtagggttaaagatgcgagcgggtagttgtatcgtcgcgtttcgttcgttttttaagtcgcgtttgtcggggtcgcgtttagttatagggaatcgcgtgtgaggattattagttagatagatagacgtaaagacgtatagattcggcgaggagggatagagtggagttggcgtcggtttatacgttatcgtttcgttgtagcgttaacgtcggtacgtcgattcgtcgatttcgggttttttgtttcgttcgcgtgcgcgcgtcgtttcgtttttcgtttttagtttttagttcgttgggttcggaggagtagaggcggaaggtttcggcggcggcgaggatgcgttttagggcgggagcgggacgttttattttattttggttgttcgtaacgggttaggtttgt

SEQ ID NO: 33696 - DNA, 755 bp, Artificial Sequence
  chemically treated genomic DNA (Homo sapiens) CpG-island No: 33696
acaaacctaacccgttacgaacaaccaaaataaaataaaacgtcccgctcccgccctaaaacgcatcctcgccgccgccgaaaccttccgcctctactcctccgaacccaacgaactaaaaactaaaaacgaaaaacgaaacgacgcgcgcacgcgaacgaaacaaaaaacccgaaatcgacgaatcgacgtaccgacgttaacgctacaacgaaacgataacgtataaaccgacgccaactccactctatccctcctcgccgaatctatacgtctttacgtctatctatctaactaataatcctcacacgcgattccctataactaaacgcgaccccgacaaacgcgacttaaaaaacgaacgaaacgcgacgatacaactacccgctcgcatctttaaccctacgctcaactcctcacccgacgtaaaaaattaaaataaaaccgaaaaaaaaaaaaacgcgataacaaaaactaacaaaataataaaaaacgcgtaaaccaaaccgaaaaataaataaataaaaataaaaataaaaaaacgaaaaaaatccccgcgcccaaaaaaactaactaaaaccgaaaacgacgaaacgaactacgcgacccgccaaaaattctcttcctacctccgaaacaaatcccgacctatcatccttttcaataacataaaatcgaatccgaaatctcgcaacaataccgcccattcctaaaatttataaataaaattaaaaataaaaaacttaacctaaact

SEQ ID NO: 33697 - DNA, 760 bp, Artificial Sequence
  chemically treated genomic DNA (Homo sapiens) CpG-island No: 33697
ggcgtcgggtagggattaattatcggcggcgatcggttattcgcgttttagcgaggagattttgagattcgcggggagagtatagggtcgcgtcgttttttggcggtttaatgatagagttgaggttcggcggttggcgattgcggcgtttggtagttttaggaaaggattttttttgtgaagaaacgtttttacgaagattgttttgttttgtttttgttttttcgttttcgttcgttttttttttttttttttatttttttttttttttttttttttattttttttattttttttgtttttttttttttttcgtttttatttttttttttatttttatttttttttttcgtttttcgtttatcgtttttcgttttcgcggggtagcgtttcggtgtattcgtttggtagttagtttattagatttcgtattattgattcgtttttgagtaaaagttgatagtattttttttcgggttttttacgtttttatttttcgcgtttttttttaggtagttttggtttgcgttttttttcgttttttacgcgggtcgcgtcgaagtttcgtttttacgaaggacgagaataaatgtaattaaagcgatcggcgaggggggtgtgtttttattaacgtaggtacgagcgagggttttagcggtcggcgttcggtttgttatttttttttttttcgttttcgttttttggagcgggagtatttgggttgagttgcgtttgttttataaatttatatataattttt

SEQ ID NO: 33698 - DNA, 760 bp, Artificial Sequence
  chemically treated genomic DNA (Homo sapiens) CpG-island No: 33698
aaaaattatatataaatttataaaacaaacgcaactcaacccaaatactcccgctccaaaaaacgaaaacgaaaaaaaaaaaaataacaaaccgaacgccgaccgctaaaaccctcgctcgtacctacgttaataaaaacacacccccctcgccgatcgctttaattacatttattctcgtccttcgtaaaaacgaaacttcgacgcgacccgcgtaaaaaacgaaaaaaaacgcaaaccaaaactacctaaaaaaaaacgcgaaaaataaaaacgtaaaaaacccgaaaaaaaatactatcaacttttactcaaaaacgaatcaataatacgaaatctaataaactaactaccaaacgaatacaccgaaacgctaccccgcgaaaacgaaaaacgataaacgaaaaacgaaaaaaaaaaataaaaataaaaaaaaaaataaaaacgaaaaaaaaaaaaaaacaaaaaaaataaaaaaaataaaaaaaaaaaaaaaaaaaaaaataaaaaaaaaaaaaaaaaacgaacgaaaacgaaaaaacaaaaacaaaacaaaacaatcttcgtaaaaacgtttcttcacaaaaaaaatcctttcctaaaactaccaaacgccgcaatcgccaaccgccgaacctcaactctatcattaaaccgccaaaaaacgacgcgaccctatactctccccgcgaatctcaaaatctcctcgctaaaacgcgaataaccgatcgccgccgataattaatccctacccgacgcc

SEQ ID NO: 33699 - DNA, 760 bp, Artificial Sequence
  chemically treated genomic DNA (Homo sapiens) CpG-island No: 33699
gagaattatatgtggatttataggataggcgtagtttaatttaaatgttttcgttttagggggcggggacgagggggagggaggtggtaggtcgggcgtcggtcgttgggattttcgttcgtgtttgcgttggtgggggtatatttttttcgtcggtcgttttaattatatttgttttcgtttttcgtgagggcgagatttcggcgcggttcgcgtggggggcgggaggaggcgtaggttaggattgtttggaggggggcgcggggaatgggaacgtggggagttcgggagggggtgttgttagtttttgtttagaagcggattaatagtacgagatttaatgggttaattgttaagcgggtgtatcgaggcgttgtttcgcgggggcgggaggcggtgggcgaaggacgagagaaaggaatgggggtgggagagggagtgaggacggggaggggggaagggtaggaagagtggaagaggtggggggaggaggaagagagaaaataaagaaggggagagaaggcgagcgggagcgggagggtagggataggataggatagttttcgtaggggcgtttttttataagggggatttttttttggagttgttagacgtcgtagtcgttagtcgtcgggttttaattttgttattgagtcgttagggggcggcgcgattttgtgtttttttcgcggattttagggttttttcgttggggcgcgagtgatcggtcgtcgtcgatgattggtttttgttcggcgtt

SEQ ID NO: 33700 - DNA, 760 bp, Artificial Sequence
  chemically treated genomic DNA (Homo sapiens) CpG-island No: 33700
aacgccgaacaaaaaccaatcatcgacgacgaccgatcactcgcgccccaacgaaaaaaccctaaaatccgcgaaaaaaacacaaaatcgcgccgccccctaacgactcaataacaaaattaaaacccgacgactaacgactacgacgtctaacaactccaaaaaaaaatcccccttataaaaaaacgcccctacgaaaactatcctatcctatccctaccctcccgctcccgctcgccttctctccccttctttattttctctcttcctcctccccccacctcttccactcttcctacccttcccccctccccgtcctcactccctctcccacccccattcctttctctcgtccttcgcccaccgcctcccgcccccgcgaaacaacgcctcgatacacccgcttaacaattaacccattaaatctcgtactattaatccgcttctaaacaaaaactaacaacaccccctcccgaactccccacgttcccattccccgcgcccccctccaaacaatcctaacctacgcctcctcccgccccccacgcgaaccgcgccgaaatctcgccctcacgaaaaacgaaaacaaatataattaaaacgaccgacgaaaaaaatatacccccaccaacgcaaacacgaacgaaaatcccaacgaccgacgcccgacctaccacctccctccccctcgtccccgccccctaaaacgaaaacatttaaattaaactacgcctatcctataaatccacatataattctc

SEQ ID NO: 33701 - DNA, 511 bp, Artificial Sequence
  chemically treated genomic DNA (Homo sapiens) CpG-island No: 33701
tgggagttgcggtttacggcgtagttttagttttttttttgggggaagttttagaattataaatttcgtgagttagtgggttttcgtttgcgtacggagaagtcgattttttttggttttttagtttgcgtttgagaggtaagagagggcggggggaaggaagaggaggcgggattcgggcgttgcgttggttgcggtttggtattaaaggggcggtttcggcggagagcggatttagtggtttcggcgattatggattcggtcgaggcggtgttgtaagagaaggtatttaagtttatggtgaggagacggtggaggtcggggaacggtggaggcgttggcgttggcggcgtcgttggtttgggtcgttcgtttattgcgggatcgggtagcgggattttgggtcgaggttggcggcggagcggttggagggatgggatgggagttttagaaaggaggttgggggttgcggagcggatttaggggtgggggtagcggtttcgttattttg

SEQ ID NO: 33702 - DNA, 511 bp, Artificial Sequence
  chemically treated genomic DNA (Homo sapiens) CpG-island No: 33702
caaaataacgaaaccgctacccccacccctaaatccgctccgcaacccccaacctcctttctaaaactcccatcccatccctccaaccgctccgccgccaacctcgacccaaaatcccgctacccgatcccgcaataaacgaacgacccaaaccaacgacgccgccaacgccaacgcctccaccgttccccgacctccaccgtctcctcaccataaacttaaataccttctcttacaacaccgcctcgaccgaatccataatcgccgaaaccactaaatccgctctccgccgaaaccgcccctttaataccaaaccgcaaccaacgcaacgcccgaatcccgcctcctcttccttccccccgccctctcttacctctcaaacgcaaactaaaaaaccaaaaaaaatcgacttctccgtacgcaaacgaaaacccactaactcacgaaatttataattctaaaacttcccccaaaaaaaaaactaaaactacgccgtaaaccgcaactccca

SEQ ID NO: 33703 - DNA, 511 bp, Artificial Sequence
  chemically treated genomic DNA (Homo sapiens) CpG-island No: 33703
taagatggcggagtcgttgtttttatttttgggttcgtttcgtaatttttagttttttttttggagtttttattttatttttttagtcgtttcgtcgttagtttcggtttagggtttcgttgttcggtttcgtagtgggcgggcggtttaggttagcgacgtcgttaacgttagcgtttttatcgtttttcggtttttatcgtttttttattataaatttgagtgtttttttttgtagtatcgtttcggtcgggtttataatcgtcgaggttattgggttcgtttttcgtcggggtcgtttttttggtgttaggtcgtagttaacgtagcgttcggatttcgttttttttttttttttttcgtttttttttattttttaggcgtaggttgaggggttaaggagaatcggttttttcgtgcgtaggcgaaagtttattggtttacgggatttgtagttttggaattttttttaggaaaaaaattgaggttacgtcgtgaatcgtaattttta

SEQ ID NO: 33704 - DNA, 511 bp, Artificial Sequence
  chemically treated genomic DNA (Homo sapiens) CpG-island No: 33704
taaaaattacgattcacgacgtaacctcaatttttttcctaaaaaaaattccaaaactacaaatcccgtaaaccaataaactttcgcctacgcacgaaaaaaccgattctccttaacccctcaacctacgcctaaaaaataaaaaaaaacgaaaaaaaaaaaaaaaaaacgaaatccgaacgctacgttaactacgacctaacaccaaaaaaacgaccccgacgaaaaacgaacccaataacctcgacgattataaacccgaccgaaacgatactacaaaaaaaaacactcaaatttataataaaaaaacgataaaaaccgaaaaacgataaaaacgctaacgttaacgacgtcgctaacctaaaccgcccgcccactacgaaaccgaacaacgaaaccctaaaccgaaactaacgacgaaacgactaaaaaaataaaataaaaactccaaaaaaaaaactaaaaattacgaaacgaacccaaaaataaaaacaacgactccgccatctta

SEQ ID NO: 33705 - DNA, 604 bp, Artificial Sequence
  chemically treated genomic DNA (Homo sapiens) CpG-island No: 33705
tacgttttagtttaagattatcgtcgttagttatttcgtatagtcgatattagggatcggtatttttaggttttatttgttcgttttttagggatttggttaggtacgcggcggcggcggcggcggcggcgttcgttgggcggtagaggcgggattttttttcggttttttatttttcgcggagtttttttcggtcggaagcgttcggtaggttagatcggaaagggttcgggttatttcggcgtttagggttatttttttacgggttggtatttgggcgcgggcgttgtttcggagtcggtcggcgggatttggcgtttaattttgggggattcggtgtcgtggtttaggggtcgggtcgaggtttcgggggcggtgttttgcgggttcgtttcggggcggtgtttggtgggttggtttcgcggttttttttttttttgcgggtttagtcgttttttggtcgggcgagttaatcgtcggtttaatgacgacgaggttcgatttttttcgtttaggatttatagagataatcgaaggagagtttaaggcggtttttttgttgtcgtcgtttttattgaagtaagagtttttcggttttattgaa

SEQ ID NO: 33706 - DNA, 604 bp, Artificial Sequence
  chemically treated genomic DNA (Homo sapiens) CpG-island No: 33706
ttcaataaaaccgaaaaactcttacttcaataaaaacgacgacaacaaaaaaaccgccttaaactctccttcgattatctctataaatcctaaacgaaaaaaatcgaacctcgtcgtcattaaaccgacgattaactcgcccgaccaaaaaacgactaaacccgcaaaaaaaaaaaaaaccgcgaaaccaacccaccaaacaccgccccgaaacgaacccgcaaaacaccgcccccgaaacctcgacccgacccctaaaccacgacaccgaatcccccaaaattaaacgccaaatcccgccgaccgactccgaaacaacgcccgcgcccaaataccaacccgtaaaaaaataaccctaaacgccgaaataacccgaaccctttccgatctaacctaccgaacgcttccgaccgaaaaaaactccgcgaaaaataaaaaaccgaaaaaaaatcccgcctctaccgcccaacgaacgccgccgccgccgccgccgccgcgtacctaaccaaatccctaaaaaacgaacaaataaaacctaaaaataccgatccctaatatcgactatacgaaataactaacgacgataatcttaaactaaaacgta

SEQ ID NO: 33707 - DNA, 604 bp, Artificial Sequence
  chemically treated genomic DNA (Homo sapiens) CpG-island No: 33707
tttagtggagtcggggagtttttgttttagtgggggcggcgatagtaaagaagtcgttttgggttttttttcggttgtttttgtaggttttggacgggaagggtcgggtttcgtcgttattgagtcgacgattagttcgttcggttaaagggcgattgggttcgtagagaggggaggagtcgcggggttagtttattaggtatcgtttcgggacgggttcgtaaggtatcgttttcgggatttcggttcggtttttgggttacggtatcgggttttttaggattgggcgttaggtttcgtcggtcggtttcggggtagcgttcgcgtttaggtgttagttcgtgggaaggtgattttgggcgtcgggatgattcgagtttttttcggtttggtttgtcgggcgttttcggtcggaagggatttcgcggagggtgggggatcgaagggaagtttcgtttttatcgtttagcggacgtcgtcgtcgtcgtcgtcgtcgcgtatttagttaggtttttgaggggcgggtagatgaggtttaggggtgtcgatttttagtgtcgattatgcgaggtgattagcggcggtgattttgggttgggacgtg

SEQ ID NO: 33708 - DNA, 604 bp, Artificial Sequence
  chemically treated genomic DNA (Homo sapiens) CpG-island No: 33708
cacgtcccaacccaaaatcaccgccgctaatcacctcgcataatcgacactaaaaatcgacacccctaaacctcatctacccgcccctcaaaaacctaactaaatacgcgacgacgacgacgacgacgacgtccgctaaacgataaaaacgaaacttcccttcgatcccccaccctccgcgaaatcccttccgaccgaaaacgcccgacaaaccaaaccgaaaaaaactcgaatcatcccgacgcccaaaatcaccttcccacgaactaacacctaaacgcgaacgctaccccgaaaccgaccgacgaaacctaacgcccaatcctaaaaaacccgataccgtaacccaaaaaccgaaccgaaatcccgaaaacgataccttacgaacccgtcccgaaacgatacctaataaactaaccccgcgactcctcccctctctacgaacccaatcgccctttaaccgaacgaactaatcgtcgactcaataacgacgaaacccgacccttcccgtccaaaacctacaaaaacaaccgaaaaaaaacccaaaacgacttctttactatcgccgcccccactaaaacaaaaactccccgactccactaaa

SEQ ID NO: 33709 - DNA, 744 bp, Artificial Sequence
  chemically treated genomic DNA (Homo sapiens) CpG-island No: 33709
gggggtttcggggtttcggtttcgttttttattttaagttagaaaaaggaagagttttagtttgaaagggaattcgggcgtcgttttggcgtttttttcggattgcgtcgtattttcgttttttgttagggaggggttgtcgggttttggcggttttcgagtatcgagaacggggttagagtagttttttgtttgtttttcgcgattatagagcgcgggtttagggcgtcgttcgcgggtgggggacgtttttaggacggaagtggtcgagagagtgtcgaagggagggcgaggtcggagttcgagggcgattcgagaagcggcggggcggcgggtcggcgggcggggcgtagagttaggtagcgtaggtaggttagatcgggtcgggcgggggttttagggtggggtcgcggggtttggtttcggggcgggcgggttttgttttttttgcgtgttcggttcgggttttattagttggagaggttagcgtttagcgtatttcggtttgagttcggcgtgaagtaggtcgttttggggaagataggttttttttgggagtagttttatgtttgggataggttttggggagcgtgaggagtcgggtggtagcggggcgtagggcggggacgggttttggtgttagttgatagcgggtatgtgggtaggaaagttttgggtgagttggggattaggtggggttcgtttaggaattaagggtcgttataggagttaaaagttggggtt

SEQ ID NO: 33710 - DNA, 744 bp, Artificial Sequence
  chemically treated genomic DNA (Homo sapiens) CpG-island No: 33710
aaccccaacttttaactcctataacgacccttaattcctaaacgaaccccacctaatccccaactcacccaaaactttcctacccacatacccgctatcaactaacaccaaaacccgtccccgccctacgccccgctaccacccgactcctcacgctccccaaaacctatcccaaacataaaactactcccaaaaaaaacctatcttccccaaaacgacctacttcacgccgaactcaaaccgaaatacgctaaacgctaacctctccaactaataaaacccgaaccgaacacgcaaaaaaaacaaaacccgcccgccccgaaaccaaaccccgcgaccccaccctaaaacccccgcccgacccgatctaacctacctacgctacctaactctacgccccgcccgccgacccgccgccccgccgcttctcgaatcgccctcgaactccgacctcgccctcccttcgacactctctcgaccacttccgtcctaaaaacgtcccccacccgcgaacgacgccctaaacccgcgctctataatcgcgaaaaacaaacaaaaaactactctaaccccgttctcgatactcgaaaaccgccaaaacccgacaacccctccctaacaaaaaacgaaaatacgacgcaatccgaaaaaaacgccaaaacgacgcccgaattccctttcaaactaaaactcttcctttttctaacttaaaataaaaaacgaaaccgaaaccccgaaaccccc

SEQ ID NO: 33711 - DNA, 744 bp, Artificial Sequence
  chemically treated genomic DNA (Homo sapiens) CpG-island No: 33711
aattttagtttttaatttttatagcgatttttgatttttaaacggattttatttaatttttaatttatttaaagtttttttatttatatgttcgttattagttaatattaaagttcgttttcgttttgcgtttcgttgttattcgattttttacgttttttaaagtttattttagatataggattgtttttaggaaaggtttgttttttttaagacggtttattttacgtcgagtttaagtcgagatgcgttggacgttgatttttttaattaataggattcgaatcggatacgtaagagaggtagggttcgttcgtttcggggttaggtttcgcggttttattttaaggttttcgttcggttcggtttggtttatttgcgttgtttggttttgcgtttcgttcgtcggttcgtcgtttcgtcgtttttcgggtcgttttcgggtttcggtttcgtttttttttcgatattttttcggttattttcgttttgggaacgttttttattcgcgggcggcgttttgggttcgcgttttatggtcgcggggggtaggtaggaagttgttttggtttcgttttcgatgttcgggagtcgttaaagttcggtagtttttttttggtaggaagcgagggtgcggcgtaattcggagaggacgttaggacgacgttcgagtttttttttaggttagaattttttttttttttagtttggggtagaaggcggagtcggagtttcggaattttt

SEQ ID NO: 33712 - DNA, 744 bp, Artificial Sequence
  chemically treated genomic DNA (Homo sapiens) CpG-island No: 33712
aaaaattccgaaactccgactccgccttctaccccaaactaaaaaaaaaaaaaattctaacctaaaaaaaaactcgaacgtcgtcctaacgtcctctccgaattacgccgcaccctcgcttcctaccaaaaaaaaactaccgaactttaacgactcccgaacatcgaaaacgaaaccaaaacaacttcctacctaccccccgcgaccataaaacgcgaacccaaaacgccgcccgcgaataaaaaacgttcccaaaacgaaaataaccgaaaaaatatcgaaaaaaaaacgaaaccgaaacccgaaaacgacccgaaaaacgacgaaacgacgaaccgacgaacgaaacgcaaaaccaaacaacgcaaataaaccaaaccgaaccgaacgaaaaccttaaaataaaaccgcgaaacctaaccccgaaacgaacgaaccctacctctcttacgtatccgattcgaatcctattaattaaaaaaatcaacgtccaacgcatctcgacttaaactcgacgtaaaataaaccgtcttaaaaaaaacaaacctttcctaaaaacaatcctatatctaaaataaactttaaaaaacgtaaaaaatcgaataacaacgaaacgcaaaacgaaaacgaactttaatattaactaataacgaacatataaataaaaaaactttaaataaattaaaaattaaataaaatccgtttaaaaatcaaaaatcgctataaaaattaaaaactaaaatt

SEQ ID NO: 33713 - DNA, 830 bp, Artificial Sequence
  chemically treated genomic DNA (Homo sapiens) CpG-island No: 33713
ttttatacgtttttaggcgtttttttatacgttgttaggcgtttttttatagatttttaggcgtttttttttacgtttttaggcgtttttttatagatttttaggcgtttttttatacgtttttaggcgtttttttatacgttgttaggcgtttttttatacgtttttaggcgtttttttatagatttttaggcgtttttttatacgtttttaggcgtttttttatagatttttaggcgtttttttatacgttgttaggcgtttttttatacgtttttaggcgtttttttatacgttgttaggcgtttttttatacgttgttaggcgtttttttatagatttttaggcgtttatttatacgttgttaggcgtttttttatacgtttttaggcgtttgtttatacgttgttaggcgtttttttttacgtttttaggcgtttttttatagatttttaggcgtttttttatacgttgttaggcgtttttttatacgttgttaggcgtttttttatacgtttttaggcgtttttttatagatttttaggcgtttttttatacgtttttaggcgtttttttatagatttttaggcgtttttttatacgttgttaggcgtttttttatacgtttttaggcgtttttttatacgttgttaggcgtttttttatacgttgttaggcgtttttttatagatttttaggcgtttttttatacgttgttaggcgtttttttatacgtttttaggcgtttttttatacgttgttaggcgtttttttatacgttgttaggcgtttttttataggttgttaggcgtttttttatatatttttag

SEQ ID NO: 33714 - DNA, 830 bp, Artificial Sequence
  chemically treated genomic DNA (Homo sapiens) CpG-island No: 33714
ctaaaaatatataaaaaaacgcctaacaacctataaaaaaacgcctaacaacgtataaaaaaacgcctaacaacgtataaaaaaacgcctaaaaacgtataaaaaaacgcctaacaacgtataaaaaaacgcctaaaaatctataaaaaaacgcctaacaacgtataaaaaaacgcctaacaacgtataaaaaaacgcctaaaaacgtataaaaaaacgcctaacaacgtataaaaaaacgcctaaaaatctataaaaaaacgcctaaaaacgtataaaaaaacgcctaaaaatctataaaaaaacgcctaaaaacgtataaaaaaacgcctaacaacgtataaaaaaacgcctaacaacgtataaaaaaacgcctaaaaatctataaaaaaacgcctaaaaacgtaaaaaaaaacgcctaacaacgtataaacaaacgcctaaaaacgtataaaaaaacgcctaacaacgtataaataaacgcctaaaaatctataaaaaaacgcctaacaacgtataaaaaaacgcctaacaacgtataaaaaaacgcctaaaaacgtataaaaaaacgcctaacaacgtataaaaaaacgcctaaaaatctataaaaaaacgcctaaaaacgtataaaaaaacgcctaaaaatctataaaaaaacgcctaaaaacgtataaaaaaacgcctaacaacgtataaaaaaacgcctaaaaacgtataaaaaaacgcctaaaaatctataaaaaaacgcctaaaaacgtaaaaaaaaacgcctaaaaatctataaaaaaacgcctaacaacgtataaaaaaacgcctaaaaacgtataaaa

SEQ ID NO: 33715 - DNA, 830 bp, Artificial Sequence
  chemically treated genomic DNA (Homo sapiens) CpG-island No: 33715
ttgggagtgtgtggggaggcgtttggtagtttgtggggaggcgtttggtagcgtgtggggaggcgtttggtagcgtgtggggaggcgtttgggagcgtgtggggaggcgtttggtagcgtgtggggaggcgtttgggagtttgtggggaggcgtttggtagcgtgtggggaggcgtttggtagcgtgtggggaggcgtttgggagcgtgtggggaggcgtttggtagcgtgtggggaggcgtttgggagtttgtggggaggcgtttgggagcgtgtggggaggcgtttgggagtttgtggggaggcgtttgggagcgtgtagggaggcgtttggtagcgtgtggggaggcgtttggtagcgtgtggggaggcgtttgggagtttgtaaggaggcgtttgggagcgtggggggaggcgtttggtagcgtgtgggtaggcgtttgggagcgtgtggggaggcgtttggtagcgtgtgggtaggcgtttgggagtttgtggagaggcgtttggtagcgtgtgggaaggcgtttggtagcgtgtggggaggcgtttgggagcgtgtggggaggcgtttggtagcgtgtggggaggcgtttgggagtttgtggggaggcgtttgggagcgtgtggggaggcgtttgggagtttgtggggaggcgtttgggagcgtgtagggaggcgtttggtagcgtgtggggaggcgtttgggagcgtgtggggaggcgtttgggagtttgtggggaggcgtttgggagcgtggggggaggcgtttgggagtttgtggggaggcgtttggtagcgtgtggggaggcgtttgggagcgtgtgggg

SEQ ID NO: 33716 - DNA, 830 bp, Artificial Sequence
  chemically treated genomic DNA (Homo sapiens) CpG-island No: 33716
ccccacacgctcccaaacgcctccccacacgctaccaaacgcctccccacaaactcccaaacgcctccccccacgctcccaaacgcctccccacaaactcccaaacgcctccccacacgctcccaaacgcctccccacacgctaccaaacgcctccctacacgctcccaaacgcctccccacaaactcccaaacgcctccccacacgctcccaaacgcctccccacaaactcccaaacgcctccccacacgctaccaaacgcctccccacacgctcccaaacgcctccccacacgctaccaaacgccttcccacacgctaccaaacgcctctccacaaactcccaaacgcctacccacacgctaccaaacgcctccccacacgctcccaaacgcctacccacacgctaccaaacgcctccccccacgctcccaaacgcctccttacaaactcccaaacgcctccccacacgctaccaaacgcctccccacacgctaccaaacgcctccctacacgctcccaaacgcctccccacaaactcccaaacgcctccccacacgctcccaaacgcctccccacaaactcccaaacgcctccccacacgctaccaaacgcctccccacacgctcccaaacgcctccccacacgctaccaaacgcctccccacacgctaccaaacgcctccccacaaactcccaaacgcctccccacacgctaccaaacgcctccccacacgctcccaaacgcctccccacacgctaccaaacgcctccccacacgctaccaaacgcctccccacaaactaccaaacgcctccccacacactcccaa

SEQ ID NO: 33717 - DNA, 706 bp, Artificial Sequence
  chemically treated genomic DNA (Homo sapiens) CpG-island No: 33717
  misc_feature (371)..(371): n is either a, c, g or t
tgatacggaattcgagatcgagaacgagtcgatcgtatatttcgtcggagtattatttagtagacgttttttattataatagttgcggaatgagttatttatttacgacgaatcgtttattgtgtacgtcgcgatttattcggtagcggattcgtacgttaatttttattatagatattttatgtatatatacgatatttaaatatacgcggagaggcgcgtagtatatacgtaagtaggtattattgcggcgatgcgacgacgtagatatgagatatagagtacgtagtacgcgagatgagagatgcgatgtacgagtgcgcgatttttatattagacgacgtatcgcgtagtgcgtatgatgatatganttacgtgtcgcgagttacgtcgttacgagaagcgatacgattatacgttgttacgttatatatagtgtattattatagtagtgtttatagttagacgacggagtcgcgtatacgatagtacgttcgagttcgatgcgcgtttttgatacgtgttattacgtagtttagttattcgcgttcgtttagtcgttacgtcgtcgcgttacgttacgcgagaatagatttacgacgcgtcgatgcgtacgtcgagatattacgaacgtgtatatagtaatgacgaatatttatacgcgatcgatcgtcgttatttgatacgtttattagtttaattgata

SEQ ID NO: 33718 - DNA, 706 bp, Artificial Sequence
  chemically treated genomic DNA (Homo sapiens) CpG-island No: 33718
  misc_feature (336)..(336): n is either a, c, g or t
tatcaattaaactaataaacgtatcaaataacgacgatcgatcgcgtataaatattcgtcattactatatacacgttcgtaatatctcgacgtacgcatcgacgcgtcgtaaatctattctcgcgtaacgtaacgcgacgacgtaacgactaaacgaacgcgaataactaaactacgtaataacacgtatcaaaaacgcgcatcgaactcgaacgtactatcgtatacgcgactccgtcgtctaactataaacactactataataatacactatatataacgtaacaacgtataatcgtatcgcttctcgtaacgacgtaactcgcgacacgtaantcatatcatcatacgcactacgcgatacgtcgtctaatataaaaatcgcgcactcgtacatcgcatctctcatctcgcgtactacgtactctatatctcatatctacgtcgtcgcatcgccgcaataatacctacttacgtatatactacgcgcctctccgcgtatatttaaatatcgtatatatacataaaatatctataataaaaattaacgtacgaatccgctaccgaataaatcgcgacgtacacaataaacgattcgtcgtaaataaataactcattccgcaactattataataaaaaacgtctactaaataatactccgacgaaatatacgatcgactcgttctcgatctcgaattccgtatca

SEQ ID NO: 33719 - DNA, 706 bp, Artificial Sequence
  chemically treated genomic DNA (Homo sapiens) CpG-island No: 33719
  misc_feature (336)..(336): n is either a, c, g or t
tattagttgagttggtaagcgtgttaagtagcgacgatcgatcgcgtatgagtattcgttattattgtatgtacgttcgtagtgtttcggcgtgcgtatcgacgcgtcgtaggtttgttttcgcgtgacgtggcgcgacgacgtgacggttggacgagcgcgagtaattgagttacgtagtagtacgtgttaaggacgcgtatcggattcgaacgtgttgtcgtgtgcgcgatttcgtcgtttgattgtaggtattgttgtgatgatatattgtgtatgacgtgatagcgtgtagtcgtgtcgtttttcgtggcgacgtagttcgcgatacgtagnttatgttattatgcgtattacgcggtacgtcgtttggtatgagagtcgcgtattcgtgtatcgtattttttatttcgcgtattgcgtattttgtgttttatgtttgcgtcgtcgtatcgtcgtagtgatgtttgtttacgtgtgtgttacgcgttttttcgcgtatgtttgagtgtcgtgtatatatatagagtgtttgtgatagaggttgacgtacggattcgttgtcgagtgagtcgcggcgtgtataataggcggttcgtcgtgagtgagtggtttatttcgtagttgttatgatgaagggcgtttgttgagtggtgtttcgacgaggtatacgatcgattcgttttcgatttcggatttcgtatta

SEQ ID NO: 33720 - DNA, 706 bp, Artificial Sequence
  chemically treated genomic DNA (Homo sapiens) CpG-island No: 33720
  misc_feature (371)..(371): n is either a, c, g or t
taatacgaaatccgaaatcgaaaacgaatcgatcgtatacctcgtcgaaacaccactcaacaaacgcccttcatcataacaactacgaaataaaccactcactcacgacgaaccgcctattatacacgccgcgactcactcgacaacgaatccgtacgtcaacctctatcacaaacactctatatatatacacgacactcaaacatacgcgaaaaaacgcgtaacacacacgtaaacaaacatcactacgacgatacgacgacgcaaacataaaacacaaaatacgcaatacgcgaaataaaaaatacgatacacgaatacgcgactctcataccaaacgacgtaccgcgtaatacgcataataacataanctacgtatcgcgaactacgtcgccacgaaaaacgacacgactacacgctatcacgtcatacacaatatatcatcacaacaatacctacaatcaaacgacgaaatcgcgcacacgacaacacgttcgaatccgatacgcgtccttaacacgtactactacgtaactcaattactcgcgctcgtccaaccgtcacgtcgtcgcgccacgtcacgcgaaaacaaacctacgacgcgtcgatacgcacgccgaaacactacgaacgtacatacaataataacgaatactcatacgcgatcgatcgtcgctacttaacacgcttaccaactcaactaata

SEQ ID NO: 33721 - DNA, 699 bp, Artificial Sequence
  chemically treated genomic DNA (Homo sapiens) CpG-island No: 33721
  misc_feature (549)..(549): n is either a, c, g or t
acgcgacgaggcgattcgtttattttggtatatttattcgtaattacgtatacgatacgtcgtttcgatttacgtcgtatcgtgtagacgcgtttgaagtcgagtaatttagttcgatttttcgacgttgagatatattacgtttgtaatatttgcgatacgattttatgtatacgatgttcggttttacgatttagcgtatcgtatttttaattttttgcgatcgttcgatacgtggataattattttgtattttttacgtacgacgattatgtttggtataacgttatatttcgatttttatttatttatcgaatacgattgttttatagtatatatcgagacgcgttgtggtttttgttattagcgatttatatggtcgcgtcgttgcgttttcgcgattttttttttttatttttagtcgtagtattcgatttgtttttatatattatatgacgtttatttgcgatttttttatcgtattatcgttttttagttacgatgttatcgtttattattatacgatatagttatatcgatatacgatantaatgtagtatcgtatttatatattcgtttcgatatttacgtgacgagtattttagtattttattgacggaattacgattatattgattcgtttttatttgacgcgataatcgttcgttagtatagtttcgttatcgcggtatattttta

SEQ ID NO: 33722 - DNA, 699 bp, Artificial Sequence
  chemically treated genomic DNA (Homo sapiens) CpG-island No: 33722
  misc_feature (151)..(151): n is either a, c, g or t
taaaaatataccgcgataacgaaactatactaacgaacgattatcgcgtcaaataaaaacgaatcaatataatcgtaattccgtcaataaaatactaaaatactcgtcacgtaaatatcgaaacgaatatataaatacgatactacattantatcgtatatcgatataactatatcgtataataataaacgataacatcgtaactaaaaaacgataatacgataaaaaaatcgcaaataaacgtcatataatatataaaaacaaatcgaatactacgactaaaaataaaaaaaaaaaatcgcgaaaacgcaacgacgcgaccatataaatcgctaataacaaaaaccacaacgcgtctcgatatatactataaaacaatcgtattcgataaataaataaaaatcgaaatataacgttataccaaacataatcgtcgtacgtaaaaaatacaaaataattatccacgtatcgaacgatcgcaaaaaattaaaaatacgatacgctaaatcgtaaaaccgaacatcgtatacataaaatcgtatcgcaaatattacaaacgtaatatatctcaacgtcgaaaaatcgaactaaattactcgacttcaaacgcgtctacacgatacgacgtaaatcgaaacgacgtatcgtatacgtaattacgaataaatataccaaaataaacgaatcgcctcgtcgcgt

SEQ ID NO: 33723 - DNA, 699 bp, Artificial Sequence
  chemically treated genomic DNA (Homo sapiens) CpG-island No: 33723
  misc_feature (151)..(151): n is either a, c, g or t
tagaggtatgtcgcggtagcggagttgtgttagcggacggttgtcgcgttagatgggaacgagttagtatgatcgtaatttcgttagtggggtattggagtattcgttacgtgagtgtcgagacgagtgtgtgagtacgatgttgtattgntgtcgtgtgtcgatgtgattatgtcgtgtagtagtgggcgatggtatcgtggttgaagagcgatgatacgatggagagatcgtaggtgagcgttatatgatgtgtgaggataggtcgggtgttgcgattgagggtggaggaggagagtcgcgagggcgtagcggcgcggttatgtgagtcgttggtggtaggagttatagcgcgtttcgatgtgtgttgtgagatagtcgtgttcgatgagtgagtaggggtcgagatgtgacgttgtgttaggtatggtcgtcgtgcgtgagagatgtaggatagttgtttacgtgtcgaacggtcgtagagggttgagagtgcgatgcgttaggtcgtgagatcggatatcgtgtgtatggagtcgtatcgtaggtgttgtaggcgtagtgtgttttagcgtcgagaggtcggattaggttgttcgattttaggcgcgtttgtacggtgcggcgtagatcgagacggcgtgtcgtgtacgtgattgcgaataagtgtgttaggatgggcgagtcgtttcgtcgcgt

SEQ ID NO: 33724 - DNA, 699 bp, Artificial Sequence
  chemically treated genomic DNA (Homo sapiens) CpG-island No: 33724
  misc_feature (549)..(549): n is either a, c, g or t
acgcgacgaaacgactcgcccatcctaacacacttattcgcaatcacgtacacgacacgccgtctcgatctacgccgcaccgtacaaacgcgcctaaaatcgaacaacctaatccgacctctcgacgctaaaacacactacgcctacaacacctacgatacgactccatacacacgatatccgatctcacgacctaacgcatcgcactctcaaccctctacgaccgttcgacacgtaaacaactatcctacatctctcacgcacgacgaccatacctaacacaacgtcacatctcgacccctactcactcatcgaacacgactatctcacaacacacatcgaaacgcgctataactcctaccaccaacgactcacataaccgcgccgctacgccctcgcgactctcctcctccaccctcaatcgcaacacccgacctatcctcacacatcatataacgctcacctacgatctctccatcgtatcatcgctcttcaaccacgataccatcgcccactactacacgacataatcacatcgacacacgacancaatacaacatcgtactcacacactcgtctcgacactcacgtaacgaatactccaataccccactaacgaaattacgatcatactaactcgttcccatctaacgcgacaaccgtccgctaacacaactccgctaccgcgacatacctcta

SEQ ID NO: 33725 - DNA, 606 bp, Artificial Sequence
  chemically treated genomic DNA (Homo sapiens) CpG-island No: 33725
atggtcgcgttcggggacgttcggtgattttaaatattgcgcgtcgtttcggtaatcgcgcggtttcgttttcgtcgttcgtaggaggcggggtttaggggcgggtcgagggcggttcgtggcggttgggtttttttttaattttgcgtttgttgttgggtcgtcggcgcgcgggcggtcgcgatcgtcggggacgagtttggaggaaaaggaatcgggagtcgtttattcgggggcgtttttcggatttttagggttttagcgcgcggtttttatcgagtttgggcgttcggatttcggtagcggatcgttttttcgggttggcggttcgtttgattgggaatagtcggtcggttgtcgggggaacgcgggagtcgggttcgatttgagttacgcgggtttggtgtttatttgtgcgcgtcgtttgcgaaaaaggaacggtttggggagaaggcgtcgtcggtcgttttcgtttttatcgcggtcgtcgttggagagttcgagtcgtttagcgtttttggagttttttaattatgaagtttaatttttttttgcgattgcggatttttaattttaattgttggtgagtgcgtttgcggagtgcgg

SEQ ID NO: 33726 - DNA, 606 bp, Artificial Sequence
  chemically treated genomic DNA (Homo sapiens) CpG-island No: 33726
ccgcactccgcaaacgcactcaccaacaattaaaattaaaaatccgcaatcgcaaaaaaaaattaaacttcataattaaaaaactccaaaaacgctaaacgactcgaactctccaacgacgaccgcgataaaaacgaaaacgaccgacgacgccttctccccaaaccgttcctttttcgcaaacgacgcgcacaaataaacaccaaacccgcgtaactcaaatcgaacccgactcccgcgttcccccgacaaccgaccgactattcccaatcaaacgaaccgccaacccgaaaaaacgatccgctaccgaaatccgaacgcccaaactcgataaaaaccgcgcgctaaaaccctaaaaatccgaaaaacgcccccgaataaacgactcccgattccttttcctccaaactcgtccccgacgatcgcgaccgcccgcgcgccgacgacccaacaacaaacgcaaaattaaaaaaaaacccaaccgccacgaaccgccctcgacccgcccctaaaccccgcctcctacgaacgacgaaaacgaaaccgcgcgattaccgaaacgacgcgcaatatttaaaatcaccgaacgtccccgaacgcgaccat

SEQ ID NO: 33727 - DNA, 606 bp, Artificial Sequence
  chemically treated genomic DNA (Homo sapiens) CpG-island No: 33727
tcgtatttcgtagacgtatttattagtagttgaggttgaagattcgtagtcgtagggagaagttgggttttatggttggggagttttaggggcgttaggcggttcgaattttttagcgacggtcgcggtggggacgggggcggtcggcggcgttttttttttagatcgtttttttttcgtaggcggcgcgtataggtgggtattaagttcgcgtggtttaggtcgggttcgattttcgcgttttttcggtaatcggtcggttgtttttaattaggcgggtcgttaattcggaaaggcgattcgttgtcgaaattcgggcgtttaggttcggtaagggtcgcgcgttaggattttgggggttcggagagcgttttcgggtgggcggttttcggtttttttttttttaagttcgttttcggcggtcgcggtcgttcgcgcgtcggcggtttagtaataggcgtaaagttgaggaaaggtttagtcgttacgggtcgttttcgattcgtttttgggtttcgttttttgcgagcggcggaggcggggtcgcgcggttgtcggagcgacgcgtagtgtttggggttatcgggcgttttcgggcgcggttat

SEQ ID NO: 33728 - DNA, 606 bp, Artificial Sequence
  chemically treated genomic DNA (Homo sapiens) CpG-island No: 33728
ataaccgcgcccgaaaacgcccgataaccccaaacactacgcgtcgctccgacaaccgcgcgaccccgcctccgccgctcgcaaaaaacgaaacccaaaaacgaatcgaaaacgacccgtaacgactaaacctttcctcaactttacgcctattactaaaccgccgacgcgcgaacgaccgcgaccgccgaaaacgaacttaaaaaaaaaaaaaccgaaaaccgcccacccgaaaacgctctccgaacccccaaaatcctaacgcgcgacccttaccgaacctaaacgcccgaatttcgacaacgaatcgcctttccgaattaacgacccgcctaattaaaaacaaccgaccgattaccgaaaaaacgcgaaaatcgaacccgacctaaaccacgcgaacttaatacccacctatacgcgccgcctacgaaaaaaaaacgatctaaaaaaaaaacgccgccgaccgcccccgtccccaccgcgaccgtcgctaaaaaattcgaaccgcctaacgcccctaaaactccccaaccataaaacccaacttctccctacgactacgaatcttcaacctcaactactaataaatacgtctacgaaatacga

SEQ ID NO: 33729 - DNA, 583 bp, Artificial Sequence
  chemically treated genomic DNA (Homo sapiens) CpG-island No: 33729
gagcggtttgaaaggatggagagggagttggatcgcgggcggtagcggtgggggttttcgatattggacggtaaagttcggacgcggcgtgagtagggttgggttgagggaagatttgtttgatttgttaggcgtggttttcgagcgatcgtagttgcgttttttcggaagcgtattttattttattttattcggtcgcggggttcgtagtcggtttcgttggacgatttatcggcggtttcgaagtcgggaggggtcgttttttgttgggttggtaattaggtttgagcgggtgggagggcgggggcgggggcgggggcggaaacgtcgagatcgggcggggatgttgggatgcggggcggttcggggcgtgcgtttggagtcgcgcggagtgtgggttttcgcgaggggcgcggggcgtcgttcgggttttattcgcgatttattagtattttattatttttggatttttttatcgtttttagcggggatagttttgggttcgtttatgtttgtagggtggcgttcgagggcgtggcgttgcggatatttcgtttcgttttggggtttttgggtgggtttg

SEQ ID NO: 33730 - DNA, 583 bp, Artificial Sequence
  chemically treated genomic DNA (Homo sapiens) CpG-island No: 33730
caaacccacccaaaaaccccaaaacgaaacgaaatatccgcaacgccacgccctcgaacgccaccctacaaacataaacgaacccaaaactatccccgctaaaaacgataaaaaaatccaaaaataataaaatactaataaatcgcgaataaaacccgaacgacgccccgcgcccctcgcgaaaacccacactccgcgcgactccaaacgcacgccccgaaccgccccgcatcccaacatccccgcccgatctcgacgtttccgcccccgcccccgcccccgccctcccacccgctcaaacctaattaccaacccaacaaaaaacgacccctcccgacttcgaaaccgccgataaatcgtccaacgaaaccgactacgaaccccgcgaccgaataaaataaaataaaatacgcttccgaaaaaacgcaactacgatcgctcgaaaaccacgcctaacaaatcaaacaaatcttccctcaacccaaccctactcacgccgcgtccgaactttaccgtccaatatcgaaaacccccaccgctaccgcccgcgatccaactccctctccatcctttcaaaccgctc

SEQ ID NO: 33731 - DNA, 583 bp, Artificial Sequence
  chemically treated genomic DNA (Homo sapiens) CpG-island No: 33731
tagatttatttagaggttttagagcggaacggggtgttcgtagcgttacgttttcgggcgttattttgtaggtatgggcgggtttaagattgttttcgttggaggcggtagagggatttagaagtaatgagatgttaatgagtcgcgaataaagttcgggcggcgtttcgcgtttttcgcggaagtttatatttcgcgcgattttaggcgtacgtttcgggtcgtttcgtattttagtattttcgttcgatttcggcgttttcgttttcgttttcgttttcgtttttttattcgtttagatttggttgttagtttaataggaagcggtttttttcggtttcggagtcgtcggtaagtcgtttagcggagtcggttgcgagtttcgcggtcgggtggggtgaggtggggtgcgttttcggggaaacgtagttgcggtcgttcgggaattacgtttggtaggttaggtaggtttttttttagtttagttttgtttacgtcgcgttcggattttgtcgtttagtgtcggggatttttatcgttgtcgttcgcggtttagttttttttttatttttttagatcgttt

SEQ ID NO: 33732 - DNA, 583 bp, Artificial Sequence
  chemically treated genomic DNA (Homo sapiens) CpG-island No: 33732
aaacgatctaaaaaaataaaaaaaaaactaaaccgcgaacgacaacgataaaaatccccgacactaaacgacaaaatccgaacgcgacgtaaacaaaactaaactaaaaaaaaacctacctaacctaccaaacgtaattcccgaacgaccgcaactacgtttccccgaaaacgcaccccacctcaccccacccgaccgcgaaactcgcaaccgactccgctaaacgacttaccgacgactccgaaaccgaaaaaaaccgcttcctattaaactaacaaccaaatctaaacgaataaaaaaacgaaaacgaaaacgaaaacgaaaacgccgaaatcgaacgaaaatactaaaatacgaaacgacccgaaacgtacgcctaaaatcgcgcgaaatataaacttccgcgaaaaacgcgaaacgccgcccgaactttattcgcgactcattaacatctcattacttctaaatccctctaccgcctccaacgaaaacaatcttaaacccgcccatacctacaaaataacgcccgaaaacgtaacgctacgaacaccccgttccgctctaaaacctctaaataaatcta

SEQ ID NO: 33733 - DNA, 899 bp, Artificial Sequence
  chemically treated genomic DNA (Homo sapiens) CpG-island No: 33733
cggagagaggcgtcgggagggtgaataattagtggtagggagaggtagttcggttttatcgttaattttagaggcgcgacgttcggttttatttttaattttatcgttgttttcgcggaaggaagttacgtttttattttcgattttaagtgaggttaggaattacgatgtatttttaaaaggtatttcgatttgtaatatttcgaggggggttttagtttcgtagttattgggaatcgcgcgttcgtttttttttagcgcgttttttattcggttcggttacgagtggattttaggttggtcgttatgttgtcggagtcgtcgtcgtatttcgagcgcggttcgttcgttcgatcgtggttcgaattcgggtttcgttcgtacggtgaggagatagtgcggttcggttgggtaggggagggcgggaagtttatagggttcgcgtttatttggtgtcggagtggtgattagcgggagggacgttatcggcgtcgaggttacgttggagatgggcgttaaagtcgttacgttcgggtgttgggtcgtgtttttgttcgcggatagtacgtagagtacgtttaggtaggtggcggtttaaagtagtgagcgggagagtcgcgatatcgtgtttttagcgttggcgttcgggagaaagttaaggttcgtaacgtttagttaattttttaattttttgcggcgtcgttttcgagattacgttttttcgcgggagcgcgtaggggttacgtgagaggtttttgttttcggcgtgcgggggcgaagaggagggaggtggggttcggacgatattaacgggaattttacggggggaagtaggggagtcgggaggaagtcgaaggaatttggtttttaaagcgattgtgttatagttaagaaaattg

SEQ ID NO: 33734 - DNA, 899 bp, Artificial Sequence
  chemically treated genomic DNA (Homo sapiens) CpG-island No: 33734
caattttcttaactataacacaatcgctttaaaaaccaaattccttcgacttcctcccgactcccctacttccccccgtaaaattcccgttaatatcgtccgaaccccacctccctcctcttcgcccccgcacgccgaaaacaaaaacctctcacgtaacccctacgcgctcccgcgaaaaaacgtaatctcgaaaacgacgccgcaaaaaattaaaaaattaactaaacgttacgaaccttaactttctcccgaacgccaacgctaaaaacacgatatcgcgactctcccgctcactactttaaaccgccacctacctaaacgtactctacgtactatccgcgaacaaaaacacgacccaacacccgaacgtaacgactttaacgcccatctccaacgtaacctcgacgccgataacgtccctcccgctaatcaccactccgacaccaaataaacgcgaaccctataaacttcccgccctcccctacccaaccgaaccgcactatctcctcaccgtacgaacgaaacccgaattcgaaccacgatcgaacgaacgaaccgcgctcgaaatacgacgacgactccgacaacataacgaccaacctaaaatccactcgtaaccgaaccgaataaaaaacgcgctaaaaaaaaacgaacgcgcgattcccaataactacgaaactaaaacccccctcgaaatattacaaatcgaaataccttttaaaaatacatcgtaattcctaacctcacttaaaatcgaaaataaaaacgtaacttccttccgcgaaaacaacgataaaattaaaaataaaaccgaacgtcgcgcctctaaaattaacgataaaaccgaactacctctccctaccactaattattcaccctcccgacgcctctctccg

SEQ ID NO: 33735 - DNA, 899 bp, Artificial Sequence
  chemically treated genomic DNA (Homo sapiens) CpG-island No: 33735
tagtttttttggttgtggtatagtcgttttgagggttaggttttttcggttttttttcgatttttttgttttttttcgtaggattttcgttggtatcgttcgagttttatttttttttttttcgttttcgtacgtcgaaaataggggttttttacgtgatttttgcgcgttttcgcgggggagcgtagtttcggaggcggcgtcgtaggggattgaggggttgattgagcgttgcgagttttagttttttttcgaacgttagcgttgaggatacgatgtcgcggttttttcgtttattgttttgggtcgttatttgtttgggcgtgttttgcgtgttgttcgcggataagaatacgatttagtattcgaacgtgacgattttagcgtttatttttaacgtaatttcggcgtcggtgacgtttttttcgttggttattatttcggtattaggtgggcgcgggttttgtgggtttttcgtttttttttgtttagtcgagtcgtattgtttttttatcgtgcgggcggggttcgggttcgggttacggtcgggcgggcgggtcgcgttcggggtgcggcggcgatttcggtaatatggcggttagtttggagtttattcgtggtcgggtcgggtggggagcgcgttggggggaagcggacgcgcggtttttagtggttgcggggttggggtttttttcgaagtgttgtaagtcgaggtgttttttaaaagtgtatcgtaatttttagttttatttggggtcggaaatggggacgtggttttttttcgcgggggtagcggtggggttgaggatggggtcgggcgtcgcgtttttgaggttggcggtggggtcgagttgtttttttttgttattggttgtttattttttcggcgttttttttcg

SEQ ID NO: 33736 - DNA, 899 bp, Artificial Sequence
  chemically treated genomic DNA (Homo sapiens) CpG-island No: 33736
cgaaaaaaaacgccgaaaaaataaacaaccaataacaaaaaaaaacaactcgaccccaccgccaacctcaaaaacgcgacgcccgaccccatcctcaaccccaccgctacccccgcgaaaaaaaaccacgtccccatttccgaccccaaataaaactaaaaattacgatacacttttaaaaaacacctcgacttacaacacttcgaaaaaaaccccaaccccgcaaccactaaaaaccgcgcgtccgcttccccccaacgcgctccccacccgacccgaccacgaataaactccaaactaaccgccatattaccgaaatcgccgccgcaccccgaacgcgacccgcccgcccgaccgtaacccgaacccgaaccccgcccgcacgataaaaaaacaatacgactcgactaaacaaaaaaaaacgaaaaacccacaaaacccgcgcccacctaataccgaaataataaccaacgaaaaaaacgtcaccgacgccgaaattacgttaaaaataaacgctaaaatcgtcacgttcgaatactaaatcgtattcttatccgcgaacaacacgcaaaacacgcccaaacaaataacgacccaaaacaataaacgaaaaaaccgcgacatcgtatcctcaacgctaacgttcgaaaaaaaactaaaactcgcaacgctcaatcaacccctcaatcccctacgacgccgcctccgaaactacgctcccccgcgaaaacgcgcaaaaatcacgtaaaaaacccctattttcgacgtacgaaaacgaaaaaaaaaaaaataaaactcgaacgataccaacgaaaatcctacgaaaaaaaacaaaaaaatcgaaaaaaaaccgaaaaaacctaaccctcaaaacgactataccacaaccaaaaaaacta

SEQ ID NO: 33737 - DNA, 1179 bp, Artificial Sequence
  chemically treated genomic DNA (Homo sapiens) CpG-island No: 33737
acgtagcgcgtttagttgcgcggggttcggtcggtattcgcggttgaatagcgtcgcggttttcgcggtttcgggtttcgacggcggggacggcggtggcgttcgcgagagttagagaggcggcgacgaggcgagaggcgaggaggcgattcgcgcggtgttattgaggttcgggattacggagatgtcggggttttgttcgacgtttattaggaataagaagggatcggtagagagtagcgttacggtttagagtatagcgatgagcgcgcggacgcggcgtcgggtgattaagacgcgggcgcggagcgggcggtagatggttaggtagcgttcgacgttgagcgcggttatgtgtagtagcgtggcgtaggtgtagttttcgtttacgtagagggataggcggtagagtagcggttcgaatatttagggtcgcgagcgttagaggcggtataggtcgaacggtagttcgagtaggatgagtaggtcggatacggttatgttgtttaggtataagttggtggtggttcgtatgtttcggtagcgttcgattagtattacggttattacgttgtcgtttatttcgacgacgaataggtataggtatatagcggttatcggtattagcgtttttaggggaaagggcgagtagcggcgttcgtcgtaaggcggtagcgcgggttacggcggttttcgcgttttttcggggcggtcgttgtcgttttaggggttgtttatgggtgtttcgcgcggtcgtcgcgtttcgggtcgggttgggagtttggcgcgtggtttttttcggtgagcgtttttttttttagttcgtacgttgcgggcgcggtaggttagacggcggagcgttgcgttgcgttgcggggcgcgagaagcggttttgcggggtgggtttcgaggcgttttcgagttagttgcgcgtagttttcgtttacggtcgcggttcgtttcggttcggttttgtttcgttttcgcgttttttttcgggtttatgtagttttagggcgtttttttttttattaattggaatattcggcgtttttagcgtacgagttttattcggttcggtgagcgatgtttgtattttagatagttttggttataggattgagtattgtacgggcgtttttgttagtttggtatttcgggtattttcgaagggatttg

SEQ ID NO: 33738 - DNA, 1179 bp, Artificial Sequence
  chemically treated genomic DNA (Homo sapiens) CpG-island No: 33738
caaatcccttcgaaaatacccgaaataccaaactaacaaaaacgcccgtacaatactcaatcctataaccaaaactatctaaaatacaaacatcgctcaccgaaccgaataaaactcgtacgctaaaaacgccgaatattccaattaataaaaaaaaaaacgccctaaaactacataaacccgaaaaaaaacgcgaaaacgaaacaaaaccgaaccgaaacgaaccgcgaccgtaaacgaaaactacgcgcaactaactcgaaaacgcctcgaaacccaccccgcaaaaccgcttctcgcgccccgcaacgcaacgcaacgctccgccgtctaacctaccgcgcccgcaacgtacgaactaaaaaaaaaaacgctcaccgaaaaaaaccacgcgccaaactcccaacccgacccgaaacgcgacgaccgcgcgaaacacccataaacaacccctaaaacgacaacgaccgccccgaaaaaacgcgaaaaccgccgtaacccgcgctaccgccttacgacgaacgccgctactcgccctttcccctaaaaacgctaataccgataaccgctatatacctatacctattcgtcgtcgaaataaacgacaacgtaataaccgtaatactaatcgaacgctaccgaaacatacgaaccaccaccaacttatacctaaacaacataaccgtatccgacctactcatcctactcgaactaccgttcgacctataccgcctctaacgctcgcgaccctaaatattcgaaccgctactctaccgcctatccctctacgtaaacgaaaactacacctacgccacgctactacacataaccgcgctcaacgtcgaacgctacctaaccatctaccgcccgctccgcgcccgcgtcttaatcacccgacgccgcgtccgcgcgctcatcgctatactctaaaccgtaacgctactctctaccgatcccttcttattcctaataaacgtcgaacaaaaccccgacatctccgtaatcccgaacctcaataacaccgcgcgaatcgcctcctcgcctctcgcctcgtcgccgcctctctaactctcgcgaacgccaccgccgtccccgccgtcgaaacccgaaaccgcgaaaaccgcgacgctattcaaccgcgaataccgaccgaaccccgcgcaactaaacgcgctacgt

SEQ ID NO: 33739 - DNA, 1179 bp, Artificial Sequence
  chemically treated genomic DNA (Homo sapiens) CpG-island No: 33739
tagattttttcgaaggtgttcggagtattagattgataaaagcgttcgtatagtgtttagttttgtaattaaagttgtttagggtgtagatatcgtttatcggatcgggtagggttcgtgcgttaagggcgtcgggtattttagttagtggagagggaagcgttttggaattgtatgggttcgggagagggcgcgggagcggagtagggtcgggtcggggcgggtcgcggtcgtgggcggagattgcgcgtagttagttcgggagcgtttcggagtttatttcgtagagtcgtttttcgcgtttcgtagcgtagcgtagcgtttcgtcgtttgatttgtcgcgttcgtagcgtgcgggttgggaaaggaggcgtttatcgagagggattacgcgttaggtttttagttcgattcgggacgcggcggtcgcgcggagtatttatgggtagtttttggaacggtagcgatcgtttcgagggggcgcgggagtcgtcgtggttcgcgttgtcgttttgcgacgagcgtcgttgttcgtttttttttttgggggcgttggtgtcggtgatcgttgtgtgtttgtgtttgttcgtcgtcggggtgagcggtaacgtggtgatcgtgatgttgatcgggcgttatcgggatatgcggattattattaatttgtatttgggtagtatggtcgtgttcgatttatttattttgttcgggttgtcgttcgatttgtatcgtttttggcgttcgcggttttgggtgttcgggtcgttgttttgtcgtttgtttttttacgtgggcgagggttgtatttacgttacgttgttgtatatgatcgcgtttagcgtcgagcgttatttggttatttgtcgttcgtttcgcgttcgcgttttggttattcggcgtcgcgttcgcgcgtttatcgttgtgttttgggtcgtggcgttgttttttgtcggtttttttttgtttttggtgggcgtcgagtaggatttcggtattttcgtagtttcgggttttaatggtatcgcgcggatcgttttttcgtttttcgtttcgtcgtcgtttttttggttttcgcgggcgttatcgtcgttttcgtcgtcggggttcgagatcgcggaggtcgcggcgttgtttagtcgcgaatgtcggtcgagtttcgcgtagttgggcgcgttgcgt

SEQ ID NO: 33740 - DNA, 1179 bp, Artificial Sequence
  chemically treated genomic DNA (Homo sapiens) CpG-island No: 33740
acgcaacgcgcccaactacgcgaaactcgaccgacattcgcgactaaacaacgccgcgacctccgcgatctcgaaccccgacgacgaaaacgacgataacgcccgcgaaaaccaaaaaaacgacgacgaaacgaaaaacgaaaaaacgatccgcgcgataccattaaaacccgaaactacgaaaataccgaaatcctactcgacgcccaccaaaaacaaaaaaaaaccgacaaaaaacaacgccacgacccaaaacacaacgataaacgcgcgaacgcgacgccgaataaccaaaacgcgaacgcgaaacgaacgacaaataaccaaataacgctcgacgctaaacgcgatcatatacaacaacgtaacgtaaatacaaccctcgcccacgtaaaaaaacaaacgacaaaacaacgacccgaacacccaaaaccgcgaacgccaaaaacgatacaaatcgaacgacaacccgaacaaaataaataaatcgaacacgaccatactacccaaatacaaattaataataatccgcatatcccgataacgcccgatcaacatcacgatcaccacgttaccgctcaccccgacgacgaacaaacacaaacacacaacgatcaccgacaccaacgcccccaaaaaaaaaaacgaacaacgacgctcgtcgcaaaacgacaacgcgaaccacgacgactcccgcgccccctcgaaacgatcgctaccgttccaaaaactacccataaatactccgcgcgaccgccgcgtcccgaatcgaactaaaaacctaacgcgtaatccctctcgataaacgcctcctttcccaacccgcacgctacgaacgcgacaaatcaaacgacgaaacgctacgctacgctacgaaacgcgaaaaacgactctacgaaataaactccgaaacgctcccgaactaactacgcgcaatctccgcccacgaccgcgacccgccccgacccgaccctactccgctcccgcgccctctcccgaacccatacaattccaaaacgcttccctctccactaactaaaatacccgacgcccttaacgcacgaaccctacccgatccgataaacgatatctacaccctaaacaactttaattacaaaactaaacactatacgaacgcttttatcaatctaatactccgaacaccttcgaaaaaatcta

SEQ ID NO: 33741 - DNA, 645 bp, Artificial Sequence
  chemically treated genomic DNA (Homo sapiens) CpG-island No: 33741
cgtcgcggtttttagtttttttttgtttcggtcgggtttttttttcgtgttttttttcggttttattttcggcgtttagcgttgttttattgtgcgcgattgggagtcgattgtgttttcgttttagcgtttcgtcgcgtatatcggaaacgagcgacgcgtttcgtttcgcggtgtttcgtttacgtttcgatttcgtttttcgcgtttttgttagtttggttttttttgttcggcgttttagcgtattcgttttaggtgtcgggcgtcgggtttggttatcgggcgtaatcgtcggagcgggttaattattggttcgtcggatagtcggttcgtcggcgtttgggggttaggttcgaattttttattagagcggcgttcgttttttttttttttcggtttcgacgtttttttggtttttttttttgttcgggaggttaagtgttcgggagaggcgcgggagttaagatttatgtattcggagagggacgcggagttagcggtcgggtaaagtcgtatttttcgcgtttggggtttcggttttgtttttgggtgtttttcggttatttttagggggagtaaaggtttcgaggtttcgtagcgtttttggtgtttttttgataattcgtagtgattaatgttttt

SEQ ID NO: 33742 - DNA, 645 bp, Artificial Sequence
  chemically treated genomic DNA (Homo sapiens) CpG-island No: 33742
aaaaacattaatcactacgaattatcaaaaaaacaccaaaaacgctacgaaacctcgaaacctttactccccctaaaaataaccgaaaaacacccaaaaacaaaaccgaaaccccaaacgcgaaaaatacgactttacccgaccgctaactccgcgtccctctccgaatacataaatcttaactcccgcgcctctcccgaacacttaacctcccgaacaaaaaaaaaaaccaaaaaaacgtcgaaaccgaaaaaaaaaaaaaacgaacgccgctctaataaaaaattcgaacctaacccccaaacgccgacgaaccgactatccgacgaaccaataattaacccgctccgacgattacgcccgataaccaaacccgacgcccgacacctaaaacgaatacgctaaaacgccgaacaaaaaaaaccaaactaacaaaaacgcgaaaaacgaaatcgaaacgtaaacgaaacaccgcgaaacgaaacgcgtcgctcgtttccgatatacgcgacgaaacgctaaaacgaaaacacaatcgactcccaatcgcgcacaataaaacaacgctaaacgccgaaaataaaaccgaaaaaaaacacgaaaaaaaaacccgaccgaaacaaaaaaaaactaaaaaccgcgacg

SEQ ID NO: 33743 - DNA, 645 bp, Artificial Sequence
  chemically treated genomic DNA (Homo sapiens) CpG-island No: 33743
gaaaatattaattattacgaattattagaaaaatattaagagcgttacgaggtttcggagtttttattttttttggaagtaatcggggagtatttaggggtaaagtcgaggttttaagcgcggggaatgcggttttgttcgatcgttggtttcgcgttttttttcgggtgtataagttttggttttcgcgtttttttcgagtatttagtttttcgagtagagaggggaattagaggagcgtcgaagtcgggagagaaaaggggcgggcgtcgttttggtaagaagttcgggtttggtttttaagcgtcggcgaatcggttattcggcgagttagtaattagttcgtttcgacggttgcgttcggtggttagattcggcgttcgatatttggagcgagtgcgttggggcgtcggataggagaggttaggttggtaaaggcgcgggaggcggggtcggagcgtgggcggggtatcgcggggcggggcgcgtcgttcgttttcggtgtgcgcggcggagcgttagggcgggggtatagtcggtttttaatcgcgtataatgagatagcgttgagcgtcggaagtggggtcgaaggaaaatacggagagggagttcggtcgggataggaagaggttggggatcgcggcg

SEQ ID NO: 33744 - DNA, 645 bp, Artificial Sequence
  chemically treated genomic DNA (Homo sapiens) CpG-island No: 33744
cgccgcgatccccaacctcttcctatcccgaccgaactccctctccgtattttccttcgaccccacttccgacgctcaacgctatctcattatacgcgattaaaaaccgactatacccccgccctaacgctccgccgcgcacaccgaaaacgaacgacgcgccccgccccgcgataccccgcccacgctccgaccccgcctcccgcgcctttaccaacctaacctctcctatccgacgccccaacgcactcgctccaaatatcgaacgccgaatctaaccaccgaacgcaaccgtcgaaacgaactaattactaactcgccgaataaccgattcgccgacgcttaaaaaccaaacccgaacttcttaccaaaacgacgcccgccccttttctctcccgacttcgacgctcctctaattcccctctctactcgaaaaactaaatactcgaaaaaaacgcgaaaaccaaaacttatacacccgaaaaaaaacgcgaaaccaacgatcgaacaaaaccgcattccccgcgcttaaaacctcgactttacccctaaatactccccgattacttccaaaaaaaataaaaactccgaaacctcgtaacgctcttaatatttttctaataattcgtaataattaatattttc

SEQ ID NO: 33745 - DNA, 1038 bp, Artificial Sequence
  chemically treated genomic DNA (Homo sapiens) CpG-island No: 33745
gcgtcgcggtcgtgatttcggtaggagtcgggggttttgttgtcgttgtgttcgttttttgcgaacgttgtcgtttcgatatagcggtttttcggatagtttggtttttttttattttacgtatttttaggttaggatttcgggttattatcgggaattttcgttatcgggtacgtttagtttttgtttaatcggaacggtcgaatagcgtaggtcggtaggagtgtggaggcgatcggttttcggggacgtttattttcgggatttttttcggttcgtacgcggttgtcgcgcggtttgacgggaaacgtagttttcggggttaagagagtagtttcgttcgggatttgtttatcgttgtaaagaggggtcggaggcgaaggaggcggcgaggttgtgcggcgggtcggagcgacgtcgaggtttgacgtgttcgcgtttttgcggttttattttcggtcgtcgtgatttttttttgtacggggcggatacgagtaatgttacgggtttcgtcgcgcgtcgcgagtatttattagggtgagggttgttcgggtgggttgtagtttttttttgtttatagttcggatagttgttcggattaaggaagtcgatattttcgtcgtttcggcgtttcggtgtttcgggtcgaaggtcggtcgttttagtttttttttatggatacggcgggcgtattgacgttataagtttcggcgtacggcgtttttagttttagtttcgtttttcgtcgttattattgggtgagttgtatgagtgacgagtcgggggcggggtaagtcgttcggggcggggttttgtcgtttaacgtcgggggtttagtagttgggttgcgtacggttttcggtagtggggttattacgttgtagggcgtagggttcgggaggaatgtttttatcgtcgaggacggagtcggcgtgacgtcggggagcgggcgggagggggcgaggaatgattttagatttgttgatttcggatgtacgtagttttattatttgttttcggggtaaggtgtagcgttat

SEQ ID NO: 33746 - DNA, 1038 bp, Artificial Sequence
  chemically treated genomic DNA (Homo sapiens) CpG-island No: 33746
ataacgctacaccttaccccgaaaacaaataataaaactacgtacatccgaaatcaacaaatctaaaatcattcctcgccccctcccgcccgctccccgacgtcacgccgactccgtcctcgacgataaaaacattcctcccgaaccctacgccctacaacgtaataaccccactaccgaaaaccgtacgcaacccaactactaaacccccgacgttaaacgacaaaaccccgccccgaacgacttaccccgcccccgactcgtcactcatacaactcacccaataataacgacgaaaaacgaaactaaaactaaaaacgccgtacgccgaaacttataacgtcaatacgcccgccgtatccataaaaaaaaactaaaacgaccgaccttcgacccgaaacaccgaaacgccgaaacgacgaaaatatcgacttccttaatccgaacaactatccgaactataaacaaaaaaaaactacaacccacccgaacaaccctcaccctaataaatactcgcgacgcgcgacgaaacccgtaacattactcgtatccgccccgtacaaaaaaaaatcacgacgaccgaaaataaaaccgcaaaaacgcgaacacgtcaaacctcgacgtcgctccgacccgccgcacaacctcgccgcctccttcgcctccgacccctctttacaacgataaacaaatcccgaacgaaactactctcttaaccccgaaaactacgtttcccgtcaaaccgcgcgacaaccgcgtacgaaccgaaaaaaatcccgaaaataaacgtccccgaaaaccgatcgcctccacactcctaccgacctacgctattcgaccgttccgattaaacaaaaactaaacgtacccgataacgaaaattcccgataataacccgaaatcctaacctaaaaatacgtaaaataaaaaaaaaccaaactatccgaaaaaccgctatatcgaaacgacaacgttcgcaaaaaacgaacacaacgacaacaaaacccccgactcctaccgaaatcacgaccgcgacgc

SEQ ID NO: 33747 - DNA, 1038 bp, Artificial Sequence
  chemically treated genomic DNA (Homo sapiens) CpG-island No: 33747
gtgacgttgtattttgtttcgggggtaggtggtgaagttacgtgtattcggagttagtaggtttgaggttatttttcgttttttttcgttcgtttttcgacgttacgtcgatttcgttttcggcggtgaagatatttttttcgggttttgcgttttgtagcgtggtaattttattgtcggagatcgtgcgtaatttagttgttagattttcggcgttgagcggtaaaatttcgtttcgagcggtttgtttcgttttcggttcgttatttatgtaatttatttaatggtggcggcggggggcggggttaggattgagggcgtcgtgcgtcgaagtttgtggcgttaatgcgttcgtcgtgtttatggagagaagttgaggcggtcgattttcggttcgaggtatcggggcgtcgggacggcgaagatgtcggtttttttagttcgggtaattgttcgggttgtgagtaagaggaagttgtagtttattcgggtagtttttattttggtgagtgttcgcggcgcgcggcggggttcgtgatattgttcgtgttcgtttcgtgtaaggggaggttacggcggtcgggagtggggtcgtagggacgcggatacgttagatttcggcgtcgtttcgattcgtcgtatagtttcgtcgtttttttcgttttcggtttttttttgtaacgataaataagtttcgggcggggttgtttttttggtttcggaaattacgtttttcgttaggtcgcgcggtaatcgcgtgcgggtcggaggggatttcgggggtgggcgttttcgggggtcgatcgtttttatatttttgtcggtttgcgttgttcggtcgtttcggttaagtagaggttgaacgtgttcggtggcgggggttttcggtggtggttcggagttttagtttggaggtgcgtggggtggggagggattaggttgttcgaaggatcgttgtgtcggggcgatagcgttcgtagagggcgagtatagcgataataaagttttcggtttttgtcgaggttacggtcgcggcgt

SEQ ID NO: 33748 - DNA, 1038 bp, Artificial Sequence
  chemically treated genomic DNA (Homo sapiens) CpG-island No: 33748
acgccgcgaccgtaacctcgacaaaaaccgaaaactttattatcgctatactcgccctctacgaacgctatcgccccgacacaacgatccttcgaacaacctaatccctccccaccccacgcacctccaaactaaaactccgaaccaccaccgaaaacccccgccaccgaacacgttcaacctctacttaaccgaaacgaccgaacaacgcaaaccgacaaaaatataaaaacgatcgacccccgaaaacgcccacccccgaaatcccctccgacccgcacgcgattaccgcgcgacctaacgaaaaacgtaatttccgaaaccaaaaaaacaaccccgcccgaaacttatttatcgttacaaaaaaaaaccgaaaacgaaaaaaacgacgaaactatacgacgaatcgaaacgacgccgaaatctaacgtatccgcgtccctacgaccccactcccgaccgccgtaacctccccttacacgaaacgaacacgaacaatatcacgaaccccgccgcgcgccgcgaacactcaccaaaataaaaactacccgaataaactacaacttcctcttactcacaacccgaacaattacccgaactaaaaaaaccgacatcttcgccgtcccgacgccccgatacctcgaaccgaaaatcgaccgcctcaacttctctccataaacacgacgaacgcattaacgccacaaacttcgacgcacgacgccctcaatcctaaccccgccccccgccgccaccattaaataaattacataaataacgaaccgaaaacgaaacaaaccgctcgaaacgaaattttaccgctcaacgccgaaaatctaacaactaaattacgcacgatctccgacaataaaattaccacgctacaaaacgcaaaacccgaaaaaaatatcttcaccgccgaaaacgaaatcgacgtaacgtcgaaaaacgaacgaaaaaaaacgaaaaataacctcaaacctactaactccgaatacacgtaacttcaccacctacccccgaaacaaaatacaacgtcac

SEQ ID NO: 33749 - DNA, 1041 bp, Artificial Sequence
  chemically treated genomic DNA (Homo sapiens) CpG-island No: 33749
ttttagattgtggttatcgttatttttttatttaaatttcgtttcgattattttttcgttttagggtttcgtatttattttgtcgggtttttacgaagcgtttttcgggttatatattgcgtaatttcggtagtcgggcggagtttgtatagaggcggagtcgcggtagtcggagagaacgttttagtaatagtcgttaggaggaagttttaggagtttttgtcgtttacggaacgcgtttgcgtaattcgggtttaggtcgtcgatattttaggatcgtttttcgtttcgtttttaattttggggcggagttttcggtcgcgtcggcgtaaagcgtcgtcgtattttacgtttgcgcgtttcgttcgttcggttttatttttttaggtttttcgcgtgggggagggggtacgtttcggcgagttacgatgatggcggttattattttgtggtgagttagcggattttttgtttgtttcgtcgattttttcgcgttttttgtagatttcgtggttggcgttcggcgcgtgaggaagtacggcggttcgagttcgcggggaaggtcgtagtcgcggaggtagcggcgcggttcggggtacgggttgggggagaggtcgtttcgttgggcgaatgtgataagtttttatttttatcgtttttttttttagagcgcgaggagcgcgggcgatttcggggtttcgttaggttatagatttcgtttagcggttagtattcggcgtaggttcggtagtcgagttgcgcggcggtattatgtaggttattttgaagattttttagtagtagatttttaagatagatattgatttcgaggagacggtatgcgcgcgggtcgggggtaggggtagtcgcgtgcgggtcgcggggagcgttaggagttcgtggggtcgggcggcgcgttttagcgggggaagtttcggagggcgcgatgagggttttgggttttggtgtcggttttggcggcgtatagcggagtcgatttttttgttttggtcgtgggttttgtggtaggagaatggggaa

SEQ ID NO: 33750 - DNA, 1041 bp, Artificial Sequence
  chemically treated genomic DNA (Homo sapiens) CpG-island No: 33750
ttccccattctcctaccacaaaacccacgaccaaaacaaaaaaatcgactccgctatacgccgccaaaaccgacaccaaaacccaaaaccctcatcgcgccctccgaaacttcccccgctaaaacgcgccgcccgaccccacgaactcctaacgctccccgcgacccgcacgcgactacccctacccccgacccgcgcgcataccgtctcctcgaaatcaatatctatcttaaaaatctactactaaaaaatcttcaaaataacctacataataccgccgcgcaactcgactaccgaacctacgccgaatactaaccgctaaacgaaatctataacctaacgaaaccccgaaatcgcccgcgctcctcgcgctctaaaaaaaaaaacgataaaaataaaaacttatcacattcgcccaacgaaacgacctctcccccaacccgtaccccgaaccgcgccgctacctccgcgactacgaccttccccgcgaactcgaaccgccgtacttcctcacgcgccgaacgccaaccacgaaatctacaaaaaacgcgaaaaaatcgacgaaacaaacaaaaaatccgctaactcaccacaaaataataaccgccatcatcgtaactcgccgaaacgtaccccctcccccacgcgaaaaacctaaaaaaataaaaccgaacgaacgaaacgcgcaaacgtaaaatacgacgacgctttacgccgacgcgaccgaaaactccgccccaaaattaaaaacgaaacgaaaaacgatcctaaaatatcgacgacctaaacccgaattacgcaaacgcgttccgtaaacgacaaaaactcctaaaacttcctcctaacgactattactaaaacgttctctccgactaccgcgactccgcctctatacaaactccgcccgactaccgaaattacgcaatatataacccgaaaaacgcttcgtaaaaacccgacaaaataaatacgaaaccctaaaacgaaaaaataatcgaaacgaaatttaaataaaaaaataacgataaccacaatctaaaa

SEQ ID NO: 33751 - DNA, 1041 bp, Artificial Sequence
  chemically treated genomic DNA (Homo sapiens) CpG-island No: 33751
ttttttatttttttgttataaagtttacggttaagataggaggatcggtttcgttgtacgtcgttagggtcggtattaggatttagggtttttatcgcgtttttcggggtttttttcgttggagcgcgtcgttcggttttacgagtttttggcgtttttcgcggttcgtacgcggttgtttttgttttcggttcgcgcgtatatcgttttttcggggttaatgtttattttgaaggtttgttgttggagggtttttagggtgatttgtatggtgtcgtcgcgtagttcggttgtcgggtttgcgtcgggtgttggtcgttgggcggggtttgtggtttggcggggtttcggggtcgttcgcgtttttcgcgttttggggaggaaggcggtgggggtgggggtttgttatattcgtttagcggagcggttttttttttagttcgtgtttcggatcgcgtcgttgttttcgcgattgcggtttttttcgcgaattcgggtcgtcgtgtttttttacgcgtcgagcgttagttacggagtttgtagaaggcgcgagggggtcggcgagataagtagggaattcgttagtttattataggatggtggtcgttattatcgtgattcgtcgagacgtgtttttttttttacgcgaaaaatttggggggatggggtcgggcgggcgaagcgcgtaggcgtggggtgcggcgacgttttgcgtcggcgcggtcgaggatttcgttttagaattgggggcggggcggaaggcggttttggaatgtcggcggtttggattcggattacgtaggcgcgtttcgtgggcggtaagggtttttggggtttttttttagcgattattgttggggcgtttttttcggttgtcgcggtttcgtttttgtgtaggtttcgttcggttgtcgaagttacgtaatgtgtagttcgggaagcgtttcgtggagattcggtagagtggatgcggagttttggagcgggggagtaatcggggcggagtttaagtgaaaggatggcggtaattatagtttgggg

SEQ ID NO: 33752 - DNA, 1041 bp, Artificial Sequence
  chemically treated genomic DNA (Homo sapiens) CpG-island No: 33752
ccccaaactataattaccgccatcctttcacttaaactccgccccgattactcccccgctccaaaactccgcatccactctaccgaatctccacgaaacgcttcccgaactacacattacgtaacttcgacaaccgaacgaaacctacacaaaaacgaaaccgcgacaaccgaaaaaaacgccccaacaataatcgctaaaaaaaaaccccaaaaacccttaccgcccacgaaacgcgcctacgtaatccgaatccaaaccgccgacattccaaaaccgccttccgccccgcccccaattctaaaacgaaatcctcgaccgcgccgacgcaaaacgtcgccgcaccccacgcctacgcgcttcgcccgcccgaccccatccccccaaatttttcgcgtaaaaaaaaaaacacgtctcgacgaatcacgataataacgaccaccatcctataataaactaacgaattccctacttatctcgccgaccccctcgcgccttctacaaactccgtaactaacgctcgacgcgtaaaaaaacacgacgacccgaattcgcgaaaaaaaccgcaatcgcgaaaacaacgacgcgatccgaaacacgaactaaaaaaaaaaccgctccgctaaacgaatataacaaacccccacccccaccgccttcctccccaaaacgcgaaaaacgcgaacgaccccgaaaccccgccaaaccacaaaccccgcccaacgaccaacacccgacgcaaacccgacaaccgaactacgcgacgacaccatacaaatcaccctaaaaaccctccaacaacaaaccttcaaaataaacattaaccccgaaaaaacgatatacgcgcgaaccgaaaacaaaaacaaccgcgtacgaaccgcgaaaaacgccaaaaactcgtaaaaccgaacgacgcgctccaacgaaaaaaaccccgaaaaacgcgataaaaaccctaaatcctaataccgaccctaacgacgtacaacgaaaccgatcctcctatcttaaccgtaaactttataacaaaaaaataaaaaa

SEQ ID NO: 33753 - DNA, 580 bp, Artificial Sequence
  chemically treated genomic DNA (Homo sapiens) CpG-island No: 33753
tgaagcgtcggttatttgggcgaagatttagtcgagtaggagcgttcgagcgacggcggtttcggggcgcgggattcggggttaggtaggggtttttatgtttattagttggcggcgagatcgagcgggtttcgtggcgttcgtggggttggggaggttgggttgaaggcgttttgggtcggttagagggagtgcgagggggtgcggggagttcgtagttttggggagtcggtgtttcgcgcgttataaagggtcggcggcgcgttttttcgcgtttttgttcgttttcggcgttcgttttcgtcgtttttttcgatttttcgttttcggttcgggttatttgtcgtcgcggtgggcggttttcggcgagtttatatttttgtttcgttttttttcggtaggaaatttcgggattttgtaagggatgatttattttagtgatttaatcgcgttatcgagcgcggagttgttttggaggacgtaggcgggtttagttgttcgggttttttaaggttttcggatttatttaggttcgcgatttcgacgtgtagtttaggtgggttgtaggtttatggtagga

SEQ ID NO: 33754 - DNA, 580 bp, Artificial Sequence
  chemically treated genomic DNA (Homo sapiens) CpG-island No: 33754
tcctaccataaacctacaacccacctaaactacacgtcgaaatcgcgaacctaaataaatccgaaaaccttaaaaaacccgaacaactaaacccgcctacgtcctccaaaacaactccgcgctcgataacgcgattaaatcactaaaataaatcatcccttacaaaatcccgaaatttcctaccgaaaaaaaacgaaacaaaaatataaactcgccgaaaaccgcccaccgcgacgacaaataacccgaaccgaaaacgaaaaatcgaaaaaaacgacgaaaacgaacgccgaaaacgaacaaaaacgcgaaaaaacgcgccgccgaccctttataacgcgcgaaacaccgactccccaaaactacgaactccccgcaccccctcgcactccctctaaccgacccaaaacgccttcaacccaacctccccaaccccacgaacgccacgaaacccgctcgatctcgccgccaactaataaacataaaaacccctacctaaccccgaatcccgcgccccgaaaccgccgtcgctcgaacgctcctactcgactaaatcttcgcccaaataaccgacgcttca

SEQ ID NO: 33755 - DNA, 580 bp, Artificial Sequence
  chemically treated genomic DNA (Homo sapiens) CpG-island No: 33755
ttttgttatagatttgtaatttatttaagttgtacgtcggagtcgcgggtttgggtgaattcgggggttttgggggattcgggtaattagattcgtttgcgttttttagggtagtttcgcgttcggtggcgcggttgaattattggggtgagttattttttgtagggtttcggagttttttatcgggaggaggcggggtaggggtgtggattcgtcgggggtcgtttatcgcgacggtaagtgattcgggtcgggggcggggagtcgggaggagcggcgggggcgggcgtcgggggcgggtagaggcgcgggagagcgcgtcgtcggttttttatagcgcgcggggtatcggttttttaagattgcgagtttttcgtattttttcgtattttttttggtcggtttagggcgtttttagtttaatttttttagttttacgggcgttacggaattcgttcgatttcgtcgttaattggtagatatggagatttttgtttggtttcgggtttcgcgtttcgagatcgtcgtcgttcggacgtttttgttcggttgggttttcgtttaggtggtcggcgtttta

SEQ ID NO: 33756 - DNA, 580 bp, Artificial Sequence
  chemically treated genomic DNA (Homo sapiens) CpG-island No: 33756
taaaacgccgaccacctaaacgaaaacccaaccgaacaaaaacgtccgaacgacgacgatctcgaaacgcgaaacccgaaaccaaacaaaaatctccatatctaccaattaacgacgaaatcgaacgaattccgtaacgcccgtaaaactaaaaaaattaaactaaaaacgccctaaaccgaccaaaaaaaatacgaaaaaatacgaaaaactcgcaatcttaaaaaaccgataccccgcgcgctataaaaaaccgacgacgcgctctcccgcgcctctacccgcccccgacgcccgcccccgccgctcctcccgactccccgcccccgacccgaatcacttaccgtcgcgataaacgacccccgacgaatccacacccctaccccgcctcctcccgataaaaaactccgaaaccctacaaaaaataactcaccccaataattcaaccgcgccaccgaacgcgaaactaccctaaaaaacgcaaacgaatctaattacccgaatcccccaaaacccccgaattcacccaaacccgcgactccgacgtacaacttaaataaattacaaatctataacaaaa

SEQ ID NO: 33757 - DNA, 507 bp, Artificial Sequence
  chemically treated genomic DNA (Homo sapiens) CpG-island No: 33757
ttatcggttttgtaagggtcgtggtaatgttttagttgttgtttcgtgtttttttcgtcgtttagttttgagtagtttgcggtggcgttcgggcgtttttcgagtttttcggcgtcgcgaggtagcggtagtagtagtagtagtgatattagggttttaagtgtagtcgttcggggtatggtggcgcggggtcggttggggtagagggagttgcgtgtacgaaagtttagttcggtcgaaagacggcgtatattgggtcggtcggtttcggtcgggattcggtggttatatagggttgttgggtatggtttaggcgcggagtaagcggagcgcggcgttttttgttttcgtcgaggtaatcgggaagtagtcgttcggagttatttgttcggcggtcgaggttgcggcggttgcgagtgtggcggtggcggcggtggttggagtagtggtcgtttcgtttttttttattagggttggattatatagttttcgttcggggttttaagt

SEQ ID NO: 33758 - DNA, 507 bp, Artificial Sequence
  chemically treated genomic DNA (Homo sapiens) CpG-island No: 33758
acttaaaaccccgaacgaaaactatataatccaaccctaataaaaaaaaacgaaacgaccactactccaaccaccgccgccaccgccacactcgcaaccgccgcaacctcgaccgccgaacaaataactccgaacgactacttcccgattacctcgacgaaaacaaaaaacgccgcgctccgcttactccgcgcctaaaccatacccaacaaccctatataaccaccgaatcccgaccgaaaccgaccgacccaatatacgccgtctttcgaccgaactaaactttcgtacacgcaactccctctaccccaaccgaccccgcgccaccataccccgaacgactacacttaaaaccctaatatcactactactactactaccgctacctcgcgacgccgaaaaactcgaaaaacgcccgaacgccaccgcaaactactcaaaactaaacgacgaaaaaaacacgaaacaacaactaaaacattaccacgacccttacaaaaccgataa

SEQ ID NO: 33759 - DNA, 507 bp, Artificial Sequence
  chemically treated genomic DNA (Homo sapiens) CpG-island No: 33759
gtttagggtttcgggcgaaggttgtgtggtttagttttggtggagaggggcggagcggttattgttttaattatcgtcgttatcgttatattcgtagtcgtcgtagtttcggtcgtcgggtaagtagtttcgagcggttgtttttcggttgtttcgacgaagatagggggcgtcgcgtttcgtttgtttcgcgtttgagttatgtttagtagttttgtgtaattatcgagtttcggtcggagtcgatcgatttagtgtgcgtcgtttttcggtcgagttgagttttcgtgtacgtaattttttttgttttagtcggtttcgcgttattatgtttcgggcgattgtatttggggttttggtgttattgttgttgttgttgtcgttgtttcgcggcgtcgggggattcggggagcgttcggacgttatcgtagattatttagagttggacggcgaggagggtacggagtagtagttggagtattattacgatttttgtaaagtcggtag

SEQ ID NO: 33760 - DNA, 507 bp, Artificial Sequence
  chemically treated genomic DNA (Homo sapiens) CpG-island No: 33760
ctaccgactttacaaaaatcgtaataatactccaactactactccgtaccctcctcgccgtccaactctaaataatctacgataacgtccgaacgctccccgaatcccccgacgccgcgaaacaacgacaacaacaacaacaataacaccaaaaccccaaatacaatcgcccgaaacataataacgcgaaaccgactaaaacaaaaaaaattacgtacacgaaaactcaactcgaccgaaaaacgacgcacactaaatcgatcgactccgaccgaaactcgataattacacaaaactactaaacataactcaaacgcgaaacaaacgaaacgcgacgccccctatcttcgtcgaaacaaccgaaaaacaaccgctcgaaactacttacccgacgaccgaaactacgacgactacgaatataacgataacgacgataattaaaacaataaccgctccgcccctctccaccaaaactaaaccacacaaccttcgcccgaaaccctaaac

SEQ ID NO: 33761 - DNA, 569 bp, Artificial Sequence
  chemically treated genomic DNA (Homo sapiens) CpG-island No: 33761
ttcggtttttattgtttttggagtaatttgaatatattgcgaggtttatttgatacgtcgaatcgcggtttcgggaatttattttcgttgtaattatatagcggttatttttcgatttaagaacgcgaggaaaattatagagttattttcgacgcgttagtacgttttcgttattttcgatttggggcgtggtttcgggtgtcgttaaatatgcgggtaagtttcgtttattttttcgtttcggttcggttttttggttgttattaagatgttgtttgcggttttttgggaagtcgcgtggttggtttcgcgggaagatgtgacggtttcgttttttggttcgtagcgttagttttggtcggagaggcggtagagtagggtgggtgttttgttaggtttgagttagtttcgttatacggcgtttttcgttggtgtttttgtttcgttttgagtagattttttagattttatcgtcgtttttgcgttttattttagtaagttcgtttggtttgttttttttgtggggtcggtttagattaggtaaaaaataaaaagataattttatattg

SEQ ID NO: 33762 - DNA, 569 bp, Artificial Sequence
  chemically treated genomic DNA (Homo sapiens) CpG-island No: 33762
caatataaaattatctttttattttttacctaatctaaaccgaccccacaaaaaaaacaaaccaaacgaacttactaaaataaaacgcaaaaacgacgataaaatctaaaaaatctactcaaaacgaaacaaaaacaccaacgaaaaacgccgtataacgaaactaactcaaacctaacaaaacacccaccctactctaccgcctctccgaccaaaactaacgctacgaaccaaaaaacgaaaccgtcacatcttcccgcgaaaccaaccacgcgacttcccaaaaaaccgcaaacaacatcttaataacaaccaaaaaaccgaaccgaaacgaaaaaataaacgaaacttacccgcatatttaacgacacccgaaaccacgccccaaatcgaaaataacgaaaacgtactaacgcgtcgaaaataactctataattttcctcgcgttcttaaatcgaaaaataaccgctatataattacaacgaaaataaattcccgaaaccgcgattcgacgtatcaaataaacctcgcaatatattcaaattactccaaaaacaataaaaaccgaa

SEQ ID NO: 33763 - DNA, 569 bp, Artificial Sequence
  chemically treated genomic DNA (Homo sapiens) CpG-island No: 33763
tagtgtgggattgtttttttgttttttgtttggtttgagtcggttttatagaaagaatagattagacgagtttattgaggtaaaacgtaggggcggcggtgaggtttagggggtttatttagaacgaggtagagatattagcgaaaagcgtcgtatggcgaagttaatttaggtttgataaaatatttattttattttatcgttttttcggttaaggttgacgttacgggttagagggcggagtcgttatattttttcgcgagattagttacgcgattttttagaaggtcgtaggtaatattttaatagtagttaggaagtcggatcggagcggaagggtgggcggggtttgttcgtatatttagcggtattcgaggttacgttttagatcggaagtgacggagacgtgttagcgcgtcgaaggtagttttatggtttttttcgcgtttttgagtcgggaaatggtcgttgtgtggttgtaacggagataaattttcggaatcgcgattcggcgtgttaggtaggtttcgtaatgtatttaagttattttaggggtagtgaagatcgag

SEQ ID NO: 33764 - DNA, 569 bp, Artificial Sequence
  chemically treated genomic DNA (Homo sapiens) CpG-island No: 33764
ctcgatcttcactacccctaaaataacttaaatacattacgaaacctacctaacacgccgaatcgcgattccgaaaatttatctccgttacaaccacacaacgaccatttcccgactcaaaaacgcgaaaaaaaccataaaactaccttcgacgcgctaacacgtctccgtcacttccgatctaaaacgtaacctcgaataccgctaaatatacgaacaaaccccgcccacccttccgctccgatccgacttcctaactactattaaaatattacctacgaccttctaaaaaatcgcgtaactaatctcgcgaaaaaatataacgactccgccctctaacccgtaacgtcaaccttaaccgaaaaaacgataaaataaaataaatattttatcaaacctaaattaacttcgccatacgacgcttttcgctaatatctctacctcgttctaaataaaccccctaaacctcaccgccgcccctacgttttacctcaataaactcgtctaatctattctttctataaaaccgactcaaaccaaacaaaaaacaaaaaaacaatcccacacta

SEQ ID NO: 33765 - DNA, 1253 bp, Artificial Sequence
  chemically treated genomic DNA (Homo sapiens) CpG-island No: 33765
  misc_feature (946)..(946): n is either a, c, g or t
  misc_feature (1148)..(1148): n is either a, c, g or t
cggagagaaagaaaatatttatatataacgcgggcgagcgaggggaggataagatttgttgacgtagcgatatcgaatagaaagagcgtcgggatagtttacgtatacgtaacgagcgatattacgataatttcgcggcggaatcgataaacggaagttagcgttattcgaaacgaataatagacgagatagttatattataatttttaagaatagattcgtcgcgtttaatatcgagtcgcgcgtatagttaatagtaatagagtttcggacgattaacgattcgtcgcgaaagggtatcggtattagcgggacggcgaattattaatcgttttttatcgttagtagtaaacgcgtataaggagaggatttttagtaatagagatttaagtagtcgagcggcggcggacgttaggttcggggcgacgtatgaggcggagtagaagaattaatatcgtttttaaatcgaggtagatttttttcggggcggcgggggttaattaatagcggttcgatttagcgaatacgggtcgatagttttatagttagtttatatgggattagggggagacggggaagatcgtagaggttcgatagttcggcgagttacgatagtcgataaggataagtattcgtttgtcggtagttcgattagcgatttattcgcgaaggcgtaaggtattcggacgattattcgtaaaggtagtaagttaagcgtggaacgaaataaacgaaaggtacgatcgatttatcgagttataggaatacgatcgtatgaggggagtaagacgcgagtgatatcggatagaattaacggagttataggtagggacgagttagacgggataattagttacggattagtggaaggtttcggtatagcggggatttttaaagattagatgatgtgatcggagtcgtagaagatcgtttacgtagggttttntagcggcgtgttacgtatatatatacggtcgagaatcggatcgaggggtatgcggcgcgaatcgcgtacgacgagcgtcgagaagcgagtgcgacgagtaaggagtgtaatacgtaagtcgtcggatttgtggtacgataagataagtcgtatagtagtggcggggttaatatattaaagaatacgcggagtagaggtcganaatattagttatagtagtcgaggcgcgtcgttattaagagtagtatatggggaggtggagacggatacgtagcgtacgacgtgcgggtataatagacgaatcgta

SEQ ID NO: 33766 - DNA, 1253 bp, Artificial Sequence
  chemically treated genomic DNA (Homo sapiens) CpG-island No: 33766
  misc_feature (106)..(106): n is either a, c, g or t
  misc_feature (308)..(308): n is either a, c, g or t
tacgattcgtctattatacccgcacgtcgtacgctacgtatccgtctccacctccccatatactactcttaataacgacgcgcctcgactactataactaatattntcgacctctactccgcgtattctttaatatattaaccccgccactactatacgacttatcttatcgtaccacaaatccgacgacttacgtattacactccttactcgtcgcactcgcttctcgacgctcgtcgtacgcgattcgcgccgcatacccctcgatccgattctcgaccgtatatatatacgtaacacgccgctanaaaaccctacgtaaacgatcttctacgactccgatcacatcatctaatctttaaaaatccccgctataccgaaaccttccactaatccgtaactaattatcccgtctaactcgtccctacctataactccgttaattctatccgatatcactcgcgtcttactcccctcatacgatcgtattcctataactcgataaatcgatcgtacctttcgtttatttcgttccacgcttaacttactacctttacgaataatcgtccgaataccttacgccttcgcgaataaatcgctaatcgaactaccgacaaacgaatacttatccttatcgactatcgtaactcgccgaactatcgaacctctacgatcttccccgtctccccctaatcccatataaactaactataaaactatcgacccgtattcgctaaatcgaaccgctattaattaacccccgccgccccgaaaaaaatctacctcgatttaaaaacgatattaattcttctactccgcctcatacgtcgccccgaacctaacgtccgccgccgctcgactacttaaatctctattactaaaaatcctctccttatacgcgtttactactaacgataaaaaacgattaataattcgccgtcccgctaataccgataccctttcgcgacgaatcgttaatcgtccgaaactctattactattaactatacgcgcgactcgatattaaacgcgacgaatctattcttaaaaattataatataactatctcgtctattattcgtttcgaataacgctaacttccgtttatcgattccgccgcgaaattatcgtaatatcgctcgttacgtatacgtaaactatcccgacgctctttctattcgatatcgctacgtcaacaaatcttatcctcccctcgctcgcccgcgttatatataaatattttctttctctccg

SEQ ID NO: 33767 - DNA, 1253 bp, Artificial Sequence
  chemically treated genomic DNA (Homo sapiens) CpG-island No: 33767
  misc_feature (106)..(106): n is either a, c, g or t
  misc_feature (308)..(308): n is either a, c, g or t
tacggttcgtttattgtgttcgtacgtcgtgcgttgcgtgttcgtttttatttttttatatgttgtttttaatggcgacgcgtttcggttgttataattaatattntcgatttttgtttcgcgtattttttagtgtgttggtttcgttattgttgtgcggtttattttgtcgtgttataagttcggcgatttacgtattgtattttttgttcgtcgtattcgtttttcgacgttcgtcgtacgcgattcgcgtcgtatatttttcggttcggttttcggtcgtatgtatatgcgtggtacgtcgttgnggggttttacgtaaacggttttttacggtttcggttatattatttggtttttgggggttttcgttgtgtcggggttttttattagttcgtagttagttatttcgtttggttcgtttttatttatggtttcgttgattttattcgatattattcgcgttttgttttttttatgcggtcgtgtttttatggttcggtagatcgatcgtgtttttcgtttgtttcgttttacgtttggtttgttgtttttgcgggtgatcgttcgggtgttttgcgttttcgcgggtgggtcgttggtcgggttgtcggtaggcgggtgtttgtttttgtcggttgtcgtggttcgtcgggttgtcgggtttttgcggtttttttcgtttttttttggttttatgtgggttggttgtggagttgtcggttcgtattcgttaggtcgggtcgttgttggttggttttcgtcgtttcggggggggtttatttcggtttgggggcggtgttggtttttttatttcgttttatgcgtcgtttcgggtttggcgttcgtcgtcgttcggttgtttgagtttttgttattgggggttttttttttgtgcgcgtttgttgttggcggtggggggcggttagtgattcgtcgtttcgttggtgtcgatgttttttcgcggcgggtcgttggtcgttcggggttttgttgttgttggttatgcgcgcggttcggtattgggcgcggcgagtttgtttttgggggttatgatgtggttgtttcgtttgttgttcgtttcgggtggcgttggttttcgtttgtcgatttcgtcgcggagttgtcgtaatgtcgttcgttacgtatgcgtgggttgtttcggcgttttttttattcggtatcgttgcgttaataaattttgtttttttttcgttcgttcgcgttgtgtgtgggtgtttttttttttttcg

SEQ ID NO: 33768 - DNA, 1253 bp, Artificial Sequence
  chemically treated genomic DNA (Homo sapiens) CpG-island No: 33768
  misc_feature (946)..(946): n is either a, c, g or t
  misc_feature (1148)..(1148): n is either a, c, g or t
cgaaaaaaaaaaaaacacccacacacaacgcgaacgaacgaaaaaaaaacaaaatttattaacgcaacgataccgaataaaaaaaacgccgaaacaacccacgcatacgtaacgaacgacattacgacaactccgcgacgaaatcgacaaacgaaaaccaacgccacccgaaacgaacaacaaacgaaacaaccacatcataacccccaaaaacaaactcgccgcgcccaataccgaaccgcgcgcataaccaacaacaacaaaaccccgaacgaccaacgacccgccgcgaaaaaacatcgacaccaacgaaacgacgaatcactaaccgccccccaccgccaacaacaaacgcgcacaaaaaaaaaacccccaataacaaaaactcaaacaaccgaacgacgacgaacgccaaacccgaaacgacgcataaaacgaaataaaaaaaccaacaccgcccccaaaccgaaataaaccccccccgaaacgacgaaaaccaaccaacaacgacccgacctaacgaatacgaaccgacaactccacaaccaacccacataaaaccaaaaaaaaacgaaaaaaaccgcaaaaacccgacaacccgacgaaccacgacaaccgacaaaaacaaacacccgcctaccgacaacccgaccaacgacccacccgcgaaaacgcaaaacacccgaacgatcacccgcaaaaacaacaaaccaaacgtaaaacgaaacaaacgaaaaacacgatcgatctaccgaaccataaaaacacgaccgcataaaaaaaacaaaacgcgaataatatcgaataaaatcaacgaaaccataaataaaaacgaaccaaacgaaataactaactacgaactaataaaaaaccccgacacaacgaaaacccccaaaaaccaaataatataaccgaaaccgtaaaaaaccgtttacgtaaaaccccncaacgacgtaccacgcatatacatacgaccgaaaaccgaaccgaaaaatatacgacgcgaatcgcgtacgacgaacgtcgaaaaacgaatacgacgaacaaaaaatacaatacgtaaatcgccgaacttataacacgacaaaataaaccgcacaacaataacgaaaccaacacactaaaaaatacgcgaaacaaaaatcganaatattaattataacaaccgaaacgcgtcgccattaaaaacaacatataaaaaaataaaaacgaacacgcaacgcacgacgtacgaacacaataaacgaaccgta

SEQ ID NO: 33769 - DNA, 713 bp, Artificial Sequence
  chemically treated genomic DNA (Homo sapiens) CpG-island No: 33769
ggcgggggtgcggcgcgcgttttttttcgcgtttcgttcgtcggtgtttcgttcggcgtcgcgttcgggtcggcgcggtcgcggttcggcgcgtgtcgcgttcgttttttttcgttcgttttcgcgcgcgtcggcggtggttgcgcgttgcggtttttcgcggtttcgtcggcgcgggtgcggtcggcgcggcgtcggcgggcggcgtcggggggggcgtcgcgcgtcggtcgcgtcgcgcgcggtcggggcgcgttcgggttcgggcgcggttttgcgcggtcgcgtcgcggtttcgtcggtcgtcggtcggggcgcggtcggtggcgtcgcgtcgcggcgggggcggcgtcgtcgcggggcgcgcggtcgttcgggtcgggcggggcgttcggttcgcggtcggcgcgggcgcggtcgcgtcgcgcggtcgtcggtcgcgggcggggggttcgtcgggcgcggcgggttcgcgcgttcgggcggtttggcgcgtgggggcgggggttcggcgcggggcgcgtcgcgtggcgcgcggttcgcgtttcgtcggtcggtttcgttcgtttcggcgcgtcgcggggcgcgcgtcgcgcggtgtgtcggcgcgcggcgcggcgcgcggggcggtcgttttgcggttcggggtgggtgggggtggggcggcgggtttttggggcggggcggggtttgcgtcgtgcgcgggcgcgcgt

SEQ ID NO: 33770 - DNA, 713 bp, Artificial Sequence
  chemically treated genomic DNA (Homo sapiens) CpG-island No: 33770
acgcgcgcccgcgcacgacgcaaaccccgccccgccccaaaaacccgccgccccacccccacccaccccgaaccgcaaaacgaccgccccgcgcgccgcgccgcgcgccgacacaccgcgcgacgcgcgccccgcgacgcgccgaaacgaacgaaaccgaccgacgaaacgcgaaccgcgcgccacgcgacgcgccccgcgccgaacccccgcccccacgcgccaaaccgcccgaacgcgcgaacccgccgcgcccgacgaaccccccgcccgcgaccgacgaccgcgcgacgcgaccgcgcccgcgccgaccgcgaaccgaacgccccgcccgacccgaacgaccgcgcgccccgcgacgacgccgcccccgccgcgacgcgacgccaccgaccgcgccccgaccgacgaccgacgaaaccgcgacgcgaccgcgcaaaaccgcgcccgaacccgaacgcgccccgaccgcgcgcgacgcgaccgacgcgcgacgccccccccgacgccgcccgccgacgccgcgccgaccgcacccgcgccgacgaaaccgcgaaaaaccgcaacgcgcaaccaccgccgacgcgcgcgaaaacgaacgaaaaaaaacgaacgcgacacgcgccgaaccgcgaccgcgccgacccgaacgcgacgccgaacgaaacaccgacgaacgaaacgcgaaaaaaaacgcgcgccgcacccccgcc

SEQ ID NO: 33771 - DNA, 713 bp, Artificial Sequence
  chemically treated genomic DNA (Homo sapiens) CpG-island No: 33771
gcgcgcgttcgcgtacgacgtagatttcgtttcgttttagaaattcgtcgttttatttttatttatttcggatcgtagggcggtcgtttcgcgcgtcgcgtcgcgcgtcggtatatcgcgcggcgcgcgtttcgcggcgcgtcggggcgggcgagatcggtcggcggggcgcgagtcgcgcgttacgcggcgcgtttcgcgtcgggttttcgtttttacgcgttaggtcgttcgagcgcgcgggttcgtcgcgttcggcgagtttttcgttcgcggtcgacgatcgcgcgacgcggtcgcgttcgcgtcggtcgcgggtcgggcgtttcgttcggttcgggcggtcgcgcgtttcgcggcggcgtcgttttcgtcgcggcgcgacgttatcggtcgcgtttcggtcggcggtcggcggggtcgcggcgcggtcgcgtagggtcgcgttcggattcgagcgcgtttcggtcgcgcgcggcgcggtcggcgcgcggcgtttttttcggcgtcgttcgtcggcgtcgcgtcggtcgtattcgcgtcggcggggtcgcggggggtcgtagcgcgtagttatcgtcggcgcgcgcgggggcgagcgggggggagcgagcgcggtacgcgtcgggtcgcggtcgcgtcggttcgggcgcggcgtcgggcgaggtatcggcgggcggggcgcggggggaggcgcgcgtcgtattttcgtt

SEQ ID NO: 33772 - DNA, 713 bp, Artificial Sequence
  chemically treated genomic DNA (Homo sapiens) CpG-island No: 33772
aacgaaaatacgacgcgcgcctccccccgcgccccgcccgccgatacctcgcccgacgccgcgcccgaaccgacgcgaccgcgacccgacgcgtaccgcgctcgctcccccccgctcgcccccgcgcgcgccgacgataactacgcgctacgaccccccgcgaccccgccgacgcgaatacgaccgacgcgacgccgacgaacgacgccgaaaaaaacgccgcgcgccgaccgcgccgcgcgcgaccgaaacgcgctcgaatccgaacgcgaccctacgcgaccgcgccgcgaccccgccgaccgccgaccgaaacgcgaccgataacgtcgcgccgcgacgaaaacgacgccgccgcgaaacgcgcgaccgcccgaaccgaacgaaacgcccgacccgcgaccgacgcgaacgcgaccgcgtcgcgcgatcgtcgaccgcgaacgaaaaactcgccgaacgcgacgaacccgcgcgctcgaacgacctaacgcgtaaaaacgaaaacccgacgcgaaacgcgccgcgtaacgcgcgactcgcgccccgccgaccgatctcgcccgccccgacgcgccgcgaaacgcgcgccgcgcgatataccgacgcgcgacgcgacgcgcgaaacgaccgccctacgatccgaaataaataaaaataaaacgacgaatttctaaaacgaaacgaaatctacgtcgtacgcgaacgcgcgc

SEQ ID NO: 33773 - DNA, 1153 bp, Artificial Sequence
  chemically treated genomic DNA (Homo sapiens) CpG-island No: 33773
gcgtttgtaggtagggtatgtgtacgcgtgcgtgtgtacgtgtgtgtgtatttgtgtgtgtgtgtgcgcgcgcgtgtgcgtgtgtgtgttcgtttttagatggttgtatgtacggatggttatgagttagtacgtcgtcgttgtgagcgcgcgaggattcggggttttaagtggtgagaattattcgagggatttttcggatgtttttttttttttttgtttttgagttttgtagtatagcggtgtcggtcgtcggtagggaaggttgtattttttttgcgtcgttaaatcgtgtttattatcgcggtgattgtcgtttaggtcgtatttttgagtcgtattcgcgcgtaggggcgtacgggtacgcgtatagggaggtcgtatatatatatatatatttgtatagggacgagtcgggggtttttgacgttcgtcgtttatttcgtttcggtttggagttttttggtttcgtaggtgtagcgacgtttagttttcgtgcggttagcgcgtcgcgtcggcggattttgtagtttagagagtttagggagtttagggaggggagcgtttcgcgggcggggtagtgtcgtataatcgtaggcgcgtttcgcgtcgttttcgtttcgggtttattttttttcgtcgcgttttttttagtttatttacggacgagcggattttcgattttcgcggtagggatattttaagagttttgtttaggtttgcgtcgtttagtatttcgttcgtgtcgggggttcggcggtttcgggcgagagacggaggttacgcgtagggttgggcgtaggggtcgtcgttcgaggattatgggtgggttagcgtttcgtcgggttgttagttggcggggatcgtcggcgtttgtgtcgggtcgcgttcgaggttgcgtcgttcgtgtcgtagcggttaatgcggtagtattcgcgaacgttatcgcggcgggtttcgttggttcgggttgcggcgtgggggcgggggatcggttttgagcggagtttcgcgggaggaggagcggacgggaggttgggagggattcgtaatattacgtaggatcggggtttttaggtgtcggggaaggcgatggggagggtttggtggggtgggagattgggtttgtattttcgggggtttttttaggaga

SEQ ID NO: 33774 - DNA, 1153 bp, Artificial Sequence
  chemically treated genomic DNA (Homo sapiens) CpG-island No: 33774
tctcctaaaaaaacccccgaaaatacaaacccaatctcccaccccaccaaaccctccccatcgccttccccgacacctaaaaaccccgatcctacgtaatattacgaatccctcccaacctcccgtccgctcctcctcccgcgaaactccgctcaaaaccgatcccccgcccccacgccgcaacccgaaccaacgaaacccgccgcgataacgttcgcgaatactaccgcattaaccgctacgacacgaacgacgcaacctcgaacgcgacccgacacaaacgccgacgatccccgccaactaacaacccgacgaaacgctaacccacccataatcctcgaacgacgacccctacgcccaaccctacgcgtaacctccgtctctcgcccgaaaccgccgaacccccgacacgaacgaaatactaaacgacgcaaacctaaacaaaactcttaaaatatccctaccgcgaaaatcgaaaatccgctcgtccgtaaataaactaaaaaaaacgcgacgaaaaaaaataaacccgaaacgaaaacgacgcgaaacgcgcctacgattatacgacactaccccgcccgcgaaacgctcccctccctaaactccctaaactctctaaactacaaaatccgccgacgcgacgcgctaaccgcacgaaaactaaacgtcgctacacctacgaaaccaaaaaactccaaaccgaaacgaaataaacgacgaacgtcaaaaacccccgactcgtccctatacaaatatatatatatatatacgacctccctatacgcgtacccgtacgcccctacgcgcgaatacgactcaaaaatacgacctaaacgacaatcaccgcgataataaacacgatttaacgacgcaaaaaaaatacaaccttccctaccgacgaccgacaccgctatactacaaaactcaaaaacaaaaaaaaaaaaaaacatccgaaaaatccctcgaataattctcaccacttaaaaccccgaatcctcgcgcgctcacaacgacgacgtactaactcataaccatccgtacatacaaccatctaaaaacgaacacacacacgcacacgcgcgcgcacacacacacacaaatacacacacacgtacacacgcacgcgtacacataccctacctacaaacgc

SEQ ID NO: 33775 - DNA, 1153 bp, Artificial Sequence
  chemically treated genomic DNA (Homo sapiens) CpG-island No: 33775
ttttttggaagagttttcgaaagtataggtttaattttttattttattaagttttttttatcgtttttttcgatatttaaaagtttcggttttgcgtaatattgcggattttttttagtttttcgttcgttttttttttcgcggggtttcgtttagggtcggtttttcgtttttacgtcgtagttcgggttagcggggttcgtcgcggtggcgttcgcggatgttgtcgtattggtcgttgcggtacggacggcgtagtttcgggcgcggttcggtataggcgtcggcggttttcgttagttagtagttcggcgaggcgttggtttatttatggttttcgggcggcggtttttgcgtttagttttgcgcgtagttttcgtttttcgttcggggtcgtcgagttttcgatacgggcgagatgttgaacggcgtaggtttggataaagtttttaagatgtttttgtcgcggaggtcgaggattcgttcgttcgtgggtgagttgggaggggcgcggcgagggagggtgggttcggggcgggggcggcgcggggcgcgtttgcggttatgcgatattgtttcgttcgcgaaacgtttttttttttgggttttttgggttttttgggttgtaggattcgtcgacgcggcgcgttggtcgtacgggggttgggcgtcgttgtatttgcggggttaaaaggttttaggtcggggcgaggtgagcggcgggcgttagagattttcggttcgtttttgtatagatgtgtgtgtgtgtgtgcggtttttttgtgcgcgtgttcgtgcgtttttacgcgcggatgcggtttagggatgcgatttaggcggtagttatcgcgatggtgggtacggtttggcggcgtagagaagatgtagttttttttgtcggcggtcggtatcgttgtgttgtagagtttaaaagtagagggggaaaaaggtattcgaagggtttttcgagtgatttttattatttggagtttcgggttttcgcgcgtttatagcggcgacgtattggtttataattattcgtgtatataattatttggagacgaatatatatacgtatacgcgcgcgtatatatatatataggtatatatatacgtatatacgtacgcgtatatatattttgtttgtaggcgt

SEQ ID NO: 33776 - DNA, 1153 bp, Artificial Sequence
  chemically treated genomic DNA (Homo sapiens) CpG-island No: 33776
acgcctacaaacaaaatatatatacgcgtacgtatatacgtatatatatacctatatatatatatacgcgcgcgtatacgtatatatattcgtctccaaataattatatacacgaataattataaaccaatacgtcgccgctataaacgcgcgaaaacccgaaactccaaataataaaaatcactcgaaaaacccttcgaatacctttttccccctctacttttaaactctacaacacaacgataccgaccgccgacaaaaaaaactacatcttctctacgccgccaaaccgtacccaccatcgcgataactaccgcctaaatcgcatccctaaaccgcatccgcgcgtaaaaacgcacgaacacgcgcacaaaaaaaccgcacacacacacacacatctatacaaaaacgaaccgaaaatctctaacgcccgccgctcacctcgccccgacctaaaaccttttaaccccgcaaatacaacgacgcccaacccccgtacgaccaacgcgccgcgtcgacgaatcctacaacccaaaaaacccaaaaaacccaaaaaaaaaaacgtttcgcgaacgaaacaatatcgcataaccgcaaacgcgccccgcgccgcccccgccccgaacccaccctccctcgccgcgcccctcccaactcacccacgaacgaacgaatcctcgacctccgcgacaaaaacatcttaaaaactttatccaaacctacgccgttcaacatctcgcccgtatcgaaaactcgacgaccccgaacgaaaaacgaaaactacgcgcaaaactaaacgcaaaaaccgccgcccgaaaaccataaataaaccaacgcctcgccgaactactaactaacgaaaaccgccgacgcctataccgaaccgcgcccgaaactacgccgtccgtaccgcaacgaccaatacgacaacatccgcgaacgccaccgcgacgaaccccgctaacccgaactacgacgtaaaaacgaaaaaccgaccctaaacgaaaccccgcgaaaaaaaaaacgaacgaaaaactaaaaaaaatccgcaatattacgcaaaaccgaaacttttaaatatcgaaaaaaacgataaaaaaaacttaataaaataaaaaattaaacctatactttcgaaaactcttccaaaaaa

SEQ ID NO: 33777 - DNA, 688 bp, Artificial Sequence
  chemically treated genomic DNA (Homo sapiens) CpG-island No: 33777
tcgtcgcgttagttttcgcggaggtttagcgggcgtttttgttttttttcgggtcggaattcgggaagggttggcgtcgagttggtcgtttatttttaggggttagggtacgtttcgaaggttttgcggaggggcgcgcggatatcgggatcgtagttttcgttttcgggggtcgaataggagtcgcggggtttcgagggtcgtttcgtcggttttcgtttagtttttcgttcggcgcggggcgcgtaggacggcggagcgcgggcggaaggtaggggggcgggatcgtcgtcgtcgttattcgcgttgttgtaaagttttttcggtggtatagtttttgcgcgttttttgtgggggcggttgttgcgttttcgtcgtttcgtcgttcgtcggttcggggcggtagaggttgggagacgcgagtttggggtcggggcggtagcggggatttaagatcgaaaggggtcgagcgggtacgtttcgggtttcgggttcgggttttatttgggcgtcgcgagagggcgttgttgacggcgcggcgcggcggtgatcggacggcgggacgcgcgcgtcggcggggtagggttgggtcgttttgtttttttttgttcgcgtcgatcgtggtacggtcgattgtgtttattaattttacgttttttatttttatatttgatttttttttattgtt

SEQ ID NO: 33778 - DNA, 688 bp, Artificial Sequence
  chemically treated genomic DNA (Homo sapiens) CpG-island No: 33778
aacaataaaaaaaaatcaaatataaaaataaaaaacgtaaaattaataaacacaatcgaccgtaccacgatcgacgcgaacaaaaaaaaacaaaacgacccaaccctaccccgccgacgcgcgcgtcccgccgtccgatcaccgccgcgccgcgccgtcaacaacgccctctcgcgacgcccaaataaaacccgaacccgaaacccgaaacgtacccgctcgacccctttcgatcttaaatccccgctaccgccccgaccccaaactcgcgtctcccaacctctaccgccccgaaccgacgaacgacgaaacgacgaaaacgcaacaaccgcccccacaaaaaacgcgcaaaaactataccaccgaaaaaactttacaacaacgcgaataacgacgacgacgatcccgcccccctaccttccgcccgcgctccgccgtcctacgcgccccgcgccgaacgaaaaactaaacgaaaaccgacgaaacgaccctcgaaaccccgcgactcctattcgacccccgaaaacgaaaactacgatcccgatatccgcgcgcccctccgcaaaaccttcgaaacgtaccctaacccctaaaaataaacgaccaactcgacgccaacccttcccgaattccgacccgaaaaaaaacaaaaacgcccgctaaacctccgcgaaaactaacgcgacga

SEQ ID NO: 33779 - DNA, 688 bp, Artificial Sequence
  chemically treated genomic DNA (Homo sapiens) CpG-island No: 33779
aataataagaaagaattaagtgtgaaagtaaaagacgtggagttaatggatatagtcgatcgtgttacggtcggcgcgggtagggaggagtaggacggtttagttttgtttcgtcggcgcgcgcgtttcgtcgttcggttatcgtcgcgtcgcgtcgttagtagcgttttttcgcggcgtttaggtgggattcgggttcgggattcgaggcgtgttcgttcggtttttttcggttttgggttttcgttgtcgtttcggttttagattcgcgttttttagtttttgtcgtttcgaatcggcgggcgacggggcggcgagggcgtagtagtcgtttttataggaagcgcgtaggaattgtgttatcgaagaaattttgtaatagcgcgagtggcggcggcggcggtttcgtttttttgtttttcgttcgcgtttcgtcgttttgcgcgtttcgcgtcgggcgggaggttggacgggagtcggcgaggcggttttcgaggtttcgcggtttttgttcgattttcgggggcgaggattgcggtttcggtgttcgcgcgttttttcgtagggttttcgggacgtgttttggtttttgaggataagcggttagttcggcgttagtttttttcggatttcgattcggaggaggataggggcgttcgttgggttttcgcgggagttggcgcggcgg

SEQ ID NO: 33780 - DNA, 688 bp, Artificial Sequence
  chemically treated genomic DNA (Homo sapiens) CpG-island No: 33780
ccgccgcgccaactcccgcgaaaacccaacgaacgcccctatcctcctccgaatcgaaatccgaaaaaaactaacgccgaactaaccgcttatcctcaaaaaccaaaacacgtcccgaaaaccctacgaaaaaacgcgcgaacaccgaaaccgcaatcctcgcccccgaaaatcgaacaaaaaccgcgaaacctcgaaaaccgcctcgccgactcccgtccaacctcccgcccgacgcgaaacgcgcaaaacgacgaaacgcgaacgaaaaacaaaaaaacgaaaccgccgccgccgccactcgcgctattacaaaatttcttcgataacacaattcctacgcgcttcctataaaaacgactactacgccctcgccgccccgtcgcccgccgattcgaaacgacaaaaactaaaaaacgcgaatctaaaaccgaaacgacaacgaaaacccaaaaccgaaaaaaaccgaacgaacacgcctcgaatcccgaacccgaatcccacctaaacgccgcgaaaaaacgctactaacgacgcgacgcgacgataaccgaacgacgaaacgcgcgcgccgacgaaacaaaactaaaccgtcctactcctccctacccgcgccgaccgtaacacgatcgactatatccattaactccacgtcttttactttcacacttaattctttcttattatt

SEQ ID NO: 33781 - DNA, 615 bp, Artificial Sequence
  chemically treated genomic DNA (Homo sapiens) CpG-island No: 33781
gattcggtacggagcgtaggggtattagggaggataggggcgtatttcgagttatttgtgtcggttttcgagttcgcgtgtaatagtttgattttcggtcgttgtttgtcgttattcggtttgcgttgtattatttgtcgtaggagtagtcgtatgcgtcgcgaggtcgggtcgtcgtggttttcgggtgtttcgaggagtagaagtcgggattgtatggcgtcgggggggttgtcggggacggcgagggggttcggggatcgagcggcgtttcgtgtaggtatcgtgaggtagcgcggagaaggggataggaagcggtatttagtcgagttcgtcggaaattttttttttcgcggcgcggtcggtttagtagatttagttcggttttattcggttttgtatggtttagacgggcggaaagagtttgcggagttttagtttaaagagtcggtatcgtttcgggattgttcgtatcgcgggggtgtttcgagttgcggcgttgggttttggtaagcgtttcgtagttcgtgagattgtttgtttatttggatgtattaggtttttattcgtcgtttttttgcgattttatagaattttaggagtttagtaaatgtt

SEQ ID NO: 33782 - DNA, 615 bp, Artificial Sequence
  chemically treated genomic DNA (Homo sapiens) CpG-island No: 33782
aacatttactaaactcctaaaattctataaaatcgcaaaaaaacgacgaataaaaacctaatacatccaaataaacaaacaatctcacgaactacgaaacgcttaccaaaacccaacgccgcaactcgaaacacccccgcgatacgaacaatcccgaaacgataccgactctttaaactaaaactccgcaaactctttccgcccgtctaaaccatacaaaaccgaataaaaccgaactaaatctactaaaccgaccgcgccgcgaaaaaaaaaatttccgacgaactcgactaaataccgcttcctatccccttctccgcgctacctcacgatacctacacgaaacgccgctcgatccccgaaccccctcgccgtccccgacaacccccccgacgccatacaatcccgacttctactcctcgaaacacccgaaaaccacgacgacccgacctcgcgacgcatacgactactcctacgacaaataatacaacgcaaaccgaataacgacaaacaacgaccgaaaatcaaactattacacgcgaactcgaaaaccgacacaaataactcgaaatacgcccctatcctccctaatacccctacgctccgtaccgaatc

SEQ ID NO: 33783 - DNA, 615 bp, Artificial Sequence
  chemically treated genomic DNA (Homo sapiens) CpG-island No: 33783
ggtatttattgaatttttgagattttgtgggatcgtagggaaacggcgggtgaaggtttggtgtatttaggtgaatagatagttttacggattgcgaggcgtttgttagagtttagcgtcgtagttcggagtattttcgcggtgcgggtagtttcgggacggtgtcggttttttgggttggagtttcgtaggtttttttcgttcgtttgggttatgtagggtcgggtagggtcgggttgagtttattgagtcggtcgcgtcgcgggggaaggagttttcggcggattcggttaggtgtcgttttttgttttttttttcgcgttgttttacggtgtttgtacgggacgtcgttcgattttcgagttttttcgtcgttttcgatagttttttcggcgttatgtaatttcggtttttatttttcggggtattcggaggttacggcggttcggtttcgcggcgtatgcggttgtttttgcggtaggtggtgtagcgtaggtcgggtggcgataggtagcggtcggaggttagattgttgtacgcgggttcgggggtcgatataggtaattcggggtgcgtttttgttttttttggtgtttttgcgtttcgtgtcgggtt

SEQ ID NO: 33784 - DNA, 615 bp, Artificial Sequence
  chemically treated genomic DNA (Homo sapiens) CpG-island No: 33784
aacccgacacgaaacgcaaaaacaccaaaaaaaacaaaaacgcaccccgaattacctatatcgacccccgaacccgcgtacaacaatctaacctccgaccgctacctatcgccacccgacctacgctacaccacctaccgcaaaaacaaccgcatacgccgcgaaaccgaaccgccgtaacctccgaataccccgaaaaataaaaaccgaaattacataacgccgaaaaaactatcgaaaacgacgaaaaaactcgaaaatcgaacgacgtcccgtacaaacaccgtaaaacaacgcgaaaaaaaaaacaaaaaacgacacctaaccgaatccgccgaaaactccttcccccgcgacgcgaccgactcaataaactcaacccgaccctacccgaccctacataacccaaacgaacgaaaaaaacctacgaaactccaacccaaaaaaccgacaccgtcccgaaactacccgcaccgcgaaaatactccgaactacgacgctaaactctaacaaacgcctcgcaatccgtaaaactatctattcacctaaatacaccaaaccttcacccgccgtttccctacgatcccacaaaatctcaaaaattcaataaatacc

SEQ ID NO: 33785 - DNA, 902 bp, Artificial Sequence
  chemically treated genomic DNA (Homo sapiens) CpG-island No: 33785
aggaaggcgggagcgtcgcggggtgaatagacgttgaggaaggcgggagcgcggcggggtgaatagacgttaatgtttgttgtagcgcggcggggtgaatagacgttgacgaaggcgggagcgcggcggggtgaatagacgttgacgaaggcgggagcgcggcggggtgaagagacgttgacgaaggcgggagcgcggcggggtgaagagacgttgacgaaggcgggagcgcggcggggtgaagagacgttgacgaaggcgggagcgcggcggggtgaagagacgttgacgaaggcgggagcgcggcggggtgaagagacgttgacgaaggcgggagcgcggcggggtgaagagacgttgacgaaggcgggagcggggcgggtgaatagacgttgacgaaggcgggagcggggcggggtgaatagacgttaaggaaggcgggagcgcggcggggtgaatagacgttaatgaaggcgggagcgcggcggggtgaatagacgttgataaaggcgggagcgcggcggggtgaatagacgttgacgaaggcgggagcgcggcggggtgaatagacgttgacgaaggcgggagcgcggcggggtgaatagacgttgacgaaggcgggagcgcggcggggtgaatagacgttgacgaaggcgggagcgcggcggggtgaatagacgttgacgaaggcgggagcgcggcggggtgaatagacgttgacgaaggcgggagcgcggcggggtgaatagacgttgacgaaggcgggagagcggcggggtgaatagacgtttaggaaggcgggagcgcggcggggtgaagagacgttaacgaaggcgggagcgtggcggggtgaatagatgttgacgaaggcgggagcgcggcggggtgaatagatgtttagg

SEQ ID NO: 33786 - DNA, 902 bp, Artificial Sequence
  chemically treated genomic DNA (Homo sapiens) CpG-island No: 33786
cctaaacatctattcaccccgccgcgctcccgccttcgtcaacatctattcaccccgccacgctcccgccttcgttaacgtctcttcaccccgccgcgctcccgccttcctaaacgtctattcaccccgccgctctcccgccttcgtcaacgtctattcaccccgccgcgctcccgccttcgtcaacgtctattcaccccgccgcgctcccgccttcgtcaacgtctattcaccccgccgcgctcccgccttcgtcaacgtctattcaccccgccgcgctcccgccttcgtcaacgtctattcaccccgccgcgctcccgccttcgtcaacgtctattcaccccgccgcgctcccgccttcgtcaacgtctattcaccccgccgcgctcccgcctttatcaacgtctattcaccccgccgcgctcccgccttcattaacgtctattcaccccgccgcgctcccgccttccttaacgtctattcaccccgccccgctcccgccttcgtcaacgtctattcacccgccccgctcccgccttcgtcaacgtctcttcaccccgccgcgctcccgccttcgtcaacgtctcttcaccccgccgcgctcccgccttcgtcaacgtctcttcaccccgccgcgctcccgccttcgtcaacgtctcttcaccccgccgcgctcccgccttcgtcaacgtctcttcaccccgccgcgctcccgccttcgtcaacgtctcttcaccccgccgcgctcccgccttcgtcaacgtctattcaccccgccgcgctcccgccttcgtcaacgtctattcaccccgccgcgctacaacaaacattaacgtctattcaccccgccgcgctcccgccttcctcaacgtctattcaccccgcgacgctcccgccttcct

SEQ ID NO: 33787 - DNA, 902 bp, Artificial Sequence
  chemically treated genomic DNA (Homo sapiens) CpG-island No: 33787
tttaagtatttgtttatttcgtcgcgttttcgttttcgttagtatttgtttatttcgttacgttttcgttttcgttagcgtttttttatttcgtcgcgttttcgtttttttgagcgtttgtttatttcgtcgttttttcgttttcgttagcgtttgtttatttcgtcgcgttttcgttttcgttagcgtttgtttatttcgtcgcgttttcgttttcgttagcgtttgtttatttcgtcgcgttttcgttttcgttagcgtttgtttatttcgtcgcgttttcgttttcgttagcgtttgtttatttcgtcgcgttttcgttttcgttagcgtttgtttatttcgtcgcgttttcgttttcgttagcgtttgtttatttcgtcgcgttttcgtttttgttagcgtttgtttatttcgtcgcgttttcgtttttattagcgtttgtttatttcgtcgcgttttcgttttttttagcgtttgtttatttcgtttcgttttcgttttcgttagcgtttgtttattcgtttcgttttcgttttcgttagcgtttttttatttcgtcgcgttttcgttttcgttagcgtttttttatttcgtcgcgttttcgttttcgttagcgtttttttatttcgtcgcgttttcgttttcgttagcgtttttttatttcgtcgcgttttcgttttcgttagcgtttttttatttcgtcgcgttttcgttttcgttagcgtttttttatttcgtcgcgttttcgttttcgttagcgtttgtttatttcgtcgcgttttcgttttcgttagcgtttgtttatttcgtcgcgttataataaatattagcgtttgtttatttcgtcgcgttttcgttttttttagcgtttgtttatttcgcggcgttttcgttttttt

SEQ ID NO: 33788 - DNA, 902 bp, Artificial Sequence
  chemically treated genomic DNA (Homo sapiens) CpG-island No: 33788
aaaaaaacgaaaacgccgcgaaataaacaaacgctaaaaaaaacgaaaacgcgacgaaataaacaaacgctaatatttattataacgcgacgaaataaacaaacgctaacgaaaacgaaaacgcgacgaaataaacaaacgctaacgaaaacgaaaacgcgacgaaataaaaaaacgctaacgaaaacgaaaacgcgacgaaataaaaaaacgctaacgaaaacgaaaacgcgacgaaataaaaaaacgctaacgaaaacgaaaacgcgacgaaataaaaaaacgctaacgaaaacgaaaacgcgacgaaataaaaaaacgctaacgaaaacgaaaacgcgacgaaataaaaaaacgctaacgaaaacgaaaacgaaacgaataaacaaacgctaacgaaaacgaaaacgaaacgaaataaacaaacgctaaaaaaaacgaaaacgcgacgaaataaacaaacgctaataaaaacgaaaacgcgacgaaataaacaaacgctaacaaaaacgaaaacgcgacgaaataaacaaacgctaacgaaaacgaaaacgcgacgaaataaacaaacgctaacgaaaacgaaaacgcgacgaaataaacaaacgctaacgaaaacgaaaacgcgacgaaataaacaaacgctaacgaaaacgaaaacgcgacgaaataaacaaacgctaacgaaaacgaaaacgcgacgaaataaacaaacgctaacgaaaacgaaaacgcgacgaaataaacaaacgctaacgaaaacgaaaaaacgacgaaataaacaaacgctcaaaaaaacgaaaacgcgacgaaataaaaaaacgctaacgaaaacgaaaacgtaacgaaataaacaaatactaacgaaaacgaaaacgcgacgaaataaacaaatacttaaa

SEQ ID NO: 33789 - DNA, 524 bp, Artificial Sequence
  chemically treated genomic DNA (Homo sapiens) CpG-island No: 33789
gattgaattagttcggtttgtagagaaaggcgagtagcgtttttatacggagagtagcggtgcgtttataaagtcgcgtatgtttatttcggtttttcgttttatttttaaggtaggcggcgaggtttagtgcgtaagcgttattcgtcggcgtcgatttttttcgttaaggcgggaatacgcggggtttaagatggcggttagtcggtatcggcgtttttttaagttttgtgaggaatggttagtggacgagattaaacggggtcgggatttgggcgtttatttgcgatagcgggtagtataggtttttcgggagggagagaatatttaggtgatcggcggggaggcggttgggacgaggggaggaaaggacgaggtaggggcggggttaacgagcgcgttagtagggggatttgcgtatgcgcgcgttttttttttaggtagtacgtgagcgcggatttttttttttttttagggagttattgatagcgacgttcgttgtatttagcgttttttttcggttg

SEQ ID NO: 33790 - DNA, 524 bp, Artificial Sequence
  chemically treated genomic DNA (Homo sapiens) CpG-island No: 33790
caaccgaaaaaaaacgctaaatacaacgaacgtcgctatcaataactccctaaaaaaaaaaaaaaatccgcgctcacgtactacctaaaaaaaaaacgcgcgcatacgcaaatccccctactaacgcgctcgttaaccccgcccctacctcgtcctttcctcccctcgtcccaaccgcctccccgccgatcacctaaatattctctccctcccgaaaaacctatactacccgctatcgcaaataaacgcccaaatcccgaccccgtttaatctcgtccactaaccattcctcacaaaacttaaaaaaacgccgataccgactaaccgccatcttaaaccccgcgtattcccgccttaacgaaaaaaatcgacgccgacgaataacgcttacgcactaaacctcgccgcctaccttaaaaataaaacgaaaaaccgaaataaacatacgcgactttataaacgcaccgctactctccgtataaaaacgctactcgcctttctctacaaaccgaactaattcaatc

SEQ ID NO: 33791 - DNA, 524 bp, Artificial Sequence
  chemically treated genomic DNA (Homo sapiens) CpG-island No: 33791
tagtcgggggagagcgttgaatataacgggcgtcgttattagtagttttttgggggaaaaagggggttcgcgtttacgtgttgtttggaaagagggcgcgcgtatgcgtagatttttttgttagcgcgttcgttggtttcgtttttgtttcgttttttttttttttcgttttagtcgttttttcgtcggttatttgggtattttttttttttcgaaaggtttgtgttattcgttgtcgtaggtaagcgtttaagtttcggtttcgtttggtttcgtttattggttattttttatagagtttaagaaaacgtcggtatcggttggtcgttattttgggtttcgcgtgttttcgttttagcgggaggagtcggcgtcgacgaatggcgtttgcgtattaagtttcgtcgtttgttttaggagtggagcgggaggtcggagtgggtatgcgcgattttgtaggcgtatcgttatttttcgtgtaggggcgttgttcgtttttttttgtaagtcgagttaatttagtt

SEQ ID NO: 33792 - DNA, 524 bp, Artificial Sequence
  chemically treated genomic DNA (Homo sapiens) CpG-island No: 33792
aactaaattaactcgacttacaaaaaaaaacgaacaacgcccctacacgaaaaataacgatacgcctacaaaatcgcgcatacccactccgacctcccgctccactcctaaaacaaacgacgaaacttaatacgcaaacgccattcgtcgacgccgactcctcccgctaaaacgaaaacacgcgaaacccaaaataacgaccaaccgataccgacgttttcttaaactctataaaaaataaccaataaacgaaaccaaacgaaaccgaaacttaaacgcttacctacgacaacgaataacacaaacctttcgaaaaaaaaaaaatacccaaataaccgacgaaaaaacgactaaaacgaaaaaaaaaaaaaacgaaacaaaaacgaaaccaacgaacgcgctaacaaaaaaatctacgcatacgcgcgccctctttccaaacaacacgtaaacgcgaaccccctttttcccccaaaaaactactaataacgacgcccgttatattcaacgctctcccccgacta

SEQ ID NO: 33793 - DNA, 518 bp, Artificial Sequence
  chemically treated genomic DNA (Homo sapiens) CpG-island No: 33793
gggcgggcggcgggcgcgttaagacgtgggtatttttttattcggatttcgggtttcgtcgagtcgttttttggttttcgtggtcgttagttcgtttcggtcgtatcgagcgtcgggattcgaggtgggagcgtattttttttcgtttttcggacgttttagtttttcgtattgagtttggttacgcgtttttaggcgttttttacgttttgggtttcggagggtcgtagttatgagtgaaatgtttagttttttttatatcggggatatcgtttttttgtacgtcgagggtttcgttaatggttttattagtattttggggtgagtgagtcgagttcgagaggggcgcgggtaaagagggggcgtcgtgggttttggtgttagttgcgtgcgtttagtcgtcgtttttcgatagaggtttggacgtttttttagttttaaggagcgggaacggttcgttttttttttttatagaaaggaagtgaagtgtttgtttaggtaggattcgggttttttat

SEQ ID NO: 33794 - DNA, 518 bp, Artificial Sequence
  chemically treated genomic DNA (Homo sapiens) CpG-island No: 33794
ataaaaaacccgaatcctacctaaacaaacacttcacttcctttctataaaaaaaaaaaacgaaccgttcccgctccttaaaactaaaaaaacgtccaaacctctatcgaaaaacgacgactaaacgcacgcaactaacaccaaaacccacgacgccccctctttacccgcgcccctctcgaactcgactcactcaccccaaaatactaataaaaccattaacgaaaccctcgacgtacaaaaaaacgatatccccgatataaaaaaaactaaacatttcactcataactacgaccctccgaaacccaaaacgtaaaaaacgcctaaaaacgcgtaaccaaactcaatacgaaaaactaaaacgtccgaaaaacgaaaaaaaatacgctcccacctcgaatcccgacgctcgatacgaccgaaacgaactaacgaccacgaaaaccaaaaaacgactcgacgaaacccgaaatccgaataaaaaaatacccacgtcttaacgcgcccgccgcccgccc

SEQ ID NO: 33795 - DNA, 518 bp, Artificial Sequence
  chemically treated genomic DNA (Homo sapiens) CpG-island No: 33795
gtagggagttcgagttttatttgagtaaatattttattttttttttgtaaaagaaggaggcgagtcgttttcgttttttgagattagggggacgtttaggtttttatcggggggcggcggttggacgtacgtagttggtattagggtttacggcgttttttttttattcgcgtttttttcgagttcggtttatttattttaaagtgttgatgaagttattgacggagttttcggcgtatagggagacgatgttttcgatgtgaagaaagttggatattttatttatggttgcggtttttcggggtttagggcgtggggggcgtttaggggcgcgtggttaagtttagtgcggaggattgaggcgttcggggagcggggaggggtacgtttttatttcggatttcgacgttcggtgcggtcggggcgggttggcggttacgggagttaggaggcggttcggcggggttcggggttcgggtgaggaggtgtttacgttttggcgcgttcgtcgttcgttt

SEQ ID NO: 33796 - DNA, 518 bp, Artificial Sequence
  chemically treated genomic DNA (Homo sapiens) CpG-island No: 33796
aaacgaacgacgaacgcgccaaaacgtaaacacctcctcacccgaaccccgaaccccgccgaaccgcctcctaactcccgtaaccgccaacccgccccgaccgcaccgaacgtcgaaatccgaaataaaaacgtacccctccccgctccccgaacgcctcaatcctccgcactaaacttaaccacgcgcccctaaacgccccccacgccctaaaccccgaaaaaccgcaaccataaataaaatatccaactttcttcacatcgaaaacatcgtctccctatacgccgaaaactccgtcaataacttcatcaacactttaaaataaataaaccgaactcgaaaaaaacgcgaataaaaaaaaaacgccgtaaaccctaataccaactacgtacgtccaaccgccgccccccgataaaaacctaaacgtccccctaatctcaaaaaacgaaaacgactcgcctccttcttttacaaaaaaaaaataaaatatttactcaaataaaactcgaactccctac

SEQ ID NO: 33797 - DNA, 634 bp, Artificial Sequence
  chemically treated genomic DNA (Homo sapiens) CpG-island No: 33797
tcgtcgtcgtcgttattttgtatataggggattatcggggcgggtagtttttcggtcggcggggtttttcggaagggcgttggtttcggcgtttttaaatttagtcgcgtttttatgggttttatgacgtcgttcgtttttggatttgttcgggtcgaatcgggtttttttggagatttaattaatttttcgggtcgtggaaggagcgtagggttgtagtttaggttcgtttttttcgaggcgagtcgttttaggttcgataagataacgtagttttattttggagttttcggtttttagttgcggttgtttagggcgaagtgggaggaggatgcgggtttggggtcggtttcggggttacgtcgtttttcggttgaatttgttcgcgacgggggagggtcgggggcggggaggcgcggtcgttgggatatttggaagtcgtgttttcgagtgttcgggtggaatgcggggggcgattttttgtcgttcgcgggttttttgtagtttttattcgtattttcggcggggttcgcgtttgtttcgttttttgagtgtttcgaagtgggggtgtagagttcgcgtttaatttttagagatttttacgtgtataaagtttttttgtttatgaatttgg

SEQ ID NO: 33798 - DNA, 634 bp, Artificial Sequence
  chemically treated genomic DNA (Homo sapiens) CpG-island No: 33798
ccaaattcataaacaaaaaaactttatacacgtaaaaatctctaaaaattaaacgcgaactctacacccccacttcgaaacactcaaaaaacgaaacaaacgcgaaccccgccgaaaatacgaataaaaactacaaaaaacccgcgaacgacaaaaaatcgccccccgcattccacccgaacactcgaaaacacgacttccaaatatcccaacgaccgcgcctccccgcccccgaccctcccccgtcgcgaacaaattcaaccgaaaaacgacgtaaccccgaaaccgaccccaaacccgcatcctcctcccacttcgccctaaacaaccgcaactaaaaaccgaaaactccaaaataaaactacgttatcttatcgaacctaaaacgactcgcctcgaaaaaaacgaacctaaactacaaccctacgctccttccacgacccgaaaaattaattaaatctccaaaaaaacccgattcgacccgaacaaatccaaaaacgaacgacgtcataaaacccataaaaacgcgactaaatttaaaaacgccgaaaccaacgcccttccgaaaaaccccgccgaccgaaaaactacccgccccgataatcccctatatacaaaataacgacgacgacga

SEQ ID NO: 33799 - DNA, 634 bp, Artificial Sequence
  chemically treated genomic DNA (Homo sapiens) CpG-island No: 33799
ttaagtttatgggtaggaagattttgtgtacgtgggggtttttgaaggttgagcgcgagttttgtatttttatttcgaggtatttaagaagcggaatagacgcgagtttcgtcgggggtgcgggtgagggttgtagggagttcgcgaacgatagaaagtcgtttttcgtattttattcgagtattcgggaatacggtttttaggtgttttagcggtcgcgttttttcgttttcggttttttttcgtcgcgggtaggtttaatcgggaggcggcgtggtttcggagtcggttttaggttcgtattttttttttatttcgttttgggtagtcgtagttaaaagtcggaggttttaaagtggaattacgttgttttgtcgagtttggggcgattcgtttcggggagggcgagtttgaattgtagttttgcgttttttttacggttcgaggagttagttaagtttttagaggggttcggttcggttcgagtaagtttaggggcgaacggcgttatggagtttataggggcgcggttaagtttggaggcgtcgggattagcgttttttcgagaggtttcgtcggtcgaggagttgttcgtttcggtggttttttgtgtgtagggtggcggcgacggcgg

SEQ ID NO: 33800 - DNA, 634 bp, Artificial Sequence
  chemically treated genomic DNA (Homo sapiens) CpG-island No: 33800
ccgccgtcgccgccaccctacacacaaaaaaccaccgaaacgaacaactcctcgaccgacgaaacctctcgaaaaaacgctaatcccgacgcctccaaacttaaccgcgcccctataaactccataacgccgttcgcccctaaacttactcgaaccgaaccgaacccctctaaaaacttaactaactcctcgaaccgtaaaaaaaacgcaaaactacaattcaaactcgccctccccgaaacgaatcgccccaaactcgacaaaacaacgtaattccactttaaaacctccgacttttaactacgactacccaaaacgaaataaaaaaaaaatacgaacctaaaaccgactccgaaaccacgccgcctcccgattaaacctacccgcgacgaaaaaaaaccgaaaacgaaaaaacgcgaccgctaaaacacctaaaaaccgtattcccgaatactcgaataaaatacgaaaaacgactttctatcgttcgcgaactccctacaaccctcacccgcacccccgacgaaactcgcgtctattccgcttcttaaatacctcgaaataaaaatacaaaactcgcgctcaaccttcaaaaacccccacgtacacaaaatcttcctacccataaacttaa

SEQ ID NO: 33801 - DNA, 1021 bp, Artificial Sequence
  chemically treated genomic DNA (Homo sapiens) CpG-island No: 33801
ttttcgggtatttttttttatttcggtttcgcgtttagattttgaggcgtttttagggcgttgagtttgaggagttcgcggcggtttgggggtttgtttggaggaatttttacggagaggtcgcgggtcggtatttttcggatgtattaggaattatcgttttttcgcgttttcgggttttacgtcgcgttttttttgttttcgttttttttaggtaagaaatgtatttatggtattaagtgtaagttttattattcggagaggtcgtattacgcgtaattggcggtggtcgacgagtttcgcgttaagataggggttcggtttggcgcgggcgtcgaggagtagcggttatcgagagtttcgggcggtttcgtaggagttcgggcggtttttcgggaattatttgcgtatagtttttcgtcggcgcgggggttttcggatttggtcgttttgcgagggagtttttttcggttggtttttagcgacgatttggggtttttggggtcgtttttttcggttttcgtttgtagttttacgtttcgattgggcgggttcgattgggtgttcgcgggcggtcgggtgttaggttcgtttagtttttttagttcggagagttagtttttttcgggcgatttttcgttttcgttcggtttgtagttttagtcgcggggcgaatatcgttttagggatttgtacggcgatttgtttttttcgcgtaggttattcgacgattcgtgggttcgtttatttcgtttcgatcgtttttttgggcgtttcgtttgggcggagtcggtttggggcgacggcgttattgggggatttttagtgtacgcgatcgaggacgacgagggggacgcgcgcgttcgggttcgtatcgcgttttatagcgttttttcgcgtgattaggtggatcgcgtgatggtcgcgttttcggagtttttagatttcgttaggtttatttttttggtatagagatgttagagcgcgggggcgtttttgggtaagttttaagggattaata

SEQ ID NO: 33802 - DNA, 1021 bp, Artificial Sequence
  chemically treated genomic DNA (Homo sapiens) CpG-island No: 33802
tattaatcccttaaaacttacccaaaaacgcccccgcgctctaacatctctataccaaaaaaataaacctaacgaaatctaaaaactccgaaaacgcgaccatcacgcgatccacctaatcacgcgaaaaaacgctataaaacgcgatacgaacccgaacgcgcgcgtccccctcgtcgtcctcgatcgcgtacactaaaaatcccccaataacgccgtcgccccaaaccgactccgcccaaacgaaacgcccaaaaaaacgatcgaaacgaaataaacgaacccacgaatcgtcgaataacctacgcgaaaaaaacaaatcgccgtacaaatccctaaaacgatattcgccccgcgactaaaactacaaaccgaacgaaaacgaaaaatcgcccgaaaaaaactaactctccgaactaaaaaaactaaacgaacctaacacccgaccgcccgcgaacacccaatcgaacccgcccaatcgaaacgtaaaactacaaacgaaaaccgaaaaaaacgaccccaaaaaccccaaatcgtcgctaaaaaccaaccgaaaaaaactccctcgcaaaacgaccaaatccgaaaacccccgcgccgacgaaaaactatacgcaaataattcccgaaaaaccgcccgaactcctacgaaaccgcccgaaactctcgataaccgctactcctcgacgcccgcgccaaaccgaacccctatcttaacgcgaaactcgtcgaccaccgccaattacgcgtaatacgacctctccgaataataaaacttacacttaataccataaatacatttcttacctaaaaaaaacgaaaacaaaaaaaacgcgacgtaaaacccgaaaacgcgaaaaaacgataattcctaatacatccgaaaaataccgacccgcgacctctccgtaaaaattcctccaaacaaacccccaaaccgccgcgaactcctcaaactcaacgccctaaaaacgcctcaaaatctaaacgcgaaaccgaaataaaaaaaaatacccgaaaa

SEQ ID NO: 33803 - DNA, 1021 bp, Artificial Sequence
  chemically treated genomic DNA (Homo sapiens) CpG-island No: 33803
tgttggttttttagggtttgtttaggggcgttttcgcgttttggtatttttgtattaggaggatgagtttggcgaggtttgagagtttcgggaacgcggttattacgcggtttatttggttacgcgggaagacgttgtagagcgcgatgcgagttcgggcgcgcgcgtttttttcgtcgttttcggtcgcgtatattgaaagttttttagtggcgtcgtcgttttaggtcggtttcgtttagacggagcgtttagggaagcggtcggagcggggtggacgggtttacgggtcgtcgggtggtttgcgcggggaaagtaagtcgtcgtgtaggtttttagggcggtgttcgtttcgcggttggagttgtaggtcgggcggaggcgggaggtcgttcggggagaattggtttttcgggttagggaggttgagcgggtttggtattcggtcgttcgcggatatttagtcgggttcgtttagtcggggcgtgaggttgtaggcggggatcgggagaggcggttttaggggttttaggtcgtcgttgaaggttagtcgagagaagttttttcgtagggcggttaggttcggggattttcgcgtcggcgggaggttgtgcgtaaatggttttcggggggtcgttcgggtttttgcggagtcgttcggggttttcggtggtcgttgtttttcggcgttcgcgttaggtcgggtttttgttttggcgcggagttcgtcggttatcgttagttgcgcgtggtgcggttttttcgggtggtagaatttgtatttgatgttataggtgtattttttgtttgaaaggggcgggggtagagagggcgcggcgtgaggttcgggggcgcggaggggcggtggtttttggtgtattcggggagtgtcggttcgcggttttttcgtggagatttttttaagtaggtttttaggtcgtcgcggattttttagatttagcgttttggaaacgttttaagatttgggcgcggggtcgaggtggggagaagtgttcgggag

SEQ ID NO: 33804 - DNA, 1021 bp, Artificial Sequence
  chemically treated genomic DNA (Homo sapiens) CpG-island No: 33804
ctcccgaacacttctccccacctcgaccccgcgcccaaatcttaaaacgtttccaaaacgctaaatctaaaaaatccgcgacgacctaaaaacctacttaaaaaaatctccacgaaaaaaccgcgaaccgacactccccgaatacaccaaaaaccaccgcccctccgcgcccccgaacctcacgccgcgccctctctacccccgcccctttcaaacaaaaaatacacctataacatcaaatacaaattctaccacccgaaaaaaccgcaccacgcgcaactaacgataaccgacgaactccgcgccaaaacaaaaacccgacctaacgcgaacgccgaaaaacaacgaccaccgaaaaccccgaacgactccgcaaaaacccgaacgaccccccgaaaaccatttacgcacaacctcccgccgacgcgaaaatccccgaacctaaccgccctacgaaaaaacttctctcgactaaccttcaacgacgacctaaaacccctaaaaccgcctctcccgatccccgcctacaacctcacgccccgactaaacgaacccgactaaatatccgcgaacgaccgaataccaaacccgctcaacctccctaacccgaaaaaccaattctccccgaacgacctcccgcctccgcccgacctacaactccaaccgcgaaacgaacaccgccctaaaaacctacacgacgacttactttccccgcgcaaaccacccgacgacccgtaaacccgtccaccccgctccgaccgcttccctaaacgctccgtctaaacgaaaccgacctaaaacgacgacgccactaaaaaactttcaatatacgcgaccgaaaacgacgaaaaaaacgcgcgcgcccgaactcgcatcgcgctctacaacgtcttcccgcgtaaccaaataaaccgcgtaataaccgcgttcccgaaactctcaaacctcgccaaactcatcctcctaatacaaaaataccaaaacgcgaaaacgcccctaaacaaaccctaaaaaaccaaca

SEQ ID NO: 33805 - DNA, 661 bp, Artificial Sequence
  chemically treated genomic DNA (Homo sapiens) CpG-island No: 33805
gggagcgcgcggttttgggagataagtacgtagggtcgaggcgaggggttgttttttttatttttgggtttcgcgttttagggaaggtgggggatggggatagcgtttggggaagaaattgttttttgttcggtttaggaattttttcggcgtatcggagaggggtatttttttgttttggcgggtatggaggtcgggtagtcgtcgggggatgtgagtgggcggcgaagtgcgggggaaaggtcggcgttttagggcggggaggatttgggagtggagttcggagataaaatcggggttaggtagaggagttagagggaaagttagtaaacgcgagttcgggtgagagttatcggaatgcgggaacgtagtttagtcgggaatagggttttcgataggggtcgttcgtggttaggacgcggtcgttgaatagaggtcgcgcggcggtttttgttcgagggatttcgtgggcgggggttatacggaggtcgcgtacggttttcggggttggcgggggtaggtgggaggatttttttcgggttcgcgaatttgatttggtagcggttaggtgtttggaagcgtttttaaatgatagggttataaagatatgttggttaggtttgtagttagcgtagtaacgtggtttgtaggagcgtagaat

SEQ ID NO: 33806 - DNA, 661 bp, Artificial Sequence
  chemically treated genomic DNA (Homo sapiens) CpG-island No: 33806
attctacgctcctacaaaccacgttactacgctaactacaaacctaaccaacatatctttataaccctatcatttaaaaacgcttccaaacacctaaccgctaccaaatcaaattcgcgaacccgaaaaaaatcctcccacctacccccgccaaccccgaaaaccgtacgcgacctccgtataacccccgcccacgaaatccctcgaacaaaaaccgccgcgcgacctctattcaacgaccgcgtcctaaccacgaacgacccctatcgaaaaccctattcccgactaaactacgttcccgcattccgataactctcacccgaactcgcgtttactaactttccctctaactcctctacctaaccccgattttatctccgaactccactcccaaatcctccccgccctaaaacgccgacctttcccccgcacttcgccgcccactcacatcccccgacgactacccgacctccatacccgccaaaacaaaaaaatacccctctccgatacgccgaaaaaattcctaaaccgaacaaaaaacaatttcttccccaaacgctatccccatcccccaccttccctaaaacgcgaaacccaaaaataaaaaaaacaacccctcgcctcgaccctacgtacttatctcccaaaaccgcgcgctccc

SEQ ID NO: 33807 - DNA, 661 bp, Artificial Sequence
  chemically treated genomic DNA (Homo sapiens) CpG-island No: 33807
gttttgcgtttttgtaaattacgttgttgcgttaattataaatttggttaatatgtttttgtaattttattatttaaaaacgtttttaggtatttggtcgttgttagattaggttcgcgggttcggaggaggtttttttatttgttttcgttagtttcggggatcgtgcgcggttttcgtgtggttttcgtttacgaggtttttcgggtaggaatcgtcgcgcgatttttgtttagcggtcgcgttttggttacgggcgatttttgtcgggaattttgttttcggttaagttgcgttttcgtatttcggtggtttttattcgagttcgcgtttgttggttttttttttggtttttttgtttgatttcgattttgttttcgaattttatttttagatttttttcgttttggaacgtcgatttttttttcgtatttcgtcgtttatttatatttttcggcgattgttcggtttttatgttcgttaagataagaagatgttttttttcgatgcgtcgagagggtttttaagtcgagtaagggataattttttttttaaacgttgtttttattttttattttttttagagcgcgaaatttaaaagtaaggaaggtaatttttcgtttcgattttacgtgtttgttttttagagtcgcgcgttttt

SEQ ID NO: 33808 - DNA, 661 bp, Artificial Sequence
  chemically treated genomic DNA (Homo sapiens) CpG-island No: 33808
aaaaacgcgcgactctaaaaaacaaacacgtaaaatcgaaacgaaaaattaccttccttacttttaaatttcgcgctctaaaaaaaataaaaaataaaaacaacgtttaaaaaaaaaattatcccttactcgacttaaaaaccctctcgacgcatcgaaaaaaaacatcttcttatcttaacgaacataaaaaccgaacaatcgccgaaaaatataaataaacgacgaaatacgaaaaaaaaatcgacgttccaaaacgaaaaaaatctaaaaataaaattcgaaaacaaaatcgaaatcaaacaaaaaaaccaaaaaaaaaaccaacaaacgcgaactcgaataaaaaccaccgaaatacgaaaacgcaacttaaccgaaaacaaaattcccgacaaaaatcgcccgtaaccaaaacgcgaccgctaaacaaaaatcgcgcgacgattcctacccgaaaaacctcgtaaacgaaaaccacacgaaaaccgcgcacgatccccgaaactaacgaaaacaaataaaaaaacctcctccgaacccgcgaacctaatctaacaacgaccaaatacctaaaaacgtttttaaataataaaattacaaaaacatattaaccaaatttataattaacgcaacaacgtaatttacaaaaacgcaaaac

SEQ ID NO: 33809 - DNA, 880 bp, Artificial Sequence
  chemically treated genomic DNA (Homo sapiens) CpG-island No: 33809
ttatgtgtcgaagggcgattaatattcgttcgataaaattttgtttcgggttatttgggagttgtacgcgtttatattcggggtttagttcggtgcgtttttacgcgtagtttttttgtttatgcggttagtagggagaggggcggagaggtagcgaattttttaatgtgtagtaggtcgcgagggttatataaagttcgggtttcggatttattggaattggttaagattgttcgcgagttggtagcggtttttcgtttagttttgcggcgttatggagaacgcgggaggcgtagagggtatagagagtggagttgcggcgtgcgcggttatcgacggttttacgcggcgcgcgggcgcggatttcgggtaggttttttcgcgttgttttgcgttttttagtttttttcgttttttttttttgcgtttttttagttttttttttttaattttttattttttattgttcggtgttagcgttcggtttcggtggattttttcgggtttgggtttacgttttttttgcgcgttttgtgtttttttatttcgtagatacgtaggtttttggagattttgggtggacgtcggaggtaagaaagaagaggagacgtcgaattacgtcgcggaggcggtgagtgagttacgcgttttaggtcgcgttttttacgggtgtagaagatcgattagggttttcgggacgtagggtttgagagagatatgcgagatatcgggttttgtttttcgtttaatatttcgtttgtcggtggttataaaggtgtcgacgcggcggatgtgttttttggagcgatgggttataggtatttagtcgggagcgaggttgttgagagttttggggttatatttttagcgggtacgagga

SEQ ID NO: 33810 - DNA, 880 bp, Artificial Sequence
  chemically treated genomic DNA (Homo sapiens) CpG-island No: 33810
tcctcgtacccgctaaaaatataaccccaaaactctcaacaacctcgctcccgactaaatacctataacccatcgctccaaaaaacacatccgccgcgtcgacacctttataaccaccgacaaacgaaatattaaacgaaaaacaaaacccgatatctcgcatatctctctcaaaccctacgtcccgaaaaccctaatcgatcttctacacccgtaaaaaacgcgacctaaaacgcgtaactcactcaccgcctccgcgacgtaattcgacgtctcctcttctttcttacctccgacgtccacccaaaatctccaaaaacctacgtatctacgaaataaaaaaacacaaaacgcgcaaaaaaaacgtaaacccaaacccgaaaaaatccaccgaaaccgaacgctaacaccgaacaataaaaaataaaaaattaaaaaaaaaaaactaaaaaaacgcaaaaaaaaaaaacgaaaaaaactaaaaaacgcaaaacaacgcgaaaaaacctacccgaaatccgcgcccgcgcgccgcgtaaaaccgtcgataaccgcgcacgccgcaactccactctctataccctctacgcctcccgcgttctccataacgccgcaaaactaaacgaaaaaccgctaccaactcgcgaacaatcttaaccaattccaataaatccgaaacccgaactttatataaccctcgcgacctactacacattaaaaaattcgctacctctccgcccctctccctactaaccgcataaacaaaaaaactacgcgtaaaaacgcaccgaactaaaccccgaatataaacgcgtacaactcccaaataacccgaaacaaaattttatcgaacgaatattaatcgcccttcgacacataa

SEQ ID NO: 33811 - DNA, 880 bp, Artificial Sequence
  chemically treated genomic DNA (Homo sapiens) CpG-island No: 33811
ttttcgtgttcgttgggaatgtaattttagggtttttagtagtttcgttttcggttgggtgtttgtggtttatcgttttagaggatatattcgtcgcgtcggtatttttatggttatcggtaggcgggatgttaagcgagaggtaggattcggtgtttcgtatgttttttttaggttttgcgtttcgagagttttggtcgattttttgtattcgtgggaggcgcggtttgagacgcgtggtttatttatcgttttcgcggcgtggttcggcgttttttttttttttttgttttcggcgtttatttagggtttttagaagtttgcgtatttgcgggataggggagtataaggcgcgtagaggagacgtgagtttagattcgggagaatttatcgaagtcgagcgttggtatcgggtagtgggggatggagagttggagggaaggagttggggaggcgtaggagggaaagacgggggaagttgggaggcgtagagtagcgcggggaagtttattcggagttcgcgttcgcgcgtcgcgtagggtcgtcggtggtcgcgtacgtcgtagttttattttttgtattttttgcgtttttcgcgttttttatgacgtcgtagagttgggcggaaggtcgttgttagttcgcgggtaattttgattagttttagtaggttcgagattcgagttttatatagttttcgcggtttgttgtatattgagaggttcgttgttttttcgtttttttttttgttagtcgtataaataaaaaggttgcgcgtgaaggcgtatcgggttgagtttcgggtgtgaacgcgtgtaatttttaaatggttcgggatagggttttgtcgagcgaatgttaatcgtttttcgatatatgg

SEQ ID NO: 33812 - DNA, 880 bp, Artificial Sequence
  chemically treated genomic DNA (Homo sapiens) CpG-island No: 33812
ccatatatcgaaaaacgattaacattcgctcgacaaaaccctatcccgaaccatttaaaaattacacgcgttcacacccgaaactcaacccgatacgccttcacgcgcaacctttttatttatacgactaacaaaaaaaaaaacgaaaaaacaacgaacctctcaatatacaacaaaccgcgaaaactatataaaactcgaatctcgaacctactaaaactaatcaaaattacccgcgaactaacaacgaccttccgcccaactctacgacgtcataaaaaacgcgaaaaacgcaaaaaatacaaaaaataaaactacgacgtacgcgaccaccgacgaccctacgcgacgcgcgaacgcgaactccgaataaacttccccgcgctactctacgcctcccaacttcccccgtctttccctcctacgcctccccaactccttccctccaactctccatcccccactacccgataccaacgctcgacttcgataaattctcccgaatctaaactcacgtctcctctacgcgccttatactcccctatcccgcaaatacgcaaacttctaaaaaccctaaataaacgccgaaaacaaaaaaaaaaaaaaaacgccgaaccacgccgcgaaaacgataaataaaccacgcgtctcaaaccgcgcctcccacgaatacaaaaaatcgaccaaaactctcgaaacgcaaaacctaaaaaaaacatacgaaacaccgaatcctacctctcgcttaacatcccgcctaccgataaccataaaaataccgacgcgacgaatatatcctctaaaacgataaaccacaaacacccaaccgaaaacgaaactactaaaaaccctaaaattacattcccaacgaacacgaaaa

SEQ ID NO: 33813 - DNA, 558 bp, Artificial Sequence
  chemically treated genomic DNA (Homo sapiens) CpG-island No: 33813
cgggatcgggacgtcggagagggtcgtttttttttaggttttttttcgtcgcggcgtttacgtgatcgagagtaggtttttattagttcgtttttttcggtcgttgttgtttatttttcgttcggggtaagtaaatcgtcgtttttcgtatcgttttaatttcgttttttttttttttttttgtttttattttttcgggttttttcgcgttattttttttatttttatattttttttatcgggttttttgtacgtgttcggcgtcgtgtaagcgcgttcggtacgtgatttcgtcgaacgtggtattgtgttattacgtgatttaggtgcgtacgcgacggagcggggtgtgaagatggcggacgaagaggtcgagtaggagaggttgagttgcggcgaaggcggttgcgtcgcggagttgtagcgtttgggcgagcggttttaggagttggagttatagttgcgggagagtcgggtatcggtcgtggaagcggttatcgattattgttagtagttgtgttaggtgagggcgttcggtggtttttttttttttttttt

SEQ ID NO: 33814 - DNA, 558 bp, Artificial Sequence
  chemically treated genomic DNA (Homo sapiens) CpG-island No: 33814
aaaaaaaaaaaaaaaaaaccaccgaacgccctcacctaacacaactactaacaataatcgataaccgcttccacgaccgatacccgactctcccgcaactataactccaactcctaaaaccgctcgcccaaacgctacaactccgcgacgcaaccgccttcgccgcaactcaacctctcctactcgacctcttcgtccgccatcttcacaccccgctccgtcgcgtacgcacctaaatcacgtaataacacaataccacgttcgacgaaatcacgtaccgaacgcgcttacacgacgccgaacacgtacaaaaaacccgataaaaaaaatataaaaataaaaaaaataacgcgaaaaaacccgaaaaaataaaaacaaaaaaaaaaaaaaaaaacgaaattaaaacgatacgaaaaacgacgatttacttaccccgaacgaaaaataaacaacaacgaccgaaaaaaacgaactaataaaaacctactctcgatcacgtaaacgccgcgacgaaaaaaaacctaaaaaaaaacgaccctctccgacgtcccgatcccg

SEQ ID NO: 33815 - DNA, 558 bp, Artificial Sequence
  chemically treated genomic DNA (Homo sapiens) CpG-island No: 33815
ggggaaagggggaggggattatcgggcgtttttatttggtatagttgttgatagtagtcggtggtcgtttttacggtcggtattcggttttttcgtagttgtagttttagtttttggagtcgttcgtttaggcgttgtagtttcgcgacgtagtcgttttcgtcgtaatttaattttttttgttcggttttttcgttcgttatttttatatttcgtttcgtcgcgtacgtatttgggttacgtgataatataatgttacgttcggcggggttacgtgtcgggcgcgtttgtacggcgtcgagtacgtataaagggttcgatggggaagatatgggggtggggagagtggcgcgagagagttcgaggaggtgaaggtaaggggaaaggagaagggcggggttggggcggtgcggaaaacggcggtttatttatttcgagcgggaagtgggtagtagcggtcgaaaggggcgggttggtgaaggtttgttttcggttacgtgggcgtcgcgacgggaaaaagtttagggaggggcgatttttttcggcgtttcgatttcg

SEQ ID NO: 33816 - DNA, 558 bp, Artificial Sequence
  chemically treated genomic DNA (Homo sapiens) CpG-island No: 33816
cgaaatcgaaacgccgaaaaaaatcgcccctccctaaactttttcccgtcgcgacgcccacgtaaccgaaaacaaaccttcaccaacccgcccctttcgaccgctactacccacttcccgctcgaaataaataaaccgccgttttccgcaccgccccaaccccgcccttctcctttccccttaccttcacctcctcgaactctctcgcgccactctccccacccccatatcttccccatcgaaccctttatacgtactcgacgccgtacaaacgcgcccgacacgtaaccccgccgaacgtaacattatattatcacgtaacccaaatacgtacgcgacgaaacgaaatataaaaataacgaacgaaaaaaccgaacaaaaaaaattaaattacgacgaaaacgactacgtcgcgaaactacaacgcctaaacgaacgactccaaaaactaaaactacaactacgaaaaaaccgaataccgaccgtaaaaacgaccaccgactactatcaacaactataccaaataaaaacgcccgataatcccctccccctttcccc

SEQ ID NO: 33817 - DNA, 580 bp, Artificial Sequence
  chemically treated genomic DNA (Homo sapiens) CpG-island No: 33817
gcgggtatcgggatgtttcgttagttattttttgtgggcgtttggcgtattttcggtttcggtttattttagttgcgcgtttttgggcgggtgtcgggcgttgtaggcgggcgggggcgatataggggatttagattttagggtcgttgttgacgcgggtcgggttcgcggaggtcgaggagtagtaaagcggagagaggtaggtcggtttttttttgtagggcgtaggatgaaacgtgtttggtttgggtaagttgtggcgaggcgggtcgattggcgtcgttttagggttttttagatttcggattacggacgatttaggatattttatttttttttcgttttttttttttcgcgattttttttcggttttttttttcggtgtttcggtttttttggtaattgggcgggatcgcgagcgtttagatcgtagcgttaaaatgcgtttagttaattcggtagttggcgtagatacgtggttcgggggcgcgtttcgttgttggttttggatgttaattttaggaaggttttttaaagagaaattagattcgtttttattcggttgttggtttggttttta

SEQ ID NO: 33818 - DNA, 580 bp, Artificial Sequence
  chemically treated genomic DNA (Homo sapiens) CpG-island No: 33818
taaaaaccaaaccaacaaccgaataaaaacgaatctaatttctctttaaaaaaccttcctaaaattaacatccaaaaccaacaacgaaacgcgcccccgaaccacgtatctacgccaactaccgaattaactaaacgcattttaacgctacgatctaaacgctcgcgatcccgcccaattaccaaaaaaaccgaaacaccgaaaaaaaaaaccgaaaaaaaatcgcgaaaaaaaaaaaacgaaaaaaaaataaaatatcctaaatcgtccgtaatccgaaatctaaaaaaccctaaaacgacgccaatcgacccgcctcgccacaacttacccaaaccaaacacgtttcatcctacgccctacaaaaaaaaaccgacctacctctctccgctttactactcctcgacctccgcgaacccgacccgcgtcaacaacgaccctaaaatctaaatcccctatatcgcccccgcccgcctacaacgcccgacacccgcccaaaaacgcgcaactaaaataaaccgaaaccgaaaatacgccaaacgcccacaaaaaataactaacgaaacatcccgatacccgc

SEQ ID NO: 33819 - DNA, 580 bp, Artificial Sequence
  chemically treated genomic DNA (Homo sapiens) CpG-island No: 33819
tgagggttagattaataatcgggtaggagcgaatttggtttttttttgaaaagtttttttagggttagtatttagggttagtaacggagcgcgttttcgaattacgtgtttgcgttagttgtcggattggttgagcgtattttagcgttgcggtttagacgttcgcggtttcgtttagttgttagaggagtcgggatatcgagggaagaggtcggagggagatcgcggaggggagggggcgggaggggggtggggtattttgagtcgttcgtggttcggagtttggaaggttttagagcggcgttagtcgattcgtttcgttataatttgtttagattagatacgttttattttgcgttttgtaagaaggagtcggtttgttttttttcgttttgttgtttttcggttttcgcgggttcggttcgcgttagtagcgattttggggtttgggttttttgtgtcgttttcgttcgtttgtagcgttcggtattcgtttaggagcgcgtagttggggtgagtcgagatcggggatgcgttaggcgtttataggaggtggttgacggggtatttcgatattcgt

SEQ ID NO: 33820 - DNA, 580 bp, Artificial Sequence
  chemically treated genomic DNA (Homo sapiens) CpG-island No: 33820
acgaatatcgaaataccccgtcaaccacctcctataaacgcctaacgcatccccgatctcgactcaccccaactacgcgctcctaaacgaataccgaacgctacaaacgaacgaaaacgacacaaaaaacccaaaccccaaaatcgctactaacgcgaaccgaacccgcgaaaaccgaaaaacaacaaaacgaaaaaaaacaaaccgactccttcttacaaaacgcaaaataaaacgtatctaatctaaacaaattataacgaaacgaatcgactaacgccgctctaaaaccttccaaactccgaaccacgaacgactcaaaataccccacccccctcccgccccctcccctccgcgatctccctccgacctcttccctcgatatcccgactcctctaacaactaaacgaaaccgcgaacgtctaaaccgcaacgctaaaatacgctcaaccaatccgacaactaacgcaaacacgtaattcgaaaacgcgctccgttactaaccctaaatactaaccctaaaaaaacttttcaaaaaaaaaccaaattcgctcctacccgattattaatctaaccctca

SEQ ID NO: 33821 - DNA, 792 bp, Artificial Sequence
  chemically treated genomic DNA (Homo sapiens) CpG-island No: 33821
tttcggaggtttcggtttcgttggagagaaagagattgcgtaggcgtcgagtagtcgacgtggtcgtagggatcgtgtttgggggggtttgcgcggggtcgttgattcgcgaggttttttgtcgtttgtcgttttcgttttttttttttttttttagagtgttacggtgatttttgggttcgaaggggacggacgtttttttacgtattatttagaaggttagagtgggtagaatttagtttgagtaggtcggtgatgaattcgttggtaagacgcgcgcgtgggtatttacgtgatttaggttgcggcggcggcgtgttgcgggttttgtggcgggagcgaggtcgacgggcggggtcgcgcggtcgcgtgacgcgaagcgttcgagagcgcgcgtcgtggaacgttttggttgttacggtaagcgcgcgcgcgaggttttgggaatttcgggatcggttttcggcgagcgtagcggcgtttagtgtaagggagtgggagttggttcgtgtcgcggcggtcgcgtagggagttttcgaggtaacgtcggggcgttcgaggtttggaaggcgtaggtggggcgcgggggagtttatttttgcgcggttttttgggtgggcggggtgggcgttttaggtttcgcggattcggttgggaggttgagcgggcgacggttacgggataagggtggagggggtggggattttattcgagttttagagatggaattttcgaggaagggagcgatttcgagagagaatagtttgagaagttgtttttagtttttttttt

SEQ ID NO: 33822 - DNA, 792 bp, Artificial Sequence
  chemically treated genomic DNA (Homo sapiens) CpG-island No: 33822
aaaaaaaaaactaaaaacaacttctcaaactattctctctcgaaatcgctcccttcctcgaaaattccatctctaaaactcgaataaaatccccaccccctccacccttatcccgtaaccgtcgcccgctcaacctcccaaccgaatccgcgaaacctaaaacgcccaccccgcccacccaaaaaaccgcgcaaaaataaactcccccgcgccccacctacgccttccaaacctcgaacgccccgacgttacctcgaaaactccctacgcgaccgccgcgacacgaaccaactcccactcccttacactaaacgccgctacgctcgccgaaaaccgatcccgaaattcccaaaacctcgcgcgcgcgcttaccgtaacaaccaaaacgttccacgacgcgcgctctcgaacgcttcgcgtcacgcgaccgcgcgaccccgcccgtcgacctcgctcccgccacaaaacccgcaacacgccgccgccgcaacctaaatcacgtaaatacccacgcgcgcgtcttaccaacgaattcatcaccgacctactcaaactaaattctacccactctaaccttctaaataatacgtaaaaaaacgtccgtccccttcgaacccaaaaatcaccgtaacactctaaaaaaaaaaaaaaaaaacgaaaacgacaaacgacaaaaaacctcgcgaatcaacgaccccgcgcaaacccccccaaacacgatccctacgaccacgtcgactactcgacgcctacgcaatctctttctctccaacgaaaccgaaacctccgaaa

SEQ ID NO: 33823 - DNA, 792 bp, Artificial Sequence
  chemically treated genomic DNA (Homo sapiens) CpG-island No: 33823
agagaagggattgagaataattttttaaattattttttttcgaaatcgttttttttttcgaaaattttatttttgagattcggatgaggtttttattttttttatttttgtttcgtgatcgtcgttcgtttagttttttagtcgagttcgcggggtttggggcgtttatttcgtttatttaagggatcgcgtaggggtgaattttttcgcgttttatttgcgttttttagatttcgggcgtttcggcgttgtttcgagagttttttgcgcggtcgtcgcggtacggattagtttttatttttttatattgggcgtcgttgcgttcgtcgggggtcggtttcgaggtttttaaggtttcgcgcgcgcgtttgtcgtggtaattaagacgttttacgacgcgcgttttcgaacgtttcgcgttacgcggtcgcgcggtttcgttcgtcggtttcgttttcgttatagagttcgtagtacgtcgtcgtcgtagtttaggttacgtgagtatttacgcgcgcgttttgttagcggatttattatcggtttgtttagattaggttttgtttattttgattttttaaatggtacgtgggaggacgttcgtttttttcggatttaagagttatcgtaatattttagaaggggagaaaaggagcgagggcggtaggcgatagagaatttcgcgagttagcggtttcgcgtagatttttttaggtacggtttttgcggttacgtcggttgttcggcgtttgcgtaatttttttttttttagcgaaatcgaggttttcggag

SEQ ID NO: 33824 - DNA, 792 bp, Artificial Sequence
  chemically treated genomic DNA (Homo sapiens) CpG-island No: 33824
ctccgaaaacctcgatttcgctaaaaaaaaaaaaattacgcaaacgccgaacaaccgacgtaaccgcaaaaaccgtacctaaaaaaatctacgcgaaaccgctaactcgcgaaattctctatcgcctaccgccctcgctccttttctccccttctaaaatattacgataactcttaaatccgaaaaaaacgaacgtcctcccacgtaccatttaaaaaatcaaaataaacaaaacctaatctaaacaaaccgataataaatccgctaacaaaacgcgcgcgtaaatactcacgtaacctaaactacgacgacgacgtactacgaactctataacgaaaacgaaaccgacgaacgaaaccgcgcgaccgcgtaacgcgaaacgttcgaaaacgcgcgtcgtaaaacgtcttaattaccacgacaaacgcgcgcgcgaaaccttaaaaacctcgaaaccgacccccgacgaacgcaacgacgcccaatataaaaaaataaaaactaatccgtaccgcgacgaccgcgcaaaaaactctcgaaacaacgccgaaacgcccgaaatctaaaaaacgcaaataaaacgcgaaaaaattcacccctacgcgatcccttaaataaacgaaataaacgccccaaaccccgcgaactcgactaaaaaactaaacgaacgacgatcacgaaacaaaaataaaaaaaataaaaacctcatccgaatctcaaaaataaaattttcgaaaaaaaaaacgatttcgaaaaaaaataatttaaaaaattattctcaatcccttctct

SEQ ID NO: 33825 - DNA, 989 bp, Artificial Sequence
  chemically treated genomic DNA (Homo sapiens) CpG-island No: 33825
tcgcggcgtagtcgttttttttattttataggatgaatttaaaggcgcgtagaggcgtttttttacggcgcgtgatattagagaagggggataaattggcgagttggtatttttttcgtttttattgacggattcgcgagcggagtgagcggtgatttagttcgtttcggttcggtttcgttttttcgtttttcgtttcggcgttttcgtttcggttttggtttttttatttttttcgtttcggttttggtttttagtttttcgttgtttttttcggttttttgattttcgaattttagtttttcgttttttcgttcgggttttacgttttcggttcgttttttagttttttgttcggttttgtattttcgtttttttagtttcggaacgtattagggttgtacgcgtagggagtagttttcgggacgggtttgcgggtttcgcgtcgttcggttattttattttcgtttttgtttaggattttgtagtataggttttgtagtagaacgttcggcgatttttggttcggggtcgttattttcgttcggagtcgtgtacggtggttcgggtagagtcgttattgtcgtcgtacgcgtagggatcgcggttcgcgttttttttgcgtttcgtaagttttttgtttttgataggttaaggcgcgggcgtcgtcggttattagggcgttattttaacggaattcgtcgaaagcgcgggcgttttttataatgtttcgttttttttttgcgtcgcggtcgcgcgtgcggttgtttaagcgttttcggttttgtttggtgtattttttttgttgttgttcggtcggtcgagaaagtttcgggcgataggtggttcgaggttttcgagttgcgcggatagagcggtttcggagtcgcgagcgtgacgggtttgtttggagggtatttggtggtcggtagtattataaaggttataatttggtgtgtgggtgtgggggtgtgtgtgttaacggtatt

SEQ ID NO: 33826 - DNA, 989 bp, Artificial Sequence
  chemically treated genomic DNA (Homo sapiens) CpG-island No: 33826
aataccgttaacacacacacccccacacccacacaccaaattataacctttataatactaccgaccaccaaataccctccaaacaaacccgtcacgctcgcgactccgaaaccgctctatccgcgcaactcgaaaacctcgaaccacctatcgcccgaaactttctcgaccgaccgaacaacaacaaaaaaaatacaccaaacaaaaccgaaaacgcttaaacaaccgcacgcgcgaccgcgacgcaaaaaaaaaacgaaacattataaaaaacgcccgcgctttcgacgaattccgttaaaataacgccctaataaccgacgacgcccgcgccttaacctatcaaaaacaaaaaacttacgaaacgcaaaaaaaacgcgaaccgcgatccctacgcgtacgacgacaataacgactctacccgaaccaccgtacacgactccgaacgaaaataacgaccccgaaccaaaaatcgccgaacgttctactacaaaacctatactacaaaatcctaaacaaaaacgaaaataaaataaccgaacgacgcgaaacccgcaaacccgtcccgaaaactactccctacgcgtacaaccctaatacgttccgaaactaaaaaaacgaaaatacaaaaccgaacaaaaaactaaaaaacgaaccgaaaacgtaaaacccgaacgaaaaaacgaaaaactaaaattcgaaaatcaaaaaaccgaaaaaaacaacgaaaaactaaaaaccaaaaccgaaacgaaaaaaataaaaaaaccaaaaccgaaacgaaaacgccgaaacgaaaaacgaaaaaacgaaaccgaaccgaaacgaactaaatcaccgctcactccgctcgcgaatccgtcaataaaaacgaaaaaaataccaactcgccaatttatcccccttctctaatatcacgcgccgtaaaaaaacgcctctacgcgcctttaaattcatcctataaaataaaaaaaacgactacgccgcga

SEQ ID NO: 33827 - DNA, 989 bp, Artificial Sequence
  chemically treated genomic DNA (Homo sapiens) CpG-island No: 33827
aatgtcgttaatatatatatttttatatttatatattaaattatggtttttatggtgttatcggttattaagtgttttttaagtaagttcgttacgttcgcgatttcggggtcgttttgttcgcgtagttcgagggtttcgggttatttgtcgttcggaattttttcggtcgatcgggtagtagtagggggaatgtattagatagggtcgggaacgtttaggtagtcgtacgcgcggtcgcggcgtagggaagaagcggggtattgtgggaagcgttcgcgttttcggcgggtttcgttaaaatggcgttttggtggtcggcggcgttcgcgttttagtttgttaggagtagggagtttgcggggcgtaggaagggcgcgggtcgcggtttttgcgcgtgcggcggtagtggcggttttgttcggattatcgtgtacggtttcgggcgaggatggcgatttcggattagaagtcgtcgaacgttttgttgtagaatttgtgttgtaggattttgggtaggagcgaaggtagagtggtcgggcgacgcgaagttcgtagattcgtttcgggggttgttttttgcgcgtgtagttttaatacgtttcggggttggaggaacgaggatgtagggtcgggtagagggttgggggacgggtcgaggacgtggggttcggacgagggagcggagggttggggttcgagggttagggagtcggggaggatagcggagggttgggggttaggatcggggcggagggagtggagaggttaaggtcggggcgagaacgtcggggcgggaggcgggagggcggagtcgagtcggagcgggttgagttatcgtttatttcgttcgcgggttcgttagtgaggacgggaggaatgttagttcgttaatttattttttttttttggtgttacgcgtcgtgggagggcgtttttgcgcgtttttgggtttattttgtggggtggagagagcggttgcgtcgcgg

SEQ ID NO: 33828 - DNA, 989 bp, Artificial Sequence
  chemically treated genomic DNA (Homo sapiens) CpG-island No: 33828
ccgcgacgcaaccgctctctccaccccacaaaataaacccaaaaacgcgcaaaaacgccctcccacgacgcgtaacaccaaaaaaaaaaaataaattaacgaactaacattcctcccgtcctcactaacgaacccgcgaacgaaataaacgataactcaacccgctccgactcgactccgccctcccgcctcccgccccgacgttctcgccccgaccttaacctctccactccctccgccccgatcctaacccccaaccctccgctatcctccccgactccctaaccctcgaaccccaaccctccgctccctcgtccgaaccccacgtcctcgacccgtcccccaaccctctacccgaccctacatcctcgttcctccaaccccgaaacgtattaaaactacacgcgcaaaaaacaacccccgaaacgaatctacgaacttcgcgtcgcccgaccactctaccttcgctcctacccaaaatcctacaacacaaattctacaacaaaacgttcgacgacttctaatccgaaatcgccatcctcgcccgaaaccgtacacgataatccgaacaaaaccgccactaccgccgcacgcgcaaaaaccgcgacccgcgcccttcctacgccccgcaaactccctactcctaacaaactaaaacgcgaacgccgccgaccaccaaaacgccattttaacgaaacccgccgaaaacgcgaacgcttcccacaataccccgcttcttccctacgccgcgaccgcgcgtacgactacctaaacgttcccgaccctatctaatacattccccctactactacccgatcgaccgaaaaaattccgaacgacaaataacccgaaaccctcgaactacgcgaacaaaacgaccccgaaatcgcgaacgtaacgaacttacttaaaaaacacttaataaccgataacaccataaaaaccataatttaatatataaatataaaaatatatatattaacgacatt

SEQ ID NO: 33829 - DNA, 633 bp, Artificial Sequence
  chemically treated genomic DNA (Homo sapiens) CpG-island No: 33829
aaataaggcgaggttgtttttttgttatatcgtcggttgtcgaatttattcgcgagttcggtttattggggaggtaacgcggttaggttataggggacgatttttagtttaaaaatttcgttaaaggttttcgcgcgtttcggagcgcgtgaatttatcggtagcgttaggttcgaagtggtttacggatcgagcggcgcgtttgggcgtagagcgggttttttagaggattttggttagggatttgtttcgcggtttttttttttcgtagttttattttgtttcgagcggcggttgttcgttcgtttcgataaaggtaggcgtagtagcgggtttgcgttttaatatcgtagagtcgttggagtggcgtaagacgttttttttttcgttaggtgcggacggagttttatacggaggttttatttttttttaagatacgaagaacgtgtagagttgcgaggtgtgtgttggtatcgttcgttttttgcgttataacggcgggcggttgtagtttttttttcgtttggtttcggcgcgtcgatagtttttttgtttttttattggcggtaatattgcgggttcggttgttgagtttaagtttggtgaaaaagttcgcggttagggttttttttg

SEQ ID NO: 33830 - DNA, 633 bp, Artificial Sequence
  chemically treated genomic DNA (Homo sapiens) CpG-island No: 33830
caaaaaaaaccctaaccgcgaactttttcaccaaacttaaactcaacaaccgaacccgcaatattaccgccaataaaaaaacaaaaaaactatcgacgcgccgaaaccaaacgaaaaaaaaactacaaccgcccgccgttataacgcaaaaaacgaacgataccaacacacacctcgcaactctacacgttcttcgtatcttaaaaaaaaataaaacctccgtataaaactccgtccgcacctaacgaaaaaaaaaacgtcttacgccactccaacgactctacgatattaaaacgcaaacccgctactacgcctacctttatcgaaacgaacgaacaaccgccgctcgaaacaaaataaaactacgaaaaaaaaaaaccgcgaaacaaatccctaaccaaaatcctctaaaaaacccgctctacgcccaaacgcgccgctcgatccgtaaaccacttcgaacctaacgctaccgataaattcacgcgctccgaaacgcgcgaaaacctttaacgaaatttttaaactaaaaatcgtcccctataacctaaccgcgttacctccccaataaaccgaactcgcgaataaattcgacaaccgacgatataacaaaaaaacaacctcgccttattt

SEQ ID NO: 33831 - DNA, 633 bp, Artificial Sequence
  chemically treated genomic DNA (Homo sapiens) CpG-island No: 33831
tagggaaagttttggtcgcgagtttttttattaggtttgagtttagtagtcgggttcgtagtgttgtcgttagtggggaggtagggaggttgtcggcgcgtcggagttaggcgggaaagggattatagtcgttcgtcgttgtagcgtaggaagcgggcggtgttaatatatatttcgtagttttgtacgtttttcgtgttttggaggagagtagagttttcgtgtgaagtttcgttcgtatttgacgaagaggagggcgttttgcgttattttagcgattttgcgatgttaagacgtagattcgttgttgcgtttgtttttgtcggggcgggcgggtagtcgtcgttcggagtaaggtggggttgcggggagggagagtcgcggggtagatttttggttaaggttttttagaaagttcgttttgcgtttaaacgcgtcgttcggttcgtgggttatttcggatttgacgttgtcggtgaatttacgcgtttcgggacgcgcggggatttttgacgaggtttttgaattggggatcgttttttgtaatttggtcgcgttatttttttagtgagtcggattcgcgggtgggttcggtagtcggcgatgtggtaaaaaggtaatttcgttttattt

SEQ ID NO: 33832 - DNA, 633 bp, Artificial Sequence
  chemically treated genomic DNA (Homo sapiens) CpG-island No: 33832
aaataaaacgaaattacctttttaccacatcgccgactaccgaacccacccgcgaatccgactcactaaaaaaataacgcgaccaaattacaaaaaacgatccccaattcaaaaacctcgtcaaaaatccccgcgcgtcccgaaacgcgtaaattcaccgacaacgtcaaatccgaaataacccacgaaccgaacgacgcgtttaaacgcaaaacgaactttctaaaaaaccttaaccaaaaatctaccccgcgactctccctccccgcaaccccaccttactccgaacgacgactacccgcccgccccgacaaaaacaaacgcaacaacgaatctacgtcttaacatcgcaaaatcgctaaaataacgcaaaacgccctcctcttcgtcaaatacgaacgaaacttcacacgaaaactctactctcctccaaaacacgaaaaacgtacaaaactacgaaatatatattaacaccgcccgcttcctacgctacaacgacgaacgactataatccctttcccgcctaactccgacgcgccgacaacctccctacctccccactaacgacaacactacgaacccgactactaaactcaaacctaataaaaaaactcgcgaccaaaactttcccta

SEQ ID NO: 33833 - DNA, 555 bp, Artificial Sequence
  chemically treated genomic DNA (Homo sapiens) CpG-island No: 33833
tttggattgcgggcggggtggtaaggttgagtgcgggcgaggcgttcgtttcgcgatggcgtcgttttttttattgcgttttcgtttttttgagtgtttggtaggtatcggcgtcggtcggggcggcgttgaatcgggcgttcgggttggaggttagttttttcgggtagtcgtaggtttagttttgtcgcggtcgttcggtttgcgttattcgttttcgttcgggatttgtgaagttgttttgacgtggtagtagtttcgtggcggtcggttattatttagtcgtcgttcgttcggtgaagtcggtttgggaaggtgtaggagcgagcggcgttttcgttttttcgtttcggttttgttcgttgtaggcgaggttcgggattttcgggttttcgagagttcggagggggcgtcgggtttcggttgtaaagttgttcgtagtcggttgttcgcgcgcggtttcgtagggtttgggaaaggttttgtttttagatttagttgttgttgcgaggggcgggggttaagtgaggagggggaaagttagtgataaggaaa

SEQ ID NO: 33834 - DNA, 555 bp, Artificial Sequence
  chemically treated genomic DNA (Homo sapiens) CpG-island No: 33834
tttccttatcactaactttccccctcctcacttaacccccgcccctcgcaacaacaactaaatctaaaaacaaaacctttcccaaaccctacgaaaccgcgcgcgaacaaccgactacgaacaactttacaaccgaaacccgacgccccctccgaactctcgaaaacccgaaaatcccgaacctcgcctacaacgaacaaaaccgaaacgaaaaaacgaaaacgccgctcgctcctacaccttcccaaaccgacttcaccgaacgaacgacgactaaataataaccgaccgccacgaaactactaccacgtcaaaacaacttcacaaatcccgaacgaaaacgaataacgcaaaccgaacgaccgcgacaaaactaaacctacgactacccgaaaaaactaacctccaacccgaacgcccgattcaacgccgccccgaccgacgccgatacctaccaaacactcaaaaaaacgaaaacgcaataaaaaaaacgacgccatcgcgaaacgaacgcctcgcccgcactcaaccttaccaccccgcccgcaatccaaa

SEQ ID NO: 33835 - DNA, 555 bp, Artificial Sequence
  chemically treated genomic DNA (Homo sapiens) CpG-island No: 33835
tttttttgttattggttttttttttttttatttaattttcgtttttcgtaatagtaattgaatttaaaaataaagttttttttagattttgcgggatcgcgcgcgggtagtcggttgcggatagttttgtagtcggagttcggcgtttttttcgagttttcgagggttcgggggtttcggatttcgtttatagcgggtagggtcgggacgagaggacgaggacgtcgttcgtttttgtatttttttaagtcggttttatcgggcgggcggcggttgggtagtgatcgatcgttacgaagttattgttacgttagggtaattttataaatttcggacgagggcgggtgacgtaagtcgggcggtcgcggtagggttgggtttgcgattattcgaggaggttgatttttagttcgggcgttcggtttagcgtcgtttcggtcggcgtcggtgtttgttaggtatttagggaggcgggggcgtagtggaggaggcggcgttatcgcgaagcgagcgtttcgttcgtatttagttttgttatttcgttcgtagtttagg

SEQ ID NO: 33836 - DNA, 555 bp, Artificial Sequence
  chemically treated genomic DNA (Homo sapiens) CpG-island No: 33836
cctaaactacgaacgaaataacaaaactaaatacgaacgaaacgctcgcttcgcgataacgccgcctcctccactacgcccccgcctccctaaatacctaacaaacaccgacgccgaccgaaacgacgctaaaccgaacgcccgaactaaaaatcaacctcctcgaataatcgcaaacccaaccctaccgcgaccgcccgacttacgtcacccgccctcgtccgaaatttataaaattaccctaacgtaacaataacttcgtaacgatcgatcactacccaaccgccgcccgcccgataaaaccgacttaaaaaaatacaaaaacgaacgacgtcctcgtcctctcgtcccgaccctacccgctataaacgaaatccgaaacccccgaaccctcgaaaactcgaaaaaaacgccgaactccgactacaaaactatccgcaaccgactacccgcgcgcgatcccgcaaaatctaaaaaaaactttatttttaaattcaattactattacgaaaaacgaaaattaaataaaaaaaaaaaaaaccaataacaaaaaaa

SEQ ID NO: 33837 - DNA, 618 bp, Artificial Sequence
  chemically treated genomic DNA (Homo sapiens) CpG-island No: 33837
gaggcgcgatttttttttttatttttaggagggtaaaaaagcgggaataatggtttttaggacggagggatataaatatttaatgtcgtagcgattgggagggtcgcgatgtaggaggacgaaatgggagaagggggataagggggatttcggtttttttgcgggcgggagttaggtcgttggaaagttcgttcgtttttcgtcggtaagggatgacgttttgggttttttgtattattcgttacggaaaatggttatacgtttttgtttttaagtcgaatattattagaaatacggggtttttggaagtcgttattttggttattggcggtggcgtatttattttcgtgttattgcgcgtgcgcggcgttgcgatatatttcgattttatttcgcgtttttagggggcggtgggaagcggaagtgtttcgttgattcgggagggcggtttttagtttatattggttgttgttagcggtttttgaggttttaggtttttggcggtgaagtaagagggacgcggaggtggtgatggttttgatgggggcgggggttgacggggtcgtggggttatggggttatgggtgaacgtttttgtgggtgatagggtggttttat

SEQ ID NO: 33838 - DNA, 618 bp, Artificial Sequence
  chemically treated genomic DNA (Homo sapiens) CpG-island No: 33838
ataaaaccaccctatcacccacaaaaacgttcacccataaccccataaccccacgaccccgtcaacccccgcccccatcaaaaccatcaccacctccgcgtccctcttacttcaccgccaaaaacctaaaacctcaaaaaccgctaacaacaaccaatataaactaaaaaccgccctcccgaatcaacgaaacacttccgcttcccaccgccccctaaaaacgcgaaataaaatcgaaatatatcgcaacgccgcgcacgcgcaataacacgaaaataaatacgccaccgccaataaccaaaataacgacttccaaaaaccccgtatttctaataatattcgacttaaaaacaaaaacgtataaccattttccgtaacgaataatacaaaaaacccaaaacgtcatcccttaccgacgaaaaacgaacgaactttccaacgacctaactcccgcccgcaaaaaaaccgaaatcccccttatcccccttctcccatttcgtcctcctacatcgcgaccctcccaatcgctacgacattaaatatttatatccctccgtcctaaaaaccattattcccgcttttttaccctcctaaaaataaaaaaaaaaatcgcgcctc

SEQ ID NO: 33839 - DNA, 618 bp, Artificial Sequence
  chemically treated genomic DNA (Homo sapiens) CpG-island No: 33839
gtagagttattttgttatttataaaggcgtttatttatggttttatgattttacgatttcgttaattttcgtttttattaaaattattattattttcgcgttttttttattttatcgttaagagtttgaaattttagaggtcgttgataatagttagtgtgaattagggatcgttttttcgggttagcggagtattttcgttttttatcgttttttgggaacgcgggatggggtcggagtgtgtcgtagcgtcgcgtacgcgtagtagtacgggggtgggtgcgttatcgttaatggttaagatggcggtttttagggatttcgtgtttttgatagtgttcggtttgaggataaaagcgtgtgattatttttcgtggcgagtggtataaaaggtttagggcgttattttttgtcggcgagaggcgagcggattttttagcggtttagttttcgttcgtagggaggtcgaagttttttttgtttttttttttttatttcgtttttttgtatcgcgatttttttagtcgttgcggtattgggtgtttgtgttttttcgttttgaaagttattgttttcgtttttttatttttttgggaataggaaaaagagtcgcgtttt

SEQ ID NO: 33840 - DNA, 618 bp, Artificial Sequence
  chemically treated genomic DNA (Homo sapiens) CpG-island No: 33840
aaaacgcgactctttttcctattcccaaaaaaataaaaaaacgaaaacaataactttcaaaacgaaaaaacacaaacacccaataccgcaacgactaaaaaaatcgcgatacaaaaaaacgaaataaaaaaaaaaaaacaaaaaaaacttcgacctccctacgaacgaaaactaaaccgctaaaaaatccgctcgcctctcgccgacaaaaaataacgccctaaaccttttataccactcgccacgaaaaataatcacacgcttttatcctcaaaccgaacactatcaaaaacacgaaatccctaaaaaccgccatcttaaccattaacgataacgcacccacccccgtactactacgcgtacgcgacgctacgacacactccgaccccatcccgcgttcccaaaaaacgataaaaaacgaaaatactccgctaacccgaaaaaacgatccctaattcacactaactattatcaacgacctctaaaatttcaaactcttaacgataaaataaaaaaaacgcgaaaataataataattttaataaaaacgaaaattaacgaaatcgtaaaatcataaaaccataaataaacgcctttataaataacaaaataactctac

SEQ ID NO: 33841 - DNA, 663 bp, Artificial Sequence
  chemically treated genomic DNA (Homo sapiens) CpG-island No: 33841
ttttcgaataattggacggtttaagttttgagcgtttggttattcgggtaatcgtatggtttttcgatatatatttcgcgtttgcgtattgtttttgtagcgggggtggggggattcggttcggagattttatttcggggtttaaattcgagtttaaaagattgggtttcgttgtgtcgttttcgggtcgcgcgacgttgtgggtcgttttttttttttcggagtgatttaatataggataacgaaatttgtattgtttcgagcgtttttttttcggttcgtcgcgtttgcgaggcgaggtcgggaggcgagggttttgcgtacgcgcggcgtaggcgtattgggcgtcggtgttgttgtttttaggtgattacggattcgttatcgtgagttttaggtgggcgcgcggggtttacgtagggtaggaggttagtttcggggggatcgggttcgggattttgcggaatttggaggtcgaagttcgcgcgtacgtagggtttttgttgtttttttaacgtttgttgcgtggtcgtaggattcgtcgttttttcggttgggtcgtttagtttcgggtcgggcgcgtgtatttagagttttcgcgtttttagttcggtttttttgttggattgtagcgtcggttgggtattaggagtataaagcgaa

SEQ ID NO: 33842 - DNA, 663 bp, Artificial Sequence
  chemically treated genomic DNA (Homo sapiens) CpG-island No: 33842
ttcgctttatactcctaatacccaaccgacgctacaatccaacaaaaaaaccgaactaaaaacgcgaaaactctaaatacacgcgcccgacccgaaactaaacgacccaaccgaaaaaacgacgaatcctacgaccacgcaacaaacgttaaaaaaacaacaaaaaccctacgtacgcgcgaacttcgacctccaaattccgcaaaatcccgaacccgatccccccgaaactaacctcctaccctacgtaaaccccgcgcgcccacctaaaactcacgataacgaatccgtaatcacctaaaaacaacaacaccgacgcccaatacgcctacgccgcgcgtacgcaaaaccctcgcctcccgacctcgcctcgcaaacgcgacgaaccgaaaaaaaaacgctcgaaacaatacaaatttcgttatcctatattaaatcactccgaaaaaaaaaaaacgacccacaacgtcgcgcgacccgaaaacgacacaacgaaacccaatcttttaaactcgaatttaaaccccgaaataaaatctccgaaccgaatccccccacccccgctacaaaaacaatacgcaaacgcgaaatatatatcgaaaaaccatacgattacccgaataaccaaacgctcaaaacttaaaccgtccaattattcgaaaa

SEQ ID NO: 33843 - DNA, 663 bp, Artificial Sequence
  chemically treated genomic DNA (Homo sapiens) CpG-island No: 33843
ttcgttttgtatttttggtgtttagtcggcgttgtaatttagtagaggagtcggattagaaacgcggaagttttgggtgtacgcgttcggttcgggattgggcggtttaatcgggagggcggcgggttttgcggttacgtaataggcgttggggaagtagtagagattttgcgtgcgcgcgggtttcggtttttagatttcgtagagtttcgggttcgattttttcggggttggttttttgttttacgtgggtttcgcgcgtttatttggaatttacgatggcgaattcgtggttatttgaaggtaatagtatcggcgtttagtgcgtttgcgtcgcgcgtgcgtagagttttcgtttttcggtttcgtttcgtagacgcgacgggtcggggaggaagcgttcggagtagtgtaggtttcgttattttgtgttaggttatttcggagaggggaaagcggtttatagcgtcgcgcgattcggaaacgatataacgaggtttaattttttagattcgagtttaggtttcggggtggagttttcggatcgggtttttttattttcgttataggggtagtgcgtaggcgcgaggtatgtatcgagagattatgcggttgttcgggtaattagacgtttaggatttggatcgtttagttgttcggagg

SEQ ID NO: 33844 - DNA, 663 bp, Artificial Sequence
  chemically treated genomic DNA (Homo sapiens) CpG-island No: 33844
cctccgaacaactaaacgatccaaatcctaaacgtctaattacccgaacaaccgcataatctctcgatacatacctcgcgcctacgcactacccctataacgaaaataaaaaaacccgatccgaaaactccaccccgaaacctaaactcgaatctaaaaaattaaacctcgttatatcgtttccgaatcgcgcgacgctataaaccgctttcccctctccgaaataacctaacacaaaataacgaaacctacactactccgaacgcttcctccccgacccgtcgcgtctacgaaacgaaaccgaaaaacgaaaactctacgcacgcgcgacgcaaacgcactaaacgccgatactattaccttcaaataaccacgaattcgccatcgtaaattccaaataaacgcgcgaaacccacgtaaaacaaaaaaccaaccccgaaaaaatcgaacccgaaactctacgaaatctaaaaaccgaaacccgcgcgcacgcaaaatctctactacttccccaacgcctattacgtaaccgcaaaacccgccgccctcccgattaaaccgcccaatcccgaaccgaacgcgtacacccaaaacttccgcgtttctaatccgactcctctactaaattacaacgccgactaaacaccaaaaatacaaaacgaa

SEQ ID NO: 33845 - DNA, 673 bp, Artificial Sequence
  chemically treated genomic DNA (Homo sapiens) CpG-island No: 33845
tttacgcgcggggtggggtgggtcgtttatttttttcgcgtttttaatttatagggaaacgggttgcgcgttcgggtcgtttcgtagagtttagatgtttaaattttttttagtttgtttttttatttgcggtttgtacgttcgtcgtagttatatttaacgtcgggacgcgtaaaaatatttgtcgggtttattttttttcgggtattatttatagtcgtttttaggttttttcggaaaatattttttgtcggaaatataattttaggtttttagagcgtagggggtttagcgtcggatttacgcggagtttacgagtcggatagtcgtcgtagagtaggttggggtcgcgcggcgtacgtcgggagggcgcgcgatagtacgtgaacgcggcgtgtcgtacggttcgggaagggcggggtgcgcgttgatcggttcgtgcgtcgtaggtagtagttaattcgcgcggattatttttaggtttcgttttcgtcggtttcgttacgttttcgtcgggttcgtagttgttttcggggttcgggatttagttggtttaggcgttcgaggtgtatttgggaggaagtaggcgcggggtgtaatggagggtggaggcgcgtatcgtgtttagagcggggttttcgggagttgatgtttcgtttggtttttttatttt

SEQ ID NO: 33846 - DNA, 673 bp, Artificial Sequence
  chemically treated genomic DNA (Homo sapiens) CpG-island No: 33846
aaaataaaaaaaccaaacgaaacatcaactcccgaaaaccccgctctaaacacgatacgcgcctccaccctccattacaccccgcgcctacttcctcccaaatacacctcgaacgcctaaaccaactaaatcccgaaccccgaaaacaactacgaacccgacgaaaacgtaacgaaaccgacgaaaacgaaacctaaaaataatccgcgcgaattaactactacctacgacgcacgaaccgatcaacgcgcaccccgcccttcccgaaccgtacgacacgccgcgttcacgtactatcgcgcgccctcccgacgtacgccgcgcgaccccaacctactctacgacgactatccgactcgtaaactccgcgtaaatccgacgctaaaccccctacgctctaaaaacctaaaattatatttccgacaaaaaatattttccgaaaaaacctaaaaacgactataaataatacccgaaaaaaaataaacccgacaaatatttttacgcgtcccgacgttaaatataactacgacgaacgtacaaaccgcaaataaaaaaacaaactaaaaaaaatttaaacatctaaactctacgaaacgacccgaacgcgcaacccgtttccctataaattaaaaacgcgaaaaaaataaacgacccaccccaccccgcgcgtaaa

SEQ ID NO: 33847 - DNA, 673 bp, Artificial Sequence
  chemically treated genomic DNA (Homo sapiens) CpG-island No: 33847
gaggtaggggggttagacgggatattagttttcgggagtttcgttttgggtacggtgcgcgtttttattttttattgtatttcgcgtttgtttttttttaggtgtatttcgggcgtttaagttagttgggtttcgggtttcgggagtagttgcgggttcgacgggggcgtggcgggatcggcgggggcggggtttgggggtggttcgcgcggattggttgttgtttgcggcgtacgagtcggttagcgcgtatttcgtttttttcgggtcgtgcggtacgtcgcgtttacgtgttgtcgcgcgttttttcggcgtgcgtcgcgcggttttagtttgttttgcggcgattgttcggttcgtgagtttcgcgtggattcggcgttgggttttttacgttttggggatttggggttgtgttttcggtaaaggatgtttttcgagaaggtttgggagcggttgtaaataatattcgagaggaaataggttcggtaggtgtttttgcgcgtttcggcgttgggtgtggttgcggcgggcgtgtaggtcgtagatgaggaaatagattaggagggatttaggtatttggattttgcggggcggttcgggcgcgtagttcgtttttttgtgggttgagggcgcgggagaagtgggcggtttattttatttcgcgcgtgga

SEQ ID NO: 33848 - DNA, 673 bp, Artificial Sequence
  chemically treated genomic DNA (Homo sapiens) CpG-island No: 33848
tccacgcgcgaaataaaataaaccgcccacttctcccgcgccctcaacccacaaaaaaacgaactacgcgcccgaaccgccccgcaaaatccaaatacctaaatccctcctaatctatttcctcatctacgacctacacgcccgccgcaaccacacccaacgccgaaacgcgcaaaaacacctaccgaacctatttcctctcgaatattatttacaaccgctcccaaaccttctcgaaaaacatcctttaccgaaaacacaaccccaaatccccaaaacgtaaaaaacccaacgccgaatccacgcgaaactcacgaaccgaacaatcgccgcaaaacaaactaaaaccgcgcgacgcacgccgaaaaaacgcgcgacaacacgtaaacgcgacgtaccgcacgacccgaaaaaaacgaaatacgcgctaaccgactcgtacgccgcaaacaacaaccaatccgcgcgaaccacccccaaaccccgcccccgccgatcccgccacgcccccgtcgaacccgcaactactcccgaaacccgaaacccaactaacttaaacgcccgaaatacacctaaaaaaaaacaaacgcgaaatacaataaaaaataaaaacgcgcaccgtacccaaaacgaaactcccgaaaactaatatcccgtctaacccccctacctc

SEQ ID NO: 33849 - DNA, 632 bp, Artificial Sequence
  chemically treated genomic DNA (Homo sapiens) CpG-island No: 33849
tatcgggtcgtagtcgcgtggagagattagcgttcgtcgcggggattgagattttcggaggtttcggttgcgttggttcggttttcgtttttcgcgacgggtttaaagtcgcgggtttgcgtttagcgtttttcgggaaggcgcgttcgttttaggtttcgttaggttatttattcggggtcgtcggggcgttatttattcggttcgttcggtcgattttgtttatgagtcgcgtcggcggtagagcggagtcgggcggtatttcgcggaaattcgttagcggtaggaggtttcggcggcgtttatttttcgttgagtttttagggcgttcggcggcgcggggttagggagcgcgggttgtcgggagagcgcgttcgcgtttgcgtttcgtttgcgtttgcgtttgtttcggtttttgcgtttgcgtcgagggcgttttgtcgtattgttttttgttcgcgggaggatcgtattgtacgttttttttcgtcggcgtttttttattattaagaggtgtcgttttggcgtatattttcgaaattttataaggtttggggagcgcggtagcgtttttagatggtgaggaggagaagtggttcgaggtcgggttttttgataggggaggtggggga

SEQ ID NO: 33850 - DNA, 632 bp, Artificial Sequence
  chemically treated genomic DNA (Homo sapiens) CpG-island No: 33850
tcccccacctcccctatcaaaaaacccgacctcgaaccacttctcctcctcaccatctaaaaacgctaccgcgctccccaaaccttataaaatttcgaaaatatacgccaaaacgacacctcttaataataaaaaaacgccgacgaaaaaaaacgtacaatacgatcctcccgcgaacaaaaaacaatacgacaaaacgccctcgacgcaaacgcaaaaaccgaaacaaacgcaaacgcaaacgaaacgcaaacgcgaacgcgctctcccgacaacccgcgctccctaaccccgcgccgccgaacgccctaaaaactcaacgaaaaataaacgccgccgaaacctcctaccgctaacgaatttccgcgaaataccgcccgactccgctctaccgccgacgcgactcataaacaaaatcgaccgaacgaaccgaataaataacgccccgacgaccccgaataaataacctaacgaaacctaaaacgaacgcgccttcccgaaaaacgctaaacgcaaacccgcgactttaaacccgtcgcgaaaaacgaaaaccgaaccaacgcaaccgaaacctccgaaaatctcaatccccgcgacgaacgctaatctctccacgcgactacgacccgata

SEQ ID NO: 33851 - DNA, 632 bp, Artificial Sequence
  chemically treated genomic DNA (Homo sapiens) CpG-island No: 33851
ttttttattttttttattagaaagttcggtttcggattattttttttttttattatttgggggcgttgtcgcgttttttaagttttgtggaatttcgaaaatgtgcgttagggcgatattttttgatggtaagaagacgtcggcggaggggagcgtgtagtgcggttttttcgcgggtagggggtagtgcggtaaggcgttttcggcgtaggcgtagaggtcgaagtaggcgtaggcgtaggcggggcgtaggcgcgggcgcgttttttcggtagttcgcgttttttgatttcgcgtcgtcgagcgttttgaggatttagcgaagggtgggcgtcgtcgaggttttttgtcgttggcgggttttcgcggagtgtcgttcggtttcgttttgtcgtcggcgcggtttatgggtagagtcggtcgggcgggtcgggtaagtggcgtttcggcggtttcgggtgggtggtttggcgggatttgaggcgggcgcgttttttcgggaggcgttagacgtaagttcgcggttttaggttcgtcgcgaggggcggaggtcgggttagcgtagtcggagttttcgagggttttagttttcgcggcgggcgttggtttttttacgcggttgcggttcggta

SEQ ID NO: 33852 - DNA, 632 bp, Artificial Sequence
  chemically treated genomic DNA (Homo sapiens) CpG-island No: 33852
taccgaaccgcaaccgcgtaaaaaaaccaacgcccgccgcgaaaactaaaaccctcgaaaactccgactacgctaacccgacctccgcccctcgcgacgaacctaaaaccgcgaacttacgtctaacgcctcccgaaaaaacgcgcccgcctcaaatcccgccaaaccacccacccgaaaccgccgaaacgccacttacccgacccgcccgaccgactctacccataaaccgcgccgacgacaaaacgaaaccgaacgacactccgcgaaaacccgccaacgacaaaaaacctcgacgacgcccacccttcgctaaatcctcaaaacgctcgacgacgcgaaatcaaaaaacgcgaactaccgaaaaaacgcgcccgcgcctacgccccgcctacgcctacgcctacttcgacctctacgcctacgccgaaaacgccttaccgcactaccccctacccgcgaaaaaaccgcactacacgctcccctccgccgacgtcttcttaccatcaaaaaatatcgccctaacgcacattttcgaaattccacaaaacttaaaaaacgcgacaacgcccccaaataataaaaaaaaaaaataatccgaaaccgaactttctaataaaaaaaataaaaaa

SEQ ID NO: 33853 - DNA, 699 bp, Artificial Sequence
  chemically treated genomic DNA (Homo sapiens) CpG-island No: 33853
  misc_feature (661)..(661): n is either a, c, g or t
gtttttttttgtttcgtggagtttataagataggcggtagttttaaggtcggtaagtttcgcgtttggggggttgcgggtcgtttttgcgggatcggggggatttgggcgggatagggcggttcggtttacgtttcggttttttttagtagttcgagggcgttcggagtttacggttggcgtcgtttcgcgttttttgtttcgtcgcggattttttttcgcgtcgtgacgcgttaggttttgattaaatatgttttttttttttttttcgttcgtttcgtcgttcgtaggcgtttcgagtcgcggggttgtcgtttggacgtcgttttgtttgggtgtcgcgggtcggtttcgcggggagcgttttcggcgcgatgttttttaggaaaggtaggagtttcggtgacgcggtttacgtttttagcgcgcgcggggatttgagcggtcgtttgtgggtattcgagttttgggttttcgttaggcgcggaagtattgtgtattcgggttgcggcggtgtcgttcggggttaagcgagacgcgtttcgttttgtttttttcgttttgcgttgcgtttcggattcgcgtgtttttttagattcgtattgtttttttcggttttgcgtgtttttttcggtttacgcgtattttttcggtttagcgtnttttttttagtttcgcgtttttttttcggttcgcgttt

SEQ ID NO: 33854 - DNA, 699 bp, Artificial Sequence
  chemically treated genomic DNA (Homo sapiens) CpG-island No: 33854
  misc_feature (39)..(39): n is either a, c, g or t
aaacgcgaaccgaaaaaaaaacgcgaaactaaaaaaaanacgctaaaccgaaaaaatacgcgtaaaccgaaaaaaacacgcaaaaccgaaaaaaacaatacgaatctaaaaaaacacgcgaatccgaaacgcaacgcaaaacgaaaaaaacaaaacgaaacgcgtctcgcttaaccccgaacgacaccgccgcaacccgaatacacaatacttccgcgcctaacgaaaacccaaaactcgaatacccacaaacgaccgctcaaatccccgcgcgcgctaaaaacgtaaaccgcgtcaccgaaactcctacctttcctaaaaaacatcgcgccgaaaacgctccccgcgaaaccgacccgcgacacccaaacaaaacgacgtccaaacgacaaccccgcgactcgaaacgcctacgaacgacgaaacgaacgaaaaaaaaaaaaaaaacatatttaatcaaaacctaacgcgtcacgacgcgaaaaaaaatccgcgacgaaacaaaaaacgcgaaacgacgccaaccgtaaactccgaacgccctcgaactactaaaaaaaaccgaaacgtaaaccgaaccgccctatcccgcccaaatccccccgatcccgcaaaaacgacccgcaaccccccaaacgcgaaacttaccgaccttaaaactaccgcctatcttataaactccacgaaacaaaaaaaaac

SEQ ID NO: 33855 - DNA, 699 bp, Artificial Sequence
  chemically treated genomic DNA (Homo sapiens) CpG-island No: 33855
  misc_feature (39)..(39): n is either a, c, g or t
agacgcgggtcggaaaggagacgcgaggttggaaagganacgttaggtcgaaggggtacgcgtgggtcggaggggatacgtaggatcggaggagatagtgcggatttggagggatacgcgggttcggggcgtagcgtagggcggaggggataaggcggagcgcgtttcgtttggtttcgggcggtatcgtcgtagttcgggtgtatagtgttttcgcgtttggcgaggatttaaggttcgggtatttataggcggtcgtttaggttttcgcgcgcgttgggggcgtgggtcgcgttatcgggatttttattttttttgaagggtatcgcgtcgggggcgtttttcgcggggtcggttcgcgatatttagataggacgacgtttaagcggtagtttcgcgattcggggcgtttgcgggcggcggggcgggcgagggaggggaaagggatatatttggttaaagtttggcgcgttacggcgcggaggaggattcgcggcgaggtaggaagcgcggggcggcgttagtcgtgagtttcgggcgttttcgggttgttgggggaagtcggggcgtgggtcgggtcgttttgtttcgtttagattttttcggtttcgtaggggcggttcgtagttttttagacgcggaatttgtcggttttgaagttgtcgtttgttttgtggattttacgggataggggaaaat

SEQ ID NO: 33856 - DNA, 699 bp, Artificial Sequence
  chemically treated genomic DNA (Homo sapiens) CpG-island No: 33856
  misc_feature (661)..(661): n is either a, c, g or t
attttcccctatcccgtaaaatccacaaaacaaacgacaacttcaaaaccgacaaattccgcgtctaaaaaactacgaaccgcccctacgaaaccgaaaaaatctaaacgaaacaaaacgacccgacccacgccccgacttcccccaacaacccgaaaacgcccgaaactcacgactaacgccgccccgcgcttcctacctcgccgcgaatcctcctccgcgccgtaacgcgccaaactttaaccaaatatatccctttcccctccctcgcccgccccgccgcccgcaaacgccccgaatcgcgaaactaccgcttaaacgtcgtcctatctaaatatcgcgaaccgaccccgcgaaaaacgcccccgacgcgatacccttcaaaaaaaataaaaatcccgataacgcgacccacgcccccaacgcgcgcgaaaacctaaacgaccgcctataaatacccgaaccttaaatcctcgccaaacgcgaaaacactatacacccgaactacgacgataccgcccgaaaccaaacgaaacgcgctccgccttatcccctccgccctacgctacgccccgaacccgcgtatccctccaaatccgcactatctcctccgatcctacgtatcccctccgacccacgcgtaccccttcgacctaacgtntcctttccaacctcgcgtctcctttccgacccgcgtct

SEQ ID NO: 33857 - DNA, 572 bp, Artificial Sequence
  chemically treated genomic DNA (Homo sapiens) CpG-island No: 33857
ttcgttttttcgttttttttcgttttttcgttttttttttttcgttttttcgttttttcgttttttttttttcgttttttttcgttttttttttcgttttttttttcgttttttcgttttttcgttttcgttttttttttttcgttttttttttttttttcgttttttcgttttttttttttcgttttttttttttcgttttttttttttcgtttttttttttttttttttttttgttttttttttttcgttttttttttcgttttttttcgttttttcgttttttttttttttttcgttttttcgttttttcgttttttttcgttttttttcgttttttcgttttttttttcgttttcgttttcgttttttcgttttcgttttttttcgttttttttttttcgttttttcgttttttttttttcgttttttttttttcgttttttttttttttttttttttcgttttttttttttcgttttttttttcgttttttttttttcgttttttttttcgttttttttcgtggaggattttggtatgtgttttttgggtagtttggttggttggga

SEQ ID NO: 33858 - DNA, 572 bp, Artificial Sequence
  chemically treated genomic DNA (Homo sapiens) CpG-island No: 33858
tcccaaccaaccaaactacccaaaaaacacataccaaaatcctccacgaaaaaaaacgaaaaaaaaaacgaaaaaaaaaaaacgaaaaaaaaaacgaaaaaaaaaaaacgaaaaaaaaaaaaaaaaaaaaaacgaaaaaaaaaaaacgaaaaaaaaaaaacgaaaaaacgaaaaaaaaaaaacgaaaaaaaacgaaaacgaaaaaacgaaaacgaaaacgaaaaaaaaaacgaaaaaacgaaaaaaaacgaaaaaaaacgaaaaaacgaaaaaacgaaaaaaaaaaaaaaaacgaaaaaacgaaaaaaaacgaaaaaaaaaacgaaaaaaaaaaaacaaaaaaaaaaaaaaaaaaaaaaacgaaaaaaaaaaaacgaaaaaaaaaaaacgaaaaaaaaaaaacgaaaaaacgaaaaaaaaaaaaaaaacgaaaaaaaaaaaacgaaaacgaaaaaacgaaaaaacgaaaaaaaaaacgaaaaaaaaaacgaaaaaaaacgaaaaaaaaaaaacgaaaaaacgaaaaaacgaaaaaaaaaaaacgaaaaaacgaaaaaaaacgaaaaaacgaa

SEQ ID NO: 33859 - DNA, 572 bp, Artificial Sequence
  chemically treated genomic DNA (Homo sapiens) CpG-island No: 33859
ttttaattaattaaattatttagagggtatatgttaaaattttttacgagagagagcgagagagagagcgagagagagagagcgagagagagagcgagagagagagagcgagagagagagagagagagagagcgagagagagagagcgagagagagagagcgagagagcgagagagagagagcgagagagagcgagagcgagagagcgagagcgagagcgagagagagagcgagagagcgagagagagcgagagagagcgagagagcgagagagcgagagagagagagagagcgagagagcgagagagagcgagagagagagcgagagagagagagtaagagagagagagagagagagagcgagagagagagagcgagagagagagagcgagagagagagagcgagagagcgagagagagagagagagcgagagagagagagcgagagcgagagagcgagagagcgagagagagagcgagagagagagcgagagagagcgagagagagagagcgagagagcgagagagcgagagagagagagcgagagagcgagagagagcgagagagcgag

SEQ ID NO: 33860 - DNA, 572 bp, Artificial Sequence
  chemically treated genomic DNA (Homo sapiens) CpG-island No: 33860
ctcgctctctcgctctctctcgctctctcgctctctctctctcgctctctcgctctctcgctctctctctctcgctctctctcgctctctctctcgctctctctctcgctctctcgctctctcgctctcgctctctctctctcgctctctctctctctctcgctctctcgctctctctctctcgctctctctctctcgctctctctctctcgctctctctctctctctctctcttactctctctctctcgctctctctctcgctctctctcgctctctcgctctctctctctctctcgctctctcgctctctcgctctctctcgctctctctcgctctctcgctctctctctcgctctcgctctcgctctctcgctctcgctctctctcgctctctctctctcgctctctcgctctctctctctcgctctctctctctcgctctctctctctctctctctctcgctctctctctctcgctctctctctcgctctctctctctcgctctctctctcgctctctctcgtaaaaaattttaacatataccctctaaataatttaattaattaaaa

SEQ ID NO: 33861 - DNA, 513 bp, Artificial Sequence
  chemically treated genomic DNA (Homo sapiens) CpG-island No: 33861
cgcgattttcgtcgatcggttcgtttttgtttcggtttttttgcgcgttttgttttttataattttttgtcgtcgtttttcggtcggttttttttgcggttttttagtcgtcggttttgtttttcggcgcggtttagcgggtttttattttagtcggattttcggttcggttcgcgggcgatttcggttttgatttcgttaggtatcgcgcgtcgttttcgtcgtcgttatcgttatcgttatttttgtcgttttttcgtcgttttttttcggttgttttttttttttttattgatttttgttcgggagtcgatttttgttttttattttttgttcgtttagttatcgtgttcgcgtttcgtgtttttgtttacgggtgtaggtttatttttttgcgtttatcggtattatttcggcgttcgtagttgcggtttattttttttttattttttttttgattttattttttaaatatttgttgcggtttttttcgtggtgttagtttttttaatt

SEQ ID NO: 33862 - DNA, 513 bp, Artificial Sequence
  chemically treated genomic DNA (Homo sapiens) CpG-island No: 33862
aattaaaaaaactaacaccacgaaaaaaaccgcaacaaatatttaaaaaataaaatcaaaaaaaaaataaaaaaaaaataaaccgcaactacgaacgccgaaataataccgataaacgcaaaaaaataaacctacacccgtaaacaaaaacacgaaacgcgaacacgataactaaacgaacaaaaaataaaaaacaaaaatcgactcccgaacaaaaatcaataaaaaaaaaaaaaacaaccgaaaaaaaacgacgaaaaaacgacaaaaataacgataacgataacgacgacgaaaacgacgcgcgatacctaacgaaatcaaaaccgaaatcgcccgcgaaccgaaccgaaaatccgactaaaataaaaacccgctaaaccgcgccgaaaaacaaaaccgacgactaaaaaaccgcaaaaaaaaccgaccgaaaaacgacgacaaaaaattataaaaaacaaaacgcgcaaaaaaaccgaaacaaaaacgaaccgatcgacgaaaatcgcg

SEQ ID NO: 33863 - DNA, 513 bp, Artificial Sequence
  chemically treated genomic DNA (Homo sapiens) CpG-island No: 33863
agttaaaagaattgatattacgaaggaggtcgtaataaatgtttgaaaaataagattagaagagaggtggagagagggtgagtcgtagttgcgggcgtcggggtaatgtcggtggacgtaaagaggtaaatttgtattcgtgggtaggggtacggggcgcgggtacggtggttgggcgggtagggggtaggaaataaaggtcggttttcgagtagaagttaataaaagggggaaaagtagtcgaggaaaagcggcgaaaaggcggtaggggtggcggtggcggtggcggcggcggggacggcgcgcggtgtttggcggggttagggtcggggtcgttcgcgggtcgggtcggggattcggttgagatgggaattcgttaggtcgcgtcgaggggtagggtcggcgattgaggggtcgtagaggggatcggtcgaggagcgacggtaaagggttgtggggggtagggcgcgtagggaggtcgggataggggcgggtcggtcggcgggagtcgcg

SEQ ID NO: 33864 - DNA, 513 bp, Artificial Sequence
  chemically treated genomic DNA (Homo sapiens) CpG-island No: 33864
cgcgactcccgccgaccgacccgcccctatcccgacctccctacgcgccctaccccccacaaccctttaccgtcgctcctcgaccgatcccctctacgacccctcaatcgccgaccctacccctcgacgcgacctaacgaattcccatctcaaccgaatccccgacccgacccgcgaacgaccccgaccctaaccccgccaaacaccgcgcgccgtccccgccgccgccaccgccaccgccacccctaccgccttttcgccgcttttcctcgactacttttcccccttttattaacttctactcgaaaaccgacctttatttcctaccccctacccgcccaaccaccgtacccgcgccccgtacccctacccacgaatacaaatttacctctttacgtccaccgacattaccccgacgcccgcaactacgactcaccctctctccacctctcttctaatcttatttttcaaacatttattacgacctccttcgtaatatcaattcttttaact

SEQ ID NO: 33865 - DNA, 529 bp, Artificial Sequence
  chemically treated genomic DNA (Homo sapiens) CpG-island No: 33865
ttttcgggagggtttcgcgttcgtttggaggagtcggcggtttttcgcgatttttttagaaggagcggatcggcgttcgggtttcgcgggttcggggttttcgagtcgtatttatttagattcgcggataggttgcgtagtcggtcgcgggtacgaaatcgggcgtcgcgtagtagcgtattttcgcgtcgttttcgtcgttttttattatttttttttagtttaggggtcgttgtcggcgttacggtttagttcggagtttttgttgcgagttgtggttttattttcggttttcgttcgggtgtcgtcggtaaatgttttcgtcggtttttatataatttgtttttcgttttcgttttcggagtgggaattttgttcgttttttcgagtatgcgtagaagtcgttgttagtgagttttcgcgacggtggttcggacggaaaagatatttcggcggcgtgggttcggttttttgttttaggatttagggattttggttttttattttttttcgagtattaggatttttt

SEQ ID NO: 33866 - DNA, 529 bp, Artificial Sequence
  chemically treated genomic DNA (Homo sapiens) CpG-island No: 33866
aaaaaatcctaatactcgaaaaaaaataaaaaaccaaaatccctaaatcctaaaacaaaaaaccgaacccacgccgccgaaatatcttttccgtccgaaccaccgtcgcgaaaactcactaacaacgacttctacgcatactcgaaaaaacgaacaaaattcccactccgaaaacgaaaacgaaaaacaaattatataaaaaccgacgaaaacatttaccgacgacacccgaacgaaaaccgaaaataaaaccacaactcgcaacaaaaactccgaactaaaccgtaacgccgacaacgacccctaaactaaaaaaaaataataaaaaacgacgaaaacgacgcgaaaatacgctactacgcgacgcccgatttcgtacccgcgaccgactacgcaacctatccgcgaatctaaataaatacgactcgaaaaccccgaacccgcgaaacccgaacgccgatccgctccttctaaaaaaatcgcgaaaaaccgccgactcctccaaacgaacgcgaaaccctcccgaaaa

SEQ ID NO: 33867 - DNA, 529 bp, Artificial Sequence
  chemically treated genomic DNA (Homo sapiens) CpG-island No: 33867
agggagttttggtgttcggaggagggtggaaggttaagatttttaggttttggagtagggagtcgggtttacgtcgtcgaggtatttttttcgttcgggttatcgtcgcgggggtttattggtagcggtttttgcgtatgttcggaagagcgggtagggtttttatttcgggagcggagacggagaataggttatgtgggagtcggcgggggtatttgtcggcgatattcgagcgggggtcggaagtggggttatagttcgtagtaggagtttcgggttagatcgtggcgtcggtagcggtttttgggttggaggaggatgatgaggagcgacggaagcgacgcgggggtacgttgttgcgcggcgttcggtttcgtgttcgcggtcgattgcgtagtttgttcgcgagtttgagtaagtgcggttcggggatttcgagttcgcggggttcgagcgtcggttcgttttttttaggagggtcgcggggagtcgtcggtttttttaggcgggcgcgaaattttttcgggag

SEQ ID NO: 33868 - DNA, 529 bp, Artificial Sequence
  chemically treated genomic DNA (Homo sapiens) CpG-island No: 33868
ctcccgaaaaaatttcgcgcccgcctaaaaaaaccgacgactccccgcgaccctcctaaaaaaaacgaaccgacgctcgaaccccgcgaactcgaaatccccgaaccgcacttactcaaactcgcgaacaaactacgcaatcgaccgcgaacacgaaaccgaacgccgcgcaacaacgtacccccgcgtcgcttccgtcgctcctcatcatcctcctccaacccaaaaaccgctaccgacgccacgatctaacccgaaactcctactacgaactataaccccacttccgacccccgctcgaatatcgccgacaaatacccccgccgactcccacataacctattctccgtctccgctcccgaaataaaaaccctacccgctcttccgaacatacgcaaaaaccgctaccaataaacccccgcgacgataacccgaacgaaaaaaatacctcgacgacgtaaacccgactccctactccaaaacctaaaaatcttaaccttccaccctcctccgaacaccaaaactccct

SEQ ID NO: 33869 - DNA, 842 bp, Artificial Sequence
  chemically treated genomic DNA (Homo sapiens) CpG-island No: 33869
tggggcggggcggttttttcgttaattgttcggattgggtaagatagaatttgattgggcggggtttggatgggcgttttttgggggcggggtttggcgggaggggcggggcggatttttagttaacggtttcggcgggtgggcgtgttttcgcgggcggcgtttgtagggtcgggagtgggtcgggagcgcgtagttttcgttttcgtttgtttttcggtcgtcgcggttttttttagcgtttttttttcggcgcgggttgttgcgtacgggattgcgttatgcggatttcgttttttcggttcgcgcggggtttgtggacgcggtagggtcggtcgtgatcgggcgtcggcgttaggggcgggcgttaggggcgtttgtcgcgtcgcgatgtgggagaggtaacgcgggtggaggtcgcgcgggcgttgggcgggcgggtggtagtcgtagttcgattgagcgtttttttgttttttataggtgggtttcggtgatcgtgtttttcggttgcgtgggttgtaggatcgtcgcggcgttggcgttttggatcgtgcgcgatgtgaaggaacgtattttcgcggagattggtttttcggtgtcggagtagcggttgtggcgcggcggtcgcgaggtaggcggtggtcgggggcgttgggttgggtttcgttacgcggaggaacggcgggcgtcgagggttcggggtgggcgacgtaggttttcgcgggcggcgcgaatgatttcggtagcgtggtcgtttgtgtttgttttgagttgtggttttttattatttgtttttttcgtttgtattttttatttcgaattttatttattattttatt

SEQ ID NO: 33870 - DNA, 842 bp, Artificial Sequence
  chemically treated genomic DNA (Homo sapiens) CpG-island No: 33870
aataaaataataaataaaattcgaaataaaaaatacaaacgaaaaaaacaaataataaaaaaccacaactcaaaacaaacacaaacgaccacgctaccgaaatcattcgcgccgcccgcgaaaacctacgtcgcccaccccgaaccctcgacgcccgccgttcctccgcgtaacgaaacccaacccaacgcccccgaccaccgcctacctcgcgaccgccgcgccacaaccgctactccgacaccgaaaaaccaatctccgcgaaaatacgttccttcacatcgcgcacgatccaaaacgccaacgccgcgacgatcctacaacccacgcaaccgaaaaacacgatcaccgaaacccacctataaaaaacaaaaaaacgctcaatcgaactacgactaccacccgcccgcccaacgcccgcgcgacctccacccgcgttacctctcccacatcgcgacgcgacaaacgcccctaacgcccgcccctaacgccgacgcccgatcacgaccgaccctaccgcgtccacaaaccccgcgcgaaccgaaaaaacgaaatccgcataacgcaatcccgtacgcaacaacccgcgccgaaaaaaaaacgctaaaaaaaaccgcgacgaccgaaaaacaaacgaaaacgaaaactacgcgctcccgacccactcccgaccctacaaacgccgcccgcgaaaacacgcccacccgccgaaaccgttaactaaaaatccgccccgcccctcccgccaaaccccgcccccaaaaaacgcccatccaaaccccgcccaatcaaattctatcttacccaatccgaacaattaacgaaaaaaccgccccgcccca

SEQ ID NO: 33871 - DNA, 842 bp, Artificial Sequence
  chemically treated genomic DNA (Homo sapiens) CpG-island No: 33871
gatgaaatgatgggtggggttcggggtgggggatgtaaacggaaaaggtaagtgatgaaaagttataatttaggataagtataggcggttacgttgtcggagttattcgcgtcgttcgcggaaatttgcgtcgtttatttcgggttttcgacgttcgtcgttttttcgcgtggcggagtttagtttagcgttttcggttatcgtttatttcgcggtcgtcgcgttatagtcgttgtttcgatatcgggaagttagttttcgcgaagatacgtttttttatatcgcgtacggtttaggacgttagcgtcgcgacggttttgtagtttacgtagtcggggagtacggttatcgggatttatttgtggaaagtagagggacgtttagtcgggttgcggttgttattcgttcgtttagcgttcgcgcggtttttattcgcgttattttttttatatcgcggcgcggtaggcgtttttagcgttcgtttttgacgtcggcgttcgattacggtcggttttatcgcgtttataggtttcgcgcgggtcgggagggcgggattcgtatggcgtagtttcgtacgtagtagttcgcgtcgaggaggaaacgttagaggaagtcgcggcggtcgaggagtaggcgggggcggggattgcgcgttttcggtttattttcggttttgtaggcgtcgttcgcggggatacgtttattcgtcgggatcgttagttggggattcgtttcgtttttttcgttaggtttcgtttttagggaacgtttatttaggtttcgtttagttaagttttgttttgtttaattcggatagttagcgaaggagtcgtttcgtttta

SEQ ID NO: 33872 - DNA, 842 bp, Artificial Sequence
  chemically treated genomic DNA (Homo sapiens) CpG-island No: 33872
taaaacgaaacgactccttcgctaactatccgaattaaacaaaacaaaacttaactaaacgaaacctaaataaacgttccctaaaaacgaaacctaacgaaaaaaacgaaacgaatccccaactaacgatcccgacgaataaacgtatccccgcgaacgacgcctacaaaaccgaaaataaaccgaaaacgcgcaatccccgcccccgcctactcctcgaccgccgcgacttcctctaacgtttcctcctcgacgcgaactactacgtacgaaactacgccatacgaatcccgccctcccgacccgcgcgaaacctataaacgcgataaaaccgaccgtaatcgaacgccgacgtcaaaaacgaacgctaaaaacgcctaccgcgccgcgatataaaaaaaataacgcgaataaaaaccgcgcgaacgctaaacgaacgaataacaaccgcaacccgactaaacgtccctctactttccacaaataaatcccgataaccgtactccccgactacgtaaactacaaaaccgtcgcgacgctaacgtcctaaaccgtacgcgatataaaaaaacgtatcttcgcgaaaactaacttcccgatatcgaaacaacgactataacgcgacgaccgcgaaataaacgataaccgaaaacgctaaactaaactccgccacgcgaaaaaacgacgaacgtcgaaaacccgaaataaacgacgcaaatttccgcgaacgacgcgaataactccgacaacgtaaccgcctatacttatcctaaattataacttttcatcacttaccttttccgtttacatcccccaccccgaaccccacccatcatttcatc

SEQ ID NO: 33873 - DNA, 976 bp, Artificial Sequence
  chemically treated genomic DNA (Homo sapiens) CpG-island No: 33873
gggagtaacgaatcgattatgggtgtgaggaagattggttagagttgatcgcgtttcggaatggagtggtggttgggatgcggaaaggtttcgagtggagtaattttgggtgaggcggaaacgggggttgattttttagtcgttcgcgtgttattgaggcggcggttattttggtatttttttttagtttcgttagttcgcgcgtatagttttgggatgtggcgggttgggagatttacgttttcggcgtgttttgcggttcggttcgcgtattcggggggcgtggtttgcgcgcgcgtgcgtcgtagtcgaacgttgtggcggggtaggcgaggcggtcgtttcgagcgcgttagttagttttttgaagggagtgacggcggttgggtgttcgcggttatttttgttttttcgggtaagtgcggcggtggcggttggcgtcgtcggttgacgggcggttttttgggagacggggagagtattcggtaggttcgtttgagacgtttgaggttcgcgggcgttattttttaggggcgtttggttcgagtcgggaggcgtttcgttaagttcggtgttcgcgggtattagtcggtgggggtttcgttcgttttgtcgggtaggagggcggaatgtggggttggtacgggcggggagagtcggacggggttaatttggattacgttagttagtttcgggtgattggttcgaagtagtttcggagttgagaggggtcgatcggggtagttcgcggcgtagtttcggtagcgcgtatttgcggagagaacggatttcgtgtttcgagcgtcgtcgagtttcgtacgttcgtgagattcgttttgaattttttttttatgtttgttggggttgttgattcgatttttcgtaagattcggatttaacgtttttgtttgttttacgatagttagtttaatgttgtggacgtaatagggtacgaacgtttgtaattgaaagttga

SEQ ID NO: 33874 - DNA, 976 bp, Artificial Sequence
  chemically treated genomic DNA (Homo sapiens) CpG-island No: 33874
tcaactttcaattacaaacgttcgtaccctattacgtccacaacattaaactaactatcgtaaaacaaacaaaaacgttaaatccgaatcttacgaaaaatcgaatcaacaaccccaacaaacataaaaaaaaaattcaaaacgaatctcacgaacgtacgaaactcgacgacgctcgaaacacgaaatccgttctctccgcaaatacgcgctaccgaaactacgccgcgaactaccccgatcgacccctctcaactccgaaactacttcgaaccaatcacccgaaactaactaacgtaatccaaattaaccccgtccgactctccccgcccgtaccaaccccacattccgccctcctacccgacaaaacgaacgaaacccccaccgactaatacccgcgaacaccgaacttaacgaaacgcctcccgactcgaaccaaacgcccctaaaaaataacgcccgcgaacctcaaacgtctcaaacgaacctaccgaatactctccccgtctcccaaaaaaccgcccgtcaaccgacgacgccaaccgccaccgccgcacttacccgaaaaaacaaaaataaccgcgaacacccaaccgccgtcactcccttcaaaaaactaactaacgcgctcgaaacgaccgcctcgcctaccccgccacaacgttcgactacgacgcacgcgcgcgcaaaccacgccccccgaatacgcgaaccgaaccgcaaaacacgccgaaaacgtaaatctcccaacccgccacatcccaaaactatacgcgcgaactaacgaaactaaaaaaaaataccaaaataaccgccgcctcaataacacgcgaacgactaaaaaatcaacccccgtttccgcctcacccaaaattactccactcgaaacctttccgcatcccaaccaccactccattccgaaacgcgatcaactctaaccaatcttcctcacacccataatcgattcgttactccc

SEQ ID NO: 33875 - DNA, 976 bp, Artificial Sequence
  chemically treated genomic DNA (Homo sapiens) CpG-island No: 33875
ttaatttttagttataaacgttcgtgttttgttacgtttatagtattaagttggttgtcgtggggtaaataaaaacgttgagttcgagttttacggggggtcgggttaataattttagtaaatatggagagaaaatttaaagcgggttttacgggcgtgcggggttcggcggcgttcggggtacgggattcgtttttttcgtaaatgcgcgttgtcggggttgcgtcgcgggttgtttcggtcgattttttttaatttcgaggttatttcgagttagttattcgggattggttgacgtggtttaggttggtttcgttcggtttttttcgttcgtattaattttatatttcgtttttttattcggtaaagcggacgaagtttttatcggttggtgttcgcgggtatcgaatttagcggaacgtttttcggttcggattagacgtttttgaggagtgacgttcgcgagttttaaacgttttaggcgggtttgtcgggtgtttttttcgttttttaggaagtcgttcgttagtcggcggcgttaatcgttatcgtcgtatttattcgggaaggtaaaagtggtcgcgggtatttaatcgtcgttattttttttagggagttgattagcgcgttcgaagcgatcgtttcgtttgtttcgttatagcgttcggttacgacgtacgcgcgcgtaggttacgtttttcgggtgcgcgggtcgggtcgtagagtacgtcgggagcgtgggttttttagttcgttatattttagggttgtacgcgcggattagcggagttaggggaaggtgttagggtggtcgtcgttttagtagtacgcggacggttggaaagttagttttcgttttcgttttatttaggattgttttattcggggttttttcgtattttagttattattttatttcgaggcgcgattagttttgattagttttttttatatttatagtcgattcgttattttt

SEQ ID NO: 33876 - DNA, 976 bp, Artificial Sequence
  chemically treated genomic DNA (Homo sapiens) CpG-island No: 33876
aaaaataacgaatcgactataaatataaaaaaaactaatcaaaactaatcgcgcctcgaaataaaataataactaaaatacgaaaaaaccccgaataaaacaatcctaaataaaacgaaaacgaaaactaactttccaaccgtccgcgtactactaaaacgacgaccaccctaacaccttcccctaactccgctaatccgcgcgtacaaccctaaaatataacgaactaaaaaacccacgctcccgacgtactctacgacccgacccgcgcacccgaaaaacgtaacctacgcgcgcgtacgtcgtaaccgaacgctataacgaaacaaacgaaacgatcgcttcgaacgcgctaatcaactccctaaaaaaaataacgacgattaaatacccgcgaccacttttaccttcccgaataaatacgacgataacgattaacgccgccgactaacgaacgacttcctaaaaaacgaaaaaaacacccgacaaacccgcctaaaacgtttaaaactcgcgaacgtcactcctcaaaaacgtctaatccgaaccgaaaaacgttccgctaaattcgatacccgcgaacaccaaccgataaaaacttcgtccgctttaccgaataaaaaaacgaaatataaaattaatacgaacgaaaaaaaccgaacgaaaccaacctaaaccacgtcaaccaatcccgaataactaactcgaaataacctcgaaattaaaaaaaatcgaccgaaacaacccgcgacgcaaccccgacaacgcgcatttacgaaaaaaacgaatcccgtaccccgaacgccgccgaaccccgcacgcccgtaaaacccgctttaaattttctctccatatttactaaaattattaacccgaccccccgtaaaactcgaactcaacgtttttatttaccccacgacaaccaacttaatactataaacgtaacaaaacacgaacgtttataactaaaaattaa

SEQ ID NO: 33877 - DNA, 754 bp, Artificial Sequence
  chemically treated genomic DNA (Homo sapiens) CpG-island No: 33877
gaattagaagcgtacgtattttagtttgagcgtgtttaacgggttcgtgtacgtcgcgggcggtcgtaacgtagaaggaagtttggtttcgttggagtgttacgtgttttttattaattagtggtagtcgaagacgtttttggaggtggcgcgttgttgttacgttagcgcggtcgtcgacggtcgcgtgttggtgatcggaggttatatagttaacgtttattcgcgttttgtgtgcgtttacgattcggttagcgattcgtggtaggagttgtcgaattttagtatatttcggggttggtattgcgcggttacgttgagcgatagagtgtacgtgatgggcggtagttagttggggtcgcgcggggagcgcgtggacgtgtttatcgtggagtgttatagtttcgcgatcggttagtggagttacgcggcgtcgttgtaggtgggagtgagtattgcgggcgtttcggcgttgtatggtcgcgtttatttggtggggggttggaacgagggcgagaagaagtataagaagtgtatttagtgttttagtttcgagtttaacgagtggacggaggacgacgagttattcgaggttattgtcggcgtgttttgttgtattttttcgatgtttaataacgtgattcgggaatttcgggttagttcggtattttttgtgttagttagtatttgagtttaggtagatgtagggacgtaggaagaatacgttatttattcgtagagttacgtggttaat

SEQ ID NO: 33878 - DNA, 754 bp, Artificial Sequence
  chemically treated genomic DNA (Homo sapiens) CpG-island No: 33878
attaaccacgtaactctacgaataaataacgtattcttcctacgtccctacatctacctaaactcaaatactaactaacacaaaaaataccgaactaacccgaaattcccgaatcacgttattaaacatcgaaaaaatacaacaaaacacgccgacaataacctcgaataactcgtcgtcctccgtccactcgttaaactcgaaactaaaacactaaatacacttcttatacttcttctcgccctcgttccaaccccccaccaaataaacgcgaccatacaacgccgaaacgcccgcaatactcactcccacctacaacgacgccgcgtaactccactaaccgatcgcgaaactataacactccacgataaacacgtccacgcgctccccgcgcgaccccaactaactaccgcccatcacgtacactctatcgctcaacgtaaccgcgcaataccaaccccgaaatatactaaaattcgacaactcctaccacgaatcgctaaccgaatcgtaaacgcacacaaaacgcgaataaacgttaactatataacctccgatcaccaacacgcgaccgtcgacgaccgcgctaacgtaacaacaacgcgccacctccaaaaacgtcttcgactaccactaattaataaaaaacacgtaacactccaacgaaaccaaacttccttctacgttacgaccgcccgcgacgtacacgaacccgttaaacacgctcaaactaaaatacgtacgcttctaattc

SEQ ID NO: 33879 - DNA, 754 bp, Artificial Sequence
  chemically treated genomic DNA (Homo sapiens) CpG-island No: 33879
gttaattacgtggttttacgaataaataacgtgttttttttgcgtttttgtatttatttgggtttagatattgattggtatagaagatatcgaattggttcgggattttcgagttacgttgttgggtatcgagagggtgtagtaggatacgtcgatagtggtttcgggtagttcgtcgtttttcgtttattcgttgagttcggggttgaagtattggatgtattttttgtattttttttcgttttcgttttagttttttattaggtaggcgcggttatgtagcgtcgagacgttcgtagtgtttatttttatttgtagcggcgtcgcgtagttttattggtcggtcgcggggttgtagtattttacggtgagtacgtttacgcgtttttcgcgcggttttagttggttgtcgtttattacgtatattttgtcgtttagcgtgatcgcgtagtgttagtttcggggtgtgttgaggttcggtagtttttgttacgagtcgttggtcgggtcgtaggcgtatatagagcgcgagtaggcgttggttatgtagttttcggttattagtacgcggtcgtcggcgatcgcgttagcgtggtagtagcgcgttatttttaggggcgttttcggttgttattgattggtggagggtacgtagtattttagcgaggttaggtttttttttgcgttgcggtcgttcgcggcgtatacgagttcgttgaatacgtttaggttgaagtgcgtgcgtttttggttt

SEQ ID NO: 33880 - DNA, 754 bp, Artificial Sequence
  chemically treated genomic DNA (Homo sapiens) CpG-island No: 33880
aaaccaaaaacgcacgcacttcaacctaaacgtattcaacgaactcgtatacgccgcgaacgaccgcaacgcaaaaaaaaacctaacctcgctaaaatactacgtaccctccaccaatcaataacaaccgaaaacgcccctaaaaataacgcgctactaccacgctaacgcgatcgccgacgaccgcgtactaataaccgaaaactacataaccaacgcctactcgcgctctatatacgcctacgacccgaccaacgactcgtaacaaaaactaccgaacctcaacacaccccgaaactaacactacgcgatcacgctaaacgacaaaatatacgtaataaacgacaaccaactaaaaccgcgcgaaaaacgcgtaaacgtactcaccgtaaaatactacaaccccgcgaccgaccaataaaactacgcgacgccgctacaaataaaaataaacactacgaacgtctcgacgctacataaccgcgcctacctaataaaaaactaaaacgaaaacgaaaaaaaatacaaaaaatacatccaatacttcaaccccgaactcaacgaataaacgaaaaacgacgaactacccgaaaccactatcgacgtatcctactacaccctctcgatacccaacaacgtaactcgaaaatcccgaaccaattcgatatcttctataccaatcaatatctaaacccaaataaatacaaaaacgcaaaaaaaacacgttatttattcgtaaaaccacgtaattaac

SEQ ID NO: 33881 - DNA, 988 bp, Artificial Sequence
  chemically treated genomic DNA (Homo sapiens) CpG-island No: 33881
ttttttaattgcgatttaattatttttgtatacgttttttgagttttcgcggtttttatcgggttttaggttacgttttcgtcgttgtatcgtttttttttttcgttttcgttcgtagtttataaaatttggagcgtaggatcgcgtttaggagcggcgagttagcggacgtaaagattgggtatgtttcgcggcggcgtaggttttggttataagtaggaagaagttagtgtattagatcggtaaagagaagcgggagtcgtcgcggtagcgcggtcgtggggttcgtcgtcgtcgtatcggagcgggaggaggagtagcggggagggcgaggtcgtcgggtcgagagtcgtttcgtttgttttcggttttttgttttcgttttcgcgcggtgcgtcggatttagggtttgttatttgggcgttaggggtcgtcgtcggggagtcggagcgggtaggatttttttttcgtcgattgcggttcgagagcgttttcgcggggtggagcggtagtcgttttttgcgggcggttgagtgttcgtttcgcgttcggagcgggcgatcgtcgttagttcggaggaggaggagggggcggttatggggttgttgttttagggttcgtcgttgagttgggaggaaattaagcgttatgtcgattacgtgcggcggtacgggattttttagtttttgtatatttattacgtcgttaaggatcggtataaggacgtttttaagtggggcgatgaggtgagcgttcgcggttttcgttttcgtcgggtattcgtgtttggtcgttcgcgttgtttttgttttgttttacgttttcggttttatcgcggttcgcgttttttattgcgttcgggggttttcgagcgtttttcggtttcgggagtatcgtttttgttttcgtttagttcgcgtttagggttatttttttgattagattttttttttgtttatttatttttttgggtttttttttttatttt

SEQ ID NO: 33882 - DNA, 988 bp, Artificial Sequence
  chemically treated genomic DNA (Homo sapiens) CpG-island No: 33882
aaaataaaaaaaaaaacccaaaaaaataaataaacaaaaaaaaaatctaatcaaaaaaataaccctaaacgcgaactaaacgaaaacaaaaacgatactcccgaaaccgaaaaacgctcgaaaacccccgaacgcaataaaaaacgcgaaccgcgataaaaccgaaaacgtaaaacaaaacaaaaacaacgcgaacgaccaaacacgaatacccgacgaaaacgaaaaccgcgaacgctcacctcatcgccccacttaaaaacgtccttataccgatccttaacgacgtaataaatatacaaaaactaaaaaatcccgtaccgccgcacgtaatcgacataacgcttaatttcctcccaactcaacgacgaaccctaaaacaacaaccccataaccgccccctcctcctcctccgaactaacgacgatcgcccgctccgaacgcgaaacgaacactcaaccgcccgcaaaaaacgactaccgctccaccccgcgaaaacgctctcgaaccgcaatcgacgaaaaaaaaatcctacccgctccgactccccgacgacgacccctaacgcccaaataacaaaccctaaatccgacgcaccgcgcgaaaacgaaaacaaaaaaccgaaaacaaacgaaacgactctcgacccgacgacctcgccctccccgctactcctcctcccgctccgatacgacgacgacgaaccccacgaccgcgctaccgcgacgactcccgcttctctttaccgatctaatacactaacttcttcctacttataaccaaaacctacgccgccgcgaaacatacccaatctttacgtccgctaactcgccgctcctaaacgcgatcctacgctccaaattttataaactacgaacgaaaacgaaaaaaaaaaacgatacaacgacgaaaacgtaacctaaaacccgataaaaaccgcgaaaactcaaaaaacgtatacaaaaataattaaatcgcaattaaaaaa

SEQ ID NO: 33883 - DNA, 988 bp, Artificial Sequence
  chemically treated genomic DNA (Homo sapiens) CpG-island No: 33883
ggaatgaaggggaaaatttaaaagaatgaatgaataagaaaggagtttagttaggaggatggttttggacgcggattaggcgaaagtagggacgatgttttcggggtcgggaggcgttcgaggattttcgggcgtagtggagaacgcggatcgcgatagggtcgggggcgtagggtaagataaaggtagcgcgggcggttagatacgggtgttcggcggggacggggatcgcgggcgtttattttatcgttttatttgagaacgtttttgtgtcggtttttgacggcgtggtagatgtgtaggaattggaggatttcgtgtcgtcgtacgtggtcggtatggcgtttggtttttttttagtttagcggcgagttttgggatagtagttttatggtcgttttttttttttttttcgggttgacggcggtcgttcgtttcgggcgcgagacggatatttagtcgttcgtagaaggcggttgtcgttttatttcgcgggggcgttttcgggtcgtagtcggcggagggagggttttgttcgtttcggtttttcggcggcggtttttggcgtttaggtgatagattttgggttcgacgtatcgcgcggaggcgaaggtagaagatcgagagtaggcgggacggttttcggttcggcggtttcgtttttttcgttgttttttttttcgtttcgatgcggcggcggcggattttacggtcgcgttgtcgcggcggttttcgtttttttttgtcggtttggtgtattggtttttttttatttgtgattaaaatttgcgtcgtcgcggagtatgtttagtttttgcgttcgttagttcgtcgtttttgggcgcgattttgcgttttaggttttatagattacgggcgaaggcggggagaggaggcggtgtagcggcggaggcgtggtttgaagttcggtgggaatcgcgggggtttaggaggcgtgtgtaagggtgattgggtcgtagttgagggg

SEQ ID NO: 33884 - DNA, 988 bp, Artificial Sequence
  chemically treated genomic DNA (Homo sapiens) CpG-island No: 33884
cccctcaactacgacccaatcacccttacacacgcctcctaaacccccgcgattcccaccgaacttcaaaccacgcctccgccgctacaccgcctcctctccccgccttcgcccgtaatctataaaacctaaaacgcaaaatcgcgcccaaaaacgacgaactaacgaacgcaaaaactaaacatactccgcgacgacgcaaattttaatcacaaataaaaaaaaaccaatacaccaaaccgacaaaaaaaaacgaaaaccgccgcgacaacgcgaccgtaaaatccgccgccgccgcatcgaaacgaaaaaaaaaacaacgaaaaaaacgaaaccgccgaaccgaaaaccgtcccgcctactctcgatcttctaccttcgcctccgcgcgatacgtcgaacccaaaatctatcacctaaacgccaaaaaccgccgccgaaaaaccgaaacgaacaaaaccctccctccgccgactacgacccgaaaacgcccccgcgaaataaaacgacaaccgccttctacgaacgactaaatatccgtctcgcgcccgaaacgaacgaccgccgtcaacccgaaaaaaaaaaaaaaaacgaccataaaactactatcccaaaactcgccgctaaactaaaaaaaaaccaaacgccataccgaccacgtacgacgacacgaaatcctccaattcctacacatctaccacgccgtcaaaaaccgacacaaaaacgttctcaaataaaacgataaaataaacgcccgcgatccccgtccccgccgaacacccgtatctaaccgcccgcgctacctttatcttaccctacgcccccgaccctatcgcgatccgcgttctccactacgcccgaaaatcctcgaacgcctcccgaccccgaaaacatcgtccctactttcgcctaatccgcgtccaaaaccatcctcctaactaaactcctttcttattcattcattcttttaaattttccccttcattcc

SEQ ID NO: 33885 - DNA, 798 bp, Artificial Sequence
  chemically treated genomic DNA (Homo sapiens) CpG-island No: 33885
cggttgcgtaaattaagttagggtatagagaggtttggtcggttgttttttcgcgttagtgcgttttgttcgcggtgcgttattatttatacgaagatttcgaagagtagggttcgtatttcgattttaatggttagttttcgtatggtgcggtcggagtagttttcgcggcgatagttggtgtttttcgcggttttcgtagttcggtcggcgtcggttcgttagattttgggaggcgagggaggcgcgttttaggtcgcgagcgggggcggaggcgggtttcgggcgggggtaggcgtcggggagggtttagtttaaatttcgcgtttcgggtttcggggtttcgggaagtcgcgtcggtcgttggcgatattgcggatttcgttttttagtgcggagtcggggtcgttttagggattttcggatttttttttttaggagtcgttttcgttttttgggttcgcgtcgggtattcgcggttcggggaggggaagttcggggaagttttatcgtcgtcgtcgtttttttgcgcgtttttcgtttttttcgttagtgggcggtttttgggtttcgcgttagggtagcgcgttcgttggggttttgttcgcggtttttttgtagtttttggttttgttttcgattttcgttgttcgggttttcgttttttggtatacgtacgtacgtgggtatgtagtggacgatcgttttggggattttttagggtttagggtagttttggttaattttgttttcgtgttcggttttttttatatcgttcgaatttgaaatttttttttt

SEQ ID NO: 33886 - DNA, 798 bp, Artificial Sequence
  chemically treated genomic DNA (Homo sapiens) CpG-island No: 33886
aaaaaaaaaatttcaaattcgaacgatataaaaaaaaccgaacacgaaaacaaaattaaccaaaactaccctaaaccctaaaaaatccccaaaacgatcgtccactacatacccacgtacgtacgtataccaaaaaacgaaaacccgaacaacgaaaatcgaaaacaaaaccaaaaactacaaaaaaaccgcgaacaaaaccccaacgaacgcgctaccctaacgcgaaacccaaaaaccgcccactaacgaaaaaaacgaaaaacgcgcaaaaaaacgacgacgacgataaaacttccccgaacttcccctccccgaaccgcgaatacccgacgcgaacccaaaaaacgaaaacgactcctaaaaaaaaaaatccgaaaatccctaaaacgaccccgactccgcactaaaaaacgaaatccgcaatatcgccaacgaccgacgcgacttcccgaaaccccgaaacccgaaacgcgaaatttaaactaaaccctccccgacgcctacccccgcccgaaacccgcctccgcccccgctcgcgacctaaaacgcgcctccctcgcctcccaaaatctaacgaaccgacgccgaccgaactacgaaaaccgcgaaaaacaccaactatcgccgcgaaaactactccgaccgcaccatacgaaaactaaccattaaaatcgaaatacgaaccctactcttcgaaatcttcgtataaataataacgcaccgcgaacaaaacgcactaacgcgaaaaaacaaccgaccaaacctctctataccctaacttaatttacgcaaccg

SEQ ID NO: 33887 - DNA, 798 bp, Artificial Sequence
  chemically treated genomic DNA (Homo sapiens) CpG-island No: 33887
aaagaaagaattttaggttcgaacggtgtagggagggtcgaatacgggagtaaggttggttagggttgttttgagttttggagaatttttagagcgatcgtttattatatgtttacgtgcgtgcgtgtgttagggagcgagagttcggatagcgggagtcggaggtaggattaggagttgtagaggggtcgcgggtagagttttagcgagcgcgttgttttggcgcggagtttaggggtcgtttattggcgggggaggcggggagcgcgtagggaggcggcggcggcggtggggttttttcgggtttttttttttcgggtcgcgggtgttcggcgcgggtttaggaggcggaggcggtttttggggagagggattcgggagtttttgaggcggtttcggtttcgtattaggaggcggggttcgtagtatcgttagcggtcggcgcggtttttcggagtttcggagttcgaggcgcgaggtttaggttgagtttttttcggcgtttgttttcgttcggagttcgttttcgttttcgttcgcggtttggagcgcgtttttttcgttttttagggtttggcgagtcggcgtcggtcgagttgcgggagtcgcggagagtattagttgtcgtcgcgggagttgtttcggtcgtattatgcgggagttggttattgagatcggggtgcgagttttgtttttcggagttttcgtgtaagtagtggcgtatcgcgggtagggcgtattgacgcgggggaataatcgattaagtttttttgtgttttaatttagtttgcgtagtcg

SEQ ID NO: 33888 - DNA, 798 bp, Artificial Sequence
  chemically treated genomic DNA (Homo sapiens) CpG-island No: 33888
cgactacgcaaactaaattaaaacacaaaaaaacttaatcgattattcccccgcgtcaatacgccctacccgcgatacgccactacttacacgaaaactccgaaaaacaaaactcgcaccccgatctcaataaccaactcccgcataatacgaccgaaacaactcccgcgacgacaactaatactctccgcgactcccgcaactcgaccgacgccgactcgccaaaccctaaaaaacgaaaaaaacgcgctccaaaccgcgaacgaaaacgaaaacgaactccgaacgaaaacaaacgccgaaaaaaactcaacctaaacctcgcgcctcgaactccgaaactccgaaaaaccgcgccgaccgctaacgatactacgaaccccgcctcctaatacgaaaccgaaaccgcctcaaaaactcccgaatccctctccccaaaaaccgcctccgcctcctaaacccgcgccgaacacccgcgacccgaaaaaaaaaaacccgaaaaaaccccaccgccgccgccgcctccctacgcgctccccgcctcccccgccaataaacgacccctaaactccgcgccaaaacaacgcgctcgctaaaactctacccgcgacccctctacaactcctaatcctacctccgactcccgctatccgaactctcgctccctaacacacgcacgcacgtaaacatataataaacgatcgctctaaaaattctccaaaactcaaaacaaccctaaccaaccttactcccgtattcgaccctccctacaccgttcgaacctaaaattctttcttt

SEQ ID NO: 33889 - DNA, 1017 bp, Artificial Sequence
  chemically treated genomic DNA (Homo sapiens) CpG-island No: 33889
tttttcgtcgttttttttcggttttattttattgttggattgtggcgttttatttttgttggcggtcggtagggggcggagttcgagtttggattttttttttcggggtttttttcgggaggtcgtttcggcgtgggggaggggaggacggggcgggaggacgcggttcggtcggttgtagcgttatttttggttcggggtcggtagggaggtcgcggttatcgtattatagttgacgtgaggattacgtggggtcgttgtcggtttcgggttgttgggcggcggcgtcgttgttgagcggcggtcgggttcgtcgtttttattttttcgcgttcgtaattagtgacgaggttcgttacgtaaatttttttgcggcgggtaagtggtgcgtcggtttcggtttcgagatttagtagcgggcgacgcggcgtatgaggtggaggtggaggtaggaggcggagcggagtcgggtgcggtggagtagtagaggtcgagcggagtcgtgggcggcgggtcgggatttcggggtcgggttaaggattggcggggtagtcgcgagtttatttgacgcggtttttcgttcggcgttttcgaggtcgcgggttcgtcgttttacgttcgtttcgtgcgtttagttgtttcgggattcgtttgttttttcgcgaatttgggacgagttggaaaattttttttgagagagtcgtgcggtttaggggagcggtttaattcggaaaaggaaaaggaatttagaagtaaggatttcggatttgagtgtttttagcgtttttgttttattttacgagcgtagtttagacgaaagcggacgtagttcgtttttttttaaaatttgggtcggagggtttcgtagttgagttattcggtttcgggcgcgggtagttttcggagtgggaagggtagagtcgcgatcgttttcggaaggcgtatttttttttttgtttgagttttgtttttttagggttatttggtaaggtttttagagtttgttgaatttgggga

SEQ ID NO: 33890 - DNA, 1017 bp, Artificial Sequence
  chemically treated genomic DNA (Homo sapiens) CpG-island No: 33890
tccccaaattcaacaaactctaaaaaccttaccaaataaccctaaaaaaacaaaactcaaacaaaaaaaaaaatacgccttccgaaaacgatcgcgactctacccttcccactccgaaaactacccgcgcccgaaaccgaataactcaactacgaaaccctccgacccaaattttaaaaaaaaacgaactacgtccgctttcgtctaaactacgctcgtaaaataaaacaaaaacgctaaaaacactcaaatccgaaatccttacttctaaattccttttccttttccgaattaaaccgctcccctaaaccgcacgactctctcaaaaaaaattttccaactcgtcccaaattcgcgaaaaaacaaacgaatcccgaaacaactaaacgcacgaaacgaacgtaaaacgacgaacccgcgacctcgaaaacgccgaacgaaaaaccgcgtcaaataaactcgcgactaccccgccaatccttaacccgaccccgaaatcccgacccgccgcccacgactccgctcgacctctactactccaccgcacccgactccgctccgcctcctacctccacctccacctcatacgccgcgtcgcccgctactaaatctcgaaaccgaaaccgacgcaccacttacccgccgcaaaaaaatttacgtaacgaacctcgtcactaattacgaacgcgaaaaaataaaaacgacgaacccgaccgccgctcaacaacgacgccgccgcccaacaacccgaaaccgacaacgaccccacgtaatcctcacgtcaactataatacgataaccgcgacctccctaccgaccccgaaccaaaaataacgctacaaccgaccgaaccgcgtcctcccgccccgtcctcccctcccccacgccgaaacgacctcccgaaaaaaaccccgaaaaaaaaaatccaaactcgaactccgccccctaccgaccgccaacaaaaataaaacgccacaatccaacaataaaataaaaccgaaaaaaaacgacgaaaaa

SEQ ID NO: 33891 - DNA, 1017 bp, Artificial Sequence
  chemically treated genomic DNA (Homo sapiens) CpG-island No: 33891
tttttagatttaataggttttggaaattttattagatggttttaaaaaggtaagatttaggtagaagggaaaatgcgtttttcgagagcggtcgcggttttgttttttttatttcggagattgttcgcgttcgggatcgaatgatttagttgcgaggtttttcggtttaggttttgggggaaaacgggttgcgttcgttttcgtttaaattgcgttcgtaaagtggggtagaggcgttgggggtatttaaattcgaggtttttatttttggatttttttttttttttcgagttaaatcgtttttttgagtcgtacggtttttttagggaggattttttaattcgttttaagttcgcgaggaggtaggcgggtttcggggtagttgagcgtacgaagcgggcgtggggcggcgagttcgcggtttcgggggcgtcgagcgaggggtcgcgttaggtgaattcgcggttgtttcgttagtttttggttcggtttcggggtttcggttcgtcgtttacggtttcgttcggtttttgttgttttatcgtattcggtttcgtttcgttttttgtttttatttttattttatgcgtcgcgtcgttcgttgttgggtttcggggtcggagtcgacgtattatttattcgtcgtaaagggatttacgtagcggatttcgttattgattacggacgcgaggaggtggagacggcgagttcgatcgtcgtttagtagcggcgtcgtcgtttagtaattcggagtcggtagcggttttacgtagtttttacgttagttgtgatgcggtagtcgcggtttttttgtcgatttcggattaaaagtagcgttgtagtcgatcgaatcgcgttttttcgtttcgttttttttttttttacgtcgggacggtttttcgggggaggtttcgaggaaaaaaatttaggttcgaatttcgttttttgtcggtcgttagtaggagtgaagcgttataatttaataatgaaatggaatcggggaggggcggcgggaag

SEQ ID NO: 33892 - DNA, 1017 bp, Artificial Sequence
  chemically treated genomic DNA (Homo sapiens) CpG-island No: 33892
cttcccgccgcccctccccgattccatttcattattaaattataacgcttcactcctactaacgaccgacaaaaaacgaaattcgaacctaaatttttttcctcgaaacctcccccgaaaaaccgtcccgacgtaaaaaaaaaaaaaacgaaacgaaaaaacgcgattcgatcgactacaacgctacttttaatccgaaatcgacaaaaaaaccgcgactaccgcatcacaactaacgtaaaaactacgtaaaaccgctaccgactccgaattactaaacgacgacgccgctactaaacgacgatcgaactcgccgtctccacctcctcgcgtccgtaatcaataacgaaatccgctacgtaaatccctttacgacgaataaataatacgtcgactccgaccccgaaacccaacaacgaacgacgcgacgcataaaataaaaataaaaacaaaaaacgaaacgaaaccgaatacgataaaacaacaaaaaccgaacgaaaccgtaaacgacgaaccgaaaccccgaaaccgaaccaaaaactaacgaaacaaccgcgaattcacctaacgcgacccctcgctcgacgcccccgaaaccgcgaactcgccgccccacgcccgcttcgtacgctcaactaccccgaaacccgcctacctcctcgcgaacttaaaacgaattaaaaaatcctccctaaaaaaaccgtacgactcaaaaaaacgatttaactcgaaaaaaaaaaaaaaatccaaaaataaaaacctcgaatttaaatacccccaacgcctctaccccactttacgaacgcaatttaaacgaaaacgaacgcaacccgttttcccccaaaacctaaaccgaaaaacctcgcaactaaatcattcgatcccgaacgcgaacaatctccgaaataaaaaaaacaaaaccgcgaccgctctcgaaaaacgcattttcccttctacctaaatcttacctttttaaaaccatctaataaaatttccaaaacctattaaatctaaaaa

SEQ ID NO: 33893 - DNA, 533 bp, Artificial Sequence
  chemically treated genomic DNA (Homo sapiens) CpG-island No: 33893
cgggtttcggcgtgggcggtcgagtttcggttgtacgcggttttcggggcggcggtcgttcggttgtttaagtcggggttgtaggtgtgcgtgttttgtcggaataataaggaggcgatggcgggttatattatttatatttttaagggtttcgacgggcgagtgttgtgtttcgtgttgcgtcgttatacgtgttttttgtgcggcgttagcggcgataacgcgtatattattaagtattgttcgttttttaaagtgtcgtcgtcgttcgttcgttcgtttttttttagcgttagggacggttcgtttggtaagaaaatgcgatgaaggttcgggttttcggtcgtttagggtcgtcgtcgtttttcgtatcgataggtatgcgtattatttcgttttcgtcgtggggaggcgtgcggtttagcggtcggttcgatatgggacgtcgttttggtggtttttgaaaaatagtcgatcgtgtggagtattttcgtgttgaacgattgggattagacgttgaaatttttatttgt

SEQ ID NO: 33894 - DNA, 533 bp, Artificial Sequence
  chemically treated genomic DNA (Homo sapiens) CpG-island No: 33894
acaaataaaaatttcaacgtctaatcccaatcgttcaacacgaaaatactccacacgatcgactatttttcaaaaaccaccaaaacgacgtcccatatcgaaccgaccgctaaaccgcacgcctccccacgacgaaaacgaaataatacgcatacctatcgatacgaaaaacgacgacgaccctaaacgaccgaaaacccgaaccttcatcgcattttcttaccaaacgaaccgtccctaacgctaaaaaaaaacgaacgaacgaacgacgacgacactttaaaaaacgaacaatacttaataatatacgcgttatcgccgctaacgccgcacaaaaaacacgtataacgacgcaacacgaaacacaacactcgcccgtcgaaacccttaaaaatataaataatataacccgccatcgcctccttattattccgacaaaacacgcacacctacaaccccgacttaaacaaccgaacgaccgccgccccgaaaaccgcgtacaaccgaaactcgaccgcccacgccgaaacccg

SEQ ID NO: 33895 - DNA, 533 bp, Artificial Sequence
  chemically treated genomic DNA (Homo sapiens) CpG-island No: 33895
ataaatggggattttagcgtttagttttaatcgtttagtacggaaatattttatacggtcggttgttttttaaaaattattaggacgacgttttatgtcgagtcgatcgttgagtcgtacgtttttttacggcgggggcgagatggtgcgtatatttatcggtgcgaggggcggcggcgattttgggcggtcgggagttcgggtttttatcgtatttttttgttaggcgggtcgtttttggcgttgagggggggcgggcgggcgggcggcggcggtattttggagagcgggtagtatttgatggtgtgcgcgttgtcgtcgttggcgtcgtataggggatacgtgtagcggcgtagtacgggatatagtattcgttcgtcggggtttttgaggatatgggtggtgtagttcgttatcgtttttttgttgtttcggtagaatacgtatatttgtagtttcggtttaagtagtcgggcggtcgtcgtttcggaggtcgcgtgtagtcggggttcggtcgtttacgtcggggttcg

SEQ ID NO: 33896 - DNA, 533 bp, Artificial Sequence
  chemically treated genomic DNA (Homo sapiens) CpG-island No: 33896
cgaaccccgacgtaaacgaccgaaccccgactacacgcgacctccgaaacgacgaccgcccgactacttaaaccgaaactacaaatatacgtattctaccgaaacaacaaaaaaacgataacgaactacaccacccatatcctcaaaaaccccgacgaacgaatactatatcccgtactacgccgctacacgtatcccctatacgacgccaacgacgacaacgcgcacaccatcaaatactacccgctctccaaaataccgccgccgcccgcccgcccgccccccctcaacgccaaaaacgacccgcctaacaaaaaaatacgataaaaacccgaactcccgaccgcccaaaatcgccgccgcccctcgcaccgataaatatacgcaccatctcgcccccgccgtaaaaaaacgtacgactcaacgatcgactcgacataaaacgtcgtcctaataatttttaaaaaacaaccgaccgtataaaatatttccgtactaaacgattaaaactaaacgctaaaatccccatttat

SEQ ID NO: 33897 - DNA, 710 bp, Artificial Sequence
  chemically treated genomic DNA (Homo sapiens) CpG-island No: 33897
acgcggttacgtattatagacgggtatacgcgtttagtatagttatagtcgcgtgtaattaggagtgtatatcgtatttatattatatcgtatgtatagacgtacgggtgtgagattatatatttcggttatttacgtttatacgttttttacgcgttcgtatacgcgttcgtacgcgtatttttcgcgtatcgtcgcgcgtatacgcgggtttcgtcggacggcgaggggcggggcgggcgcgggcgtaggcgcgggtgtttagtcgggcgcggtcgggagagggcgcggcgcggggttcgcggttggcgtttgagttgtttgtcggttttcgggtcgttagacgttcggagggagttcggtcggttcggattgggcggtcgggagggagggcgtttcgggttacgacggcgttcgtaagtcgagcgcggtcgggacgtgtattatggatttaaaggcgggcggcggcggcgaggaggacgattgcgtggattcgggcgtcgagatcggagggtgagtcgcgtcgggtcgggtcgcgggcggggggcgtttttcgagttgcgcggcggttttttttcggacggggatttttttgattcgtgcgacgggatcggggcgcggggtttttttttttgtcggatttttcgtttttttttgggcgggtcgcgttgttttgggtagggcgggtattattcggggggaggaaagtg

SEQ ID NO: 33898 - DNA, 710 bp, Artificial Sequence
  chemically treated genomic DNA (Homo sapiens) CpG-island No: 33898
cactttcctccccccgaataatacccgccctacccaaaacaacgcgacccgcccaaaaaaaaacgaaaaatccgacaaaaaaaaaaaccccgcgccccgatcccgtcgcacgaatcaaaaaaatccccgtccgaaaaaaaaccgccgcgcaactcgaaaaacgccccccgcccgcgacccgacccgacgcgactcaccctccgatctcgacgcccgaatccacgcaatcgtcctcctcgccgccgccgcccgcctttaaatccataatacacgtcccgaccgcgctcgacttacgaacgccgtcgtaacccgaaacgccctccctcccgaccgcccaatccgaaccgaccgaactccctccgaacgtctaacgacccgaaaaccgacaaacaactcaaacgccaaccgcgaaccccgcgccgcgccctctcccgaccgcgcccgactaaacacccgcgcctacgcccgcgcccgccccgcccctcgccgtccgacgaaacccgcgtatacgcgcgacgatacgcgaaaaatacgcgtacgaacgcgtatacgaacgcgtaaaaaacgtataaacgtaaataaccgaaatatataatctcacacccgtacgtctatacatacgatataatataaatacgatatacactcctaattacacgcgactataactatactaaacgcgtatacccgtctataatacgtaaccgcgt

SEQ ID NO: 33899 - DNA, 710 bp, Artificial Sequence
  chemically treated genomic DNA (Homo sapiens) CpG-island No: 33899
tattttttttttttcgggtggtgttcgttttgtttagggtagcgcggttcgtttaggagagagcgggggattcggtaggaggagaagtttcgcgtttcggtttcgtcgtacggattaggagggttttcgttcggggaggagtcgtcgcgtaattcggagagcgtttttcgttcgcggttcggttcggcgcggtttatttttcggtttcggcgttcgagtttacgtagtcgtttttttcgtcgtcgtcgttcgtttttgggtttatggtgtacgtttcggtcgcgttcggtttgcgggcgtcgtcgtgattcggggcgttttttttttcggtcgtttagttcgagtcggtcgggtttttttcgagcgtttggcggttcgggagtcggtaaataatttaagcgttagtcgcgaatttcgcgtcgcgttttttttcgatcgcgttcggttgggtattcgcgtttgcgttcgcgttcgtttcgtttttcgtcgttcggcgggattcgcgtgtgcgcgcggcggtgcgcggggagtgcgcgtgcgagcgcgtgtgcgagcgcgtggggggcgtgtgagcgtgagtggtcgaggtgtgtggttttatattcgtgcgtttgtgtatgcggtgtgatgtgggtgcggtgtgtatttttggttgtacgcgattgtggttgtgttgagcgcgtgtgttcgtttgtggtgcgtgatcgcgt

SEQ ID NO: 33900 - DNA, 710 bp, Artificial Sequence
  chemically treated genomic DNA (Homo sapiens) CpG-island No: 33900
acgcgatcacgcaccacaaacgaacacacgcgctcaacacaaccacaatcgcgtacaaccaaaaatacacaccgcacccacatcacaccgcatacacaaacgcacgaatataaaaccacacacctcgaccactcacgctcacacgccccccacgcgctcgcacacgcgctcgcacgcgcactccccgcgcaccgccgcgcgcacacgcgaatcccgccgaacgacgaaaaacgaaacgaacgcgaacgcaaacgcgaatacccaaccgaacgcgatcgaaaaaaaacgcgacgcgaaattcgcgactaacgcttaaattatttaccgactcccgaaccgccaaacgctcgaaaaaaacccgaccgactcgaactaaacgaccgaaaaaaaaaacgccccgaatcacgacgacgcccgcaaaccgaacgcgaccgaaacgtacaccataaacccaaaaacgaacgacgacgacgaaaaaaacgactacgtaaactcgaacgccgaaaccgaaaaataaaccgcgccgaaccgaaccgcgaacgaaaaacgctctccgaattacgcgacgactcctccccgaacgaaaaccctcctaatccgtacgacgaaaccgaaacgcgaaacttctcctcctaccgaatcccccgctctctcctaaacgaaccgcgctaccctaaacaaaacgaacaccacccgaaaaaaaaaaaata

SEQ ID NO: 33901 - DNA, 683 bp, Artificial Sequence
  chemically treated genomic DNA (Homo sapiens) CpG-island No: 33901
attcgtcgttgtcgtagtcgattatttttttataggagatttggttgtatagatagtacgtgggttcgttggggtcgatggggaggtcggtaggggacgtttttcgtttcgttttggttttggagcgttttttttttttggaggttttggtttttttttttttgggtgtgttcgaggcgtcgtcgtcgtggtcgtggttgttggacgcgtttttacggttttcgttgttgcgttgtcgtcgtgagcgtttgttgttgggtttgttagtttgcgttgtcgtttcgtttttgggtttgttcgcgttagttttgtcgttgttgttcgttgtgtcgtttagtttttgttgcgtttcgaatagttttacgtggttgtttatttgtcgcgtgcggttttttattagttttattatttggtttacgatttggattttttcgtcgtttagtttttggttgcggattagcgcgcgttgtatatagtgtagtatttttcgtttttgcgtttcgtttgtttcgcgattgaagcgttcgtagtattcgtttagtttttttatgatttttgggggtaagaaggataggcgttattcgcgagtaggatatcgggataatttatacggtttcggacgggtttacggagagggttggtagggagtttaggggttagcgtacggtttgtttagaataaag

SEQ ID NO: 33902 - DNA, 683 bp, Artificial Sequence
  chemically treated genomic DNA (Homo sapiens) CpG-island No: 33902
ctttattctaaacaaaccgtacgctaacccctaaactccctaccaaccctctccgtaaacccgtccgaaaccgtataaattatcccgatatcctactcgcgaataacgcctatccttcttacccccaaaaatcataaaaaaactaaacgaatactacgaacgcttcaatcgcgaaacaaacgaaacgcaaaaacgaaaaatactacactatatacaacgcgcgctaatccgcaaccaaaaactaaacgacgaaaaaatccaaatcgtaaaccaaataataaaactaataaaaaaccgcacgcgacaaataaacaaccacgtaaaactattcgaaacgcaacaaaaactaaacgacacaacgaacaacaacgacaaaactaacgcgaacaaacccaaaaacgaaacgacaacgcaaactaacaaacccaacaacaaacgctcacgacgacaacgcaacaacgaaaaccgtaaaaacgcgtccaacaaccacgaccacgacgacgacgcctcgaacacacccaaaaaaaaaaaaaccaaaacctccaaaaaaaaaaaacgctccaaaaccaaaacgaaacgaaaaacgtcccctaccgacctccccatcgaccccaacgaacccacgtactatctatacaaccaaatctcctataaaaaaataatcgactacgacaacgacgaat

SEQ ID NO: 33903 - DNA, 683 bp, Artificial Sequence
  chemically treated genomic DNA (Homo sapiens) CpG-island No: 33903
ttttgttttgggtaagtcgtgcgttggtttttaggttttttgttagtttttttcgtagattcgttcggggtcgtgtgggttgtttcggtgttttgttcgcgagtgacgtttgttttttttgtttttagagattatgaaggagttagacgagtgttacgagcgttttagtcgcgagatagacggggcgtagaagcgggggatgttgtattgtgtgtagcgcgcgttgattcgtagttaggagttgggcgacgagaagatttagatcgtgagttagatggtggagttggtggagaatcgtacgcggtaggtggatagttacgtggagttgttcgaggcgtagtaggagttgggcgatatagcgggtaatagcggtaaggttggcgcggataggtttaaaggcgaggcggtagcgtaggttgataagtttaatagtaagcgtttacggcggtagcgtaataacgagaatcgtgagaacgcgtttagtaattacgattacgacgacggcgtttcgggtatatttaaggagaagaaggttaagatttttaagaagaagaagcgttttaaggttaaggcggagcgagaggcgttttttgtcgatttttttatcgattttaacgaatttacgtattgtttgtgtaattaggttttttatggggagatgatcggttgcgataacgacgagt

SEQ ID NO: 33904 - DNA, 683 bp, Artificial Sequence
  chemically treated genomic DNA (Homo sapiens) CpG-island No: 33904
actcgtcgttatcgcaaccgatcatctccccataaaaaacctaattacacaaacaatacgtaaattcgttaaaatcgataaaaaaatcgacaaaaaacgcctctcgctccgccttaaccttaaaacgcttcttcttcttaaaaatcttaaccttcttctccttaaatatacccgaaacgccgtcgtcgtaatcgtaattactaaacgcgttctcacgattctcgttattacgctaccgccgtaaacgcttactattaaacttatcaacctacgctaccgcctcgcctttaaacctatccgcgccaaccttaccgctattacccgctatatcgcccaactcctactacgcctcgaacaactccacgtaactatccacctaccgcgtacgattctccaccaactccaccatctaactcacgatctaaatcttctcgtcgcccaactcctaactacgaatcaacgcgcgctacacacaatacaacatcccccgcttctacgccccgtctatctcgcgactaaaacgctcgtaacactcgtctaactccttcataatctctaaaaacaaaaaaaacaaacgtcactcgcgaacaaaacaccgaaacaacccacacgaccccgaacgaatctacgaaaaaaactaacaaaaaacctaaaaaccaacgcacgacttacccaaaacaaaa

SEQ ID NO: 33905 - DNA, 970 bp, Artificial Sequence
  chemically treated genomic DNA (Homo sapiens) CpG-island No: 33905
ggcggatacgaattcgttatttttttttgatattcggggcggttaggtttgtagagaacgacgtataggtttttttatttgttatagttttttttaagttagcgatttgttcgcgttttttcgagcgtagcgtagatgggcgtttttttcgttttcgtttttttttttttttttttttttttacggtatatagagaaaagttttcgtttttcgtaaattataatcggcggcgtcgtttttcgtagtcggtttttattcggtgtttagttttaagtgagggtcggagggggttgggcgggggcggtcgatttatttcgagcggagtattattcggtattttatgtaatatttagattcgggattgagtggggggcgattaagaagggttagaggaacggcgttgttcgggatcgaggtatcgggttcgcggaaatttcggtttatagtcgttttttttttgtagtttcgtttcggcgttttatagttttaggcgtcggtatatttttttatttcgcgtcgtaatatgtatttttttttagaggacgcggtttggattcgtcgttttttttttcgtagtattcgttttattattttattataaagagcgttttggtcgcgtagttttgtagcgagatttttcgcgttttttttttttttcgtgtttcgggttttgtatataaggattttggcgaattaaaggcgttttagattttttgtttttgtttttgtcgagggtcgtcgttgcggagtcggtcgtttttttcggtttacggtaggatcggttcggtttcgcggcgcgttcggattcgtcgggaaggaggcggtcgttttcgtttatttattattcggtcgtattttggtatttcgcgtcgatttttcgtattagcgagatatttttttgtaagtcgaaaggtagggattcgatggagtttaggtagttttttatatagtttattaggtggagttgttt

SEQ ID NO: 33906 - DNA, 970 bp, Artificial Sequence
  chemically treated genomic DNA (Homo sapiens) CpG-island No: 33906
aaacaactccacctaataaactatataaaaaactacctaaactccatcgaatccctacctttcgacttacaaaaaaatatctcgctaatacgaaaaatcgacgcgaaataccaaaatacgaccgaataataaataaacgaaaacgaccgcctccttcccgacgaatccgaacgcgccgcgaaaccgaaccgatcctaccgtaaaccgaaaaaaacgaccgactccgcaacgacgaccctcgacaaaaacaaaaacaaaaaatctaaaacgcctttaattcgccaaaatccttatatacaaaacccgaaacacgaaaaaaaaaaaaaacgcgaaaaatctcgctacaaaactacgcgaccaaaacgctctttataataaaataataaaacgaatactacgaaaaaaaaaacgacgaatccaaaccgcgtcctctaaaaaaaaatacatattacgacgcgaaataaaaaaatataccgacgcctaaaactataaaacgccgaaacgaaactacaaaaaaaaaacgactataaaccgaaatttccgcgaacccgatacctcgatcccgaacaacgccgttcctctaacccttcttaatcgccccccactcaatcccgaatctaaatattacataaaataccgaataatactccgctcgaaataaatcgaccgcccccgcccaaccccctccgaccctcacttaaaactaaacaccgaataaaaaccgactacgaaaaacgacgccgccgattataatttacgaaaaacgaaaacttttctctatataccgtaaaaaaaaaaaaaaaaaaaaaaaaacgaaaacgaaaaaaacgcccatctacgctacgctcgaaaaaacgcgaacaaatcgctaacttaaaaaaaactataacaaataaaaaaacctatacgtcgttctctacaaacctaaccgccccgaatatcaaaaaaaaataacgaattcgtatccgcc

SEQ ID NO: 33907 - DNA, 970 bp, Artificial Sequence
  chemically treated genomic DNA (Homo sapiens) CpG-island No: 33907
gagtagttttatttggtgaattatgtggaggattatttggattttatcgagtttttgtttttcgatttgtagagaaatgtttcgttgatgcgggagatcgacgcgaaatattaaggtacggtcgggtgatggatgggcgggggcggtcgtttttttttcggcgggttcgggcgcgtcgcggagtcgggtcggttttgtcgtggatcggaggaagcggtcggtttcgtagcggcggttttcggtaggggtaggaataaaaggtttggagcgtttttgattcgttaaggtttttgtgtgtaaagttcgggatacggaggaggaaggaggcgcgagaggtttcgttgtaaggttgcgcgattaaagcgttttttgtagtgaagtgatgaggcgggtgttgcgggggagggggcggcgggtttaagtcgcgttttttaggagggggtgtatattacggcgcgagatggagggatgtgtcggcgtttggggttatagggcgtcgagacggggttgtaggagaagggcggttgtgggtcggggttttcgcggattcggtgtttcggtttcgggtaacgtcgtttttttggttttttttagtcgttttttatttagtttcgaatttgagtgttatataaagtatcgggtagtatttcgttcggggtaggtcggtcgttttcgtttagtttttttcggtttttatttggagttggatatcgagtaggggtcgattgcgaggggcgacgtcgtcggttgtagtttgcggaggacgagggtttttttttgtgtgtcgtagggaagggaagggaaggggaggagcggaggcggggaaggcgtttatttgcgttgcgttcgggggggcgcgggtagatcgttggtttggagaggattgtggtaggtgagaggatttgtgcgtcgttttttgtagatttggtcgtttcgggtgttagagagaggtggcgagttcgtgttcgtt

SEQ ID NO: 33908 - DNA, 970 bp, Artificial Sequence
  chemically treated genomic DNA (Homo sapiens) CpG-island No: 33908
aacgaacacgaactcgccacctctctctaacacccgaaacgaccaaatctacaaaaaacgacgcacaaatcctctcacctaccacaatcctctccaaaccaacgatctacccgcgcccccccgaacgcaacgcaaataaacgccttccccgcctccgctcctccccttcccttcccttccctacgacacacaaaaaaaaaccctcgtcctccgcaaactacaaccgacgacgtcgcccctcgcaatcgacccctactcgatatccaactccaaataaaaaccgaaaaaaactaaacgaaaacgaccgacctaccccgaacgaaatactacccgatactttatataacactcaaattcgaaactaaataaaaaacgactaaaaaaaaccaaaaaaacgacgttacccgaaaccgaaacaccgaatccgcgaaaaccccgacccacaaccgcccttctcctacaaccccgtctcgacgccctataaccccaaacgccgacacatccctccatctcgcgccgtaatatacaccccctcctaaaaaacgcgacttaaacccgccgccccctcccccgcaacacccgcctcatcacttcactacaaaaaacgctttaatcgcgcaaccttacaacgaaacctctcgcgcctccttcctcctccgtatcccgaactttacacacaaaaaccttaacgaatcaaaaacgctccaaaccttttattcctacccctaccgaaaaccgccgctacgaaaccgaccgcttcctccgatccacgacaaaaccgacccgactccgcgacgcgcccgaacccgccgaaaaaaaaacgaccgcccccgcccatccatcacccgaccgtaccttaatatttcgcgtcgatctcccgcatcaacgaaacatttctctacaaatcgaaaaacaaaaactcgataaaatccaaataatcctccacataattcaccaaataaaactactc

SEQ ID NO: 33909 - DNA, 812 bp, Artificial Sequence
  chemically treated genomic DNA (Homo sapiens) CpG-island No: 33909
ttgtaaacgtttttttcgcgcggcggatatagttttaggttggtatcgcgcgtatacggacgtttcgtaggatttgggttaataaggagaggagatcggtacggtatcgtttttttttacggtttttcggcgcggtatcgtttttttttttttatttcgggtttttttcgttttaattttttcgggttttggttttttatttttgtcgcgggcgattcgagttaggttaaagggaggcgttatttgaggattgttttcgggagtgggcgtggttttaagggcgtgggcggggcggggcggggtcgtgttgtttttgagcgatcggtagcgtattcggcgtggttttcgttttcgtttagtcgtaggcgttggtcgttgatatgttgaggattacgcgcggtttaagtttgggtttttcgttgttttaggtcgcgttgggttttgggcgggttgggtggtattggtttgcgggtcgggcggcgagcggggggcgcgggcgggtttggttgtagtttacgggtcgggagacgggtgtgtaggtgtataatagttttatcgggaggaaggaatttttaatcgtggcgtacgtcgaagtcgttttttggtgggtcgcgcgggattggggtacgggcgggggtcgatcgtggcggagattttttacggttgaacgggatttgggttcggggagggcgtttaggaagttgtatggagggcgtcgttttagaagttgggggtgcgcggtgtttttgtaggtttgggtgtgaattgagtaagtatgaaaatttcggttatttattttttagaagtgatta

SEQ ID NO: 33910 - DNA, 812 bp, Artificial Sequence
  chemically treated genomic DNA (Homo sapiens) CpG-island No: 33910
taatcacttctaaaaaataaataaccgaaattttcatacttactcaattcacacccaaacctacaaaaacaccgcgcacccccaacttctaaaacgacgccctccatacaacttcctaaacgccctccccgaacccaaatcccgttcaaccgtaaaaaatctccgccacgatcgacccccgcccgtaccccaatcccgcgcgacccaccaaaaaacgacttcgacgtacgccacgattaaaaattccttcctcccgataaaactattatacacctacacacccgtctcccgacccgtaaactacaaccaaacccgcccgcgccccccgctcgccgcccgacccgcaaaccaataccacccaacccgcccaaaacccaacgcgacctaaaacaacgaaaaacccaaacttaaaccgcgcgtaatcctcaacatatcaacgaccaacgcctacgactaaacgaaaacgaaaaccacgccgaatacgctaccgatcgctcaaaaacaacacgaccccgccccgccccgcccacgcccttaaaaccacgcccactcccgaaaacaatcctcaaataacgcctccctttaacctaactcgaatcgcccgcgacaaaaataaaaaaccaaaacccgaaaaaattaaaacgaaaaaaacccgaaataaaaaaaaaaaaacgataccgcgccgaaaaaccgtaaaaaaaaacgataccgtaccgatctcctctccttattaacccaaatcctacgaaacgtccgtatacgcgcgataccaacctaaaactatatccgccgcgcgaaaaaaacgtttacaa

SEQ ID NO: 33911 - DNA, 812 bp, Artificial Sequence
  chemically treated genomic DNA (Homo sapiens) CpG-island No: 33911
taattatttttgggggatgaatagtcggggtttttatatttgtttaatttatatttaaatttgtaaaagtatcgcgtatttttagtttttagaacggcgttttttatgtagttttttaaacgtttttttcgagtttagatttcgtttagtcgtgggaagttttcgttacgatcggttttcgttcgtgttttagtttcgcgcggtttattaggaggcggtttcggcgtgcgttacgattaggggtttttttttttcggtgaggttgttgtatatttgtatattcgtttttcggttcgtgggttgtagttaggttcgttcgcgtttttcgttcgtcgttcggttcgtaggttagtgttatttagttcgtttaaggtttagcgcggtttggagtagcggggggtttaggtttgggtcgcgcgtagtttttaatatgttagcggttagcgtttacgattgggcggagacgggagttacgtcgggtacgttgtcggtcgtttaagagtagtacggtttcgtttcgtttcgtttacgtttttggggttacgtttattttcggaagtagtttttaggtagcgtttttttttggtttggttcgagtcgttcgcggtaagggtggagaattagggttcgaagaggttggggcggggaaggttcggggtggagggaggagggcggtgtcgcgtcgggaggtcgtgggaagaggcggtatcgtgtcgattttttttttttattagtttaggttttgcgaggcgttcgtgtgcgcgcggtattagtttggagttgtgttcgtcgcgcgggaggagcgtttatag

SEQ ID NO: 33912 - DNA, 812 bp, Artificial Sequence
  chemically treated genomic DNA (Homo sapiens) CpG-island No: 33912
ctataaacgctcctcccgcgcgacgaacacaactccaaactaataccgcgcgcacacgaacgcctcgcaaaacctaaactaataaaaaaaaaaaatcgacacgataccgcctcttcccacgacctcccgacgcgacaccgccctcctccctccaccccgaaccttccccgccccaacctcttcgaaccctaattctccacccttaccgcgaacgactcgaaccaaaccaaaaaaaaacgctacctaaaaactacttccgaaaataaacgtaaccccaaaaacgtaaacgaaacgaaacgaaaccgtactactcttaaacgaccgacaacgtacccgacgtaactcccgtctccgcccaatcgtaaacgctaaccgctaacatattaaaaactacgcgcgacccaaacctaaaccccccgctactccaaaccgcgctaaaccttaaacgaactaaataacactaacctacgaaccgaacgacgaacgaaaaacgcgaacgaacctaactacaacccacgaaccgaaaaacgaatatacaaatatacaacaacctcaccgaaaaaaaaaaacccctaatcgtaacgcacgccgaaaccgcctcctaataaaccgcgcgaaactaaaacacgaacgaaaaccgatcgtaacgaaaacttcccacgactaaacgaaatctaaactcgaaaaaaacgtttaaaaaactacataaaaaacgccgttctaaaaactaaaaatacgcgatacttttacaaatttaaatataaattaaacaaatataaaaaccccgactattcatcccccaaaaataatta

SEQ ID NO: 33913 - DNA, 668 bp, Artificial Sequence
  chemically treated genomic DNA (Homo sapiens) CpG-island No: 33913
cgtcgtgagggggacgtcgtgagaggggtgttttgagggggacgtcgtgaggggggagcgtggtgacggggacgtcgtgaggggggcgtcgtgagaaggacgttgttagtggaggcgtggtgagggggggttaggagagggacgtcgtgaggggggcgtattgtgagggggtcgcgttatgagggggatgtgtcgtgagggaggcgcgacgtgaggagggtacgtagtgaggaaggcgtcgtgagggggattttgtgagggggagtatcgtgagggggattttttgaaggaggtgtatcgtgacgggggcgtcgtgacggggatgtcgtgaggagggcgcgtggtaacgggggtatcgtgaggggagcgcgtcgtgtggagggcgtcgtgacggggacgtcgtgaggagggtacgtcgtgaggaaggcgtcgtgagggggaggtcgtgagggggacgtgacgaagggggcgcgtcgtgacgggggcgtcgtgagggggatgtcgtgaggagggcgcgtggtaacgggggtatcgtgaggggagcgcgtcgtgtgtagggcgtcgtgacgggtacgtcgtgaggggcgcgttgtgaggcgagtttttgttttttttttttggagttttcgttttttagttgtttttcgtcgttaggggttttttttgtt

SEQ ID NO: 33914 - DNA, 668 bp, Artificial Sequence
  chemically treated genomic DNA (Homo sapiens) CpG-island No: 33914
aacaaaaaaaacccctaacgacgaaaaacaactaaaaaacgaaaactccaaaaaaaaaaaacaaaaactcgcctcacaacgcgcccctcacgacgtacccgtcacgacgccctacacacgacgcgctcccctcacgatacccccgttaccacgcgccctcctcacgacatccccctcacgacgcccccgtcacgacgcgcccccttcgtcacgtccccctcacgacctccccctcacgacgccttcctcacgacgtaccctcctcacgacgtccccgtcacgacgccctccacacgacgcgctcccctcacgatacccccgttaccacgcgccctcctcacgacatccccgtcacgacgcccccgtcacgatacacctccttcaaaaaatccccctcacgatactccccctcacaaaatccccctcacgacgccttcctcactacgtaccctcctcacgtcgcgcctccctcacgacacatccccctcataacgcgaccccctcacaatacgcccccctcacgacgtccctctcctaaccccccctcaccacgcctccactaacaacgtccttctcacgacgcccccctcacgacgtccccgtcaccacgctcccccctcacgacgtccccctcaaaacacccctctcacgacgtccccctcacgacg

SEQ ID NO: 33915 - DNA, 668 bp, Artificial Sequence
  chemically treated genomic DNA (Homo sapiens) CpG-island No: 33915
gataggaagagtttttgacggcggggggtagttgaggagcgggagttttagggggagggggtagagattcgttttatagcgcgttttttacgacgtgttcgttacgacgttttatatacgacgcgttttttttacgatgttttcgttattacgcgttttttttacgatattttttttacgacgttttcgttacgacgcgtttttttcgttacgttttttttacgattttttttttacgacgttttttttacgacgtgttttttttacgacgttttcgttacgacgttttttatacgacgcgttttttttacgatgttttcgttattacgcgttttttttacgatattttcgttacgacgttttcgttacgatgtattttttttaggaagttttttttacgatgtttttttttataaagttttttttacgacgttttttttattacgtgttttttttacgtcgcgttttttttacgatatattttttttatgacgcggtttttttataatgcgttttttttacgacgttttttttttgatttttttttattacgtttttattgataacgttttttttacgacgttttttttacgacgttttcgttattacgttttttttttacgacgttttttttaggatattttttttacgacgttttttttacgacg

SEQ ID NO: 33916 - DNA, 668 bp, Artificial Sequence
  chemically treated genomic DNA (Homo sapiens) CpG-island No: 33916
cgtcgtaaaaaaaacgtcgtaaaaaaaatatcctaaaaaaaacgtcgtaaaaaaaaaacgtaataacgaaaacgtcgtaaaaaaaacgtcgtaaaaaaaacgttatcaataaaaacgtaataaaaaaaaatcaaaaaaaaaacgtcgtaaaaaaaacgcattataaaaaaaccgcgtcataaaaaaaatatatcgtaaaaaaaacgcgacgtaaaaaaaacacgtaataaaaaaaacgtcgtaaaaaaaactttataaaaaaaaacatcgtaaaaaaaacttcctaaaaaaaatacatcgtaacgaaaacgtcgtaacgaaaatatcgtaaaaaaaacgcgtaataacgaaaacatcgtaaaaaaaacgcgtcgtataaaaaacgtcgtaacgaaaacgtcgtaaaaaaaacacgtcgtaaaaaaaacgtcgtaaaaaaaaaatcgtaaaaaaaacgtaacgaaaaaaacgcgtcgtaacgaaaacgtcgtaaaaaaaatatcgtaaaaaaaacgcgtaataacgaaaacatcgtaaaaaaaacgcgtcgtatataaaacgtcgtaacgaacacgtcgtaaaaaacgcgctataaaacgaatctctaccccctccccctaaaactcccgctcctcaactaccccccgccgtcaaaaactcttcctatc

SEQ ID NO: 33917 - DNA, 914 bp, Artificial Sequence
  chemically treated genomic DNA (Homo sapiens) CpG-island No: 33917
attacgtggggagttttaagaattttttttaagaaagtgattgattgatggcgggggagggggtgggcgcgggtttagtttcgggaaaaggttggggttttcgttgggagtgtatagaaagatgatttgaagaacgtggggagtcgttcgtagttcggtacggaggggcggtggtcggggttgttgggtataagggatcggtagcgcgcggaatattcgtttttaattttcgttttcgtgcgcgtttcgtttttacgcgcgcgttttttttcgttaggcgcgtagagaggcggggcgtagcgcgtacggaggtaataagggacgcggcgggaagagggcgtgcgtttcgtttcgtttttttcgcggtttcgtacgtttcgtttttattttttgcgcgtgttgggagtcggttggtaaggcgtgcggtgggcggggcgtcgcgttgacgttgttcgggatgcggataggtttcgtcgtttttagcgtcgtcgtcgtagttgtcgtcgtcgtcgttttcgtttcgtttgttatcggggtttgtatgaaaatatcgggcggcgggcggcgagggattcgtcgtgatttaggtgttgagtcgggtgttgcggttttgcgcggttttcgttagcgttttattttgagtcggtgagcgttttgttgtagtttttatgtttcggtcggtcgtttttttgtttttttcgggtcgcgggagatgcgagcgacggcgttcgggggtaggaggggcgatttcggatttttgcgttttttatttgacgggttgtgtaacgtatgttatatatgtgacgcgtgaggggaacgtattcggttttgagggaaagttttgacggggtggggttttgattgggtttggaaaacgttttttttagttttcggattttcggtggattttcgtt

SEQ ID NO: 33918 - DNA, 914 bp, Artificial Sequence
  chemically treated genomic DNA (Homo sapiens) CpG-island No: 33918
aacgaaaatccaccgaaaatccgaaaactaaaaaaaacgttttccaaacccaatcaaaaccccaccccgtcaaaactttccctcaaaaccgaatacgttcccctcacgcgtcacatatataacatacgttacacaacccgtcaaataaaaaacgcaaaaatccgaaatcgcccctcctacccccgaacgccgtcgctcgcatctcccgcgacccgaaaaaaacaaaaaaacgaccgaccgaaacataaaaactacaacaaaacgctcaccgactcaaaataaaacgctaacgaaaaccgcgcaaaaccgcaacacccgactcaacacctaaatcacgacgaatccctcgccgcccgccgcccgatattttcatacaaaccccgataacaaacgaaacgaaaacgacgacgacgacaactacgacgacgacgctaaaaacgacgaaacctatccgcatcccgaacaacgtcaacgcgacgccccgcccaccgcacgccttaccaaccgactcccaacacgcgcaaaaaataaaaacgaaacgtacgaaaccgcgaaaaaaacgaaacgaaacgcacgccctcttcccgccgcgtcccttattacctccgtacgcgctacgccccgcctctctacgcgcctaacgaaaaaaaacgcgcgcgtaaaaacgaaacgcgcacgaaaacgaaaattaaaaacgaatattccgcgcgctaccgatcccttatacccaacaaccccgaccaccgcccctccgtaccgaactacgaacgactccccacgttcttcaaatcatctttctatacactcccaacgaaaaccccaaccttttcccgaaactaaacccgcgcccaccccctcccccgccatcaatcaatcactttcttaaaaaaaattcttaaaactccccacgtaat

SEQ ID NO: 33919 - DNA, 914 bp, Artificial Sequence
  chemically treated genomic DNA (Homo sapiens) CpG-island No: 33919
gacggggatttatcgagggttcggggattggggaaggcgttttttagatttagttaaagttttatttcgttagggtttttttttaagatcgagtgcgttttttttacgcgttatatgtgtaatatgcgttatataattcgttaggtaaggggcgtagggattcggggtcgttttttttattttcgggcgtcgtcgttcgtatttttcgcggttcggggagagtagagggacggtcggtcgggatatgaggattgtagtagggcgtttatcggtttaggatggggcgttggcggggatcgcgtagagtcgtagtattcggtttagtatttggattacggcggatttttcgtcgttcgtcgttcggtgtttttatataaatttcggtggtaggcgaggcggaggcggcggcggcggtagttgcggcggcggcgttggaggcggcggaatttgttcgtatttcgggtaacgttagcgcggcgtttcgtttatcgtacgttttgttagtcggtttttagtacgcgtagggagtgggggcggggcgtgcgaggtcgcgaaaggggcggggcggagcgtacgtttttttttcgtcgcgttttttgttattttcgtgcgcgttgcgtttcgtttttttgcgcgtttgacgggagggagcgcgcgcgtgggggcggagcgcgtacgggagcgggaattaggggcgggtgtttcgcgcgttgtcggttttttgtatttagtagtttcggttatcgttttttcgtatcgaattgcgagcgattttttacgttttttaagttatttttttgtatatttttaacgagggttttagttttttttcggaattaagttcgcgtttattttttttttcgttattaattagttatttttttaggaagggtttttaaagttttttacgtgat

SEQ ID NO: 33920 - DNA, 914 bp, Artificial Sequence
  chemically treated genomic DNA (Homo sapiens) CpG-island No: 33920
atcacgtaaaaaactttaaaaacccttcctaaaaaaataactaattaataacgaaaaaaaaaataaacgcgaacttaattccgaaaaaaaactaaaaccctcgttaaaaatatacaaaaaaataacttaaaaaacgtaaaaaatcgctcgcaattcgatacgaaaaaacgataaccgaaactactaaatacaaaaaaccgacaacgcgcgaaacacccgcccctaattcccgctcccgtacgcgctccgcccccacgcgcgcgctccctcccgtcaaacgcgcaaaaaaacgaaacgcaacgcgcacgaaaataacaaaaaacgcgacgaaaaaaaaacgtacgctccgccccgcccctttcgcgacctcgcacgccccgcccccactccctacgcgtactaaaaaccgactaacaaaacgtacgataaacgaaacgccgcgctaacgttacccgaaatacgaacaaattccgccgcctccaacgccgccgccgcaactaccgccgccgccgcctccgcctcgcctaccaccgaaatttatataaaaacaccgaacgacgaacgacgaaaaatccgccgtaatccaaatactaaaccgaatactacgactctacgcgatccccgccaacgccccatcctaaaccgataaacgccctactacaatcctcatatcccgaccgaccgtccctctactctccccgaaccgcgaaaaatacgaacgacgacgcccgaaaataaaaaaaacgaccccgaatccctacgccccttacctaacgaattatataacgcatattacacatataacgcgtaaaaaaaacgcactcgatcttaaaaaaaaaccctaacgaaataaaactttaactaaatctaaaaaacgccttccccaatccccgaaccctcgataaatccccgtc

SEQ ID NO: 33921 - DNA, 540 bp, Artificial Sequence
  chemically treated genomic DNA (Homo sapiens) CpG-island No: 33921
ttcgcgggggtcgagtcgcgtatattttcggcgttgtcgtcgtcgagcgggtaagcgcggtcgggcgggcgagcgcgggtttattttgttggtcgtcgggcgggcgggttgcgcgcgttcgttttattcgtattatacgttgtagttggtttcgttttgtttttttgggatttagcgttgattttatcgatatttcgcggataattaatgggttgcggtgttcgtttttttattagtatgtttttggaatcgtttattttggtagcgttcggttagcgggcggtgtcgggggcggggtcgggtttagtcgtgataggaaggggcgtgtgcgcggatgggaggcgaagaagtgttcggcgttcggtttttggtattgtgagttcgtcggttttcgtcggtaacgggcgcgcgggtttagtaatttttttcgttttggtcgggtcggacgttggtttggcgcgttttttggtttttcggaagggtcgtttacggggagtttggaaggaattttagacgtaaaataatagtgataagttattt

SEQ ID NO: 33922 - DNA, 540 bp, Artificial Sequence
  chemically treated genomic DNA (Homo sapiens) CpG-island No: 33922
aaataacttatcactattattttacgtctaaaattccttccaaactccccgtaaacgacccttccgaaaaaccaaaaaacgcgccaaaccaacgtccgacccgaccaaaacgaaaaaaattactaaacccgcgcgcccgttaccgacgaaaaccgacgaactcacaataccaaaaaccgaacgccgaacacttcttcgcctcccatccgcgcacacgccccttcctatcacgactaaacccgaccccgcccccgacaccgcccgctaaccgaacgctaccaaaataaacgattccaaaaacatactaataaaaaaacgaacaccgcaacccattaattatccgcgaaatatcgataaaatcaacgctaaatcccaaaaaaacaaaacgaaaccaactacaacgtataatacgaataaaacgaacgcgcgcaacccgcccgcccgacgaccaacaaaataaacccgcgctcgcccgcccgaccgcgcttacccgctcgacgacgacaacgccgaaaatatacgcgactcgacccccgcgaa

SEQ ID NO: 33923 - DNA, 540 bp, Artificial Sequence
  chemically treated genomic DNA (Homo sapiens) CpG-island No: 33923
aaataatttattattgttattttacgtttaaggttttttttaagtttttcgtgggcgattttttcgaaggattagaaggcgcgttaggttagcgttcggttcggttaggacggaaagggttattaggttcgcgcgttcgttatcggcggaggtcggcgggtttataatgttaggagtcgggcgtcggatattttttcgttttttattcgcgtatacgtttttttttgttacggttgggttcggtttcgttttcggtatcgttcgttggtcgggcgttgttagagtggacggttttagaggtatgttaatgagggggcgggtatcgtagtttattggttgttcgcggagtgtcggtgaagttagcgttgagttttagaaaaatagagcggggttagttgtagcgtgtagtgcgagtggggcggacgcgcgtagttcgttcgttcggcgattagtaaggtaagttcgcgttcgttcgttcggtcgcgtttgttcgttcggcggcggtagcgtcgggggtgtgcgcggttcggttttcgcggg

SEQ ID NO: 33924 - DNA, 540 bp, Artificial Sequence
  chemically treated genomic DNA (Homo sapiens) CpG-island No: 33924
cccgcgaaaaccgaaccgcgcacacccccgacgctaccgccgccgaacgaacaaacgcgaccgaacgaacgaacgcgaacttaccttactaatcgccgaacgaacgaactacgcgcgtccgccccactcgcactacacgctacaactaaccccgctctatttttctaaaactcaacgctaacttcaccgacactccgcgaacaaccaataaactacgatacccgccccctcattaacatacctctaaaaccgtccactctaacaacgcccgaccaacgaacgataccgaaaacgaaaccgaacccaaccgtaacaaaaaaaaacgtatacgcgaataaaaaacgaaaaaatatccgacgcccgactcctaacattataaacccgccgacctccgccgataacgaacgcgcgaacctaataaccctttccgtcctaaccgaaccgaacgctaacctaacgcgccttctaatccttcgaaaaaatcgcccacgaaaaacttaaaaaaaaccttaaacgtaaaataacaataataaattattt

SEQ ID NO: 33925 - DNA, 529 bp, Artificial Sequence
  chemically treated genomic DNA (Homo sapiens) CpG-island No: 33925
ttttcgtttgattttttttcgtttttaggtttttttcgattttttcgagtcgggacggttgaagcggtcggcgggagtttcggtatttcgggcgtatttatcgtggtgggtcggagggtatttttgtatcgtggttttgatcgagttttcgtagtagggcgggacgtggttgttttgatcgtcgatgttaaaaagtatatttatttttttcggtagcgggtattgcgtcgcgtttatgtaggagtggttgaggttcgggtggtgcgtgttcgggtgttgttcgttgagtacggcggggtggtggtggtttatttagcgcggttggttcgtcgttatttttatggtttcggttgtgttcgcgttttttcgtcgggttcggaattcgcgcgcgggagggagggttgttcgtttgggaagtcggggggtttttgtcgttcgagggtttggggtcgttgaatgatttgttttcggtggggggatgggaaggttgggaagtaaaggtgagtaaaggagaaggttttttaaaaat

SEQ ID NO: 33926 - DNA, 529 bp, Artificial Sequence
  chemically treated genomic DNA (Homo sapiens) CpG-island No: 33926
atttttaaaaaaccttctcctttactcacctttacttcccaaccttcccatccccccaccgaaaacaaatcattcaacgaccccaaaccctcgaacgacaaaaaccccccgacttcccaaacgaacaaccctccctcccgcgcgcgaattccgaacccgacgaaaaaacgcgaacacaaccgaaaccataaaaataacgacgaaccaaccgcgctaaataaaccaccaccaccccgccgtactcaacgaacaacacccgaacacgcaccacccgaacctcaaccactcctacataaacgcgacgcaatacccgctaccgaaaaaaataaatatactttttaacatcgacgatcaaaacaaccacgtcccgccctactacgaaaactcgatcaaaaccacgatacaaaaataccctccgacccaccacgataaatacgcccgaaataccgaaactcccgccgaccgcttcaaccgtcccgactcgaaaaaatcgaaaaaaacctaaaaacgaaaaaaaatcaaacgaaaa

SEQ ID NO: 33927 - DNA, 529 bp, Artificial Sequence
  chemically treated genomic DNA (Homo sapiens) CpG-island No: 33927
atttttaaaaaatttttttttttgtttatttttgttttttagtttttttatttttttatcgaaagtaaattatttaacgattttaggttttcggacggtaggagtttttcgattttttaggcggatagttttttttttcgcgcgcgggtttcgggttcggcgagagggcgcgagtatagtcgaggttatggaggtgacggcggattagtcgcgttgggtgagttattattatttcgtcgtgtttaacgggtagtattcggatacgtattattcgggttttagttatttttatatggacgcggcgtagtattcgttgtcggaggaggtggatgtgttttttaatatcgacggttaaggtaattacgtttcgttttattacggaaattcggttagggttacggtgtagaggtatttttcgatttattacggtgagtgcgttcggggtgtcggggttttcgtcggtcgttttagtcgtttcggttcggggaggtcgggagggatttgagggcggggagaggttaagcgaaag

SEQ ID NO: 33928 - DNA, 529 bp, Artificial Sequence
  chemically treated genomic DNA (Homo sapiens) CpG-island No: 33928
ctttcgcttaacctctccccgccctcaaatccctcccgacctccccgaaccgaaacgactaaaacgaccgacgaaaaccccgacaccccgaacgcactcaccgtaataaatcgaaaaatacctctacaccgtaaccctaaccgaatttccgtaataaaacgaaacgtaattaccttaaccgtcgatattaaaaaacacatccacctcctccgacaacgaatactacgccgcgtccatataaaaataactaaaacccgaataatacgtatccgaatactacccgttaaacacgacgaaataataataactcacccaacgcgactaatccgccgtcacctccataacctcgactatactcgcgccctctcgccgaacccgaaacccgcgcgcgaaaaaaaaaactatccgcctaaaaaatcgaaaaactcctaccgtccgaaaacctaaaatcgttaaataatttactttcgataaaaaaataaaaaaactaaaaaacaaaaataaacaaaaaaaaaaattttttaaaaat

SEQ ID NO: 33929 - DNA, 822 bp, Artificial Sequence
  chemically treated genomic DNA (Homo sapiens) CpG-island No: 33929
cgtttttttcggttattagcgtgaagtagatgtggcgttcggtgttttttacgtattttacggttttgatgcgggcgaagttgagttttttgggtcggtcgttcgtgtttttggtttcgaagagttgtagttcgcgttcggtgaggacgtagcgttttcgtttttatagttgtagtagttcgtcgttgcgtttttttagtacgttttttttgagtacggtagtcgtcgtcgtcgtcgttatgggcgtttcgaggttcgcggaaagttttaggttgcggcgggcgcggcgtttttttcggtttcgtagcgtaggattttggcgtttcgggttggtaggtcgtgcgcgttgtttatttgcgttttgattgtttcgcgtatttatatcgcggtttttagtattcggttgtcggtgaggtggtgtcggtgtttttagcgcgtttcgcgtttatcgtttcgttttagtcggtattcgttttttcgttttattttagttggtttagttcgattcgtttttgttagatgttttcgcgtttttttaggtcgtgagttttatcgttcgttcgtttttttgtttttttgggttttgtttgcgcgttgggcggtagttcgcgggatgtgtttttatatgtttcgtcgttcgttttttgcgtcgttcgttcgtagcgtatttttattttggtcggttttttttttcgcgtcgcgtattagtttcggtagggtttcgggggcggggtcgtagcgggggtttagttatttattggaggcgtagggcgcggggcggggagggtcgggattgagagggggttgtttatttaatagttt

SEQ ID NO: 33930 - DNA, 822 bp, Artificial Sequence
  chemically treated genomic DNA (Homo sapiens) CpG-island No: 33930
aaactattaaataaacaaccccctctcaatcccgaccctccccgccccgcgccctacgcctccaataaataactaaacccccgctacgaccccgcccccgaaaccctaccgaaactaatacgcgacgcgaaaaaaaaaaccgaccaaaataaaaatacgctacgaacgaacgacgcaaaaaacgaacgacgaaacatataaaaacacatcccgcgaactaccgcccaacgcgcaaacaaaacccaaaaaaacaaaaaaacgaacgaacgataaaactcacgacctaaaaaaacgcgaaaacatctaacaaaaacgaatcgaactaaaccaactaaaataaaacgaaaaaacgaataccgactaaaacgaaacgataaacgcgaaacgcgctaaaaacaccgacaccacctcaccgacaaccgaatactaaaaaccgcgatataaatacgcgaaacaatcaaaacgcaaataaacaacgcgcacgacctaccaacccgaaacgccaaaatcctacgctacgaaaccgaaaaaaacgccgcgcccgccgcaacctaaaactttccgcgaacctcgaaacgcccataacgacgacgacgacgactaccgtactcaaaaaaaacgtactaaaaaaacgcaacgacgaactactacaactataaaaacgaaaacgctacgtcctcaccgaacgcgaactacaactcttcgaaaccaaaaacacgaacgaccgacccaaaaaactcaacttcgcccgcatcaaaaccgtaaaatacgtaaaaaacaccgaacgccacatctacttcacgctaataaccgaaaaaaacg

SEQ ID NO: 33931 - DNA, 822 bp, Artificial Sequence
  chemically treated genomic DNA (Homo sapiens) CpG-island No: 33931
gggttgttgagtaagtagtttttttttagtttcggtttttttcgtttcgcgttttgcgtttttagtgagtgattgagttttcgttgcggtttcgttttcggggttttgtcggagttggtgcgcggcgcggaggggagggtcggttagggtaggaatgcgttgcgggcgggcggcgtaggaggcgagcggcggaatatgtaagggtatatttcgcgagttgtcgtttagcgcgtagatagagtttaggggagtaagagaacgggcgggcggtggggtttacggtttagggaggcgcggaggtatttggtagaggcgggtcgggttgggttagttggggtagagcggaggagcgggtgtcggttgaagcggggcggtgggcgcggagcgcgttgggggtatcgatattattttatcggtagtcgggtgttgagggtcgcggtgtgggtgcgcggagtagttagggcgtaggtgggtagcgcgtacggtttgttagttcggggcgttagaattttgcgttgcggggtcgagaggggcgtcgcgttcgtcgtagtttggagtttttcgcgaatttcggggcgtttatgacggcggcggcgacggttatcgtgtttaaggagggcgtgttggagaagcgtagcggcgggttgttgtagttgtggaagcggaagcgttgcgtttttatcgaacgcgggttgtagtttttcgaggttaagggtacgggcggtcggtttaaggagtttagtttcgttcgtattaaggtcgtggagtgcgtggagagtatcgggcgttatatttattttacgttggtgatcgaagggggcg

SEQ ID NO: 33932 - DNA, 822 bp, Artificial Sequence
  chemically treated genomic DNA (Homo sapiens) CpG-island No: 33932
cgcccccttcgatcaccaacgtaaaataaatataacgcccgatactctccacgcactccacgaccttaatacgaacgaaactaaactccttaaaccgaccgcccgtacccttaacctcgaaaaactacaacccgcgttcgataaaaacgcaacgcttccgcttccacaactacaacaacccgccgctacgcttctccaacacgccctccttaaacacgataaccgtcgccgccgccgtcataaacgccccgaaattcgcgaaaaactccaaactacgacgaacgcgacgcccctctcgaccccgcaacgcaaaattctaacgccccgaactaacaaaccgtacgcgctacccacctacgccctaactactccgcgcacccacaccgcgaccctcaacacccgactaccgataaaataatatcgatacccccaacgcgctccgcgcccaccgccccgcttcaaccgacacccgctcctccgctctaccccaactaacccaacccgacccgcctctaccaaatacctccgcgcctccctaaaccgtaaaccccaccgcccgcccgttctcttactcccctaaactctatctacgcgctaaacgacaactcgcgaaatatacccttacatattccgccgctcgcctcctacgccgcccgcccgcaacgcattcctaccctaaccgaccctcccctccgcgccgcgcaccaactccgacaaaaccccgaaaacgaaaccgcaacgaaaactcaatcactcactaaaaacgcaaaacgcgaaacgaaaaaaaccgaaactaaaaaaaaactacttactcaacaaccc

SEQ ID NO: 33933 - DNA, 603 bp, Artificial Sequence
  chemically treated genomic DNA (Homo sapiens) CpG-island No: 33933
gtagtcggcgtgtgtttggggtagcgggttacgaggtttcgtttcggtcgtcgttttcgaggggacggtattttgtttaggatgtcgtttttttttttattgtggggtcggggtcggcggttgttttagtgcggggttcgaggttggagtgcgcggcggacgttaagtttggtgcgaggggtcgaggcggtttggggagtttcgggaaattttgtgttcgcgagaagcggatttcgtattcgcgttgtttttggggatgcgcgattttgcgcggttgcggcgcggattcggagttcgggcgggtaggcgtttcggtgagtggtcggcgcggggcggtcgcgcggtcgcggcgttgagggtttggcgtttttcgttttgcgaggtttggttggtaggttttgcgaggtcgagattaagtttcggggtaggggaggttggtgttcgagggagttgtgggttgggttcgggagaggcgttggaataaataataattaagatgttcgcggtttttcggaaaggtgtgtgttttttcgatttttatgggattgattgcgcgtttgattttagagttgatttttcgggggggttgtttaattttagttt

SEQ ID NO: 33934 - DNA, 603 bp, Artificial Sequence
  chemically treated genomic DNA (Homo sapiens) CpG-island No: 33934
aaactaaaattaaacaacccccccgaaaaatcaactctaaaatcaaacgcgcaatcaatcccataaaaatcgaaaaaacacacacctttccgaaaaaccgcgaacatcttaattattatttattccaacgcctctcccgaacccaacccacaactccctcgaacaccaacctcccctaccccgaaacttaatctcgacctcgcaaaacctaccaaccaaacctcgcaaaacgaaaaacgccaaaccctcaacgccgcgaccgcgcgaccgccccgcgccgaccactcaccgaaacgcctacccgcccgaactccgaatccgcgccgcaaccgcgcaaaatcgcgcatccccaaaaacaacgcgaatacgaaatccgcttctcgcgaacacaaaatttcccgaaactccccaaaccgcctcgacccctcgcaccaaacttaacgtccgccgcgcactccaacctcgaaccccgcactaaaacaaccgccgaccccgaccccacaataaaaaaaaaaacgacatcctaaacaaaataccgtcccctcgaaaacgacgaccgaaacgaaacctcgtaacccgctaccccaaacacacgccgactac

SEQ ID NO: 33935 - DNA, 603 bp, Artificial Sequence
  chemically treated genomic DNA (Homo sapiens) CpG-island No: 33935
ggattgaagttaggtagttttttcggagagttaattttagaattaaacgcgtagttagttttataggggtcgaaagggtatatattttttcgggaagtcgcgagtattttggttgttatttattttagcgtttttttcgagtttagtttatagttttttcgggtattaattttttttatttcgagatttggtttcggtttcgtaggatttgttagttaagtttcgtaaaacgggaagcgttagatttttagcgtcgcgatcgcgcgatcgtttcgcgtcggttatttatcggagcgtttgttcgttcgggtttcgggttcgcgtcgtagtcgcgtagagtcgcgtatttttaagggtagcgcgggtgcggggttcgtttttcgcgagtataaagtttttcggggttttttaggtcgtttcggtttttcgtattaggtttggcgttcgtcgcgtattttagtttcgggtttcgtattagggtagtcgtcggtttcggttttataatgaggagggaggcggtattttgaataaagtgtcgttttttcgggaacggcggtcggggcggagtttcgtgattcgttgttttaggtatacgtcggttgt

SEQ ID NO: 33936 - DNA, 603 bp, Artificial Sequence
  chemically treated genomic DNA (Homo sapiens) CpG-island No: 33936
acaaccgacgtatacctaaaacaacgaatcacgaaactccgccccgaccgccgttcccgaaaaaacgacactttattcaaaataccgcctccctcctcattataaaaccgaaaccgacgactaccctaatacgaaacccgaaactaaaatacgcgacgaacgccaaacctaatacgaaaaaccgaaacgacctaaaaaaccccgaaaaactttatactcgcgaaaaacgaaccccgcacccgcgctacccttaaaaatacgcgactctacgcgactacgacgcgaacccgaaacccgaacgaacaaacgctccgataaataaccgacgcgaaacgatcgcgcgatcgcgacgctaaaaatctaacgcttcccgttttacgaaacttaactaacaaatcctacgaaaccgaaaccaaatctcgaaataaaaaaaattaatacccgaaaaaactataaactaaactcgaaaaaaacgctaaaataaataacaaccaaaatactcgcgacttcccgaaaaaatatataccctttcgacccctataaaactaactacgcgtttaattctaaaattaactctccgaaaaaactacctaacttcaatcc

SEQ ID NO: 33937 - DNA, 739 bp, Artificial Sequence
  chemically treated genomic DNA (Homo sapiens) CpG-island No: 33937
ggcggcggcggcgttgggagggggacgtcggtggtcgggtttcgtattttttttagttttcggtcggcggtcgggttaacggcggcggcggtttttttttcggtttttgtcggtttcgtcgcgttttatgttcgggttagggcgttagttttcgggggtttttcgtgcgtttcgcggggtttgcgtttggatggttcggcgggatttcgcgttgtatttttcgacgagttcgggtttttattgttttttgagttagattcgttttcgggttattttgagtatcgcgggttgtcgtcgcgtttttatttgcgtttcgggtatttattatttgcgttcgggggtttcgcggcgtttttggttttgtcgggtttcgggtttcggagtcggggtgtttttttcgtttttatgggatcgtttatttgcgttcgcgtagtcgtgcgtttcgatttcggttcggtttcggcggttttcgacggtttcgcgtcgttcgttcgcgtttcgcgttttcgtcgcggttgttgtttgtcgtcgcggtttcgggtttagtttcgcgttttttcgttttttcggcgggcgggcgagttttgtagattcgcggcggcggtttattattatagatttgttcgcgtcgcggtcgttttaaagcggtaacgtcggtcgcgttggaggaggtgggttttatttagagtattttttcgtttaaagcgttaggattttttttagtaggattttttatttt

SEQ ID NO: 33938 - DNA, 739 bp, Artificial Sequence
  chemically treated genomic DNA (Homo sapiens) CpG-island No: 33938
aaaataaaaaatcctactaaaaaaaatcctaacgctttaaacgaaaaaatactctaaataaaacccacctcctccaacgcgaccgacgttaccgctttaaaacgaccgcgacgcgaacaaatctataataataaaccgccgccgcgaatctacaaaactcgcccgcccgccgaaaaaacgaaaaaacgcgaaactaaacccgaaaccgcgacgacaaacaacaaccgcgacgaaaacgcgaaacgcgaacgaacgacgcgaaaccgtcgaaaaccgccgaaaccgaaccgaaatcgaaacgcacgactacgcgaacgcaaataaacgatcccataaaaacgaaaaaaacaccccgactccgaaacccgaaacccgacaaaaccaaaaacgccgcgaaacccccgaacgcaaataataaatacccgaaacgcaaataaaaacgcgacgacaacccgcgatactcaaaataacccgaaaacgaatctaactcaaaaaacaataaaaacccgaactcgtcgaaaaatacaacgcgaaatcccgccgaaccatccaaacgcaaaccccgcgaaacgcacgaaaaacccccgaaaactaacgccctaacccgaacataaaacgcgacgaaaccgacaaaaaccgaaaaaaaaaccgccgccgccgttaacccgaccgccgaccgaaaactaaaaaaaatacgaaacccgaccaccgacgtccccctcccaacgccgccgccgcc

SEQ ID NO: 33939 - DNA, 739 bp, Artificial Sequence
  chemically treated genomic DNA (Homo sapiens) CpG-island No: 33939
gggatggagggttttgttggagggaattttggcgttttgggcggaggagtgttttgggtggggtttattttttttagcgcggtcggcgttgtcgttttaaggcggtcgcggcgcgagtaggtttatggtaatgagtcgtcgtcgcgagtttgtagagttcgttcgttcgtcggggaggcgagggagcgcggggttgggttcggggtcgcggcgataggtagtagtcgcggcggggacgcggggcgcgagcgggcggcgcgggatcgtcgggggtcgtcggggtcgggtcggggtcggggcgtacggttacgcgggcgtaggtgggcgattttataggggcggagggggtatttcggtttcggaattcggggttcggtaaggttaggggcgtcgcggggttttcgggcgtaggtggtgagtgttcggagcgtaggtggaggcgcggcggtagttcgcggtgtttagggtgattcgggagcgggtttggtttagggggtagtgggagttcgggttcgtcggagggtgtagcgcggggtttcgtcgagttatttagacgtaggtttcgcggggcgtacgggaggttttcggggattggcgttttggttcgggtatgaggcgcggcggggtcggtaggagtcggaggaggagtcgtcgtcgtcgttgattcggtcgtcggtcgggagttgggagagatgcggagttcggttatcggcgttttttttttaacgtcgtcgtcgtt

SEQ ID NO: 33940 - DNA, 739 bp, Artificial Sequence
  chemically treated genomic DNA (Homo sapiens) CpG-island No: 33940
aacgacgacgacgttaaaaaaaaaacgccgataaccgaactccgcatctctcccaactcccgaccgacgaccgaatcaacgacgacgacgactcctcctccgactcctaccgaccccgccgcgcctcatacccgaaccaaaacgccaatccccgaaaacctcccgtacgccccgcgaaacctacgtctaaataactcgacgaaaccccgcgctacaccctccgacgaacccgaactcccactaccccctaaaccaaacccgctcccgaatcaccctaaacaccgcgaactaccgccgcgcctccacctacgctccgaacactcaccacctacgcccgaaaaccccgcgacgcccctaaccttaccgaaccccgaattccgaaaccgaaataccccctccgcccctataaaatcgcccacctacgcccgcgtaaccgtacgccccgaccccgacccgaccccgacgacccccgacgatcccgcgccgcccgctcgcgccccgcgtccccgccgcgactactacctatcgccgcgaccccgaacccaaccccgcgctccctcgcctccccgacgaacgaacgaactctacaaactcgcgacgacgactcattaccataaacctactcgcgccgcgaccgccttaaaacgacaacgccgaccgcgctaaaaaaaataaaccccacccaaaacactcctccgcccaaaacgccaaaattccctccaacaaaaccctccatccc

SEQ ID NO: 33941 - DNA, 507 bp, Artificial Sequence
  chemically treated genomic DNA (Homo sapiens) CpG-island No: 33941
ggtgagcgtcgcgtcggggtgagagtatgcgttggatttaggaggttgtgtacgttaacggtcgtgttaggcgcgagtgtgttagagaagtgtgtgaacgcgggaacgtttgtgtcgttttagggtggtgatagaagtagtgtttggaaaacgttggttgagagcgcgtgtattaggttatcgtaggttgcgaagaagtcggggttttttattttaagggtttcgggagttggtatcgacgtattattgtaagcgcgttcgcgtttagtttttttttatcgacgcggtttttttcggtttttttatcgttcgttcggcggtgttcggtttttgggttgttaggttacggcgggggcgcggcgcgcggggcgttcgttgaaagataacgggcggtcgaggtttcgttgttttgggttgggttgcgtcgcgttggattgggttgcgttgggttgcgcgttcggttttcgcgcggttcggtagcgttcgcgcgttcggtttcgttcggtt

SEQ ID NO: 33942 - DNA, 507 bp, Artificial Sequence
  chemically treated genomic DNA (Homo sapiens) CpG-island No: 33942
aaccgaacgaaaccgaacgcgcgaacgctaccgaaccgcgcgaaaaccgaacgcgcaacccaacgcaacccaatccaacgcgacgcaacccaacccaaaacaacgaaacctcgaccgcccgttatctttcaacgaacgccccgcgcgccgcgcccccgccgtaacctaacaacccaaaaaccgaacaccgccgaacgaacgataaaaaaaccgaaaaaaaccgcgtcgataaaaaaaaactaaacgcgaacgcgcttacaataatacgtcgataccaactcccgaaacccttaaaataaaaaaccccgacttcttcgcaacctacgataacctaatacacgcgctctcaaccaacgttttccaaacactacttctatcaccaccctaaaacgacacaaacgttcccgcgttcacacacttctctaacacactcgcgcctaacacgaccgttaacgtacacaacctcctaaatccaacgcatactctcaccccgacgcgacgctcacc

SEQ ID NO: 33943 - DNA, 507 bp, Artificial Sequence
  chemically treated genomic DNA (Homo sapiens) CpG-island No: 33943
agtcgggcggagtcgagcgcgcgggcgttgtcgagtcgcgcggaggtcgggcgcgtagtttagcgtagtttagtttagcgcggcgtagtttagtttagagtagcggagtttcggtcgttcgttgttttttaacgagcgtttcgcgcgtcgcgttttcgtcgtggtttggtagtttagggatcgggtatcgtcgagcgggcggtagagggatcggagggagtcgcgtcggtgggagagggttgggcgcgggcgcgtttgtagtagtgcgtcggtgttaattttcgggatttttggagtgaggggtttcggttttttcgtagtttgcggtggtttgatgtacgcgtttttagttagcgttttttagatattatttttgttattattttagggcgatataagcgttttcgcgtttatatatttttttggtatattcgcgtttggtacggtcgttggcgtgtatagttttttgagtttagcgtatatttttatttcggcgcggcgtttatt

SEQ ID NO: 33944 - DNA, 507 bp, Artificial Sequence
  chemically treated genomic DNA (Homo sapiens) CpG-island No: 33944
aataaacgccgcgccgaaataaaaatatacgctaaactcaaaaaactatacacgccaacgaccgtaccaaacgcgaatataccaaaaaaatatataaacgcgaaaacgcttatatcgccctaaaataataacaaaaataatatctaaaaaacgctaactaaaaacgcgtacatcaaaccaccgcaaactacgaaaaaaccgaaacccctcactccaaaaatcccgaaaattaacaccgacgcactactacaaacgcgcccgcgcccaaccctctcccaccgacgcgactccctccgatccctctaccgcccgctcgacgatacccgatccctaaactaccaaaccacgacgaaaacgcgacgcgcgaaacgctcgttaaaaaacaacgaacgaccgaaactccgctactctaaactaaactacgccgcgctaaactaaactacgctaaactacgcgcccgacctccgcgcgactcgacaacgcccgcgcgctcgactccgcccgact

SEQ ID NO: 33945 - DNA, 703 bp, Artificial Sequence
  chemically treated genomic DNA (Homo sapiens) CpG-island No: 33945
taagcgcggtttattttttttttacggtagggtaggcggggttgttgcgcgggttttaggtttaggttcgcgggtcgtcggttgtggatgtcgttttggtagtttgggttcggggtggttttggcggtaggagtttggttattcgtatatcgcgtttcgtagttcgtttttcgtgcgggtggtttaggagtttggagggtcgtggtagtttcgagcgatggttgttgagttttcgggttttagggcgtttaggcgtgcgtcgtgatttcgttaggttgtgttacggagttttttcgttgttgttcgcgttgtttagtttgtaggtcgaaggttttggatttattcgttttggagatgcgtcgagtttttcgtaatttcggtgtatttgtcgtcggggtagtcgggtttaaggatttagtcgtagtttttatttacgttcgtttattgtttcggttcgaggcgttgcgggattttagatttagcgaggagggcgtcgttttttttttgtatattcgtatttttgtcgtttcgaattcggtttattttcggtaacggagtattttagcgtagtttcgttaattttattttttgagggagggatagtcgttttcgttcgtcgtttatagttttgtttttttcggttttttttaacgtttttttttacgaggacgggttagtcgtatagtttagttttttttgttaa

SEQ ID NO: 33946 - DNA, 703 bp, Artificial Sequence
  chemically treated genomic DNA (Homo sapiens) CpG-island No: 33946
ttaacaaaaaaaactaaactatacgactaacccgtcctcgtaaaaaaaaacgttaaaaaaaaccgaaaaaaacaaaactataaacgacgaacgaaaacgactatccctccctcaaaaaataaaattaacgaaactacgctaaaatactccgttaccgaaaataaaccgaattcgaaacgacaaaaatacgaatatacaaaaaaaaaacgacgccctcctcgctaaatctaaaatcccgcaacgcctcgaaccgaaacaataaacgaacgtaaataaaaactacgactaaatccttaaacccgactaccccgacgacaaatacaccgaaattacgaaaaactcgacgcatctccaaaacgaataaatccaaaaccttcgacctacaaactaaacaacgcgaacaacaacgaaaaaactccgtaacacaacctaacgaaatcacgacgcacgcctaaacgccctaaaacccgaaaactcaacaaccatcgctcgaaactaccacgaccctccaaactcctaaaccacccgcacgaaaaacgaactacgaaacgcgatatacgaataaccaaactcctaccgccaaaaccaccccgaacccaaactaccaaaacgacatccacaaccgacgacccgcgaacctaaacctaaaacccgcgcaacaaccccgcctaccctaccgtaaaaaaaaaataaaccgcgctta

SEQ ID NO: 33947 - DNA, 703 bp, Artificial Sequence
  chemically treated genomic DNA (Homo sapiens) CpG-island No: 33947
ttgatagggagggttgggttgtgcggttggttcgttttcgtgaagaggagcgttgggaggagtcgggagagataaggttatgggcggcgggcggggacggttgttttttttttaaggagtggagttagcgaggttgcgttggggtgtttcgttgtcgaggatgggtcgagttcgaggcggtaaaggtgcgggtgtgtaggggggaggcggcgtttttttcgttgggtttggggtttcgtagcgtttcgggtcggagtagtgagcgagcgtgggtgggagttgcggttgggtttttgagttcggttgtttcgacggtaggtgtatcggggttgcgggggattcggcgtatttttagggcgagtgagtttagggttttcggtttataggttgagtaacgcggataatagcgagggggtttcgtggtatagtttggcggggttacggcgtacgtttgggcgttttggagttcggagatttagtagttatcgttcggggttattacggttttttaggtttttgagttattcgtacggaggacgagttgcggagcgcggtgtgcggatagttaagtttttgtcgttaaggttatttcgagtttaggttgttagggcggtatttatagtcggcggttcgcgggtttgggtttgagattcgcgtagtagtttcgtttgttttgtcgtgagagggaagtagatcgcgtttg

SEQ ID NO: 33948 - DNA, 703 bp, Artificial Sequence
  chemically treated genomic DNA (Homo sapiens) CpG-island No: 33948
caaacgcgatctacttccctctcacgacaaaacaaacgaaactactacgcgaatctcaaacccaaacccgcgaaccgccgactataaataccgccctaacaacctaaactcgaaataaccttaacgacaaaaacttaactatccgcacaccgcgctccgcaactcgtcctccgtacgaataactcaaaaacctaaaaaaccgtaataaccccgaacgataactactaaatctccgaactccaaaacgcccaaacgtacgccgtaaccccgccaaactataccacgaaaccccctcgctattatccgcgttactcaacctataaaccgaaaaccctaaactcactcgccctaaaaatacgccgaatcccccgcaaccccgatacacctaccgtcgaaacaaccgaactcaaaaacccaaccgcaactcccacccacgctcgctcactactccgacccgaaacgctacgaaaccccaaacccaacgaaaaaaacgccgcctcccccctacacacccgcacctttaccgcctcgaactcgacccatcctcgacaacgaaacaccccaacgcaacctcgctaactccactccttaaaaaaaaaacaaccgtccccgcccgccgcccataaccttatctctcccgactcctcccaacgctcctcttcacgaaaacgaaccaaccgcacaacccaaccctccctatcaa

SEQ ID NO: 33949 - DNA, 681 bp, Artificial Sequence
  chemically treated genomic DNA (Homo sapiens) CpG-island No: 33949
tcgttttttttttttttacggtttcgtttttttgcgcggtttcgagcggttcgtttttcgttatcgtcgtagttttttacgggcgtagaattcgtttttcgttttttttttcgttttcggcgttttttttttttttttttcgttattcgtttttatatttcgtcgatttttttttcggcgggtggttcggaatatacgtgatttttttgttaggttttataaggcgcggaatcgaaagcggtcgtcgggtggttacgggtatcgggcggtcgcgcggaaaggagcggtttttttcggggtcgggcgcgcggagagcggcgaggaaagttcgggttgggttgggttaggttggttatcgcgttggcgacgggagtagacgcgggtttcgggagacgttttttagcgtttttgtttttcgttttcgtcgtttttcggtgtagttcgtattcgtttttttttaaacgttggcggttcgcgttgtaggcgtttttttttttgggggtgttgaggtttgagcgaaattttattggatagtaatcggttttagcggagcgaaaatttagtcgtattttagttacgttttagggtaagttgcgtcgggtatcgttttttttttgtgacgtttaaaagaatgtagatgggttattaattataggagaggttaaatttgagggcgtgttt

SEQ ID NO: 33950 - DNA, 681 bp, Artificial Sequence
  chemically treated genomic DNA (Homo sapiens) CpG-island No: 33950
aaacacgccctcaaatttaacctctcctataattaataacccatctacattcttttaaacgtcacaaaaaaaaaacgatacccgacgcaacttaccctaaaacgtaactaaaatacgactaaattttcgctccgctaaaaccgattactatccaataaaatttcgctcaaacctcaacacccccaaaaaaaaaaacgcctacaacgcgaaccgccaacgtttaaaaaaaaacgaatacgaactacaccgaaaaacgacgaaaacgaaaaacaaaaacgctaaaaaacgtctcccgaaacccgcgtctactcccgtcgccaacgcgataaccaacctaacccaacccaacccgaactttcctcgccgctctccgcgcgcccgaccccgaaaaaaaccgctcctttccgcgcgaccgcccgatacccgtaaccacccgacgaccgctttcgattccgcgccttataaaacctaacaaaaaaatcacgtatattccgaaccacccgccgaaaaaaaaatcgacgaaatataaaaacgaataacgaaaaaaaaaaaaaaaaaacgccgaaaacgaaaaaaaaaacgaaaaacgaattctacgcccgtaaaaaactacgacgataacgaaaaacgaaccgctcgaaaccgcgcaaaaaaacgaaaccgtaaaaaaaaaaaaaacga

SEQ ID NO: 33951 - DNA, 681 bp, Artificial Sequence
  chemically treated genomic DNA (Homo sapiens) CpG-island No: 33951
aagtacgtttttaagtttaattttttttgtagttggtaatttatttgtatttttttgaacgttataaggaagaaacggtgttcggcgtagtttgttttggagcgtagttggagtgcggttgagttttcgtttcgttgaagtcggttattgtttagtgggatttcgtttaagttttagtatttttaggaggggaggcgtttgtagcgcgggtcgttagcgtttggagggaggcgggtgcgggttgtatcgggagacggcgagagcgagagataggggcgttgggaggcgtttttcgggattcgcgtttgttttcgtcgttagcgcggtggttagtttagtttagtttagttcgggtttttttcgtcgtttttcgcgcgttcggtttcgggggaggtcgttttttttcgcgcggtcgttcggtgttcgtgattattcggcggtcgttttcggtttcgcgttttataaggtttgataggggggttacgtgtgtttcgggttattcgtcgggaggagggtcgacggggtgtaagggcgggtagcggggaggaaaaggggagggcgtcgggggcggaggaaggagcgaggggcggattttgcgttcgtgggaggttgcggcggtggcggggagcggatcgttcggagtcgcgtaggggagcgggatcgtggagaaggaggaggcgg

SEQ ID NO: 33952 - DNA, 681 bp, Artificial Sequence
  chemically treated genomic DNA (Homo sapiens) CpG-island No: 33952
ccgcctcctccttctccacgatcccgctcccctacgcgactccgaacgatccgctccccgccaccgccgcaacctcccacgaacgcaaaatccgcccctcgctccttcctccgcccccgacgccctccccttttcctccccgctacccgcccttacaccccgtcgaccctcctcccgacgaataacccgaaacacacgtaacccccctatcaaaccttataaaacgcgaaaccgaaaacgaccgccgaataatcacgaacaccgaacgaccgcgcgaaaaaaaacgacctcccccgaaaccgaacgcgcgaaaaacgacgaaaaaaacccgaactaaactaaactaaactaaccaccgcgctaacgacgaaaacaaacgcgaatcccgaaaaacgcctcccaacgcccctatctctcgctctcgccgtctcccgatacaacccgcacccgcctccctccaaacgctaacgacccgcgctacaaacgcctcccctcctaaaaatactaaaacttaaacgaaatcccactaaacaataaccgacttcaacgaaacgaaaactcaaccgcactccaactacgctccaaaacaaactacgccgaacaccgtttcttccttataacgttcaaaaaaatacaaataaattaccaactacaaaaaaaattaaacttaaaaacgtactt

SEQ ID NO: 33953 - DNA, 701 bp, Artificial Sequence
  chemically treated genomic DNA (Homo sapiens) CpG-island No: 33953
atggtaggggtcggaggttagtattatttttcgggtatcgttggaggagcggtcgtcggagtcggcgtcgcggttattttcgtcgttgtttcggcggggtcgggagaggattcgtttgatagcgaagcggagtaagagggattttagaaattgattcgtaaagtgtttatttcggggtagattcggattaaggtagggcggaggaggcgggtttgagggtcgcgtggaaagcgggaggtggagagggcgcgggggcgttggaacgcgtcgggcgatttcgggaaggcggggaaggcggggaaggcggggaaggcggggaaggcggggaaggcggggaaggcggggaaggcggggaaggcggggatggtgagacggtgaggcggggcggggtttggggcgcgggcggagcggggaggggtggggcggggttcgggggcgttggatcgcggtgttgcgggacggattttcggcggttgcgcgggaggttgttagtttgggtttttagggagttcgattggtagaggcgggtgtagggaattcgcggttcggcgggagcgtgggaaaaagttgacgcgtagtcgcgagtttttatttagggaatttaaaaggagagttttaattttttttttttgtcgttcggaggagcgtgcgtatgtgttggttaattagtttgcgttgtagtgagttttgttgttttttta

SEQ ID NO: 33954 - DNA, 701 bp, Artificial Sequence
  chemically treated genomic DNA (Homo sapiens) CpG-island No: 33954
taaaaaaacaacaaaactcactacaacgcaaactaattaaccaacacatacgcacgctcctccgaacgacaaaaaaaaaaaattaaaactctccttttaaattccctaaataaaaactcgcgactacgcgtcaactttttcccacgctcccgccgaaccgcgaattccctacacccgcctctaccaatcgaactccctaaaaacccaaactaacaacctcccgcgcaaccgccgaaaatccgtcccgcaacaccgcgatccaacgcccccgaaccccgccccacccctccccgctccgcccgcgccccaaaccccgccccgcctcaccgtctcaccatccccgccttccccgccttccccgccttccccgccttccccgccttccccgccttccccgccttccccgccttccccgccttcccgaaatcgcccgacgcgttccaacgcccccgcgccctctccacctcccgctttccacgcgaccctcaaacccgcctcctccgccctaccttaatccgaatctaccccgaaataaacactttacgaatcaatttctaaaatccctcttactccgcttcgctatcaaacgaatcctctcccgaccccgccgaaacaacgacgaaaataaccgcgacgccgactccgacgaccgctcctccaacgatacccgaaaaataatactaacctccgacccctaccat

SEQ ID NO: 33955 - DNA, 701 bp, Artificial Sequence
  chemically treated genomic DNA (Homo sapiens) CpG-island No: 33955
tgggaaagtagtagggtttattgtagcgtaggttggttggttagtatatgcgtacgttttttcgaacggtagggaagaaaaattgaaattttttttttaagttttttaagtaggaattcgcgattgcgcgttagtttttttttacgttttcgtcgagtcgcgggttttttgtattcgtttttgttagtcgaattttttgggagtttaggttagtagtttttcgcgtagtcgtcgggaattcgtttcgtagtatcgcggtttagcgttttcgggtttcgttttattttttttcgtttcgttcgcgttttaggtttcgtttcgttttatcgttttattattttcgtttttttcgtttttttcgtttttttcgtttttttcgtttttttcgtttttttcgtttttttcgtttttttcgttttttcgggatcgttcggcgcgttttagcgttttcgcgttttttttatttttcgttttttacgcggtttttaggttcgtttttttcgttttattttggttcggatttgtttcgaggtagatattttgcggattagtttttggggttttttttgtttcgtttcgttgttagacgaattttttttcggtttcgtcgaggtagcggcggaagtgatcgcggcgtcggtttcggcggtcgtttttttagcggtgttcggagggtggtgttggttttcggtttttgttat

SEQ ID NO: 33956 - DNA, 701 bp, Artificial Sequence
  chemically treated genomic DNA (Homo sapiens) CpG-island No: 33956
ataacaaaaaccgaaaaccaacaccaccctccgaacaccgctaaaaaaacgaccgccgaaaccgacgccgcgatcacttccgccgctacctcgacgaaaccgaaaaaaaattcgtctaacaacgaaacgaaacaaaaaaaaccccaaaaactaatccgcaaaatatctacctcgaaacaaatccgaaccaaaataaaacgaaaaaaacgaacctaaaaaccgcgtaaaaaacgaaaaataaaaaaaacgcgaaaacgctaaaacgcgccgaacgatcccgaaaaaacgaaaaaaacgaaaaaaacgaaaaaaacgaaaaaaacgaaaaaaacgaaaaaaacgaaaaaaacgaaaaaaacgaaaataataaaacgataaaacgaaacgaaacctaaaacgcgaacgaaacgaaaaaaaataaaacgaaacccgaaaacgctaaaccgcgatactacgaaacgaattcccgacgactacgcgaaaaactactaacctaaactcccaaaaaattcgactaacaaaaacgaatacaaaaaacccgcgactcgacgaaaacgtaaaaaaaaactaacgcgcaatcgcgaattcctacttaaaaaacttaaaaaaaaaatttcaatttttcttccctaccgttcgaaaaaacgtacgcatatactaaccaaccaacctacgctacaataaaccctactactttccca

SEQ ID NO: 33957 - DNA, 726 bp, Artificial Sequence
  chemically treated genomic DNA (Homo sapiens) CpG-island No: 33957
tagttcgcgcggttatcgagaggaagtattatttattttttttttttttaaagagtttgtcgattatattatttaattaaaatggtagcggcgattacgttacggagtttttcgtagtaacgggtttggggttcggaggcggcgttgagtttttgttacgacgcgttattcgggttattttgagagaacgcggtagtcgcggtttcgttgtttttttttcgttttatattattttttataggatttttaagtttttatttattaggttttagggttaggattcgattcggttggttcggtcgtcgtcgtcgaggttgtttcgtatttttttggtcgtcgtttttaagttcgtttttaatgagtagttggttgagattcgtttttagtttagcgtttgttcggagacgttgtttaggtagttattattttttttattgttattaagtagcgataggaaacgattgtttataataggaagtgatgatgtcgcgtttcggtatcgtagttttatttttagtttattagttaattttagtcgatttttcgaaaaggtttcgcgggaggaggagggggacggtagacgacgcggtaaggcgggcggcggtttggaaaaggaaagttgttatgacgtttattatgtgataggttttattttttttcgttattttgaattgtggcgagaaatttgcgttttgagaattgtgggaattttcgtttttttatttt

SEQ ID NO: 33958 - DNA, 726 bp, Artificial Sequence
  chemically treated genomic DNA (Homo sapiens) CpG-island No: 33958
aaaataaaaaaacgaaaattcccacaattctcaaaacgcaaatttctcgccacaattcaaaataacgaaaaaaaataaaacctatcacataataaacgtcataacaactttccttttccaaaccgccgcccgccttaccgcgtcgtctaccgtccccctcctcctcccgcgaaaccttttcgaaaaatcgactaaaattaactaataaactaaaaataaaactacgataccgaaacgcgacatcatcacttcctattataaacaatcgtttcctatcgctacttaataacaataaaaaaaataataactacctaaacaacgtctccgaacaaacgctaaactaaaaacgaatctcaaccaactactcattaaaaacgaacttaaaaacgacgaccaaaaaaatacgaaacaacctcgacgacgacgaccgaaccaaccgaatcgaatcctaaccctaaaacctaataaataaaaacttaaaaatcctataaaaaataatataaaacgaaaaaaaaacaacgaaaccgcgactaccgcgttctctcaaaataacccgaataacgcgtcgtaacaaaaactcaacgccgcctccgaaccccaaacccgttactacgaaaaactccgtaacgtaatcgccgctaccattttaattaaataatataatcgacaaactctttaaaaaaaaaaaaaataaataatacttcctctcgataaccgcgcgaacta

SEQ ID NO: 33959 - DNA, 726 bp, Artificial Sequence
  chemically treated genomic DNA (Homo sapiens) CpG-island No: 33959
aaaatgggaaagcgaaggtttttataatttttagaacgtaaatttttcgttataatttaaaatggcggaggagggtggggtttgttatatggtgggcgttataatagttttttttttttaaatcgtcgttcgttttgtcgcgtcgtttgtcgtttttttttttttttcgcggagttttttcgaggaatcgattgggattggttaataggttgggagtggggttgcggtgtcgggacgcggtattattattttttgttgtgggtagtcgttttttgtcgttgtttggtaataatggggaagataatggttgtttgagtaacgttttcgagtaggcgttgggttagaggcgggttttaattagttatttattggaggcgggtttgagagcggcggttagggaggtgcggagtagtttcggcggcggcggtcgaattaatcgagtcggattttgattttaaaatttagtaagtgaagatttgggaattttgtgagaaatgatgtagagcgagaggaagatagcggagtcgcggttgtcgcgtttttttaaaatggttcgagtgacgcgtcgtggtagaggtttagcgtcgttttcggattttaggttcgttgttgcggggggtttcgtggcgtagtcgtcgttgttattttagttgagtggtatagtcgataggttttttgaaggggaaggaggtgggtagtattttttttcggtggtcgcgcgagttg

SEQ ID NO: 33960 - DNA, 726 bp, Artificial Sequence
  chemically treated genomic DNA (Homo sapiens) CpG-island No: 33960
caactcgcgcgaccaccgaaaaaaaatactacccacctccttccccttcaaaaaacctatcgactataccactcaactaaaataacaacgacgactacgccacgaaaccccccgcaacaacgaacctaaaatccgaaaacgacgctaaacctctaccacgacgcgtcactcgaaccattttaaaaaaacgcgacaaccgcgactccgctatcttcctctcgctctacatcatttctcacaaaattcccaaatcttcacttactaaattttaaaatcaaaatccgactcgattaattcgaccgccgccgccgaaactactccgcacctccctaaccgccgctctcaaacccgcctccaataaataactaattaaaacccgcctctaacccaacgcctactcgaaaacgttactcaaacaaccattatcttccccattattaccaaacaacgacaaaaaacgactacccacaacaaaaaataataataccgcgtcccgacaccgcaaccccactcccaacctattaaccaatcccaatcgattcctcgaaaaaactccgcgaaaaaaaaaaaaaaacgacaaacgacgcgacaaaacgaacgacgatttaaaaaaaaaaaactattataacgcccaccatataacaaaccccaccctcctccgccattttaaattataacgaaaaatttacgttctaaaaattataaaaaccttcgctttcccatttt

SEQ ID NO: 33961 - DNA, 563 bp, Artificial Sequence
  chemically treated genomic DNA (Homo sapiens) CpG-island No: 33961
agtttcgtttcgttttaggaggcgggttcggtcgcgcggtgtattaattcgagagtttcgagtcgtttttgtttttcgcgagttttattttacgttatcgtttattaatcgcgttgcgcgttcgtttagtcgggtcgcgtaatagcgggagggttgagtcgtcggcgtttcgtttttgtcgtgttcggcggcggttaggcgggcggtcgcgcggggtttaggtattttttaagcggcgtttcgtagtatcgggttttggttgtagcgtcggggtcgtagggggcggcgttgttgttcgaagggtgtcgggcgaggcgggcgttatcggtcgggtcgaagggcgttttagtttcgtcggggttcgcggcgcgggttttaggatcgaggaggaggcggcgttttcgttgttcggggtcggttcggtgtttgttttgaggaggttcgaggtcggacgttttcggttcgtagcgatttcgacgcgttttttggagaggttttcgagtttttggtagttttttgggggtgttttatttttttcggttttatttgcgttggtcgttcgg

SEQ ID NO: 33962 - DNA, 563 bp, Artificial Sequence
  chemically treated genomic DNA (Homo sapiens) CpG-island No: 33962
ccgaacgaccaacgcaaataaaaccgaaaaaaataaaacacccccaaaaaactaccaaaaactcgaaaacctctccaaaaaacgcgtcgaaatcgctacgaaccgaaaacgtccgacctcgaacctcctcaaaacaaacaccgaaccgaccccgaacaacgaaaacgccgcctcctcctcgatcctaaaacccgcgccgcgaaccccgacgaaactaaaacgcccttcgacccgaccgataacgcccgcctcgcccgacacccttcgaacaacaacgccgccccctacgaccccgacgctacaaccaaaacccgatactacgaaacgccgcttaaaaaatacctaaaccccgcgcgaccgcccgcctaaccgccgccgaacacgacaaaaacgaaacgccgacgactcaaccctcccgctattacgcgacccgactaaacgaacgcgcaacgcgattaataaacgataacgtaaaataaaactcgcgaaaaacaaaaacgactcgaaactctcgaattaatacaccgcgcgaccgaacccgcctcctaaaacgaaacgaaact

SEQ ID NO: 33963 - DNA, 563 bp, Artificial Sequence
  chemically treated genomic DNA (Homo sapiens) CpG-island No: 33963
tcgggcggttagcgtaggtgaagtcggggaaggtggggtatttttagggggttgttaggagttcgggggtttttttaggaggcgcgtcggggtcgttgcgggtcgggaacgttcggtttcgggtttttttagggtaggtatcgggtcggtttcgggtagcggaggcgtcgtttttttttcgattttgggattcgcgtcgcgggtttcggcggagttgaggcgtttttcggttcggtcggtggcgttcgtttcgttcggtatttttcgagtagtagcgtcgttttttgcggtttcgacgttgtagttagagttcgatgttgcgaggcgtcgtttggagaatgtttgggtttcgcgcggtcgttcgtttagtcgtcgtcgagtacggtaggggcggggcgtcggcggtttagttttttcgttattgcgcggttcggttaggcgggcgcgtagcgcgattggtgggcggtggcgtggggtgggattcgcgggaggtagaggcggttcggggttttcggattggtgtatcgcgcggtcgggttcgttttttagggcggggcggggtt

SEQ ID NO: 33964 - DNA, 563 bp, Artificial Sequence
  chemically treated genomic DNA (Homo sapiens) CpG-island No: 33964
aaccccgccccgccctaaaaaacgaacccgaccgcgcgatacaccaatccgaaaaccccgaaccgcctctacctcccgcgaatcccaccccacgccaccgcccaccaatcgcgctacgcgcccgcctaaccgaaccgcgcaataacgaaaaaactaaaccgccgacgccccgcccctaccgtactcgacgacgactaaacgaacgaccgcgcgaaacccaaacattctccaaacgacgcctcgcaacatcgaactctaactacaacgtcgaaaccgcaaaaaacgacgctactactcgaaaaataccgaacgaaacgaacgccaccgaccgaaccgaaaaacgcctcaactccgccgaaacccgcgacgcgaatcccaaaatcgaaaaaaaaacgacgcctccgctacccgaaaccgacccgatacctaccctaaaaaaacccgaaaccgaacgttcccgacccgcaacgaccccgacgcgcctcctaaaaaaacccccgaactcctaacaaccccctaaaaataccccaccttccccgacttcacctacgctaaccgcccga

SEQ ID NO: 33965 - DNA, 508 bp, Artificial Sequence
  chemically treated genomic DNA (Homo sapiens) CpG-island No: 33965
tttttagcgttcggggaatatagttacgtaaatatatacggattataattacggatatatagtcgtatagtttttagggagtttcgtattagtacgttttcgttttttttcggtgtcgttgttttttttcgtagaggcgtttttttagatacgcgcgggtacgtattgatttggggaggggtgcgggtgggcgtcggggttagtgcgtgttttgttcgttttcgcggcggtcggtaaaggcgattatttataaggttgttagcgcgcggtatgtcgggagtcggcgttttcgaaggtagggagggcgggaaggagggagggagagcggattagggatcgggaagcggggcgggatcgagttcgagttcgggtgcgcggcgatatcgtattcggtatcgtgtgtttcgtatcgtggatttttaggtggttgtgtttatatacgcgaattatattttatagtttgttaagagttttttattgcgatatttcgattgtgtttaaggtatat

SEQ ID NO: 33966 - DNA, 508 bp, Artificial Sequence
  chemically treated genomic DNA (Homo sapiens) CpG-island No: 33966
atataccttaaacacaatcgaaatatcgcaataaaaaactcttaacaaactataaaatataattcgcgtatataaacacaaccacctaaaaatccacgatacgaaacacacgataccgaatacgatatcgccgcgcacccgaactcgaactcgatcccgccccgcttcccgatccctaatccgctctccctccctccttcccgccctccctaccttcgaaaacgccgactcccgacataccgcgcgctaacaaccttataaataatcgcctttaccgaccgccgcgaaaacgaacaaaacacgcactaaccccgacgcccacccgcacccctccccaaatcaatacgtacccgcgcgtatctaaaaaaacgcctctacgaaaaaaaacaacgacaccgaaaaaaaacgaaaacgtactaatacgaaactccctaaaaactatacgactatatatccgtaattataatccgtatatatttacgtaactatattccccgaacgctaaaaa

SEQ ID NO: 33967 - DNA, 508 bp, Artificial Sequence
  chemically treated genomic DNA (Homo sapiens) CpG-island No: 33967
gtgtattttgagtatagtcggggtatcgtaatggaaaatttttggtaaattgtaaagtgtagttcgcgtgtgtgggtatagttatttgggggtttacggtgcggggtatacggtgtcgggtgcggtgtcgtcgcgtattcgggttcgggttcggtttcgtttcgtttttcggtttttggttcgttttttttttttttttttcgttttttttgttttcgggaacgtcggttttcggtatgtcgcgcgttgatagttttataaatagtcgtttttgtcggtcgtcgcgaggacgggtagggtacgtattggtttcggcgtttattcgtatttttttttaggttagtgcgtgttcgcgcgtgtttgggggggcgtttttgcggggaggggtagcggtatcgggggagggcgggggcgtgttggtgcggggttttttgggggttgtgcggttgtgtattcgtggttgtgattcgtgtgtgtttgcgtggttgtgtttttcgggcgttgggga

SEQ ID NO: 33968 - DNA, 508 bp, Artificial Sequence
  chemically treated genomic DNA (Homo sapiens) CpG-island No: 33968
tccccaacgcccgaaaaacacaaccacgcaaacacacacgaatcacaaccacgaatacacaaccgcacaacccccaaaaaaccccgcaccaacacgcccccgccctcccccgataccgctacccctccccgcaaaaacgcccccccaaacacgcgcgaacacgcactaacctaaaaaaaaatacgaataaacgccgaaaccaatacgtaccctacccgtcctcgcgacgaccgacaaaaacgactatttataaaactatcaacgcgcgacataccgaaaaccgacgttcccgaaaacaaaaaaaacgaaaaaaaaaaaaaaaaaacgaaccaaaaaccgaaaaacgaaacgaaaccgaacccgaacccgaatacgcgacgacaccgcacccgacaccgtataccccgcaccgtaaacccccaaataactatacccacacacgcgaactacactttacaatttaccaaaaattttccattacgataccccgactatactcaaaatacac

SEQ ID NO: 33969 - DNA, 675 bp, Artificial Sequence
  chemically treated genomic DNA (Homo sapiens) CpG-island No: 33969
ggggggcgatagtttaggaagattagggggcggtagggcgcgtgggggcgggggttgggagattcgtaggaggattttcgattttgtttgaagatttaagtaggcggagtcgcggtttggttcgcggggtaggcggggcgtaagagtgttttcgggggcggggggtcgattcgcgttttaaaggttttcgcgatttattcgtcggcgtttggtttggtttagttgtattacgagcgttgcggatattcggggcggtagtcggtttgttagttttttcgttaggtttcgcggttcgtatttgtcgttcgtatttgtagtttcgtatttgcggttagtgtttattgtttttttttgtcgttcgtatttgtagtttcgtatttgtcgtttgtatttgtagtttcgcgttttattcggtttaagtatggttgattaggcgtttttcgatacggacgttaatattttgattcgtttcgttatggaggagggtaggaaggttcgcggtacgggcgagttgatttagttgtttaattcgttttgtatagtagttaaagttattttttcggcggtgcgtaaggcgggtatcgcgtatttgtgagtcgggttttgggcggtgggtttcgttttgtttgtttgtttggggagtttgttcggcgggttgacgttgggttttttgag

SEQ ID NO: 33970 - DNA, 675 bp, Artificial Sequence
  chemically treated genomic DNA (Homo sapiens) CpG-island No: 33970
ctcaaaaaacccaacgtcaacccgccgaacaaactccccaaacaaacaaacaaaacgaaacccaccgcccaaaacccgactcacaaatacgcgatacccgccttacgcaccgccgaaaaaataactttaactactatacaaaacgaattaaacaactaaatcaactcgcccgtaccgcgaaccttcctaccctcctccataacgaaacgaatcaaaatattaacgtccgtatcgaaaaacgcctaatcaaccatacttaaaccgaataaaacgcgaaactacaaatacaaacgacaaatacgaaactacaaatacgaacgacaaaaaaaaacaataaacactaaccgcaaatacgaaactacaaatacgaacgacaaatacgaaccgcgaaacctaacgaaaaaactaacaaaccgactaccgccccgaatatccgcaacgctcgtaatacaactaaaccaaaccaaacgccgacgaataaatcgcgaaaacctttaaaacgcgaatcgaccccccgcccccgaaaacactcttacgccccgcctaccccgcgaaccaaaccgcgactccgcctacttaaatcttcaaacaaaatcgaaaatcctcctacgaatctcccaacccccgcccccacgcgccctaccgccccctaatcttcctaaactatcgcccccc

SEQ ID NO: 33971 - DNA, 675 bp, Artificial Sequence
  chemically treated genomic DNA (Homo sapiens) CpG-island No: 33971
tttagagggtttaacgttagttcgtcgggtaggttttttaggtagatagataggacggggtttatcgtttaaggttcgatttataggtgcgcgatgttcgttttgcgtatcgtcgaagagatggttttgattgttgtgtagagcgagttgagtagttgggttaattcgttcgtgtcgcgggtttttttgtttttttttatgacgaagcgggttagggtgttgacgttcgtgtcgaagggcgtttggttagttatgtttgaatcgggtagagcgcggggttgtaggtgtaagcggtaggtgcggggttgtaggtgcgggcggtaagagagggtagtaggtattggtcgtaggtgcggagttgtaggtgcgggcggtaggtgcgggtcgcgggatttggcgggaggattgatagatcgattgtcgtttcgagtgttcgtagcgttcgtggtgtaattgggttaggttaggcgtcggcgggtgaatcgcggaaatttttagaacgcgggtcggtttttcgttttcgggaatatttttgcgtttcgtttatttcgcggattagatcgcggtttcgtttgtttggatttttagataaggtcggggatttttttgcgggttttttaattttcgtttttacgcgttttgtcgttttttagtttttttgggttgtcgtttttt

SEQ ID NO: 33972 - DNA, 675 bp, Artificial Sequence
  chemically treated genomic DNA (Homo sapiens) CpG-island No: 33972
aaaaaacgacaacccaaaaaaactaaaaaacgacaaaacgcgtaaaaacgaaaattaaaaaacccgcaaaaaaatccccgaccttatctaaaaatccaaacaaacgaaaccgcgatctaatccgcgaaataaacgaaacgcaaaaatattcccgaaaacgaaaaaccgacccgcgttctaaaaatttccgcgattcacccgccgacgcctaacctaacccaattacaccacgaacgctacgaacactcgaaacgacaatcgatctatcaatcctcccgccaaatcccgcgacccgcacctaccgcccgcacctacaactccgcacctacgaccaatacctactaccctctcttaccgcccgcacctacaaccccgcacctaccgcttacacctacaaccccgcgctctacccgattcaaacataactaaccaaacgcccttcgacacgaacgtcaacaccctaacccgcttcgtcataaaaaaaaacaaaaaaacccgcgacacgaacgaattaacccaactactcaactcgctctacacaacaatcaaaaccatctcttcgacgatacgcaaaacgaacatcgcgcacctataaatcgaaccttaaacgataaaccccgtcctatctatctacctaaaaaacctacccgacgaactaacgttaaaccctctaaa

SEQ ID NO: 33973 - DNA, 780 bp, Artificial Sequence
  chemically treated genomic DNA (Homo sapiens) CpG-island No: 33973
gtacgttgcgtattcgtattggggtttgggcggtgtagcggcggcgggagggttttgggaatcgtagtcgtcgaggttagtgtgtgagtcggtcggtcgcggtaagtcgtatttttcggtcgtttttcgtagttttttgtttttcggtagtcgtcgtcgtttttaggtagtttagtcgggcgttcgcgttaggattttttcgtcgttcgtttcggttcggaatatggttgcgcgttttgttgttattttcgtttggtcgttattgtttttttttttagttttgtttcgcgaaggttgtcgagcgcgtttcgtcgtcgagcgggattcggaggacgacggagaggagtcggtggttttttcggagtcgtttttgtagagttttacggtgttcgtggcggttttcgttcgtaacgcggcgtatacgttgtcgtattttttcggttgtttggagcggttggattattttaagagtaggatggttatttggtgagcgcgtacgggtttcgggtcgtcgcggcgggacgcgggggcggtttgtttagcgcggatagcgttcggagtagtagttgtagggcgagggagtcgttggaggggcgggggggtacgcggaaaatttggcgtatatattttttcgttgttcgcgtcggtggttggcggatcgggcggttaggttgcggagggacgcgcgggttagtgtgcgtagagggtgttgatggggagaatcggatcgttggagttttggagggtagtttgcgaattggggttttgttttataagggg

SEQ ID NO: 33974 - DNA, 780 bp, Artificial Sequence
  chemically treated genomic DNA (Homo sapiens) CpG-island No: 33974
ccccttataaaacaaaaccccaattcgcaaactaccctccaaaactccaacgatccgattctccccatcaacaccctctacgcacactaacccgcgcgtccctccgcaacctaaccgcccgatccgccaaccaccgacgcgaacaacgaaaaaatatatacgccaaattttccgcgtacccccccgcccctccaacgactccctcgccctacaactactactccgaacgctatccgcgctaaacaaaccgcccccgcgtcccgccgcgacgacccgaaacccgtacgcgctcaccaaataaccatcctactcttaaaataatccaaccgctccaaacaaccgaaaaaatacgacaacgtatacgccgcgttacgaacgaaaaccgccacgaacaccgtaaaactctacaaaaacgactccgaaaaaaccaccgactcctctccgtcgtcctccgaatcccgctcgacgacgaaacgcgctcgacaaccttcgcgaaacaaaactaaaaaaaaaaacaataacgaccaaacgaaaataacaacaaaacgcgcaaccatattccgaaccgaaacgaacgacgaaaaaatcctaacgcgaacgcccgactaaactacctaaaaacgacgacgactaccgaaaaacaaaaaactacgaaaaacgaccgaaaaatacgacttaccgcgaccgaccgactcacacactaacctcgacgactacgattcccaaaaccctcccgccgccgctacaccgcccaaaccccaatacgaatacgcaacgtac

SEQ ID NO: 33975 - DNA, 780 bp, Artificial Sequence
  chemically treated genomic DNA (Homo sapiens) CpG-island No: 33975
ttttttgtgggataaagttttaattcgtaggttattttttagagttttagcggttcggttttttttattagtattttttgcgtatattgattcgcgcgttttttcgtagtttgatcgttcgattcgttagttatcggcgcgggtagcgagggggtgtgtgcgttagatttttcgcgtgttttttcgtttttttagcggttttttcgttttgtagttgttgtttcgggcgttgttcgcgttgggtaggtcgttttcgcgtttcgtcgcggcggttcggggttcgtgcgcgtttattagatggttattttgtttttggggtagtttagtcgttttaggtagtcgaggaagtgcggtagcgtgtgcgtcgcgttgcgggcgaggatcgttacgagtatcgtggggttttgtaggggcgatttcgggaaaattatcggttttttttcgtcgtttttcgagtttcgttcggcgacgaagcgcgttcggtagttttcgcggagtagggttgaggagaggagtagtagcgattaggcgagggtggtagtagggcgcgtagttatgtttcgggtcgaggcgggcggcggggaagttttggcgcgagcgttcggttgggttgtttgagggcggcggcggttgtcggggagtaaggggttgcgaggggcggtcgggggatgcggtttgtcgcggtcggtcggtttatatattggtttcggcggttgcggtttttaggattttttcgtcgtcgttgtatcgtttaggttttagtgcgggtgcgtagcgtat

SEQ ID NO: 33976 - DNA, 780 bp, Artificial Sequence
  chemically treated genomic DNA (Homo sapiens) CpG-island No: 33976
atacgctacgcacccgcactaaaacctaaacgatacaacgacgacgaaaaaatcctaaaaaccgcaaccgccgaaaccaatatataaaccgaccgaccgcgacaaaccgcatcccccgaccgcccctcgcaaccccttactccccgacaaccgccgccgccctcaaacaacccaaccgaacgctcgcgccaaaacttccccgccgcccgcctcgacccgaaacataactacgcgccctactaccaccctcgcctaatcgctactactcctctcctcaaccctactccgcgaaaactaccgaacgcgcttcgtcgccgaacgaaactcgaaaaacgacgaaaaaaaaccgataattttcccgaaatcgcccctacaaaaccccacgatactcgtaacgatcctcgcccgcaacgcgacgcacacgctaccgcacttcctcgactacctaaaacgactaaactaccccaaaaacaaaataaccatctaataaacgcgcacgaaccccgaaccgccgcgacgaaacgcgaaaacgacctacccaacgcgaacaacgcccgaaacaacaactacaaaacgaaaaaaccgctaaaaaaacgaaaaaacacgcgaaaaatctaacgcacacaccccctcgctacccgcgccgataactaacgaatcgaacgatcaaactacgaaaaaacgcgcgaatcaatatacgcaaaaaatactaataaaaaaaaccgaaccgctaaaactctaaaaaataacctacgaattaaaactttatcccacaaaaaa

SEQ ID NO: 33977 - DNA, 1399 bp, Artificial Sequence
  chemically treated genomic DNA (Homo sapiens) CpG-island No: 33977
ttgtgttacgtggaggcggtaagcgtagaaggatttcgtacgttcggcggtaattgaagattacggttagttttagattttgatttttgtaatttatgagcgttattttcgtatcgtttttcgtatttgattcgtttttgatagttgtagaggtgtaaacgggtgacggaaagagttcgattttttcggtacgcgagacggtttcggtcgggggtgtttcgggggcgtagtttcgttcgggaagtggttgtcgatagtagcgaggagcggtaagggttagggttttcgttttttcggttcgtttcgttcgttcgttcgtttcgtttcgtttcgtcgtatttacgcgagtgttttagttcgcgcgtcgttttggcggcgcgttttaggtcggtggggtcgaaagttgttttatttgtgtttgggcgtttgtcggtgttataattcgcggttttcgtcgttttcggatatttgttgcgcgggcggtaaaggcggcggcggtttcgcgtttttatttttggggtttttgttaatgcgcgaagagttacgatatgttcgtatcgtcgtcgtcgttatcgtcgtcgggatttttattcgagtttgattcgcgcgcggttgggagtagtttttacgcgtcgcgagtcggtggttatcgttattgagtaggcgttatatatatttttttttttcggcgatagaagcgcgtaagggatacgcgcgtagtttttggattggtttcgaggatagtgacgttatagcgacggcgtcgcgattgtcgaataggttttgggagttagcggggcgggagcggcgaagtatttggttacgggagttacgtcgggataaaattttcgagggacgtaggcgaatttaaggtagcgttagtttcgcgtcgtattcgcgtgggtttcgttgttaggggtttcgttgttaggggttttgaggagtttcggttttggcggtagcgggtggtaagtttttagggagttttaaggttttcgattcgtgcggcggggcgttttgcggtgagtttaggacgtagagaagagtttcgcgggaattttattcgaggcggtatcggcgttcgggtaagtcgagttttttcgcgatgagtcggcgttttggggtcgttgcgttaagagtttaggagaggcgtttttttttttcggtgttttcgtagttcgtacggttttttcgtttaagatttcggggcgattttttttcgcgtggcggggttagcgagttttttttgcggggcgtggacggggtcggggtgttcgggtaggcgtcgtttcggagtttacggtttacgcgtttttagcggttttgattttttttttgatggaattggttgattttacggaatatatggagtgattttttttattggattggaaattgt

SEQ ID NO: 33978 - DNA, 1399 bp, Artificial Sequence
  chemically treated genomic DNA (Homo sapiens) CpG-island No: 33978
acaatttccaatccaataaaaaaaatcactccatatattccgtaaaatcaaccaattccatcaaaaaaaaaatcaaaaccgctaaaaacgcgtaaaccgtaaactccgaaacgacgcctacccgaacaccccgaccccgtccacgccccgcaaaaaaaactcgctaaccccgccacgcgaaaaaaaatcgccccgaaatcttaaacgaaaaaaccgtacgaactacgaaaacaccgaaaaaaaaaaacgcctctcctaaactcttaacgcaacgaccccaaaacgccgactcatcgcgaaaaaactcgacttacccgaacgccgataccgcctcgaataaaattcccgcgaaactcttctctacgtcctaaactcaccgcaaaacgccccgccgcacgaatcgaaaaccttaaaactccctaaaaacttaccacccgctaccgccaaaaccgaaactcctcaaaacccctaacaacgaaacccctaacaacgaaacccacgcgaatacgacgcgaaactaacgctaccttaaattcgcctacgtccctcgaaaattttatcccgacgtaactcccgtaaccaaatacttcgccgctcccgccccgctaactcccaaaacctattcgacaatcgcgacgccgtcgctataacgtcactatcctcgaaaccaatccaaaaactacgcgcgtatcccttacgcgcttctatcgccgaaaaaaaaaaatatatataacgcctactcaataacgataaccaccgactcgcgacgcgtaaaaactactcccaaccgcgcgcgaatcaaactcgaataaaaatcccgacgacgataacgacgacgacgatacgaacatatcgtaactcttcgcgcattaacaaaaaccccaaaaataaaaacgcgaaaccgccgccgcctttaccgcccgcgcaacaaatatccgaaaacgacgaaaaccgcgaattataacaccgacaaacgcccaaacacaaataaaacaactttcgaccccaccgacctaaaacgcgccgccaaaacgacgcgcgaactaaaacactcgcgtaaatacgacgaaacgaaacgaaacgaacgaacgaacgaaacgaaccgaaaaaacgaaaaccctaacccttaccgctcctcgctactatcgacaaccacttcccgaacgaaactacgcccccgaaacacccccgaccgaaaccgtctcgcgtaccgaaaaaatcgaactctttccgtcacccgtttacacctctacaactatcaaaaacgaatcaaatacgaaaaacgatacgaaaataacgctcataaattacaaaaatcaaaatctaaaactaaccgtaatcttcaattaccgccgaacgtacgaaatccttctacgcttaccgcctccacgtaacacaa

SEQ ID NO: 33979 - DNA, 1399 bp, Artificial Sequence
  chemically treated genomic DNA (Homo sapiens) CpG-island No: 33979
atagtttttaatttagtgggaaaagttattttatatatttcgtgaagttaattagttttattaaggagaaagttagggtcgttgggagcgcgtggatcgtgggtttcggggcggcgtttgttcgggtatttcggtttcgtttacgtttcgtaagaggagttcgttggtttcgttacgcgggaaggggtcgtttcggggttttgggcgggagggtcgtgcgggttgcggagatatcgaggaggggaggcgttttttttgagtttttggcgtagcgattttagggcgtcgatttatcgcggaagggttcggtttgttcgggcgtcggtgtcgtttcgggtgaggttttcgcgagatttttttttgcgttttggatttatcgtagggcgtttcgtcgtacggatcgagaattttggggttttttggaaatttgttattcgttgtcgttaaggtcggaattttttagagtttttagtaacggagtttttagtaacggagtttacgcggatgcggcgcggggttgacgttgttttgggttcgtttacgtttttcgggaattttgtttcggcgtggttttcgtagttagatgtttcgtcgttttcgtttcgttggtttttaaagtttgttcggtagtcgcggcgtcgtcgttatggcgttattgttttcggggttaatttaagggttgcgcgcgtgttttttacgcgtttttatcgtcgggaggaaggggtgtgtgtggcgtttgtttagtggcggtgattatcggttcgcggcgcgtggaggttgtttttagtcgcgcgcgagttagattcgggtgggggtttcggcggcggtagcggcggcggcggtgcgagtatgtcgtggtttttcgcgtattaataagggttttaagggtgaaggcgcggggtcgtcgtcgtttttgtcgttcgcgtagtaggtgttcgaggacggcggggatcgcgggttgtaatatcggtaggcgtttaagtataaatggagtaattttcgattttatcggtttggagcgcgtcgttaaggcggcgcgcgagttggagtattcgcgtgagtgcggcggggcggggcggggcgggcgggcgggcgggacgggtcggggaagcgggagttttggtttttgtcgtttttcgttgttgtcggtagttatttttcgggcgagattgcgttttcggagtattttcggtcggagtcgtttcgcgtgtcgggaggatcggatttttttcgttattcgtttgtatttttgtagttgttaggagcgggttaggtgcgaaaagcggtgcggaggtggcgtttataggttataggggttagggtttggggttggtcgtggtttttagttatcgtcgagcgtgcgggatttttttgcgtttgtcgtttttacgtggtatag

SEQ ID NO: 33980 - DNA, 1399 bp, Artificial Sequence
  chemically treated genomic DNA (Homo sapiens) CpG-island No: 33980
ctataccacgtaaaaacgacaaacgcaaaaaaatcccgcacgctcgacgataactaaaaaccacgaccaaccccaaaccctaacccctataacctataaacgccacctccgcaccgcttttcgcacctaacccgctcctaacaactacaaaaatacaaacgaataacgaaaaaaatccgatcctcccgacacgcgaaacgactccgaccgaaaatactccgaaaacgcaatctcgcccgaaaaataactaccgacaacaacgaaaaacgacaaaaaccaaaactcccgcttccccgacccgtcccgcccgcccgcccgccccgccccgccccgccgcactcacgcgaatactccaactcgcgcgccgccttaacgacgcgctccaaaccgataaaatcgaaaattactccatttatacttaaacgcctaccgatattacaacccgcgatccccgccgtcctcgaacacctactacgcgaacgacaaaaacgacgacgaccccgcgccttcacccttaaaacccttattaatacgcgaaaaaccacgacatactcgcaccgccgccgccgctaccgccgccgaaacccccacccgaatctaactcgcgcgcgactaaaaacaacctccacgcgccgcgaaccgataatcaccgccactaaacaaacgccacacacaccccttcctcccgacgataaaaacgcgtaaaaaacacgcgcgcaacccttaaattaaccccgaaaacaataacgccataacgacgacgccgcgactaccgaacaaactttaaaaaccaacgaaacgaaaacgacgaaacatctaactacgaaaaccacgccgaaacaaaattcccgaaaaacgtaaacgaacccaaaacaacgtcaaccccgcgccgcatccgcgtaaactccgttactaaaaactccgttactaaaaactctaaaaaattccgaccttaacgacaacgaataacaaatttccaaaaaaccccaaaattctcgatccgtacgacgaaacgccctacgataaatccaaaacgcaaaaaaaaatctcgcgaaaacctcacccgaaacgacaccgacgcccgaacaaaccgaacccttccgcgataaatcgacgccctaaaatcgctacgccaaaaactcaaaaaaaacgcctcccctcctcgatatctccgcaacccgcacgaccctcccgcccaaaaccccgaaacgaccccttcccgcgtaacgaaaccaacgaactcctcttacgaaacgtaaacgaaaccgaaatacccgaacaaacgccgccccgaaacccacgatccacgcgctcccaacgaccctaactttctccttaataaaactaattaacttcacgaaatatataaaataacttttcccactaaattaaaaactat

SEQ ID NO: 33981 - DNA, 621 bp, Artificial Sequence
  chemically treated genomic DNA (Homo sapiens) CpG-island No: 33981
gtttcgagtagcggtagcgaggtttggagtcgtaggcgttgttttcgcgaggtaggggaggagttttgtattgttaggggcggggttttgagtagcgaggtcgggtttgaattattaggcgcggtttttgcgagttgggggcggggttttgtataggcgggggcggggttgtgagtggtgggggcggggtttggagtagtaggcgtcgcgtttgcgagttaaggtcggagttttgtatcggcgggggcggggttttgcgtggtcggggcgggttcggggattcgcggggcgattttcggtttggtttgggtaggttgttcgggtcgtggtaggaagtcggaagtagtcgcggttttagttcgggagatatggcgggcgttaaaggtatatcgcggttttcggttcgtttgtcgtgtggtggggttgttattttcgtttcggttaagtttggggttgcgtttttcgcgcgtcgttggggaacggttttattatttttttcgttttttcggttcgggaggcgatcgatcgtttttttcgttttttggggtgtgggtggagcggcgtttcgggggagttttggttttttttgtaaggtcgttggtttttttgttttttagtggt

SEQ ID NO: 33982 - DNA, 621 bp, Artificial Sequence
  chemically treated genomic DNA (Homo sapiens) CpG-island No: 33982
accactaaaaaacaaaaaaaccaacgaccttacaaaaaaaaccaaaactcccccgaaacgccgctccacccacaccccaaaaaacgaaaaaaacgatcgatcgcctcccgaaccgaaaaaacgaaaaaaataataaaaccgttccccaacgacgcgcgaaaaacgcaaccccaaacttaaccgaaacgaaaataacaaccccaccacacgacaaacgaaccgaaaaccgcgatatacctttaacgcccgccatatctcccgaactaaaaccgcgactacttccgacttcctaccacgacccgaacaacctacccaaaccaaaccgaaaatcgccccgcgaatccccgaacccgccccgaccacgcaaaaccccgcccccgccgatacaaaactccgaccttaactcgcaaacgcgacgcctactactccaaaccccgcccccaccactcacaaccccgcccccgcctatacaaaaccccgcccccaactcgcaaaaaccgcgcctaataattcaaacccgacctcgctactcaaaaccccgcccctaacaatacaaaactcctcccctacctcgcgaaaacaacgcctacgactccaaacctcgctaccgctactcgaaac

SEQ ID NO: 33983 - DNA, 621 bp, Artificial Sequence
  chemically treated genomic DNA (Homo sapiens) CpG-island No: 33983
gttattggagagtaggaaggttagcggttttgtaaaaagggttaaggttttttcgaaacgtcgttttatttatattttaagggacgaagggagcggtcgatcgtttttcgaatcggagaggcgggaagggtggtgaggtcgttttttaacggcgcgcggaaggcgtagttttaggtttgatcggaacggaggtggtaattttattatacgataagcgagtcggggatcgcgatgtatttttaacgttcgttatgtttttcgaattggggtcgcggttgttttcggttttttgttacggttcgggtagtttgtttaagttagatcgggagtcgtttcgcggattttcgagttcgtttcggttacgtagagtttcgttttcgtcggtgtagaatttcgattttagttcgtaaacgcggcgtttgttgttttagatttcgtttttattatttataatttcgttttcgtttgtgtagaatttcgtttttagttcgtagaggtcgcgtttgatagtttagattcggtttcgttatttagagtttcgtttttgatagtatagagttttttttttatttcgcggaggtagcgtttgcggttttagatttcgttatcgttattcgaagt

SEQ ID NO: 33984 - DNA, 621 bp, Artificial Sequence
  chemically treated genomic DNA (Homo sapiens) CpG-island No: 33984
acttcgaataacgataacgaaatctaaaaccgcaaacgctacctccgcgaaataaaaaaaaaactctatactatcaaaaacgaaactctaaataacgaaaccgaatctaaactatcaaacgcgacctctacgaactaaaaacgaaattctacacaaacgaaaacgaaattataaataataaaaacgaaatctaaaacaacaaacgccgcgtttacgaactaaaatcgaaattctacaccgacgaaaacgaaactctacgtaaccgaaacgaactcgaaaatccgcgaaacgactcccgatctaacttaaacaaactacccgaaccgtaacaaaaaaccgaaaacaaccgcgaccccaattcgaaaaacataacgaacgttaaaaatacatcgcgatccccgactcgcttatcgtataataaaattaccacctccgttccgatcaaacctaaaactacgccttccgcgcgccgttaaaaaacgacctcaccacccttcccgcctctccgattcgaaaaacgatcgaccgctcccttcgtcccttaaaatataaataaaacgacgtttcgaaaaaaccttaaccctttttacaaaaccgctaaccttcctactctccaataac

SEQ ID NO: 33985 - DNA, 623 bp, Artificial Sequence
  chemically treated genomic DNA (Homo sapiens) CpG-island No: 33985
ttcggaggttcggcgcgttttcgttattataattggagtgtatggagtaggttacgtttagaggaggaagggcgggcgttgggtattcgttgatcgatttttttaagtgcgattagtgttcgttcgttttgtttttatggattcgttcgggaacggttatcgttgaggattttacgtttattaggatttcggttgggtcgtatttagttatcgtatcgtgattttcgcgggttgtgtcggttttcggcgtttttgttcgtagcgttcgtcgtcgggttagggtttcgtcgtcgttacgtttcgcgttcggtatttatcgttttatgttggtgtatatttatttcgttatggtgagtagtttcgggttcgggatatattcggtcgggggatcggggcgtttgagtgttggattttttaatttttttgtttcgcgttaacgaaatttcggagggagggggtcgtagggatttcgttagttgagaacgcgatgcgtaagtgatcgttgtttttagtttgaggtttttgcgttcgcgggtggttcggaaataaatttcgggttttaagaaacgggagggattgtagttgaattttttcgagttgaggaggatttttttaggttgggg

SEQ ID NO: 33986 - DNA, 623 bp, Artificial Sequence
  chemically treated genomic DNA (Homo sapiens) CpG-island No: 33986
ccccaacctaaaaaaatcctcctcaactcgaaaaaattcaactacaatccctcccgtttcttaaaacccgaaatttatttccgaaccacccgcgaacgcaaaaacctcaaactaaaaacaacgatcacttacgcatcgcgttctcaactaacgaaatccctacgaccccctccctccgaaatttcgttaacgcgaaacaaaaaaattaaaaaatccaacactcaaacgccccgatcccccgaccgaatatatcccgaacccgaaactactcaccataacgaaataaatatacaccaacataaaacgataaataccgaacgcgaaacgtaacgacgacgaaaccctaacccgacgacgaacgctacgaacaaaaacgccgaaaaccgacacaacccgcgaaaatcacgatacgataactaaatacgacccaaccgaaatcctaataaacgtaaaatcctcaacgataaccgttcccgaacgaatccataaaaacaaaacgaacgaacactaatcgcacttaaaaaaatcgatcaacgaatacccaacgcccgcccttcctcctctaaacgtaacctactccatacactccaattataataacgaaaacgcgccgaacctccgaa

SEQ ID NO: 33987 - DNA, 623 bp, Artificial Sequence
  chemically treated genomic DNA (Homo sapiens) CpG-island No: 33987
ttttagtttgaaaggattttttttagttcgggagggtttagttgtagtttttttcgttttttggggttcgaggtttattttcgagttattcgcgggcgtaggagttttaggttggggatagcggttatttgcgtatcgcgtttttagttggcgaagtttttgcggtttttttttttcgagatttcgttagcgcgggataggagggttggaaagtttagtatttaggcgtttcgatttttcggtcgaatatgtttcgggttcgagattatttattatggcggagtaggtgtgtattagtatggggcggtgagtgtcgggcgcgaggcgtggcggcggcggagttttagttcgacggcgagcgttgcgggtagaggcgtcgggagtcggtatagttcgcggaggttacggtgcggtagttgggtgcgatttagtcgggattttagtgggcgtggggtttttagcggtggtcgttttcgggcgggtttatggaggtaggacggacgggtattgatcgtatttggaaaagtcggttaacgggtgtttagcgttcgtttttttttttttgagcgtagtttgttttatgtattttagttatagtggcgggggcgcgtcgggttttcggg

SEQ ID NO: 33988 - DNA, 623 bp, Artificial Sequence
  chemically treated genomic DNA (Homo sapiens) CpG-island No: 33988
cccgaaaacccgacgcgcccccgccactataactaaaatacataaaacaaactacgctcaaaaaaaaaaaaacgaacgctaaacacccgttaaccgacttttccaaatacgatcaatacccgtccgtcctacctccataaacccgcccgaaaacgaccaccgctaaaaaccccacgcccactaaaatcccgactaaatcgcacccaactaccgcaccgtaacctccgcgaactataccgactcccgacgcctctacccgcaacgctcgccgtcgaactaaaactccgccgccgccacgcctcgcgcccgacactcaccgccccatactaatacacacctactccgccataataaataatctcgaacccgaaacatattcgaccgaaaaatcgaaacgcctaaatactaaactttccaaccctcctatcccgcgctaacgaaatctcgaaaaaaaaaaaccgcaaaaacttcgccaactaaaaacgcgatacgcaaataaccgctatccccaacctaaaactcctacgcccgcgaataactcgaaaataaacctcgaaccccaaaaaacgaaaaaaactacaactaaaccctcccgaactaaaaaaaatcctttcaaactaaaa

SEQ ID NO: 33989 - DNA, 502 bp, Artificial Sequence
  chemically treated genomic DNA (Homo sapiens) CpG-island No: 33989
gtttacgggtcggcgttttcgttttgttatacgtcggtcgttatagttgtcgtcgaattttagtcgttttatttttcgtcgttttattcgtagttatcgttgttttacggttaggcgttcgacgtcgtcgtagtttttttttatttggtaggggatttatatggcggtttggcgtttttggcgtagtcgtagtttttttaggtcgtttgggtcgcgtttcgcgtagtcgttcgcgtttacgaggagtttttcggtttgttggtatcgttcgttcgcgttttgggttttgattcgcgtcgtgattatgttattgtcgtgtttcggtttttgtacggtttggtcgacggcgcgtacggtttggtagacgtatttttcggtttttcggggttggcggcggttttcggtttggaggatttgtaggtgagattcgagggattcgggatgggtcgggattggtcgcggtggtttattattatggttggaggtagaaggtgataaatgt

SEQ ID NO: 33990 - DNA, 502 bp, Artificial Sequence
  chemically treated genomic DNA (Homo sapiens) CpG-island No: 33990
acatttatcaccttctacctccaaccataataataaaccaccgcgaccaatcccgacccatcccgaatccctcgaatctcacctacaaatcctccaaaccgaaaaccgccgccaaccccgaaaaaccgaaaaatacgtctaccaaaccgtacgcgccgtcgaccaaaccgtacaaaaaccgaaacacgacaataacataatcacgacgcgaatcaaaacccaaaacgcgaacgaacgataccaacaaaccgaaaaactcctcgtaaacgcgaacgactacgcgaaacgcgacccaaacgacctaaaaaaactacgactacgccaaaaacgccaaaccgccatataaatcccctaccaaataaaaaaaaactacgacgacgtcgaacgcctaaccgtaaaacaacgataactacgaataaaacgacgaaaaataaaacgactaaaattcgacgacaactataacgaccgacgtataacaaaacgaaaacgccgacccgtaaac

SEQ ID NO: 33991 - DNA, 502 bp, Artificial Sequence
  chemically treated genomic DNA (Homo sapiens) CpG-island No: 33991
gtatttgttattttttgtttttagttatggtagtaaattatcgcggttagtttcgatttatttcggatttttcgggttttatttgtaggttttttagatcgggggtcgtcgttagtttcggaaggtcgagaggtgcgtttgttaggtcgtgcgcgtcgtcggttaggtcgtgtaggagtcggggtacggtagtggtatagttacggcgcgggttaaggtttagggcgcgggcgggcggtgttagtaggtcgggaggtttttcgtgggcgcgggcggttgcgcggggcgcggtttaggcggtttgaggaggttgcggttgcgttaggggcgttaggtcgttatatgggttttttgttaggtggggaaaggttgcggcggcgtcgggcgtttgatcgtagggtagcggtggttgcgggtagggcggcgggaagtagggcggttggaattcggcggtagttgtggcggtcggcgtgtggtagagcgggggcgtcggttcgtaggt

SEQ ID NO: 33992 - DNA, 502 bp, Artificial Sequence
  chemically treated genomic DNA (Homo sapiens) CpG-island No: 33992
acctacgaaccgacgcccccgctctaccacacgccgaccgccacaactaccgccgaattccaaccgccctacttcccgccgccctacccgcaaccaccgctaccctacgatcaaacgcccgacgccgccgcaacctttccccacctaacaaaaaacccatataacgacctaacgcccctaacgcaaccgcaacctcctcaaaccgcctaaaccgcgccccgcgcaaccgcccgcgcccacgaaaaacctcccgacctactaacaccgcccgcccgcgccctaaaccttaacccgcgccgtaactataccactaccgtaccccgactcctacacgacctaaccgacgacgcgcacgacctaacaaacgcacctctcgaccttccgaaactaacgacgacccccgatctaaaaaacctacaaataaaacccgaaaaatccgaaataaatcgaaactaaccgcgataatttactaccataactaaaaacaaaaaataacaaatac

SEQ ID NO: 33993 - DNA, 670 bp, Artificial Sequence
  chemically treated genomic DNA (Homo sapiens) CpG-island No: 33993
gacgcggtgggaaagacgagggtcgttagttttttttgtttcgtattggggtaggggttcggcgttgtttcggagaaaggttaggttttttttagttagggaataatgatagttcgcgcgttcgtagttcgtttcgtttcgttttattaggttcgtaggcggtttttttcgttcggttgaggggttcggtcgcgttttttttttttttcgttttggttcggggtgtttttcgttcgtatcgttagttttatcgggtcggagttggaggtcgtcgtcgcggcggttgtattatagcgcgcgttcgttttgttgtaggatgtagtggtttttggtttggaagagttttatgttggtttcgcgcgtttagggaggcggcggttcgcgggcggcgtacggggcgttttagtcggtcgaggtcgttagagttcgcgtttcggggagcggtcgggtaggaatcgcgtcgagaagtagcggtagagggaacgtttcggggtattcgatcggtaggaggagaacgcgtttcggtagcggcggcggtagcggcggtcgtagaggtttttttttttcgtttttttttttttttggtttcgttttaggttcggttttattttttttgttggttatttttttcgagcgttcggtttcgttttttagttttttttttttttta

SEQ ID NO: 33994 - DNA, 670 bp, Artificial Sequence
  chemically treated genomic DNA (Homo sapiens) CpG-island No: 33994
taaaaaaaaaaaaaaactaaaaaacgaaaccgaacgctcgaaaaaaataaccaacaaaaaaaataaaaccgaacctaaaacgaaaccaaaaaaaaaaaaaaacgaaaaaaaaaaacctctacgaccgccgctaccgccgccgctaccgaaacgcgttctcctcctaccgatcgaataccccgaaacgttccctctaccgctacttctcgacgcgattcctacccgaccgctccccgaaacgcgaactctaacgacctcgaccgactaaaacgccccgtacgccgcccgcgaaccgccgcctccctaaacgcgcgaaaccaacataaaactcttccaaaccaaaaaccactacatcctacaacaaaacgaacgcgcgctataatacaaccgccgcgacgacgacctccaactccgacccgataaaactaacgatacgaacgaaaaacaccccgaaccaaaacgaaaaaaaaaaaaaacgcgaccgaacccctcaaccgaacgaaaaaaaccgcctacgaacctaataaaacgaaacgaaacgaactacgaacgcgcgaactatcattattccctaactaaaaaaaacctaacctttctccgaaacaacgccgaacccctaccccaatacgaaacaaaaaaaactaacgaccctcgtctttcccaccgcgtc

SEQ ID NO: 33995 - DNA, 670 bp, Artificial Sequence
  chemically treated genomic DNA (Homo sapiens) CpG-island No: 33995
tgaaaggaggaggaggttgaggggcggagtcgggcgttcggggagagtagttagtagagggggtggagtcgggtttggggcggagttagggaaggggaggagcgggggggagaggtttttacggtcgtcgttgtcgtcgtcgttgtcggggcgcgttttttttttatcggtcgggtgtttcggggcgttttttttgtcgttgtttttcggcgcggtttttattcggtcgtttttcgaggcgcgggttttggcggtttcgatcgattaggacgtttcgtgcgtcgttcgcgggtcgtcgtttttttgggcgcgcggggttagtatggagtttttttaagttaaggattattatattttgtagtagggcgagcgcgcgttgtggtgtagtcgtcgcgacggcggtttttagtttcgattcggtgaggttggcggtgcgggcggggggtatttcgggttagggcggggagaggagggggcgcggtcggattttttagtcgggcgggaggagtcgtttgcgggtttggtgaggcggggcggggcgggttgcgagcgcgcgagttgttattattttttgattggaaggagtttggttttttttcgagatagcgtcgagtttttattttagtgcggagtagaaggggttggcgattttcgttttttttatcgcgtt

SEQ ID NO: 33996 - DNA, 670 bp, Artificial Sequence
  chemically treated genomic DNA (Homo sapiens) CpG-island No: 33996
aacgcgataaaaaaaacgaaaatcgccaaccccttctactccgcactaaaataaaaactcgacgctatctcgaaaaaaaaccaaactccttccaatcaaaaaataataacaactcgcgcgctcgcaacccgccccgccccgcctcaccaaacccgcaaacgactcctcccgcccgactaaaaaatccgaccgcgccccctcctctccccgccctaacccgaaataccccccgcccgcaccgccaacctcaccgaatcgaaactaaaaaccgccgtcgcgacgactacaccacaacgcgcgctcgccctactacaaaatataataatccttaacttaaaaaaactccatactaaccccgcgcgcccaaaaaaacgacgacccgcgaacgacgcacgaaacgtcctaatcgatcgaaaccgccaaaacccgcgcctcgaaaaacgaccgaataaaaaccgcgccgaaaaacaacgacaaaaaaaacgccccgaaacacccgaccgataaaaaaaaaacgcgccccgacaacgacgacgacaacgacgaccgtaaaaacctctcccccccgctcctccccttccctaactccgccccaaacccgactccaccccctctactaactactctccccgaacgcccgactccgcccctcaacctcctcctcctttca

SEQ ID NO: 33997 - DNA, 558 bp, Artificial Sequence
  chemically treated genomic DNA (Homo sapiens) CpG-island No: 33997
tcgtttgcgggcgaggaaatggggtttttattttcgcgttgtttcggggtcgtatttcgtaggggtgtttttcggtgtaatcgcgggaagattttaagtatcgatttttcggtagtttcgcggagcgttttggcggttaagggatcgtagtatcgggttttgcggcgggggcggcgtgcgcgggggcgtcggcggtcgggttttttcgtagtattttcgaggtttttcgcgacgtattttcgtcgtttgtttatttgcgcggcgttgaggtttcggagtttatttatatggtttttttttcgttttttttcggcgcggtcgaggcggtttcggggggttttcggcgggttcgggagtcggtgggtttttcgagagtatcgagggggcggtatttttttttttttatgttcggcggtcgattttttgtgtggggcgggcggcggtcgtcgggcggtgcggcgcgggcggggggtgagtgagcgtttcggcggttttaaaagttttgggagaagcgcggcgcgttcgggcgggagaggatcgcgtcgttcgtataataat

SEQ ID NO: 33998 - DNA, 558 bp, Artificial Sequence
  chemically treated genomic DNA (Homo sapiens) CpG-island No: 33998
attattatacgaacgacgcgatcctctcccgcccgaacgcgccgcgcttctcccaaaacttttaaaaccgccgaaacgctcactcaccccccgcccgcgccgcaccgcccgacgaccgccgcccgccccacacaaaaaatcgaccgccgaacataaaaaaaaaaaaataccgccccctcgatactctcgaaaaacccaccgactcccgaacccgccgaaaaccccccgaaaccgcctcgaccgcgccgaaaaaaaacgaaaaaaaaaccatataaataaactccgaaacctcaacgccgcgcaaataaacaaacgacgaaaatacgtcgcgaaaaacctcgaaaatactacgaaaaaacccgaccgccgacgcccccgcgcacgccgcccccgccgcaaaacccgatactacgatcccttaaccgccaaaacgctccgcgaaactaccgaaaaatcgatacttaaaatcttcccgcgattacaccgaaaaacacccctacgaaatacgaccccgaaacaacgcgaaaataaaaaccccatttcctcgcccgcaaacga

SEQ ID NO: 33999 - DNA, 558 bp, Artificial Sequence
  chemically treated genomic DNA (Homo sapiens) CpG-island No: 33999
gttgttgtgcgagcggcgcggttttttttcgttcgggcgcgtcgcgttttttttagagtttttaggatcgtcggggcgtttatttatttttcgttcgcgtcgtatcgttcggcggtcgtcgttcgttttatataaaaaatcggtcgtcgggtataaagaaaaaaaggtgtcgttttttcggtgttttcggaaggtttatcggttttcgggttcgtcggggatttttcggagtcgtttcggtcgcgtcggaggagggcggggagaggattatgtgagtgggtttcggagttttagcgtcgcgtaggtaagtaggcggcggggatgcgtcgcgggaggtttcggggatgttgcggagaagttcggtcgtcggcgttttcgcgtacgtcgttttcgtcgtagggttcggtgttgcggttttttggtcgttagggcgtttcgcggggttgtcggggagtcggtgtttggggttttttcgcggttgtatcggaggatatttttgcggggtgcggtttcgaggtagcgcggggatggggattttattttttcgttcgtaagcgg

SEQ ID NO: 34000 - DNA, 558 bp, Artificial Sequence
  chemically treated genomic DNA (Homo sapiens) CpG-island No: 34000
ccgcttacgaacgaaaaaataaaatccccatccccgcgctacctcgaaaccgcaccccgcaaaaatatcctccgatacaaccgcgaaaaaaccccaaacaccgactccccgacaaccccgcgaaacgccctaacgaccaaaaaaccgcaacaccgaaccctacgacgaaaacgacgtacgcgaaaacgccgacgaccgaacttctccgcaacatccccgaaacctcccgcgacgcatccccgccgcctacttacctacgcgacgctaaaactccgaaacccactcacataatcctctccccgccctcctccgacgcgaccgaaacgactccgaaaaatccccgacgaacccgaaaaccgataaaccttccgaaaacaccgaaaaaacgacacctttttttctttatacccgacgaccgattttttatataaaacgaacgacgaccgccgaacgatacgacgcgaacgaaaaataaataaacgccccgacgatcctaaaaactctaaaaaaaacgcgacgcgcccgaacgaaaaaaaaccgcgccgctcgcacaacaac

SEQ ID NO: 34001 - DNA, 876 bp, Artificial Sequence
  chemically treated genomic DNA (Homo sapiens) CpG-island No: 34001
tttcggaggaagtaggcgagcgtcggtagatttataaataaggaaggttttgttttcgcgcggtcgcgttattttcgcggtagaagtttgattttttgtttttcggtttttcgtacgcgtttttttcgggtttcgtattcgtattcgttcggcgcggtcgaattaattgtagagtagtttgtgtttattcggtcgaggtttcggcgttttcggggcgagcgtcgattcgcggtttttaggaggcgagtttagggtttcggtcgttcgtcggtgacgggggagcgcggcgcgggttttcgtcggcgtttattcgcgggcgcgggtcggacgtttttacgtaggggcgtcgcgttttttcgtcgttgtcgttgtcggtcgtcgtgtagggtttcggggttgcgtttcggtcgtcgtcgtttgtttcgtcgcggtcgtcgaggatttggtgggaggtggaagggatagcgcgttaaggttagttttaaagttaagtcgaattttgttgcggggggcgcgcgggggcggcgacgcgtgtgcgttgggcgcgggttgcggagttgacggcgtagttttgggcggttttttcggaggcggtggttttcgtttttcgcgttcgtttcgttagtggcggtcgtacgatcgcgcgtattagcgaataatagtcgttcgtgatattttcgttgatatcgtttcggacgggcggggtggggggcgagcggttgtcgttgtagggggcggcgagtatttgttttgttttgtttttatcgtcgcgtcgttagcgttaggtgttttttttttatttcggttttttcggttttttgggcgtagggttatttattagtgtcgtcggattcggcgggtatttttttttcggtt

SEQ ID NO: 34002 - DNA, 876 bp, Artificial Sequence
  chemically treated genomic DNA (Homo sapiens) CpG-island No: 34002
aaccgaaaaaaaaatacccgccgaatccgacgacactaataaataaccctacgcccaaaaaaccgaaaaaaccgaaataaaaaaaaaacacctaacgctaacgacgcgacgataaaaacaaaacaaaacaaatactcgccgccccctacaacgacaaccgctcgccccccaccccgcccgtccgaaacgatatcaacgaaaatatcacgaacgactattattcgctaatacgcgcgatcgtacgaccgccactaacgaaacgaacgcgaaaaacgaaaaccaccgcctccgaaaaaaccgcccaaaactacgccgtcaactccgcaacccgcgcccaacgcacacgcgtcgccgcccccgcgcgccccccgcaacaaaattcgacttaactttaaaactaaccttaacgcgctatcccttccacctcccaccaaatcctcgacgaccgcgacgaaacaaacgacgacgaccgaaacgcaaccccgaaaccctacacgacgaccgacaacgacaacgacgaaaaaacgcgacgcccctacgtaaaaacgtccgacccgcgcccgcgaataaacgccgacgaaaacccgcgccgcgctcccccgtcaccgacgaacgaccgaaaccctaaactcgcctcctaaaaaccgcgaatcgacgctcgccccgaaaacgccgaaacctcgaccgaataaacacaaactactctacaattaattcgaccgcgccgaacgaatacgaatacgaaacccgaaaaaaacgcgtacgaaaaaccgaaaaacaaaaaatcaaacttctaccgcgaaaataacgcgaccgcgcgaaaacaaaaccttccttatttataaatctaccgacgctcgcctacttcctccgaaa

SEQ ID NO: 34003 - DNA, 876 bp, Artificial Sequence
  chemically treated genomic DNA (Homo sapiens) CpG-island No: 34003
agtcgggaaaggggtgttcgtcggattcgacggtattggtgggtggttttgcgtttagggagtcggagggatcggggtggggaaggggtatttggcgttggcggcgcggcggtggggatagagtagggtaagtgttcgtcgttttttgtagcggtagtcgttcgttttttatttcgttcgttcgggacggtattagcggagatgttacgggcggttattattcgttggtgcgcgcggtcgtgcggtcgttattgacggggcgggcgcggggggcgggggttatcgttttcggggagatcgtttagagttgcgtcgttagtttcgtagttcgcgtttagcgtatacgcgtcgtcgttttcgcgcgtttttcgtagtaaagttcggtttaattttgaggttggttttgacgcgttgttttttttattttttattaggttttcggcggtcgcggcgaagtaggcggcggcggtcggagcgtagtttcgggattttgtacggcggtcggtagcgatagcggcgaagggacgcggcgtttttgcgtggggacgttcggttcgcgttcgcgagtgggcgtcgacggggattcgcgtcgcgttttttcgttatcggcgagcggtcggagttttgagttcgttttttggaagtcgcgggtcggcgttcgtttcgagggcgtcgggatttcggtcgggtgaatataaattgttttgtaattgattcgatcgcgtcgggcgggtgcgggtgcggggttcggagggagcgcgtgcggaaggtcggagggtaggaagttaggtttttgtcgcgagggtggcgcggtcgcgcggggatagagttttttttatttatgagtttgtcggcgttcgtttgtttttttcgaag

SEQ ID NO: 34004 - DNA, 876 bp, Artificial Sequence
  chemically treated genomic DNA (Homo sapiens) CpG-island No: 34004
cttcgaaaaaaacaaacgaacgccgacaaactcataaataaaaaaaactctatccccgcgcgaccgcgccaccctcgcgacaaaaacctaacttcctaccctccgaccttccgcacgcgctccctccgaaccccgcacccgcacccgcccgacgcgatcgaatcaattacaaaacaatttatattcacccgaccgaaatcccgacgccctcgaaacgaacgccgacccgcgacttccaaaaaacgaactcaaaactccgaccgctcgccgataacgaaaaaacgcgacgcgaatccccgtcgacgcccactcgcgaacgcgaaccgaacgtccccacgcaaaaacgccgcgtcccttcgccgctatcgctaccgaccgccgtacaaaatcccgaaactacgctccgaccgccgccgcctacttcgccgcgaccgccgaaaacctaataaaaaataaaaaaaacaacgcgtcaaaaccaacctcaaaattaaaccgaactttactacgaaaaacgcgcgaaaacgacgacgcgtatacgctaaacgcgaactacgaaactaacgacgcaactctaaacgatctccccgaaaacgataacccccgccccccgcgcccgccccgtcaataacgaccgcacgaccgcgcgcaccaacgaataataaccgcccgtaacatctccgctaataccgtcccgaacgaacgaaataaaaaacgaacgactaccgctacaaaaaacgacgaacacttaccctactctatccccaccgccgcgccgccaacgccaaataccccttccccaccccgatccctccgactccctaaacgcaaaaccacccaccaataccgtcgaatccgacgaacacccctttcccgact

SEQ ID NO: 34005 - DNA, 590 bp, Artificial Sequence
  chemically treated genomic DNA (Homo sapiens) CpG-island No: 34005
cgatttgtgcgaggttcgcgcgcggcgcggacgatgttgaggtataagtagagcgtaatggttacggtttagaagaaggagttggtgttggcgaaggtggatagcgcgttttgtagtacgtagttttacgacgggttcgcgaagttttgtagtatttcgtagaagtaggaggcggtcgagagtaggtcggttagcgataggaagagtagtaggcgtcgtgttcggttgcgtaggtcgggttatagggcgtgcgtggttattagtaggttcgagtcgagcgcggagagtgcgtacgatagtagtattacggcgcgtttcgacggtattagttcggtgggcggcggggacggttgtatggcgtggggggttaggagtcggagcgtcgcgaggatagaagtcgggtcgcgcgtgcggttacgtcgtcgtcgtttgggtatcgaggcgttttaggttcgcgtttaggcgttcgtttcgttcgcgttcggtcgttttttcgtttatttgggtttcgggttttgaatttcgtttacgttttgcgtttcgtttttatatttcgggttttgagtttcgtttacgcgtcgcgttttatt

SEQ ID NO: 34006 - DNA, 590 bp, Artificial Sequence
  chemically treated genomic DNA (Homo sapiens) CpG-island No: 34006
aataaaacgcgacgcgtaaacgaaactcaaaacccgaaatataaaaacgaaacgcaaaacgtaaacgaaattcaaaacccgaaacccaaataaacgaaaaaacgaccgaacgcgaacgaaacgaacgcctaaacgcgaacctaaaacgcctcgatacccaaacgacgacgacgtaaccgcacgcgcgacccgacttctatcctcgcgacgctccgactcctaaccccccacgccatacaaccgtccccgccgcccaccgaactaataccgtcgaaacgcgccgtaatactactatcgtacgcactctccgcgctcgactcgaacctactaataaccacgcacgccctataacccgacctacgcaaccgaacacgacgcctactactcttcctatcgctaaccgacctactctcgaccgcctcctacttctacgaaatactacaaaacttcgcgaacccgtcgtaaaactacgtactacaaaacgcgctatccaccttcgccaacaccaactccttcttctaaaccgtaaccattacgctctacttatacctcaacatcgtccgcgccgcgcgcgaacctcgcacaaatcg

SEQ ID NO: 34007 - DNA, 590 bp, Artificial Sequence
  chemically treated genomic DNA (Homo sapiens) CpG-island No: 34007
ggtggggcgcggcgcgtgggcggggtttagggttcgggatataggggcggggcgtagggcgtggacggggtttagggttcggggtttagatgggcgggggagcggtcggacgcgggcggggcgggcgtttggacgcgagtttagggcgtttcggtgtttagacggcggcggcgtggtcgtacgcgcggttcggtttttgttttcgcggcgtttcggtttttggttttttacgttatgtagtcgttttcgtcgtttatcgagttggtgtcgtcggagcgcgtcgtggtgttgttgtcgtgcgtatttttcgcgttcggttcgggtttgttggtggttacgtacgttttgtggttcgatttgcgtagtcgggtacggcgtttgttgttttttttgtcgttggtcgatttgttttcggtcgttttttatttttacggagtgttgtagaatttcgcgggttcgtcgtgggattgcgtgttgtagggcgcgttgtttattttcgttaatattagtttttttttttggatcgtggttattgcgttttatttgtattttagtatcgttcgcgtcgcgcgcgggtttcgtatagatcg

SEQ ID NO: 34008 - DNA, 590 bp, Artificial Sequence
  chemically treated genomic DNA (Homo sapiens) CpG-island No: 34008
cgatctatacgaaacccgcgcgcgacgcgaacgatactaaaatacaaataaaacgcaataaccacgatccaaaaaaaaaaactaatattaacgaaaataaacaacgcgccctacaacacgcaatcccacgacgaacccgcgaaattctacaacactccgtaaaaataaaaaacgaccgaaaacaaatcgaccaacgacaaaaaaaacaacaaacgccgtacccgactacgcaaatcgaaccacaaaacgtacgtaaccaccaacaaacccgaaccgaacgcgaaaaatacgcacgacaacaacaccacgacgcgctccgacgacaccaactcgataaacgacgaaaacgactacataacgtaaaaaaccaaaaaccgaaacgccgcgaaaacaaaaaccgaaccgcgcgtacgaccacgccgccgccgtctaaacaccgaaacgccctaaactcgcgtccaaacgcccgccccgcccgcgtccgaccgctcccccgcccatctaaaccccgaaccctaaaccccgtccacgccctacgccccgcccctatatcccgaaccctaaaccccgcccacgcgccgcgccccacc

SEQ ID NO: 34009 - DNA, 582 bp, Artificial Sequence
  chemically treated genomic DNA (Homo sapiens) CpG-island No: 34009
ataagttgcgtcgtttgcggggcgaggttcggttgcgcgacgaggagcggttgcgggaggaggttcggtcgcggggcgaggagcggttacgggaagaggttcggttacgcgaggatgcgtcgttgcgcgttcggttcgtcgcggttttttcgcgggcggagttttggtttttttagtcggtttcgggttcggtttacgcgatttttggggtttacggtgatattcggtttttcgcggttttttgggtagggagtcgcggtttcgtttattttgttcgttcggcgtaatttaggcgtcgcgtttcggttcggggtagtttcgaggaggacgaggacgttcggacgttcgatagggttacgtagggttcgggtttcgcggttcgtcgttggtgggtagcgtttttcgtttcggcgcggttgttttttttttttttcggtttcgattcgcgttcgggtttgcgggcgattcgagcgggttttgttggcgcggcgagggttcggtttgaggtggggcgtcggttggagcgttggttttttcggtttttgttttgggttagtttagggttattgttcgtttttttgg

SEQ ID NO: 34010 - DNA, 582 bp, Artificial Sequence
  chemically treated genomic DNA (Homo sapiens) CpG-island No: 34010
ccaaaaaaacgaacaataaccctaaactaacccaaaacaaaaaccgaaaaaaccaacgctccaaccgacgccccacctcaaaccgaaccctcgccgcgccaacaaaacccgctcgaatcgcccgcaaacccgaacgcgaatcgaaaccgaaaaaaaaaaaaaacaaccgcgccgaaacgaaaaacgctacccaccaacgacgaaccgcgaaacccgaaccctacgtaaccctatcgaacgtccgaacgtcctcgtcctcctcgaaactaccccgaaccgaaacgcgacgcctaaattacgccgaacgaacaaaataaacgaaaccgcgactccctacccaaaaaaccgcgaaaaaccgaatatcaccgtaaaccccaaaaatcgcgtaaaccgaacccgaaaccgactaaaaaaaccaaaactccgcccgcgaaaaaaccgcgacgaaccgaacgcgcaacgacgcatcctcgcgtaaccgaacctcttcccgtaaccgctcctcgccccgcgaccgaacctcctcccgcaaccgctcctcgtcgcgcaaccgaacctcgccccgcaaacgacgcaacttat

SEQ ID NO: 34011 - DNA, 582 bp, Artificial Sequence
  chemically treated genomic DNA (Homo sapiens) CpG-island No: 34011
ttaggaagacgagtagtagttttaggttggtttagagtagaagtcgagagagttagcgttttagtcggcgttttattttaggtcgggttttcgtcgcgttagtagggttcgttcgagtcgttcgtaggttcgggcgcgggtcgggatcgaggagggaggaaggtagtcgcgtcggggcgggagacgttgtttattagcggcgggtcgcgagattcgggttttgcgtggttttgtcgggcgttcgggcgttttcgtttttttcggagttgtttcggatcgaggcgcggcgtttgagttgcgtcgggcgggtaggataggcgaggtcgcggttttttatttaggaagtcgcggagggtcggatattatcgtaggttttaggggtcgcgtaggtcgagttcgaggtcggttgggagagttagggtttcgttcgcggagaggtcgcggcgggtcgggcgcgtagcggcgtattttcgcgtaatcgggttttttttcgtaatcgtttttcgtttcgcggtcgggttttttttcgtagtcgtttttcgtcgcgtagtcgggtttcgtttcgtaggcggcgtagtttgt

SEQ ID NO: 34012 - DNA, 582 bp, Artificial Sequence
  chemically treated genomic DNA (Homo sapiens) CpG-island No: 34012
acaaactacgccgcctacgaaacgaaacccgactacgcgacgaaaaacgactacgaaaaaaaacccgaccgcgaaacgaaaaacgattacgaaaaaaaacccgattacgcgaaaatacgccgctacgcgcccgacccgccgcgacctctccgcgaacgaaaccctaactctcccaaccgacctcgaactcgacctacgcgacccctaaaacctacgataatatccgaccctccgcgacttcctaaataaaaaaccgcgacctcgcctatcctacccgcccgacgcaactcaaacgccgcgcctcgatccgaaacaactccgaaaaaaacgaaaacgcccgaacgcccgacaaaaccacgcaaaacccgaatctcgcgacccgccgctaataaacaacgtctcccgccccgacgcgactaccttcctccctcctcgatcccgacccgcgcccgaacctacgaacgactcgaacgaaccctactaacgcgacgaaaacccgacctaaaataaaacgccgactaaaacgctaactctctcgacttctactctaaaccaacctaaaactactactcgtcttcctaa

SEQ ID NO: 34013 - DNA, 522 bp, Artificial Sequence
  chemically treated genomic DNA (Homo sapiens) CpG-island No: 34013
agggcgcgcgtatgcgtagatttttttgttagcgcgttcgttggtttcgtttttgtttcgttttttttttttttcgttttagtcgttttttcgtcggttatttgggtattttttttttttcgaaaggtttgtgttattcgttgtcgtaggtaagcgtttaagtttcggtttcgtttggtttcgtttattggttattttttatagagtttaagaaaacgtcggtatcggttggtcgttattttgggtttcgcgtgttttcgttttagcgggaggagtcggcgtcgacgaatggcgtttgcgtattaagtttcgtcgtttgttttaggagtggagcgggaggtcggagtgggtatgcgcgattttgtaggcgtatcgttatttttcgtgtaggggcgttgttcgtttttttttgtaagtcgagttaatttagttttcgtttttttggaatcggtttagtttttaggggtaaggcggacgtggagtattttagagatagttttgcgttttttttttaatgattgt

SEQ ID NO: 34014 - DNA, 522 bp, Artificial Sequence
  chemically treated genomic DNA (Homo sapiens) CpG-island No: 34014
acaatcattaaaaaaaaaacgcaaaactatctctaaaatactccacgtccgccttacccctaaaaactaaaccgattccaaaaaaacgaaaactaaattaactcgacttacaaaaaaaaacgaacaacgcccctacacgaaaaataacgatacgcctacaaaatcgcgcatacccactccgacctcccgctccactcctaaaacaaacgacgaaacttaatacgcaaacgccattcgtcgacgccgactcctcccgctaaaacgaaaacacgcgaaacccaaaataacgaccaaccgataccgacgttttcttaaactctataaaaaataaccaataaacgaaaccaaacgaaaccgaaacttaaacgcttacctacgacaacgaataacacaaacctttcgaaaaaaaaaaaatacccaaataaccgacgaaaaaacgactaaaacgaaaaaaaaaaaaaacgaaacaaaaacgaaaccaacgaacgcgctaacaaaaaaatctacgcatacgcgcgccct

SEQ ID NO: 34015 - DNA, 522 bp, Artificial Sequence
  chemically treated genomic DNA (Homo sapiens) CpG-island No: 34015
gtagttattgaaaaagagacgtaaagttgtttttggggtattttacgttcgttttgtttttgggagttgggtcggttttaggaggacgaagattgaattagttcggtttgtagagaaaggcgagtagcgtttttatacggagagtagcggtgcgtttataaagtcgcgtatgtttatttcggtttttcgttttatttttaaggtaggcggcgaggtttagtgcgtaagcgttattcgtcggcgtcgatttttttcgttaaggcgggaatacgcggggtttaagatggcggttagtcggtatcggcgtttttttaagttttgtgaggaatggttagtggacgagattaaacggggtcgggatttgggcgtttatttgcgatagcgggtagtataggtttttcgggagggagagaatatttaggtgatcggcggggaggcggttgggacgaggggaggaaaggacgaggtaggggcggggttaacgagcgcgttagtagggggatttgcgtatgcgcgcgtttt

SEQ ID NO: 34016 - DNA, 522 bp, Artificial Sequence
  chemically treated genomic DNA (Homo sapiens) CpG-island No: 34016
aaaacgcgcgcatacgcaaatccccctactaacgcgctcgttaaccccgcccctacctcgtcctttcctcccctcgtcccaaccgcctccccgccgatcacctaaatattctctccctcccgaaaaacctatactacccgctatcgcaaataaacgcccaaatcccgaccccgtttaatctcgtccactaaccattcctcacaaaacttaaaaaaacgccgataccgactaaccgccatcttaaaccccgcgtattcccgccttaacgaaaaaaatcgacgccgacgaataacgcttacgcactaaacctcgccgcctaccttaaaaataaaacgaaaaaccgaaataaacatacgcgactttataaacgcaccgctactctccgtataaaaacgctactcgcctttctctacaaaccgaactaattcaatcttcgtcctcctaaaaccgacccaactcccaaaaacaaaacgaacgtaaaataccccaaaaacaactttacgtctctttttcaataactac

SEQ ID NO: 34017 - DNA, 1228 bp, Artificial Sequence
  chemically treated genomic DNA (Homo sapiens) CpG-island No: 34017
  misc_feature (774)..(774): n is either a, c, g or t
  misc_feature (800)..(800): n is either a, c, g or t
ttttcgattttgaattattttcgtttttttttaatgttaatcgaatttttttaattttttagtagtttcgtgatagttagtatatatacgtacgttttgtgtttgcgattttggttttgttcgaagacgtttaggagtcggtttaatttttttttgattttcgttttttcgtatatttttcggatcgtcgtatcgttcggttttttttcgggttttatgttttcgttcggtacgatttagcggttcgggtatcggttgttatttattaataggatttcgttttcgcgttcgtttcggaagtataggtacgtcgttcgttttttgaatttttcggggtcgtaggttcgcgtttggttgggtttgtattttattttcgaggtagttttttcgaggtagttttttttcgtttttcgttgttgtgtgggtcgtcgttgtcgttgtcgtcgtcggggaatagtcgaggtgttgggaagagaaagggtcgaggcgaggggcggggaaagagaggcgttttcgtttgttcgcgagttcggggagcggagggagagatgaagttgggcggggcgtaggcggaggcgggggtagcgaggcgcgttagttagtcggtagttcgatgggcggtcggtcgaattcgggttcgtcggagtggaggaggtgtcgtcgttcgcgagttcgcgattgtttatagattttattcgtttgtcgggggcgcgttttttttttttcgtcgcgggtaagggtttgagcgaggtgaggcgtattaacggacgcgtncgcgttttcgtttacgtgcgcgtttncggcgaagggtaaggggcgggggcgggggttttttggttttcgtagcgcgcgacgtttcgggtttattgcgtaggcgtttcgtatttttgggggtcgagaacgtcgttcgcgtattgtgaaatatatcgtattgtgattttggtcgattgtttttacgtgtgtttttgatttaaacgcgattgtagcgcggtaggacgttttttttttttttttttatcgcgttgtacgaaatttatacgtagtcgttttatatacgatagaggtaagggtatcgtcgttattatttttttttacgatgaattattttggtttatttatgggatttgggtttcggtgttgttaaaacgatttacgggatttttggtagaatagtcgcgtatttttgttgagttatatgatgtagttttatttttttaataggttttta

SEQ ID NO: 34018 - DNA, 1228 bp, Artificial Sequence
  chemically treated genomic DNA (Homo sapiens) CpG-island No: 34018
  misc_feature (429)..(429): n is either a, c, g or t
  misc_feature (455)..(455): n is either a, c, g or t
taaaaacctattaaaaaaataaaactacatcatataactcaacaaaaatacgcgactattctaccaaaaatcccgtaaatcgttttaacaacaccgaaacccaaatcccataaataaaccaaaataattcatcgtaaaaaaaaataataacgacgatacccttacctctatcgtatataaaacgactacgtataaatttcgtacaacgcgataaaaaaaaaaaaaaaaaacgtcctaccgcgctacaatcgcgtttaaatcaaaaacacacgtaaaaacaatcgaccaaaatcacaatacgatatatttcacaatacgcgaacgacgttctcgacccccaaaaatacgaaacgcctacgcaataaacccgaaacgtcgcgcgctacgaaaaccaaaaaacccccgcccccgccccttacccttcgccgnaaacgcgcacgtaaacgaaaacgcgnacgcgtccgttaatacgcctcacctcgctcaaacccttacccgcgacgaaaaaaaaaaaacgcgcccccgacaaacgaataaaatctataaacaatcgcgaactcgcgaacgacgacacctcctccactccgacgaacccgaattcgaccgaccgcccatcgaactaccgactaactaacgcgcctcgctacccccgcctccgcctacgccccgcccaacttcatctctccctccgctccccgaactcgcgaacaaacgaaaacgcctctctttccccgcccctcgcctcgaccctttctcttcccaacacctcgactattccccgacgacgacaacgacaacgacgacccacacaacaacgaaaaacgaaaaaaaactacctcgaaaaaactacctcgaaaataaaatacaaacccaaccaaacgcgaacctacgaccccgaaaaattcaaaaaacgaacgacgtacctatacttccgaaacgaacgcgaaaacgaaatcctattaataaataacaaccgatacccgaaccgctaaatcgtaccgaacgaaaacataaaacccgaaaaaaaaccgaacgatacgacgatccgaaaaatatacgaaaaaacgaaaatcaaaaaaaaattaaaccgactcctaaacgtcttcgaacaaaaccaaaatcgcaaacacaaaacgtacgtatatatactaactatcacgaaactactaaaaaattaaaaaaattcgattaacattaaaaaaaaacgaaaataattcaaaatcgaaaa

SEQ ID NO: 34019 - DNA, 1228 bp, Artificial Sequence
  chemically treated genomic DNA (Homo sapiens) CpG-island No: 34019
  misc_feature (429)..(429): n is either a, c, g or t
  misc_feature (455)..(455): n is either a, c, g or t
tgggaatttgttgaagaaataaaattgtattatgtgatttagtaaggatgcgcggttattttgttaagaatttcgtgggtcgttttgataatatcggggtttaggttttatgagtaagttagaatggtttatcgtgggggaggatgatgacgacgatgtttttgtttttgtcgtgtgtaaaacggttgcgtgtgggtttcgtgtagcgcggtggggagggagaggagaaacgttttgtcgcgttatagtcgcgtttgggttaaaggtatacgtggaggtagtcggttaaagttataatgcggtgtattttatagtgcgcgaacgacgttttcggtttttaggggtgcggggcgtttgcgtagtgggttcgaggcgtcgcgcgttgcgggagttaggagattttcgttttcgttttttgtttttcgtcgngaacgcgtacgtgaacgggagcgcgnacgcgttcgttaatgcgttttatttcgtttaaatttttattcgcggcggagggagggagacgcgttttcgataagcgagtggggtttgtggatagtcgcgggttcgcgggcggcggtattttttttatttcggcgggttcgggttcggtcggtcgtttatcggattgtcgattggttgacgcgtttcgttgttttcgttttcgtttgcgtttcgtttagttttattttttttttcgtttttcgggttcgcgggtagacggaggcgttttttttttttcgtttttcgtttcggttttttttttttttagtatttcggttgtttttcggcggcggtagcggtagcggcggtttatatagtagcgagaggcgagaggaggttgtttcgaggaggttgtttcgaggatgaagtgtaaatttaattagacgcggatttacgatttcgaggggtttaagaagcgggcggcgtgtttgtgttttcggagcgaacgcgaggacgaggttttgttagtgagtagtagtcggtattcggatcgttggatcgtgtcgggcgggggtatggagttcgaggaggagtcgggcggtgcggcggttcgagaggtgtacgaagaagcgggagttaaggggaagttaggtcggtttttgggcgttttcgaatagaattaggatcgtaagtatagaacgtacgtgtatgtattgattgttacggagttgttggaggattgggaagattcggttagtattgggaggaagcgagagtggtttaaagtcgaaga

SEQ ID NO: 34020 - DNA, 1228 bp, Artificial Sequence
  chemically treated genomic DNA (Homo sapiens) CpG-island No: 34020
  misc_feature (774)..(774): n is either a, c, g or t
  misc_feature (800)..(800): n is either a, c, g or t
tcttcgactttaaaccactctcgcttcctcccaatactaaccgaatcttcccaatcctccaacaactccgtaacaatcaatacatacacgtacgttctatacttacgatcctaattctattcgaaaacgcccaaaaaccgacctaacttccccttaactcccgcttcttcgtacacctctcgaaccgccgcaccgcccgactcctcctcgaactccatacccccgcccgacacgatccaacgatccgaataccgactactactcactaacaaaacctcgtcctcgcgttcgctccgaaaacacaaacacgccgcccgcttcttaaacccctcgaaatcgtaaatccgcgtctaattaaatttacacttcatcctcgaaacaacctcctcgaaacaacctcctctcgcctctcgctactatataaaccgccgctaccgctaccgccgccgaaaaacaaccgaaatactaaaaaaaaaaaaaaccgaaacgaaaaacgaaaaaaaaaaaacgcctccgtctacccgcgaacccgaaaaacgaaaaaaaaaataaaactaaacgaaacgcaaacgaaaacgaaaacaacgaaacgcgtcaaccaatcgacaatccgataaacgaccgaccgaacccgaacccgccgaaataaaaaaaataccgccgcccgcgaacccgcgactatccacaaaccccactcgcttatcgaaaacgcgtctccctccctccgccgcgaataaaaatttaaacgaaataaaacgcattaacgaacgcgtncgcgctcccgttcacgtacgcgttcncgacgaaaaacaaaaaacgaaaacgaaaatctcctaactcccgcaacgcgcgacgcctcgaacccactacgcaaacgccccgcacccctaaaaaccgaaaacgtcgttcgcgcactataaaatacaccgcattataactttaaccgactacctccacgtatacctttaacccaaacgcgactataacgcgacaaaacgtttctcctctccctccccaccgcgctacacgaaacccacacgcaaccgttttacacacgacaaaaacaaaaacatcgtcgtcatcatcctcccccacgataaaccattctaacttactcataaaacctaaaccccgatattatcaaaacgacccacgaaattcttaacaaaataaccgcgcatccttactaaatcacataatacaattttatttcttcaacaaattccca

SEQ ID NO: 34021 - DNA, 596 bp, Artificial Sequence
  chemically treated genomic DNA (Homo sapiens) CpG-island No: 34021
  misc_feature (568)..(568): n is either a, c, g or t
tttgtattttattttcgaggtagttttttttcgtttttcgttgttgtgtgggtcgtcgacgtagttgttgtcgttgtcgggtagtagtcgaggtgttgggaagagaaagggtcgaggagaggggcggggagagagaggcgttttcgtttgtcgtttgttttcgagttcggggagcggagggagagatgaagttgggcggggtacgggcggaggcgggggtaagcgaggcgtgttagttagttagttcgttagttcgatgggcggtcggtcgaattcgggttcgtcggagtggaggaggcgttgttgttcgcgagttcgcgattttttatagagtttattcgtttttgcgaggtgaagcgtattttcgggcgcgttcgcgttttcgtttacgtgcgcgttcgtaggggagggcgtgggttgaggggcgaggaatcggggcgaggggttaggggcgggggttttttggttttcgtagcgcgtaacgtttggggtttattgcgtaggcgtttcgtatttttggggttaggaatttttttggcgtatagcgaaatttatcgtattgtgattntggttaagattgtttttatgtgtgtttt

SEQ ID NO: 34022 - DNA, 596 bp, Artificial Sequence
  chemically treated genomic DNA (Homo sapiens) CpG-island No: 34022
  misc_feature (29)..(29): n is either a, c, g or t
aaaacacacataaaaacaatcttaaccanaatcacaatacgataaatttcgctatacgccaaaaaaattcctaaccccaaaaatacgaaacgcctacgcaataaaccccaaacgttacgcgctacgaaaaccaaaaaacccccgcccctaacccctcgccccgattcctcgcccctcaacccacgccctcccctacgaacgcgcacgtaaacgaaaacgcgaacgcgcccgaaaatacgcttcacctcgcaaaaacgaataaactctataaaaaatcgcgaactcgcgaacaacaacgcctcctccactccgacgaacccgaattcgaccgaccgcccatcgaactaacgaactaactaactaacacgcctcgcttacccccgcctccgcccgtaccccgcccaacttcatctctccctccgctccccgaactcgaaaacaaacgacaaacgaaaacgcctctctctccccgcccctctcctcgaccctttctcttcccaacacctcgactactacccgacaacgacaacaactacgtcgacgacccacacaacaacgaaaaacgaaaaaaaactacctcgaaaataaaatacaaa

SEQ ID NO: 34023 - DNA, 596 bp, Artificial Sequence
  chemically treated genomic DNA (Homo sapiens) CpG-island No: 34023
  misc_feature (29)..(29): n is either a, c, g or t
aaggtatatatggaggtagttttggttanagttataatgcggtgaatttcgttgtgcgttaaggaggtttttggttttaggagtgcgaagcgtttgcgtagtgggttttaggcgttgcgcgttgcgggagttaggagattttcgtttttggtttttcgtttcggtttttcgttttttagtttacgtttttttttgcgaacgcgtacgtgaacgggagcgcggacgcgttcgagaatgcgttttatttcgtagaagcgggtgggttttgtggagagtcgcgggttcgcgggtagtagcgttttttttatttcggcgggttcgggttcggtcggtcgtttatcggattggcggattggttgattgatacgtttcgtttgttttcgttttcgttcgtgtttcgtttagttttattttttttttcgtttttcgggttcgggggtagacggtagacggaggcgttttttttttttcgttttttttttcggttttttttttttttagtatttcggttgttgttcggtagcggtagtagttgcgtcggcggtttatatagtagcgagaggcgagaggaggttgtttcgaggatgaagtgtaaa

SEQ ID NO: 34024 - DNA, 596 bp, Artificial Sequence
  chemically treated genomic DNA (Homo sapiens) CpG-island No: 34024
  misc_feature (568)..(568): n is either a, c, g or t
tttacacttcatcctcgaaacaacctcctctcgcctctcgctactatataaaccgccgacgcaactactaccgctaccgaacaacaaccgaaatactaaaaaaaaaaaaaaccgaaaaaaaaaacgaaaaaaaaaaaacgcctccgtctaccgtctacccccgaacccgaaaaacgaaaaaaaaaataaaactaaacgaaacacgaacgaaaacgaaaacaaacgaaacgtatcaatcaaccaatccgccaatccgataaacgaccgaccgaacccgaacccgccgaaataaaaaaaacgctactacccgcgaacccgcgactctccacaaaacccacccgcttctacgaaataaaacgcattctcgaacgcgtccgcgctcccgttcacgtacgcgttcgcaaaaaaaaacgtaaactaaaaaacgaaaaaccgaaacgaaaaaccaaaaacgaaaatctcctaactcccgcaacgcgcaacgcctaaaacccactacgcaaacgcttcgcactcctaaaaccaaaaacctccttaacgcacaacgaaattcaccgcattataactntaaccaaaactacctccatatatacctt

SEQ ID NO: 34025 - DNA, 651 bp, Artificial Sequence
  chemically treated genomic DNA (Homo sapiens) CpG-island No: 34025
tagcgattttggtattgtgcgtcgttgagtttttttggcgggcgttcgtttttttcgcgtttggttttgatttttgtttatttcggtgttgtttatttcggttcggattcggtcgtagagcggggttttggtttgtcgggtttcgagattgtgtttttattcgcgttttcggtcgttcgcgttttcgcgttcgggttttcgggggtcgttttatttgtatgttcggagttttcgggtcgattttcgtgtttaggattgcgatgagtatttttcgtttattatatttcgggtagcggtagaggaaggaggcggtttcggttttttttttcggtaggagatcgtgaaaagggaagggttttttagtcgtagcggtggttatggacgtaggatggaggacgaggaagcggtaaattgttaggttgcgcgcggattagtagcgcgaggatattcgtgcggtttcgggtcggaggcgggggcgaggggcggggtcggttcgttttttattaatttcggtttgttagggagcggtggttaattacgtgttgttacgtaagttaacggcgtcgtttttaggagttaggttcgagtattgttcgggttgtagtgaagggggaggagtttgaggatattattggagggttcggatttcga

SEQ ID NO: 34026 - DNA, 651 bp, Artificial Sequence
  chemically treated genomic DNA (Homo sapiens) CpG-island No: 34026
tcgaaatccgaaccctccaataatatcctcaaactcctcccccttcactacaacccgaacaatactcgaacctaactcctaaaaacgacgccgttaacttacgtaacaacacgtaattaaccaccgctccctaacaaaccgaaattaataaaaaacgaaccgaccccgcccctcgcccccgcctccgacccgaaaccgcacgaatatcctcgcgctactaatccgcgcgcaacctaacaatttaccgcttcctcgtcctccatcctacgtccataaccaccgctacgactaaaaaacccttcccttttcacgatctcctaccgaaaaaaaaaaccgaaaccgcctccttcctctaccgctacccgaaatataataaacgaaaaatactcatcgcaatcctaaacacgaaaatcgacccgaaaactccgaacatacaaataaaacgacccccgaaaacccgaacgcgaaaacgcgaacgaccgaaaacgcgaataaaaacacaatctcgaaacccgacaaaccaaaaccccgctctacgaccgaatccgaaccgaaataaacaacaccgaaataaacaaaaatcaaaaccaaacgcgaaaaaaacgaacgcccgccaaaaaaactcaacgacgcacaataccaaaatcgcta

SEQ ID NO: 34027 - DNA, 651 bp, Artificial Sequence
  chemically treated genomic DNA (Homo sapiens) CpG-island No: 34027
tcgagattcgaattttttagtaatgtttttagatttttttttttttattgtagttcgggtaatattcgggtttagtttttgagagcggcgtcgttggtttacgtagtagtacgtgattggttatcgttttttggtaggtcgggattggtggaagacgggtcgatttcgtttttcgttttcgttttcggttcgaggtcgtacgggtgttttcgcgttgttagttcgcgcgtagtttggtagtttgtcgttttttcgttttttattttgcgtttatggttatcgttgcgattgaggagtttttttttttttacggttttttgtcgaagaaggagatcggagtcgttttttttttttgtcgttattcggagtatgatgggcggggggtgtttatcgtagttttggatacgggggtcgattcgggggtttcgggtatgtaggtgaggcggttttcgagggttcgggcgcgggggcgcgggcggtcggggacgcgggtggggatatagtttcggagttcggtaggttaaagtttcgttttgcggtcgagttcgggtcggggtgggtagtatcggggtgggtagaggttagagttaggcgcgggagggacgggcgttcgttaaggggatttaacggcgtatagtgttagggtcgttg

SEQ ID NO: 34028 - DNA, 651 bp, Artificial Sequence
  chemically treated genomic DNA (Homo sapiens) CpG-island No: 34028
caacgaccctaacactatacgccgttaaatccccttaacgaacgcccgtccctcccgcgcctaactctaacctctacccaccccgatactacccaccccgacccgaactcgaccgcaaaacgaaactttaacctaccgaactccgaaactatatccccacccgcgtccccgaccgcccgcgcccccgcgcccgaaccctcgaaaaccgcctcacctacatacccgaaacccccgaatcgacccccgtatccaaaactacgataaacaccccccgcccatcatactccgaataacgacaaaaaaaaaaaacgactccgatctccttcttcgacaaaaaaccgtaaaaaaaaaaaaactcctcaatcgcaacgataaccataaacgcaaaataaaaaacgaaaaaacgacaaactaccaaactacgcgcgaactaacaacgcgaaaacacccgtacgacctcgaaccgaaaacgaaaacgaaaaacgaaatcgacccgtcttccaccaatcccgacctaccaaaaaacgataaccaatcacgtactactacgtaaaccaacgacgccgctctcaaaaactaaacccgaatattacccgaactacaataaaaaaaaaaaaatctaaaaacattactaaaaaattcgaatctcga

SEQ ID NO: 34029 - DNA, 1244 bp, Artificial Sequence
  chemically treated genomic DNA (Homo sapiens) CpG-island No: 34029
agttatagcggtgcgaacgagaggcggaagcgagaggcgtattaagtaaagttcggtgtttgcgttcggcgtttgtggcgttgtcgggagttaggtggttcgttcgagtcggaattttaggagtagcgggtgcggagttagagcggagttcgttagggattggtttcggcgaatattcggagcgcgaacgaagttcgaagggttcggtaacggatcggtcggtcggtttaggagggcgcgagcgaggtagggagcggcgtggagcgggtagcgggcggacgggcgggagcggagcggcgcggggcgaggggagcggagcggagcgcggcggcggggttcgtacggcggcgttgaggggcgtagagttgcgtcgaatcgagacggtcggtttggagtgcgagtcgggcggtcgtcggcgcggagtgaagtggtacggagtcgagggtagttgaggggttcgatattatgaggagtgcggcgtcgtcgtcgtagtcgttatcgttttagtgtttcgtatcgtttttagtcgggacgtcgggtagcgtttagcgggtcgggcggcggcgttcgggttgagagcgacggagcgcgggagcggcgcggagacggtattagagcgtttcgcgatttcggtttgagcggggtatcgcgtcggtcggtttgttttattatgtagttttcgaggtagagtttggacggcgtcgaggagcgtagagcggcgcgtagttcgttcgttttagacggtcgtttggtttcgcgtttgtttgttttttttagttcggatttttttgaaatatgtttaggggcgtttggatgtggttcgggaaagacgtcgtcgcgttgattatttgttgttgttgttgttgttgggtttttaggtcgagcgataaattttgcgtcgatttcgagcgggcgtagcgatggcgattgtttttggcgtttttgtttttttttatcgtgttgttcgttgattatttgtggttgtgcgcgggggttcggtttcgggttagggagttgagtagcgttatgcggtttttatggggggtcggtcgggagcggtagtcggtgttttttcgcgcggtgttgacgttgtcgtcgtcgtcgttcggcgagtttaatagcgtttttaggtatttgcggttttagatatagtaatttgattaaagtcgtttttttcggcggttttcggtcggtttgtcgcggcgttttagagtttatcgggttggacgtagtttgtattaaat

SEQ ID NO: 34030 - DNA, 1244 bp, Artificial Sequence
  chemically treated genomic DNA (Homo sapiens) CpG-island No: 34030
atttaatacaaactacgtccaacccgataaactctaaaacgccgcgacaaaccgaccgaaaaccgccgaaaaaaacgactttaatcaaattactatatctaaaaccgcaaatacctaaaaacgctattaaactcgccgaacgacgacgacgacaacgtcaacaccgcgcgaaaaaacaccgactaccgctcccgaccgaccccccataaaaaccgcataacgctactcaactccctaacccgaaaccgaacccccgcgcacaaccacaaataatcaacgaacaacacgataaaaaaaaacaaaaacgccaaaaacaatcgccatcgctacgcccgctcgaaatcgacgcaaaatttatcgctcgacctaaaaacccaacaacaacaacaacaacaaataatcaacgcgacgacgtctttcccgaaccacatccaaacgcccctaaacatatttcaaaaaaatccgaactaaaaaaaacaaacaaacgcgaaaccaaacgaccgtctaaaacgaacgaactacgcgccgctctacgctcctcgacgccgtccaaactctacctcgaaaactacataataaaacaaaccgaccgacgcgataccccgctcaaaccgaaatcgcgaaacgctctaataccgtctccgcgccgctcccgcgctccgtcgctctcaacccgaacgccgccgcccgacccgctaaacgctacccgacgtcccgactaaaaacgatacgaaacactaaaacgataacgactacgacgacgacgccgcactcctcataatatcgaacccctcaactaccctcgactccgtaccacttcactccgcgccgacgaccgcccgactcgcactccaaaccgaccgtctcgattcgacgcaactctacgcccctcaacgccgccgtacgaaccccgccgccgcgctccgctccgctcccctcgccccgcgccgctccgctcccgcccgtccgcccgctacccgctccacgccgctccctacctcgctcgcgccctcctaaaccgaccgaccgatccgttaccgaacccttcgaacttcgttcgcgctccgaatattcgccgaaaccaatccctaacgaactccgctctaactccgcacccgctactcctaaaattccgactcgaacgaaccacctaactcccgacaacgccacaaacgccgaacgcaaacaccgaactttacttaatacgcctctcgcttccgcctctcgttcgcaccgctataact

SEQ ID NO: 34031 - DNA, 1244 bp, Artificial Sequence
  chemically treated genomic DNA (Homo sapiens) CpG-island No: 34031
atttggtgtaagttgcgtttagttcggtgggttttggagcgtcgcggtagatcggtcgagagtcgtcggagggggcggttttggttaggttgttgtatttggggtcgtaggtgtttgggggcgttgttgggttcgtcgggcggcggcggcggtaacgttagtatcgcgcgaggaggtatcggttgtcgttttcggtcggttttttatgggggtcgtatggcgttgtttagttttttggttcggggtcgggttttcgcgtatagttatagatggttagcgagtagtacggtgaagaagagtagggacgttagggatagtcgttatcgttgcgttcgttcggagtcggcgtaaggtttgtcgttcggtttgggagtttagtagtagtagtagtagtagatagttagcgcggcggcgtttttttcgggttatatttaagcgtttttgaatatattttaggggggttcgggttggagggaataggtaggcgcgaggttagacggtcgtttggggcgggcgggttgcgcgtcgttttgcgtttttcggcgtcgtttaggttttatttcgggggttgtatggtgaggtaggtcggtcggcgcgatgtttcgtttaggtcggagtcgcggggcgttttggtgtcgttttcgcgtcgttttcgcgtttcgtcgtttttagttcgggcgtcgtcgttcggttcgttaggcgttgttcggcgtttcggttgggggcggtgcggggtattggggcggtggcggttgcggcggcggcgtcgtattttttatagtgtcgggttttttagttgttttcggtttcgtgttattttatttcgcgtcggcggtcgttcggttcgtattttaaatcggtcgtttcggttcggcgtagttttgcgttttttagcgtcgtcgtgcgggtttcgtcgtcgcgtttcgtttcgtttttttcgtttcgcgtcgtttcgttttcgttcgttcgttcgttgttcgttttacgtcgttttttgtttcgttcgcgtttttttaggtcggtcggtcggttcgttgtcgggtttttcgggtttcgttcgcgtttcgggtgttcgtcggggttagtttttggcgggtttcgttttggtttcgtattcgttgtttttggagtttcggttcgggcgggttatttggttttcggtagcgttataggcgtcggacgtagatatcgggttttatttagtgcgtttttcgttttcgtttttcgttcgtatcgttgtggtt

SEQ ID NO: 34032 - DNA, 1244 bp, Artificial Sequence
  chemically treated genomic DNA (Homo sapiens) CpG-island No: 34032
aaccacaacgatacgaacgaaaaacgaaaacgaaaaacgcactaaataaaacccgatatctacgtccgacgcctataacgctaccgaaaaccaaataacccgcccgaaccgaaactccaaaaacaacgaatacgaaaccaaaacgaaacccgccaaaaactaaccccgacgaacacccgaaacgcgaacgaaacccgaaaaacccgacaacgaaccgaccgaccgacctaaaaaaacgcgaacgaaacaaaaaacgacgtaaaacgaacaacgaacgaacgaacgaaaacgaaacgacgcgaaacgaaaaaaacgaaacgaaacgcgacgacgaaacccgcacgacgacgctaaaaaacgcaaaactacgccgaaccgaaacgaccgatttaaaatacgaaccgaacgaccgccgacgcgaaataaaataacacgaaaccgaaaacaactaaaaaacccgacactataaaaaatacgacgccgccgccgcaaccgccaccgccccaataccccgcaccgcccccaaccgaaacgccgaacaacgcctaacgaaccgaacgacgacgcccgaactaaaaacgacgaaacgcgaaaacgacgcgaaaacgacaccaaaacgccccgcgactccgacctaaacgaaacatcgcgccgaccgacctacctcaccatacaacccccgaaataaaacctaaacgacgccgaaaaacgcaaaacgacgcgcaacccgcccgccccaaacgaccgtctaacctcgcgcctacctattccctccaacccgaacccccctaaaatatattcaaaaacgcttaaatataacccgaaaaaaacgccgccgcgctaactatctactactactactactactaaactcccaaaccgaacgacaaaccttacgccgactccgaacgaacgcaacgataacgactatccctaacgtccctactcttcttcaccgtactactcgctaaccatctataactatacgcgaaaacccgaccccgaaccaaaaaactaaacaacgccatacgacccccataaaaaaccgaccgaaaacgacaaccgatacctcctcgcgcgatactaacgttaccgccgccgccgcccgacgaacccaacaacgcccccaaacacctacgaccccaaatacaacaacctaaccaaaaccgccccctccgacgactctcgaccgatctaccgcgacgctccaaaacccaccgaactaaacgcaacttacaccaaat

SEQ ID NO: 34033 - DNA, 536 bp, Artificial Sequence
  chemically treated genomic DNA (Homo sapiens) CpG-island No: 34033
ttttcgggtttcgcgagataaagggcggtgttttataaaggcggcggcggcggcggcgcggtgtttaggcgagggcgtatacggtcggcgagggcgacggttacggcgacgacgcgggttttttgcgaggaggtgcgtggatttcggggggatatgggcgtaattagggtcgggttcgtgggtttgcgggtttttcgttgagttatatttattcgggagagtaggaatgcggcggagatttggtagcggttatcgagttaattcggtgggaagatcgggggatttttcgcggggtaggggcggtggtttagtttcgggggtgttaggtcgattttttagcgtgttggcgggttcgcgtcgtttttatgcgtgatgtcggggatttttttgtatcgttttcggcggcgtattttttagagttttttaaggagttcgcgcgttttcgagcgattttcggatatttggtagattcgaaattttagttattagatgtttttttggattttttaaatatttaattattaggtaaggtaatg

SEQ ID NO: 34034 - DNA, 536 bp, Artificial Sequence
  chemically treated genomic DNA (Homo sapiens) CpG-island No: 34034
cattaccttacctaataattaaatatttaaaaaatccaaaaaaacatctaataactaaaatttcgaatctaccaaatatccgaaaatcgctcgaaaacgcgcgaactccttaaaaaactctaaaaaatacgccgccgaaaacgatacaaaaaaatccccgacatcacgcataaaaacgacgcgaacccgccaacacgctaaaaaatcgacctaacacccccgaaactaaaccaccgcccctaccccgcgaaaaatcccccgatcttcccaccgaattaactcgataaccgctaccaaatctccgccgcattcctactctcccgaataaatataactcaacgaaaaacccgcaaacccacgaacccgaccctaattacgcccatatccccccgaaatccacgcacctcctcgcaaaaaacccgcgtcgtcgccgtaaccgtcgccctcgccgaccgtatacgccctcgcctaaacaccgcgccgccgccgccgccgcctttataaaacaccgccctttatctcgcgaaacccgaaaa

SEQ ID NO: 34035 - DNA, 536 bp, Artificial Sequence
  chemically treated genomic DNA (Homo sapiens) CpG-island No: 34035
tattgttttgtttaatgattaagtatttagggagtttaggaaagtatttagtggttgaagtttcgaatttgttaggtgttcgggagtcgttcggggacgcgcgagttttttgaagggttttgggagatgcgtcgtcgagagcggtataagggggttttcggtattacgtataaaagcgacgcgggttcgttaatacgttagagagtcggtttagtattttcggagttgagttatcgtttttgtttcgcggaaagtttttcggtttttttatcgaattggttcggtggtcgttattaagttttcgtcgtatttttgttttttcgggtgagtatggtttagcgagagattcgtaggtttacgagttcggttttggttgcgtttatgttttttcggagtttacgtattttttcgtaaagagttcgcgtcgtcgtcgtagtcgtcgttttcgtcggtcgtgtgcgttttcgtttggatatcgcgtcgtcgtcgtcgtcgtttttataggatatcgttttttgtttcgcggggttcggggg

SEQ ID NO: 34036 - DNA, 536 bp, Artificial Sequence
  chemically treated genomic DNA (Homo sapiens) CpG-island No: 34036
cccccgaaccccgcgaaacaaaaaacgatatcctataaaaacgacgacgacgacgacgcgatatccaaacgaaaacgcacacgaccgacgaaaacgacgactacgacgacgacgcgaactctttacgaaaaaatacgtaaactccgaaaaaacataaacgcaaccaaaaccgaactcgtaaacctacgaatctctcgctaaaccatactcacccgaaaaaacaaaaatacgacgaaaacttaataacgaccaccgaaccaattcgataaaaaaaccgaaaaactttccgcgaaacaaaaacgataactcaactccgaaaatactaaaccgactctctaacgtattaacgaacccgcgtcgcttttatacgtaataccgaaaacccccttataccgctctcgacgacgcatctcccaaaacccttcaaaaaactcgcgcgtccccgaacgactcccgaacacctaacaaattcgaaacttcaaccactaaatactttcctaaactccctaaatacttaatcattaaacaaaacaata

SEQ ID NO: 34037 - DNA, 531 bp, Artificial Sequence
  chemically treated genomic DNA (Homo sapiens) CpG-island No: 34037
cgtgttcgttgaggaacggtagttgggggcgtgcgtcggtgttcgtgtgcgtgtcgaaagcgtaggcgatttggtttttttgttggttgtacgtgtttacggtatataggatgtcgtatattaggaagtagttttcgtaggagtttcgtcgtagtcgtgttttttacgtggtttttcggtgtacggagagatcgtcggggtttaagcgatttaggacgattatttcgggttgggttttatcgcggtcgtttacggcggggtagatgatttataggtcgttttcgtttacggtaaagttaatgttcgagtgttcgcgttatttttaaggtgtggtgtttttatatattacgtcgggtagtagcgtttaggaggttacgaagcgttgtcgtaggtcgtatttgatgatgtttttggtgaaggcgcggttgtagtagaaggcgttttggtatattacgtggtttgtgtcgatttagttgtagggtagtttgtatatgttattttagcggtttgtaggcgagggcgatggttatt

SEQ ID NO: 34038 - DNA, 531 bp, Artificial Sequence
  chemically treated genomic DNA (Homo sapiens) CpG-island No: 34038
aataaccatcgccctcgcctacaaaccgctaaaataacatatacaaactaccctacaactaaatcgacacaaaccacgtaatataccaaaacgccttctactacaaccgcgccttcaccaaaaacatcatcaaatacgacctacgacaacgcttcgtaacctcctaaacgctactacccgacgtaatatataaaaacaccacaccttaaaaataacgcgaacactcgaacattaactttaccgtaaacgaaaacgacctataaatcatctaccccgccgtaaacgaccgcgataaaacccaacccgaaataatcgtcctaaatcgcttaaaccccgacgatctctccgtacaccgaaaaaccacgtaaaaaacacgactacgacgaaactcctacgaaaactacttcctaatatacgacatcctatataccgtaaacacgtacaaccaacaaaaaaaccaaatcgcctacgctttcgacacgcacacgaacaccgacgcacgcccccaactaccgttcctcaacgaacacg

SEQ ID NO: 34039 - DNA, 531 bp, Artificial Sequence
  chemically treated genomic DNA (Homo sapiens) CpG-island No: 34039
ggtgattatcgttttcgtttgtaggtcgttggagtaatatgtataagttattttataattggatcggtataggttacgtggtgtattagggcgttttttattataatcgcgtttttattaagaatattattaagtacgatttacggtagcgtttcgtggttttttgggcgttgttgttcgacgtggtatatgaggatattatattttggaagtggcgcggatattcggatattgattttgtcgtggacgagagcggtttgtgggttatttatttcgtcgtggacgatcgcgatgaggtttagttcgaggtgatcgttttgagtcgtttggatttcggcgattttttcgtgtatcgggagattacgtggaagatacggttgcggcggaatttttacgggaattgttttttggtgtgcggtattttgtatgtcgtggatacgtataattagtaggaaggttaggtcgtttacgttttcgatacgtatacgggtatcgacgtacgtttttagttgtcgttttttaacgagtacg

SEQ ID NO: 34040 - DNA, 531 bp, Artificial Sequence
  chemically treated genomic DNA (Homo sapiens) CpG-island No: 34040
cgtactcgttaaaaaacgacaactaaaaacgtacgtcgatacccgtatacgtatcgaaaacgtaaacgacctaaccttcctactaattatacgtatccacgacatacaaaataccgcacaccaaaaaacaattcccgtaaaaattccgccgcaaccgtatcttccacgtaatctcccgatacacgaaaaaatcgccgaaatccaaacgactcaaaacgatcacctcgaactaaacctcatcgcgatcgtccacgacgaaataaataacccacaaaccgctctcgtccacgacaaaatcaatatccgaatatccgcgccacttccaaaatataatatcctcatataccacgtcgaacaacaacgcccaaaaaaccacgaaacgctaccgtaaatcgtacttaataatattcttaataaaaacgcgattataataaaaaacgccctaatacaccacgtaacctataccgatccaattataaaataacttatacatattactccaacgacctacaaacgaaaacgataatcacc

SEQ ID NO: 34041 - DNA, 1190 bp, Artificial Sequence
  chemically treated genomic DNA (Homo sapiens) CpG-island No: 34041
gtttcgcgcgtttgtcgtcgtttattttcggcgcgtatttggtagtttcgggttcgagtttcgttttgtcgttagttaggtgagaggggttaggtttcgttttcgtcggtttcgtttcgttttattgcgtttgcgtagtcggtcgtcggcgttaggcgtcggggcggcgcggtcgtcgtagttcggcgggcgtagtgcgcgtgcgttttgattgttggggggcgggcggcgttcgcggcgagggagcgggggcggggaggcgtcgtttggtttaggttggggtcggcgggagcgcgaacgagcgacggcggaattcgtgggtttgtggattgtagtttcggcggttagtaggtgaggttcgcgtagggcgggcgtgggtcgtgagggagtgcgggttgcgggcgggttagcggtgcggcggtttgttcgggggcgtaggtgagcgcggttcgcgcggggttcggcggagtattgtttagcgggcggcgttcgtatagcgttttttgtcggttgggtcgcggcggggattcgggttgggcgggtttgggtttcggggcgggcgcgcgtttttttgttcgtcggtttttattttttcgtgtttttattttcgtcgtttttcgttaatatggtcgttattttttcgtttttagtttttcggtcgtcgtcggttttttagcgcgcgttttgtttggagtcgggcggggaggtcggcgggtagggggcggcggcgttgcgtagtcgggcgcggggagggggcgttgcgttagaatgtaggcggggagggggaacgttgtataatttcgggtcggcgacgggggcggggcggggggaggggcgggatttcggcgcgacgggtcgggttatttcggggacgcgggtttgttttggggttattttttttaggttcgggggatggtcgcggattttgtaagttgtaggtttcgcggttcgcggcgtcggaacgtttatcggttagttttcgcgttcgcgtagttttttttttgatgcgtcgttttttcgtcgtttttcgtgggggcgcggcgaacgggttgcgtgttttggagagagataggtattttttttttttatcgtgagtgattttgggtgtattcgttaaggaatgtgttgaaacgaattgtgcgatgcgggaattgcgtagcgtttcgggtttggttttttcgagtatttta

SEQ ID NO: 34042 - DNA, 1190 bp, Artificial Sequence
  chemically treated genomic DNA (Homo sapiens) CpG-island No: 34042
taaaatactcgaaaaaaccaaacccgaaacgctacgcaattcccgcatcgcacaattcgtttcaacacattccttaacgaatacacccaaaatcactcacgataaaaaaaaaaaatacctatctctctccaaaacacgcaacccgttcgccgcgcccccacgaaaaacgacgaaaaaacgacgcatcaaaaaaaaaactacgcgaacgcgaaaactaaccgataaacgttccgacgccgcgaaccgcgaaacctacaacttacaaaatccgcgaccatcccccgaacctaaaaaaaataaccccaaaacaaacccgcgtccccgaaataacccgacccgtcgcgccgaaatcccgcccctccccccgccccgcccccgtcgccgacccgaaattatacaacgttccccctccccgcctacattctaacgcaacgccccctccccgcgcccgactacgcaacgccgccgccccctacccgccgacctccccgcccgactccaaacaaaacgcgcgctaaaaaaccgacgacgaccgaaaaactaaaaacgaaaaaataacgaccatattaacgaaaaacgacgaaaataaaaacacgaaaaaataaaaaccgacgaacaaaaaaacgcgcgcccgccccgaaacccaaacccgcccaacccgaatccccgccgcgacccaaccgacaaaaaacgctatacgaacgccgcccgctaaacaatactccgccgaaccccgcgcgaaccgcgctcacctacgcccccgaacaaaccgccgcaccgctaacccgcccgcaacccgcactccctcacgacccacgcccgccctacgcgaacctcacctactaaccgccgaaactacaatccacaaacccacgaattccgccgtcgctcgttcgcgctcccgccgaccccaacctaaaccaaacgacgcctccccgcccccgctccctcgccgcgaacgccgcccgccccccaacaatcaaaacgcacgcgcactacgcccgccgaactacgacgaccgcgccgccccgacgcctaacgccgacgaccgactacgcaaacgcaataaaacgaaacgaaaccgacgaaaacgaaacctaacccctctcacctaactaacgacaaaacgaaactcgaacccgaaactaccaaatacgcgccgaaaataaacgacgacaaacgcgcgaaac

SEQ ID NO: 34043 - DNA, 1190 bp, Artificial Sequence
  chemically treated genomic DNA (Homo sapiens) CpG-island No: 34043
taaaatgttcgagaaagttaaattcgaggcgttgcgtagttttcgtatcgtataattcgttttaatatattttttgacgaatatatttaaggttatttacgatggagaggaaaagtgtttgtttttttttagagtacgtaattcgttcgtcgcgtttttacggagggcggcgaagagacggcgtattaggaaaggggttgcgcgggcgcgaggattggtcggtgggcgtttcggcgtcgcgaatcgcggagtttgtaatttataaggttcgcggttatttttcgggtttgggaggggtggttttagggtaggttcgcgttttcggggtgattcgattcgtcgcgtcggggtttcgttttttttttcgtttcgttttcgtcgtcggttcgggattatgtaacgtttttttttttcgtttgtattttggcgtagcgtttttttttcgcgttcgattgcgtagcgtcgtcgttttttgttcgtcggttttttcgttcggttttaaataaagcgcgcgttaaggggtcggcggcggtcggggaattggggacgagagggtggcggttatgttggcggggggcggcggggatgggggtacggaggagtaggggtcggcgaataaaggagcgcgcgttcgtttcgaggtttaggttcgtttagttcgggttttcgtcgcggtttagtcggtagggggcgttatgcgggcgtcgttcgttggataatgtttcgtcgggtttcgcgcgggtcgcgtttatttgcgttttcgggtagatcgtcgtatcgttggttcgttcgtagttcgtatttttttacgatttacgttcgttttgcgcgggttttatttgttgatcgtcgaggttgtagtttataggtttacgggtttcgtcgtcgttcgttcgcgttttcgtcggttttagtttgagttagacggcgttttttcgttttcgttttttcgtcgcggacgtcgttcgttttttaatagttagggcgtacgcgtattgcgttcgtcgaattgcgacggtcgcgtcgtttcggcgtttggcgtcgacggtcgattgcgtaggcgtagtggggcggggcggggtcggcgagggcggggtttggttttttttatttggttggcggtagggcggggttcgagttcgggattgttaggtgcgcgtcgggaatgggcggcggtaggcgcgcggggt

SEQ ID NO: 34044 - DNA, 1190 bp, Artificial Sequence
  chemically treated genomic DNA (Homo sapiens) CpG-island No: 34044
accccgcgcgcctaccgccgcccattcccgacgcgcacctaacaatcccgaactcgaaccccgccctaccgccaaccaaataaaaaaaaccaaaccccgccctcgccgaccccgccccgccccactacgcctacgcaatcgaccgtcgacgccaaacgccgaaacgacgcgaccgtcgcaattcgacgaacgcaatacgcgtacgccctaactattaaaaaacgaacgacgtccgcgacgaaaaaacgaaaacgaaaaaacgccgtctaactcaaactaaaaccgacgaaaacgcgaacgaacgacgacgaaacccgtaaacctataaactacaacctcgacgatcaacaaataaaacccgcgcaaaacgaacgtaaatcgtaaaaaaatacgaactacgaacgaaccaacgatacgacgatctacccgaaaacgcaaataaacgcgacccgcgcgaaacccgacgaaacattatccaacgaacgacgcccgcataacgccccctaccgactaaaccgcgacgaaaacccgaactaaacgaacctaaacctcgaaacgaacgcgcgctcctttattcgccgacccctactcctccgtacccccatccccgccgccccccgccaacataaccgccaccctctcgtccccaattccccgaccgccgccgaccccttaacgcgcgctttatttaaaaccgaacgaaaaaaccgacgaacaaaaaacgacgacgctacgcaatcgaacgcgaaaaaaaaacgctacgccaaaatacaaacgaaaaaaaaaaacgttacataatcccgaaccgacgacgaaaacgaaacgaaaaaaaaaacgaaaccccgacgcgacgaatcgaatcaccccgaaaacgcgaacctaccctaaaaccacccctcccaaacccgaaaaataaccgcgaaccttataaattacaaactccgcgattcgcgacgccgaaacgcccaccgaccaatcctcgcgcccgcgcaacccctttcctaatacgccgtctcttcgccgccctccgtaaaaacgcgacgaacgaattacgtactctaaaaaaaaacaaacacttttcctctccatcgtaaataaccttaaatatattcgtcaaaaaatatattaaaacgaattatacgatacgaaaactacgcaacgcctcgaatttaactttctcgaacatttta

SEQ ID NO: 34045 - DNA, 550 bp, Artificial Sequence
  chemically treated genomic DNA (Homo sapiens) CpG-island No: 34045
gtaatcgggatgcggggacgatcgttatagcggttatagcggtaggcggggcgtagtcgttcgtatttattaggataagatgggaggacgcgtatacggcggggttttcgagcgcggttcgtcgttttagttcgtcggtttttcgtttattcgttttgaggttcgggttttggttcgtattggttgtcgttttcgttagtcgggttgggttcgggaggagattgagtcgttgtgagttcggcgtttcgagtttggcgttgttcggttttcgtcggtttttttttttgggttgtgcgttgtgcgttgggagcggggtcgtagcgcgtttagttttcgagttttttgttttacgttttttgggcgtagaggcgacgttggtagtcgttttttaggagattttttcgtagtgtggacgggggttaggatttgtaggcgagtaagggtagagaggagaaatcgtataggtcggtgacgcgtttaatttataaagtttgaaagtgttgttaattttggggttattttatgttgggtatcgtttttttaattattt

SEQ ID NO: 34046 - DNA, 550 bp, Artificial Sequence
  chemically treated genomic DNA (Homo sapiens) CpG-island No: 34046
aaataattaaaaaaacgatacccaacataaaataaccccaaaattaacaacactttcaaactttataaattaaacgcgtcaccgacctatacgatttctcctctctacccttactcgcctacaaatcctaacccccgtccacactacgaaaaaatctcctaaaaaacgactaccaacgtcgcctctacgcccaaaaaacgtaaaacaaaaaactcgaaaactaaacgcgctacgaccccgctcccaacgcacaacgcacaacccaaaaaaaaaaaccgacgaaaaccgaacaacgccaaactcgaaacgccgaactcacaacgactcaatctcctcccgaacccaacccgactaacgaaaacgacaaccaatacgaaccaaaacccgaacctcaaaacgaataaacgaaaaaccgacgaactaaaacgacgaaccgcgctcgaaaaccccgccgtatacgcgtcctcccatcttatcctaataaatacgaacgactacgccccgcctaccgctataaccgctataacgatcgtccccgcatcccgattac

SEQ ID NO: 34047 - DNA, 550 bp, Artificial Sequence
  chemically treated genomic DNA (Homo sapiens) CpG-island No: 34047
agataattggagaggcggtgtttagtataagatgattttaaagttgatagtatttttaggttttgtgaattaggcgcgttatcgatttgtacgattttttttttttgtttttgttcgtttgtaaattttgattttcgtttatattgcggagaaattttttaagagacggttgttagcgtcgtttttgcgtttaggaggcgtggagtaaaggattcgggagttgagcgcgttgcggtttcgtttttagcgtatagcgtatagtttagagggaggggtcggcgggggtcgggtagcgttagattcggagcgtcgggtttatagcggtttagttttttttcgaatttagttcggttggcgagagcggtagttagtgcgagttagagttcgggttttagagcgggtaggcggagggtcggcggattggagcggcgggtcgcgttcgggggtttcgtcgtgtgcgcgtttttttattttattttggtaagtgcgggcggttgcgtttcgtttgtcgttgtagtcgttgtggcggtcgttttcgtatttcggttgt

SEQ ID NO: 34048 - DNA, 550 bp, Artificial Sequence
  chemically treated genomic DNA (Homo sapiens) CpG-island No: 34048
acaaccgaaatacgaaaacgaccgccacaacgactacaacgacaaacgaaacgcaaccgcccgcacttaccaaaataaaataaaaaaacgcgcacacgacgaaacccccgaacgcgacccgccgctccaatccgccgaccctccgcctacccgctctaaaacccgaactctaactcgcactaactaccgctctcgccaaccgaactaaattcgaaaaaaaactaaaccgctataaacccgacgctccgaatctaacgctacccgacccccgccgacccctccctctaaactatacgctatacgctaaaaacgaaaccgcaacgcgctcaactcccgaatcctttactccacgcctcctaaacgcaaaaacgacgctaacaaccgtctcttaaaaaatttctccgcaatataaacgaaaatcaaaatttacaaacgaacaaaaacaaaaaaaaaaaatcgtacaaatcgataacgcgcctaattcacaaaacctaaaaatactatcaactttaaaatcatcttatactaaacaccgcctctccaattatct

SEQ ID NO: 34049 - DNA, 761 bp, Artificial Sequence
  chemically treated genomic DNA (Homo sapiens) CpG-island No: 34049
gggttttttcgcggtttatttttatgggtattaaagattacgatttcgataaagacgaaggggattaggttttgtttcgggagcgatcgttgttgtacgtggcggtatcgcgggttcgcgatgagtttgtcgtaagttggatcgattagtttagtttattgttgagcgtttttgtatcgttcgtggtagttagtatattttgagggcgatattcgaggttttgaatgtcggttaacggttgttcggaattattatttcggtgacgtgagaaagtaacgtttttttattgttatgggttgacgtagtcgattatattggcgcgcgtttcggcgaggcgtattagtttttgatcggcgttattttgcgattcgattatcgtagttagatttattttggtgaagcgaagattttggggtttttgtttgatcggtaagttttttggcgtatttatatacgttgttattgatttatttcggcggtaattcgttgtttttaatcgttttaagtattatgtcgattttgagttgattatcggtgattttgtcggagtatattaacgtaattttcgttttttcgtacgtttcgacgacgggaagaaagtgttgatttatttgggtcgataataggtttattattacgtcgtttattttgacgtttacgatcgttttttttgtcgttttgagttttttgataaacgattttagtttagttattattggtatagagtgttcgtcggtaagtagatttaataaagttttagt

SEQ ID NO: 34050 - DNA, 761 bp, Artificial Sequence
  chemically treated genomic DNA (Homo sapiens) CpG-island No: 34050
actaaaactttattaaatctacttaccgacgaacactctataccaataataactaaactaaaatcgtttatcaaaaaactcaaaacgacaaaaaaaacgatcgtaaacgtcaaaataaacgacgtaataataaacctattatcgacccaaataaatcaacactttcttcccgtcgtcgaaacgtacgaaaaaacgaaaattacgttaatatactccgacaaaatcaccgataatcaactcaaaatcgacataatacttaaaacgattaaaaacaacgaattaccgccgaaataaatcaataacaacgtatataaatacgccaaaaaacttaccgatcaaacaaaaaccccaaaatcttcgcttcaccaaaataaatctaactacgataatcgaatcgcaaaataacgccgatcaaaaactaatacgcctcgccgaaacgcgcgccaatataatcgactacgtcaacccataacaataaaaaaacgttactttctcacgtcaccgaaataataattccgaacaaccgttaaccgacattcaaaacctcgaatatcgccctcaaaatatactaactaccacgaacgatacaaaaacgctcaacaataaactaaactaatcgatccaacttacgacaaactcatcgcgaacccgcgataccgccacgtacaacaacgatcgctcccgaaacaaaacctaatccccttcgtctttatcgaaatcgtaatctttaatacccataaaaataaaccgcgaaaaaaccc

SEQ ID NO: 34051 - DNA, 761 bp, Artificial Sequence
  chemically treated genomic DNA (Homo sapiens) CpG-island No: 34051
attgaggttttgttgggtttgtttgtcggcgagtattttgtattagtggtagttgagttggagtcgtttattaagaagtttaagacgatagagaggacggtcgtaggcgttaaggtaggcggcgtgatggtgggtttgttgtcgatttaaatgagttagtatttttttttcgtcgtcgaagcgtgcgaggaaacgggaattacgttggtgtgtttcggtagaattatcggtaattagtttaaggtcgatatggtgtttgaggcggttaagggtagcgaattatcgtcggaatggattaatgataacgtgtataggtacgttaagaggtttgtcggttaagtaggagttttagaattttcgttttattagggtgaatttagttacgatgatcgggtcgtagagtgacgtcgattaagggttggtgcgtttcgtcgagacgcgcgttagtgtgatcggttacgttagtttatgataatgggaggacgttatttttttacgttatcgaggtggtgatttcgaatagtcgttagtcgatatttaaggtttcgggtgtcgtttttaagatgtgttggttgttacggacgatatagaagcgtttaataatgggttgggttggtcggtttaatttacgataagtttatcgcgggttcgcgatgtcgttacgtatagtagcgatcgttttcggagtagggtttgatttttttcgtttttatcgaagtcgtaatttttgatgtttatggggatagatcgcgaggagattt

SEQ ID NO: 34052 - DNA, 761 bp, Artificial Sequence
  chemically treated genomic DNA (Homo sapiens) CpG-island No: 34052
aaatctcctcgcgatctatccccataaacatcaaaaattacgacttcgataaaaacgaaaaaaatcaaaccctactccgaaaacgatcgctactatacgtaacgacatcgcgaacccgcgataaacttatcgtaaattaaaccgaccaacccaacccattattaaacgcttctatatcgtccgtaacaaccaacacatcttaaaaacgacacccgaaaccttaaatatcgactaacgactattcgaaatcaccacctcgataacgtaaaaaaataacgtcctcccattatcataaactaacgtaaccgatcacactaacgcgcgtctcgacgaaacgcaccaacccttaatcgacgtcactctacgacccgatcatcgtaactaaattcaccctaataaaacgaaaattctaaaactcctacttaaccgacaaacctcttaacgtacctatacacgttatcattaatccattccgacgataattcgctacccttaaccgcctcaaacaccatatcgaccttaaactaattaccgataattctaccgaaacacaccaacgtaattcccgtttcctcgcacgcttcgacgacgaaaaaaaaatactaactcatttaaatcgacaacaaacccaccatcacgccgcctaccttaacgcctacgaccgtcctctctatcgtcttaaacttcttaataaacgactccaactcaactaccactaatacaaaatactcgccgacaaacaaacccaacaaaacctcaat

SEQ ID NO: 34053 - DNA, 909 bp, Artificial Sequence
  chemically treated genomic DNA (Homo sapiens) CpG-island No: 34053
  misc_feature (292)..(292): n is either a, c, g or t
gcgcggagtagtttggaaatattttacgggagcggcgatttcggcgagggtattcgtttttttttcgggtcgcgtatcgggcgttgtttacgcgtaggtttttcgggggcgttcgggtgtttaggttatcggacgtgcgcgcgtttgacgcgcggttgtattgcgcgcgtttcgtaaatttggcgatttttttagttcggtcgggtattaacgcgggtcgttcgcggtgcggaaaaggcgtttttaaggaaggtcggtcggggtgcggggtttggaagggtttgggtatcgngcgcgtttatttttggggggtttcggcgtattcggagatcggcgtatttcgggcgtaggtttcgtgggggtgttcgttagtggggttcgtttttggttgattaggggtatcgacggtcgcgcgtgggtttttttcgtcgtgttgtttgcgggggacgaatggtttcgggagggggcgggaattagcggttcgggtttcgttttagttcgtgtgtagtttcgattcgaacggtttgggacgcgtttttattattcggcgttcggattttgcgcgtcgtttatcgttttcgtcgtttttagttttcgggcgggtagagtgggaagcgcggtttcgtatttttggtcggtttgcgtaggggtaaaggttatttcgtttttttttttcgggcgcggcgggaagggaggtgagtttgtggtcggtagtcgcgcgagggagtcgagttcggttcggttaattaatggggaggcgttcgggtcgtttagtttgtttttttgcgggtttagcgtagcggatttttcgggaggtgggaggcggcggttttatgggtgtttttaaatttggatgtgtgaggcgtatttaggagcggtagtgggaggcggttgagggttttttatgag

SEQ ID NO: 34054 - DNA, 909 bp, Artificial Sequence
  chemically treated genomic DNA (Homo sapiens) CpG-island No: 34054
  misc_feature (618)..(618): n is either a, c, g or t
ctcataaaaaaccctcaaccgcctcccactaccgctcctaaatacgcctcacacatccaaatttaaaaacacccataaaaccgccgcctcccacctcccgaaaaatccgctacgctaaacccgcaaaaaaacaaactaaacgacccgaacgcctccccattaattaaccgaaccgaactcgactccctcgcgcgactaccgaccacaaactcacctcccttcccgccgcgcccgaaaaaaaaaaacgaaataacctttacccctacgcaaaccgaccaaaaatacgaaaccgcgcttcccactctacccgcccgaaaactaaaaacgacgaaaacgataaacgacgcgcaaaatccgaacgccgaataataaaaacgcgtcccaaaccgttcgaatcgaaactacacacgaactaaaacgaaacccgaaccgctaattcccgccccctcccgaaaccattcgtcccccgcaaacaacacgacgaaaaaaacccacgcgcgaccgtcgatacccctaatcaaccaaaaacgaaccccactaacgaacacccccacgaaacctacgcccgaaatacgccgatctccgaatacgccgaaaccccccaaaaataaacgcgcncgatacccaaacccttccaaaccccgcaccccgaccgaccttccttaaaaacgccttttccgcaccgcgaacgacccgcgttaatacccgaccgaactaaaaaaatcgccaaatttacgaaacgcgcgcaatacaaccgcgcgtcaaacgcgcgcacgtccgataacctaaacacccgaacgcccccgaaaaacctacgcgtaaacaacgcccgatacgcgacccgaaaaaaaaacgaataccctcgccgaaatcgccgctcccgtaaaatatttccaaactactccgcgc

SEQ ID NO: 34055 - DNA, 909 bp, Artificial Sequence
  chemically treated genomic DNA (Homo sapiens) CpG-island No: 34055
  misc_feature (618)..(618): n is either a, c, g or t
tttatggagagtttttagtcgttttttattgtcgtttttgaatgcgttttatatatttagatttgaaagtatttatagggtcgtcgttttttatttttcgaggaattcgttgcgttgggttcgtagggaggtaggttggacggttcgggcgtttttttattggttggtcgggtcgggttcgattttttcgcgcggttgtcggttataggtttattttttttttcgtcgcgttcggggagaggaagcgaggtggtttttatttttgcgtaggtcggttaggaatgcggggtcgcgttttttattttattcgttcgagggttgaggacggcggaggcgataagcgacgcgtagagttcgggcgtcgagtggtggagacgcgttttaggtcgttcggatcggggttgtatacgggttggggcgaggttcgggtcgttggttttcgttttttttcggagttattcgtttttcgtagataatacgacgggagggatttacgcgcggtcgtcggtgtttttagttagttaaaagcgagttttattggcgggtatttttacgaggtttgcgttcgaggtgcgtcgattttcgggtgcgtcgaggttttttaagggtaggcgcgtncggtgtttaggtttttttagatttcgtatttcggtcggttttttttgggggcgtttttttcgtatcgcgagcggttcgcgttgatgttcggtcgggttgggggagtcgttaagtttgcgagacgcgcgtagtgtaatcgcgcgttaggcgcgcgtacgttcggtgatttgggtattcgaacgttttcgaggaatttgcgcgtgggtagcgttcggtgcgcggttcgggaagggagcgggtgttttcgtcggggtcgtcgttttcgtggggtgtttttaggttgtttcgcgt

SEQ ID NO: 34056 - DNA, 909 bp, Artificial Sequence
  chemically treated genomic DNA (Homo sapiens) CpG-island No: 34056
  misc_feature (292)..(292): n is either a, c, g or t
acgcgaaacaacctaaaaacaccccacgaaaacgacgaccccgacgaaaacacccgctcccttcccgaaccgcgcaccgaacgctacccacgcgcaaattcctcgaaaacgttcgaatacccaaatcaccgaacgtacgcgcgcctaacgcgcgattacactacgcgcgtctcgcaaacttaacgactcccccaacccgaccgaacatcaacgcgaaccgctcgcgatacgaaaaaaacgcccccaaaaaaaaccgaccgaaatacgaaatctaaaaaaacctaaacaccgnacgcgcctacccttaaaaaacctcgacgcacccgaaaatcgacgcacctcgaacgcaaacctcgtaaaaatacccgccaataaaactcgcttttaactaactaaaaacaccgacgaccgcgcgtaaatccctcccgtcgtattatctacgaaaaacgaataactccgaaaaaaaacgaaaaccaacgacccgaacctcgccccaacccgtatacaaccccgatccgaacgacctaaaacgcgtctccaccactcgacgcccgaactctacgcgtcgcttatcgcctccgccgtcctcaaccctcgaacgaataaaataaaaaacgcgaccccgcattcctaaccgacctacgcaaaaataaaaaccacctcgcttcctctccccgaacgcgacgaaaaaaaaaataaacctataaccgacaaccgcgcgaaaaaatcgaacccgacccgaccaaccaataaaaaaacgcccgaaccgtccaacctacctccctacgaacccaacgcaacgaattcctcgaaaaataaaaaacgacgaccctataaatactttcaaatctaaatatataaaacgcattcaaaaacgacaataaaaaacgactaaaaactctccataaa

SEQ ID NO: 34057 - DNA, 587 bp, Artificial Sequence
  chemically treated genomic DNA (Homo sapiens) CpG-island No: 34057
ggattttcgcgtgtcggtcgatgtagtagtcgtcgttgttcgggcgcggtgggtgcgggacgtcgtcgtcgtcgtttatcggatgtttattattcgcgttttcggtgcgttgttcgttaatttagtttttatcgtagtagtcgtttaggtttttcgtcgagtcgttgttgtcggggtcgttgtttaattcggcgtcgaagtataggcgggttatgttttttttgatcgattcgtagatgggtcgttcgaggtcgtcgtatacgtagtcgttgagtagcgtcgttttgggtatagttagtatgtttttaatgacggtgcggtattcgttcgtgtagcgtagttcgttgaagattttgtcgtagtaggttaggtagcggtttagcgttaggttgtagcggttgttacggtcgtagcgtcggcgggtttcggtgtagtttatgatttcgttcgcgtcggggtcgttcgcgtcgtcgtcgttcgttcggggtaggtacggtttaatggcgcgtttggtggatttgtagttttcgttttgcgcgtagatatagttttttagggcggggttcgcggcgcgtgtggttgagttg

SEQ ID NO: 34058 - DNA, 587 bp, Artificial Sequence
  chemically treated genomic DNA (Homo sapiens) CpG-island No: 34058
caactcaaccacacgcgccgcgaaccccgccctaaaaaactatatctacgcgcaaaacgaaaactacaaatccaccaaacgcgccattaaaccgtacctaccccgaacgaacgacgacgacgcgaacgaccccgacgcgaacgaaatcataaactacaccgaaacccgccgacgctacgaccgtaacaaccgctacaacctaacgctaaaccgctacctaacctactacgacaaaatcttcaacgaactacgctacacgaacgaataccgcaccgtcattaaaaacatactaactatacccaaaacgacgctactcaacgactacgtatacgacgacctcgaacgacccatctacgaatcgatcaaaaaaaacataacccgcctatacttcgacgccgaattaaacaacgaccccgacaacaacgactcgacgaaaaacctaaacgactactacgataaaaactaaattaacgaacaacgcaccgaaaacgcgaataataaacatccgataaacgacgacgacgacgtcccgcacccaccgcgcccgaacaacgacgactactacatcgaccgacacgcgaaaatcc

SEQ ID NO: 34059 - DNA, 587 bp, Artificial Sequence
  chemically treated genomic DNA (Homo sapiens) CpG-island No: 34059
tagtttaattatacgcgtcgcgggtttcgttttggaggattgtgtttgcgcgtaggacgagaattgtaagtttattaagcgcgttattgagtcgtgtttgtttcggacgagcggcggcggcgcgggcggtttcggcgcgggcggggttatgggttgtatcgaggttcgtcggcgttgcgatcgtgatagtcgttgtaatttggcgttgagtcgttatttgatttattgcggtaaagtttttaacgggttgcgttgtacggacgaatgtcgtatcgttattgaggatatgttggttatgtttaaggcggcgttgtttaacgattgcgtgtgcgacggtttcgagcggtttatttgcgagtcggttaaggagaatatggttcgtttgtgtttcggcgtcgagttgggtaacggtttcggtagtagcgattcgacggggggtttggacgattattacgatgaggattagattgacgagtagcgtatcgggggcgcgggtggtgagtattcgatggacgacgacgacggcgtttcgtatttatcgcgttcgggtagcggcgattgttgtatcggtcggtacgcggggattt

SEQ ID NO: 34060 - DNA, 587 bp, Artificial Sequence
  chemically treated genomic DNA (Homo sapiens) CpG-island No: 34060
aaatccccgcgtaccgaccgatacaacaatcgccgctacccgaacgcgataaatacgaaacgccgtcgtcgtcgtccatcgaatactcaccacccgcgcccccgatacgctactcgtcaatctaatcctcatcgtaataatcgtccaaaccccccgtcgaatcgctactaccgaaaccgttacccaactcgacgccgaaacacaaacgaaccatattctccttaaccgactcgcaaataaaccgctcgaaaccgtcgcacacgcaatcgttaaacaacgccgccttaaacataaccaacatatcctcaataacgatacgacattcgtccgtacaacgcaacccgttaaaaactttaccgcaataaatcaaataacgactcaacgccaaattacaacgactatcacgatcgcaacgccgacgaacctcgatacaacccataaccccgcccgcgccgaaaccgcccgcgccgccgccgctcgtccgaaacaaacacgactcaataacgcgcttaataaacttacaattctcgtcctacgcgcaaacacaatcctccaaaacgaaacccgcgacgcgtataattaaacta

SEQ ID NO: 34061 - DNA, 518 bp, Artificial Sequence
  chemically treated genomic DNA (Homo sapiens) CpG-island No: 34061
tcgggatcgggtttggcgttcgtcgtcggttgtaagcgtaagtattattttggttaggaggaggaggaagacgacgaggaggatgcgggcgggttgggggtcgagtttttcgggggcgtttcgttcgttttttgtaagcgcgttcgtttcgaggatttttgttcggattcgttttcggacgcgtttaatattttaaatttgatttttatttttggtttcggtttttcggggttggtgagtcgatagtcggatttttcggagtagtcgtcgtcgtttaacgggtagttgtgcgttaagtaggcgttcgttagtttcggcgtttggattcgagttattgtcgttttttagggattttcgagggtatagggattcggggtttcgcggggttggggttagataaagattcggtaaaggggcgagaggagggaacgagcgggcgttcggttattcggggttgaatttggggttaacgcggggtacgtcgtttaatttttaataattgtaaaaaaaaaaaaaaa

SEQ ID NO: 34062 - DNA, 518 bp, Artificial Sequence
  chemically treated genomic DNA (Homo sapiens) CpG-island No: 34062
tttttttttttttttacaattattaaaaattaaacgacgtaccccgcgttaaccccaaattcaaccccgaataaccgaacgcccgctcgttccctcctctcgcccctttaccgaatctttatctaaccccaaccccgcgaaaccccgaatccctataccctcgaaaatccctaaaaaacgacaataactcgaatccaaacgccgaaactaacgaacgcctacttaacgcacaactacccgttaaacgacgacgactactccgaaaaatccgactatcgactcaccaaccccgaaaaaccgaaaccaaaaataaaaatcaaatttaaaatattaaacgcgtccgaaaacgaatccgaacaaaaatcctcgaaacgaacgcgcttacaaaaaacgaacgaaacgcccccgaaaaactcgacccccaacccgcccgcatcctcctcgtcgtcttcctcctcctcctaaccaaaataatacttacgcttacaaccgacgacgaacgccaaacccgatcccga

SEQ ID NO: 34063 - DNA, 518 bp, Artificial Sequence
  chemically treated genomic DNA (Homo sapiens) CpG-island No: 34063
tttttttttttttttataattattaaaaattaagcggcgtgtttcgcgttggttttaagtttagtttcgagtggtcgggcgttcgttcgtttttttttttcgtttttttgtcgagtttttgtttggttttagtttcgcggggtttcgggtttttgtgttttcgggggtttttagaaggcgataatggttcgagtttaggcgtcgaggttggcgagcgtttgtttggcgtatagttgttcgttgagcggcggcggttgtttcgaggagttcggttgtcggtttattagtttcgagaagtcggagttaaagatggagattaagtttgagatgttggacgcgttcggggacgagttcgggtagaagttttcgaagcgggcgcgtttgtagggggcgaacggggcgttttcggggggttcggtttttagttcgttcgtatttttttcgtcgttttttttttttttttggttagggtaatatttgcgtttgtagtcggcggcggacgttaggttcggtttcgg

SEQ ID NO: 34064 - DNA, 518 bp, Artificial Sequence
  chemically treated genomic DNA (Homo sapiens) CpG-island No: 34064
ccgaaaccgaacctaacgtccgccgccgactacaaacgcaaatattaccctaaccaaaaaaaaaaaaaaaacgacgaaaaaaatacgaacgaactaaaaaccgaaccccccgaaaacgccccgttcgccccctacaaacgcgcccgcttcgaaaacttctacccgaactcgtccccgaacgcgtccaacatctcaaacttaatctccatctttaactccgacttctcgaaactaataaaccgacaaccgaactcctcgaaacaaccgccgccgctcaacgaacaactatacgccaaacaaacgctcgccaacctcgacgcctaaactcgaaccattatcgccttctaaaaacccccgaaaacacaaaaacccgaaaccccgcgaaactaaaaccaaacaaaaactcgacaaaaaaacgaaaaaaaaaaacgaacgaacgcccgaccactcgaaactaaacttaaaaccaacgcgaaacacgccgcttaatttttaataattataaaaaaaaaaaaaaa

SEQ ID NO: 34065 - DNA, 600 bp, Artificial Sequence
  chemically treated genomic DNA (Homo sapiens) CpG-island No: 34065
cgcgttttcgcgttttcgtcgtcgttaagttggagcgggtcgaagtcggtcgcgttggtcggtatgttcggcgtcgcgtacgttaggtgttggtgttggtggtggggcggttgttgttgttgttgttgttgttggcgtcggtagagttcggcgtagcgttcgtttaggtagagttggcgcgcgttgcggagtacgtaggatattaggaggtttttgtgtagtttgatgtcgtcgcgttgggttcgggagttgtggattttgcgtagggagatgttgattaggttttgggcgtgttagggcgtattttatgttttcgcggagacggcggcggagtagtcgtcgtcgttgttgttgttaacgtttttgttgtttttgtttttagtcggtcgtcggggcgcgtcgggtaggggtaacggagttcgggttagaggttcggttgcgtttcgaaaggagtcgttattatgcgtcgcgcgttattcgcgggttcgcgttttttagacggcgttaaagtaatgagtttcggtcggtttcggttttagttatttagtcgggtgttcgggtttcgttttatatgagaagagttaataggagttttgagag

SEQ ID NO: 34066 - DNA, 600 bp, Artificial Sequence
  chemically treated genomic DNA (Homo sapiens) CpG-island No: 34066
ctctcaaaactcctattaactcttctcatataaaacgaaacccgaacacccgactaaataactaaaaccgaaaccgaccgaaactcattactttaacgccgtctaaaaaacgcgaacccgcgaataacgcgcgacgcataataacgactcctttcgaaacgcaaccgaacctctaacccgaactccgttacccctacccgacgcgccccgacgaccgactaaaaacaaaaacaacaaaaacgttaacaacaacaacgacgacgactactccgccgccgtctccgcgaaaacataaaatacgccctaacacgcccaaaacctaatcaacatctccctacgcaaaatccacaactcccgaacccaacgcgacgacatcaaactacacaaaaacctcctaatatcctacgtactccgcaacgcgcgccaactctacctaaacgaacgctacgccgaactctaccgacgccaacaacaacaacaacaacaacaaccgccccaccaccaacaccaacacctaacgtacgcgacgccgaacataccgaccaacgcgaccgacttcgacccgctccaacttaacgacgacgaaaacgcgaaaacgcg

SEQ ID NO: 34067 - DNA, 600 bp, Artificial Sequence
  chemically treated genomic DNA (Homo sapiens) CpG-island No: 34067
tttttagagtttttattggttttttttatgtggggcggggttcgggtattcggttaaatagttggggtcggggtcggtcgagatttattgttttggcgtcgtttggggagcgcgagttcgcgggtggcgcgcggcgtatggtgacggtttttttcggagcgtagtcgaatttttgattcggatttcgttatttttgttcggcgcgtttcggcggtcggttggaggtagaaatagtagaagcgttaatagtagtagcggcggcggttgtttcgtcgtcgttttcgcgggagtatggagtgcgttttggtacgtttagagtttgattagtatttttttgcgtaagatttatagttttcgaatttagcgcggcggtattaagttgtataagaattttttggtgttttacgtgtttcgtaacgcgcgttagttttatttgagcgagcgttacgtcgagttttatcggcgttagtagtagtagtaatagtagtagtcgttttattattagtattagtatttagcgtacgcggcgtcgggtatgtcggttagcgcggtcgatttcggttcgttttaatttggcggcggcggggacgcggaggcgcg

SEQ ID NO: 34068 - DNA, 600 bp, Artificial Sequence
  chemically treated genomic DNA (Homo sapiens) CpG-island No: 34068
cgcgcctccgcgtccccgccgccgccaaattaaaacgaaccgaaatcgaccgcgctaaccgacatacccgacgccgcgtacgctaaatactaatactaataataaaacgactactactattactactactactaacgccgataaaactcgacgtaacgctcgctcaaataaaactaacgcgcgttacgaaacacgtaaaacaccaaaaaattcttatacaacttaataccgccgcgctaaattcgaaaactataaatcttacgcaaaaaaatactaatcaaactctaaacgtaccaaaacgcactccatactcccgcgaaaacgacgacgaaacaaccgccgccgctactactattaacgcttctactatttctacctccaaccgaccgccgaaacgcgccgaacaaaaataacgaaatccgaatcaaaaattcgactacgctccgaaaaaaaccgtcaccatacgccgcgcgccacccgcgaactcgcgctccccaaacgacgccaaaacaataaatctcgaccgaccccgaccccaactatttaaccgaatacccgaaccccgccccacataaaaaaaaccaataaaaactctaaaaa

SEQ ID NO: 34069 - DNA, 621 bp, Artificial Sequence
  chemically treated genomic DNA (Homo sapiens) CpG-island No: 34069
tcgggtcgaatagcggtcgtaggacgcggttttcgttttcggacgtaatcgtacggttcgtttaggtcgtttagggtttttaggttcgggattcgtcgtatttattacggttttggtagcgaaggttaatattttcgttgttcgttcgcggatacgtagttcgtttcgttttatatatcgggtaaagttcgcgtcgtcgtcgtcgcggttggggtcggtgggtttttgttagagttttcgggttaaggtcgttgagttatagtcgttagtcggtagaggtagtttcgcgtttattttttgggtcgagcgggttgcgggaaggtattcggggaggaggattcgcgaggcggggtttgggtcggtagcgggtttcgggcgggtaacggtgttcgggaggttggttgtggggcggggacggggtatcgatggggcggagtttttttgaggagggataggaggggcggggacggaggggcggggcgtcgttcggtagcgggtcgtagtaggttggttgcgagtcgggggcgggattacggcgggcggggatagaggggtagggtcgagggcgagttattgagatttgtggaggaggaaggaggaggttatcgtttagttgttttt

SEQ ID NO: 34070 - DNA, 621 bp, Artificial Sequence
  chemically treated genomic DNA (Homo sapiens) CpG-island No: 34070
aaaaacaactaaacgataacctcctccttcctcctccacaaatctcaataactcgccctcgaccctacccctctatccccgcccgccgtaatcccgcccccgactcgcaaccaacctactacgacccgctaccgaacgacgccccgcccctccgtccccgcccctcctatccctcctcaaaaaaactccgccccatcgataccccgtccccgccccacaaccaacctcccgaacaccgttacccgcccgaaacccgctaccgacccaaaccccgcctcgcgaatcctcctccccgaataccttcccgcaacccgctcgacccaaaaaataaacgcgaaactacctctaccgactaacgactataactcaacgaccttaacccgaaaactctaacaaaaacccaccgaccccaaccgcgacgacgacgacgcgaactttacccgatatataaaacgaaacgaactacgtatccgcgaacgaacaacgaaaatattaaccttcgctaccaaaaccgtaataaatacgacgaatcccgaacctaaaaaccctaaacgacctaaacgaaccgtacgattacgtccgaaaacgaaaaccgcgtcctacgaccgctattcgacccga

SEQ ID NO: 34071 - DNA, 621 bp, Artificial Sequence
  chemically treated genomic DNA (Homo sapiens) CpG-island No: 34071
agagatagttggacggtgattttttttttttttttttataggttttaatgattcgttttcggttttgtttttttgttttcgttcgtcgtggtttcgttttcgattcgtagttagtttattgcgattcgttatcgggcgacgtttcgttttttcgttttcgttttttttgtttttttttaaggagatttcgttttatcgatgtttcgttttcgttttatagttaatttttcgggtatcgttgttcgttcggggttcgttatcggtttaggtttcgtttcgcgagttttttttttcgggtgttttttcgtagttcgttcggtttagagggtgggcgcggggttgtttttatcggttggcggttgtaatttagcgattttggttcgaaggttttagtaaggatttatcgattttagtcgcggcggcggcggcgcggattttgttcggtgtgtggggcggagcggattgcgtgttcgcggacgggtagcgaagatgttagttttcgttgttaggatcgtggtgagtgcggcggatttcgggtttgagggttttggacggtttgggcgggtcgtgcggttgcgttcgggaacggagatcgcgttttgcggtcgttgttcgattcgg

SEQ ID NO: 34072 - DNA, 621 bp, Artificial Sequence
  chemically treated genomic DNA (Homo sapiens) CpG-island No: 34072
ccgaatcgaacaacgaccgcaaaacgcgatctccgttcccgaacgcaaccgcacgacccgcccaaaccgtccaaaaccctcaaacccgaaatccgccgcactcaccacgatcctaacaacgaaaactaacatcttcgctacccgtccgcgaacacgcaatccgctccgccccacacaccgaacaaaatccgcgccgccgccgccgcgactaaaatcgataaatccttactaaaaccttcgaaccaaaatcgctaaattacaaccgccaaccgataaaaacaaccccgcgcccaccctctaaaccgaacgaactacgaaaaaacacccgaaaaaaaaaactcgcgaaacgaaacctaaaccgataacgaaccccgaacgaacaacgatacccgaaaaattaactataaaacgaaaacgaaacatcgataaaacgaaatctccttaaaaaaaaacaaaaaaaacgaaaacgaaaaaacgaaacgtcgcccgataacgaatcgcaataaactaactacgaatcgaaaacgaaaccacgacgaacgaaaacaaaaaaacaaaaccgaaaacgaatcattaaaacctataaaaaaaaaaaaaaaaaatcaccgtccaactatctct

SEQ ID NO: 34073 - DNA, 815 bp, Artificial Sequence
  chemically treated genomic DNA (Homo sapiens) CpG-island No: 34073
gcgaggcgggtttagtcgtcgttttttagtgaggggacggacgagtttagttaggttaaggcgaaagagcgacgcgtattttaattagacggttttattaatgggtttgcgcgtttttcgcggcgttcgtttttgtatcggtttttcggcgatcgcgttgtttttttttaggtcgtcgcggcggcgttcgttcgcgtttttattcgggttttggcgcggtgttttttcggtagcgacgggcgcgagggtcggggtatttttacggtcgcgacggtttttttcgcgagcgcgaggtgggtatggcggacgcggtagcgagcgcgggttcgtcgttattttatttcgcggagattcgcggtagcgggtgggtagaatgggagagtcgtgcgtcggttcgcgtttgttcggttaacgcgggttgggattggtggggcggtttgttttttttagcgggcgggtggtttcggggggtcggcgggttgttagcggaagtcgcgggcgttcggggtacgggggaggggtgtcgcgtggtcgtcgcggggtcggttttaatttttttcgtttttcgtttagttttttatcgatagggcgggggagggggggttattttttatattttttatttcgttttttttttcgttttaattaaatttggggcgggcggaaggttcgtttttcggtcggcgtttgttggtcggcgtcgtttttgattgtggcgtgattggttgtaggcgtcgttaggtgtttttgacgttattttcgttattaagtttgtgggtcggggagattttggttttgggggttgggatgaagga

SEQ ID NO: 34074 - DNA, 815 bp, Artificial Sequence
  chemically treated genomic DNA (Homo sapiens) CpG-island No: 34074
tccttcatcccaacccccaaaaccaaaatctccccgacccacaaacttaataacgaaaataacgtcaaaaacacctaacgacgcctacaaccaatcacgccacaatcaaaaacgacgccgaccaacaaacgccgaccgaaaaacgaaccttccgcccgccccaaatttaattaaaacgaaaaaaaaaacgaaataaaaaatataaaaaataaccccccctcccccgccctatcgataaaaaactaaacgaaaaacgaaaaaaattaaaaccgaccccgcgacgaccacgcgacacccctcccccgtaccccgaacgcccgcgacttccgctaacaacccgccgaccccccgaaaccacccgcccgctaaaaaaaacaaaccgccccaccaatcccaacccgcgttaaccgaacaaacgcgaaccgacgcacgactctcccattctacccacccgctaccgcgaatctccgcgaaataaaataacgacgaacccgcgctcgctaccgcgtccgccatacccacctcgcgctcgcgaaaaaaaccgtcgcgaccgtaaaaataccccgaccctcgcgcccgtcgctaccgaaaaaacaccgcgccaaaacccgaataaaaacgcgaacgaacgccgccgcgacgacctaaaaaaaaacaacgcgatcgccgaaaaaccgatacaaaaacgaacgccgcgaaaaacgcgcaaacccattaataaaaccgtctaattaaaatacgcgtcgctctttcgccttaacctaactaaactcgtccgtcccctcactaaaaaacgacgactaaacccgcctcgc

SEQ ID NO: 34075 - DNA, 815 bp, Artificial Sequence
  chemically treated genomic DNA (Homo sapiens) CpG-island No: 34075
ttttttattttaatttttaaggttaaggttttttcggtttataaatttgatagcggaagtgacgttagaggtatttggcggcgtttataattagttacgttatagttagaggcggcgtcggttaataggcgtcggtcggaaggcgggtttttcgttcgttttaagtttgattgaagcggggggaagggcggggtaaggaatgtgaagaatgattttttttttttcgttttgtcggtgaggagttgggcgggaagcggagggggttggagtcggtttcgcggcggttacgcggtatttttttttcgtgtttcgagcgttcgcgattttcgttagtagttcgtcggtttttcggggttattcgttcgttggagggggtaggtcgttttattagttttagttcgcgttagtcggataggcgcgggtcggcgtacggtttttttattttgtttattcgttgtcgcgagttttcgcgaaataaaatggcgacggattcgcgttcgttgtcgcgttcgttatatttatttcgcgttcgcggagagggtcgtcgcggtcgtgggaatgtttcggttttcgcgttcgtcgttgtcgggagagtatcgcgttaggattcggatggaggcgcgggcgggcgtcgtcgcggcggtttgagggaaagtagcgcggtcgtcgggaggtcgatgtaggggcgggcgtcgcggaaagcgcgtaagtttattggtgaagtcgtttgattgaagtgcgcgtcgttttttcgttttggtttagttgagttcgttcgtttttttattggagggcggcggttgggttcgtttcgt

SEQ ID NO: 34076 - DNA, 815 bp, Artificial Sequence
  chemically treated genomic DNA (Homo sapiens) CpG-island No: 34076
acgaaacgaacccaaccgccgccctccaataaaaaaacgaacgaactcaactaaaccaaaacgaaaaaacgacgcgcacttcaatcaaacgacttcaccaataaacttacgcgctttccgcgacgcccgcccctacatcgacctcccgacgaccgcgctactttccctcaaaccgccgcgacgacgcccgcccgcgcctccatccgaatcctaacgcgatactctcccgacaacgacgaacgcgaaaaccgaaacattcccacgaccgcgacgaccctctccgcgaacgcgaaataaatataacgaacgcgacaacgaacgcgaatccgtcgccattttatttcgcgaaaactcgcgacaacgaataaacaaaataaaaaaaccgtacgccgacccgcgcctatccgactaacgcgaactaaaactaataaaacgacctaccccctccaacgaacgaataaccccgaaaaaccgacgaactactaacgaaaatcgcgaacgctcgaaacacgaaaaaaaaataccgcgtaaccgccgcgaaaccgactccaaccccctccgcttcccgcccaactcctcaccgacaaaacgaaaaaaaaaaaatcattcttcacattccttaccccgcccttccccccgcttcaatcaaacttaaaacgaacgaaaaacccgccttccgaccgacgcctattaaccgacgccgcctctaactataacgtaactaattataaacgccgccaaatacctctaacgtcacttccgctatcaaatttataaaccgaaaaaaccttaaccttaaaaattaaaataaaaaa

SEQ ID NO: 34077 - DNA, 631 bp, Artificial Sequence
  chemically treated genomic DNA (Homo sapiens) CpG-island No: 34077
ttaaggttagatttataagttaggtatatatttatacgtttacgttcgcgcgttgtcggagtttcggggtttgttggttagtatatttttatattcgcggcgcggttttcgggtaatttataggaagttttttatcgagatgcggacgatagagttttttacgaaaggttcggacgattgtaatagcggtagttgcggggtcgaatttttttttttgttcgggattttcgacgaagggtttttcgggagagtttttttggaaggttgggggtttggagttgacgtttttttgttcggagtcgttattttggtttttttagcgttttatagcgattttcgtttttatcgttcggtagtttaggcgtttaagcgtttatttatttaggcgtttcgttttcgcgcgaattgtcgcgaattgttatcgcgcgttcgttttcgcgatttcgcgtcgcgtttgcgtagtttaggttcggcgacgttagtaggttcgtttcgtttttttcgcgtttcgtcgtgttgtgcgaggtttagattaagggcgagatagtaggtaggattgggtggagacgttcggggacgtggtaattggagtttttttttcgtattttcggtatttagttttttttttttt

SEQ ID NO: 34078 - DNA, 631 bp, Artificial Sequence
  chemically treated genomic DNA (Homo sapiens) CpG-island No: 34078
aaaaaaaaaaaaactaaataccgaaaatacgaaaaaaaaactccaattaccacgtccccgaacgtctccacccaatcctacctactatctcgcccttaatctaaacctcgcacaacacgacgaaacgcgaaaaaaacgaaacgaacctactaacgtcgccgaacctaaactacgcaaacgcgacgcgaaatcgcgaaaacgaacgcgcgataacaattcgcgacaattcgcgcgaaaacgaaacgcctaaataaataaacgcttaaacgcctaaactaccgaacgataaaaacgaaaatcgctataaaacgctaaaaaaaccaaaataacgactccgaacaaaaaaacgtcaactccaaacccccaaccttccaaaaaaactctcccgaaaaacccttcgtcgaaaatcccgaacaaaaaaaaaaattcgaccccgcaactaccgctattacaatcgtccgaacctttcgtaaaaaactctatcgtccgcatctcgataaaaaacttcctataaattacccgaaaaccgcgccgcgaatataaaaatatactaaccaacaaaccccgaaactccgacaacgcgcgaacgtaaacgtataaatatatacctaacttataaatctaaccttaa

SEQ ID NO: 34079 - DNA, 631 bp, Artificial Sequence
  chemically treated genomic DNA (Homo sapiens) CpG-island No: 34079
aaaaaaaaaggaattgaatgtcgaaaatacggagaagaaattttagttgttacgttttcgaacgtttttatttagttttgtttgttgtttcgtttttagtttgggtttcgtatagtacggcggagcgcgggaggggcggggcgggtttgttgacgtcgtcggatttgaattgcgtaggcgcggcgcgagatcgcgggagcgagcgcgcggtaatagttcgcggtagttcgcgcgggagcggggcgtttgggtggatgggcgtttgggcgtttgggttgtcggacggtgggaacggaagtcgttgtgggacgttgaggaagttaggatggcgatttcgagtaagaagacgttaattttaagtttttagttttttaagagagttttttcgagagatttttcgtcggaggtttcgagtaagaggaagaattcggtttcgtagttgtcgttgttgtagtcgttcgggtttttcgtggaaggttttatcgttcgtatttcgatggagaattttttgtaagttgttcggaggtcgcgtcgcgggtgtggaggtgtgttggttagtaggtttcggggtttcggtagcgcgcgggcgtgggcgtgtgggtgtgtatttggtttgtgggtttggttttga

SEQ ID NO: 34080 - DNA, 631 bp, Artificial Sequence
  chemically treated genomic DNA (Homo sapiens) CpG-island No: 34080
tcaaaaccaaacccacaaaccaaatacacacccacacgcccacgcccgcgcgctaccgaaaccccgaaacctactaaccaacacacctccacacccgcgacgcgacctccgaacaacttacaaaaaattctccatcgaaatacgaacgataaaaccttccacgaaaaacccgaacgactacaacaacgacaactacgaaaccgaattcttcctcttactcgaaacctccgacgaaaaatctctcgaaaaaactctcttaaaaaactaaaaacttaaaattaacgtcttcttactcgaaatcgccatcctaacttcctcaacgtcccacaacgacttccgttcccaccgtccgacaacccaaacgcccaaacgcccatccacccaaacgccccgctcccgcgcgaactaccgcgaactattaccgcgcgctcgctcccgcgatctcgcgccgcgcctacgcaattcaaatccgacgacgtcaacaaacccgccccgcccctcccgcgctccgccgtactatacgaaacccaaactaaaaacgaaacaacaaacaaaactaaataaaaacgttcgaaaacgtaacaactaaaatttcttctccgtattttcgacattcaattccttttttttt

SEQ ID NO: 34081 - DNA, 572 bp, Artificial Sequence
  chemically treated genomic DNA (Homo sapiens) CpG-island No: 34081
attagttttcgttttatttcgtagatagtttggcgtcgggatatcggggacgtttgcgtagaagaattcgtttggttttttggttttaacggtaataatgttttttttcgaaagatagttagagtagttcgggggtattagtatacgtttgcgcgtttttcgacgttttggcgcgtttttggtgtttaattttttttacgtgagcgcgttcgttattacgatattcgttgacggggtttttttatttgagtcgggtttcgtttttttttttttcgttgaaggaggcggtgattttttttcgatcggattcggtagtgttagaggaggtgggaacgttttgattagcgttttcgttacgggatttttttttttttttattcgttttttttttatttcgtttttagttttttagtttttttagttagttcgtcgtagtattttgagaatacggcggcggcgttcgaggataagcggaagtgacgtaatgtaagagcgtttatttcgttttatttcgttttttttagttgggttgtaattaattagtaatgggaagggcggggtcggggtaggag

SEQ ID NO: 34082 - DNA, 572 bp, Artificial Sequence
  chemically treated genomic DNA (Homo sapiens) CpG-island No: 34082
ctcctaccccgaccccgcccttcccattactaattaattacaacccaactaaaaaaaacgaaataaaacgaaataaacgctcttacattacgtcacttccgcttatcctcgaacgccgccgccgtattctcaaaatactacgacgaactaactaaaaaaactaaaaaactaaaaacgaaataaaaaaaaaacgaataaaaaaaaaaaaaaatcccgtaacgaaaacgctaatcaaaacgttcccacctcctctaacactaccgaatccgatcgaaaaaaaatcaccgcctccttcaacgaaaaaaaaaaaaacgaaacccgactcaaataaaaaaaccccgtcaacgaatatcgtaataacgaacgcgctcacgtaaaaaaaattaaacaccaaaaacgcgccaaaacgtcgaaaaacgcgcaaacgtatactaatacccccgaactactctaactatctttcgaaaaaaaacattattaccgttaaaaccaaaaaaccaaacgaattcttctacgcaaacgtccccgatatcccgacgccaaactatctacgaaataaaacgaaaactaat

SEQ ID NO: 34083 - DNA, 572 bp, Artificial Sequence
  chemically treated genomic DNA (Homo sapiens) CpG-island No: 34083
tttttatttcggtttcgttttttttattgttgattggttgtagtttaattgggagaggcggaatggggcggagtaggcgtttttgtattacgttattttcgtttattttcgggcgtcgtcgtcgtgtttttagagtgttgcggcgaattggttggaggagttaggggattagaggcggggtgggaggggggcgggtggaagggggaggaagtttcgtaacggagacgttggttaggacgtttttattttttttgatattgtcgagttcgatcggagaggggttatcgttttttttagcgaggaggaggggggcggagttcgatttaggtgaggagatttcgttagcgagtatcgtgatggcgggcgcgtttacgtggggaaggttgagtattaggggcgcgttaaggcgtcggggagcgcgtagacgtgtattggtgttttcggattattttggttgtttttcggaggggagtattgttatcgttggagttaaggggttaggcgggtttttttgcgtaggcgttttcggtgtttcgacgttaggttgtttgcggggtggggcgggggttggt

SEQ ID NO: 34084 - DNA, 572 bp, Artificial Sequence
  chemically treated genomic DNA (Homo sapiens) CpG-island No: 34084
accaacccccgccccaccccgcaaacaacctaacgtcgaaacaccgaaaacgcctacgcaaaaaaacccgcctaaccccttaactccaacgataacaatactcccctccgaaaaacaaccaaaataatccgaaaacaccaatacacgtctacgcgctccccgacgccttaacgcgcccctaatactcaaccttccccacgtaaacgcgcccgccatcacgatactcgctaacgaaatctcctcacctaaatcgaactccgcccccctcctcctcgctaaaaaaaacgataacccctctccgatcgaactcgacaatatcaaaaaaaataaaaacgtcctaaccaacgtctccgttacgaaacttcctcccccttccacccgcccccctcccaccccgcctctaatcccctaactcctccaaccaattcgccgcaacactctaaaaacacgacgacgacgcccgaaaataaacgaaaataacgtaatacaaaaacgcctactccgccccattccgcctctcccaattaaactacaaccaatcaacaataaaaaaaacgaaaccgaaataaaaa

SEQ ID NO: 34085 - DNA, 753 bp, Artificial Sequence
  chemically treated genomic DNA (Homo sapiens) CpG-island No: 34085
cgtttttcgaggtttagcgttaggcgcgggcgttagattggcggaggggtggtgcgaggggcgggggagggtcggttttttacgtgggggttgacgtcggttgtttagtaacgtttgtttgattttggggttataaaacgagtttatcgtgagcgtagcggagtagtagtagttttagttcggtgtagaagtttagtagtcggcgtgtcgtcgttcggttattttagcgttttttttttcgttttgcgtttttgttttaattcgcgttgtcgtcggatttcggtttatttagtagcgttcggcgtttattaggcggacgtttaggagaatttttgttttcgtcgcggtttttggagagttgatcgtttatttgtttcggttcgtttgaggacgggggtgtttttatgcggtttttatattttttatttcgtcgtcgtcgtcgtttcggagtttcgtatagtgtgttttagttttagtagggcgtataattttggaagtttcgcggcgtttcgagaggcggtagagttcgcgttttagtttcgggtcgggtcgggttagaatcgtagcgtttgggggaagttagagagtcggtaatcgtttcggggatgtaaggcgatagatataggattttcgagttcgtattagtatttttcggttgtttttcggggtgggggcgggtttcgtatacggtaagattttttgttttcgtttaggtttaagatttaagatatagatattgatatgtatatatat

SEQ ID NO: 34086 - DNA, 753 bp, Artificial Sequence
  chemically treated genomic DNA (Homo sapiens) CpG-island No: 34086
atatatatacatatcaatatctatatcttaaatcttaaacctaaacgaaaacaaaaaatcttaccgtatacgaaacccgcccccaccccgaaaaacaaccgaaaaatactaatacgaactcgaaaatcctatatctatcgccttacatccccgaaacgattaccgactctctaacttcccccaaacgctacgattctaacccgacccgacccgaaactaaaacgcgaactctaccgcctctcgaaacgccgcgaaacttccaaaattatacgccctactaaaactaaaacacactatacgaaactccgaaacgacgacgacgacgaaataaaaaatataaaaaccgcataaaaacacccccgtcctcaaacgaaccgaaacaaataaacgatcaactctccaaaaaccgcgacgaaaacaaaaattctcctaaacgtccgcctaataaacgccgaacgctactaaataaaccgaaatccgacgacaacgcgaattaaaacaaaaacgcaaaacgaaaaaaaaaacgctaaaataaccgaacgacgacacgccgactactaaacttctacaccgaactaaaactactactactccgctacgctcacgataaactcgttttataaccccaaaatcaaacaaacgttactaaacaaccgacgtcaacccccacgtaaaaaaccgaccctcccccgcccctcgcaccacccctccgccaatctaacgcccgcgcctaacgctaaacctcgaaaaacg

SEQ ID NO: 34087 - DNA, 753 bp, Artificial Sequence
  chemically treated genomic DNA (Homo sapiens) CpG-island No: 34087
atatatatatatattaatatttgtattttgaattttgagtttgagcgaaagtaagaggttttatcgtgtgcggggttcgtttttatttcgggaggtagtcgaagggtgttgatgcgagttcgggggttttatgtttgtcgttttatattttcgaagcgattatcgattttttggttttttttagacgttgcggttttggttcggttcggttcggggttggggcgcggattttgtcgtttttcggagcgtcgcgagatttttaaagttgtgcgttttgttggggttggggtatattgtgcggagtttcgggacggcggcggcggcggggtgaggagtgtgggggtcgtatgaaggtattttcgtttttaggcgggtcggggtaggtgaacgattagttttttaggagtcgcgacggaggtaggggtttttttgggcgttcgtttggtgggcgtcgagcgttgttggatgggtcggggttcgacgatagcgcgagttggggtaggagcgtaaggcggggaagaaggcgttggagtggtcgggcggcggtacgtcggttgttgggtttttgtatcgagttggagttgttgttgtttcgttgcgtttacggtggattcgttttatagttttaggattaagtaagcgttgttgagtagtcggcgttagtttttacgtgggaagtcgattttttttcgtttttcgtattattttttcgttagtttagcgttcgcgtttagcgttggatttcggggagcg

SEQ ID NO: 34088 - DNA, 753 bp, Artificial Sequence
  chemically treated genomic DNA (Homo sapiens) CpG-island No: 34088
cgctccccgaaatccaacgctaaacgcgaacgctaaactaacgaaaaaataatacgaaaaacgaaaaaaaatcgacttcccacgtaaaaactaacgccgactactcaacaacgcttacttaatcctaaaactataaaacgaatccaccgtaaacgcaacgaaacaacaacaactccaactcgatacaaaaacccaacaaccgacgtaccgccgcccgaccactccaacgccttcttccccgccttacgctcctaccccaactcgcgctatcgtcgaaccccgacccatccaacaacgctcgacgcccaccaaacgaacgcccaaaaaaacccctacctccgtcgcgactcctaaaaaactaatcgttcacctaccccgacccgcctaaaaacgaaaataccttcatacgacccccacactcctcaccccgccgccgccgccgtcccgaaactccgcacaatataccccaaccccaacaaaacgcacaactttaaaaatctcgcgacgctccgaaaaacgacaaaatccgcgccccaaccccgaaccgaaccgaaccaaaaccgcaacgtctaaaaaaaaccaaaaaatcgataatcgcttcgaaaatataaaacgacaaacataaaacccccgaactcgcatcaacacccttcgactacctcccgaaataaaaacgaaccccgcacacgataaaacctcttactttcgctcaaactcaaaattcaaaatacaaatattaatatatatatatat

SEQ ID NO: 34089 - DNA, 1733 bp, Artificial Sequence
  chemically treated genomic DNA (Homo sapiens) CpG-island No: 34089
ttatcgagagcgtttgaagcgcgagttaggcgtagttcgcgggattcgggttatgggtcgttagcggttttttagttcgggttcggtttttttgcggttttttttttatgtgagtcgtagttaggcgagcggggcgtcggaggaagaggaggatttacgggcgtcgggtcggaaggtagttggtagtaggtttaggttagcgggcgttcgcgtttatgtttcgttaggagtagtcgttggtcgagggtagttttgcgtttatgggttttttgtagtcggacgcgggtaacgcgagttggaacgggatcgaggcgtcggggggcggcgttcgggttattttttattttttgtaggtgacgttgacgttggtgtgtttggtcggtttgtttatgttgtttatcgtgttcggtaacgtgttcgttattatcgtcgtgtttacgagtcgcgcgtttaaggcgttttaaaatttttttttggtgtttttggtttcggtcgatattttggtggttacgttcgttatttttttttcgttggttaacgaggttatgggttattggtatttcggtaaggtttggtgcgagatttatttggcgttcgacgtgtttttttgtacgtcgtttatcgtgtatttgtgcgttattagtttggatcgttattggtttattatataggttatcgagtataatttgaagcgtacgtcgcgtcgtattaaggttattattattatcgtgtgggttatttcggtcgttatttttttttcgtcgtttatttttatcgagaagaagggcggcggcggcggttcgtagtcggtcgagtcgcgttgcgagattaacgattagaagtggtacgttatttcgtcgtgtatcggtttttttttcgttttttgttttattatgattttggtttacgtgcgtatttattagatcgttaagcgtcgtattcgcgtgttatttagtcgtcggggttcggacgtcgtcgtcgcgtcgtcggggggtatcgagcgtaggtttaacggtttgggtttcgagcgtagcgcgggttcggggggcgtagaggtcgaatcgttgtttatttagtttaacggcgtttttggcgagttcgcgtcggtcgggtcgcgcgatatcgacgcgttggatttggaggagagttcgtttttcgattacgtcgagcggtttttagggtttcgtagattcgagcgcggttttcggggtaaaggtaaggttcgagcgagttaggtgaagtcgggcgatagtttgtcgcggcgcgggtcgggggcgacggggatcgggacgtcggttgtagggtcgggggaggagcgcgtcggggttgttaaggcgtcgcgttggcgcgggcggtagaatcgcgagaagcgttttacgttcgtgttggtcgtggttatcggagtgttcgtggtgtgttggtttttttttttttttatttatacgtttacggtcgtcgggtgtttcgtgttacgtacgttttttaaattttttttttggttcggttattgtaatagttcgttgaattcggttatttatattatttttaattacgattttcgtcgcgtttttaagaagattttttgtcggggggataggaagcggatcgtgtgaggttttcgttggcgttcgcgtagatttacgttgattgtaggtagcggggggtatcgaggggtgtttagttttagggtatttagaaattcgggcgttgtttgttttgcgttttttcgtttg

SEQ ID NO: 34090 - DNA, 1733 bp, Artificial Sequence
  chemically treated genomic DNA (Homo sapiens) CpG-island No: 34090
caaacgaaaaaacgcaaaacaaacaacgcccgaatttctaaataccctaaaactaaacacccctcgataccccccgctacctacaatcaacgtaaatctacgcgaacgccaacgaaaacctcacacgatccgcttcctatccccccgacaaaaaatcttcttaaaaacgcgacgaaaatcgtaattaaaaataatataaataaccgaattcaacgaactattacaataaccgaaccaaaaaaaaaatttaaaaaacgtacgtaacacgaaacacccgacgaccgtaaacgtataaataaaaaaaaaaaaaaaccaacacaccacgaacactccgataaccacgaccaacacgaacgtaaaacgcttctcgcgattctaccgcccgcgccaacgcgacgccttaacaaccccgacgcgctcctcccccgaccctacaaccgacgtcccgatccccgtcgcccccgacccgcgccgcgacaaactatcgcccgacttcacctaactcgctcgaaccttacctttaccccgaaaaccgcgctcgaatctacgaaaccctaaaaaccgctcgacgtaatcgaaaaacgaactctcctccaaatccaacgcgtcgatatcgcgcgacccgaccgacgcgaactcgccaaaaacgccgttaaactaaataaacaacgattcgacctctacgccccccgaacccgcgctacgctcgaaacccaaaccgttaaacctacgctcgataccccccgacgacgcgacgacgacgtccgaaccccgacgactaaataacacgcgaatacgacgcttaacgatctaataaatacgcacgtaaaccaaaatcataataaaacaaaaaacgaaaaaaaaaccgatacacgacgaaataacgtaccacttctaatcgttaatctcgcaacgcgactcgaccgactacgaaccgccgccgccgcccttcttctcgataaaaataaacgacgaaaaaaaaataacgaccgaaataacccacacgataataataataaccttaatacgacgcgacgtacgcttcaaattatactcgataacctatataataaaccaataacgatccaaactaataacgcacaaatacacgataaacgacgtacaaaaaaacacgtcgaacgccaaataaatctcgcaccaaaccttaccgaaataccaataacccataacctcgttaaccaacgaaaaaaaaataacgaacgtaaccaccaaaatatcgaccgaaaccaaaaacaccaaaaaaaaattttaaaacgccttaaacgcgcgactcgtaaacacgacgataataacgaacacgttaccgaacacgataaacaacataaacaaaccgaccaaacacaccaacgtcaacgtcacctacaaaaaataaaaaataacccgaacgccgccccccgacgcctcgatcccgttccaactcgcgttacccgcgtccgactacaaaaaacccataaacgcaaaactaccctcgaccaacgactactcctaacgaaacataaacgcgaacgcccgctaacctaaacctactaccaactaccttccgacccgacgcccgtaaatcctcctcttcctccgacgccccgctcgcctaactacgactcacataaaaaaaaaaccgcaaaaaaaccgaacccgaactaaaaaaccgctaacgacccataacccgaatcccgcgaactacgcctaactcgcgcttcaaacgctctcgataa

SEQ ID NO: 34091 - DNA, 1733 bp, Artificial Sequence
  chemically treated genomic DNA (Homo sapiens) CpG-island No: 34091
tagacgaggaaacgtagagtaggtagcgttcgggtttttgagtgttttggggttaagtatttttcgatgtttttcgttgtttgtagttagcgtgagtttacgcgggcgttagcggaaattttatacgattcgttttttgttttttcgatagaggatttttttgaaggcgcggcggaaatcgtggttgaagatggtgtagatgatcgggtttaacgagttgttgtagtagtcgaattagaagaagaatttgaagagcgtgcgtggtacggagtattcgacggtcgtgagcgtgtaggtgaagaagaaggggaattagtatattacgaatatttcgatgattacggttagtacgaacgtgaagcgtttttcgcggttttgtcgttcgcgttagcgcgacgttttggtagtttcgacgcgtttttttttcggttttgtagtcggcgtttcgattttcgtcgttttcggttcgcgtcgcggtaggttgtcgttcggttttatttggttcgttcgggttttgtttttgtttcggggatcgcgttcgggtttgcggggttttggaggtcgttcggcgtggtcggaagacgagtttttttttaggtttagcgcgtcggtgtcgcgcggttcggtcggcgcgggttcgttaggggcgtcgttgagttgggtgggtagcggttcggtttttgcgtttttcgggttcgcgttgcgttcggggtttagatcgttgggtttgcgttcggtgtttttcggcggcgcggcgacggcgttcggatttcggcggttgggtggtacgcgggtgcgacgtttggcgatttggtagatgcgtacgtagattaggattatgatgaggtagggagcgaagaaggagtcgatgtacgacgagatgacgtattatttttggtcgttgatttcgtagcgcggttcggtcggttgcgggtcgtcgtcgtcgttttttttttcgatggagatgagcggcgggaaggagatgacggtcgagatgatttatacggtgatgatgatggttttgatgcggcgcggcgtgcgttttaggttgtattcgatggtttgtgtgatggattagtagcggtttaggttgatggcgtataggtgtacgatggacgacgtgtagaagagtacgtcgagcgttaggtagatttcgtattaagttttgtcgaagtattagtagtttatgatttcgttggttagcgagaaagggatgacgagcgtggttattaggatgtcggtcgaggttagagatattaggaagaggttttggggcgttttgagcgcgcggttcgtgaatacggcgatgatgacgagtacgttgtcgaatacggtgagtagtatgagtaggtcggttaggtatattagcgttagcgttatttgtagggagtaaggggtggttcgggcgtcgtttttcggcgtttcggtttcgttttagttcgcgttgttcgcgttcggttgtagggagtttatgggcgtaaagttgttttcggttaacggttgtttttggcggaatatgaacgcgggcgttcgttggtttgggtttgttgttagttgtttttcggttcggcgttcgtgggttttttttttttttcggcgtttcgttcgtttggttgcggtttatatagggagggggtcgtagggaggtcgggttcgaattggaggatcgttagcggtttatggttcgggtttcgcgaattgcgtttggttcgcgttttagacgttttcggtgg

SEQ ID NO: 34092 - DNA, 1733 bp, Artificial Sequence
  chemically treated genomic DNA (Homo sapiens) CpG-island No: 34092
ccaccgaaaacgtctaaaacgcgaaccaaacgcaattcgcgaaacccgaaccataaaccgctaacgatcctccaattcgaacccgacctccctacgaccccctccctatataaaccgcaaccaaacgaacgaaacgccgaaaaaaaaaaaaaacccacgaacgccgaaccgaaaaacaactaacaacaaacccaaaccaacgaacgcccgcgttcatattccgccaaaaacaaccgttaaccgaaaacaactttacgcccataaactccctacaaccgaacgcgaacaacgcgaactaaaacgaaaccgaaacgccgaaaaacgacgcccgaaccaccccttactccctacaaataacgctaacgctaatatacctaaccgacctactcatactactcaccgtattcgacaacgtactcgtcatcatcgccgtattcacgaaccgcgcgctcaaaacgccccaaaacctcttcctaatatctctaacctcgaccgacatcctaataaccacgctcgtcatccctttctcgctaaccaacgaaatcataaactactaatacttcgacaaaacttaatacgaaatctacctaacgctcgacgtactcttctacacgtcgtccatcgtacacctatacgccatcaacctaaaccgctactaatccatcacacaaaccatcgaatacaacctaaaacgcacgccgcgccgcatcaaaaccatcatcatcaccgtataaatcatctcgaccgtcatctccttcccgccgctcatctccatcgaaaaaaaaaacgacgacgacgacccgcaaccgaccgaaccgcgctacgaaatcaacgaccaaaaataatacgtcatctcgtcgtacatcgactccttcttcgctccctacctcatcataatcctaatctacgtacgcatctaccaaatcgccaaacgtcgcacccgcgtaccacccaaccgccgaaatccgaacgccgtcgccgcgccgccgaaaaacaccgaacgcaaacccaacgatctaaaccccgaacgcaacgcgaacccgaaaaacgcaaaaaccgaaccgctacccacccaactcaacgacgcccctaacgaacccgcgccgaccgaaccgcgcgacaccgacgcgctaaacctaaaaaaaaactcgtcttccgaccacgccgaacgacctccaaaaccccgcaaacccgaacgcgatccccgaaacaaaaacaaaacccgaacgaaccaaataaaaccgaacgacaacctaccgcgacgcgaaccgaaaacgacgaaaatcgaaacgccgactacaaaaccgaaaaaaaaacgcgtcgaaactaccaaaacgtcgcgctaacgcgaacgacaaaaccgcgaaaaacgcttcacgttcgtactaaccgtaatcatcgaaatattcgtaatatactaattccccttcttcttcacctacacgctcacgaccgtcgaatactccgtaccacgcacgctcttcaaattcttcttctaattcgactactacaacaactcgttaaacccgatcatctacaccatcttcaaccacgatttccgccgcgccttcaaaaaaatcctctatcgaaaaaacaaaaaacgaatcgtataaaatttccgctaacgcccgcgtaaactcacgctaactacaaacaacgaaaaacatcgaaaaatacttaaccccaaaacactcaaaaacccgaacgctacctactctacgtttcctcgtcta

SEQ ID NO: 34093 - DNA, 771 bp, Artificial Sequence
  chemically treated genomic DNA (Homo sapiens) CpG-island No: 34093
tattaggcgtcgttttcgtttttcgtagcgtttaggttttcgttttcgtcgcggagttatagtcggagttggagtcgaggcggcggcgggacgcggtcggtcggataaattttttgttaggttgcggatagcgggcggtaggagtcggcgcgagcggttttaggaatttacggtttttgcgcgttttcgcgattttttttcgcgttcggcgaatatagtcgggcgtttcggagggcggcgggtatgcgttcgggagatgcggagttttcgttgtagcgcgatatgcgcgattagatcggttttttttaaggtgagcgcgcgtgcggatagggattttgcgtttttgtggggaattgtgtatttcgggaggtttaagtaggtcggggcgttgtttcggtcgttgtcgcgggagggaggggtcgtttcggggtttagagttcggatttcggtttcgtcgttttcgcggcgcgtttagtattagcggatggggttcgtacgattttcgatttcggtttgtggcgcgtttttttattcggagtttttagtttaatttggcgattatagtggtagtgtttacgttttttttcggtaaataggaggagggcgcgcgtgtttgcgggtggttatagtgcgcgggggtcggcggtagggcggcgtacgtgaaagcgggcgatatagagagggggtgtaggtcgcgcgtggggggttgcgtttattcgaggttggaggttggagtttttgaagaaagtggttcgagttgtgttaattttg

SEQ ID NO: 34094 - DNA, 771 bp, Artificial Sequence
  chemically treated genomic DNA (Homo sapiens) CpG-island No: 34094
caaaattaacacaactcgaaccactttcttcaaaaactccaacctccaacctcgaataaacgcaaccccccacgcgcgacctacaccccctctctatatcgcccgctttcacgtacgccgccctaccgccgacccccgcgcactataaccacccgcaaacacgcgcgccctcctcctatttaccgaaaaaaaacgtaaacactaccactataatcgccaaattaaactaaaaactccgaataaaaaaacgcgccacaaaccgaaatcgaaaatcgtacgaaccccatccgctaatactaaacgcgccgcgaaaacgacgaaaccgaaatccgaactctaaaccccgaaacgacccctccctcccgcgacaacgaccgaaacaacgccccgacctacttaaacctcccgaaatacacaattccccacaaaaacgcaaaatccctatccgcacgcgcgctcaccttaaaaaaaaccgatctaatcgcgcatatcgcgctacaacgaaaactccgcatctcccgaacgcatacccgccgccctccgaaacgcccgactatattcgccgaacgcgaaaaaaaatcgcgaaaacgcgcaaaaaccgtaaattcctaaaaccgctcgcgccgactcctaccgcccgctatccgcaacctaacaaaaaatttatccgaccgaccgcgtcccgccgccgcctcgactccaactccgactataactccgcgacgaaaacgaaaacctaaacgctacgaaaaacgaaaacgacgcctaata

SEQ ID NO: 34095 - DNA, 771 bp, Artificial Sequence
  chemically treated genomic DNA (Homo sapiens) CpG-island No: 34095
tagagttggtataattcgagttattttttttaaaggttttagtttttagtttcgagtgggcgtagttttttacgcgcggtttgtattttttttttgtgtcgttcgtttttacgtacgtcgttttgtcgtcggttttcgcgtattgtagttattcgtagatacgcgcgttttttttttgtttatcgagagggagcgtgagtattgttattgtggtcgttaagttgggttggggatttcgggtgaggggacgcgttataggtcggggtcgggggtcgtacgggttttattcgttggtattgggcgcgtcgcgggggcggcggggtcggggttcggattttgagtttcggagcggtttttttttttcgcggtagcggtcgaggtagcgtttcggtttgtttgggtttttcggggtgtatagttttttataggggcgtagggtttttgttcgtacgcgcgtttattttggggggggtcggtttggtcgcgtatatcgcgttgtagcggaggtttcgtatttttcgggcgtatgttcgtcgtttttcggggcgttcggttgtattcgtcgggcgcgaagaagggtcgcggggacgcgtagagatcgtgggtttttgaagtcgttcgcgtcggtttttgtcgttcgttgttcgtagtttagtaggaaatttgttcggtcggtcgcgtttcgtcgtcgtttcggttttagtttcggttgtggtttcgcggcgggggcgggggtttgggcgttgcgaggagcgggggcgacgtttggtg

SEQ ID NO: 34096 - DNA, 771 bp, Artificial Sequence
  chemically treated genomic DNA (Homo sapiens) CpG-island No: 34096
caccaaacgtcgcccccgctcctcgcaacgcccaaacccccgcccccgccgcgaaaccacaaccgaaactaaaaccgaaacgacgacgaaacgcgaccgaccgaacaaatttcctactaaactacgaacaacgaacgacaaaaaccgacgcgaacgacttcaaaaacccacgatctctacgcgtccccgcgacccttcttcgcgcccgacgaatacaaccgaacgccccgaaaaacgacgaacatacgcccgaaaaatacgaaacctccgctacaacgcgatatacgcgaccaaaccgaccccccccaaaataaacgcgcgtacgaacaaaaaccctacgcccctataaaaaactatacaccccgaaaaacccaaacaaaccgaaacgctacctcgaccgctaccgcgaaaaaaaaaaaccgctccgaaactcaaaatccgaaccccgaccccgccgcccccgcgacgcgcccaataccaacgaataaaacccgtacgacccccgaccccgacctataacgcgtcccctcacccgaaatccccaacccaacttaacgaccacaataacaatactcacgctccctctcgataaacaaaaaaaaaacgcgcgtatctacgaataactacaatacgcgaaaaccgacgacaaaacgacgtacgtaaaaacgaacgacacaaaaaaaaaatacaaaccgcgcgtaaaaaactacgcccactcgaaactaaaaactaaaacctttaaaaaaaataactcgaattataccaactcta

SEQ ID NO: 34097 - DNA, 511 bp, Artificial Sequence
  chemically treated genomic DNA (Homo sapiens) CpG-island No: 34097
gttattcgttttcgtgggtttttttttcgttttgttttgttttgcggcgttttttgtcggtttcgcgtgttttttgcggttgtttttttttttcgggttcgttcgtttcgcgcggttgttttggagagggacgcgtaggttacgttatcgcggacgggtcggattcggtttttggacgcggaatagagattttttgatttagttatttttagattgagtttcgtagagtgcgtttttatttttttgtttcgacgaaggttttagagacgttgcggataatattagtatgtcgagcgagtagagcgcgtcgggggttttatttagggtttcgcgttcggggatttagaagttttttggcgcggtgattaaaaagggagagcgcgcggttaaagagaagttagcgatcgttttgtttttcgtgggggaggaggagtttaaaagttttggtacgttggcgtcggggtttggggatcgggtttttaggttgcgttttttcgggtttttattagtt

SEQ ID NO: 34098 - DNA, 511 bp, Artificial Sequence
  chemically treated genomic DNA (Homo sapiens) CpG-island No: 34098
aactaataaaaacccgaaaaaacgcaacctaaaaacccgatccccaaaccccgacgccaacgtaccaaaacttttaaactcctcctcccccacgaaaaacaaaacgatcgctaacttctctttaaccgcgcgctctccctttttaatcaccgcgccaaaaaacttctaaatccccgaacgcgaaaccctaaataaaacccccgacgcgctctactcgctcgacatactaatattatccgcaacgtctctaaaaccttcgtcgaaacaaaaaaataaaaacgcactctacgaaactcaatctaaaaataactaaatcaaaaaatctctattccgcgtccaaaaaccgaatccgacccgtccgcgataacgtaacctacgcgtccctctccaaaacaaccgcgcgaaacgaacgaacccgaaaaaaaaaaacaaccgcaaaaaacacgcgaaaccgacaaaaaacgccgcaaaacaaaacaaaacgaaaaaaaaacccacgaaaacgaataac

SEQ ID NO: 34099 - DNA, 511 bp, Artificial Sequence
  chemically treated genomic DNA (Homo sapiens) CpG-island No: 34099
agttagtgggaattcgggaagacgtagtttggaagttcgatttttaaatttcggcgttagcgtattagggtttttgggtttttttttttttacgggaggtagaacggtcgttggtttttttttggtcgcgcgttttttttttttggttatcgcgttagaagatttttgggttttcggacgcggggttttgggtgaggttttcggcgcgttttgttcgttcgatatgttggtgttgttcgtagcgtttttgggattttcgtcggggtaggaaggtaagaacgtattttacggggtttagtttgggggtggttgaattaggggatttttgtttcgcgtttagggatcggattcgattcgttcgcggtggcgtagtttacgcgtttttttttaagataatcgcgcgaggcgggcgggttcgagggaaaggggtaatcgtagagagtacgcggggtcgatagggggcgtcgtagggtagagtaaggcgaggggagagtttacgagggcgggtggt

SEQ ID NO: 34100 - DNA, 511 bp, Artificial Sequence
  chemically treated genomic DNA (Homo sapiens) CpG-island No: 34100
accacccgccctcgtaaactctcccctcgccttactctaccctacgacgccccctatcgaccccgcgtactctctacgattacccctttccctcgaacccgcccgcctcgcgcgattatcttaaaaaaaaacgcgtaaactacgccaccgcgaacgaatcgaatccgatccctaaacgcgaaacaaaaatcccctaattcaaccacccccaaactaaaccccgtaaaatacgttcttaccttcctaccccgacgaaaatcccaaaaacgctacgaacaacaccaacatatcgaacgaacaaaacgcgccgaaaacctcacccaaaaccccgcgtccgaaaacccaaaaatcttctaacgcgataaccaaaaaaaaaaaacgcgcgaccaaaaaaaaaccaacgaccgttctacctcccgtaaaaaaaaaaaaacccaaaaaccctaatacgctaacgccgaaatttaaaaatcgaacttccaaactacgtcttcccgaattcccactaact

SEQ ID NO: 34101 - DNA, 640 bp, Artificial Sequence
  chemically treated genomic DNA (Homo sapiens) CpG-island No: 34101
gcgttcgggttacgtattttttaggtgcgtgtttcgtggggattgcgtttcggttggtcgttcgtttcgagtcgaagtcggacgtcggtaggtttttaagcggggtgtttatcgggtcggtttttttgggcgttggtaggttgtcgcgtttaatgtggataggagtgtcgggtcgagggtaagggaagaacgtggtttttttcgattttttcggttttttttattttttttaagtttttttaattttaaagagtagtttcgcggtgtttgcgaagtttttaacgggggaggcggcgttgggagtaggtcgggagcgcgggcgggggtttagcgggtgtagcgggaggaaggggcgggggcgcgcggttttaaggcgttagtgcggaagcgtttagcgggtcgggggttttttttcgcggggtttttcggggcggattcgggtgcggcggtcgagatgcgggcggtggagggggtaggtttcgattttttcgtttttttcgcgtcgcgggtcgtcggtttgagttgggaaaggcgcggcgggcggttggcgaggaaggaggtttttgtttttttattttgtttttcgggttaggtttttagttggagtcgtattgtcgttcgggggtcggggcgaaggttt

SEQ ID NO: 34102 - DNA, 640 bp, Artificial Sequence
  chemically treated genomic DNA (Homo sapiens) CpG-island No: 34102
aaaccttcgccccgacccccgaacgacaatacgactccaactaaaaacctaacccgaaaaacaaaataaaaaaacaaaaacctccttcctcgccaaccgcccgccgcgcctttcccaactcaaaccgacgacccgcgacgcgaaaaaaacgaaaaaatcgaaacctaccccctccaccgcccgcatctcgaccgccgcacccgaatccgccccgaaaaaccccgcgaaaaaaaacccccgacccgctaaacgcttccgcactaacgccttaaaaccgcgcgcccccgccccttcctcccgctacacccgctaaacccccgcccgcgctcccgacctactcccaacgccgcctcccccgttaaaaacttcgcaaacaccgcgaaactactctttaaaattaaaaaaacttaaaaaaaataaaaaaaaccgaaaaaatcgaaaaaaaccacgttcttcccttaccctcgacccgacactcctatccacattaaacgcgacaacctaccaacgcccaaaaaaaccgacccgataaacaccccgcttaaaaacctaccgacgtccgacttcgactcgaaacgaacgaccaaccgaaacgcaatccccacgaaacacgcacctaaaaaatacgtaacccgaacgc

SEQ ID NO: 34103 - DNA, 640 bp, Artificial Sequence
  chemically treated genomic DNA (Homo sapiens) CpG-island No: 34103
ggattttcgtttcggttttcgagcggtagtgcggttttagttggaggtttggttcgggaagtaaagtgaaaggatagaggttttttttttcgttagtcgttcgtcgcgttttttttagtttaggtcggcggttcgcggcgcggagggagcgaaagagtcggggtttgttttttttatcgttcgtatttcggtcgtcgtattcgggttcgtttcgggaggtttcgcgggagggaattttcggttcgttgggcgttttcgtattgacgttttggggtcgcgcgttttcgtttttttttttcgttatattcgttgggttttcgttcgcgttttcggtttgtttttagcgtcgtttttttcgttagaaatttcgtagatatcgcgaagttgttttttggagttggagaaatttaggaagaatgggaaaagtcgaggaagtcggggaggattacgttttttttttgttttcggttcgatatttttgtttatattggacgcggtagtttgttagcgtttaggagagtcgattcggtggatatttcgtttggggatttgtcggcgttcggtttcggttcgaggcgggcggttagtcggggcgtaatttttacgggatacgtatttaggggatgcgtgattcggacgt

SEQ ID NO: 34104 - DNA, 640 bp, Artificial Sequence
  chemically treated genomic DNA (Homo sapiens) CpG-island No: 34104
acgtccgaatcacgcatcccctaaatacgtatcccgtaaaaattacgccccgactaaccgcccgcctcgaaccgaaaccgaacgccgacaaatccccaaacgaaatatccaccgaatcgactctcctaaacgctaacaaactaccgcgtccaatataaacaaaaatatcgaaccgaaaacaaaaaaaaaacgtaatcctccccgacttcctcgacttttcccattcttcctaaatttctccaactccaaaaaacaacttcgcgatatctacgaaatttctaacgaaaaaaacgacgctaaaaacaaaccgaaaacgcgaacgaaaacccaacgaatataacgaaaaaaaaaaacgaaaacgcgcgaccccaaaacgtcaatacgaaaacgcccaacgaaccgaaaattccctcccgcgaaacctcccgaaacgaacccgaatacgacgaccgaaatacgaacgataaaaaaaacaaaccccgactctttcgctccctccgcgccgcgaaccgccgacctaaactaaaaaaaacgcgacgaacgactaacgaaaaaaaaaacctctatcctttcactttacttcccgaaccaaacctccaactaaaaccgcactaccgctcgaaaaccgaaacgaaaatcc

SEQ ID NO: 34105 - DNA, 612 bp, Artificial Sequence
  chemically treated genomic DNA (Homo sapiens) CpG-island No: 34105
ttgcggcggcggttttggttgtaaatcgtcgtcgtgtggttgttattggtaatcgagtttttgtcgagcgcgtagtttcgtagtttttggaacgaaggtggtaagggaagcggttgtcgcggcgcggtcgcgtcggtttggtagtttatagggttttcgttttcgttcgcgtttcgtagttttttcgggttttgattgtagttgtgcggtaaagacggtcgaagggtttttaggtgggggtttcgttgtttcgaaagcgttaagtgattggcggttttcgcgaagagtaatatggtagttcgggttttaagaatgggatttttgcgttttttgcgggcggggggggcgggttttagtttttaggtcgggagtgagttttgttcgcgttttcgatttttagttaggtcgagttaagggagtcgcgcgcgttgtttcgtttcgttttcggttttcggttttttgttttttattgggcgggcgttttacgtttcgggggttttttatgaaaatttcgaagtttcggttattcgaggtggtgatatcggttttgttagtatttaatagaaatgattggtatttttcgttttcggtggggatcgggtagagtaggag

SEQ ID NO: 34106 - DNA, 612 bp, Artificial Sequence
  chemically treated genomic DNA (Homo sapiens) CpG-island No: 34106
ctcctactctacccgatccccaccgaaaacgaaaaataccaatcatttctattaaatactaacaaaaccgatatcaccacctcgaataaccgaaacttcgaaattttcataaaaaacccccgaaacgtaaaacgcccgcccaataaaaaacaaaaaaccgaaaaccgaaaacgaaacgaaacaacgcgcgcgactcccttaactcgacctaactaaaaatcgaaaacgcgaacaaaactcactcccgacctaaaaactaaaacccgccccccccgcccgcaaaaaacgcaaaaatcccattcttaaaacccgaactaccatattactcttcgcgaaaaccgccaatcacttaacgctttcgaaacaacgaaacccccacctaaaaacccttcgaccgtctttaccgcacaactacaatcaaaacccgaaaaaactacgaaacgcgaacgaaaacgaaaaccctataaactaccaaaccgacgcgaccgcgccgcgacaaccgcttcccttaccaccttcgttccaaaaactacgaaactacgcgctcgacaaaaactcgattaccaataacaaccacacgacgacgatttacaaccaaaaccgccgccgcaa

SEQ ID NO: 34107 - DNA, 612 bp, Artificial Sequence
  chemically treated genomic DNA (Homo sapiens) CpG-island No: 34107
tttttgttttgttcggtttttatcggggacggggaatgttagttatttttgttgagtgttagtagggtcggtgttattatttcgggtggtcgaggtttcgaggtttttatgaaaagttttcgaagcgtgaggcgttcgtttagtggagaataaagggtcgagggtcgaaggcgaggcgaggtagcgcgcgcggtttttttggttcgatttagttgggagtcgggggcgcgggtagggtttattttcggtttagaaattggagttcgtttttttcgttcgtaggggacgtagggattttatttttgaagttcgagttgttatgttgtttttcgcggaggtcgttagttatttgacgttttcgagatagcgaagtttttatttgagagtttttcggtcgtttttgtcgtatagttgtagttaaggttcggagggattgcgggacgcgggcgggagcgagagttttgtgggttgttaagtcggcgcggtcgcgtcgcggtagtcgttttttttgttattttcgttttaggggttgcggggttgcgcgttcggtagaggttcggttgttagtagtaattatacgacggcgatttgtagttagggtcgtcgtcgtag

SEQ ID NO: 34108 - DNA, 612 bp, Artificial Sequence
  chemically treated genomic DNA (Homo sapiens) CpG-island No: 34108
ctacgacgacgaccctaactacaaatcgccgtcgtataattactactaacaaccgaacctctaccgaacgcgcaaccccgcaacccctaaaacgaaaataacaaaaaaaacgactaccgcgacgcgaccgcgccgacttaacaacccacaaaactctcgctcccgcccgcgtcccgcaatccctccgaaccttaactacaactatacgacaaaaacgaccgaaaaactctcaaataaaaacttcgctatctcgaaaacgtcaaataactaacgacctccgcgaaaaacaacataacaactcgaacttcaaaaataaaatccctacgtcccctacgaacgaaaaaaacgaactccaatttctaaaccgaaaataaaccctacccgcgcccccgactcccaactaaatcgaaccaaaaaaaccgcgcgcgctacctcgcctcgccttcgaccctcgaccctttattctccactaaacgaacgcctcacgcttcgaaaacttttcataaaaacctcgaaacctcgaccacccgaaataataacaccgaccctactaacactcaacaaaaataactaacattccccgtccccgataaaaaccgaacaaaacaaaaa

SEQ ID NO: 34109 - DNA, 877 bp, Artificial Sequence
  chemically treated genomic DNA (Homo sapiens) CpG-island No: 34109
ttgttttcgaattaggtttttttggcgcgtggggttttttcggcgtttggtttcgattcgcgtcgtagttaggatattacggtaatttggggtcgttttgtaaggagtttcgattttcgggtagtgtagggatattcgacggcgcgcgatgtttcggcggtttcgcgagtttggcgcgttgagagttttagtagttcgagttttcgagttcgggcgttttcgcgtcgtcgtttcgtttagtgcgtttaggtatcgcggtcgtgacgttacgttcgggattggtcgttgtagtaagacggtcgcgtttcggtttcggtaggttgttcgggagacgcgggtatatagagaagcggtttcggtcggaggtcgagtcgtcgttacgatcgtttttttggtggattcgtaggtcgagcggttttttcgtagagttcgaggagggtagacggcggcgggggcgttatgagttagaggtaggtgttgtaaggtagggtcgaggcgggtaggtgttttaattagttggcgtcgaggagattcgggtgcggtgggttttatcgattttttttttcgtagtgttcgagtaatattagaaggttaggatttagttcgtgtagatggtggcggagttggcgattagattttaaaatatcgagacgttgtagaacgcgggtgagttcggagttcgaattttcgtcgtttttcgcgtattgagttttcgacgttttcgtttcgttgttttgttcgtggagtttttggggagtcgtagtgtggggatcggagttcgtaaaagtatttattttttttagcgggtttttgggggttaggtcgagagggtgaagtttttagatggttgtgggaggtgcgcgttgtttttgttttt

SEQ ID NO: 34110 - DNA, 877 bp, Artificial Sequence
  chemically treated genomic DNA (Homo sapiens) CpG-island No: 34110
aaaaacaaaaacaacgcgcacctcccacaaccatctaaaaacttcaccctctcgacctaacccccaaaaacccgctaaaaaaaataaatacttttacgaactccgatccccacactacgactccccaaaaactccacgaacaaaacaacgaaacgaaaacgtcgaaaactcaatacgcgaaaaacgacgaaaattcgaactccgaactcacccgcgttctacaacgtctcgatattttaaaatctaatcgccaactccgccaccatctacacgaactaaatcctaaccttctaatattactcgaacactacgaaaaaaaaaatcgataaaacccaccgcacccgaatctcctcgacgccaactaattaaaacacctacccgcctcgaccctaccttacaacacctacctctaactcataacgcccccgccgccgtctaccctcctcgaactctacgaaaaaaccgctcgacctacgaatccaccaaaaaaacgatcgtaacgacgactcgacctccgaccgaaaccgcttctctatatacccgcgtctcccgaacaacctaccgaaaccgaaacgcgaccgtcttactacaacgaccaatcccgaacgtaacgtcacgaccgcgatacctaaacgcactaaacgaaacgacgacgcgaaaacgcccgaactcgaaaactcgaactactaaaactctcaacgcgccaaactcgcgaaaccgccgaaacatcgcgcgccgtcgaatatccctacactacccgaaaatcgaaactccttacaaaacgaccccaaattaccgtaatatcctaactacgacgcgaatcgaaaccaaacgccgaaaaaaccccacgcgccaaaaaaacctaattcgaaaacaa

SEQ ID NO: 34111 - DNA, 877 bp, Artificial Sequence
  chemically treated genomic DNA (Homo sapiens) CpG-island No: 34111
ggaaatagggataacgcgtattttttataattatttggaagttttattttttcggtttgatttttaaagattcgttgaaaagaatggatgtttttgcgaatttcggtttttatattgcggttttttaagagttttacgggtagggtagcggggcggaggcgtcggggatttagtgcgcggggggcgacgggggttcgggtttcgggtttattcgcgttttgtagcgtttcgatgttttggggtttagtcgttagtttcgttattatttgtacgaattgggttttggttttttggtattgttcgaatattgcgggagagagagtcggtggagtttatcgtattcgggttttttcggcgttagttagttagggtatttgttcgtttcggttttattttgtagtatttgtttttgatttatggcgttttcgtcgtcgtttgtttttttcgagttttgcggggaagtcgttcggtttgcgagtttattaagggggcgatcgtggcgacgattcggttttcgatcggagtcgtttttttgtgtattcgcgtttttcgggtaatttatcggaatcggaacgcggtcgttttgttgtaacggttagtttcgggcgtgacgttacggtcgcggtgtttgggcgtattgagcggggcggcggcgcgaagacgttcgagttcgaggattcggattgttggggtttttagcgcgttaggttcgcggagtcgtcgggatatcgcgcgtcgtcgagtatttttgtattgttcggaggtcggagttttttataaagcgattttagattgtcgtggtattttgattgcggcgcgggtcgggattaagcgtcgggagagttttacgcgttaagggagtttggttcgagggtag

SEQ ID NO: 34112 - DNA, 877 bp, Artificial Sequence
  chemically treated genomic DNA (Homo sapiens) CpG-island No: 34112
ctaccctcgaaccaaactcccttaacgcgtaaaactctcccgacgcttaatcccgacccgcgccgcaatcaaaataccacgacaatctaaaatcgctttataaaaaactccgacctccgaacaatacaaaaatactcgacgacgcgcgatatcccgacgactccgcgaacctaacgcgctaaaaaccccaacaatccgaatcctcgaactcgaacgtcttcgcgccgccgccccgctcaatacgcccaaacaccgcgaccgtaacgtcacgcccgaaactaaccgttacaacaaaacgaccgcgttccgattccgataaattacccgaaaaacgcgaatacacaaaaaaacgactccgatcgaaaaccgaatcgtcgccacgatcgcccccttaataaactcgcaaaccgaacgacttccccgcaaaactcgaaaaaaacaaacgacgacgaaaacgccataaatcaaaaacaaatactacaaaataaaaccgaaacgaacaaataccctaactaactaacgccgaaaaaacccgaatacgataaactccaccgactctctctcccgcaatattcgaacaataccaaaaaaccaaaacccaattcgtacaaataataacgaaactaacgactaaaccccaaaacatcgaaacgctacaaaacgcgaataaacccgaaacccgaacccccgtcgccccccgcgcactaaatccccgacgcctccgccccgctaccctacccgtaaaactcttaaaaaaccgcaatataaaaaccgaaattcgcaaaaacatccattcttttcaacgaatctttaaaaatcaaaccgaaaaaataaaacttccaaataattataaaaaatacgcgttatccctatttcc

SEQ ID NO: 34113 - DNA, 551 bp, Artificial Sequence
  chemically treated genomic DNA (Homo sapiens) CpG-island No: 34113
attcgtgtagtagcggcggttttcgcgttttttttggttagagttaggcgtaggtcggtttgcggtgtcgtcgtttattggtcgcggcgcgggcgttgttatgttggttggaagcggatttttttgtgtcgtggaaattggcggtggtcgcggtcgtcgagtcggtttgcgtagttttttgcgttttttcgtttggattttggtattgagaggcggtggtcggcgggatggagaaaagtaggatgaatttgtttaaggggtcggatacgttttgtttcgataaggacgagtttatgaaggtgcgcgcggcgttcgtttttcggagtcgggttatgagggtgtttttgttttgtgttttttgtggcggttttttcggtcggttgtttttgtttgcgtacgtttagtgttaggtttttcgtcgagatttcgttgtatttcgtaatgagttttttggcgttaggtttggcgggtgtagtttggagaaagtatttttgtaaaatcgtgcgtgttatatggaaaggtttgaaagttttgggtaagtggttttgagt

SEQ ID NO: 34114 - DNA, 551 bp, Artificial Sequence
  chemically treated genomic DNA (Homo sapiens) CpG-island No: 34114
actcaaaaccacttacccaaaactttcaaacctttccatataacacgcacgattttacaaaaatactttctccaaactacacccgccaaacctaacgccaaaaaactcattacgaaatacaacgaaatctcgacgaaaaacctaacactaaacgtacgcaaacaaaaacaaccgaccgaaaaaaccgccacaaaaaacacaaaacaaaaacaccctcataacccgactccgaaaaacgaacgccgcgcgcaccttcataaactcgtccttatcgaaacaaaacgtatccgaccccttaaacaaattcatcctacttttctccatcccgccgaccaccgcctctcaataccaaaatccaaacgaaaaaacgcaaaaaactacgcaaaccgactcgacgaccgcgaccaccgccaatttccacgacacaaaaaaatccgcttccaaccaacataacaacgcccgcgccgcgaccaataaacgacgacaccgcaaaccgacctacgcctaactctaaccaaaaaaaacgcgaaaaccgccgctactacacgaat

SEQ ID NO: 34115 - DNA, 551 bp, Artificial Sequence
  chemically treated genomic DNA (Homo sapiens) CpG-island No: 34115
gtttaaaattatttgtttagaatttttaggtttttttatgtaatacgtacgattttatagaagtgttttttttaggttgtattcgttaaatttgacgttaaaagatttattgcgaagtgtagcgaggtttcggcggaggatttgatattgagcgtgcgtaggtaggagtagtcgatcgaagagatcgttatagagggtatagggtagaggtatttttatggttcggtttcggggagcggacgtcgcgcgtatttttatgaattcgtttttgtcgaagtagagcgtgttcggttttttgggtaggtttattttatttttttttatttcgtcggttatcgttttttagtgttaagatttaagcgagaaaacgtaggaggttgcgtagatcgattcggcggtcgcggttatcgttagtttttacggtataggggggttcgtttttagttaatatggtagcgttcgcgtcgcggttaatgaacgacggtatcgtaagtcggtttgcgtttggttttggttaagaggggcgcgggggtcgtcgttgttgtacgggt

SEQ ID NO: 34116 - DNA, 551 bp, Artificial Sequence
  chemically treated genomic DNA (Homo sapiens) CpG-island No: 34116
acccgtacaacaacgacgacccccgcgcccctcttaaccaaaaccaaacgcaaaccgacttacgataccgtcgttcattaaccgcgacgcgaacgctaccatattaactaaaaacgaacccccctataccgtaaaaactaacgataaccgcgaccgccgaatcgatctacgcaacctcctacgttttctcgcttaaatcttaacactaaaaaacgataaccgacgaaataaaaaaaaataaaataaacctacccaaaaaaccgaacacgctctacttcgacaaaaacgaattcataaaaatacgcgcgacgtccgctccccgaaaccgaaccataaaaatacctctaccctataccctctataacgatctcttcgatcgactactcctacctacgcacgctcaatatcaaatcctccgccgaaacctcgctacacttcgcaataaatcttttaacgtcaaatttaacgaatacaacctaaaaaaaacacttctataaaatcgtacgtattacataaaaaaacctaaaaattctaaacaaataattttaaac

SEQ ID NO: 34117 - DNA, 1290 bp, Artificial Sequence
  chemically treated genomic DNA (Homo sapiens) CpG-island No: 34117
gggcggcgagggtatcggagcggatgcgggttttggggtagacgcgggcgttggggcgggggtagacgggttattggaatttttagcgcgttcgtcgtttagggtggcgttggtcgtttttcgttataggtgttttagtaggcgcgcgtttacggcgggttttaggatacggtaggcgggtagtacgcgggttaggcgcgttatataggcgttgtagttttcgcggtagttgtcgtaaggtattgcgggcggagagtcgcgtgaggcgcggggtagggtgtcgggtgcggggtgtagagcgcgcggtagggtagggagggtttatttacggggcgttgtcgtgggttatgaggacgtaggtagtttttgtaggaagcgtacggttatttttaggacgtttgttttttttagtttcgagtagttggagttttgcgttcggttacgaggaagagcgatagagaattattaagatagaattttggtcggttatcgtgcgtattttcgttttagtcgggagttgggtgtggggcgcgtcgtggtttgttgggggttcgtttcgacgcgtttattttatttaggtttcgtttcgggcgtcgcgcggaattttttggtgggtttttttcgtaggagtatttcgtttttttgttttcgtttcgcgttttaggattttttgtttttcgttcgggcgcgtttatttttcggtttagtagcggtaggatgagttttttaagttggtttaggttttggttgatgcgcgcgcgtcggcgtttttttagtagcggttttaggttttgcggacgggcggcgcggtggttagacgggttttcggagtttttagtttcgtttttagttttcggtatttattttgcgtagtttcgtcgcgttttttgttcggcgaggtagttttatgtttcgcggggaagcggtggtagttgcgagttttacgtaaagggaaatcgaggttcgaaatgaggtttcgggcgcggttcgggttggtgttagacgagtgcgcgtttcgttcgcggtcgagttttaagggagcggttcgttcgtttcgtttcgtttcgcggagttcggtcgttcgttggttttattttttgtttttgtttttgcgtagggtggagtcgggaggggagatcgcgacgttttcggggatttcgtttttcgtttttgcgttttgtttatcgcggggtggcggtttttagtttttttcgagtatttgcgggagagtggtaaaggcgttatcgggggttttcgttgcgtgatttcgagggtaggagggttaggtgg

SEQ ID NO: 34118 - DNA, 1290 bp, Artificial Sequence
  chemically treated genomic DNA (Homo sapiens) CpG-island No: 34118
ccacctaaccctcctaccctcgaaatcacgcaacgaaaacccccgataacgcctttaccactctcccgcaaatactcgaaaaaaactaaaaaccgccaccccgcgataaacaaaacgcaaaaacgaaaaacgaaatccccgaaaacgtcgcgatctcccctcccgactccaccctacgcaaaaacaaaaacaaaaaataaaaccaacgaacgaccgaactccgcgaaacgaaacgaaacgaacgaaccgctcccttaaaactcgaccgcgaacgaaacgcgcactcgtctaacaccaacccgaaccgcgcccgaaacctcatttcgaacctcgatttccctttacgtaaaactcgcaactaccaccgcttccccgcgaaacataaaactacctcgccgaacaaaaaacgcgacgaaactacgcaaaataaataccgaaaactaaaaacgaaactaaaaactccgaaaacccgtctaaccaccgcgccgcccgtccgcaaaacctaaaaccgctactaaaaaaacgccgacgcgcgcgcatcaaccaaaacctaaaccaacttaaaaaactcatcctaccgctactaaaccgaaaaataaacgcgcccgaacgaaaaacaaaaaatcctaaaacgcgaaacgaaaacaaaaaaacgaaatactcctacgaaaaaaacccaccaaaaaattccgcgcgacgcccgaaacgaaacctaaataaaataaacgcgtcgaaacgaacccccaacaaaccacgacgcgccccacacccaactcccgactaaaacgaaaatacgcacgataaccgaccaaaattctatcttaataattctctatcgctcttcctcgtaaccgaacgcaaaactccaactactcgaaactaaaaaaaacaaacgtcctaaaaataaccgtacgcttcctacaaaaactacctacgtcctcataacccacgacaacgccccgtaaataaaccctccctaccctaccgcgcgctctacaccccgcacccgacaccctaccccgcgcctcacgcgactctccgcccgcaataccttacgacaactaccgcgaaaactacaacgcctatataacgcgcctaacccgcgtactacccgcctaccgtatcctaaaacccgccgtaaacgcgcgcctactaaaacacctataacgaaaaacgaccaacgccaccctaaacgacgaacgcgctaaaaattccaataacccgtctacccccgccccaacgcccgcgtctaccccaaaacccgcatccgctccgataccctcgccgccc

SEQ ID NO: 34119 - DNA, 1290 bp, Artificial Sequence
  chemically treated genomic DNA (Homo sapiens) CpG-island No: 34119
ttatttggtttttttgttttcggggttacgtagcgaaggttttcgatggcgtttttattattttttcgtaggtgttcggggaaaattgggggtcgttatttcgcggtagataggacgtaaaggcggggagcgggattttcgggggcgtcgcggttttttttttcggttttattttgcgtaggaataaaggtaggaggtgggattagcgggcggtcggatttcgcggggcggggcggggcgggcgagtcgtttttttaaagttcggtcgcgggcggggcgcgtattcgtttggtattagttcgggtcgcgttcgggattttatttcggatttcggtttttttttgcgtggggttcgtagttgttatcgttttttcgcggagtatggggttgtttcgtcgggtaggggacgcggcggagttgcgtaaggtgggtatcggggattgggggcggggttggggatttcggggattcgtttaattatcgcgtcgttcgttcgtagagtttgaagtcgttgttggagaagcgtcggcgcgcgcgtattaattagagtttgagttagtttaaggggtttattttgtcgttgttgggtcgggaggtgagcgcgttcgggcggagggtagagggttttggggcgcggagcgggggtagggggacggggtgtttttgcgggaggaatttattagggggtttcgcgcggcgttcgaggcggagtttgggtggggtgggcgcgtcggagcggatttttagtaggttacggcgcgttttatatttagttttcgattagagcgagggtgcgtacggtagtcggttaaagttttgttttggtggttttttgtcgttttttttcgtggtcgggcgtagaattttaattgttcgaagttagagaaggtagacgttttggaaatgatcgtgcgttttttgtaggagttgtttgcgtttttatggtttacggtagcgtttcgtgagtgagttttttttgttttgtcgcgcgttttgtatttcgtattcggtattttatttcgcgttttacgcggtttttcgttcgtagtgttttgcgatagttatcgcgagggttatagcgtttgtgtggcgcgtttggttcgcgtgttgttcgtttgtcgtgttttggagttcgtcgtgagcgcgcgtttgttggagtatttgtggcggagagcggttagcgttattttggacggcgggcgcgttggggattttagtggttcgtttgttttcgttttagcgttcgcgtttgttttagagttcgtattcgtttcggtgttttcgtcgttt

SEQ ID NO: 34120 - DNA, 1290 bp, Artificial Sequence
  chemically treated genomic DNA (Homo sapiens) CpG-island No: 34120
aaacgacgaaaacaccgaaacgaatacgaactctaaaacaaacgcgaacgctaaaacgaaaacaaacgaaccactaaaatccccaacgcgcccgccgtccaaaataacgctaaccgctctccgccacaaatactccaacaaacgcgcgctcacgacgaactccaaaacacgacaaacgaacaacacgcgaaccaaacgcgccacacaaacgctataaccctcgcgataactatcgcaaaacactacgaacgaaaaaccgcgtaaaacgcgaaataaaataccgaatacgaaatacaaaacgcgcgacaaaacaaaaaaaactcactcacgaaacgctaccgtaaaccataaaaacgcaaacaactcctacaaaaaacgcacgatcatttccaaaacgtctaccttctctaacttcgaacaattaaaattctacgcccgaccacgaaaaaaaacgacaaaaaaccaccaaaacaaaactttaaccgactaccgtacgcaccctcgctctaatcgaaaactaaatataaaacgcgccgtaacctactaaaaatccgctccgacgcgcccaccccacccaaactccgcctcgaacgccgcgcgaaaccccctaataaattcctcccgcaaaaacaccccgtccccctacccccgctccgcgccccaaaaccctctaccctccgcccgaacgcgctcacctcccgacccaacaacgacaaaataaaccccttaaactaactcaaactctaattaatacgcgcgcgccgacgcttctccaacaacgacttcaaactctacgaacgaacgacgcgataattaaacgaatccccgaaatccccaaccccgcccccaatccccgatacccaccttacgcaactccgccgcgtcccctacccgacgaaacaaccccatactccgcgaaaaaacgataacaactacgaaccccacgcaaaaaaaaaccgaaatccgaaataaaatcccgaacgcgacccgaactaataccaaacgaatacgcgccccgcccgcgaccgaactttaaaaaaacgactcgcccgccccgccccgccccgcgaaatccgaccgcccgctaatcccacctcctacctttattcctacgcaaaataaaaccgaaaaaaaaaaccgcgacgcccccgaaaatcccgctccccgcctttacgtcctatctaccgcgaaataacgacccccaattttccccgaacacctacgaaaaaataataaaaacgccatcgaaaaccttcgctacgtaaccccgaaaacaaaaaaaccaaataa

SEQ ID NO: 34121 - DNA, 511 bp, Artificial Sequence
  chemically treated genomic DNA (Homo sapiens) CpG-island No: 34121
tttacgacgtgatggacgcggttttagcgcggcgttggaaggagttcgtgcgtacgttggggttgcgcgaggtagagatcgaagtcgtggaggtggagatcggtcgttttcgagattagtagtacgagatgtttaagcgttggcgttagtagtagttcgcgggtttcggagtcgtttacgcggttttggagcgtatggggttggacggttgcgtggaagatttgcgtagtcgtttgtagcgcggttcgtgatacggcgtttatttgttatttaggcgttttggtggtttttgtagaagttttaagtacggttatttatgcgtgtagatattttatgttatttattaagtcgttggtacggttttgcgtagtagtattagtcggttttatttttgttcgttttttatcgttttagttaaggcgaagaagtacgaacgaatgtcgagagggggtgaagatattttttaatttttcggtcggagtttggttgagatcgcggtattaaatttgtg

SEQ ID NO: 34122 - DNA, 511 bp, Artificial Sequence
  chemically treated genomic DNA (Homo sapiens) CpG-island No: 34122
cacaaatttaataccgcgatctcaaccaaactccgaccgaaaaattaaaaaatatcttcaccccctctcgacattcgttcgtacttcttcgccttaactaaaacgataaaaaacgaacaaaaataaaaccgactaatactactacgcaaaaccgtaccaacgacttaataaataacataaaatatctacacgcataaataaccgtacttaaaacttctacaaaaaccaccaaaacgcctaaataacaaataaacgccgtatcacgaaccgcgctacaaacgactacgcaaatcttccacgcaaccgtccaaccccatacgctccaaaaccgcgtaaacgactccgaaacccgcgaactactactaacgccaacgcttaaacatctcgtactactaatctcgaaaacgaccgatctccacctccacgacttcgatctctacctcgcgcaaccccaacgtacgcacgaactccttccaacgccgcgctaaaaccgcgtccatcacgtcgtaaa

SEQ ID NO: 34123 - DNA, 511 bp, Artificial Sequence
  chemically treated genomic DNA (Homo sapiens) CpG-island No: 34123
tatagatttaatatcgcgattttagttaaatttcggtcgagaagttgagaaatgtttttattttttttcgatattcgttcgtgttttttcgttttggttggagcgatagggggcgagtaggggtggggtcggttggtgttgttacgtagggtcgtgttagcggtttaataagtgatataaaatgtttatacgtataagtaatcgtatttagggtttttgtaagggttattagagcgtttaggtggtaagtgggcgtcgtgttacgggtcgcgttgtaggcggttgcgtaagttttttacgtagtcgtttagttttatgcgttttagggtcgcgtaaacggtttcgaggttcgcgggttgttgttggcgttagcgtttgagtatttcgtattgttggtttcggaagcggtcgatttttatttttacggtttcgatttttgtttcgcgtagttttagcgtgcgtacgaattttttttagcgtcgcgttgggatcgcgtttattacgtcgtaga

SEQ ID NO: 34124 - DNA, 511 bp, Artificial Sequence
  chemically treated genomic DNA (Homo sapiens) CpG-island No: 34124
tctacgacgtaataaacgcgatcccaacgcgacgctaaaaaaaattcgtacgcacgctaaaactacgcgaaacaaaaatcgaaaccgtaaaaataaaaatcgaccgcttccgaaaccaacaatacgaaatactcaaacgctaacgccaacaacaacccgcgaacctcgaaaccgtttacgcgaccctaaaacgcataaaactaaacgactacgtaaaaaacttacgcaaccgcctacaacgcgacccgtaacacgacgcccacttaccacctaaacgctctaataacccttacaaaaaccctaaatacgattacttatacgtataaacattttatatcacttattaaaccgctaacacgaccctacgtaacaacaccaaccgaccccacccctactcgccccctatcgctccaaccaaaacgaaaaaacacgaacgaatatcgaaaaaaaataaaaacatttctcaacttctcgaccgaaatttaactaaaatcgcgatattaaatctata

SEQ ID NO: 34125 - DNA, 539 bp, Artificial Sequence
  chemically treated genomic DNA (Homo sapiens) CpG-island No: 34125
gatgcggagaatgtcggtttcggttataagttcgttaaagggttcgagtatggcgttgtgttcgcgggagtatttttagttttcgcgggggtagtagtacgagttggcggtcgttagttaaggcggggaagataagagaggggagggaggcgcgtttttttttggtttagttttcgtcgtggcgtcgggagttttttgtatgtttcgggtggtgtaatggtttcgcggggttgcgtttgtagggagggatcgcgtttggtcggcggggggtgacgttggggtgaggtttcggtttgagtcgtcgttttaggttttgggtagtgtttattttggtcggtggcgtggggtacggtcggtcgttggtcgttgttgcggcggtaagaataggttagtagacggggtttttatgtttggtttgttcgtttattatattatttaaggaatttgcgaaaggcgttgaagttgagaggcgcggtggttttttttaatttattcgagggcggttattgaggtttttttttttagatttatgatttttt

SEQ ID NO: 34126 - DNA, 539 bp, Artificial Sequence
  chemically treated genomic DNA (Homo sapiens) CpG-island No: 34126
aaaaaatcataaatctaaaaaaaaaaacctcaataaccgccctcgaataaattaaaaaaaaccaccgcgcctctcaacttcaacgcctttcgcaaattccttaaataatataataaacgaacaaaccaaacataaaaaccccgtctactaacctattcttaccgccgcaacaacgaccaacgaccgaccgtaccccacgccaccgaccaaaataaacactacccaaaacctaaaacgacgactcaaaccgaaacctcaccccaacgtcaccccccgccgaccaaacgcgatccctccctacaaacgcaaccccgcgaaaccattacaccacccgaaacatacaaaaaactcccgacgccacgacgaaaactaaaccaaaaaaaaacgcgcctccctcccctctcttatcttccccgccttaactaacgaccgccaactcgtactactacccccgcgaaaactaaaaatactcccgcgaacacaacgccatactcgaaccctttaacgaacttataaccgaaaccgacattctccgcatc

SEQ ID NO: 34127 - DNA, 539 bp, Artificial Sequence
  chemically treated genomic DNA (Homo sapiens) CpG-island No: 34127
aaggggttatgagtttgggaggagaggttttaatagtcgttttcggatgggttggggagggttatcgcgttttttagttttaacgtttttcgtaagttttttgggtggtgtaatgagcgaataagttaggtatggagatttcgtttgttggtttgtttttgtcgtcgtagtagcgattagcgatcggtcgtgttttacgttatcgattaaagtggatattgtttagagtttggagcggcggtttaggtcgaagttttattttagcgttatttttcgtcggttagacgcggtttttttttgtagacgtagtttcgcggagttattatattattcgggatatgtaaaaggttttcggcgttacggcgggagttaggttagagggagacgcgtttttttttttttttttgtttttttcgttttagttgacggtcgttagttcgtgttgttattttcgcgagggttggaggtattttcgcgagtataacgttatattcgggttttttggcgagtttatgatcgaagtcgatatttttcgtatt

SEQ ID NO: 34128 - DNA, 539 bp, Artificial Sequence
  chemically treated genomic DNA (Homo sapiens) CpG-island No: 34128
aatacgaaaaatatcgacttcgatcataaactcgccaaaaaacccgaatataacgttatactcgcgaaaatacctccaaccctcgcgaaaataacaacacgaactaacgaccgtcaactaaaacgaaaaaaacaaaaaaaaaaaaaaaaacgcgtctccctctaacctaactcccgccgtaacgccgaaaaccttttacatatcccgaataatataataactccgcgaaactacgtctacaaaaaaaaaccgcgtctaaccgacgaaaaataacgctaaaataaaacttcgacctaaaccgccgctccaaactctaaacaatatccactttaatcgataacgtaaaacacgaccgatcgctaatcgctactacgacgacaaaaacaaaccaacaaacgaaatctccatacctaacttattcgctcattacaccacccaaaaaacttacgaaaaacgttaaaactaaaaaacgcgataaccctccccaacccatccgaaaacgactattaaaacctctcctcccaaactcataacccctt

SEQ ID NO: 34129 - DNA, 583 bp, Artificial Sequence
  chemically treated genomic DNA (Homo sapiens) CpG-island No: 34129
tcggtcggcggattttcggtttcggtttttttggtattttttattatttcgatttagggtaggcgatacgacgggggagcggaggagtagtagtagtaacgtaggtttaaagtagggtaagcgttagagacgtttcgcggatcgtattttcggtttttgttaggaagaagtagttgtgattcgttattaaatttcgcgatttttgtttcgaaggttcggtttcgtttttcgttgcgggtgttattttcgcggttagggcgggaattgtagtgcgtttgcgtttgttcgaattttttcgggagattatttttcgcggtatttgatttttaggtttcgttttttgtacgtcgtttacggtatttgacgtttaggtttcgttttttgtatgtttttgttggtaaatagttttgggggtcgttcgattttgtaggtagtgttcgcgtgggaggggaggtgtagtcgttagcgttgtcggcggttttcgttacgtgaattagtgagaggtttaaattttttttttaggttttagtgttatatttttttatacgggtatttcgagggttcggattggaaaggcgagtta

SEQ ID NO: 34130 - DNA, 583 bp, Artificial Sequence
  chemically treated genomic DNA (Homo sapiens) CpG-island No: 34130
taactcgcctttccaatccgaaccctcgaaatacccgtataaaaaaatataacactaaaacctaaaaaaaaaatttaaacctctcactaattcacgtaacgaaaaccgccgacaacgctaacgactacacctcccctcccacgcgaacactacctacaaaatcgaacgacccccaaaactatttaccaacaaaaacatacaaaaaacgaaacctaaacgtcaaataccgtaaacgacgtacaaaaaacgaaacctaaaaatcaaataccgcgaaaaataatctcccgaaaaaattcgaacaaacgcaaacgcactacaattcccgccctaaccgcgaaaataacacccgcaacgaaaaacgaaaccgaaccttcgaaacaaaaatcgcgaaatttaataacgaatcacaactacttcttcctaacaaaaaccgaaaatacgatccgcgaaacgtctctaacgcttaccctactttaaacctacgttactactactactcctccgctcccccgtcgtatcgcctaccctaaatcgaaataataaaaaataccaaaaaaaccgaaaccgaaaatccgccgaccga

SEQ ID NO: 34131 - DNA, 583 bp, Artificial Sequence
  chemically treated genomic DNA (Homo sapiens) CpG-island No: 34131
tggttcgtttttttagttcgggttttcggggtgttcgtgtgaaaagatgtgatattgaagtttggggaagaagtttgaattttttattaatttacgtaacgggagtcgtcggtagcgttgacggttgtatttttttttttacgcggatattatttgtaggatcggacgatttttagaattgtttgttaataaagatatgtagggggcggagtttgagcgttagatatcgtgagcggcgtgtagagggcggagtttaggagttagatatcgcgagaagtagtttttcgaagaggttcggataagcgtaggcgtattataattttcgttttggtcgcgaaggtggtattcgtagcgggaggcggggtcgggttttcgggataaagatcgcgagatttaatggcgagttatagttatttttttttggtagagatcggaagtgcggttcgcggagcgtttttggcgtttattttgttttgggtttgcgttgttgttgttgttttttcgttttttcgtcgtatcgtttgttttggatcgaagtgatgggggatgttaaggaggtcggagtcgagggttcgtcggtcgg

SEQ ID NO: 34132 - DNA, 583 bp, Artificial Sequence
  chemically treated genomic DNA (Homo sapiens) CpG-island No: 34132
ccgaccgacgaaccctcgactccgacctccttaacatcccccatcacttcgatccaaaacaaacgatacgacgaaaaaacgaaaaaacaacaacaacaacgcaaacccaaaacaaaataaacgccaaaaacgctccgcgaaccgcacttccgatctctaccaaaaaaaaataactataactcgccattaaatctcgcgatctttatcccgaaaacccgaccccgcctcccgctacgaataccaccttcgcgaccaaaacgaaaattataatacgcctacgcttatccgaacctcttcgaaaaactacttctcgcgatatctaactcctaaactccgccctctacacgccgctcacgatatctaacgctcaaactccgccccctacatatctttattaacaaacaattctaaaaatcgtccgatcctacaaataatatccgcgtaaaaaaaaaaatacaaccgtcaacgctaccgacgactcccgttacgtaaattaataaaaaattcaaacttcttccccaaacttcaatatcacatcttttcacacgaacaccccgaaaacccgaactaaaaaaacgaacca

SEQ ID NO: 34133 - DNA, 642 bp, Artificial Sequence
  chemically treated genomic DNA (Homo sapiens) CpG-island No: 34133
tcgggaggtttatcgttggcgacggagttggcgttgcggcggtataaggcgattagagcggtggttaagagtttttagcgtagtatgaatttttattgagttttcgagtttgggataaacgtatttttcggggaagagtcggttttcgtttaggtacgaagggacgcgcgttcgttgggggaagttagaatttaggtgtttacgatattaggattttagtttcgtcgtcgtagtcgtcgtcgttgttttatatcgaaaaatagggtacggttattttttttttgtttttttcgcgagagtttttttaggagtgaagagagagaaaatatcgcgataagtgagttattcgttttttttttcgtattttttatttttagaattattaggcgtcggcgttttcgaggtagtgtgttttcgtttagagttggagttttttagttgttagtcgatttcgaattcgtattttcgttaatcgcgttttttgtgggcggtcggaaattatagttttcgttggatatgttcggtgtatgttataaataattatttaaatttttcggatttgagtttttcgtagaggaatgtagaatgacgttacggtacgtaggatgtgatgttatcgagatgtagaggatatttagttaa

SEQ ID NO: 34134 - DNA, 642 bp, Artificial Sequence
  chemically treated genomic DNA (Homo sapiens) CpG-island No: 34134
ttaactaaatatcctctacatctcgataacatcacatcctacgtaccgtaacgtcattctacattcctctacgaaaaactcaaatccgaaaaatttaaataattatttataacatacaccgaacatatccaacgaaaactataatttccgaccgcccacaaaaaacgcgattaacgaaaatacgaattcgaaatcgactaacaactaaaaaactccaactctaaacgaaaacacactacctcgaaaacgccgacgcctaataattctaaaaataaaaaatacgaaaaaaaaaacgaataactcacttatcgcgatattttctctctcttcactcctaaaaaaactctcgcgaaaaaaacaaaaaaaaaataaccgtaccctatttttcgatataaaacaacgacgacgactacgacgacgaaactaaaatcctaatatcgtaaacacctaaattctaacttcccccaacgaacgcgcgtcccttcgtacctaaacgaaaaccgactcttccccgaaaaatacgtttatcccaaactcgaaaactcaataaaaattcatactacgctaaaaactcttaaccaccgctctaatcgccttataccgccgcaacgccaactccgtcgccaacgataaacctcccga

SEQ ID NO: 34135 - DNA, 642 bp, Artificial Sequence
  chemically treated genomic DNA (Homo sapiens) CpG-island No: 34135
ttgattgagtattttttgtatttcggtgatattatattttgcgtgtcgtggcgttattttgtatttttttgcgggaggtttagattcggagggtttaagtggttgtttataatatgtatcgaatatatttaacggaggttgtggttttcgatcgtttataaaaagcgcggttggcgggagtgcgggttcggggtcggttggtagttgggagattttagttttgggcggaaatatattgtttcggaggcgtcggcgtttagtgattttgggaatagaaggtgcgagggagggagcgggtggtttatttatcgcggtgttttttttttttttatttttgggggagttttcgcgagaggagtaagaggaagatggtcgtgttttgtttttcggtgtaaggtagcgacggcggttgcgacggcgagattgagattttggtgtcgtgggtatttgagttttagttttttttagcgagcgcgcgttttttcgtgtttaggcgagagtcggttttttttcgggagatgcgtttgttttaggttcgggggtttagtgggagtttatgttgcgttggaggtttttggttatcgttttaatcgttttgtgtcgtcgtagcgttagtttcgtcgttagcggtgagtttttcga

SEQ ID NO: 34136 - DNA, 642 bp, Artificial Sequence
  chemically treated genomic DNA (Homo sapiens) CpG-island No: 34136
tcgaaaaactcaccgctaacgacgaaactaacgctacgacgacacaaaacgattaaaacgataaccaaaaacctccaacgcaacataaactcccactaaacccccgaacctaaaacaaacgcatctcccgaaaaaaaaccgactctcgcctaaacacgaaaaaacgcgcgctcgctaaaaaaaactaaaactcaaatacccacgacaccaaaatctcaatctcgccgtcgcaaccgccgtcgctaccttacaccgaaaaacaaaacacgaccatcttcctcttactcctctcgcgaaaactcccccaaaaataaaaaaaaaaaaaacaccgcgataaataaaccacccgctccctccctcgcaccttctattcccaaaatcactaaacgccgacgcctccgaaacaatatatttccgcccaaaactaaaatctcccaactaccaaccgaccccgaacccgcactcccgccaaccgcgctttttataaacgatcgaaaaccacaacctccgttaaatatattcgatacatattataaacaaccacttaaaccctccgaatctaaacctcccgcaaaaaaatacaaaataacgccacgacacgcaaaatataatatcaccgaaatacaaaaaatactcaatcaa

SEQ ID NO: 34137 - DNA, 1085 bp, Artificial Sequence
  chemically treated genomic DNA (Homo sapiens) CpG-island No: 34137
ttttcgcggagggcgcgcgcggggtttagtcgttgggtgtagggttcggcgggtagtcgggttttttttttttttcggtacgtcgggcgggcgtcggtcgtttttagtagtttacggagtcggcgggcggcgcggattttaagttcgagaagtagtcgaattcgttttggtttaggaagagttcgggtagttcgcgtacgcggtgtagttcgagttttagttttagcgacgttagcgttttttcgtcgatgagttcggcgtttatgtcgtttagggcgtgcgcgggcggcggcggggttgcggcgtttggcgtcggttgcgggttcggggggtttttcggagcgttggggggcgcggtcgcgcggtcggggtacggcgtcgttataggttgtaggtgcgcgatgttcgcggtcggcggaggtacggtcggaaagggttggaaggaggacggcggttcgaaggtttcgtacgttagggtttcgggttggcggggcggcggcggttttagcggagtttttcgcggttttagtttattgtttaggttcgggttcgcgtacggcggtagagttcggagcgtatgagggttatgggcggtcgcggcggacggcggtttttgtattaggcggtagttttcggcgagtattaggtggtcggttatggcggtaggtcggttgtttgcggggatagcgcgcggtggttagcgtcggttttttcggttcgggttagcggttgttttgcggcgggagattcgggtatcgtgcggtttttgtagttcggtcgggcggagtaaaattaaattcgattggtgtttcggtttagtttattattgcgtattttgcggtcgtagtttggggttataaaggttcgtaatttgtagtgtttcgaaattttcgcgtcgcgtagttgggttcggcgtatttttatatttagaggcggggttttttcgttttcggacgtttattggttgggcgagacgtttttgggcgggtcgcgtacgtttgtatttaggttttggtttcgttttttttattggaatttcgttttttgggatttcggttacgttttaggttttgagtatcgttttg

SEQ ID NO: 34138 - DNA, 1085 bp, Artificial Sequence
  chemically treated genomic DNA (Homo sapiens) CpG-island No: 34138
caaaacgatactcaaaacctaaaacgtaaccgaaatcccaaaaaacgaaattccaataaaaaaaacgaaaccaaaacctaaatacaaacgtacgcgacccgcccaaaaacgtctcgcccaaccaataaacgtccgaaaacgaaaaaaccccgcctctaaatataaaaatacgccgaacccaactacgcgacgcgaaaatttcgaaacactacaaattacgaacctttataaccccaaactacgaccgcaaaatacgcaataataaactaaaccgaaacaccaatcgaatttaattttactccgcccgaccgaactacaaaaaccgcacgatacccgaatctcccgccgcaaaacaaccgctaacccgaaccgaaaaaaccgacgctaaccaccgcgcgctatccccgcaaacaaccgacctaccgccataaccgaccacctaatactcgccgaaaactaccgcctaatacaaaaaccgccgtccgccgcgaccgcccataaccctcatacgctccgaactctaccgccgtacgcgaacccgaacctaaacaataaactaaaaccgcgaaaaactccgctaaaaccgccgccgccccgccaacccgaaaccctaacgtacgaaaccttcgaaccgccgtcctccttccaaccctttccgaccgtacctccgccgaccgcgaacatcgcgcacctacaacctataacgacgccgtaccccgaccgcgcgaccgcgccccccaacgctccgaaaaaccccccgaacccgcaaccgacgccaaacgccgcaaccccgccgccgcccgcgcacgccctaaacgacataaacgccgaactcatcgacgaaaaaacgctaacgtcgctaaaactaaaactcgaactacaccgcgtacgcgaactacccgaactcttcctaaaccaaaacgaattcgactacttctcgaacttaaaatccgcgccgcccgccgactccgtaaactactaaaaacgaccgacgcccgcccgacgtaccgaaaaaaaaaaaaaacccgactacccgccgaaccctacacccaacgactaaaccccgcgcgcgccctccgcgaaaa

SEQ ID NO: 34139 - DNA, 1085 bp, Artificial Sequence
  chemically treated genomic DNA (Homo sapiens) CpG-island No: 34139
tagggcggtgtttagagtttggggcgtggtcggagttttaaggggcggggttttagtgggaggggcggggttaagatttagatgtaggcgtgcgcggttcgtttagaagcgtttcgtttagttaatgagcgttcgagggcggggaagtttcgtttttgggtataagaatacgtcgagtttagttacgcgacgcggaggtttcggagtattataggttgcgggtttttgtgattttaggttgcggtcgtaaggtgcgtagtagtgggttgggtcggggtattagtcgggtttggttttgtttcgttcggtcgagttgtagggatcgtacggtgttcgggtttttcgtcgtagagtagtcgttggttcgggtcgggggagtcggcgttgattatcgcgcgttgttttcgtaggtagtcggtttgtcgttatggtcgattatttgatgttcgtcgagggttatcgtttggtgtagaggtcgtcgttcgtcgcggtcgtttatggtttttatgcgtttcggattttgtcgtcgtacgcgggttcgggtttggatagtgggttgaggtcgcggggggtttcgttggggtcgtcgtcgtttcgttaattcggggttttggcgtacggggttttcgggtcgtcgttttttttttagtttttttcggtcgtgttttcgtcggtcgcgggtatcgcgtatttgtagtttgtggcgacgtcgtatttcggtcgcgcggtcgcgttttttaacgtttcgggaggtttttcgggttcgtagtcggcgttaagcgtcgtagtttcgtcgtcgttcgcgtacgttttgggcggtatggacgtcgaatttatcgacgaggaggcgttgacgtcgttggagttggagttcgggttgtatcgcgtgcgcgagttgttcgagttttttttgggttagagcgagttcgattgtttttcggatttggggttcgcgtcgttcgtcggtttcgtgagttgttgagggcggtcggcgttcgttcggcgtgtcggagaggagaaagggttcgattgttcgtcggattttgtatttagcgattgggtttcgcgcgcgtttttcgcgaggg

SEQ ID NO: 34140 - DNA, 1085 bp, Artificial Sequence
  chemically treated genomic DNA (Homo sapiens) CpG-island No: 34140
ccctcgcgaaaaacgcgcgcgaaacccaatcgctaaatacaaaatccgacgaacaatcgaaccctttctcctctccgacacgccgaacgaacgccgaccgccctcaacaactcacgaaaccgacgaacgacgcgaaccccaaatccgaaaaacaatcgaactcgctctaacccaaaaaaaactcgaacaactcgcgcacgcgatacaacccgaactccaactccaacgacgtcaacgcctcctcgtcgataaattcgacgtccataccgcccaaaacgtacgcgaacgacgacgaaactacgacgcttaacgccgactacgaacccgaaaaacctcccgaaacgttaaaaaacgcgaccgcgcgaccgaaatacgacgtcgccacaaactacaaatacgcgatacccgcgaccgacgaaaacacgaccgaaaaaaactaaaaaaaaaacgacgacccgaaaaccccgtacgccaaaaccccgaattaacgaaacgacgacgaccccaacgaaaccccccgcgacctcaacccactatccaaacccgaacccgcgtacgacgacaaaatccgaaacgcataaaaaccataaacgaccgcgacgaacgacgacctctacaccaaacgataaccctcgacgaacatcaaataatcgaccataacgacaaaccgactacctacgaaaacaacgcgcgataatcaacgccgactcccccgacccgaaccaacgactactctacgacgaaaaacccgaacaccgtacgatccctacaactcgaccgaacgaaacaaaaccaaacccgactaataccccgacccaacccactactacgcaccttacgaccgcaacctaaaatcacaaaaacccgcaacctataatactccgaaacctccgcgtcgcgtaactaaactcgacgtattcttatacccaaaaacgaaacttccccgccctcgaacgctcattaactaaacgaaacgcttctaaacgaaccgcgcacgcctacatctaaatcttaaccccgcccctcccactaaaaccccgccccttaaaactccgaccacgccccaaactctaaacaccgcccta

SEQ ID NO: 34141 - DNA, 559 bp, Artificial Sequence
  chemically treated genomic DNA (Homo sapiens) CpG-island No: 34141
gttaaggagtcgtaggattttagtatgtttgcggtaattattatttcgttttcgaatttaacgtcgaggattgaggtttcggttattatggggtttttaaagagtgagaacggtgggagttgagaggggggatggattgcgtttttttttcgcgtattgagttgcgtttttgattttttataattttttttaattattttgtattttttaggatttcgcgttttgagtttttttgtcgttcgcgcgttttcggggttttcgttttattttttcgggtttttaaaattagtcggtagtattaggttttacggtttttttcgttacgtaaacgaaagcgtcgagaatttattgggttcgcgtgattggatttttgtaaagtgtagacgtcggatttatgaaggaatcgggagtggacggaatgcggtaaaattgttttggggtcggatttttcgtttaaagttcggatcgcgattttaaaaacgtttttattttagttacggtagtagaaaaaatgaaagcgtttgcgttaacggaagcggaagtgattttttagtgttat

SEQ ID NO: 34142 - DNA, 559 bp, Artificial Sequence
  chemically treated genomic DNA (Homo sapiens) CpG-island No: 34142
ataacactaaaaaatcacttccgcttccgttaacgcaaacgctttcattttttctactaccgtaactaaaataaaaacgtttttaaaatcgcgatccgaactttaaacgaaaaatccgaccccaaaacaattttaccgcattccgtccactcccgattccttcataaatccgacgtctacactttacaaaaatccaatcacgcgaacccaataaattctcgacgctttcgtttacgtaacgaaaaaaaccgtaaaacctaatactaccgactaattttaaaaacccgaaaaaataaaacgaaaaccccgaaaacgcgcgaacgacaaaaaaactcaaaacgcgaaatcctaaaaaatacaaaataattaaaaaaaattataaaaaatcaaaaacgcaactcaatacgcgaaaaaaaaacgcaatccatcccccctctcaactcccaccgttctcactctttaaaaaccccataataaccgaaacctcaatcctcgacgttaaattcgaaaacgaaataataattaccgcaaacatactaaaatcctacgactccttaac

SEQ ID NO: 34143 - DNA, 559 bp, Artificial Sequence
  chemically treated genomic DNA (Homo sapiens) CpG-island No: 34143
atgatattgaaggattattttcgttttcgttggcgtaagcgtttttattttttttgttatcgtgattaagatggaagcgtttttggggtcgcggttcggattttgggcggggggttcggttttaggatagttttatcgtatttcgtttattttcgatttttttatggattcggcgtttgtattttatagaggtttaattacgcggatttagtaagttttcggcgttttcgtttgcgtagcgggagggatcgtggggtttggtgttgtcggttggttttgagagttcgggaaggtgaggcggggatttcgggggcgcgcgaacggtaggggagtttagggcgcggagttttggagaatgtagaataattggaaggaattatagaaaattagaagcgtagtttagtgcgcggaaagagggcgtagtttatttttttttttagtttttatcgtttttattttttaggaattttatggtgatcgggattttagttttcggcgttaagttcgagggcggagtggtgattgtcgtagatatgttgggattttacggttttttggt

SEQ ID NO: 34144 - DNA, 559 bp, Artificial Sequence
  chemically treated genomic DNA (Homo sapiens) CpG-island No: 34144
accaaaaaaccgtaaaatcccaacatatctacgacaatcaccactccgccctcgaacttaacgccgaaaactaaaatcccgatcaccataaaattcctaaaaaataaaaacgataaaaactaaaaaaaaaaataaactacgccctctttccgcgcactaaactacgcttctaattttctataattccttccaattattctacattctccaaaactccgcgccctaaactcccctaccgttcgcgcgcccccgaaatccccgcctcaccttcccgaactctcaaaaccaaccgacaacaccaaaccccacgatccctcccgctacgcaaacgaaaacgccgaaaacttactaaatccgcgtaattaaacctctataaaatacaaacgccgaatccataaaaaaatcgaaaataaacgaaatacgataaaactatcctaaaaccgaaccccccgcccaaaatccgaaccgcgaccccaaaaacgcttccatcttaatcacgataacaaaaaaaataaaaacgcttacgccaacgaaaacgaaaataatccttcaatatcat

SEQ ID NO: 34145 - DNA, 749 bp, Artificial Sequence
  chemically treated genomic DNA (Homo sapiens) CpG-island No: 34145
acgggtacgcggagcggtattatttttttcgtacgtgtatcgtttttttttataagaggtattcgtgaattttaggagtaggcggatggcgtgcgttagttggggaagatagcggtttagcgattgcgtagtttttatttatttttaattttcgttcgttaacgtttttcggttcggggttgtcgagtttttgcgttttgtcggggcggtggttaagcggtttttaggttcggtttcggcgtggtttttttcgtttttttttatagggttcgcgattttagaggttgggtaggggtcgatattcgtggttcggtagttcgaaaaggttttcgcgtagagttgtttttgttggagatcgcggatttagagattcgtttttttcgcgttagtttttttgatcgagcggttttatcgttgagacggtatttattttacgaatattttagtattcgagaattatagacgattcgtacgatatggtgacgggttttcgagttttcgaggattagggaaattgtgagcgggaggggttttatattcgatataagggggcggggtttacgcgcgggcgttttgatttcgttttcgtttcgtttttcgttttttgttttcgcggttttatagggtcgtgcgtaggcgcgattaatgtcggcgttggggtttagggtttggcgatttcgaggcgggattcgggtaggagtgttgtaggagagtaaaggattcgaggttgaggtttttttttttttcgt

SEQ ID NO: 34146 - DNA, 749 bp, Artificial Sequence
  chemically treated genomic DNA (Homo sapiens) CpG-island No: 34146
acgaaaaaaaaaaaaacctcaacctcgaatcctttactctcctacaacactcctacccgaatcccgcctcgaaatcgccaaaccctaaaccccaacgccgacattaatcgcgcctacgcacgaccctataaaaccgcgaaaacaaaaaacgaaaaacgaaacgaaaacgaaatcaaaacgcccgcgcgtaaaccccgcccccttatatcgaatataaaacccctcccgctcacaatttccctaatcctcgaaaactcgaaaacccgtcaccatatcgtacgaatcgtctataattctcgaatactaaaatattcgtaaaataaataccgtctcaacgataaaaccgctcgatcaaaaaaactaacgcgaaaaaaacgaatctctaaatccgcgatctccaacaaaaacaactctacgcgaaaaccttttcgaactaccgaaccacgaatatcgacccctacccaacctctaaaatcgcgaaccctataaaaaaaaacgaaaaaaaccacgccgaaaccgaacctaaaaaccgcttaaccaccgccccgacaaaacgcaaaaactcgacaaccccgaaccgaaaaacgttaacgaacgaaaattaaaaataaataaaaactacgcaatcgctaaaccgctatcttccccaactaacgcacgccatccgcctactcctaaaattcacgaatacctcttataaaaaaaaacgatacacgtacgaaaaaaataataccgctccgcgtacccgt

SEQ ID NO: 34147 - DNA, 749 bp, Artificial Sequence
  chemically treated genomic DNA (Homo sapiens) CpG-island No: 34147
gcggggaagggaggagttttaatttcgggttttttgtttttttgtagtatttttgttcgggtttcgtttcggggtcgttaggttttgaattttaacgtcggtattagtcgcgtttgcgtacggttttgtggagtcgcggaggtaagggacggagaacggggcggaggcggagttagggcgttcgcgcgtgggtttcgtttttttatgtcgggtataaagtttttttcgtttatagtttttttagttttcgaaggttcggaagttcgttattatgtcgtgcgagtcgtttatggttttcgggtattgggatattcgtggggtgagtgtcgttttaacggtagagtcgttcggttaaagagattgacgcggagagggcgggtttttgggttcgcgatttttagtaggagtagttttacgcgggagttttttcgagttgtcgagttacggatgtcgatttttgtttagtttttgggatcgcgggttttgtggggaggggcggaggagattacgtcggagtcgggtttaggggtcgtttaattatcgtttcggtaggacgtagggattcggtagtttcgggtcggggaacgttagcgggcgggggttgggaatgggtgggagttgcgtagtcgttgaatcgttgttttttttagttggcgtacgttattcgtttgtttttggagtttacggatattttttatgaggagaaacggtatacgtgcggggaaggtaatgtcgtttcgcgtgttcgt

SEQ ID NO: 34148 - DNA, 749 bp, Artificial Sequence
  chemically treated genomic DNA (Homo sapiens) CpG-island No: 34148
acgaacacgcgaaacgacattaccttccccgcacgtataccgtttctcctcataaaaaatatccgtaaactccaaaaacaaacgaataacgtacgccaactaaaaaaaacaacgattcaacgactacgcaactcccacccattcccaacccccgcccgctaacgttccccgacccgaaactaccgaatccctacgtcctaccgaaacgataattaaacgacccctaaacccgactccgacgtaatctcctccgcccctccccacaaaacccgcgatcccaaaaactaaacaaaaatcgacatccgtaactcgacaactcgaaaaaactcccgcgtaaaactactcctactaaaaatcgcgaacccaaaaacccgccctctccgcgtcaatctctttaaccgaacgactctaccgttaaaacgacactcaccccacgaatatcccaatacccgaaaaccataaacgactcgcacgacataataacgaacttccgaaccttcgaaaactaaaaaaactataaacgaaaaaaactttatacccgacataaaaaaacgaaacccacgcgcgaacgccctaactccgcctccgccccgttctccgtcccttacctccgcgactccacaaaaccgtacgcaaacgcgactaataccgacgttaaaattcaaaacctaacgaccccgaaacgaaacccgaacaaaaatactacaaaaaaacaaaaaacccgaaattaaaactcctcccttccccgc

SEQ ID NO: 34149 - DNA, 514 bp, Artificial Sequence
  chemically treated genomic DNA (Homo sapiens) CpG-island No: 34149
tataggtatataggatacgttgggtttattttttcgtgtttcgacggtattataggtgcgaagttcgttcggggaggtagtgtttgttgttcgcgtagatttatttgcggcgtcggggatcgttcgtggtttcgatttttttacgaggcgcggaaggcggttatcggtaggttttcggtgttcgcgaagagtcggcgtaggggtggggttgtgggagggggcggggtttgttgcgcgttacggttgtcgtagtcgtcgtatcgggtcgtcgcggtcgtcgaatcggggggcggggggtcggggtgagcgttaagatggtcgtttcggttcgggttggtgagtgtgcgcgagggcgcgcggtcgcggcgattggcggagtgaggatttttgcgggagcggacgtgcgacggtagttttcggggtcgggaggtatttgggggtttattttcgtcgcgtagggcgttggggggttattgagagagggagagtttggggttgcgggcgcgcggaaggg

SEQ ID NO: 34150 - DNA, 514 bp, Artificial Sequence
  chemically treated genomic DNA (Homo sapiens) CpG-island No: 34150
cccttccgcgcgcccgcaaccccaaactctccctctctcaataaccccccaacgccctacgcgacgaaaataaacccccaaatacctcccgaccccgaaaactaccgtcgcacgtccgctcccgcaaaaatcctcactccgccaatcgccgcgaccgcgcgccctcgcgcacactcaccaacccgaaccgaaacgaccatcttaacgctcaccccgaccccccgccccccgattcgacgaccgcgacgacccgatacgacgactacgacaaccgtaacgcgcaacaaaccccgccccctcccacaaccccacccctacgccgactcttcgcgaacaccgaaaacctaccgataaccgccttccgcgcctcgtaaaaaaatcgaaaccacgaacgatccccgacgccgcaaataaatctacgcgaacaacaaacactacctccccgaacgaacttcgcacctataataccgtcgaaacacgaaaaaataaacccaacgtatcctatatacctata

SEQ ID NO: 34151 - DNA, 514 bp, Artificial Sequence
  chemically treated genomic DNA (Homo sapiens) CpG-island No: 34151
ttttttcgcgcgttcgtagttttaggtttttttttttttagtgattttttagcgttttgcgcggcgagaataggtttttaggtgtttttcggtttcgggggttgtcgtcgtacgttcgttttcgtaggggtttttatttcgttaatcgtcgcggtcgcgcgttttcgcgtatatttattagttcgagtcggggcggttattttagcgtttatttcggtttttcgtttttcggttcggcggtcgcgacgattcggtgcggcggttacgatagtcgtgacgcgtagtaggtttcgtttttttttatagttttatttttgcgtcggtttttcgcgggtatcgagaatttgtcggtggtcgtttttcgcgtttcgtgggggggtcggggttacggacggttttcggcgtcgtaagtgggtttgcgcgaataataagtattgttttttcgggcgggtttcgtatttgtagtgtcgtcgggatacgggagggtaaatttagcgtgttttgtgtgtttgtg

SEQ ID NO: 34152 - DNA, 514 bp, Artificial Sequence
  chemically treated genomic DNA (Homo sapiens) CpG-island No: 34152
cacaaacacacaaaacacgctaaatttaccctcccgtatcccgacgacactacaaatacgaaacccgcccgaaaaaacaatacttattattcgcgcaaacccacttacgacgccgaaaaccgtccgtaaccccgacccccccacgaaacgcgaaaaacgaccaccgacaaattctcgatacccgcgaaaaaccgacgcaaaaataaaactataaaaaaaaacgaaacctactacgcgtcacgactatcgtaaccgccgcaccgaatcgtcgcgaccgccgaaccgaaaaacgaaaaaccgaaataaacgctaaaataaccgccccgactcgaactaataaatatacgcgaaaacgcgcgaccgcgacgattaacgaaataaaaacccctacgaaaacgaacgtacgacgacaacccccgaaaccgaaaaacacctaaaaacctattctcgccgcgcaaaacgctaaaaaatcactaaaaaaaaaaaaacctaaaactacgaacgcgcgaaaaaa

SEQ ID NO: 34153 - DNA, 639 bp, Artificial Sequence
  chemically treated genomic DNA (Homo sapiens) CpG-island No: 34153
tttcgaggtataaggattttaagtcgttcggaattgtcggtcgttagatgatatcggttgcgtcgatgtagagtttcgggagttttagggtattatttgttttagcggagggattttgcgtgcgtcgaagcgatcgtgatcgcgtagggatttgacgtcgttgacgtcgggtcggcggcgtagcgacgtcgtaggaggcggtggcggcgagggcgggcgggggatgcgggtcgggaagtagtttcgggtgcgcggtttcggatgttggttgtttttgttgtcgtcgtcgttttcggggttgttcggggtttcgatcgttcgtagtaggtatcgttgggatttttttcgggggggcggagacgtacggagcggtcgggggttcggtcgggtcgtttcggtttgcgtagtttgaggtaagtgtttttcgttagggcggtcgggtttgggcggcgggcgaggaggcggggttgtggtatttttcgggacggaggtaggggttgtttttcgcgagacgtttttttttttttagtcgtagtcgcgttgcggggtgggcggcgggtggggtagggggtttgggtttcggttggggtttggcggacgtcgagggttgggtttttttttttttcgcggcgtttttta

SEQ ID NO: 34154 - DNA, 639 bp, Artificial Sequence
  chemically treated genomic DNA (Homo sapiens) CpG-island No: 34154
taaaaaacgccgcgaaaaaaaaaaaaacccaaccctcgacgtccgccaaaccccaaccgaaacccaaaccccctaccccacccgccgcccaccccgcaacgcgactacgactaaaaaaaaaaaaacgtctcgcgaaaaacaacccctacctccgtcccgaaaaataccacaaccccgcctcctcgcccgccgcccaaacccgaccgccctaacgaaaaacacttacctcaaactacgcaaaccgaaacgacccgaccgaacccccgaccgctccgtacgtctccgcccccccgaaaaaaatcccaacgatacctactacgaacgatcgaaaccccgaacaaccccgaaaacgacgacgacaacaaaaacaaccaacatccgaaaccgcgcacccgaaactacttcccgacccgcatcccccgcccgccctcgccgccaccgcctcctacgacgtcgctacgccgccgacccgacgtcaacgacgtcaaatccctacgcgatcacgatcgcttcgacgcacgcaaaatccctccgctaaaacaaataataccctaaaactcccgaaactctacatcgacgcaaccgatatcatctaacgaccgacaattccgaacgacttaaaatccttatacctcgaaa

SEQ ID NO: 34155 - DNA, 639 bp, Artificial Sequence
  chemically treated genomic DNA (Homo sapiens) CpG-island No: 34155
tgagaagcgtcgcgggggagggaaggatttagttttcggcgttcgttaggttttagtcggggtttaggttttttgttttattcgtcgtttatttcgtaacgcggttgcggttggaagagagagggcgtttcgcggaggatagtttttgttttcgtttcgggagatgttatagtttcgttttttcgttcgtcgtttaggttcggtcgttttggcggggggtatttattttaggttgcgtaggtcgggacggttcggtcgagttttcggtcgtttcgtgcgttttcgttttttcgggaaaggttttaacggtgtttattgcgagcggtcgaggtttcgagtagtttcgagagcggcggcggtagtaagagtagttaatattcggggtcgcgtattcggaattatttttcgattcgtatttttcgttcgttttcgtcgttatcgttttttgcggcgtcgttgcgtcgtcggttcggcgttagcggcgttaagtttttgcgcggttacggtcgtttcgacgtacgtaggattttttcgttgggataagtagtgttttgagattttcgaggttttgtatcggcgtagtcggtgttatttagcggtcggtagtttcgagcgatttggggtttttgtgtttcggag

SEQ ID NO: 34156 - DNA, 639 bp, Artificial Sequence
  chemically treated genomic DNA (Homo sapiens) CpG-island No: 34156
ctccgaaacacaaaaaccccaaatcgctcgaaactaccgaccgctaaataacaccgactacgccgatacaaaacctcgaaaatctcaaaacactacttatcccaacgaaaaaatcctacgtacgtcgaaacgaccgtaaccgcgcaaaaacttaacgccgctaacgccgaaccgacgacgcaacgacgccgcaaaaaacgataacgacgaaaacgaacgaaaaatacgaatcgaaaaataattccgaatacgcgaccccgaatattaactactcttactaccgccgccgctctcgaaactactcgaaacctcgaccgctcgcaataaacaccgttaaaacctttcccgaaaaaacgaaaacgcacgaaacgaccgaaaactcgaccgaaccgtcccgacctacgcaacctaaaataaataccccccgccaaaacgaccgaacctaaacgacgaacgaaaaaacgaaactataacatctcccgaaacgaaaacaaaaactatcctccgcgaaacgccctctctcttccaaccgcaaccgcgttacgaaataaacgacgaataaaacaaaaaacctaaaccccgactaaaacctaacgaacgccgaaaactaaatccttccctcccccgcgacgcttctca

SEQ ID NO: 34157 - DNA, 1029 bp, Artificial Sequence
  chemically treated genomic DNA (Homo sapiens) CpG-island No: 34157
gcgttcggttattttatttttttgtttcgttaggtcgttggtttgtttttggttttttttcgcgatttttcggtcgtgtaggtttcgcggtagcgaagcggttggggttggcgtttcgtttttttagcgttttattttttttttcggttttcgtcggtcgtagtcgtttttcgtagtcggggttttcgtcgggattgacgcgttgggggaggagcggtttttcgttgcgcgtttttaaggaatattacggtagggttcgtttttggtttcggtcgttagttttagttttttaggttcggagttcggattggcggaggtcgcgagggagggagtacgagcgaggaggtacgcgttcgtcggttcgtattcggttcgtcgtagtcgtcgtcgtcgtcgtcgtcgtcgtagtagttatggtcgagcgtcgcgttttcgtttagaagattagtaggtaaatattcggcgtggggcgcgtcgtcgtcgtcgttcgagaaagagtcgcggagtttttttaggtttggtttaggaggcgggtgggtgtggcggggtcggtatcgggatttcgcggtttggttcgcggcggggcggaaggggttcggggtggttgagggggtagcggaggtttcgcgtcgttttcgaatttcggtttttagttcgcgttcgtcgttgagtttcggtagggagcggagagggtcgcggattttagcgcgttcgtttttttttgtttttcggcggttcgggtttggatttttgcggaggtttatggaagggcggtcggtcgttttttaaattttttgtgtttttattttcgggttcgtcgggggtcgtcgcggcgtttcgttttttttcgttttttcgtttattttttttggtttttagagggtgcggggttcgtttttttttattttaataaaaggagaaacgcgcggcggttcggggcgggtgggaggtcgttttttttttacgcgtttttttttttttgagaaatttgataggaattttttttgtattttcgggttaggtttaaag

SEQ ID NO: 34158 - DNA, 1029 bp, Artificial Sequence
  chemically treated genomic DNA (Homo sapiens) CpG-island No: 34158
ctttaaacctaacccgaaaatacaaaaaaaattcctatcaaatttctcaaaaaaaaaaaaacgcgtaaaaaaaaaacgacctcccacccgccccgaaccgccgcgcgtttctccttttattaaaataaaaaaaaacgaaccccgcaccctctaaaaaccaaaaaaaataaacgaaaaaacgaaaaaaaacgaaacgccgcgacgacccccgacgaacccgaaaataaaaacacaaaaaatttaaaaaacgaccgaccgcccttccataaacctccgcaaaaatccaaacccgaaccgccgaaaaacaaaaaaaaacgaacgcgctaaaatccgcgaccctctccgctccctaccgaaactcaacgacgaacgcgaactaaaaaccgaaattcgaaaacgacgcgaaacctccgctaccccctcaaccaccccgaaccccttccgccccgccgcgaaccaaaccgcgaaatcccgataccgaccccgccacacccacccgcctcctaaaccaaacctaaaaaaactccgcgactctttctcgaacgacgacgacgacgcgccccacgccgaatatttacctactaatcttctaaacgaaaacgcgacgctcgaccataactactacgacgacgacgacgacgacgacgactacgacgaaccgaatacgaaccgacgaacgcgtacctcctcgctcgtactccctccctcgcgacctccgccaatccgaactccgaacctaaaaaactaaaactaacgaccgaaaccaaaaacgaaccctaccgtaatattccttaaaaacgcgcaacgaaaaaccgctcctcccccaacgcgtcaatcccgacgaaaaccccgactacgaaaaacgactacgaccgacgaaaaccgaaaaaaaaaataaaacgctaaaaaaacgaaacgccaaccccaaccgcttcgctaccgcgaaacctacacgaccgaaaaatcgcgaaaaaaaaccaaaaacaaaccaacgacctaacgaaacaaaaaaataaaataaccgaacgc

SEQ ID NO: 34159 - DNA, 1029 bp, Artificial Sequence
  chemically treated genomic DNA (Homo sapiens) CpG-island No: 34159
ttttgaatttggttcgagggtgtaaagagggtttttgttagattttttaggaagagagagacgcgtgaaggaggggcggttttttattcgtttcgagtcgtcgcgcgtttttttttttgttggggtggaggagggcggatttcgtattttttaggggttaagaggggtgggcggagagacgggagggggcgaaacgtcgcggcggttttcgacgagttcgggggtgggaatataaagaatttgggaagcggtcgatcgtttttttataaattttcgtagaagtttaggttcgggtcgtcgaggagtaggaggaggcgggcgcgttggagttcgcggtttttttcgttttttgtcgaggtttagcggcgggcgcgggttgaaggtcggggttcgagggcggcgcgaggttttcgttatttttttagttatttcgaatttttttcgtttcgtcgcgagttaggtcgcgggatttcggtgtcggtttcgttatatttattcgttttttaggttaggtttgggaggatttcgcggttttttttcgggcggcggcggcggcgcgttttacgtcggatatttatttgttgattttttgggcgaaggcgcggcgttcggttatggttgttgcggcgacggcgacggcggcggcggttgcggcgggtcgggtgcggatcggcgggcgcgtgttttttcgttcgtgttttttttttcgcggttttcgttagttcgggtttcggatttgggaggttggggttggcggtcggagttaggaacgagttttgtcgtaatgttttttagaggcgcgtaacgagaaatcgttttttttttagcgcgttaatttcggcgggaatttcggttgcggaaggcggttgcggtcggcgggagtcgaggggaagaatggagcgttgaggaagcgaggcgttagttttagtcgtttcgttgtcgcggagtttgtacgatcgagaggtcgcggagagaagttagagataggttagcgatttggcgaggtaagaaaataagataatcgaacgt

SEQ ID NO: 34160 - DNA, 1029 bp, Artificial Sequence
  chemically treated genomic DNA (Homo sapiens) CpG-island No: 34160
acgttcgattatcttattttcttacctcgccaaatcgctaacctatctctaacttctctccgcgacctctcgatcgtacaaactccgcgacaacgaaacgactaaaactaacgcctcgcttcctcaacgctccattcttcccctcgactcccgccgaccgcaaccgccttccgcaaccgaaattcccgccgaaattaacgcgctaaaaaaaaaacgatttctcgttacgcgcctctaaaaaacattacgacaaaactcgttcctaactccgaccgccaaccccaacctcccaaatccgaaacccgaactaacgaaaaccgcgaaaaaaaaaacacgaacgaaaaaacacgcgcccgccgatccgcacccgacccgccgcaaccgccgccgccgtcgccgtcgccgcaacaaccataaccgaacgccgcgccttcgcccaaaaaatcaacaaataaatatccgacgtaaaacgcgccgccgccgccgcccgaaaaaaaaccgcgaaatcctcccaaacctaacctaaaaaacgaataaatataacgaaaccgacaccgaaatcccgcgacctaactcgcgacgaaacgaaaaaaattcgaaataactaaaaaaataacgaaaacctcgcgccgccctcgaaccccgaccttcaacccgcgcccgccgctaaacctcgacaaaaaacgaaaaaaaccgcgaactccaacgcgcccgcctcctcctactcctcgacgacccgaacctaaacttctacgaaaatttataaaaaaacgatcgaccgcttcccaaattctttatattcccacccccgaactcgtcgaaaaccgccgcgacgtttcgccccctcccgtctctccgcccacccctcttaacccctaaaaaatacgaaatccgccctcctccaccccaacaaaaaaaaaaacgcgcgacgactcgaaacgaataaaaaaccgcccctccttcacgcgtctctctcttcctaaaaaatctaacaaaaaccctctttacaccctcgaaccaaattcaaaa

SEQ ID NO: 34161 - DNA, 765 bp, Artificial Sequence
  chemically treated genomic DNA (Homo sapiens) CpG-island No: 34161
agcgcgagacggggtttcggaggattgttaattttattacggtggttttttcggggttttcgtttttttttgagcgtgcgggggtttttggttttattcggatatagtgtacgcggcgtattggtttttaggagttggggcggaggttggtttcggaattttcggcgggagggtttgggcggtggggacgtttttatcgggcggttggcgtgtacgtcgtcggggttacgcggttttttcgacggattcgagtttttcgtggcgggggtggggcggttatcgttagttcggttttttcgaacgatcgggttcggttttagtttttagagcgtttagtcgttggttttatttttttgcgtacgtttagtaacgagtaatagtttttattgtttagttttttttcgtttaaggtcgtcgttattttcgtaattttttatttcgttaaatcggtaaggtcgtgtttaagaggggttagtgattcgcgttagggatagcgcgggttagttcggttgcgttatagcggtttttggcggttcggagtcgttcgcgttcggcgggagtgcgtttgcgttttgcgttttcgcgcggtttagggcgggacgcggcgtttaggtagttttggcggggtgattacgcgggtgttttttcgtgtttttaatggacgcgtggtacgcggcgtggttgcgttttcgggggtttgagatttagttaggattttttagggttttttttgtattagaaagggaaattttgtttttttttttt

SEQ ID NO: 34162 - DNA, 765 bp, Artificial Sequence
  chemically treated genomic DNA (Homo sapiens) CpG-island No: 34162
aaaaaaaaaaaacaaaatttccctttctaatacaaaaaaaaccctaaaaaatcctaactaaatctcaaacccccgaaaacgcaaccacgccgcgtaccacgcgtccattaaaaacacgaaaaaacacccgcgtaatcaccccgccaaaactacctaaacgccgcgtcccgccctaaaccgcgcgaaaacgcaaaacgcaaacgcactcccgccgaacgcgaacgactccgaaccgccaaaaaccgctataacgcaaccgaactaacccgcgctatccctaacgcgaatcactaacccctcttaaacacgaccttaccgatttaacgaaataaaaaattacgaaaataacgacgaccttaaacgaaaaaaaactaaacaataaaaactattactcgttactaaacgtacgcaaaaaaataaaaccaacgactaaacgctctaaaaactaaaaccgaacccgatcgttcgaaaaaaccgaactaacgataaccgccccacccccgccacgaaaaactcgaatccgtcgaaaaaaccgcgtaaccccgacgacgtacacgccaaccgcccgataaaaacgtccccaccgcccaaaccctcccgccgaaaattccgaaaccaacctccgccccaactcctaaaaaccaatacgccgcgtacactatatccgaataaaaccaaaaacccccgcacgctcaaaaaaaaacgaaaaccccgaaaaaaccaccgtaataaaattaacaatcctccgaaaccccgtctcgcgct

SEQ ID NO: 34163 - DNA, 765 bp, Artificial Sequence
  chemically treated genomic DNA (Homo sapiens) CpG-island No: 34163
aaaaaaaaaaagtaaagtttttttttttagtataggaaaagttttagggagttttggttggattttaggttttcgaggacgtagttacgtcgcgtgttacgcgtttattgggagtacgaagagatattcgcgtggttatttcgttagggttgtttaggcgtcgcgtttcgttttaggtcgcgcgggggcgtaaagcgtaggcgtattttcgtcgggcgcggacggtttcgggtcgttaggggtcgttgtggcgtagtcgggttggttcgcgttgtttttgacgcggattattggttttttttgagtacggttttgtcggtttggcggggtgaaaggttgcgaagatggcgacggttttgagcgaggaggagttggataatgaagattattattcgttgttgaacgtgcgtagggaggtgaggttagcggttggacgttttgggggttgaggtcgagttcggtcgttcgggagggtcgggttggcggtggtcgttttattttcgttacgggaggttcgggttcgtcggggaggtcgcgtgatttcggcgacgtgtacgttagtcgttcgatggaggcgtttttatcgtttagattttttcgtcgggggtttcggggttagttttcgttttagtttttgaaggttagtgcgtcgcgtgtattgtgttcgggtagggttagaggttttcgtacgtttaagaggaaacgggggtttcgaggaggttatcgtagtggggttagtagtttttcgagatttcgtttcgcgtt

SEQ ID NO: 34164 - DNA, 765 bp, Artificial Sequence
  chemically treated genomic DNA (Homo sapiens) CpG-island No: 34164
aacgcgaaacgaaatctcgaaaaactactaaccccactacgataacctcctcgaaacccccgtttcctcttaaacgtacgaaaacctctaaccctacccgaacacaatacacgcgacgcactaaccttcaaaaactaaaacgaaaactaaccccgaaacccccgacgaaaaaatctaaacgataaaaacgcctccatcgaacgactaacgtacacgtcgccgaaatcacgcgacctccccgacgaacccgaacctcccgtaacgaaaataaaacgaccaccgccaacccgaccctcccgaacgaccgaactcgacctcaacccccaaaacgtccaaccgctaacctcacctccctacgcacgttcaacaacgaataataatcttcattatccaactcctcctcgctcaaaaccgtcgccatcttcgcaacctttcaccccgccaaaccgacaaaaccgtactcaaaaaaaaccaataatccgcgtcaaaaacaacgcgaaccaacccgactacgccacaacgacccctaacgacccgaaaccgtccgcgcccgacgaaaatacgcctacgctttacgcccccgcgcgacctaaaacgaaacgcgacgcctaaacaaccctaacgaaataaccacgcgaatatctcttcgtactcccaataaacgcgtaacacgcgacgtaactacgtcctcgaaaacctaaaatccaaccaaaactccctaaaacttttcctatactaaaaaaaaaaactttacttttttttttt

SEQ ID NO: 34165 - DNA, 903 bp, Artificial Sequence
  chemically treated genomic DNA (Homo sapiens) CpG-island No: 34165
tcgcgggtttggtcgcgagtacgattggcgggatatttttttcgtattttattttcgaataggcgttaatttcgtcgagattttaggagtagatgtattaggaaacgttagggaagtaggtcgggacggatcgggatttatttagcgcgaaagtagttcgattttatttgtattcgcgttttttgtttcggtcgaggcgtttttttttcgtagcgtttttagtggtcgcggtcggagtcggggagcgaagtcgttcgggggttttcgtcgtatttatcgtttttgtttacgcggtcggcgtttagtatcgttagtttgatgtttttgggtagtaggtagttcgaggaggattcggggatgggtgcgagtagaaagtgttcggatatgttgagcggtcgtatggagcgcgtttcggggttcggcgcgtaattcgagagggttgggtttcgtcgtattcggagtcggttcgttagttgggagtgcgggattagaggttcgggatcgcggcggttgtttgtagaattgttaaggttcgcggtttttaaagggtttggtgcgttcgggagcgcggcggtcgttttagttttttttcgttttcgttttttttcggagcggtcgggaggggcgggagtagaggtcgcggagttgattatcgtcgaggttgtgcgtttcgtcgggttgttagttgttcgcggttttaggcgttttgcggtaggattgcggtttcggggtttagattttggagatacggttatcgtttagagcgcgcgagtggtttttagttaggtattttgcgagttttttcgtttcgtagtagttagtcggagttattagatttgtgggtgaatttgagataggagttacgagttgacgagagaagaagaaaaagtgtaattagttgga

SEQ ID NO: 34166 - DNA, 903 bp, Artificial Sequence
  chemically treated genomic DNA (Homo sapiens) CpG-island No: 34166
tccaactaattacactttttcttcttctctcgtcaactcgtaactcctatctcaaattcacccacaaatctaataactccgactaactactacgaaacgaaaaaactcgcaaaatacctaactaaaaaccactcgcgcgctctaaacgataaccgtatctccaaaatctaaaccccgaaaccgcaatcctaccgcaaaacgcctaaaaccgcgaacaactaacaacccgacgaaacgcacaacctcgacgataatcaactccgcgacctctactcccgcccctcccgaccgctccgaaaaaaaacgaaaacgaaaaaaaactaaaacgaccgccgcgctcccgaacgcaccaaaccctttaaaaaccgcgaaccttaacaattctacaaacaaccgccgcgatcccgaacctctaatcccgcactcccaactaacgaaccgactccgaatacgacgaaacccaaccctctcgaattacgcgccgaaccccgaaacgcgctccatacgaccgctcaacatatccgaacactttctactcgcacccatccccgaatcctcctcgaactacctactacccaaaaacatcaaactaacgatactaaacgccgaccgcgtaaacaaaaacgataaatacgacgaaaacccccgaacgacttcgctccccgactccgaccgcgaccactaaaaacgctacgaaaaaaaaacgcctcgaccgaaacaaaaaacgcgaatacaaataaaatcgaactactttcgcgctaaataaatcccgatccgtcccgacctacttccctaacgtttcctaatacatctactcctaaaatctcgacgaaattaacgcctattcgaaaataaaatacgaaaaaaatatcccgccaatcgtactcgcgaccaaacccgcga

SEQ ID NO: 34167 - DNA, 903 bp, Artificial Sequence
  chemically treated genomic DNA (Homo sapiens) CpG-island No: 34167
tttaattgattgtattttttttttttttttcgttaattcgtaatttttattttaagtttatttataggtttagtgatttcggttggttgttgcggggcgaggagattcgtagaatgtttgattagaggttattcgcgcgttttggacggtggtcgtatttttagggtttgagtttcggagtcgtagttttgtcgtagagcgtttggagtcgcgagtagttagtagttcggcgaagcgtatagtttcggcgatagttagtttcgcggtttttgttttcgtttttttcggtcgtttcgggaaggggcggagacgaggaggagttgggacggtcgtcgcgttttcgggcgtattaagttttttaaaagtcgcgggttttgatagttttgtaggtagtcgtcgcggtttcggatttttagtttcgtatttttagttggcgagtcggtttcgggtgcggcgaggtttagttttttcggattgcgcgtcggatttcgggacgcgttttatgcggtcgtttagtatgttcgggtattttttgttcgtatttattttcgagtttttttcggattatttattgtttaaggatattaaattggcggtgttgggcgtcggtcgcgtgggtaagagcggtgagtgcggcggggattttcgggcggtttcgtttttcggtttcggtcgcgattattgggggcgttgcggagagagggcgtttcggtcgaagtagagggcgcgggtgtaggtagaatcgggttgttttcgcgttgggtgggtttcggttcgtttcggtttgtttttttggcgttttttggtgtatttatttttgggatttcggcgggattggcgtttgttcggggatggggtgcgggagaggtgtttcgttagtcgtattcgcggttaagttcgcgg

SEQ ID NO: 34168 - DNA, 903 bp, Artificial Sequence
  chemically treated genomic DNA (Homo sapiens) CpG-island No: 34168
ccgcgaacttaaccgcgaatacgactaacgaaacacctctcccgcaccccatccccgaacaaacgccaatcccgccgaaatcccaaaaataaatacaccaaaaaacgccaaaaaaacaaaccgaaacgaaccgaaacccacccaacgcgaaaacaacccgattctacctacacccgcgccctctacttcgaccgaaacgccctctctccgcaacgcccccaataatcgcgaccgaaaccgaaaaacgaaaccgcccgaaaatccccgccgcactcaccgctcttacccacgcgaccgacgcccaacaccgccaatttaatatccttaaacaataaataatccgaaaaaaactcgaaaataaatacgaacaaaaaatacccgaacatactaaacgaccgcataaaacgcgtcccgaaatccgacgcgcaatccgaaaaaactaaacctcgccgcacccgaaaccgactcgccaactaaaaatacgaaactaaaaatccgaaaccgcgacgactacctacaaaactatcaaaacccgcgacttttaaaaaacttaatacgcccgaaaacgcgacgaccgtcccaactcctcctcgtctccgccccttcccgaaacgaccgaaaaaaacgaaaacaaaaaccgcgaaactaactatcgccgaaactatacgcttcgccgaactactaactactcgcgactccaaacgctctacgacaaaactacgactccgaaactcaaaccctaaaaatacgaccaccgtccaaaacgcgcgaataacctctaatcaaacattctacgaatctcctcgccccgcaacaaccaaccgaaatcactaaacctataaataaacttaaaataaaaattacgaattaacgaaaaaaaaaaaaaaaatacaatcaattaaa

SEQ ID NO: 34169 - DNA, 729 bp, Artificial Sequence
  chemically treated genomic DNA (Homo sapiens) CpG-island No: 34169
tacggcggggagggtagggtgttgattttagggattacgatagtcggtttcggtggtggggatttcgcgcgggatttacgcgggaataaagaggcggttggacggtttagtttttcgtattcggaaggatttgttttattttttcggttttcgtatttttttattcgtatttgagtgattagattttattgtagttaatagttcgcggggtagttagtttcgagggatcgttcggaaagatataacgcgcgtggaaggcgtcgggcgtttagtttcgggagagattagaagtggcgtttttgtttagcgtcggtaatttaggggaattcgcggttatcgcggatttattaggggtgaggcggtattgagtataagtgtgaggttttcgggagttacgttttcgtttttttagtgttattcgtttttattttaggcggttttgatcgttatcgttttaatttggagaggtgagtttttttttatcgacgtatttttttttttcggtaggaaggagggcgttgatttagcgggcgtacgtttttgattgcgtatgcgtcgggtgcgtcgttcgttagcggcgagtggtttcgcggcgtcggattcgtcgtttcgttaagagtgcgtttgcgcggtcgttggggttcgtattttagttttttttttttcggcgttttttggggtttcgagttcggcgggattatgtttattagtatcggttttagtgggttt

SEQ ID NO: 34170 - DNA, 729 bp, Artificial Sequence
  chemically treated genomic DNA (Homo sapiens) CpG-island No: 34170
aaacccactaaaaccgatactaataaacataatcccgccgaactcgaaaccccaaaaaacgccgaaaaaaaaaaaactaaaatacgaaccccaacgaccgcgcaaacgcactcttaacgaaacgacgaatccgacgccgcgaaaccactcgccgctaacgaacgacgcacccgacgcatacgcaatcaaaaacgtacgcccgctaaatcaacgccctccttcctaccgaaaaaaaaaaatacgtcgataaaaaaaaactcacctctccaaattaaaacgataacgatcaaaaccgcctaaaataaaaacgaataacactaaaaaaacgaaaacgtaactcccgaaaacctcacacttatactcaataccgcctcacccctaataaatccgcgataaccgcgaattcccctaaattaccgacgctaaacaaaaacgccacttctaatctctcccgaaactaaacgcccgacgccttccacgcgcgttatatctttccgaacgatccctcgaaactaactaccccgcgaactattaactacaataaaatctaatcactcaaatacgaataaaaaaatacgaaaaccgaaaaaataaaacaaatccttccgaatacgaaaaactaaaccgtccaaccgcctctttattcccgcgtaaatcccgcgcgaaatccccaccaccgaaaccgactatcgtaatccctaaaatcaacaccctaccctccccgccgta

SEQ ID NO: 34171 - DNA, 729 bp, Artificial Sequence
  chemically treated genomic DNA (Homo sapiens) CpG-island No: 34171
gagtttattggagtcggtgttggtgaatatggtttcgtcgggttcggagttttagagggcgtcgggggaggggaagttgaagtgcgagttttagcgatcgcgtaggcgtatttttggcggagcgacgaattcggcgtcgcgaggttattcgtcgttgacgaacggcgtattcggcgtatgcgtagttaggggcgtgcgttcgttgggttagcgtttttttttttgtcggggaagggaagtgcgtcggtaggggagggtttatttttttaggttgaaacgatggcggttagaatcgtttgaggtaaaaacgggtggtattggggaagcggaggcgtagttttcgagagttttatatttgtgtttagtgtcgttttatttttggtggattcgcgatggtcgcggatttttttggattgtcggcgttgggtaggagcgttatttttaatttttttcgagattggacgttcggcgttttttacgcgcgttgtgttttttcgggcggtttttcgaagttggttatttcgcgggttgttgattgtagtgggatttggttatttagatgcggatagaggggtacgggagtcggagaggtggaataggttttttcgggtgcggagagttgggtcgtttagtcgtttttttgttttcgcgtgggtttcgcgcggaatttttattatcggggtcgattgtcgtggtttttggagttagtattttgtttttttcgtcgtg

SEQ ID NO: 34172 - DNA, 729 bp, Artificial Sequence
  chemically treated genomic DNA (Homo sapiens) CpG-island No: 34172
cacgacgaaaaaaacaaaatactaactccaaaaaccacgacaatcgaccccgataataaaaattccgcgcgaaacccacgcgaaaacaaaaaaacgactaaacgacccaactctccgcacccgaaaaaacctattccacctctccgactcccgtacccctctatccgcatctaaataaccaaatcccactacaatcaacaacccgcgaaataaccaacttcgaaaaaccgcccgaaaaaacacaacgcgcgtaaaaaacgccgaacgtccaatctcgaaaaaaattaaaaataacgctcctacccaacgccgacaatccaaaaaaatccgcgaccatcgcgaatccaccaaaaataaaacgacactaaacacaaatataaaactctcgaaaactacgcctccgcttccccaataccacccgtttttacctcaaacgattctaaccgccatcgtttcaacctaaaaaaataaaccctcccctaccgacgcacttcccttccccgacaaaaaaaaaaacgctaacccaacgaacgcacgcccctaactacgcatacgccgaatacgccgttcgtcaacgacgaataacctcgcgacgccgaattcgtcgctccgccaaaaatacgcctacgcgatcgctaaaactcgcacttcaacttcccctcccccgacgccctctaaaactccgaacccgacgaaaccatattcaccaacaccgactccaataaactc

SEQ ID NO: 34173 - DNA, 578 bp, Artificial Sequence
  chemically treated genomic DNA (Homo sapiens) CpG-island No: 34173
ggtaggtcggcgcggttcggcgttggagttaggcggtcggattggtaggggcggcgtgtcgttcgggatttttattggggaaggtggggggtcggggtcgttttcgtttcgggtcgtacgttcgaagatcggaggaggggattgcgtacgttattaagagggcgtatagtcgaggttggacgatgcgcggtttcggagtagggttttttgtttagggagttcggttgcgttcgaggggatttcgaagttatcggtagggtcggagttcggtgtattacgttttttttttgcgttcggggtttttgcggggatagaggttttaggaaagtagtttttatttatgtggtatcgatcggaattcgcggtcggttaggcggatttggacggagcgtttttgttcggaatttggcgcggggcgtcgcgcgttcgtgtggcgtttcggtttttttatcgtttagttttcggaggtacggagttcgcggcgggacgatgacggttgggtcgggttaggcgtgggagatttttagatttcggttcgtcgggacggttagttgcgttattttggacgtgggtaatat

SEQ ID NO: 34174 - DNA, 578 bp, Artificial Sequence
  chemically treated genomic DNA (Homo sapiens) CpG-island No: 34174
atattacccacgtccaaaataacgcaactaaccgtcccgacgaaccgaaatctaaaaatctcccacgcctaacccgacccaaccgtcatcgtcccgccgcgaactccgtacctccgaaaactaaacgataaaaaaaccgaaacgccacacgaacgcgcgacgccccgcgccaaattccgaacaaaaacgctccgtccaaatccgcctaaccgaccgcgaattccgatcgataccacataaataaaaactactttcctaaaacctctatccccgcaaaaaccccgaacgcaaaaaaaaaacgtaatacaccgaactccgaccctaccgataacttcgaaatcccctcgaacgcaaccgaactccctaaacaaaaaaccctactccgaaaccgcgcatcgtccaacctcgactatacgccctcttaataacgtacgcaatcccctcctccgatcttcgaacgtacgacccgaaacgaaaacgaccccgaccccccaccttccccaataaaaatcccgaacgacacgccgcccctaccaatccgaccgcctaactccaacgccgaaccgcgccgacctacc

SEQ ID NO: 34175 - DNA, 578 bp, Artificial Sequence
  chemically treated genomic DNA (Homo sapiens) CpG-island No: 34175
gtattgtttacgtttaaggtgacgtagttggtcgtttcggcgggtcggagtttgggagttttttacgtttggttcggtttaatcgttatcgtttcgtcgcgagtttcgtgttttcggggattgaacggtggggaggtcgaggcgttatacgagcgcgcggcgtttcgcgttaggtttcgagtagggacgtttcgtttaggttcgtttggtcggtcgcgggtttcgatcggtgttatataaataaaggttatttttttgagatttttgttttcgtagaggtttcgggcgtagagggggggcgtggtgtatcgagtttcgattttgtcggtgatttcggggttttttcgagcgtagtcgggttttttgggtaggaaattttgtttcgaaatcgcgtatcgtttagtttcggttgtgcgtttttttggtggcgtgcgtagttttttttttcggttttcggacgtgcggttcggggcggaggcggtttcgattttttattttttttagtgagggtttcgagcggtacgtcgtttttgttagttcggtcgtttagttttagcgtcgggtcgcgtcgatttgtt

SEQ ID NO: 34176 - DNA, 578 bp, Artificial Sequence
  chemically treated genomic DNA (Homo sapiens) CpG-island No: 34176
aacaaatcgacgcgacccgacgctaaaactaaacgaccgaactaacaaaaacgacgtaccgctcgaaaccctcactaaaaaaaataaaaaatcgaaaccgcctccgccccgaaccgcacgtccgaaaaccgaaaaaaaaaactacgcacgccaccaaaaaaacgcacaaccgaaactaaacgatacgcgatttcgaaacaaaatttcctacccaaaaaacccgactacgctcgaaaaaaccccgaaatcaccgacaaaatcgaaactcgatacaccacgccccccctctacgcccgaaacctctacgaaaacaaaaatctcaaaaaaataacctttatttatataacaccgatcgaaacccgcgaccgaccaaacgaacctaaacgaaacgtccctactcgaaacctaacgcgaaacgccgcgcgctcgtataacgcctcgacctccccaccgttcaatccccgaaaacacgaaactcgcgacgaaacgataacgattaaaccgaaccaaacgtaaaaaactcccaaactccgacccgccgaaacgaccaactacgtcaccttaaacgtaaacaatac

SEQ ID NO: 34177 - DNA, 622 bp, Artificial Sequence
  chemically treated genomic DNA (Homo sapiens) CpG-island No: 34177
ttttcgcgtcggatcgttaggcggggtattagggaaattgcgatgcgtcggtttgcgagtttatcgtgacgtagagttggcggtcgttagcgatagttattttgtgagggattttttttttaatattttaatcgtttttttgtttttaagggttcgttttcgtttcggtttcgtttttgtttttttgaggaagttcggcgtagtttaatttttatagggtcgcggagagggcgcgttaggcggggatttgcgttaggttcgcggcgtatgtttagtggttggggattgggcgggtatttcgggcggggagtttgattgaacggcggttttgttgattggtcgggttgtttacgttacgttcgttgtttttcgatggatagttttttatttgtcgggtcggttttcgtagagagtggtggttttgaaaatttagttttgggagaatatttgtcgcgtttttcgtttaaatatttagaggttttatagtcgttatcgttgcggtggaggaggtcgtttgttgcgttttattttattagaaagtttaatattggtttgaagcgtaattttaaagtggtaggggaaaatatcgatttagcgtagagagtaaaatattttcgttttg

SEQ ID NO: 34178 - DNA, 622 bp, Artificial Sequence
  chemically treated genomic DNA (Homo sapiens) CpG-island No: 34178
caaaacgaaaatattttactctctacgctaaatcgatattttcccctaccactttaaaattacgcttcaaaccaatattaaactttctaataaaataaaacgcaacaaacgacctcctccaccgcaacgataacgactataaaacctctaaatatttaaacgaaaaacgcgacaaatattctcccaaaactaaattttcaaaaccaccactctctacgaaaaccgacccgacaaataaaaaactatccatcgaaaaacaacgaacgtaacgtaaacaacccgaccaatcaacaaaaccgccgttcaatcaaactccccgcccgaaatacccgcccaatccccaaccactaaacatacgccgcgaacctaacgcaaatccccgcctaacgcgccctctccgcgaccctataaaaattaaactacgccgaacttcctcaaaaaaacaaaaacgaaaccgaaacgaaaacgaacccttaaaaacaaaaaaacgattaaaatattaaaaaaaaaatccctcacaaaataactatcgctaacgaccgccaactctacgtcacgataaactcgcaaaccgacgcatcgcaatttccctaataccccgcctaacgatccgacgcgaaaa

SEQ ID NO: 34179 - DNA, 622 bp, Artificial Sequence
  chemically treated genomic DNA (Homo sapiens) CpG-island No: 34179
tagaacggaggtgttttgttttttgcgttagatcggtatttttttttattattttaagattacgttttaggttagtgttaggttttttggtggggtgggacgtaataggcggttttttttatcgtagcgatggcggttatgaaatttttgggtatttgggcgggaggcgcggtaggtatttttttaaaattgggtttttaagattattattttttgcggaggtcgattcggtaggtaaggaattgtttatcggaaggtaacgggcgtggcgtgagtagttcgattaattagtagagtcgtcgtttagttaggtttttcgttcggggtattcgtttagtttttaattattgagtatgcgtcgcgggtttggcgtaaattttcgtttggcgcgtttttttcgcggttttgtgagggttaggttgcgtcgggtttttttagagagatagaaacggagtcggggcgggagcgggtttttagggataggaaagcggttagggtattggggggaaagttttttatagggtggttgtcgttagcggtcgttagttttgcgttacggtgggttcgtaagtcggcgtatcgtagtttttttggtatttcgtttggcggttcggcgcggagg

SEQ ID NO: 34180 - DNA, 622 bp, Artificial Sequence
  chemically treated genomic DNA (Homo sapiens) CpG-island No: 34180
cctccgcgccgaaccgccaaacgaaataccaaaaaaactacgatacgccgacttacgaacccaccgtaacgcaaaactaacgaccgctaacgacaaccaccctataaaaaactttccccccaataccctaaccgctttcctatccctaaaaacccgctcccgccccgactccgtttctatctctctaaaaaaacccgacgcaacctaaccctcacaaaaccgcgaaaaaaacgcgccaaacgaaaatttacgccaaacccgcgacgcatactcaataattaaaaactaaacgaataccccgaacgaaaaacctaactaaacgacgactctactaattaatcgaactactcacgccacgcccgttaccttccgataaacaattccttacctaccgaatcgacctccgcaaaaaataataatcttaaaaacccaattttaaaaaaatacctaccgcgcctcccgcccaaatacccaaaaatttcataaccgccatcgctacgataaaaaaaaccgcctattacgtcccaccccaccaaaaaacctaacactaacctaaaacgtaatcttaaaataataaaaaaaaataccgatctaacgcaaaaaacaaaacacctccgttcta

SEQ ID NO: 34181 - DNA, 588 bp, Artificial Sequence
  chemically treated genomic DNA (Homo sapiens) CpG-island No: 34181
attttttttcgttcgtttttcgatgatttttttcgttttcgcgttttttcgttcgttgtcgtcgtttttttcgcgttgggtgtttcgtcgtcgtattatgttttcgggttgcgttttttgcgcgcgcgtgttcgcgtaattttttttcgcgcgcgtgcgtcgttttttcgtgttttttcgttttgttcgggtcgttttttatcgtcgttttcgggcggcggttcgtggtttttttgtttttgcgtttcgtgcgcgggcgtttgttcgtttttcgcgcgttcgatgcgtttcggtgcgcggtcggtttcgggcgacggggggattcgcgtggtcggtcgtgtgttgtgttcgtcgtgtttttttttagtttttttcggtcgggttttttttcgttttgttttttttcgttggtcgcgttttcgcgcgtttcgttttttttacgttcgttttcgcggttcgttcgcggttttttttcgtggtttttttttttttttttcgtgtcggtggtggttttcgtttttcgtcggttttttttttttgtttgtcgcgttttcgcgtttttttttgtttcgtgtattcggtttttcg

SEQ ID NO: 34182 - DNA, 588 bp, Artificial Sequence
  chemically treated genomic DNA (Homo sapiens) CpG-island No: 34182
cgaaaaaccgaatacacgaaacaaaaaaaaacgcgaaaacgcgacaaacaaaaaaaaaaaaccgacgaaaaacgaaaaccaccaccgacacgaaaaaaaaaaaaaaaaaccacgaaaaaaaaccgcgaacgaaccgcgaaaacgaacgtaaaaaaaacgaaacgcgcgaaaacgcgaccaacgaaaaaaaacaaaacgaaaaaaaacccgaccgaaaaaaactaaaaaaaaacacgacgaacacaacacacgaccgaccacgcgaatccccccgtcgcccgaaaccgaccgcgcaccgaaacgcatcgaacgcgcgaaaaacgaacaaacgcccgcgcacgaaacgcaaaaacaaaaaaaccacgaaccgccgcccgaaaacgacgataaaaaacgacccgaacaaaacgaaaaaacacgaaaaaacgacgcacgcgcgcgaaaaaaaattacgcgaacacgcgcgcgcaaaaaacgcaacccgaaaacataatacgacgacgaaacacccaacgcgaaaaaaacgacgacaacgaacgaaaaaacgcgaaaacgaaaaaaatcatcgaaaaacgaacgaaaaaaaat

SEQ ID NO: 34183 - DNA, 588 bp, Artificial Sequence
  chemically treated genomic DNA (Homo sapiens) CpG-island No: 34183
cgggggatcgggtatacgggatagggaagggcgcgggggcgcgataggtaaaaaagggggatcggcgaagggcgggggttattatcgatacggggggggagaggggggattacggaggggagtcgcggacgggtcgcgggaacggacgtgaaaagggcggaacgcgcgggaacgcgattagcgggggggggtaaaacgggaaaaggttcgatcgagggggattaggggggggtacgacgggtatagtatacggtcggttacgcgaattttttcgtcgttcgggatcgatcgcgtatcgaagcgtatcgggcgcgcgggagacggataggcgttcgcgtacgaagcgtaaggataggggggttacgggtcgtcgttcgggggcggcgatggggggcggttcggatagaacgggagaatacgggggaacgacgtacgcgcgcgggggagggttgcgcgggtacgcgcgcgtaaaaggcgtagttcgggggtatggtacgacggcggggtatttagcgcgaaaggaacggcggtagcgggcgaggaaacgcggaggcggaaggaattatcgggaagcggacgggggaaggt

SEQ ID NO: 34184 - DNA, 588 bp, Artificial Sequence
  chemically treated genomic DNA (Homo sapiens) CpG-island No: 34184
accttcccccgtccgcttcccgataattccttccgcctccgcgtttcctcgcccgctaccgccgttcctttcgcgctaaataccccgccgtcgtaccatacccccgaactacgccttttacgcgcgcgtacccgcgcaaccctcccccgcgcgcgtacgtcgttcccccgtattctcccgttctatccgaaccgccccccatcgccgcccccgaacgacgacccgtaacccccctatccttacgcttcgtacgcgaacgcctatccgtctcccgcgcgcccgatacgcttcgatacgcgatcgatcccgaacgacgaaaaaattcgcgtaaccgaccgtatactatacccgtcgtacccccccctaatccccctcgatcgaaccttttcccgttttacccccccccgctaatcgcgttcccgcgcgttccgcccttttcacgtccgttcccgcgacccgtccgcgactcccctccgtaatcccccctctccccccccgtatcgataataacccccgcccttcgccgatcccccttttttacctatcgcgcccccgcgcccttccctatcccgtatacccgatcccccg

SEQ ID NO: 34185 - DNA, 578 bp, Artificial Sequence
  chemically treated genomic DNA (Homo sapiens) CpG-island No: 34185
ggttatcgcgtaggaagtcgagtacgaggggatataggtcgttgggaattacgcggcgaatgtcggcgttcgttattttttaggtaatacgcgttattatcgttgtcgacgtagtacgatttaggaatttaataggggtagtgggcgggtttgtgttacgttattgcgtcgcgcgggcgtataacggaaagggtgggttttatagggtagttttatttttattttagaggtagggtagacgggaaatttataaatttttttcggttttacgcgtatcgttattttggttaagggcggagtttatcggtcgttagtttgtggaggcggagttttgacgttagggattacgttttcggcgtggcgggaaaattcgggatttttcgcgtagtttttttgggggaggtatttttttttagagtagcggtttttcgcgtttttgttgggattcggattttagagtaatgagtggataagcgggttcgaatagttgttttataagattttttaatcgtttttatggcgtattggtacggttaatggattttcgttttttatttttattgtttttaatatttagg

SEQ ID NO: 34186 - DNA, 578 bp, Artificial Sequence
  chemically treated genomic DNA (Homo sapiens) CpG-island No: 34186
cctaaatattaaaaacaataaaaataaaaaacgaaaatccattaaccgtaccaatacgccataaaaacgattaaaaaatcttataaaacaactattcgaacccgcttatccactcattactctaaaatccgaatcccaacaaaaacgcgaaaaaccgctactctaaaaaaaaatacctcccccaaaaaaactacgcgaaaaatcccgaattttcccgccacgccgaaaacgtaatccctaacgtcaaaactccgcctccacaaactaacgaccgataaactccgcccttaaccaaaataacgatacgcgtaaaaccgaaaaaaatttataaatttcccgtctaccctacctctaaaataaaaataaaactaccctataaaacccaccctttccgttatacgcccgcgcgacgcaataacgtaacacaaacccgcccactacccctattaaattcctaaatcgtactacgtcgacaacgataataacgcgtattacctaaaaaataacgaacgccgacattcgccgcgtaattcccaacgacctatatcccctcgtactcgacttcctacgcgataacc

SEQ ID NO: 34187 - DNA, 578 bp, Artificial Sequence
  chemically treated genomic DNA (Homo sapiens) CpG-island No: 34187
tttgggtattggaggtagtgaagatgaagggcgagaatttattggtcgtgttagtacgttatgggggcggttgggagattttgtagaataattgttcgagttcgtttgtttatttattattttggaattcgagttttagtaggggcgcgggaaatcgttgttttgagaaaaggtattttttttagaaagattgcgcgggaagtttcgagttttttcgttacgtcgagggcgtgatttttgacgttagagtttcgtttttataagttggcggtcggtgggtttcgtttttaattaagatggcgatacgcgtgggatcggaaagagtttatagatttttcgtttattttatttttgaggtgaaggtgggattgttttgtggagtttatttttttcgttatgcgttcgcgcggcgtaatgacgtaatataggttcgtttattgtttttgttgggtttttgagtcgtgttgcgtcgataacggtagtgacgcgtattgtttggaggatggcggacgtcggtattcgtcgcgtggtttttagcgatttgtattttttcgtgttcggttttttgcgcgataatt

SEQ ID NO: 34188 - DNA, 578 bp, Artificial Sequence
  chemically treated genomic DNA (Homo sapiens) CpG-island No: 34188
aattatcgcgcaaaaaaccgaacacgaaaaaatacaaatcgctaaaaaccacgcgacgaataccgacgtccgccatcctccaaacaatacgcgtcactaccgttatcgacgcaacacgactcaaaaacccaacaaaaacaataaacgaacctatattacgtcattacgccgcgcgaacgcataacgaaaaaaataaactccacaaaacaatcccaccttcacctcaaaaataaaataaacgaaaaatctataaactctttccgatcccacgcgtatcgccatcttaattaaaaacgaaacccaccgaccgccaacttataaaaacgaaactctaacgtcaaaaatcacgccctcgacgtaacgaaaaaactcgaaacttcccgcgcaatctttctaaaaaaaataccttttctcaaaacaacgatttcccgcgcccctactaaaactcgaattccaaaataataaataaacaaacgaactcgaacaattattctacaaaatctcccaaccgcccccataacgtactaacacgaccaataaattctcgcccttcatcttcactacctccaatacccaaa

SEQ ID NO: 34189 - DNA, 529 bp, Artificial Sequence
  chemically treated genomic DNA (Homo sapiens) CpG-island No: 34189
attattttttaatttttagatttcgtttatttcgtttcggcggtgttttcgtgacgacgttattcgaagtgcggttgcgtaagggtgacggcgcgcgagtaaaggggaagggggtgttttggttttagtcgttcgtcgtttttgtaggttttgtcgtcggaaagtcgtttattttcgtttttttttttttttttcggtttaagttttttttttttttttttttttttttcgtttattttttttttgttgtcgtttcgggttcgggttatttttcgggtcgggcgtattaaggtgcgcggtttcggggtttagtatatgattcgtcgttttgttatttttcgtttttttcgttttatgtggttgcggggtcgcggcggcgttgtttattatggttcggaaagtagttagtaggaagcggaaagcgttcgtttcgtcgggagttggaaacgacgtttagggttcgtaggtgagggttgagaggtcggtatttgggtggtgaggttgaggaattaagatgggtttagggttt

SEQ ID NO: 34190 - DNA, 529 bp, Artificial Sequence
  chemically treated genomic DNA (Homo sapiens) CpG-island No: 34190
aaaccctaaacccatcttaattcctcaacctcaccacccaaataccgacctctcaaccctcacctacgaaccctaaacgtcgtttccaactcccgacgaaacgaacgctttccgcttcctactaactactttccgaaccataataaacaacgccgccgcgaccccgcaaccacataaaacgaaaaaaacgaaaaataacaaaacgacgaatcatatactaaaccccgaaaccgcgcaccttaatacgcccgacccgaaaaataacccgaacccgaaacgacaacaaaaaaaaaataaacgaaaaaaaaaaaaaaaaaaaaaaaaaacttaaaccgaaaaaaaaaaaaaaaaacgaaaataaacgactttccgacgacaaaacctacaaaaacgacgaacgactaaaaccaaaacacccccttcccctttactcgcgcgccgtcacccttacgcaaccgcacttcgaataacgtcgtcacgaaaacaccgccgaaacgaaataaacgaaatctaaaaattaaaaaataat

SEQ ID NO: 34191 - DNA, 529 bp, Artificial Sequence
  chemically treated genomic DNA (Homo sapiens) CpG-island No: 34191
ggattttaagtttattttggttttttagttttattatttaggtgtcggttttttaatttttatttgcgggttttgagcgtcgtttttagttttcggcgaggcgggcgtttttcgttttttgttaattatttttcgggttatagtgggtagcgtcgtcgcggtttcgtagttatatggggcgggggaagcgaaggatagtaggacggcgggttatatattgggtttcggggtcgcgtattttagtgcgttcggttcggaaaatggttcggattcggagcggtagtagaaaaaagataggcggaaagaaaggaaagagagaggaaggatttgagtcgggaaagggaaggggaagcgagaatgagcggtttttcgacggtagagtttgtaaggacggcgagcggttagaattaaaatattttttttttttttgttcgcgcgtcgttatttttgcgtagtcgtatttcggatagcgtcgttacggaaatatcgtcggaacgagatgggcgggatttaagggttggaagatagt

SEQ ID NO: 34192 - DNA, 529 bp, Artificial Sequence
  chemically treated genomic DNA (Homo sapiens) CpG-island No: 34192
actatcttccaacccttaaatcccgcccatctcgttccgacgatatttccgtaacgacgctatccgaaatacgactacgcaaaaataacgacgcgcgaacaaaaaaaaaaaaaatattttaattctaaccgctcgccgtccttacaaactctaccgtcgaaaaaccgctcattctcgcttccccttccctttcccgactcaaatccttcctctctctttcctttctttccgcctatcttttttctactaccgctccgaatccgaaccattttccgaaccgaacgcactaaaatacgcgaccccgaaacccaatatataacccgccgtcctactatccttcgcttcccccgccccatataactacgaaaccgcgacgacgctacccactataacccgaaaaataattaacaaaaaacgaaaaacgcccgcctcgccgaaaactaaaaacgacgctcaaaacccgcaaataaaaattaaaaaaccgacacctaaataataaaactaaaaaaccaaaataaacttaaaatcc

SEQ ID NO: 34193 - DNA, 1024 bp, Artificial Sequence
  chemically treated genomic DNA (Homo sapiens) CpG-island No: 34193
aggtcgatagttttcgtttaaagttttgtggtttacgttttcggtttcgatcgattacgttattattaaatttcgtgatattttattttatttttaggtttttcgttttaacggtttcgtgttttggaattttttacgtttttgcgtacgcgttttgcggtttttaacgtttcgatttcgtttttttttggttacgtttttgttcgttaagggttttgttattttcgtgacgtatttattttttttcgggtaatttcgtaatagatttttgattggttgatttaggaagcggattttgcgaggcggcggcgacgataggttggtagtcggtcgattttcgtagaaggtgattggtcggcgttgttgtttaatcggcggcgggttgtcggatttaaattcggatcgttgggattgcggtcgttagttttcggcgagttgttgtttgggttggacgtggttttgtttgttgcgttcgtttttcgcgttttcgttttattttttgtagcgcgttagtaggatggtttataagtagatttattattcggataagtatttcgacgaatattacgagtatcggtgggcgttttttttagatttcgagtcggtttttttagtcggggttttcgcgggcggggcgatttaggtatagtagggtcgggggtgggggtcggggtttggggggcggagttcggggtcggagggcgagggtcggggtttggggtcgcggttatttggcgtttcgcgtagtcggatatggttgggtgtttggtcgcgtcgggtcggttgggtttttgttcggtgtgcgcggagggtgagggaagagtgtttatcgggtcgtatttagtatttgggtaggaatcggcgtaatttgggggttatggggttttcggcgacgcggagtgattatttcgttatttttttttcggtcgtggtcgaagtaattaggtcgtttagtagttggttttagttttagttttttgaattagtttaggaaaatttatttggtgtcgttttttttttttta

SEQ ID NO: 34194 - DNA, 1024 bp, Artificial Sequence
  chemically treated genomic DNA (Homo sapiens) CpG-island No: 34194
taaaaaaaaaaaaacgacaccaaataaattttcctaaactaattcaaaaaactaaaactaaaaccaactactaaacgacctaattacttcgaccacgaccgaaaaaaaaataacgaaataatcactccgcgtcgccgaaaaccccataacccccaaattacgccgattcctacccaaatactaaatacgacccgataaacactcttccctcaccctccgcgcacaccgaacaaaaacccaaccgacccgacgcgaccaaacacccaaccatatccgactacgcgaaacgccaaataaccgcgaccccaaaccccgaccctcgccctccgaccccgaactccgccccccaaaccccgacccccacccccgaccctactatacctaaatcgccccgcccgcgaaaaccccgactaaaaaaaccgactcgaaatctaaaaaaaacgcccaccgatactcgtaatattcgtcgaaatacttatccgaataataaatctacttataaaccatcctactaacgcgctacaaaaaataaaacgaaaacgcgaaaaacgaacgcaacaaacaaaaccacgtccaacccaaacaacaactcgccgaaaactaacgaccgcaatcccaacgatccgaatttaaatccgacaacccgccgccgattaaacaacaacgccgaccaatcaccttctacgaaaatcgaccgactaccaacctatcgtcgccgccgcctcgcaaaatccgcttcctaaatcaaccaatcaaaaatctattacgaaattacccgaaaaaaaataaatacgtcacgaaaataacaaaacccttaacgaacaaaaacgtaaccaaaaaaaaacgaaatcgaaacgttaaaaaccgcaaaacgcgtacgcaaaaacgtaaaaaattccaaaacacgaaaccgttaaaacgaaaaacctaaaaataaaataaaatatcacgaaatttaataataacgtaatcgatcgaaaccgaaaacgtaaaccacaaaactttaaacgaaaactatcgacct

SEQ ID NO: 34195 - DNA, 1024 bp, Artificial Sequence
  chemically treated genomic DNA (Homo sapiens) CpG-island No: 34195
taaaggaaaaaggacggtattaggtgggtttttttggattggtttaaagaattggaattgagattagttattgaacggtttaattatttcggttacggtcgagaaaaaagtgacgggatggttatttcgcgtcgtcgaggattttatgatttttaagttgcgtcggtttttatttaggtattaaatgcggttcggtgggtattttttttttatttttcgcgtatatcgaataaaggtttaatcggttcggcgcggttaggtatttaattatgttcgattgcgcggggcgttaggtggtcgcgattttaaatttcggttttcgtttttcggtttcgggtttcgttttttaggtttcggtttttattttcgattttattatgtttgggtcgtttcgttcgcgggggtttcggttgagggagtcggttcggggtttaagaaaggcgtttatcggtattcgtagtgttcgtcgaagtatttgttcgagtagtagatttgtttgtgggttattttgttggcgcgttgtagaaaatgaaacgagagcgcgaagagcgggcgtagtagataaaattacgtttagtttaggtaataattcgtcggagattaacgatcgtagttttaacgattcggatttgaattcgatagttcgtcgtcgattggatagtagcgtcgattaattattttttgcggaagtcggtcggttgttagtttatcgtcgtcgtcgtttcgtaaagttcgttttttgggttagttaattagagatttgttgcgaggttgttcgagggaagataggtacgttacgggggtggtagggtttttaacgggtaggggcgtggttagaggagggcgaagtcgggacgttaagggtcgtagagcgcgtgcgtaggaacgtggaaagttttaggatacggaatcgttgggacggaggatttgaaggtggagtgaggtattacggggtttggtgatgacgtagtcggtcgaggtcggaagcgtgggttatagggttttgagcggaagttgtcgattt

SEQ ID NO: 34196 - DNA, 1024 bp, Artificial Sequence
  chemically treated genomic DNA (Homo sapiens) CpG-island No: 34196
aaatcgacaacttccgctcaaaaccctataacccacgcttccgacctcgaccgactacgtcatcaccaaaccccgtaatacctcactccaccttcaaatcctccgtcccaacgattccgtatcctaaaactttccacgttcctacgcacgcgctctacgacccttaacgtcccgacttcgccctcctctaaccacgcccctacccgttaaaaaccctaccacccccgtaacgtacctatcttccctcgaacaacctcgcaacaaatctctaattaactaacccaaaaaacgaactttacgaaacgacgacgacgataaactaacaaccgaccgacttccgcaaaaaataattaatcgacgctactatccaatcgacgacgaactatcgaattcaaatccgaatcgttaaaactacgatcgttaatctccgacgaattattacctaaactaaacgtaattttatctactacgcccgctcttcgcgctctcgtttcattttctacaacgcgccaacaaaataacccacaaacaaatctactactcgaacaaatacttcgacgaacactacgaataccgataaacgcctttcttaaaccccgaaccgactccctcaaccgaaacccccgcgaacgaaacgacccaaacataataaaatcgaaaataaaaaccgaaacctaaaaaacgaaacccgaaaccgaaaaacgaaaaccgaaatttaaaatcgcgaccacctaacgccccgcgcaatcgaacataattaaatacctaaccgcgccgaaccgattaaacctttattcgatatacgcgaaaaataaaaaaaaaatacccaccgaaccgcatttaatacctaaataaaaaccgacgcaacttaaaaatcataaaatcctcgacgacgcgaaataaccatcccgtcacttttttctcgaccgtaaccgaaataattaaaccgttcaataactaatctcaattccaattctttaaaccaatccaaaaaaacccacctaataccgtcctttttccttta

SEQ ID NO: 34197 - DNA, 589 bp, Artificial Sequence
  chemically treated genomic DNA (Homo sapiens) CpG-island No: 34197
gtgtcgtcgtcgcgtattttcggtcggaagaaagggcgggttttgtcgttttgttgtgacgtattttttggcgtcgtttgcgggggcggaaacgttttgtttgttcggtaagtcgacggttcgttgttggttttcgtgacgcggtttttttcgcgtttcgcggtatggcgtcggaggggtcgcgggagttcgaaagcgaggtaagggtcgacgggggttttttcggtagttttagttcgttcgtttgtttcgtattgggggttcggtcgggcggtgacggggttggtttagcgggcgtgggtcggatgttggtgacggtacgggagcgttttatcgggtggtcgcgattttcgcgtttcgtttcgggttcgttttggggtggcggttagcggttatagatttcgtttatagttagcgtcgcgtttgtggtgcgatgttatttagcgtagtgattgcggtttagttcggcgtttttcgtagtcggggcggggggattttggcgagtttttcgcgtttttgggaacggatagattgttttaaaggattttgcgtttttttgaacgttatttttcgttttacgtatttagta

SEQ ID NO: 34198 - DNA, 589 bp, Artificial Sequence
  chemically treated genomic DNA (Homo sapiens) CpG-island No: 34198
tactaaatacgtaaaacgaaaaataacgttcaaaaaaacgcaaaatcctttaaaacaatctatccgttcccaaaaacgcgaaaaactcgccaaaatccccccgccccgactacgaaaaacgccgaactaaaccgcaatcactacgctaaataacatcgcaccacaaacgcgacgctaactataaacgaaatctataaccgctaaccgccaccccaaaacgaacccgaaacgaaacgcgaaaatcgcgaccacccgataaaacgctcccgtaccgtcaccaacatccgacccacgcccgctaaaccaaccccgtcaccgcccgaccgaacccccaatacgaaacaaacgaacgaactaaaactaccgaaaaaacccccgtcgacccttacctcgctttcgaactcccgcgacccctccgacgccataccgcgaaacgcgaaaaaaaccgcgtcacgaaaaccaacaacgaaccgtcgacttaccgaacaaacaaaacgtttccgcccccgcaaacgacgccaaaaaatacgtcacaacaaaacgacaaaacccgccctttcttccgaccgaaaatacgcgacgacgacac

SEQ ID NO: 34199 - DNA, 589 bp, Artificial Sequence
  chemically treated genomic DNA (Homo sapiens) CpG-island No: 34199
tgttgagtacgtagagcggagaatgacgtttagaaaaacgtaggattttttaaaataatttattcgtttttaagagcgcgggaagttcgttagagttttttcgtttcgattgcggggagcgtcgggttgggtcgtagttattgcgttgggtgatatcgtattatagacgcggcgttaattgtgggcggggtttgtagtcgttgatcgttattttaaggcggattcgaggcggggcgcgaagatcgcggttattcggtagggcgttttcgtgtcgttattagtattcgatttacgttcgttggattagtttcgttatcgttcggtcgagtttttagtgcgaggtaggcggacggattgaggttgtcgagagagttttcgtcggtttttatttcgttttcgggttttcgcggttttttcgacgttatgtcgcgaggcgcggaggaggtcgcgttacggaggttagtagcgggtcgtcggtttgtcggatagataaagcgttttcgttttcgtaggcgacgttaggaagtgcgttatagtaaagcgatagagttcgttttttttttcggtcggaagtacgcggcggcggtat

SEQ ID NO: 34200 - DNA, 589 bp, Artificial Sequence
  chemically treated genomic DNA (Homo sapiens) CpG-island No: 34200
ataccgccgccgcgtacttccgaccgaaaaaaaaaacgaactctatcgctttactataacgcacttcctaacgtcgcctacgaaaacgaaaacgctttatctatccgacaaaccgacgacccgctactaacctccgtaacgcgacctcctccgcgcctcgcgacataacgtcgaaaaaaccgcgaaaacccgaaaacgaaataaaaaccgacgaaaactctctcgacaacctcaatccgtccgcctacctcgcactaaaaactcgaccgaacgataacgaaactaatccaacgaacgtaaatcgaatactaataacgacacgaaaacgccctaccgaataaccgcgatcttcgcgccccgcctcgaatccgccttaaaataacgatcaacgactacaaaccccgcccacaattaacgccgcgtctataatacgatatcacccaacgcaataactacgacccaacccgacgctccccgcaatcgaaacgaaaaaactctaacgaacttcccgcgctcttaaaaacgaataaattattttaaaaaatcctacgtttttctaaacgtcattctccgctctacgtactcaaca

SEQ ID NO: 34201 - DNA, 600 bp, Artificial Sequence
  chemically treated genomic DNA (Homo sapiens) CpG-island No: 34201
gtcgttggcgtgcggcgtttttcgagggggtttgggtagcggttcgtcgtcgggtcggttttttttggcggcgtttatggtcggggcgcggggcgtcgagggcgtattgtcgttcggggcggttaggttgggcgcgttgtagttgttcgagattcgcgcgttcgttcgttttcgggcggtcgacgataggtcgcggaggttcgagttggagagttttaggtgggatattttgtggagtaggtggtttaggttgtcgggtttatcgtcgggcgttttgcgtagcgtttcgtcggatattaagtagggagtcgtcgtcggggtcgcgcgcgtcgtcgaaattttgttttcgtcgtcgtttatcgataggttgtggagaaggttatcgatcgatgttatcgagttatttttgaagcggttatatttggtgcgtggaagtatgttttttcgtgggttcgttgtattcgttcgggcgttgttggtgtcggtttcggcgcgggttgtcgcgtatagtaggcgagttattgttttcggagcgggacggagagtgggggtttcgggatagttttttggagaacgagagtagagtaagaggatggtgtt

SEQ ID NO: 34202 - DNA, 600 bp, Artificial Sequence
  chemically treated genomic DNA (Homo sapiens) CpG-island No: 34202
aacaccatcctcttactctactctcgttctccaaaaaactatcccgaaacccccactctccgtcccgctccgaaaacaataactcgcctactatacgcgacaacccgcgccgaaaccgacaccaacaacgcccgaacgaatacaacgaacccacgaaaaaacatacttccacgcaccaaatataaccgcttcaaaaataactcgataacatcgatcgataaccttctccacaacctatcgataaacgacgacgaaaacaaaatttcgacgacgcgcgcgaccccgacgacgactccctacttaatatccgacgaaacgctacgcaaaacgcccgacgataaacccgacaacctaaaccacctactccacaaaatatcccacctaaaactctccaactcgaacctccgcgacctatcgtcgaccgcccgaaaacgaacgaacgcgcgaatctcgaacaactacaacgcgcccaacctaaccgccccgaacgacaatacgccctcgacgccccgcgccccgaccataaacgccgccaaaaaaaaccgacccgacgacgaaccgctacccaaaccccctcgaaaaacgccgcacgccaacgac

SEQ ID NO: 34203 - DNA, 600 bp, Artificial Sequence
  chemically treated genomic DNA (Homo sapiens) CpG-island No: 34203
ggtattatttttttgttttgttttcgttttttagaaggttgtttcggggtttttatttttcgtttcgtttcggggatagtggttcgtttgttatgcgcggtagttcgcgtcggggtcggtattagtagcgttcgggcggatgtagcgagtttacggaggggtatgtttttacgtattaagtataatcgttttaggaatgattcggtgatatcggtcgatgattttttttatagtttgtcggtgagcggcggcggaggtaaggtttcggcggcgcgcgcgatttcggcggcggttttttatttggtgttcggcgaggcgttgcgtaaggcgttcgacgatgggttcggtagtttgggttatttgttttataaggtgttttatttgaaattttttagttcgggttttcgcggtttgtcgtcggtcgttcgggagcgggcgggcgcgcggatttcgggtagttgtagcgcgtttagtttggtcgtttcggacggtagtgcgttttcggcgtttcgcgtttcggttatgagcgtcgttaggaagggtcggttcggcgacgagtcgttgtttaggttttttcggggggcgtcgtacgttagcgat

SEQ ID NO: 34204 - DNA, 600 bp, Artificial Sequence
  chemically treated genomic DNA (Homo sapiens) CpG-island No: 34204
atcgctaacgtacgacgccccccgaaaaaacctaaacaacgactcgtcgccgaaccgacccttcctaacgacgctcataaccgaaacgcgaaacgccgaaaacgcactaccgtccgaaacgaccaaactaaacgcgctacaactacccgaaatccgcgcgcccgcccgctcccgaacgaccgacgacaaaccgcgaaaacccgaactaaaaaatttcaaataaaacaccttataaaacaaataacccaaactaccgaacccatcgtcgaacgccttacgcaacgcctcgccgaacaccaaataaaaaaccgccgccgaaatcgcgcgcgccgccgaaaccttacctccgccgccgctcaccgacaaactataaaaaaaatcatcgaccgatatcaccgaatcattcctaaaacgattatacttaatacgtaaaaacatacccctccgtaaactcgctacatccgcccgaacgctactaataccgaccccgacgcgaactaccgcgcataacaaacgaaccactatccccgaaacgaaacgaaaaataaaaaccccgaaacaaccttctaaaaaacgaaaacaaaacaaaaaaataatacc

SEQ ID NO: 34205 - DNA, 502 bp, Artificial Sequence
  chemically treated genomic DNA (Homo sapiens) CpG-island No: 34205
gaaatgtatttaagagtgagtcgggttagtcggggttttttttcgaggcgatttttttgtttttgtagatattttcggtattggtcgattggcgggaggattttttcgcgcgtttcgtatatcggtttttgcgcgtattttaatagagcgtagcgttaggagtttagaagcgggcgggacgtttttcgggttttttatagtgttttttttcgatttggggtaggtgagggtcgtaacggggcggttgggacgcgggattgtaaattttatcgtttcgcgtgtttggattcggtcgttcgagggagggtatttattttttatatatttaatatattttagtagttgcgtttttgtagagacgtttcgagggtttattttcgtataggttggggcggagtcggattcgggatggaaaatttggggtaagggatgtaggtgggggtgaggggggtaggagaaggagaaacgtagttggggggcggaggtttaagtatataacgtg

SEQ ID NO: 34206 - DNA, 502 bp, Artificial Sequence
  chemically treated genomic DNA (Homo sapiens) CpG-island No: 34206
cacgttatatacttaaacctccgccccccaactacgtttctccttctcctacccccctcacccccacctacatcccttaccccaaattttccatcccgaatccgactccgccccaacctatacgaaaataaaccctcgaaacgtctctacaaaaacgcaactactaaaatatattaaatatataaaaaataaataccctccctcgaacgaccgaatccaaacacgcgaaacgataaaatttacaatcccgcgtcccaaccgccccgttacgaccctcacctaccccaaatcgaaaaaaaacactataaaaaacccgaaaaacgtcccgcccgcttctaaactcctaacgctacgctctattaaaatacgcgcaaaaaccgatatacgaaacgcgcgaaaaaatcctcccgccaatcgaccaataccgaaaatatctacaaaaacaaaaaaatcgcctcgaaaaaaaaccccgactaacccgactcactcttaaatacatttc

SEQ ID NO: 34207 - DNA, 502 bp, Artificial Sequence
  chemically treated genomic DNA (Homo sapiens) CpG-island No: 34207
tacgttatgtatttaggttttcgttttttaattgcgttttttttttttttgttttttttatttttatttatattttttgttttaggttttttatttcgaattcgatttcgttttaatttatacgaaggtgggttttcgggacgtttttgtaggaacgtagttattggggtatattgggtatataaagagtgggtattttttttcgagcgatcgggtttaggtacgcgggacgatggggtttgtaatttcgcgttttagtcgtttcgttgcggtttttatttgttttaggtcgagaaggggtattgtaagggattcggagggcgtttcgttcgtttttggatttttggcgttgcgttttgttggggtgcgcgtaggagtcggtgtgcggggcgcgcggggaggttttttcgttagtcggttagtgtcgggaatgtttgtagaagtaaaagagtcgtttcggggaggagtttcggttggttcggtttatttttggatgtatttt

SEQ ID NO: 34208 - DNA, 502 bp, Artificial Sequence
  chemically treated genomic DNA (Homo sapiens) CpG-island No: 34208
aaaatacatccaaaaataaaccgaaccaaccgaaactcctccccgaaacgactcttttacttctacaaacattcccgacactaaccgactaacgaaaaaacctccccgcgcgccccgcacaccgactcctacgcgcaccccaacaaaacgcaacgccaaaaatccaaaaacgaacgaaacgccctccgaatcccttacaataccccttctcgacctaaaacaaataaaaaccgcaacgaaacgactaaaacgcgaaattacaaaccccatcgtcccgcgtacctaaacccgatcgctcgaaaaaaaatacccactctttatatacccaatataccccaataactacgttcctacaaaaacgtcccgaaaacccaccttcgtataaattaaaacgaaatcgaattcgaaataaaaaacctaaaacaaaaaatataaataaaaataaaaaaaacaaaaaaaaaaaaaacgcaattaaaaaacgaaaacctaaatacataacgta

SEQ ID NO: 34209 - DNA, 502 bp, Artificial Sequence
  chemically treated genomic DNA (Homo sapiens) CpG-island No: 34209
gaggggcggcgttgatggcgtttttggttttcgaatgttagggggcgttgtgatcgtcgggcggttttttgggcgttgggagtttatcgcgtaagcgtattttggtttttttttagtttttacgtgcgatttttttcggtaattttttcgagaaaaatgtttaaatttaaggcggttcgtggggtggggggttaggaaaaatatgcgtttttggtcgattagattttggttgggaatgcggtgcgggcgggggttcgggagaagcggcggggtcgcgggataggagaagcggaggaagagtatgtggggtttcggttgagtcgacggattttgtagtaagtacggtagtaataggaggaattcgaggtcgagtatgggattggggataagttcgcggcgtcgcgggaacgtattacgcggttgggtgagtgtttgggatgaggttcgaggaagatagtggttagtagtggggcggggtgggtagttaaaaagtgtttggtag

SEQ ID NO: 34210 - DNA, 502 bp, Artificial Sequence
  chemically treated genomic DNA (Homo sapiens) CpG-island No: 34210
ctaccaaacactttttaactacccaccccgccccactactaaccactatcttcctcgaacctcatcccaaacactcacccaaccgcgtaatacgttcccgcgacgccgcgaacttatccccaatcccatactcgacctcgaattcctcctattactaccgtacttactacaaaatccgtcgactcaaccgaaaccccacatactcttcctccgcttctcctatcccgcgaccccgccgcttctcccgaacccccgcccgcaccgcattcccaaccaaaatctaatcgaccaaaaacgcatatttttcctaaccccccaccccacgaaccgccttaaatttaaacatttttctcgaaaaaattaccgaaaaaaatcgcacgtaaaaactaaaaaaaaaccaaaatacgcttacgcgataaactcccaacgcccaaaaaaccgcccgacgatcacaacgccccctaacattcgaaaaccaaaaacgccatcaacgccgcccctc

SEQ ID NO: 34211 - DNA, 502 bp, Artificial Sequence
  chemically treated genomic DNA (Homo sapiens) CpG-island No: 34211
ttgttagatattttttagttgtttatttcgttttattattggttattgtttttttcggattttattttagatatttatttagtcgcgtggtgcgttttcgcggcgtcgcgggtttgtttttagttttatgttcggtttcgagttttttttgttgttgtcgtgtttgttgtaaaattcgtcggtttagtcggggttttatatatttttttttcgttttttttgtttcgcgatttcgtcgtttttttcggattttcgttcgtatcgtatttttagttaggatttgatcggttaggggcgtatgttttttttgattttttattttacgggtcgttttgaatttgggtatttttttcgaaaaagttgtcgggaaggatcgtacgtggggattgaagaaaggttaggatgcgtttgcgcggtggatttttagcgtttaagaggtcgttcggcgattatagcgttttttagtattcggaggttagaagcgttattagcgtcgtttttt

SEQ ID NO: 34212 - DNA, 502 bp, Artificial Sequence
  chemically treated genomic DNA (Homo sapiens) CpG-island No: 34212
aaaaaacgacgctaataacgcttctaacctccgaatactaaaaaacgctataatcgccgaacgacctcttaaacgctaaaaatccaccgcgcaaacgcatcctaacctttcttcaatccccacgtacgatccttcccgacaactttttcgaaaaaaatacccaaattcaaaacgacccgtaaaataaaaaatcaaaaaaaacatacgcccctaaccgatcaaatcctaactaaaaatacgatacgaacgaaaatccgaaaaaaacgacgaaatcgcgaaacaaaaaaaacgaaaaaaaaatatataaaaccccgactaaaccgacgaattttacaacaaacacgacaacaacaaaaaaaactcgaaaccgaacataaaactaaaaacaaacccgcgacgccgcgaaaacgcaccacgcgactaaataaatatctaaaataaaatccgaaaaaaacaataaccaataataaaacgaaataaacaactaaaaaatatctaacaa

SEQ ID NO: 34213 - DNA, 515 bp, Artificial Sequence
  chemically treated genomic DNA (Homo sapiens) CpG-island No: 34213
tcggtcgtcgaggtcgtatatttttttttaattttatgggggcgtttcgtgcgtcgcgtatttattagcgttgtaggtcgttagattcgtatcggggttcgggtttttacgttttttcggtcgtattttttgtatagtgtttacgttattgtagtagggaagatttagagggttggtttttgttgcgtttagtttcgcgtttttggtcgtcgcggttgtagcggtcgtcgttgttacgtcggtatggttgaagtgtgcggggtattcgttttgtagtagcgtttcgaagtgtaagcggtagtagattaggttgttttttatgtcgaagtggtcgttcgtggttagtattttgttatacgtggtgtacgtgaagtagttgaggtgataaattaagtttcgagcgcgtattattattttcgaggtcgagatgtttaggtggtagcgggcgtagcgttgtatagagaagcgtttgtagggattatggagggaggggttgtggaaatatacggttgggt

SEQ ID NO: 34214 - DNA, 515 bp, Artificial Sequence
  chemically treated genomic DNA (Homo sapiens) CpG-island No: 34214
acccaaccgtatatttccacaacccctccctccataatccctacaaacgcttctctatacaacgctacgcccgctaccacctaaacatctcgacctcgaaaataataatacgcgctcgaaacttaatttatcacctcaactacttcacgtacaccacgtataacaaaatactaaccacgaacgaccacttcgacataaaaaacaacctaatctactaccgcttacacttcgaaacgctactacaaaacgaataccccgcacacttcaaccataccgacgtaacaacgacgaccgctacaaccgcgacgaccaaaaacgcgaaactaaacgcaacaaaaaccaaccctctaaatcttccctactacaataacgtaaacactatacaaaaaatacgaccgaaaaaacgtaaaaacccgaaccccgatacgaatctaacgacctacaacgctaataaatacgcgacgcacgaaacgcccccataaaattaaaaaaaaatatacgacctcgacgaccga

SEQ ID NO: 34215 - DNA, 515 bp, Artificial Sequence
  chemically treated genomic DNA (Homo sapiens) CpG-island No: 34215
atttaatcgtgtgtttttatagtttttttttttatggtttttataggcgtttttttgtgtagcgttgcgttcgttgttatttgggtatttcggtttcggagatggtgatgcgcgttcgggatttggtttattattttaattgttttacgtgtattacgtgtaataagatgttgattacgggcgattatttcggtatgaaggatagtttggtttattgtcgtttgtatttcgaggcgttgttgtagggcgagtatttcgtatattttaattatgtcgacgtggtagcggcggtcgttgtagtcgcggcggttaagagcgcggggttgggcgtagtaggggttaattttttgggttttttttattataatggcgtgggtattgtgtagaaggtgcggtcgaggaaacgtaagagttcgggtttcggtgcggatttggcggtttataacgttggtgagtgcgcggcgtacgaagcgtttttatagggttgggggaaagtgtgcggtttcgacggtcgg

SEQ ID NO: 34216 - DNA, 515 bp, Artificial Sequence
  chemically treated genomic DNA (Homo sapiens) CpG-island No: 34216
ccgaccgtcgaaaccgcacactttcccccaaccctataaaaacgcttcgtacgccgcgcactcaccaacgttataaaccgccaaatccgcaccgaaacccgaactcttacgtttcctcgaccgcaccttctacacaatacccacgccattataataaaaaaaacccaaaaaattaacccctactacgcccaaccccgcgctcttaaccgccgcgactacaacgaccgccgctaccacgtcgacataattaaaatatacgaaatactcgccctacaacaacgcctcgaaatacaaacgacaataaaccaaactatccttcataccgaaataatcgcccgtaatcaacatcttattacacgtaatacacgtaaaacaattaaaataataaaccaaatcccgaacgcgcatcaccatctccgaaaccgaaatacccaaataacaacgaacgcaacgctacacaaaaaaacgcctataaaaaccataaaaaaaaaaactataaaaacacacgattaaat

SEQ ID NO: 34217 - DNA, 667 bp, Artificial Sequence
  chemically treated genomic DNA (Homo sapiens) CpG-island No: 34217
ggcggcgagttttatgcggttttgtacgtttaggtatttttgtcgttcgaagttgcgttttagttgcgttagttgatggtcggtgaaggtcgtgcgcgttttgcgtggtttttttaggcgtatcgggggattgtttttggagttggagatttcgcggtcgttttttttttttattgcggatatagcggtatgttagggttcggtttcgtagtcgtcgtcggtgttttttcgtttttgttcgtggcgtttgtgtaatttcggttttcgatagcggtggtttcgcgatatttaagttcgcgggggtcgtttttagacgggatttttggggtttcgggaataggatatgaattttgaggggaataggacggcggcgggagcgttcgaggtcgagatttttcgggtagtttcggggagaaagaattcgaagttggcgagaattttagtttttgcgtcgcgttcggcgttttgttcgcgttttttggagggataaacggagtcgcgacgatggaatcggatttagtttgttagcgtaggggaagggatttagggtttttggcggagtgagtttcgcgtttgggttttagttttttcggttgcgttcgtgataggaagggaggaagtcgaaggttggggtttggggagagaaatttgcgtggagggataaaaa

SEQ ID NO: 34218 - DNA, 667 bp, Artificial Sequence
  chemically treated genomic DNA (Homo sapiens) CpG-island No: 34218
tttttatccctccacgcaaatttctctccccaaaccccaaccttcgacttcctcccttcctatcacgaacgcaaccgaaaaaactaaaacccaaacgcgaaactcactccgccaaaaaccctaaatcccttcccctacgctaacaaactaaatccgattccatcgtcgcgactccgtttatccctccaaaaaacgcgaacaaaacgccgaacgcgacgcaaaaactaaaattctcgccaacttcgaattctttctccccgaaactacccgaaaaatctcgacctcgaacgctcccgccgccgtcctattcccctcaaaattcatatcctattcccgaaaccccaaaaatcccgtctaaaaacgacccccgcgaacttaaatatcgcgaaaccaccgctatcgaaaaccgaaattacacaaacgccacgaacaaaaacgaaaaaacaccgacgacgactacgaaaccgaaccctaacataccgctatatccgcaataaaaaaaaaaaacgaccgcgaaatctccaactccaaaaacaatcccccgatacgcctaaaaaaaccacgcaaaacgcgcacgaccttcaccgaccatcaactaacgcaactaaaacgcaacttcgaacgacaaaaatacctaaacgtacaaaaccgcataaaactcgccgcc

SEQ ID NO: 34219 - DNA, 667 bp, Artificial Sequence
  chemically treated genomic DNA (Homo sapiens) CpG-island No: 34219
tttttgtttttttacgtaggtttttttttttagattttagttttcggttttttttttttttgttacggacgtagtcggagaaattggggtttagacgcggagtttatttcgttagaaattttgggtttttttttttacgttggtaggttgggttcggttttatcgtcgcggtttcgtttatttttttagggagcgcgggtagagcgtcgagcgcggcgtagggattggagttttcgttagtttcgggtttttttttttcggagttgttcggggggtttcggtttcgggcgttttcgtcgtcgttttgttttttttagggtttatgttttgttttcggggttttagaggtttcgtttgagagcggttttcgcgagtttgggtgtcgcggaattatcgttgtcggaagtcgaggttatataaacgttacgggtaggagcgggagggtatcggcggcggttgcgaggtcgggttttgatatgtcgttgtgttcgtagtgaaggaggagggcgatcgcgagatttttagttttagggatagtttttcggtgcgtttgaaaaagttacgtaaggcgcgtacggtttttatcgattattagttggcgtagttggagcgtagtttcgagcggtagaagtatttgagcgtgtaggatcgtatggagttcgtcgtt

SEQ ID NO: 34220 - DNA, 667 bp, Artificial Sequence
  chemically treated genomic DNA (Homo sapiens) CpG-island No: 34220
aacgacgaactccatacgatcctacacgctcaaatacttctaccgctcgaaactacgctccaactacgccaactaataatcgataaaaaccgtacgcgccttacgtaactttttcaaacgcaccgaaaaactatccctaaaactaaaaatctcgcgatcgccctcctccttcactacgaacacaacgacatatcaaaacccgacctcgcaaccgccgccgataccctcccgctcctacccgtaacgtttatataacctcgacttccgacaacgataattccgcgacacccaaactcgcgaaaaccgctctcaaacgaaacctctaaaaccccgaaaacaaaacataaaccctaaaaaaaacaaaacgacgacgaaaacgcccgaaaccgaaaccccccgaacaactccgaaaaaaaaaaacccgaaactaacgaaaactccaatccctacgccgcgctcgacgctctacccgcgctccctaaaaaaataaacgaaaccgcgacgataaaaccgaacccaacctaccaacgtaaaaaaaaaaacccaaaatttctaacgaaataaactccgcgtctaaaccccaatttctccgactacgtccgtaacaaaaaaaaaaaaaaccgaaaactaaaatctaaaaaaaaaaacctacgtaaaaaaacaaaaa

SEQ ID NO: 34221 - DNA, 532 bp, Artificial Sequence
  chemically treated genomic DNA (Homo sapiens) CpG-island No: 34221
ggggtttgcgggggaaatgaggaatacgcgggaatggaaatggggaaagaaaaagaggagcggaaaagggcgggcgacgagaataacggggggataaagcggggaacgggggagcgcgggggaagggagggaataataagcggggtggggagggaggtaaaaagtggagaagggtgcgagtaggcgttagacgggggcggtgggtggggatatggaagagtgtgcgaaaggtgtcgtacgagtaattgtcggatggtgggtgggatatgtcggggcgggggtacggaaagaaatatgtgggggaataaacgggggtcgggggggggaagaaaaaaagggggaaggggggcggggcggtatagtggggggttgaacgggaacgggtcgtgattttgcggatatgggggcgaaagaaaggcgtatttttcgttacgtagggatttaggggtgttataatcggagtgtgtacggtttttttttaaaaaaggggagttcgttgttagttcgatttatattttttttttttttttat

SEQ ID NO: 34222 - DNA, 532 bp, Artificial Sequence
  chemically treated genomic DNA (Homo sapiens) CpG-island No: 34222
ataaaaaaaaaaaaaaaatataaatcgaactaacaacgaactccccttttttaaaaaaaaaccgtacacactccgattataacacccctaaatccctacgtaacgaaaaatacgcctttctttcgcccccatatccgcaaaatcacgacccgttcccgttcaaccccccactataccgccccgccccccttccccctttttttcttcccccccccgacccccgtttattcccccacatatttctttccgtacccccgccccgacatatcccacccaccatccgacaattactcgtacgacacctttcgcacactcttccatatccccacccaccgcccccgtctaacgcctactcgcacccttctccactttttacctccctccccaccccgcttattattccctcccttcccccgcgctcccccgttccccgctttatccccccgttattctcgtcgcccgcccttttccgctcctctttttctttccccatttccattcccgcgtattcctcatttcccccgcaaacccc

SEQ ID NO: 34223 - DNA, 532 bp, Artificial Sequence
  chemically treated genomic DNA (Homo sapiens) CpG-island No: 34223
gtgaaaggggaggaaaagtatgagtcggattaataacgggttttttttttttgggggggggtcgtatatatttcgattataatatttttaaatttttgcgtggcgagaaatgcgtttttttttcgtttttatattcgtagaattacgattcgttttcgtttaattttttattatatcgtttcgtttttttttttttttttttttttttttttttcgattttcgtttgtttttttatatattttttttcgtattttcgtttcgatatattttatttattattcggtaattattcgtacgatatttttcgtatatttttttatatttttatttatcgttttcgtttaacgtttgttcgtatttttttttattttttgtttttttttttatttcgtttattatttttttttttttttcgcgttttttcgtttttcgttttattttttcgttattttcgtcgttcgttttttttcgtttttttttttttttttttatttttattttcgcgtattttttatttttttcgtaagtttt

SEQ ID NO: 34224 - DNA, 532 bp, Artificial Sequence
  chemically treated genomic DNA (Homo sapiens) CpG-island No: 34224
aaaacttacgaaaaaaataaaaaatacgcgaaaataaaaataaaaaaaaaaaaaaaaaaacgaaaaaaaacgaacgacgaaaataacgaaaaaataaaacgaaaaacgaaaaaacgcgaaaaaaaaaaaaaaataataaacgaaataaaaaaaaaaacaaaaaataaaaaaaaatacgaacaaacgttaaacgaaaacgataaataaaaatataaaaaaatatacgaaaaatatcgtacgaataattaccgaataataaataaaatatatcgaaacgaaaatacgaaaaaaaatatataaaaaaacaaacgaaaatcgaaaaaaaaaaaaaaaaaaaaaaaaaaaaaaacgaaacgatataataaaaaattaaacgaaaacgaatcgtaattctacgaatataaaaacgaaaaaaaaacgcatttctcgccacgcaaaaatttaaaaatattataatcgaaatatatacgacccccccccaaaaaaaaaaaacccgttattaatccgactcatacttttcctcccctttcac

SEQ ID NO: 34225 - DNA, 992 bp, Artificial Sequence
  chemically treated genomic DNA (Homo sapiens) CpG-island No: 34225
ttcgggtttcgcgtcgcgtttttcgatcgttttcggtagcgagcgaggtagggagcgcggagttagtatcgttcgtcggattttatcgtcgagtttcgcgtcgcgtcggttggagtcgtcgttttcgttgtcgtcgtcgtcgtcgttcgttttgtatcggttttttagcgttcggcggttttaatttttttatttttttttttttttcgcgcgttttttttttttttttttcgtttatgtgatcgcgggcgttcgttcggtcgcgcgcgttttcgttttttttttttttttgttttgttttttcgcgttttcgcggtcgcgcgttacgattttttttcgttacgggtttcgcgcgttttcgttttggtacgttttcgtttttggtatacgcggttcgttcgttttgcgcgggtttgtgagtttttatttttattcgtttagtattggtacgcgttttgttttttcgttggtatattcgttcgtattggtacgcgtggttttttcgcgtttattttttttcgggcgcgtttttaagacggttgtggttttcgtgttttacgcgtagtttcggtcgcgggtttcgtaaacgcgcgcgcgtatatatatatatatatatatttattcggttcgtttttttagggcggttgggcgcgtatttattttcgggatcgtttttttatatttattttttttttcggttttagttaggttttttttgcgtatattttcgtacgtttaggttttgacggtttcgtatcgattttttggtatatttcgggttaattttcggggtttttttttcggcgtcgtcgtgagaggaacgcgagttagaatttttaatttttattttgggtagaagaagttagtcggtttcgttttttttttattgttattgtttttcgtaacgatttttttttcggttattttttcgcgcgggggaaaggggtttttttgatcggggatggattttgtcgggagtttaggtttatgtt

SEQ ID NO: 34226 - DNA, 992 bp, Artificial Sequence
  chemically treated genomic DNA (Homo sapiens) CpG-island No: 34226
aacataaacctaaactcccgacaaaatccatccccgatcaaaaaaacccctttcccccgcgcgaaaaaataaccgaaaaaaaaatcgttacgaaaaacaataacaataaaaaaaaaacgaaaccgactaacttcttctacccaaaataaaaattaaaaattctaactcgcgttcctctcacgacgacgccgaaaaaaaaaccccgaaaattaacccgaaatataccaaaaaatcgatacgaaaccgtcaaaacctaaacgtacgaaaatatacgcaaaaaaaacctaactaaaaccgaaaaaaaaaataaatataaaaaaacgatcccgaaaataaatacgcgcccaaccgccctaaaaaaacgaaccgaataaatatatatatatatatatatacgcgcgcgcgtttacgaaacccgcgaccgaaactacgcgtaaaacacgaaaaccacaaccgtcttaaaaacgcgcccgaaaaaaaataaacgcgaaaaaaccacgcgtaccaatacgaacgaatataccaacgaaaaaacaaaacgcgtaccaatactaaacgaataaaaataaaaactcacaaacccgcgcaaaacgaacgaaccgcgtataccaaaaacgaaaacgtaccaaaacgaaaacgcgcgaaacccgtaacgaaaaaaaatcgtaacgcgcgaccgcgaaaacgcgaaaaaacaaaacaaaaaaaaaaaaaaaacgaaaacgcgcgcgaccgaacgaacgcccgcgatcacataaacgaaaaaaaaaaaaaaaaaacgcgcgaaaaaaaaaaaaaaataaaaaaattaaaaccgccgaacgctaaaaaaccgatacaaaacgaacgacgacgacgacgacaacgaaaacgacgactccaaccgacgcgacgcgaaactcgacgataaaatccgacgaacgatactaactccgcgctccctacctcgctcgctaccgaaaacgatcgaaaaacgcgacgcgaaacccgaa

SEQ ID NO: 34227 - DNA, 992 bp, Artificial Sequence
  chemically treated genomic DNA (Homo sapiens) CpG-island No: 34227
ggtatgggtttgggttttcggtagggtttattttcggttaaggaagtttttttttttcgcgcgagggggtgatcgggaggggagtcgttgcggggggtagtagtaataggggagaggcggagtcggttggttttttttgtttaaagtgggggttgggggttttggttcgcgttttttttacggcgacgtcggagggaggatttcgagagttggttcggggtgtgttagggagtcggtgcgaggtcgttagggtttgaacgtgcgggagtgtgcgtaggagagatttggttaaggtcgagagggagagtgagtgtgaaggagcgatttcgggggtgagtgcgcgtttagtcgttttaggggagcgggtcgagtgggtgtgtgtgtgtgtgtgtgtgcgcgcgcgcgtttgcgagattcgcggtcggggttgcgcgtgaagtacggggattatagtcgttttgagggcgcgttcgagaaagggtgaacgcgagggggttacgcgtgttagtgcggacgagtgtgttagcgggggggtagagcgcgtgttagtgttgggcgagtgggagtgggggtttataggttcgcgtagggcgagcggatcgcgtgtgttaggagcgagagcgtgttaaggcgggggcgcgcggggttcgtggcggggaggggtcgtggcgcgcggtcgcggaggcgcggggagataaggtaagagggggaggggagcgagggcgcgcgcggtcgagcgggcgttcgcggttatatgggcgagagaaggagggagggagcgcgcgagggagggaggaggatgggggggttaaagtcgtcgagcgttgaagagtcggtgtagagcgggcggcggcggcggcggtagcggaggcggcggttttagtcggcgcggcgcgaggttcggcggtgggattcggcgggcggtgttagtttcgcgttttttgtttcgttcgttgtcgggggcggtcggaaggcgcggcgcgaagttcggg

SEQ ID NO: 34228 - DNA, 992 bp, Artificial Sequence
  chemically treated genomic DNA (Homo sapiens) CpG-island No: 34228
cccgaacttcgcgccgcgccttccgaccgcccccgacaacgaacgaaacaaaaaacgcgaaactaacaccgcccgccgaatcccaccgccgaacctcgcgccgcgccgactaaaaccgccgcctccgctaccgccgccgccgccgcccgctctacaccgactcttcaacgctcgacgactttaacccccccatcctcctccctccctcgcgcgctccctccctccttctctcgcccatataaccgcgaacgcccgctcgaccgcgcgcgccctcgctcccctccccctcttaccttatctccccgcgcctccgcgaccgcgcgccacgacccctccccgccacgaaccccgcgcgcccccgccttaacacgctctcgctcctaacacacgcgatccgctcgccctacgcgaacctataaacccccactcccactcgcccaacactaacacgcgctctacccccccgctaacacactcgtccgcactaacacgcgtaaccccctcgcgttcaccctttctcgaacgcgccctcaaaacgactataatccccgtacttcacgcgcaaccccgaccgcgaatctcgcaaacgcgcgcgcgcacacacacacacacacacacccactcgacccgctcccctaaaacgactaaacgcgcactcacccccgaaatcgctccttcacactcactctccctctcgaccttaaccaaatctctcctacgcacactcccgcacgttcaaaccctaacgacctcgcaccgactccctaacacaccccgaaccaactctcgaaatcctccctccgacgtcgccgtaaaaaaaacgcgaaccaaaacccccaacccccactttaaacaaaaaaaaccaaccgactccgcctctcccctattactactaccccccgcaacgactcccctcccgatcaccccctcgcgcgaaaaaaaaaaacttccttaaccgaaaataaaccctaccgaaaacccaaacccatacc

SEQ ID NO: 34229 - DNA, 511 bp, Artificial Sequence
  chemically treated genomic DNA (Homo sapiens) CpG-island No: 34229
gcgtacgaaggatttttcgtaggttgttcgtcgcgtcgaatttaggtcgtttggttcgaacgtaggttaaggcggaggcgtttaggttgtttttcggtttcggagttttatagtattaagttcggatcgtaggatacgggcgcgcgttcgggttcgcgtatatttatcgttcgcgtcgtcgtcgtcgtcgtcgtcgttatttcgggacgcggaaggtcgggggcgtcgagtttttaatgtcgtagtttttgggtatcgtagtttcgcgtttagtacgtttttcgcgtcgcgttgcgtcgtttttacgggttcgtttttcgttcggtcggtttcgttcggtcgtttaatttcgaggagtcgttcgtcggattcgttttggggttaagagggaacgcgtttttcgggttcgcggcggagcggagttggaggtcgcgttttattagtcgagcgttttttcgggacgtcggaaggagttttcgcgcggagtcgattacgtgtacggtattttggg

SEQ ID NO: 34230 - DNA, 511 bp, Artificial Sequence
  chemically treated genomic DNA (Homo sapiens) CpG-island No: 34230
cccaaaataccgtacacgtaatcgactccgcgcgaaaactccttccgacgtcccgaaaaaacgctcgactaataaaacgcgacctccaactccgctccgccgcgaacccgaaaaacgcgttccctcttaaccccaaaacgaatccgacgaacgactcctcgaaattaaacgaccgaacgaaaccgaccgaacgaaaaacgaacccgtaaaaacgacgcaacgcgacgcgaaaaacgtactaaacgcgaaactacgatacccaaaaactacgacattaaaaactcgacgcccccgaccttccgcgtcccgaaataacgacgacgacgacgacgacgacgcgaacgataaatatacgcgaacccgaacgcgcgcccgtatcctacgatccgaacttaatactataaaactccgaaaccgaaaaacaacctaaacgcctccgccttaacctacgttcgaaccaaacgacctaaattcgacgcgacgaacaacctacgaaaaatccttcgtacgc

SEQ ID NO: 34231 - DNA, 511 bp, Artificial Sequence
  chemically treated genomic DNA (Homo sapiens) CpG-island No: 34231
tttaagatgtcgtgtacgtggtcggtttcgcgcggaggtttttttcggcgtttcgggggggcgttcggttgatgaaacgcggtttttagtttcgtttcgtcgcgggttcgggaggcgcgtttttttttggttttaaagcgagttcggcgggcggtttttcggggttgggcgatcgagcggggtcggtcgggcggggggcgggttcgtgaaggcggcgtagcgcggcgcgggaggcgtgttgggcgcggggttgcggtgtttagaggttgcggtattaggggttcggcgttttcgatttttcgcgtttcggggtggcggcggcggcggcggcggcggcgcgggcggtgagtgtgcgcgggttcgggcgcgcgttcgtgttttgcgattcgggtttggtgttgtggggtttcggggtcgggaagtagtttgggcgttttcgttttggtttgcgttcgggttagacggtttgggttcggcgcggcgggtagtttgcggggggtttttcgtgcgt

SEQ ID NO: 34232 - DNA, 511 bp, Artificial Sequence
  chemically treated genomic DNA (Homo sapiens) CpG-island No: 34232
acgcacgaaaaaccccccgcaaactacccgccgcgccgaacccaaaccgtctaacccgaacgcaaaccaaaacgaaaacgcccaaactacttcccgaccccgaaaccccacaacaccaaacccgaatcgcaaaacacgaacgcgcgcccgaacccgcgcacactcaccgcccgcgccgccgccgccgccgccgccgccaccccgaaacgcgaaaaatcgaaaacgccgaacccctaataccgcaacctctaaacaccgcaaccccgcgcccaacacgcctcccgcgccgcgctacgccgccttcacgaacccgccccccgcccgaccgaccccgctcgatcgcccaaccccgaaaaaccgcccgccgaactcgctttaaaaccaaaaaaaaacgcgcctcccgaacccgcgacgaaacgaaactaaaaaccgcgtttcatcaaccgaacgcccccccgaaacgccgaaaaaaacctccgcgcgaaaccgaccacgtacacgacatcttaaa

SEQ ID NO: 34233 - DNA, 578 bp, Artificial Sequence
  chemically treated genomic DNA (Homo sapiens) CpG-island No: 34233
cggcgagaggcgagatttcggttcgttcggttttttattttttcgttggtagtgtcgtcgtttatttttattaggaagggtcgttggtgcggacggtcggttttcggcgcggggttttcgtagttttcgtttttcgtcgaagttatttcggttttcgttttcgcgtatcgggttttcgcgttcgttttttttttaggttcggcgcgttcgtttagcgtcgaggtcggaggtaatcggagcgattattttcgggaggcgcgcggggtacgtcgggagttgtagtttatcgggggggggggggtcgcgtatgcgtgagggtgtagggttcgaggtcggtatattaggagcgttcgcgttttattgcgtcgaaagttggttggtagggattgttgcgttcgggtttcgagtcggttataaggttttagatttaagtggttcggaaggtgttcgtttcgtatttcgaggttggggttgcgttttcgttcgagtgtttgtttttgtttcgcgttgtttttgcgttagtttcgggttttttttcggtcgttttcgggtttggttttttttagtttaggtttttt

SEQ ID NO: 34234 - DNA, 578 bp, Artificial Sequence
  chemically treated genomic DNA (Homo sapiens) CpG-island No: 34234
aaaaaacctaaactaaaaaaaaccaaacccgaaaacgaccgaaaaaaaacccgaaactaacgcaaaaacaacgcgaaacaaaaacaaacactcgaacgaaaacgcaaccccaacctcgaaatacgaaacgaacaccttccgaaccacttaaatctaaaaccttataaccgactcgaaacccgaacgcaacaatccctaccaaccaactttcgacgcaataaaacgcgaacgctcctaatataccgacctcgaaccctacaccctcacgcatacgcgacccccccccccccgataaactacaactcccgacgtaccccgcgcgcctcccgaaaataatcgctccgattacctccgacctcgacgctaaacgaacgcgccgaacctaaaaaaaaaacgaacgcgaaaacccgatacgcgaaaacgaaaaccgaaataacttcgacgaaaaacgaaaactacgaaaaccccgcgccgaaaaccgaccgtccgcaccaacgacccttcctaataaaaataaacgacgacactaccaacgaaaaaataaaaaaccgaacgaaccgaaatctcgcctctcgccg

SEQ ID NO: 34235 - DNA, 578 bp, Artificial Sequence
  chemically treated genomic DNA (Homo sapiens) CpG-island No: 34235
gaggagtttgggttggagggggttaggttcgggggcggtcgggggagggttcgggattggcgtagaggtagcgcgaggtagaggtaagtattcggacgaaggcgtagttttagtttcggggtgcggaacgggtatttttcgggttatttgagtttgagattttgtagtcggttcgaggttcgggcgtagtagtttttgttagttagttttcggcgtaatgggacgcgggcgtttttggtgtgtcggtttcgggttttgtatttttacgtatgcgcggttttttttttttcggtggattataattttcggcgtgtttcgcgcgtttttcggaagtgatcgtttcggttgttttcgatttcggcgttgggcgggcgcgtcgggtttggggaaggggcgggcgcggggattcgatgcgcgggagcggaggtcgagatggtttcggcgggaggcgaagattgcgagagtttcgcgtcggaggtcgatcgttcgtattagcggttttttttgataggggtgagcggcggtattgttagcgggaaggtaaggggtcgagcgggtcggggtttcgtttttcgtcg

SEQ ID NO: 34236 - DNA, 578 bp, Artificial Sequence
  chemically treated genomic DNA (Homo sapiens) CpG-island No: 34236
cgacgaaaaacgaaaccccgacccgctcgaccccttaccttcccgctaacaataccgccgctcacccctatcaaaaaaaaccgctaatacgaacgatcgacctccgacgcgaaactctcgcaatcttcgcctcccgccgaaaccatctcgacctccgctcccgcgcatcgaatccccgcgcccgccccttccccaaacccgacgcgcccgcccaacgccgaaatcgaaaacaaccgaaacgatcacttccgaaaaacgcgcgaaacacgccgaaaattataatccaccgaaaaaaaaaaaaccgcgcatacgtaaaaatacaaaacccgaaaccgacacaccaaaaacgcccgcgtcccattacgccgaaaactaactaacaaaaactactacgcccgaacctcgaaccgactacaaaatctcaaactcaaataacccgaaaaatacccgttccgcaccccgaaactaaaactacgccttcgtccgaatacttacctctacctcgcgctacctctacgccaatcccgaaccctcccccgaccgcccccgaacctaaccccctccaacccaaactcctc

SEQ ID NO: 34237 - DNA, 559 bp, Artificial Sequence
  chemically treated genomic DNA (Homo sapiens) CpG-island No: 34237
taatcgtagcgtagttaggcggcggggcggtgtcggtcgaatttagattcgaggttttagaagtagagttaggcgaagttgggttagaatcgcgattttcgtaattttgagcggtattcgtggagtgcgtttgcgtagttacgatcgtagtaggaaagcgtcgtcggttaggtttagttgtggtcggatagggattggaagagaggacgcggtcgagtaggtgtgtattagttttggtaacgagagcgtttatttcgaattttgttggttttgaggtggggaagtcggggagggtagttgaggatttcgcggaggcgcgtgattggttgagcgggtaggttagttttcgagtcgggtggatataggtatcgtagttaggtcgcgtcgcgtcgatttagggtttggttcggttagatagggaagtttagttttcgtacgttagatagcggtatttttgttggcgttatcgtaaatattttttgatcgttatagttagtgtgtggcgtaggcgttatgttttcggttttgttacgtttggagttttggaagttggttgtag

SEQ ID NO: 34238 - DNA, 559 bp, Artificial Sequence
  chemically treated genomic DNA (Homo sapiens) CpG-island No: 34238
ctacaaccaacttccaaaactccaaacgtaacaaaaccgaaaacataacgcctacgccacacactaactataacgatcaaaaaatatttacgataacgccaacaaaaataccgctatctaacgtacgaaaactaaacttccctatctaaccgaaccaaaccctaaatcgacgcgacgcgacctaactacgatacctatatccacccgactcgaaaactaacctacccgctcaaccaatcacgcgcctccgcgaaatcctcaactaccctccccgacttccccacctcaaaaccaacaaaattcgaaataaacgctctcgttaccaaaactaatacacacctactcgaccgcgtcctctcttccaatccctatccgaccacaactaaacctaaccgacgacgctttcctactacgatcgtaactacgcaaacgcactccacgaataccgctcaaaattacgaaaatcgcgattctaacccaacttcgcctaactctacttctaaaacctcgaatctaaattcgaccgacaccgccccgccgcctaactacgctacgatta

SEQ ID NO: 34239 - DNA, 559 bp, Artificial Sequence
  chemically treated genomic DNA (Homo sapiens) CpG-island No: 34239
ttgtagttagtttttagggttttaggcgtggtagggtcggggatatgacgtttgcgttatatattggttgtagcggttagaggatgtttgcggtgacgttagtaggagtatcgttgtttggcgtgcggggattgagtttttttgtttggtcgggttaggttttgagtcggcgcggcgcggtttggttgcggtatttgtgtttattcggttcggaggttggtttgttcgtttaattagttacgcgttttcgcggggtttttaattgtttttttcggtttttttattttaaggttagtagagttcggggtagacgttttcgttgttagggttggtgtatatttattcgatcgcgtttttttttttagtttttgttcggttatagttgggtttggtcggcggcgtttttttgttgcggtcgtagttgcgtaggcgtattttacggatgtcgtttaaggttgcggaggtcgcggttttggtttagtttcgtttgattttgtttttaaaatttcgggtttgggttcggtcggtatcgtttcgtcgtttggttgcgttgcgattg

SEQ ID NO: 34240 - DNA, 559 bp, Artificial Sequence
  chemically treated genomic DNA (Homo sapiens) CpG-island No: 34240
caatcgcaacgcaaccaaacgacgaaacgataccgaccgaacccaaacccgaaattttaaaaacaaaatcaaacgaaactaaaccaaaaccgcgacctccgcaaccttaaacgacatccgtaaaatacgcctacgcaactacgaccgcaacaaaaaaacgccgccgaccaaacccaactataaccgaacaaaaactaaaaaaaaaaacgcgatcgaataaatatacaccaaccctaacaacgaaaacgtctaccccgaactctactaaccttaaaataaaaaaaccgaaaaaaacaattaaaaaccccgcgaaaacgcgtaactaattaaacgaacaaaccaacctccgaaccgaataaacacaaataccgcaaccaaaccgcgccgcgccgactcaaaacctaacccgaccaaacaaaaaaactcaatccccgcacgccaaacaacgatactcctactaacgtcaccgcaaacatcctctaaccgctacaaccaatatataacgcaaacgtcatatccccgaccctaccacgcctaaaaccctaaaaactaactacaa

SEQ ID NO: 34241 - DNA, 732 bp, Artificial Sequence
  chemically treated genomic DNA (Homo sapiens) CpG-island No: 34241
tttcgtttttgtaaaagtggtagaaaaatcggtgggcggttatagcggcgttcgagttcgtttcggtcgtcgaagttttcgttatttttgtttttcgtcgcggtcgttcgagagggtagtcggttcgtttttcgttaggtcgttatttttcgagttgtagtcgtcgtcgtcgtcgtcgtttcggtgcggtttatcgttttagagttcgcgtcggttacgtgagttggttaggtttagaaacgcggcggcgttaatagttattttgcggttcgttttttagtattaaagaggcgtaggaaggagagataaacggttcgttcgtcggttttataaatagtttttcgttggttttttagttttttagcgagaagaaagaaagagcgttttcggaagtcgtcgaaattttggggtagagtggtacgcgttttttgttttttcgcgtttttttcggtggcgattcgcgttttagaaagggcggtgggttttatttcggtttagaaggttagcgggagtcgtaggaagtcgtcgcgggaagtttagtcgaattggagttggagttttcggattgcgttgattttgaggttagtggaaaatgttgtttgaacgtggcggtattgattggattaagagattacgttcgaaacgggaatttgtgtaaaggaagtgtagagttaggagttaagcgttttggaagtttttttcgaggatggtaaaggatttgggaatgttttt

SEQ ID NO: 34242 - DNA, 732 bp, Artificial Sequence
  chemically treated genomic DNA (Homo sapiens) CpG-island No: 34242
aaaaacattcccaaatcctttaccatcctcgaaaaaaacttccaaaacgcttaactcctaactctacacttcctttacacaaattcccgtttcgaacgtaatctcttaatccaatcaataccgccacgttcaaacaacattttccactaacctcaaaatcaacgcaatccgaaaactccaactccaattcgactaaacttcccgcgacgacttcctacgactcccgctaaccttctaaaccgaaataaaacccaccgccctttctaaaacgcgaatcgccaccgaaaaaaacgcgaaaaaacaaaaaacgcgtaccactctaccccaaaatttcgacgacttccgaaaacgctctttctttcttctcgctaaaaaactaaaaaaccaacgaaaaactatttataaaaccgacgaacgaaccgtttatctctccttcctacgcctctttaatactaaaaaacgaaccgcaaaataactattaacgccgccgcgtttctaaacctaaccaactcacgtaaccgacgcgaactctaaaacgataaaccgcaccgaaacgacgacgacgacgacgactacaactcgaaaaataacgacctaacgaaaaacgaaccgactaccctctcgaacgaccgcgacgaaaaacaaaaataacgaaaacttcgacgaccgaaacgaactcgaacgccgctataaccgcccaccgatttttctaccacttttacaaaaacgaaa

SEQ ID NO: 34243 - DNA, 732 bp, Artificial Sequence
  chemically treated genomic DNA (Homo sapiens) CpG-island No: 34243
agaagtatttttagattttttgttattttcggaaagggtttttaaggcgtttggtttttagttttatattttttttatataggttttcgtttcggacgtggttttttggtttagttagtgtcgttacgtttagatagtattttttattaattttagggttagcgtaattcgggggttttaattttaattcggttgagtttttcgcgacggttttttacggttttcgttggttttttaggtcgaggtggagtttatcgttttttttaggacgcggatcgttatcgaagaagacgcggaaaagtaaaaagcgcgtgttattttattttagagtttcggcggttttcggggacgtttttttttttttttcgttggaagattggaggattagcgaggggttgtttgtggagtcggcgggcgggtcgtttgttttttttttttgcgtttttttggtgttgggaggcgggtcgtagggtagttgttggcgtcgtcgcgtttttgggtttggttaatttacgtgatcgacgcgggttttgaagcggtgggtcgtatcgaggcggcggcggcggcgacgattgtagttcgggaggtagcggtttggcgagggacgggtcggttgttttttcggacggtcgcggcggagggtaaaaatggcggaggtttcggcggtcggggcggattcgggcgtcgttgtagtcgtttatcggtttttttgttatttttgtaagggcgagg

SEQ ID NO: 34244 - DNA, 732 bp, Artificial Sequence
  chemically treated genomic DNA (Homo sapiens) CpG-island No: 34244
cctcgcccttacaaaaataacaaaaaaaccgataaacgactacaacgacgcccgaatccgccccgaccgccgaaacctccgccatttttaccctccgccgcgaccgtccgaaaaaacaaccgacccgtccctcgccaaaccgctacctcccgaactacaatcgtcgccgccgccgccgcctcgatacgacccaccgcttcaaaacccgcgtcgatcacgtaaattaaccaaacccaaaaacgcgacgacgccaacaactaccctacgacccgcctcccaacaccaaaaaaacgcaaaaaaaaaaaacaaacgacccgcccgccgactccacaaacaacccctcgctaatcctccaatcttccaacgaaaaaaaaaaaaaaacgtccccgaaaaccgccgaaactctaaaataaaataacacgcgctttttacttttccgcgtcttcttcgataacgatccgcgtcctaaaaaaaacgataaactccacctcgacctaaaaaaccaacgaaaaccgtaaaaaaccgtcgcgaaaaactcaaccgaattaaaattaaaacccccgaattacgctaaccctaaaattaataaaaaatactatctaaacgtaacgacactaactaaaccaaaaaaccacgtccgaaacgaaaacctatataaaaaaaatataaaactaaaaaccaaacgccttaaaaaccctttccgaaaataacaaaaaatctaaaaatacttct

SEQ ID NO: 34245 - DNA, 806 bp, Artificial Sequence
  chemically treated genomic DNA (Homo sapiens) CpG-island No: 34245
tcgtgtttacgtttttttcgcgttttttttaggataggggtcgttttaattcgggtacgttgagttcggtcgcgtttttagttttttttttttcggttttttcgtttcgaagggaagtataggttcgagtagtattcggggtttatttattagtcgcggaggtaaagggggaggagagaggaggcgggaggcgggaggcgggaggaggagtttttgggcggtcgagagttttcggtggggtcggcggaggagcgttttttttttcgcgcgttgattgttgtggcgttttgttcgttttcgttcgcgtgtgtgcgagggagggcgagtgcgtcgggtcggtttgatgggggtaatcgagggtttcggggacgtcgagcggtatttttttttttttagcgagtgaaggagggtagtcggcggttttcgcgtttcggttattttttttgcgcgattttcggagttttttgtaggaggtgagagtttttagcgggttcggatggcgtagttttgtcgcggcgtagtagttgtcggagttcgtcgtcgtcgagcgttgggcggggaaatttgtcgtcgtttttttttaatttgttgcgggtggattttcgttggatatatcgttttcgaggtacgtgtcggtttagtttcgcggcgttgtagttcgttcgggttgtgggttttgtaggttgcgcgggtgttcgtcggcgcggcgcgggttgttagtgtttatttatcggttagggtcgttttagtcgttaggattttcggttttgggagggaggcgttggtggggcggtgtttatttttcg

SEQ ID NO: 34246 - DNA, 806 bp, Artificial Sequence
  chemically treated genomic DNA (Homo sapiens) CpG-island No: 34246
cgaaaaataaacaccgccccaccaacgcctccctcccaaaaccgaaaatcctaacgactaaaacgaccctaaccgataaataaacactaacaacccgcgccgcgccgacgaacacccgcgcaacctacaaaacccacaacccgaacgaactacaacgccgcgaaactaaaccgacacgtacctcgaaaacgatatatccaacgaaaatccacccgcaacaaattaaaaaaaaacgacgacaaatttccccgcccaacgctcgacgacgacgaactccgacaactactacgccgcgacaaaactacgccatccgaacccgctaaaaactctcacctcctacaaaaaactccgaaaatcgcgcaaaaaaaataaccgaaacgcgaaaaccgccgactaccctccttcactcgctaaaaaaaaaaaaataccgctcgacgtccccgaaaccctcgattacccccatcaaaccgacccgacgcactcgccctccctcgcacacacgcgaacgaaaacgaacaaaacgccacaacaatcaacgcgcgaaaaaaaaaacgctcctccgccgaccccaccgaaaactctcgaccgcccaaaaactcctcctcccgcctcccgcctcccgcctcctctctcctccccctttacctccgcgactaataaataaaccccgaatactactcgaacctatacttcccttcgaaacgaaaaaaccgaaaaaaaaaaaactaaaaacgcgaccgaactcaacgtacccgaattaaaacgacccctatcctaaaaaaaacgcgaaaaaaacgtaaacacga

SEQ ID NO: 34247 - DNA, 806 bp, Artificial Sequence
  chemically treated genomic DNA (Homo sapiens) CpG-island No: 34247
cggagggtaaatatcgttttattagcgttttttttttaaggtcggaggttttggcggttggagcgattttggtcggtaagtaggtattggtagttcgcgtcgcgtcgacgggtattcgcgtagtttgtagagtttatagttcgggcgggttgtagcgtcgcggggttgggtcggtacgtatttcggaggcggtgtgtttagcggagatttattcgtagtaagttggaggaaagcggcggtaagttttttcgtttagcgttcggcggcggcgagtttcggtagttgttgcgtcgcggtaaaattacgttattcggattcgttggggatttttattttttgtagggagtttcgggaatcgcgtagggaaagtggtcggggcgcgagagtcgtcgattgtttttttttattcgttgggaagaggaaagtgtcgttcggcgttttcgaaattttcgattatttttattaggtcgattcggcgtattcgttttttttcgtatatacgcgggcggggacgggtaggacgttatagtaattagcgcgcggggggaagggcgttttttcgtcggttttatcgggggttttcggtcgtttagaaattttttttttcgtttttcgtttttcgtttttttttttttttttttttgttttcgcggttgatggatgagtttcgaatgttgttcgagtttgtgttttttttcgggacgaggaggtcgagagagaaggggttaggggcgcggtcgggtttagcgtgttcgggttggggcggtttttgttttgggggaagcgcgagggagacgtgggtacga

SEQ ID NO: 34248 - DNA, 806 bp, Artificial Sequence
  chemically treated genomic DNA (Homo sapiens) CpG-island No: 34248
tcgtacccacgtctccctcgcgcttcccccaaaacaaaaaccgccccaacccgaacacgctaaacccgaccgcgcccctaaccccttctctctcgacctcctcgtcccgaaaaaaaacacaaactcgaacaacattcgaaactcatccatcaaccgcgaaaacaaaaaaaaaaaaaaaaaaaaacgaaaaacgaaaaacgaaaaaaaaaatttctaaacgaccgaaaacccccgataaaaccgacgaaaaaacgcccttccccccgcgcgctaattactataacgtcctacccgtccccgcccgcgtatatacgaaaaaaaacgaatacgccgaatcgacctaataaaaataatcgaaaatttcgaaaacgccgaacgacactttcctcttcccaacgaataaaaaaaaacaatcgacgactctcgcgccccgaccactttccctacgcgattcccgaaactccctacaaaaaataaaaatccccaacgaatccgaataacgtaattttaccgcgacgcaacaactaccgaaactcgccgccgccgaacgctaaacgaaaaaacttaccgccgctttcctccaacttactacgaataaatctccgctaaacacaccgcctccgaaatacgtaccgacccaaccccgcgacgctacaacccgcccgaactataaactctacaaactacgcgaatacccgtcgacgcgacgcgaactaccaatacctacttaccgaccaaaatcgctccaaccgccaaaacctccgaccttaaaaaaaaaacgctaataaaacgatatttaccctccg

SEQ ID NO: 34249 - DNA, 607 bp, Artificial Sequence
  chemically treated genomic DNA (Homo sapiens) CpG-island No: 34249
gttttagcgtcgtttcggtcgtgggagtcggcgggcgtagtttatagttttattaagatatagttgtcggggtttcgggtgcgtttcgttcgcggtttcggtgtttcgtttttcgtttttagtttttattcgacggtttttagggtttttcgggtacgttacgcggattcgtagcgattttatagggattgcgttttcgtgtttttagcgttttcgcgttgttgttttagtcgttcggtagttttgaggatggagaggagggcgcggagtttttttagggagtttcgcgggcgaggcggtaggatttcgtataaggagaataagagggtaaaggtcgagaggagcggcggaggtcgcgggcgttaggaggttgggttcgagtcgtcgggtttcggacgggcggggatttcgggggagtttcgagcgttcgtcgttacggtggtggacgtggatgaggttcgaggtttcggcgaggagggtatcgaggtggtggcgttgttggagagcgagcggttcgaggaaggtacggatttagtattattatttgttatttttttaggtggtaattaaggggcgttagataaggtggaaagggttatttttacga

SEQ ID NO: 34250 - DNA, 607 bp, Artificial Sequence
  chemically treated genomic DNA (Homo sapiens) CpG-island No: 34250
tcgtaaaaataaccctttccaccttatctaacgccccttaattaccacctaaaaaaataacaaataataatactaaatccgtaccttcctcgaaccgctcgctctccaacaacgccaccacctcgataccctcctcgccgaaacctcgaacctcatccacgtccaccaccgtaacgacgaacgctcgaaactcccccgaaatccccgcccgtccgaaacccgacgactcgaacccaacctcctaacgcccgcgacctccgccgctcctctcgacctttaccctcttattctccttatacgaaatcctaccgcctcgcccgcgaaactccctaaaaaaactccgcgccctcctctccatcctcaaaactaccgaacgactaaaacaacaacgcgaaaacgctaaaaacacgaaaacgcaatccctataaaatcgctacgaatccgcgtaacgtacccgaaaaaccctaaaaaccgtcgaataaaaactaaaaacgaaaaacgaaacaccgaaaccgcgaacgaaacgcacccgaaaccccgacaactatatcttaataaaactataaactacgcccgccgactcccacgaccgaaacgacgctaaaac

SEQ ID NO: 34251 - DNA, 607 bp, Artificial Sequence
  chemically treated genomic DNA (Homo sapiens) CpG-island No: 34251
tcgtggggatgattttttttattttatttgacgttttttagttattatttggaaaagtagtagatagtggtgttgaattcgtatttttttcgggtcgttcgttttttaatagcgttattatttcggtgtttttttcgtcggagtttcggattttatttacgtttattatcgtggcggcgggcgttcggggttttttcggggttttcgttcgttcggagttcgacggttcgggtttagttttttggcgttcgcggttttcgtcgtttttttcggtttttgtttttttgttttttttgtgcggagttttgtcgtttcgttcgcgggattttttggaggagtttcgcgtttttttttttatttttagagttgtcgggcggttggagtagtagcgcgggagcgttaggggtacgggagcgtagtttttgtggagtcgttgcgggttcgcgtggcgtgttcgggggattttaaagatcgtcgggtgggggttgagggcgaggggcgggatatcggggtcgcgggcggggcgtattcggaatttcgatagttgtgttttggtggagttgtggattgcgttcgtcgatttttacggtcggggcggcgttgaagt

SEQ ID NO: 34252 - DNA, 607 bp, Artificial Sequence
  chemically treated genomic DNA (Homo sapiens) CpG-island No: 34252
acttcaacgccgccccgaccgtaaaaatcgacgaacgcaatccacaactccaccaaaacacaactatcgaaattccgaatacgccccgcccgcgaccccgatatcccgcccctcgccctcaacccccacccgacgatctttaaaatcccccgaacacgccacgcgaacccgcaacgactccacaaaaactacgctcccgtacccctaacgctcccgcgctactactccaaccgcccgacaactctaaaaataaaaaaaaaaacgcgaaactcctccaaaaaatcccgcgaacgaaacgacaaaactccgcacaaaaaaaacaaaaaaacaaaaaccgaaaaaaacgacgaaaaccgcgaacgccaaaaaactaaacccgaaccgtcgaactccgaacgaacgaaaaccccgaaaaaaccccgaacgcccgccgccacgataataaacgtaaataaaatccgaaactccgacgaaaaaaacaccgaaataataacgctattaaaaaacgaacgacccgaaaaaaatacgaattcaacaccactatctactacttttccaaataataactaaaaaacgtcaaataaaataaaaaaaatcatccccacga

SEQ ID NO: 34253 - DNA, 601 bp, Artificial Sequence
  chemically treated genomic DNA (Homo sapiens) CpG-island No: 34253
gtagtagtaggttggcgagtagggcgagtagtgcgtttttcggtcgtattttgagttataggcgtcgtcgttatcgttgttgtcggggcgaagtatagttcgggcggtttcgattcgcggttttcgtcgtcgtcgttatcgtcgtcgtggtcgtagtttcgcgtatttatagcgtttataggcggtagcgaggggcgttcgtagtttattcggtagagttttcgcggcgggcggagaagaagtcgcgttcgggttcgtttcgggttttcggtttcggttcgcggagcgtcgcgatcggttggtagatgacgattcgtcgagttcgtcgtttgttttttcggaggcgttcggagttgttgcgggtttcggtcgtcgttgttattgttgttgtcgtcgtcgtcgcgcggggttatttgaaggttggggcgcggaagtttaatttcgtgttgattgggttttaagttttttgcgttttcgtttcgtttcgagtgttcgcgaatttttcggacgtttacgtagattatttagttatattataattttgtttgcggagagaggagaggagaaaaaggggtcgttttaaaaatttttaaaattgtgt

SEQ ID NO: 34254 - DNA, 601 bp, Artificial Sequence
  chemically treated genomic DNA (Homo sapiens) CpG-island No: 34254
acacaattttaaaaatttttaaaacgacccctttttctcctctcctctctccgcaaacaaaattataatataactaaataatctacgtaaacgtccgaaaaattcgcgaacactcgaaacgaaacgaaaacgcaaaaaacttaaaacccaatcaacacgaaattaaacttccgcgccccaaccttcaaataaccccgcgcgacgacgacgacaacaacaataacaacgacgaccgaaacccgcaacaactccgaacgcctccgaaaaaacaaacgacgaactcgacgaatcgtcatctaccaaccgatcgcgacgctccgcgaaccgaaaccgaaaacccgaaacgaacccgaacgcgacttcttctccgcccgccgcgaaaactctaccgaataaactacgaacgcccctcgctaccgcctataaacgctataaatacgcgaaactacgaccacgacgacgataacgacgacgacgaaaaccgcgaatcgaaaccgcccgaactatacttcgccccgacaacaacgataacgacgacgcctataactcaaaatacgaccgaaaaacgcactactcgccctactcgccaacctactactac

SEQ ID NO: 34255 - DNA, 601 bp, Artificial Sequence
  chemically treated genomic DNA (Homo sapiens) CpG-island No: 34255
gtatagttttgaaagtttttgaagcggttttttttttttttttttttttttcgtaggtagagttgtggtgtggttgggtggtttgcgtgggcgttcgggggattcgcgggtattcgggacgaggcgagggcgtagaaaatttggagtttaattagtacggagttgagttttcgcgttttaatttttaggtgatttcgcgcggcggcggcggtagtagtagtggtagcggcgatcggagttcgtagtagtttcgagcgttttcgggaggataggcggcgagttcggcgaatcgttatttgttagtcgatcgcggcgtttcgcgggtcggggtcgggagttcggggcgagttcgaacgcggtttttttttcgttcgtcgcggagattttgtcgggtgggttgcgggcgtttttcgttgtcgtttgtgaacgttgtgggtgcgcggggttgcggttacggcggcggtggcggcggcggcgggagtcgcgagtcggggtcgttcgggttgtgtttcgtttcggtagtagcggtggcggcggcgtttgtggtttaggatgcggtcggggggcgtattgttcgttttgttcgttagtttgttgttgt

SEQ ID NO: 34256 - DNA, 601 bp, Artificial Sequence
  chemically treated genomic DNA (Homo sapiens) CpG-island No: 34256
acaacaacaaactaacgaacaaaacgaacaatacgccccccgaccgcatcctaaaccacaaacgccgccgccaccgctactaccgaaacgaaacacaacccgaacgaccccgactcgcgactcccgccgccgccgccaccgccgccgtaaccgcaaccccgcgcacccacaacgttcacaaacgacaacgaaaaacgcccgcaacccacccgacaaaatctccgcgacgaacgaaaaaaaaaccgcgttcgaactcgccccgaactcccgaccccgacccgcgaaacgccgcgatcgactaacaaataacgattcgccgaactcgccgcctatcctcccgaaaacgctcgaaactactacgaactccgatcgccgctaccactactactaccgccgccgccgcgcgaaatcacctaaaaattaaaacgcgaaaactcaactccgtactaattaaactccaaattttctacgccctcgcctcgtcccgaatacccgcgaatcccccgaacgcccacgcaaaccacccaaccacaccacaactctacctacgaaaaaaaaaaaaaaaaaaaaaaaaccgcttcaaaaactttcaaaactatac

SEQ ID NO: 34257 - DNA, 618 bp, Artificial Sequence
  chemically treated genomic DNA (Homo sapiens) CpG-island No: 34257
tttattcgtttcggtaggtcgggtttttatcgtttaggcgttcggtttttcgggttttttcgttaggtttcggcgttttttattgtttttattgcgttcgtcgtttttcgttcgtttttttttttttttcggttttagtcgtcgtcgtcgtatacgttcgaatttatcgggggtttagttagcggtaacgtagtagtagtcggggtaggtgggtcgtcgttaggatgaggtggcgtttaagacgcggttgagttcggttagggtgggtagtagtagttggcggaagttgtcgttgtttttcgtttttatatacgtatattatattatatatattagcgtttttggcggcggcggcgggggcggcggggttggggtagttatttggcgtgtattatcgaggttttcggtcgttaataaagtggtttacgatgattttaagagcgaggaggaggagtacggcgacgttgaggagatttaggagtttgaggataattaggaggatgagatggaggaggacgacgatgatttcgattatttttattcggaggagttggaagacgacgaggaggattttagttattgtagggaaagtaattttaggagttatagtatttatag

SEQ ID NO: 34258 - DNA, 618 bp, Artificial Sequence
  chemically treated genomic DNA (Homo sapiens) CpG-island No: 34258
ctataaatactataactcctaaaattactttccctacaataactaaaatcctcctcgtcgtcttccaactcctccgaataaaaataatcgaaatcatcgtcgtcctcctccatctcatcctcctaattatcctcaaactcctaaatctcctcaacgtcgccgtactcctcctcctcgctcttaaaatcatcgtaaaccactttattaacgaccgaaaacctcgataatacacgccaaataactaccccaaccccgccgcccccgccgccgccgccaaaaacgctaatatatataatataatatacgtatataaaaacgaaaaacaacgacaacttccgccaactactactacccaccctaaccgaactcaaccgcgtcttaaacgccacctcatcctaacgacgacccacctaccccgactactactacgttaccgctaactaaacccccgataaattcgaacgtatacgacgacgacgactaaaaccgaaaaaaaaaaaaaaacgaacgaaaaacgacgaacgcaataaaaacaataaaaaacgccgaaacctaacgaaaaaacccgaaaaaccgaacgcctaaacgataaaaacccgacctaccgaaacgaataaa

SEQ ID NO: 34259 - DNA, 618 bp, Artificial Sequence
  chemically treated genomic DNA (Homo sapiens) CpG-island No: 34259
ttgtaggtattatggtttttgaagttgttttttttgtagtaattggagtttttttcgtcgttttttagttttttcgggtaagggtaatcgaagttatcgtcgtttttttttattttatttttttagttgtttttagatttttgggtttttttagcgtcgtcgtatttttttttttcgtttttgaggttatcgtaaattattttgttaacggtcgagggtttcggtggtgtacgttaggtggttgttttagtttcgtcgttttcgtcgtcgtcgttaggggcgttggtgtgtgtggtgtggtgtgcgtgtgtgggggcggaaggtagcggtagttttcgttaattattgttgtttattttggtcgagtttagtcgcgttttgggcgttattttattttggcggcggtttatttgtttcggttgttattgcgttgtcgttagttgagttttcgatgggttcggacgtgtgcggcggcggcggttgagatcgggggagaagggaaagcggacgaggagcggcgggcgtagtggaggtagtggggagcgtcggggtttgacgaggaggttcgaggggtcgggcgtttgggcggtagagattcggtttgtcgaagcgggtgga

SEQ ID NO: 34260 - DNA, 618 bp, Artificial Sequence
  chemically treated genomic DNA (Homo sapiens) CpG-island No: 34260
tccacccgcttcgacaaaccgaatctctaccgcccaaacgcccgacccctcgaacctcctcgtcaaaccccgacgctccccactacctccactacgcccgccgctcctcgtccgctttcccttctcccccgatctcaaccgccgccgccgcacacgtccgaacccatcgaaaactcaactaacgacaacgcaataacaaccgaaacaaataaaccgccgccaaaataaaataacgcccaaaacgcgactaaactcgaccaaaataaacaacaataattaacgaaaactaccgctaccttccgcccccacacacgcacaccacaccacacacaccaacgcccctaacgacgacgacgaaaacgacgaaactaaaacaaccacctaacgtacaccaccgaaaccctcgaccgttaacaaaataatttacgataacctcaaaaacgaaaaaaaaaaatacgacgacgctaaaaaaacccaaaaatctaaaaacaactaaaaaaataaaataaaaaaaaacgacgataacttcgattacccttacccgaaaaaactaaaaaacgacgaaaaaaactccaattactacaaaaaaaacaacttcaaaaaccataatacctacaa

SEQ ID NO: 34261 - DNA, 624 bp, Artificial Sequence
  chemically treated genomic DNA (Homo sapiens) CpG-island No: 34261
gaagggcgggggcgacggggcgcgtacgcggaggaggaggaggaggagggagacgggagggcgtgtgagcgagtgagataagaaaagggagcgcgttcgtcgtcgtcgtcgtcgtcgtttttttttggagagagaggttggagtgaggttgtgcgaagcgtcgtattttaatgaggacgggtcgaggtatatttttgtattagtggtcgtaatcgaggcgtcgcgttttagtagttgttgtcgtttagttcggtttcgtcgtcgttttttagttttgtagtttcgtagtttcggtcgcgtttagttcggcgaggatagtattaggaggcggtttttagcgcggttataaagattttcggcggcgttttttcgcggatcggtgcgtggtttgttttttttggggacgggagttgcggggagggcggtcgggggatttcgtagagttcgtttcgttcgtagtcgcggggcgtcgagggtagggcgggcgtttagtttggtttcgtcgtttcgttcgtagtttttcgaaaggcggtcgttttgttttggttagtttggttcgattcgggggcgttgcgtgcgggcggtttcggggttgttggtatttgttttttttgtttggtgtta

SEQ ID NO: 34262 - DNA, 624 bp, Artificial Sequence
  chemically treated genomic DNA (Homo sapiens) CpG-island No: 34262
taacaccaaacaaaaaaaacaaataccaacaaccccgaaaccgcccgcacgcaacgcccccgaatcgaaccaaactaaccaaaacaaaacgaccgcctttcgaaaaactacgaacgaaacgacgaaaccaaactaaacgcccgccctaccctcgacgccccgcgactacgaacgaaacgaactctacgaaatcccccgaccgccctccccgcaactcccgtccccaaaaaaaacaaaccacgcaccgatccgcgaaaaaacgccgccgaaaatctttataaccgcgctaaaaaccgcctcctaatactatcctcgccgaactaaacgcgaccgaaactacgaaactacaaaactaaaaaacgacgacgaaaccgaactaaacgacaacaactactaaaacgcgacgcctcgattacgaccactaatacaaaaatatacctcgacccgtcctcattaaaatacgacgcttcgcacaacctcactccaacctctctctccaaaaaaaaacgacgacgacgacgacgacgaacgcgctcccttttcttatctcactcgctcacacgccctcccgtctccctcctcctcctcctcctccgcgtacgcgccccgtcgcccccgcccttc

SEQ ID NO: 34263 - DNA, 624 bp, Artificial Sequence
  chemically treated genomic DNA (Homo sapiens) CpG-island No: 34263
tggtattaaataaaagaggtaggtgttagtagtttcggggtcgttcgtacgtaacgttttcgggtcgggttaggttggttagggtagggcggtcgtttttcgaggaattgcgggcggggcggcggggttaagttgagcgttcgttttgttttcggcgtttcgcggttgcgggcggagcgggttttgcggagtttttcggtcgtttttttcgtagttttcgtttttagggaaggtaaattacgtatcggttcgcggagagacgtcgtcgggggtttttgtggtcgcgttgggggtcgttttttggtgttgttttcgtcgggttgggcgcggtcggggttgcggggttgtagggttggggggcggcggcggggtcgggttgggcggtagtagttgttggagcgcggcgtttcggttgcggttattagtgtagggatgtgtttcggttcgtttttattgaaatgcggcgtttcgtatagttttattttagtttttttttttagaggagggcggcggcggcggcggcggcgggcgcgttttttttttttgttttattcgtttatacgttttttcgtttttttttttttttttttttttcgcgtgcgcgtttcgtcgttttcgtttttt

SEQ ID NO: 34264 - DNA, 624 bp, Artificial Sequence
  chemically treated genomic DNA (Homo sapiens) CpG-island No: 34264
aaaaaacgaaaacgacgaaacgcgcacgcgaaaaaaaaaaaaaaaaaaaaaaacgaaaaaacgtataaacgaataaaacaaaaaaaaaaaacgcgcccgccgccgccgccgccgccgccctcctctaaaaaaaaaaactaaaataaaactatacgaaacgccgcatttcaataaaaacgaaccgaaacacatccctacactaataaccgcaaccgaaacgccgcgctccaacaactactaccgcccaacccgaccccgccgccgccccccaaccctacaaccccgcaaccccgaccgcgcccaacccgacgaaaacaacaccaaaaaacgacccccaacgcgaccacaaaaacccccgacgacgtctctccgcgaaccgatacgtaatttaccttccctaaaaacgaaaactacgaaaaaaacgaccgaaaaactccgcaaaacccgctccgcccgcaaccgcgaaacgccgaaaacaaaacgaacgctcaacttaaccccgccgccccgcccgcaattcctcgaaaaacgaccgccctaccctaaccaacctaacccgacccgaaaacgttacgtacgaacgaccccgaaactactaacacctacctcttttatttaatacca

SEQ ID NO: 34265 - DNA, 1490 bp, Artificial Sequence
  chemically treated genomic DNA (Homo sapiens) CpG-island No: 34265
tttacgttgtttcgttttatatcggcgagtgcgttattacgttttagcggggatcgaatatatagggatttattgttacgttttagtagggatcgtacgcgaggggacgttttgttacgttttagcggggatcgtaagtacggggatacgtcgttatttttaagcggggatcgaatatatagggatttattgttattttttagcggggatcgtaagtatagggacgcgtcgttacgttttagcggggatcgtaagtacggggacgcgtcgttacgttttagcggggatcgtaagtacggggacgcgtcgttacgttttagcggggatcgtaagtacggggacgcgtcgttacgttttagcggggatcgtaagtacggggacgcgtcgttattttttagcggggatcgtacgtacggggacgcgtcgttacgttttagcggggatcgtacgtacggggacgcgtcgttattttttagcggggatcgtacgtacggggacgcgtcgttattttttagcggggatcgtacgtacggggacgcgtcgttacgttttagcggggatcgtaagtacggggacgcgtcgttacgtttcggcggggatcgtacgtacggggacgcgtcgttacgttttagcggggatcgtaagtacggggacgcgtcgttacgtttcggcggggatcgtatatacggggacgcgtcgttacgttttagtggggatcgtatttacggggacgcgtcgttacgtttcggcggggatcgtatttacggggaagcgtcgttacgttttagtggggatcgtatttacggggacgcgtcgttacgtttcggcggggatcgtatatacggggacgcgtcgttacgtttcggcggggatcgtatatacggggacgcgtcgttacgttttagtggggatcgtatttacggggacgcgtcgttacgttttagcggggatagtatatacggggacgcgtcgttacgttttagcggggatcgtatttacggggacgcgtcgttatttttcggcggggatcgtatatacggggacgcgttgttacgttttagtggggatcgtatttacggggacgcgttattatattttagcggggatcgtatatacggggacgcgtcgttatttttcggtggggatcgtatatacggggacgcgtcgttattttttagcggggatcgtatatacggggacgcgttgttacgttttagcggggatcgtatatacggggatttattgttacgttttagtagggatcgtaagtacggggacgcgtcgttattttttagcggggattgtatatacggggacgcgtcgttattttttagcggggatcgtacgtacggggatttattgttacgttttagcggggatcgtaaatacggggacgcgtcgttattttttagcggggattattagttgttttgtttatggattggaacgtattgggtggagtaagtgagagtaatattgaggcgaggtat

SEQ ID NO: 34266 - DNA, 1490 bp, Artificial Sequence
  chemically treated genomic DNA (Homo sapiens) CpG-island No: 34266
atacctcgcctcaatattactctcacttactccacccaatacgttccaatccataaacaaaacaactaataatccccgctaaaaaataacgacgcgtccccgtatttacgatccccgctaaaacgtaacaataaatccccgtacgtacgatccccgctaaaaaataacgacgcgtccccgtatatacaatccccgctaaaaaataacgacgcgtccccgtacttacgatccctactaaaacgtaacaataaatccccgtatatacgatccccgctaaaacgtaacaacgcgtccccgtatatacgatccccgctaaaaaataacgacgcgtccccgtatatacgatccccaccgaaaaataacgacgcgtccccgtatatacgatccccgctaaaatataataacgcgtccccgtaaatacgatccccactaaaacgtaacaacgcgtccccgtatatacgatccccgccgaaaaataacgacgcgtccccgtaaatacgatccccgctaaaacgtaacgacgcgtccccgtatatactatccccgctaaaacgtaacgacgcgtccccgtaaatacgatccccactaaaacgtaacgacgcgtccccgtatatacgatccccgccgaaacgtaacgacgcgtccccgtatatacgatccccgccgaaacgtaacgacgcgtccccgtaaatacgatccccactaaaacgtaacgacgcttccccgtaaatacgatccccgccgaaacgtaacgacgcgtccccgtaaatacgatccccactaaaacgtaacgacgcgtccccgtatatacgatccccgccgaaacgtaacgacgcgtccccgtacttacgatccccgctaaaacgtaacgacgcgtccccgtacgtacgatccccgccgaaacgtaacgacgcgtccccgtacttacgatccccgctaaaacgtaacgacgcgtccccgtacgtacgatccccgctaaaaaataacgacgcgtccccgtacgtacgatccccgctaaaaaataacgacgcgtccccgtacgtacgatccccgctaaaacgtaacgacgcgtccccgtacgtacgatccccgctaaaaaataacgacgcgtccccgtacttacgatccccgctaaaacgtaacgacgcgtccccgtacttacgatccccgctaaaacgtaacgacgcgtccccgtacttacgatccccgctaaaacgtaacgacgcgtccccgtacttacgatccccgctaaaacgtaacgacgcgtccctatacttacgatccccgctaaaaaataacaataaatccctatatattcgatccccgcttaaaaataacgacgtatccccgtacttacgatccccgctaaaacgtaacaaaacgtcccctcgcgtacgatccctactaaaacgtaacaataaatccctatatattcgatccccgctaaaacgtaataacgcactcgccgatataaaacgaaacaacgtaaa

SEQ ID NO: 34267 - DNA, 1490 bp, Artificial Sequence
  chemically treated genomic DNA (Homo sapiens) CpG-island No: 34267
gtgtttcgttttagtgttatttttatttattttatttaatgcgttttaatttatgggtaaagtagttggtggttttcgttgaggggtgacggcgcgttttcgtgtttacggttttcgttgaggcgtgatagtgggttttcgtgcgtacggttttcgttgaggggtgacggcgcgttttcgtgtgtatagttttcgttgaggggtgacggcgcgttttcgtgtttacggtttttgttgaggcgtgatagtgggttttcgtgtgtacggttttcgttgaggcgtgatagcgcgttttcgtgtgtacggttttcgttgaggggtgacggcgcgttttcgtgtgtacggtttttatcgaggggtgacggcgcgttttcgtgtgtacggttttcgttgaggtgtgatggcgcgttttcgtgggtacggtttttattgaggcgtgatagcgcgttttcgtgtgtacggttttcgtcgaggggtgacggcgcgttttcgtgggtacggttttcgttgaggcgtgacggcgcgttttcgtgtgtattgttttcgttgaggcgtgacggcgcgttttcgtgggtacggtttttattgaggcgtgacggcgcgttttcgtgtgtacggttttcgtcgaggcgtgacggcgcgttttcgtgtgtacggttttcgtcgaggcgtgacggcgcgttttcgtgggtacggtttttattgaggcgtgacggcgttttttcgtgggtacggttttcgtcgaggcgtgacggcgcgttttcgtgggtacggtttttattgaggcgtgacggcgcgttttcgtgtgtacggttttcgtcgaggcgtgacggcgcgttttcgtgtttacggttttcgttgaggcgtgacggcgcgttttcgtgcgtacggttttcgtcgaggcgtgacggcgcgttttcgtgtttacggttttcgttgaggcgtgacggcgcgttttcgtgcgtacggttttcgttgaggggtgacggcgcgttttcgtgcgtacggttttcgttgaggggtgacggcgcgttttcgtgcgtacggttttcgttgaggcgtgacggcgcgttttcgtgcgtacggttttcgttgaggggtgacggcgcgttttcgtgtttacggttttcgttgaggcgtgacggcgcgttttcgtgtttacggttttcgttgaggcgtgacggcgcgttttcgtgtttacggttttcgttgaggcgtgacggcgcgttttcgtgtttacggttttcgttgaggcgtgacggcgcgtttttgtgtttacggttttcgttgaggggtgatagtgggtttttgtgtgttcggttttcgtttaggggtgacggcgtgttttcgtgtttacggttttcgttgaggcgtaatagggcgttttttcgcgtacggtttttgttgaggcgtgatagtgggtttttgtgtgttcggttttcgttgaggcgtgatggcgtattcgtcgatatgagacgaggtagcgtaaa

SEQ ID NO: 34268 - DNA, 1490 bp, Artificial Sequence
  chemically treated genomic DNA (Homo sapiens) CpG-island No: 34268
tttacgctacctcgtctcatatcgacgaatacgccatcacgcctcaacgaaaaccgaacacacaaaaacccactatcacgcctcaacaaaaaccgtacgcgaaaaaacgccctattacgcctcaacgaaaaccgtaaacacgaaaacacgccgtcacccctaaacgaaaaccgaacacacaaaaacccactatcacccctcaacgaaaaccgtaaacacaaaaacgcgccgtcacgcctcaacgaaaaccgtaaacacgaaaacgcgccgtcacgcctcaacgaaaaccgtaaacacgaaaacgcgccgtcacgcctcaacgaaaaccgtaaacacgaaaacgcgccgtcacgcctcaacgaaaaccgtaaacacgaaaacgcgccgtcacccctcaacgaaaaccgtacgcacgaaaacgcgccgtcacgcctcaacgaaaaccgtacgcacgaaaacgcgccgtcacccctcaacgaaaaccgtacgcacgaaaacgcgccgtcacccctcaacgaaaaccgtacgcacgaaaacgcgccgtcacgcctcaacgaaaaccgtaaacacgaaaacgcgccgtcacgcctcgacgaaaaccgtacgcacgaaaacgcgccgtcacgcctcaacgaaaaccgtaaacacgaaaacgcgccgtcacgcctcgacgaaaaccgtacacacgaaaacgcgccgtcacgcctcaataaaaaccgtacccacgaaaacgcgccgtcacgcctcgacgaaaaccgtacccacgaaaaaacgccgtcacgcctcaataaaaaccgtacccacgaaaacgcgccgtcacgcctcgacgaaaaccgtacacacgaaaacgcgccgtcacgcctcgacgaaaaccgtacacacgaaaacgcgccgtcacgcctcaataaaaaccgtacccacgaaaacgcgccgtcacgcctcaacgaaaacaatacacacgaaaacgcgccgtcacgcctcaacgaaaaccgtacccacgaaaacgcgccgtcacccctcgacgaaaaccgtacacacgaaaacgcgctatcacgcctcaataaaaaccgtacccacgaaaacgcgccatcacacctcaacgaaaaccgtacacacgaaaacgcgccgtcacccctcgataaaaaccgtacacacgaaaacgcgccgtcacccctcaacgaaaaccgtacacacgaaaacgcgctatcacgcctcaacgaaaaccgtacacacgaaaacccactatcacgcctcaacaaaaaccgtaaacacgaaaacgcgccgtcacccctcaacgaaaactatacacacgaaaacgcgccgtcacccctcaacgaaaaccgtacgcacgaaaacccactatcacgcctcaacgaaaaccgtaaacacgaaaacgcgccgtcacccctcaacgaaaaccaccaactactttacccataaattaaaacgcattaaataaaataaataaaaataacactaaaacgaaacac

SEQ ID NO: 34269 - DNA, 727 bp, Artificial Sequence
  chemically treated genomic DNA (Homo sapiens) CpG-island No: 34269
tttggtcggaggttataggttagacgcggcggaattttttcggagtcgcgttcgggcgcgcgcgggaagcggaggcggagtgggtacgtgcggtattttcggggcggggcgggtacgtagttttttcgaaggttcgcgcgagtcgttagttttgtttacgtatttttggtatagtcgcgttacgcgatcggcgatttgattggttcgcgcgggagggcgcgcggcgttaaatttgtttttcgttagttttcgttcgtttcgcgggagcgcgtacgttcgcgtattcggatttcggtttttgtatttagtcgttattcgggaggtcgttgcgttgtagggtttcgcggagtcgttcgcgatcgcgagtcgggtttttcgcgcggtttatcgtttattggacgtcgttcgcggtcggatcggtgaggagcgagagcgagcgggggaggggcgtggttggggtttgtattttcgagtttcgtgtcggtcgtcgatttggcggggacggtttcgggaagtcgcgggttcgagtgaagggggtttgcgttgtttcgttttttatacggttcgagggaagggttcgtttttataggtcggggcgggagtgcgtttttgtgtagggagcggggaggttcggtgttagtcgttgtcgaggttggaaatattgcgtttgaaattattgggaagttgagggcggtataagacgaaagttattttttttgttttagtt

SEQ ID NO: 34270 - DNA, 727 bp, Artificial Sequence
  chemically treated genomic DNA (Homo sapiens) CpG-island No: 34270
aactaaaacaaaaaaaataactttcgtcttataccgccctcaacttcccaataatttcaaacgcaatatttccaacctcgacaacgactaacaccgaacctccccgctccctacacaaaaacgcactcccgccccgacctataaaaacgaacccttccctcgaaccgtataaaaaacgaaacaacgcaaacccccttcactcgaacccgcgacttcccgaaaccgtccccgccaaatcgacgaccgacacgaaactcgaaaatacaaaccccaaccacgcccctcccccgctcgctctcgctcctcaccgatccgaccgcgaacgacgtccaataaacgataaaccgcgcgaaaaacccgactcgcgatcgcgaacgactccgcgaaaccctacaacgcaacgacctcccgaataacgactaaatacaaaaaccgaaatccgaatacgcgaacgtacgcgctcccgcgaaacgaacgaaaactaacgaaaaacaaatttaacgccgcgcgccctcccgcgcgaaccaatcaaatcgccgatcgcgtaacgcgactataccaaaaatacgtaaacaaaactaacgactcgcgcgaaccttcgaaaaaactacgtacccgccccgccccgaaaataccgcacgtacccactccgcctccgcttcccgcgcgcgcccgaacgcgactccgaaaaaattccgccgcgtctaacctataacctccgaccaaa

SEQ ID NO: 34271 - DNA, 727 bp, Artificial Sequence
  chemically treated genomic DNA (Homo sapiens) CpG-island No: 34271
aattaaaatagaaagaatggttttcgttttgtgtcgtttttaattttttaatggttttaaacgtaatgtttttagtttcggtagcgattgatatcgggttttttcgttttttgtataaagacgtattttcgtttcggtttgtgggggcgggtttttttttcgggtcgtgtgggaagcgaggtagcgtaggttttttttattcggattcgcggtttttcgggatcgttttcgttaggtcggcggtcgatacggggttcggggatgtaggttttaattacgtttttttttcgttcgttttcgttttttatcggttcggtcgcgggcggcgtttagtgggcgatggatcgcgcggagggttcggttcgcggtcgcgggcggtttcgcgaggttttgtagcgtagcggtttttcgaatggcgattggatgtaggagtcgggattcgggtgcgcgagcgtgcgcgttttcgcgggacgggcgggggttgacgggaagtaagtttggcgtcgcgcgttttttcgcgcgggttaattagatcgtcgatcgcgtggcgcggttgtgttaaaagtgcgtgggtaaaattagcggttcgcgcgggttttcggaagggttgcgtgttcgtttcgtttcggaagtgtcgtacgtgtttatttcgttttcgtttttcgcgcgcgttcgggcgcggtttcgggagggtttcgtcgcgtttggtttgtggttttcggttagg

SEQ ID NO: 34272 - DNA, 727 bp, Artificial Sequence
  chemically treated genomic DNA (Homo sapiens) CpG-island No: 34272
cctaaccgaaaaccacaaaccaaacgcgacgaaaccctcccgaaaccgcgcccgaacgcgcgcgaaaaacgaaaacgaaataaacacgtacgacacttccgaaacgaaacgaacacgcaacccttccgaaaacccgcgcgaaccgctaattttacccacgcacttttaacacaaccgcgccacgcgatcgacgatctaattaacccgcgcgaaaaaacgcgcgacgccaaacttacttcccgtcaacccccgcccgtcccgcgaaaacgcgcacgctcgcgcacccgaatcccgactcctacatccaatcgccattcgaaaaaccgctacgctacaaaacctcgcgaaaccgcccgcgaccgcgaaccgaaccctccgcgcgatccatcgcccactaaacgccgcccgcgaccgaaccgataaaaaacgaaaacgaacgaaaaaaaaacgtaattaaaacctacatccccgaaccccgtatcgaccgccgacctaacgaaaacgatcccgaaaaaccgcgaatccgaataaaaaaaacctacgctacctcgcttcccacacgacccgaaaaaaaaacccgcccccacaaaccgaaacgaaaatacgtctttatacaaaaaacgaaaaaacccgatatcaatcgctaccgaaactaaaaacattacgtttaaaaccattaaaaaattaaaaacgacacaaaacgaaaaccattctttctattttaatt

SEQ ID NO: 34273 - DNA, 609 bp, Artificial Sequence
  chemically treated genomic DNA (Homo sapiens) CpG-island No: 34273
ggcggttcgtttgcgggacggcgggttagttagttagtcggtcgtttttacggttatcgggaatttcgcggaggcgagtaggattttttttttttttattcgcgttttcgtttttcgttatttcgagtttaagttcgggttcggggcgcgttttacgtttaattcgtcgaagggggtggagtttgcgttgtgacgcggtcgcgttggtcgtagatttcggatttttggaatgtgtattcgttttacgaggttttagtgttagcggcgtcgaggtacgtttgcgcggagcgtgcgtattcgcggcggcggtcgtttacggtttcgcgtttacgttacgcgttcgtcgcgtatatttatataaggtagtcggggcgattggcgcggcgaggttttcgatgaatagggcgggttggacggggttaagagcggtatttggtgttcgggagaggttagttcgaatcgcgtttttttttttttagagggtttcgtggaaaacgcgcgagttagttggcggcgtgtgtacgtggtgttgggtttgggaatatttatagtttttttagttagtaaaagggataggcggggcgtatgttttttttaagataaatgtaa

SEQ ID NO: 34274 - DNA, 609 bp, Artificial Sequence
  chemically treated genomic DNA (Homo sapiens) CpG-island No: 34274
ttacatttatcttaaaaaaaacatacgccccgcctatcccttttactaactaaaaaaactataaatattcccaaacccaacaccacgtacacacgccgccaactaactcgcgcgttttccacgaaaccctctaaaaaaaaaaaaacgcgattcgaactaacctctcccgaacaccaaataccgctcttaaccccgtccaacccgccctattcatcgaaaacctcgccgcgccaatcgccccgactaccttatataaatatacgcgacgaacgcgtaacgtaaacgcgaaaccgtaaacgaccgccgccgcgaatacgcacgctccgcgcaaacgtacctcgacgccgctaacactaaaacctcgtaaaacgaatacacattccaaaaatccgaaatctacgaccaacgcgaccgcgtcacaacgcaaactccacccccttcgacgaattaaacgtaaaacgcgccccgaacccgaacttaaactcgaaataacgaaaaacgaaaacgcgaataaaaaaaaaaaaaatcctactcgcctccgcgaaattcccgataaccgtaaaaacgaccgactaactaactaacccgccgtcccgcaaacgaaccgcc

SEQ ID NO: 34275 - DNA, 609 bp, Artificial Sequence
  chemically treated genomic DNA (Homo sapiens) CpG-island No: 34275
ttgtatttgttttggaaaggatatacgtttcgtttgttttttttattaattagggagattgtgaatatttttaagtttagtattacgtgtatacgtcgttagttggttcgcgcgttttttacggagttttttggaggggagggagcgcggttcggattagtttttttcgaatattaagtgtcgtttttagtttcgtttagttcgttttgtttatcgggggtttcgtcgcgttagtcgtttcggttgttttatgtaggtatgcgcggcgggcgcgtgacgtgggcgcggggtcgtgggcggtcgtcgtcgcgagtgcgtacgtttcgcgtagacgtgtttcggcgtcgttggtattagggtttcgtggaacgaatgtatattttagggattcggggtttacggttagcgcggtcgcgttatagcgtaggttttatttttttcggcgagttgggcgtgaggcgcgtttcgggttcgaatttggattcgaggtggcgggaggcgagggcgcgagtggggggggggggggttttgttcgttttcgcgaggttttcgatggtcgtgggggcgatcggttggttggttggttcgtcgtttcgtaggcgggtcgtt

SEQ ID NO: 34276 - DNA, 609 bp, Artificial Sequence
  chemically treated genomic DNA (Homo sapiens) CpG-island No: 34276
aacgacccgcctacgaaacgacgaaccaaccaaccaaccgatcgcccccacgaccatcgaaaacctcgcgaaaacgaacaaaaccccccccccccccactcgcgccctcgcctcccgccacctcgaatccaaattcgaacccgaaacgcgcctcacgcccaactcgccgaaaaaaataaaacctacgctataacgcgaccgcgctaaccgtaaaccccgaatccctaaaatatacattcgttccacgaaaccctaataccaacgacgccgaaacacgtctacgcgaaacgtacgcactcgcgacgacgaccgcccacgaccccgcgcccacgtcacgcgcccgccgcgcatacctacataaaacaaccgaaacgactaacgcgacgaaacccccgataaacaaaacgaactaaacgaaactaaaaacgacacttaatattcgaaaaaaactaatccgaaccgcgctccctcccctccaaaaaactccgtaaaaaacgcgcgaaccaactaacgacgtatacacgtaatactaaacttaaaaatattcacaatctccctaattaataaaaaaaacaaacgaaacgtatatcctttccaaaacaaatacaa

SEQ ID NO: 34277 - DNA, 777 bp, Artificial Sequence
  chemically treated genomic DNA (Homo sapiens) CpG-island No: 34277
taaagcggcgggtgtagtaatttcggcgttttcgagcgcgttcggggtcggacgttcggcgttcggcgttggttttagaaaggcggcgggtgtggggcgtagaggtttatttcgcgttttagtcgcggttcgcgtttcgtcgtagttttcggggacggtatttatatacgtagagttttattacgtacgcgtagtaggattagacgattacgaaggtgatgaagagtatcggtatttagtttacgacgcgttggtagtagcgttatagcgtttagggcgttatgtttcgttggcggttgtcgagtttcgcgttttatcgttttggggagcgcgggagtttcggcgacggtgattcggacgttttaggcggttgttggtttagttttttcgttttcgaggtaggatttgtgggagtaaaagttcgaggcgtcgtcgggatttttttcgtttcggcgtttagttaggtttcgtttttattttatatttcgtcgttttttttttttcgcgttcgttttcgttagttcgttcgtcgcgggtcgcgggtcgttttcggttttcgcgtcgttggggcggggttttcgcggtcggggaggcggtgagggggcggggtcgtagttcgggatcgtttatggggcgtggcggggttggatgcggataggttgggcggacgcgggaggtcggggaaggagaggcgaaaaatacgtttttgatggatgagaggtataggggatagtttttgtggatcgagatttaataggggagggagattatggaaat

SEQ ID NO: 34278 - DNA, 777 bp, Artificial Sequence
  chemically treated genomic DNA (Homo sapiens) CpG-island No: 34278
atttccataatctccctcccctattaaatctcgatccacaaaaactatcccctatacctctcatccatcaaaaacgtatttttcgcctctccttccccgacctcccgcgtccgcccaacctatccgcatccaaccccgccacgccccataaacgatcccgaactacgaccccgccccctcaccgcctccccgaccgcgaaaaccccgccccaacgacgcgaaaaccgaaaacgacccgcgacccgcgacgaacgaactaacgaaaacgaacgcgaaaaaaaaaaaacgacgaaatataaaataaaaacgaaacctaactaaacgccgaaacgaaaaaaatcccgacgacgcctcgaacttttactcccacaaatcctacctcgaaaacgaaaaaactaaaccaacaaccgcctaaaacgtccgaatcaccgtcgccgaaactcccgcgctccccaaaacgataaaacgcgaaactcgacaaccgccaacgaaacataacgccctaaacgctataacgctactaccaacgcgtcgtaaactaaataccgatactcttcatcaccttcgtaatcgtctaatcctactacgcgtacgtaataaaactctacgtatataaataccgtccccgaaaactacgacgaaacgcgaaccgcgactaaaacgcgaaataaacctctacgccccacacccgccgcctttctaaaaccaacgccgaacgccgaacgtccgaccccgaacgcgctcgaaaacgccgaaattactacacccgccgcttta

SEQ ID NO: 34279 - DNA, 777 bp, Artificial Sequence
  chemically treated genomic DNA (Homo sapiens) CpG-island No: 34279
atttttatagttttttttttttattgagtttcgatttataaaagttattttttgtattttttatttattaagggcgtgtttttcgttttttttttttcggtttttcgcgttcgtttagtttgttcgtatttagtttcgttacgttttatgggcggtttcgagttgcggtttcgtttttttatcgttttttcggtcgcggaaatttcgttttaacgacgcggagatcgggggcggttcgcggttcgcggcgggcgggttggcggggacggacgcggggggaggggggcgacgggatgtggggtgggggcggggtttggttgggcgtcgggacgggaggagtttcggcggcgtttcggatttttgtttttataagttttgtttcggaggcgggggagttggattagtagtcgtttggagcgttcgagttatcgtcgtcggggttttcgcgttttttagaacggtgggacgcggggttcggtagtcgttagcggaatatggcgttttggacgttgtggcgttgttgttagcgcgtcgtgggttgggtgtcggtgttttttattattttcgtggtcgtttggttttattacgcgtacgtggtggagttttgcgtgtgtgagtatcgttttcggggattgcggcggggcgcgggtcgcggttagggcgcgagataggtttttgcgttttatattcgtcgtttttttggagttagcgtcggacgtcgggcgttcggtttcgaacgcgttcggaagcgtcgaggttgttgtattcgtcgttttg

SEQ ID NO: 34280 - DNA, 777 bp, Artificial Sequence
  chemically treated genomic DNA (Homo sapiens) CpG-island No: 34280
caaaacgacgaatacaacaacctcgacgcttccgaacgcgttcgaaaccgaacgcccgacgtccgacgctaactccaaaaaaacgacgaatataaaacgcaaaaacctatctcgcgccctaaccgcgacccgcgccccgccgcaatccccgaaaacgatactcacacacgcaaaactccaccacgtacgcgtaataaaaccaaacgaccacgaaaataataaaaaacaccgacacccaacccacgacgcgctaacaacaacgccacaacgtccaaaacgccatattccgctaacgactaccgaaccccgcgtcccaccgttctaaaaaacgcgaaaaccccgacgacgataactcgaacgctccaaacgactactaatccaactcccccgcctccgaaacaaaacttataaaaacaaaaatccgaaacgccgccgaaactcctcccgtcccgacgcccaaccaaaccccgcccccaccccacatcccgtcgcccccctccccccgcgtccgtccccgccaacccgcccgccgcgaaccgcgaaccgcccccgatctccgcgtcgttaaaacgaaatttccgcgaccgaaaaaacgataaaaaaacgaaaccgcaactcgaaaccgcccataaaacgtaacgaaactaaatacgaacaaactaaacgaacgcgaaaaaccgaaaaaaaaaaaacgaaaaacacgcccttaataaataaaaaatacaaaaaataacttttataaatcgaaactcaataaaaaaaaaaaactataaaaat

SEQ ID NO: 34281 - DNA, 537 bp, Artificial Sequence
  chemically treated genomic DNA (Homo sapiens) CpG-island No: 34281
tgaacgtgaagggggttcgaggtcgaggaagattcggagttcggttagaagggtcggtttgagagaagttagtttcgcgtttgatagattttcgtttcgttgtttgggttttggggatacggtgtcgcgggcgacggcggttcggtcgatcgaaagcgttttcgttcggagtttgaggttttcggtacgggtaattttcggttatttatacgcgtaggttttattttagtcgcgatttcggtttttgtttcggtttcggtcgcggttgttttcgatacgttgttgttggcgttggtggcggcggttgcggcggcggcggtcgcgagttttagtttcgggttatcgttttagttttagattattttttttttggtagcggtcgtttgcgtcgtttgttagtaagtcgtatttttattggtcgttcgttggggtgacgttacgtcggggcgaaagtcgtggcggagaggtggggcgttaaaggggttttgtttcggttggggttgggttttatttgtcgattagggtggtttcgttttt

SEQ ID NO: 34282 - DNA, 537 bp, Artificial Sequence
  chemically treated genomic DNA (Homo sapiens) CpG-island No: 34282
aaaaacgaaaccaccctaatcgacaaataaaacccaaccccaaccgaaacaaaacccctttaacgccccacctctccgccacgactttcgccccgacgtaacgtcaccccaacgaacgaccaataaaaatacgacttactaacaaacgacgcaaacgaccgctaccaaaaaaaaaataatctaaaactaaaacgataacccgaaactaaaactcgcgaccgccgccgccgcaaccgccgccaccaacgccaacaacaacgtatcgaaaacaaccgcgaccgaaaccgaaacaaaaaccgaaatcgcgactaaaataaaacctacgcgtataaataaccgaaaattacccgtaccgaaaacctcaaactccgaacgaaaacgctttcgatcgaccgaaccgccgtcgcccgcgacaccgtatccccaaaacccaaacaacgaaacgaaaatctatcaaacgcgaaactaacttctctcaaaccgacccttctaaccgaactccgaatcttcctcgacctcgaacccccttcacgttca

SEQ ID NO: 34283 - DNA, 537 bp, Artificial Sequence
  chemically treated genomic DNA (Homo sapiens) CpG-island No: 34283
gggggcggggttattttaatcggtaggtgggatttagttttagtcggggtagggtttttttaacgttttattttttcgttacgattttcgtttcggcgtgacgttattttagcgggcgattaatgggagtgcggtttattggtaggcggcgtaggcggtcgttgttaaaggggaagtgatttggggttggagcgatggttcggggttggagttcgcggtcgtcgtcgtcgtagtcgtcgttattaacgttaataataacgtgtcgggagtagtcgcggtcgaagtcggagtaggggtcggagtcgcggttggagtggggtttgcgcgtgtgagtggtcgagagttgttcgtgtcggagattttaaatttcgggcgggagcgttttcggtcggtcgagtcgtcgtcgttcgcggtatcgtgtttttaaggtttagatagcggggcgggggtttattaggcgcgggattggttttttttaggtcgatttttttagtcgggtttcggatttttttcggtttcgggttttttttacgttta

SEQ ID NO: 34284 - DNA, 537 bp, Artificial Sequence
  chemically treated genomic DNA (Homo sapiens) CpG-island No: 34284
taaacgtaaaaaaaacccgaaaccgaaaaaaatccgaaacccgactaaaaaaatcgacctaaaaaaaaccaatcccgcgcctaataaacccccgccccgctatctaaaccttaaaaacacgataccgcgaacgacgacgactcgaccgaccgaaaacgctcccgcccgaaatttaaaatctccgacacgaacaactctcgaccactcacacgcgcaaaccccactccaaccgcgactccgacccctactccgacttcgaccgcgactactcccgacacgttattattaacgttaataacgacgactacgacgacgacgaccgcgaactccaaccccgaaccatcgctccaaccccaaatcacttcccctttaacaacgaccgcctacgccgcctaccaataaaccgcactcccattaatcgcccgctaaaataacgtcacgccgaaacgaaaatcgtaacgaaaaaataaaacgttaaaaaaaccctaccccgactaaaactaaatcccacctaccgattaaaataaccccgccccc

SEQ ID NO: 34285 - DNA, 652 bp, Artificial Sequence
  chemically treated genomic DNA (Homo sapiens) CpG-island No: 34285
ggatttttttcgagtacggtcggcgtcgttacggttttattatttatcgcgcgtttacgagtttgtattttagtcgtatttttattttcgatgttcgtttttatttcggtcgacgtattttcgttttatcgatttttgtagatcgtacgaattttgtatttacggtttattcgatcgatttacggttcgtttattcgtttatttatttttttttagatacggtttgatttatcgtatacgttcgagtttacgttgttatatattgcgtattttttattcgattttacgtatgtttatatcgtatcgacgtatgtttgtattcgcgatagtattcgacgttcgtacgtagtatatttttttagatgtatgcgtttagaattagcgtgagagtttatgtttggatcgtattttatcgtttcgtttcgtatattatattatttttagttattatgacgcgtatcgatatacgtatatatttacgttttttcgtattcgatcggttttttgattatattcgttttcgatttttacgttatcgtttggttttcgttttattcgttattatttcgtttttacgcgttattcgatcgatttttgatgttattcgatcgttatcgtatcgttatcgtatcgtattcgattatagatcgat

SEQ ID NO: 34286 - DNA, 652 bp, Artificial Sequence
  chemically treated genomic DNA (Homo sapiens) CpG-island No: 34286
atcgatctataatcgaatacgatacgataacgatacgataacgatcgaataacatcaaaaatcgatcgaataacgcgtaaaaacgaaataataacgaataaaacgaaaaccaaacgataacgtaaaaatcgaaaacgaatataatcaaaaaaccgatcgaatacgaaaaaacgtaaatatatacgtatatcgatacgcgtcataataactaaaaataatataatatacgaaacgaaacgataaaatacgatccaaacataaactctcacgctaattctaaacgcatacatctaaaaaaatatactacgtacgaacgtcgaatactatcgcgaatacaaacatacgtcgatacgatataaacatacgtaaaatcgaataaaaaatacgcaatatataacaacgtaaactcgaacgtatacgataaatcaaaccgtatctaaaaaaaaataaataaacgaataaacgaaccgtaaatcgatcgaataaaccgtaaatacaaaattcgtacgatctacaaaaatcgataaaacgaaaatacgtcgaccgaaataaaaacgaacatcgaaaataaaaatacgactaaaatacaaactcgtaaacgcgcgataaataataaaaccgtaacgacgccgaccgtactcgaaaaaaatcc

SEQ ID NO: 34287 - DNA, 652 bp, Artificial Sequence
  chemically treated genomic DNA (Homo sapiens) CpG-island No: 34287
atcggtttgtggtcggatacgatgcgatgacgatgcgatgacgatcgagtagtattagagatcgatcgagtggcgcgtaggagcggagtgatggcgagtggagcgagagttaggcgatggcgtgagagtcgagagcgagtgtagttagagagtcgatcgagtacgagagagcgtggatgtgtgcgtatgtcgatgcgcgttatgatgattgaggatggtgtgatgtacgaggcgaggcgatagagtgcgatttagatatgagtttttacgttagttttgggcgtatgtatttggagaagtgtgttgcgtgcgagcgtcgagtgttgtcgcgagtgtaggtatgcgtcggtgcgatgtgaatatgcgtagaatcggatggagaatacgtagtgtgtggtagcgtgaattcggacgtatacggtgggttagatcgtgtttgagagaggatggataggcggataggcgagtcgtaggtcgatcgaatgagtcgtgggtgtagggttcgtgcgatttatagaggtcggtaggacgaggatacgtcggtcggagtgaggacggatatcgagagtggggatgcgattggggtatagattcgtaggcgcgcgatgagtggtgaggtcgtggcgacgtcggtcgtgttcgagagaggttt

SEQ ID NO: 34288 - DNA, 652 bp, Artificial Sequence
  chemically treated genomic DNA (Homo sapiens) CpG-island No: 34288
aaacctctctcgaacacgaccgacgtcgccacgacctcaccactcatcgcgcgcctacgaatctataccccaatcgcatccccactctcgatatccgtcctcactccgaccgacgtatcctcgtcctaccgacctctataaatcgcacgaaccctacacccacgactcattcgatcgacctacgactcgcctatccgcctatccatcctctctcaaacacgatctaacccaccgtatacgtccgaattcacgctaccacacactacgtattctccatccgattctacgcatattcacatcgcaccgacgcatacctacactcgcgacaacactcgacgctcgcacgcaacacacttctccaaatacatacgcccaaaactaacgtaaaaactcatatctaaatcgcactctatcgcctcgcctcgtacatcacaccatcctcaatcatcataacgcgcatcgacatacgcacacatccacgctctctcgtactcgatcgactctctaactacactcgctctcgactctcacgccatcgcctaactctcgctccactcgccatcactccgctcctacgcgccactcgatcgatctctaatactactcgatcgtcatcgcatcgtcatcgcatcgtatccgaccacaaaccgat

SEQ ID NO: 34289 - DNA, 1085 bp, Artificial Sequence
  chemically treated genomic DNA (Homo sapiens) CpG-island No: 34289
agtcgttattcgggcgcggttgggaggaggcgtttagaggaggcggcggtcgggttttttcggttcggagtttttcggaggattgttcgatggcggcggtattgttcgagtcgttttgtagcggtgtggagatttcgattagttggggtaggcggtttaggtcgcggttagttaggtagtaaacgagggtgacgttaaggtgtagagcgtagacggttacgagtaggcggtaggttcgttgtagggacgcgtttggtatcgcggcgttgtcgtttaggagcggttttcgaagttttattttttcgtcgtcgttttaagaagggtgtgggttataggaggggaggcgattcgttcgcgggtcgttcgttaggcgttgttttatagcggcgattaggggagggttcggagcgggggcgggcgagcggttgagagttgagatttttttagttagttagatttgggagcggcgagaagtcgttcgaggcgtcggcggagaggggaggggcggggtttcggcgaaggcgggggcggggtcgggcgcggggttttttggacgagggcgggaaggcggggtagttcgtggcgggatgggcgcgttgggcggggtttcgggagggtgggtagcgggcggggcgtcgtcgtggggttttcggagtatgattgtagtttcgacgtttggtcgcgtatcgttttttttttttcgagtttttgcggcggagtttcggtcgcgttgagtcgcgtttttttttttttttttacgttgttttcgataggtcgcgttattttttggggtgcgaagggattcgggtgcgagtttgggtttgtagcgcggcggcggagagaacggagaggatagttggcgggtggttatttggagtggtttggggtcgcggcggcgttttggttagtgggttttggtgggttaggaagagaggtagaaaaaggttatttaggaaacgggtttcgacgtcgggcgaggagtggtacgttcgaaattttttttttaatttagttcggttggatttcgttgtttaacggggggttttgcggtaaagaaagtggacgggttgttatttttgtgtttt

SEQ ID NO: 34290 - DNA, 1085 bp, Artificial Sequence
  chemically treated genomic DNA (Homo sapiens) CpG-island No: 34290
aaaacacaaaaataacaacccgtccactttctttaccgcaaaaccccccgttaaacaacgaaatccaaccgaactaaattaaaaaaaaaatttcgaacgtaccactcctcgcccgacgtcgaaacccgtttcctaaataacctttttctacctctcttcctaacccaccaaaacccactaaccaaaacgccgccgcgaccccaaaccactccaaataaccacccgccaactatcctctccgttctctccgccgccgcgctacaaacccaaactcgcacccgaatcccttcgcaccccaaaaaataacgcgacctatcgaaaacaacgtaaaaaaaaaaaaaaaaacgcgactcaacgcgaccgaaactccgccgcaaaaactcgaaaaaaaaaaaacgatacgcgaccaaacgtcgaaactacaatcatactccgaaaaccccacgacgacgccccgcccgctacccaccctcccgaaaccccgcccaacgcgcccatcccgccacgaactaccccgccttcccgccctcgtccaaaaaaccccgcgcccgaccccgcccccgccttcgccgaaaccccgcccctcccctctccgccgacgcctcgaacgacttctcgccgctcccaaatctaactaactaaaaaaatctcaactctcaaccgctcgcccgcccccgctccgaaccctcccctaatcgccgctataaaacaacgcctaacgaacgacccgcgaacgaatcgcctcccctcctataacccacacccttcttaaaacgacgacgaaaaaataaaacttcgaaaaccgctcctaaacgacaacgccgcgataccaaacgcgtccctacaacgaacctaccgcctactcgtaaccgtctacgctctacaccttaacgtcaccctcgtttactacctaactaaccgcgacctaaaccgcctaccccaactaatcgaaatctccacaccgctacaaaacgactcgaacaataccgccgccatcgaacaatcctccgaaaaactccgaaccgaaaaaacccgaccgccgcctcctctaaacgcctcctcccaaccgcgcccgaataacgact

SEQ ID NO: 34291 - DNA, 1085 bp, Artificial Sequence
  chemically treated genomic DNA (Homo sapiens) CpG-island No: 34291
gaggtatagaagtggtaattcgtttattttttttgtcgtaggatttttcgttaagtagcggggtttagtcgggttgagttagggagggggtttcgaacgtgttatttttcgttcggcgtcgaagttcgttttttgggtaatttttttttgtttttttttttagtttattaaggtttattggttagaacgtcgtcgcggttttaaattattttagataattattcgttagttgtttttttcgtttttttcgtcgtcgcgttgtaggtttaggttcgtattcgagttttttcgtattttaggaagtggcgcggtttgtcgagggtagcgtggaggaggaagaggaggcgcggtttaacgcgatcgaagtttcgtcgtaaaggttcgggaggaagagggcggtgcgcggttaagcgtcggagttgtagttatatttcggggattttacgacggcgtttcgttcgttgtttattttttcgaggtttcgtttagcgcgtttatttcgttacgggttgtttcgttttttcgttttcgtttagaaaatttcgcgttcggtttcgttttcgttttcgtcggggtttcgtttttttttttttcgtcggcgtttcgggcggtttttcgtcgtttttaggtttggttggttggaggagttttagtttttagtcgttcgttcgttttcgtttcgggtttttttttagtcgtcgttgtggggtagcgtttggcgggcggttcgcgggcgggtcgtttttttttttgtagtttatattttttttaaagcggcggcgggaagatgaggtttcgggagtcgtttttgagcggtagcgtcgcgatgttaggcgcgtttttatagcgggtttgtcgtttgttcgtggtcgtttgcgttttgtattttggcgttattttcgtttattatttggttggtcgcgatttgagtcgtttgttttaattggtcggagtttttatatcgttgtagggcggttcgaatagtgtcgtcgttatcgggtagtttttcggggagtttcggatcggaggggttcggtcgtcgttttttttaggcgtttttttttagtcgcgttcgggtggcgatt

SEQ ID NO: 34292 - DNA, 1085 bp, Artificial Sequence
  chemically treated genomic DNA (Homo sapiens) CpG-island No: 34292
aatcgccacccgaacgcgactaaaaaaaaacgcctaaaaaaaacgacgaccgaacccctccgatccgaaactccccgaaaaactacccgataacgacgacactattcgaaccgccctacaacgatataaaaactccgaccaattaaaacaaacgactcaaatcgcgaccaaccaaataataaacgaaaataacgccaaaatacaaaacgcaaacgaccacgaacaaacgacaaacccgctataaaaacgcgcctaacatcgcgacgctaccgctcaaaaacgactcccgaaacctcatcttcccgccgccgctttaaaaaaaatataaactacaaaaaaaaaaacgacccgcccgcgaaccgcccgccaaacgctaccccacaacgacgactaaaaaaaaacccgaaacgaaaacgaacgaacgactaaaaactaaaactcctccaaccaaccaaacctaaaaacgacgaaaaaccgcccgaaacgccgacgaaaaaaaaaaaaacgaaaccccgacgaaaacgaaaacgaaaccgaacgcgaaattttctaaacgaaaacgaaaaaacgaaacaacccgtaacgaaataaacgcgctaaacgaaacctcgaaaaaataaacaacgaacgaaacgccgtcgtaaaatccccgaaatataactacaactccgacgcttaaccgcgcaccgccctcttcctcccgaacctttacgacgaaacttcgatcgcgttaaaccgcgcctcctcttcctcctccacgctaccctcgacaaaccgcgccacttcctaaaatacgaaaaaactcgaatacgaacctaaacctacaacgcgacgacgaaaaaaacgaaaaaaacaactaacgaataattatctaaaataatttaaaaccgcgacgacgttctaaccaataaaccttaataaactaaaaaaaaaaacaaaaaaaaattacccaaaaaacgaacttcgacgccgaacgaaaaataacacgttcgaaaccccctccctaactcaacccgactaaaccccgctacttaacgaaaaatcctacgacaaaaaaaataaacgaattaccacttctatacctc

SEQ ID NO: 34293 - DNA, 815 bp, Artificial Sequence
  chemically treated genomic DNA (Homo sapiens) CpG-island No: 34293
gtatataggtttttgcgtaaggggcgagcgcggagttggtatttttgtttgaggttttcgcgcggggttgtggcgtcgacggatttattcggttagggggaggggtcgagttcggttgtatgtaatattcggaaggcggcggaggatagtaaggtggttggtcggtaggttaatggcggttaacgttattttcggtcgtttttcgagtatcgtttttcggtaattcgaagttataggatggaggagggggattttagtaaaggtagcgattaaggggatttaagtagaacgggagggcgacgttcggagcggcggtagagttaggggacgttgtgtgaggttggtaaagcggtgtttatttagttttttcgggtttcgtcgtcgtcggaggaggataggaggtcggtaaggcgatttttaaatttttttaggttttgattttcgttttttaattttcgtaaattttaattcggttttggaaaatttcgcgagaacgggttttcgaattgttattgggatttcgcgagaacgaaatttttttttttgtgggcggagtaattttttcgatgttttttttttttgaggttagtagtaggaagggtttcgggagttgcgagtgtcgcgaggtttgaggtcgttcggtgggtcgggcgttgtgcgaagttagaaataattgggggtatggagaatgcggtggttgtaaagggtcgttgaggcggtggaggtttggtagagagcgttttcgcggtcgcggtttttggtttttttgtggagtttggttttttcgtggtggtgtagtattttaggaattttag

SEQ ID NO: 34294 - DNA, 815 bp, Artificial Sequence
  chemically treated genomic DNA (Homo sapiens) CpG-island No: 34294
ctaaaattcctaaaatactacaccaccacgaaaaaaccaaactccacaaaaaaaccaaaaaccgcgaccgcgaaaacgctctctaccaaacctccaccgcctcaacgaccctttacaaccaccgcattctccatacccccaattatttctaacttcgcacaacgcccgacccaccgaacgacctcaaacctcgcgacactcgcaactcccgaaacccttcctactactaacctcaaaaaaaaaaaacatcgaaaaaattactccgcccacaaaaaaaaaaatttcgttctcgcgaaatcccaataacaattcgaaaacccgttctcgcgaaattttccaaaaccgaattaaaatttacgaaaattaaaaaacgaaaatcaaaacctaaaaaaatttaaaaatcgccttaccgacctcctatcctcctccgacgacgacgaaacccgaaaaaactaaataaacaccgctttaccaacctcacacaacgtcccctaactctaccgccgctccgaacgtcgccctcccgttctacttaaatccccttaatcgctacctttactaaaatccccctcctccatcctataacttcgaattaccgaaaaacgatactcgaaaaacgaccgaaaataacgttaaccgccattaacctaccgaccaaccaccttactatcctccgccgccttccgaatattacatacaaccgaactcgacccctccccctaaccgaataaatccgtcgacgccacaaccccgcgcgaaaacctcaaacaaaaataccaactccgcgctcgccccttacgcaaaaacctatatac

SEQ ID NO: 34295 - DNA, 815 bp, Artificial Sequence
  chemically treated genomic DNA (Homo sapiens) CpG-island No: 34295
ttgaagtttttggggtgttgtattattacggaagaattaagttttatagagaagttagaagtcgcgatcgcggggacgttttttgttaggtttttatcgttttagcggttttttatagttatcgtattttttatgtttttagttatttttagtttcgtatagcgttcggtttatcgagcgattttaaatttcgcgatattcgtaattttcgaggttttttttgttattggttttagagggaagagatatcgggaagattgtttcgtttatagaaaggaagatttcgttttcgcgagattttaatgataattcgggagttcgttttcgcgggattttttaagatcgggttggaatttgcgggggttaggagacggaagttagagtttaggaagatttgggggtcgttttgtcggttttttgttttttttcggcggcggcggagttcgagagaattaggtgaatatcgttttgttagttttatatagcgttttttggttttgtcgtcgtttcggacgtcgttttttcgttttgtttgggtttttttagtcgttatttttgttgggattttttttttttattttgtggtttcgggttgtcgaagagcgatgttcggagggcggtcggaagtggcgttggtcgttattggtttgtcggttagttattttgttgtttttcgtcgtttttcgggtgttatatgtagtcgggttcggtttttttttttggtcggatggattcgtcggcgttatagtttcgcgcggaaattttaggtaaaggtattagtttcgcgttcgttttttacgtagaggtttgtgtat

SEQ ID NO: 34296 - DNA, 815 bp, Artificial Sequence
  chemically treated genomic DNA (Homo sapiens) CpG-island No: 34296
atacacaaacctctacgtaaaaaacgaacgcgaaactaatacctttacctaaaatttccgcgcgaaactataacgccgacgaatccatccgaccaaaaaaaaaaaccgaacccgactacatataacacccgaaaaacgacgaaaaacaacaaaataactaaccgacaaaccaataacgaccaacgccacttccgaccgccctccgaacatcgctcttcgacaacccgaaaccacaaaataaaaaaaaaaaatcccaacaaaaataacgactaaaaaaacccaaacaaaacgaaaaaacgacgtccgaaacgacgacaaaaccaaaaaacgctatataaaactaacaaaacgatattcacctaattctctcgaactccgccgccgccgaaaaaaaacaaaaaaccgacaaaacgacccccaaatcttcctaaactctaacttccgtctcctaacccccgcaaattccaacccgatcttaaaaaatcccgcgaaaacgaactcccgaattatcattaaaatctcgcgaaaacgaaatcttcctttctataaacgaaacaatcttcccgatatctcttccctctaaaaccaataacaaaaaaaacctcgaaaattacgaatatcgcgaaatttaaaatcgctcgataaaccgaacgctatacgaaactaaaaataactaaaaacataaaaaatacgataactataaaaaaccgctaaaacgataaaaacctaacaaaaaacgtccccgcgatcgcgacttctaacttctctataaaacttaattcttccgtaataatacaacaccccaaaaacttcaa

SEQ ID NO: 34297 - DNA, 877 bp, Artificial Sequence
  chemically treated genomic DNA (Homo sapiens) CpG-island No: 34297
cgaggtcggaggtaggaagtacggtcgggcggggttgggcggagcggtcgcggaggagtaggggtcgtaggcgtttcgttcggattggtatgcggtcgagagtgacgcgggaggcggggttacgtgacgttcgtggaatgttaataatgtagcgaatgttttatttgggtttgcgttttggaatcgcggcgtgagcgtttcgggaagatggagtagtcgtcgtttacgttatcgtcgtcgttcggggttttttcgtttttgcggggttagtagtagttttagttattagtgttcggtttttcggcgcgagaggttcgggagtcgtcggttaggacgttttcgagggtgtagatcgcgtttttggaggtgagggggttgggagttggggtcggggcggtagttcggagggtggcgagagttttcgcgaagcggtcgagttttgcggtttcgcgtatttattgtggtgtcgaggtttcgggaagggcgttcggcggggcggtcgaggaagtttgttcggacggagttttgcgttttgtttttacggttcgcgttcgttcggagtcgttttcgttcggcggttcgtagtttaggtcgtacggagttcgcggagtcggttttagaggagtcggggaagttggaggtcggcgtcgggcgggggtagcggggttgcgtcgttttgttgtgcggcgatcggggcggtcgggatttcggcggggtaggggcggcgcgggtcgggggcggtgttttagatttaaaaggtcgtagcgtcgggcgcgtttttgttttcgttgttttcgggggatcggttttttattagacgttcggtcgggcgtttttgatagtttcgggattttcggttcggcggcgtagcggttta

SEQ ID NO: 34298 - DNA, 877 bp, Artificial Sequence
  chemically treated genomic DNA (Homo sapiens) CpG-island No: 34298
taaaccgctacgccgccgaaccgaaaatcccgaaactatcaaaaacgcccgaccgaacgtctaataaaaaaccgatcccccgaaaacaacgaaaacaaaaacgcgcccgacgctacgaccttttaaatctaaaacaccgcccccgacccgcgccgcccctaccccgccgaaatcccgaccgccccgatcgccgcacaacaaaacgacgcaaccccgctacccccgcccgacgccgacctccaacttccccgactcctctaaaaccgactccgcgaactccgtacgacctaaactacgaaccgccgaacgaaaacgactccgaacgaacgcgaaccgtaaaaacaaaacgcaaaactccgtccgaacaaacttcctcgaccgccccgccgaacgcccttcccgaaacctcgacaccacaataaatacgcgaaaccgcaaaactcgaccgcttcgcgaaaactctcgccaccctccgaactaccgccccgaccccaactcccaaccccctcacctccaaaaacgcgatctacaccctcgaaaacgtcctaaccgacgactcccgaacctctcgcgccgaaaaaccgaacactaataactaaaactactactaaccccgcaaaaacgaaaaaaccccgaacgacgacgataacgtaaacgacgactactccatcttcccgaaacgctcacgccgcgattccaaaacgcaaacccaaataaaacattcgctacattattaacattccacgaacgtcacgtaaccccgcctcccgcgtcactctcgaccgcataccaatccgaacgaaacgcctacgacccctactcctccgcgaccgctccgcccaaccccgcccgaccgtacttcctacctccgacctcg

SEQ ID NO: 34299 - DNA, 877 bp, Artificial Sequence
  chemically treated genomic DNA (Homo sapiens) CpG-island No: 34299
tggatcgttgcgtcgtcggatcgggggtttcgaggttgttaggggcgttcggtcgggcgtttagtgaaaagtcgatttttcggagataacggaagtagaggcgcgttcggcgttacggttttttgggtttaggatatcgttttcggttcgcgtcgtttttgtttcgtcgggatttcggtcgtttcggtcgtcgtataataaagcggcgtagtttcgttgttttcgttcgacgtcggtttttaattttttcggtttttttggaatcggtttcgcgggtttcgtacggtttggattacgagtcgtcgggcgggggcggtttcgggcgggcgcggatcgtgggggtagggcgtagggtttcgttcggataaattttttcggtcgtttcgtcgggcgtttttttcggagtttcggtattatagtaggtgcgcggagtcgtagggttcgatcgtttcgcggaaattttcgttatttttcgagttgtcgtttcgattttagtttttagtttttttatttttaggggcgcggtttatattttcgggggcgttttggtcggcggttttcgggtttttcgcgtcgggagatcgggtattggtggttggagttgttgttggtttcgtagggacgggggagtttcgggcggcggcggtggcgtggacggcgattgttttattttttcggggcgtttacgtcgcggttttaaagcgtagatttaagtgggatattcgttatattgttggtattttacgggcgttacgtgatttcgtttttcgcgttattttcggtcgtatattagttcgggcggggcgtttgcggtttttgttttttcgcggtcgtttcgtttagtttcgttcggtcgtgttttttgttttcggtttcg

SEQ ID NO: 34300 - DNA, 877 bp, Artificial Sequence
  chemically treated genomic DNA (Homo sapiens) CpG-island No: 34300
cgaaaccgaaaacaaaaaacacgaccgaacgaaactaaacgaaacgaccgcgaaaaaacaaaaaccgcaaacgccccgcccgaactaatatacgaccgaaaataacgcgaaaaacgaaatcacgtaacgcccgtaaaataccaacaatataacgaatatcccacttaaatctacgctttaaaaccgcgacgtaaacgccccgaaaaaataaaacaatcgccgtccacgccaccgccgccgcccgaaactcccccgtccctacgaaaccaacaacaactccaaccaccaatacccgatctcccgacgcgaaaaacccgaaaaccgccgaccaaaacgcccccgaaaatataaaccgcgcccctaaaaataaaaaaactaaaaactaaaatcgaaacgacaactcgaaaaataacgaaaatttccgcgaaacgatcgaaccctacgactccgcgcacctactataataccgaaactccgaaaaaaacgcccgacgaaacgaccgaaaaaatttatccgaacgaaaccctacgccctacccccacgatccgcgcccgcccgaaaccgcccccgcccgacgactcgtaatccaaaccgtacgaaacccgcgaaaccgattccaaaaaaaccgaaaaaattaaaaaccgacgtcgaacgaaaacaacgaaactacgccgctttattatacgacgaccgaaacgaccgaaatcccgacgaaacaaaaacgacgcgaaccgaaaacgatatcctaaacccaaaaaaccgtaacgccgaacgcgcctctacttccgttatctccgaaaaatcgacttttcactaaacgcccgaccgaacgcccctaacaacctcgaaacccccgatccgacgacgcaacgatcca

SEQ ID NO: 34301 - DNA, 542 bp, Artificial Sequence
  chemically treated genomic DNA (Homo sapiens) CpG-island No: 34301
tcgtgacggttgttacggtcgcgtatattttgtattcggtgaagagcgtgcgtgtgttgaggtcggagtcgtagacggttgtggggttttcgtatttcgtttgggtgttcgcgtttgtttcggttttcgttttcgttttcgtttcggttgcggagggtttggacgttaaggaggagtatgttttggcgttgggcggcgtaggcgttttttcgttggacgtggagtacggaggtttagatcggaggtgttcgttttcgttttattcgaagtatttgttgttgcgtagtaagtcggagtagtacgatttggatagtttgtgcgtaggtatggagtagagttttcgtgcgggttttaacgagttcgagggcggcgataagagtcgtaaaagcgttaagggggataaaggcggaaaggataaaaagtagatttagatttttttcgttttcgttcgtaaaaatagtagagacgaagagaagagagagttacgtattaagagttattcgttatacgtttttaagttttttatggagtagtacgtggag

SEQ ID NO: 34302 - DNA, 542 bp, Artificial Sequence
  chemically treated genomic DNA (Homo sapiens) CpG-island No: 34302
ctccacgtactactccataaaaaacttaaaaacgtataacgaataactcttaatacgtaactctctcttctcttcgtctctactatttttacgaacgaaaacgaaaaaaatctaaatctactttttatcctttccgcctttatcccccttaacgcttttacgactcttatcgccgccctcgaactcgttaaaacccgcacgaaaactctactccatacctacgcacaaactatccaaatcgtactactccgacttactacgcaacaacaaatacttcgaataaaacgaaaacgaacacctccgatctaaacctccgtactccacgtccaacgaaaaaacgcctacgccgcccaacgccaaaacatactcctccttaacgtccaaaccctccgcaaccgaaacgaaaacgaaaacgaaaaccgaaacaaacgcgaacacccaaacgaaatacgaaaaccccacaaccgtctacgactccgacctcaacacacgcacgctcttcaccgaatacaaaatatacgcgaccgtaacaaccgtcacga

SEQ ID NO: 34303 - DNA, 542 bp, Artificial Sequence
  chemically treated genomic DNA (Homo sapiens) CpG-island No: 34303
ttttacgtgttgttttatgaagaatttaaaggcgtatggcgagtagtttttgatgcgtgattttttttttttttcgtttttgttgtttttgcggacgggaacgggagaggtttgaatttgttttttatttttttcgtttttgttttttttggcgtttttgcggtttttgtcgtcgttttcgggttcgttggggttcgtacggaggttttgttttatgtttgcgtataggttgtttaggtcgtattgtttcgatttgttgcgtagtagtaggtgtttcgggtagggcggaggcgggtattttcggtttgggttttcgtattttacgtttagcgggaaggcgtttgcgtcgtttagcgttagggtatgtttttttttggcgtttaagtttttcgtagtcggggcgggggcgggggcgggggtcggggtaggcgcgggtatttaggcggggtgcgagggttttatagtcgtttgcggtttcggttttagtatacgtacgttttttatcgggtgtaagatgtgcgcggtcgtgatagtcgttacgg

SEQ ID NO: 34304 - DNA, 542 bp, Artificial Sequence
  chemically treated genomic DNA (Homo sapiens) CpG-island No: 34304
ccgtaacgactatcacgaccgcgcacatcttacacccgataaaaaacgtacgtatactaaaaccgaaaccgcaaacgactataaaaccctcgcaccccgcctaaatacccgcgcctaccccgacccccgcccccgcccccgccccgactacgaaaaacttaaacgccaaaaaaaaacataccctaacgctaaacgacgcaaacgccttcccgctaaacgtaaaatacgaaaacccaaaccgaaaatacccgcctccgccctacccgaaacacctactactacgcaacaaatcgaaacaatacgacctaaacaacctatacgcaaacataaaacaaaacctccgtacgaaccccaacgaacccgaaaacgacgacaaaaaccgcaaaaacgccaaaaaaaacaaaaacgaaaaaaataaaaaacaaattcaaacctctcccgttcccgtccgcaaaaacaacaaaaacgaaaaaaaaaaaaaatcacgcatcaaaaactactcgccatacgcctttaaattcttcataaaacaacacgtaaaa

SEQ ID NO: 34305 - DNA, 719 bp, Artificial Sequence
  chemically treated genomic DNA (Homo sapiens) CpG-island No: 34305
ttatttatttgtcgtttcgatgattatggggatcgtttgttaatatttttatatataagtagacgtacgtattttgggagtttacggttttcgtcgggagggtatttgtagttaagtcgttaggtagttcgttattggttttcgtgattcgatttttatagtggggtgatttttttgtggggtaggcgtttcggggtttacgagttcgaggagtttcgggagcgttagtgttcgaacgtgttggtaggtttttggtttttttcgagcgaatttatttcggttttgatttacggtttcggttttttggatcggagtaggtatgggtgagagagggaagcgtatatttttcggtcggagtcgtagatttcgttcgtttttttacgttttttagttaaggtagttattttttcggtttttatttaggtggtttcgagcgatttttttttttttggtttatcggatagggatttcgttttcgaattttgagttattttggagtggtttcggtataagtcgcggttttatttgggacggggattcgtttagagtttttttgaggtttttttcggttggagagagggcgtttgcgataggggagtgtacggcgggatttagcgtcgttttcgtttgtgtttaggtttttaaagtgcgcggtgcggggaagacggaggcgggagtcgtttcgagatttttagggggttagttttgtatttgggtag

SEQ ID NO: 34306 - DNA, 719 bp, Artificial Sequence
  chemically treated genomic DNA (Homo sapiens) CpG-island No: 34306
ctacccaaatacaaaactaaccccctaaaaatctcgaaacgactcccgcctccgtcttccccgcaccgcgcactttaaaaacctaaacacaaacgaaaacgacgctaaatcccgccgtacactcccctatcgcaaacgccctctctccaaccgaaaaaaacctcaaaaaaactctaaacgaatccccgtcccaaataaaaccgcgacttataccgaaaccactccaaaataactcaaaattcgaaaacgaaatccctatccgataaaccaaaaaaaaaaaaatcgctcgaaaccacctaaataaaaaccgaaaaaataactaccttaactaaaaaacgtaaaaaaacgaacgaaatctacgactccgaccgaaaaatatacgcttccctctctcacccatacctactccgatccaaaaaaccgaaaccgtaaatcaaaaccgaaataaattcgctcgaaaaaaaccaaaaacctaccaacacgttcgaacactaacgctcccgaaactcctcgaactcgtaaaccccgaaacgcctaccccacaaaaaaatcaccccactataaaaatcgaatcacgaaaaccaataacgaactacctaacgacttaactacaaataccctcccgacgaaaaccgtaaactcccaaaatacgtacgtctacttatatataaaaatattaacaaacgatccccataatcatcgaaacgacaaataaataa

SEQ ID NO: 34307 - DNA, 719 bp, Artificial Sequence
  chemically treated genomic DNA (Homo sapiens) CpG-island No: 34307
ttgtttaggtgtaggattggttttttgggggtttcgggacggttttcgttttcgtttttttcgtatcgcgtattttggaggtttgggtataggcggaggcggcgttgggtttcgtcgtatatttttttgtcgtaggcgttttttttttagtcggagggaattttaaaaaagttttgagcgagttttcgttttaggtggggtcgcggtttatatcgggattattttagggtagtttaaggttcgaaaacggaatttttgttcggtgaattagagaagagaaaatcgttcggggttatttgggtagagatcggaggagtgattgttttgattgggaggcgtggaggagcgagcggggtttgcggtttcggtcgggaggtatgcgttttttttttttatttatgtttgtttcggtttaaagagtcgagatcgtgggttaagatcgggatggattcgttcgggagaggttaggagtttgttagtacgttcgggtattagcgttttcggggtttttcggattcgtggatttcgaaacgtttgttttataggaagattattttattgtagaagtcgggttacggggattagtggcgagttatttgacggtttaattatagatattttttcgacgaaagtcgtggatttttagggtgcgtgcgtttgtttgtgtgtgggggtgttggtaggcggtttttataattatcgaagcgataggtggatga

SEQ ID NO: 34308 - DNA, 719 bp, Artificial Sequence
  chemically treated genomic DNA (Homo sapiens) CpG-island No: 34308
tcatccacctatcgcttcgataattataaaaaccgcctaccaacacccccacacacaaacaaacgcacgcaccctaaaaatccacgactttcgtcgaaaaaatatctataattaaaccgtcaaataactcgccactaatccccgtaacccgacttctacaataaaataatcttcctataaaacaaacgtttcgaaatccacgaatccgaaaaaccccgaaaacgctaatacccgaacgtactaacaaactcctaacctctcccgaacgaatccatcccgatcttaacccacgatctcgactctttaaaccgaaacaaacataaataaaaaaaaaaaacgcatacctcccgaccgaaaccgcaaaccccgctcgctcctccacgcctcccaatcaaaacaatcactcctccgatctctacccaaataaccccgaacgattttctcttctctaattcaccgaacaaaaattccgttttcgaaccttaaactaccctaaaataatcccgatataaaccgcgaccccacctaaaacgaaaactcgctcaaaacttttttaaaattccctccgactaaaaaaaaaacgcctacgacaaaaaaatatacgacgaaacccaacgccgcctccgcctatacccaaacctccaaaatacgcgatacgaaaaaaacgaaaacgaaaaccgtcccgaaacccccaaaaaaccaatcctacacctaaacaa

SEQ ID NO: 34309 - DNA, 700 bp, Artificial Sequence
  chemically treated genomic DNA (Homo sapiens) CpG-island No: 34309
tttgggtgcgcggagagcgcgtatggcggttgtgggatcgcggatcggtttcggaatcggcgtcgaggttttagcgttggcggtagagttgtagggcgaggcgacgtgttttatttgtttagagttttttcgtgagtcggtgttcgtcgagtgcggttatagtttttgtcgcgtttgtatagggcgttgttgggagcgttcgggcgcggggtttgttggggtcgttattcgcgcgtttttttttttattgttttgttcgtagtgtcgcgagttcgcgcgttttagttagttgcggtttaatcggtagttggcggcggtggttacgtttttgcggcgttttagtttgttcgcggtcgtttcgggagagtacgggttttaggcggtcgcggttcgggtagcggttgttcgttgcgggtagtatggcgaattttttaagttttattgttaggacgacggacgcgttatttgcgtggtgtgcgatcgcgttcgcgagtatcgcgagtacgtcgtgttgtcgttggacgaggcggtgtaggaggttaaggtgagcgtagtttttatttatttcgtgggttttcgggattttcgatttggtttcgcgttttcgcgtacggggtgtagagaatagtttgtcgattaggaggttcgggtgagttttttttttttttttttattttaggaagtttagcgttggttttcg

SEQ ID NO: 34310 - DNA, 700 bp, Artificial Sequence
  chemically treated genomic DNA (Homo sapiens) CpG-island No: 34310
cgaaaaccaacgctaaacttcctaaaataaaaaaaaaaaaaaaaaactcacccgaacctcctaatcgacaaactattctctacaccccgtacgcgaaaacgcgaaaccaaatcgaaaatcccgaaaacccacgaaataaataaaaactacgctcaccttaacctcctacaccgcctcgtccaacgacaacacgacgtactcgcgatactcgcgaacgcgatcgcacaccacgcaaataacgcgtccgtcgtcctaacaataaaacttaaaaaattcgccatactacccgcaacgaacaaccgctacccgaaccgcgaccgcctaaaacccgtactctcccgaaacgaccgcgaacaaactaaaacgccgcaaaaacgtaaccaccgccgccaactaccgattaaaccgcaactaactaaaacgcgcgaactcgcgacactacgaacaaaacaataaaaaaaaaaacgcgcgaataacgaccccaacaaaccccgcgcccgaacgctcccaacaacgccctatacaaacgcgacaaaaactataaccgcactcgacgaacaccgactcacgaaaaaactctaaacaaataaaacacgtcgcctcgccctacaactctaccgccaacgctaaaacctcgacgccgattccgaaaccgatccgcgatcccacaaccgccatacgcgctctccgcgcacccaaa

SEQ ID NO: 34311 - DNA, 700 bp, Artificial Sequence
  chemically treated genomic DNA (Homo sapiens) CpG-island No: 34311
cgggaattagcgttgggttttttggaatggagaaagaagggaggggtttattcgggttttttgatcgataggttgttttttgtatttcgtgcgcgggagcgcgggattaagtcgggggtttcggggatttacggggtgggtgggggttgcgtttattttggttttttgtatcgtttcgtttagcggtagtacggcgtgttcgcggtgttcgcgggcgcggtcgtatattacgtagatggcgcgttcgtcgttttggtagtagagtttgaagggttcgttatgttgttcgtagcgggtagtcgttgttcgggtcgcggtcgtttgagattcgtgttttttcggggcggtcgcgggtaggttgaagcgtcgtaggagcgtggttatcgtcgttagttgtcggttgggtcgtagttgattggggcgcgcgggttcgcggtattgcggatagggtagtgggaaggagggcgcgcgggtggcggttttaatagatttcgcgttcgggcgtttttagtagcgttttatgtaggcgcggtagaagttgtggtcgtattcgacggatatcggtttacgaaagagttttaggtagatggagtacgtcgtttcgttttgtagttttgtcgttagcgttagagtttcggcgtcggtttcggggtcggttcgcggttttatagtcgttatgcgcgtttttcgcgtatttaga

SEQ ID NO: 34312 - DNA, 700 bp, Artificial Sequence
  chemically treated genomic DNA (Homo sapiens) CpG-island No: 34312
tctaaatacgcgaaaaacgcgcataacgactataaaaccgcgaaccgaccccgaaaccgacgccgaaactctaacgctaacgacaaaactacaaaacgaaacgacgtactccatctacctaaaactctttcgtaaaccgatatccgtcgaatacgaccacaacttctaccgcgcctacataaaacgctactaaaaacgcccgaacgcgaaatctattaaaaccgccacccgcgcgccctccttcccactaccctatccgcaataccgcgaacccgcgcgccccaatcaactacgacccaaccgacaactaacgacgataaccacgctcctacgacgcttcaacctacccgcgaccgccccgaaaaaacacgaatctcaaacgaccgcgacccgaacaacgactacccgctacgaacaacataacgaacccttcaaactctactaccaaaacgacgaacgcgccatctacgtaatatacgaccgcgcccgcgaacaccgcgaacacgccgtactaccgctaaacgaaacgatacaaaaaaccaaaataaacgcaacccccacccaccccgtaaatccccgaaacccccgacttaatcccgcgctcccgcgcacgaaatacaaaaaacaacctatcgatcaaaaaacccgaataaacccctcccttctttctccattccaaaaaacccaacgctaattcccg

SEQ ID NO: 34313 - DNA, 727 bp, Artificial Sequence
  chemically treated genomic DNA (Homo sapiens) CpG-island No: 34313
gggtcgttagtcgttattttttgtttttttttgtttgcggtgcgttgggatattttcgaggcggtttagcgttcgcggtttttagcgcgggcggggtcgcggtagaggtttttaaatcggttgtatagaaatagcgttattttttattgttcgcggggttatttgtgtgtgttttttttttaaaaataaaggcggggcgggggcggaagtgttttaaaagaaggcgggtcgaagcgaggtgcggttttttgtcgtcgcggaggggcgggggtaggacgcgtaatttcggtcggagttgttcggggtcgtgagtcggtttcgttttggtggcggcgttttttcgcggtttagaggtagacgtatcgggtgggttcgggtttttagttcggtcgggaggagggatcgggtttgcggagcggggattcggggtttcggcggggcgcgtatacgtaggcggggcggttcggggtgcggggtttttgcgcggttgattaggtttttagagcgttagcgtcgtttatggtcgagtcgttttagttagatttcggggcggtcgaggacgcggcggtttaagttgtggagacgtcgggttggaaggtttcggaggacgtcggtttttaggtaggcgtcgattcgggagcggaggggttgggttcgtttttcggttgatttgtagtgaggttagtaggttttatagagttaagtaaaaagtatagttttttaaatg

SEQ ID NO: 34314 - DNA, 727 bp, Artificial Sequence
  chemically treated genomic DNA (Homo sapiens) CpG-island No: 34314
catttaaaaaactatactttttacttaactctataaaacctactaacctcactacaaatcaaccgaaaaacgaacccaacccctccgctcccgaatcgacgcctacctaaaaaccgacgtcctccgaaaccttccaacccgacgtctccacaacttaaaccgccgcgtcctcgaccgccccgaaatctaactaaaacgactcgaccataaacgacgctaacgctctaaaaacctaatcaaccgcgcaaaaaccccgcaccccgaaccgccccgcctacgtatacgcgccccgccgaaaccccgaatccccgctccgcaaacccgatccctcctcccgaccgaactaaaaacccgaacccacccgatacgtctacctctaaaccgcgaaaaaacgccgccaccaaaacgaaaccgactcacgaccccgaacaactccgaccgaaattacgcgtcctacccccgcccctccgcgacgacaaaaaaccgcacctcgcttcgacccgccttcttttaaaacacttccgcccccgccccgcctttatttttaaaaaaaaaacacacacaaataaccccgcgaacaataaaaaataacgctatttctatacaaccgatttaaaaacctctaccgcgaccccgcccgcgctaaaaaccgcgaacgctaaaccgcctcgaaaatatcccaacgcaccgcaaacaaaaaaaaacaaaaaataacgactaacgaccc

SEQ ID NO: 34315 - DNA, 727 bp, Artificial Sequence
  chemically treated genomic DNA (Homo sapiens) CpG-island No: 34315
tatttaaaaaattgtattttttatttaattttatgggatttgttggttttattgtaaattagtcggaaggcgggtttagttttttcgttttcgagtcggcgtttatttgggggtcggcgtttttcggggttttttagttcggcgtttttatagtttgggtcgtcgcgttttcggtcgtttcggggtttggttggagcggttcggttatgggcggcgttgacgttttgggagtttggttagtcgcgtagaggtttcgtatttcgggtcgtttcgtttgcgtgtgcgcgtttcgtcgaggtttcgagttttcgtttcgtagattcggttttttttttcggtcgggttggagattcgagtttattcgatgcgtttgtttttggatcgcgagggggcgtcgttattaaggcggggtcggtttacgatttcggatagtttcggtcggagttgcgcgttttgttttcgttttttcgcggcgatagggagtcgtatttcgtttcggttcgtttttttttgaggtattttcgttttcgtttcgtttttgtttttgaaggaaaggtatatataggtggtttcgcgggtagtagggggtggcgttgtttttgtgtaatcggtttgggaatttttgtcgcggtttcgttcgcgttgggaatcgcgggcgttgagtcgtttcgagggtgttttagcgtatcgtaggtagagaaaggtaggaggtggcggttggcgattt

SEQ ID NO: 34316 - DNA, 727 bp, Artificial Sequence
  chemically treated genomic DNA (Homo sapiens) CpG-island No: 34316
aaatcgccaaccgccacctcctacctttctctacctacgatacgctaaaacaccctcgaaacgactcaacgcccgcgattcccaacgcgaacgaaaccgcgacaaaaattcccaaaccgattacacaaaaacaacgccaccccctactacccgcgaaaccacctatatatacctttccttcaaaaacaaaaacgaaacgaaaacgaaaatacctcaaaaaaaaacgaaccgaaacgaaatacgactccctatcgccgcgaaaaaacgaaaacaaaacgcgcaactccgaccgaaactatccgaaatcgtaaaccgaccccgccttaataacgacgccccctcgcgatccaaaaacaaacgcatcgaataaactcgaatctccaacccgaccgaaaaaaaaaaccgaatctacgaaacgaaaactcgaaacctcgacgaaacgcgcacacgcaaacgaaacgacccgaaatacgaaacctctacgcgactaaccaaactcccaaaacgtcaacgccgcccataaccgaaccgctccaaccaaaccccgaaacgaccgaaaacgcgacgacccaaactataaaaacgccgaactaaaaaaccccgaaaaacgccgacccccaaataaacgccgactcgaaaacgaaaaaactaaacccgccttccgactaatttacaataaaaccaacaaatcccataaaattaaataaaaaatacaattttttaaata

SEQ ID NO: 34317 - DNA, 604 bp, Artificial Sequence
  chemically treated genomic DNA (Homo sapiens) CpG-island No: 34317
gggggtcgcgggggatcgcggggacggggttttgtgatgtaggagacggagggggttggtgacggaggacgggaggtcgtaaggatgggggacgcgatatttttttttttttttatcggtttattagggatgcgttttcgcgattgttcgttttaattttagggcggaggtttcgcgtaaaatttaggcgtcgcggtttcgcgtttcggttgagggttcgcgtcgtcgttcgttcgttttttttcgttcggtcgcggttttagggacggatattttagcgcgcggttttaatcgaggttcgtggcgggtaaggtcgggaggttggggcgggtacggggtcgggagcgaggggcggcgcggggaggggatgtagttgtcgttcgtatagtcgtgtttggacgcggtttcgtaattcgatttcgtttcgtttttagttagttgttgaattaggcggtcggggacggtattgagcgttgggcgcgcgcgggagggattgtttttggggtacgggtttgttggggcggagttcgtacggtgttagtagtcgtttgtttttcgtagtattcgtaaggttcgtatttaggttttggttttaaaggtgggg

SEQ ID NO: 34318 - DNA, 604 bp, Artificial Sequence
  chemically treated genomic DNA (Homo sapiens) CpG-island No: 34318
ccccacctttaaaaccaaaacctaaatacgaaccttacgaatactacgaaaaacaaacgactactaacaccgtacgaactccgccccaacaaacccgtaccccaaaaacaatccctcccgcgcgcgcccaacgctcaataccgtccccgaccgcctaattcaacaactaactaaaaacgaaacgaaatcgaattacgaaaccgcgtccaaacacgactatacgaacgacaactacatcccctccccgcgccgcccctcgctcccgaccccgtacccgccccaacctcccgaccttacccgccacgaacctcgattaaaaccgcgcgctaaaatatccgtccctaaaaccgcgaccgaacgaaaaaaaacgaacgaacgacgacgcgaaccctcaaccgaaacgcgaaaccgcgacgcctaaattttacgcgaaacctccgccctaaaattaaaacgaacaatcgcgaaaacgcatccctaataaaccgataaaaaaaaaaaaaaatatcgcgtcccccatccttacgacctcccgtcctccgtcaccaaccccctccgtctcctacatcacaaaaccccgtccccgcgatcccccgcgaccccc

SEQ ID NO: 34319 - DNA, 604 bp, Artificial Sequence
  chemically treated genomic DNA (Homo sapiens) CpG-island No: 34319
ttttatttttggggttaaagtttgggtgcgggttttgcggatgttgcggaggataagcggttgttgatatcgtgcggatttcgttttagtagattcgtgttttagggatagtttttttcgcgcgcgtttagcgtttaatgtcgttttcggtcgtttagtttagtagttggttgggggcgggacggggtcgagttgcggggtcgcgtttagatacggttgtgcgggcgatagttgtatttttttttcgcgtcgtttttcgttttcggtttcgtattcgttttagtttttcggttttattcgttacgggtttcggttggaatcgcgcgttggagtattcgtttttgaggtcgcggtcgagcgggaaggagcgggcgggcggcggcgcggatttttagtcggagcgcggagtcgcggcgtttgggttttgcgcgaggttttcgttttgggattggggcgggtagtcgcggaggcgtatttttggtgagtcggtgggaggggaaaaggatgtcgcgttttttatttttgcggtttttcgtttttcgttattagtttttttcgttttttgtattataaggtttcgttttcgcggtttttcgcgattttt

SEQ ID NO: 34320 - DNA, 604 bp, Artificial Sequence
  chemically treated genomic DNA (Homo sapiens) CpG-island No: 34320
aaaaatcgcgaaaaaccgcgaaaacgaaaccttataatacaaaaaacgaaaaaaactaataacgaaaaacgaaaaaccgcaaaaataaaaaacgcgacatccttttcccctcccaccgactcaccaaaaatacgcctccgcgactacccgccccaatcccaaaacgaaaacctcgcgcaaaacccaaacgccgcgactccgcgctccgactaaaaatccgcgccgccgcccgcccgctccttcccgctcgaccgcgacctcaaaaacgaatactccaacgcgcgattccaaccgaaacccgtaacgaataaaaccgaaaaactaaaacgaatacgaaaccgaaaacgaaaaacgacgcgaaaaaaaaatacaactatcgcccgcacaaccgtatctaaacgcgaccccgcaactcgaccccgtcccgcccccaaccaactactaaactaaacgaccgaaaacgacattaaacgctaaacgcgcgcgaaaaaaactatccctaaaacacgaatctactaaaacgaaatccgcacgatatcaacaaccgcttatcctccgcaacatccgcaaaacccgcacccaaactttaaccccaaaaataaaa

SEQ ID NO: 34321 - DNA, 516 bp, Artificial Sequence
  chemically treated genomic DNA (Homo sapiens) CpG-island No: 34321
atggcgtgtggggtcgcgttttggacgatgtttgggatttgcgcggcgcgggcgtggtgtgtcggtaattcgggtgtagaggggtttagtaagtttatgacgtatttgtttttagtcgcggattcgtttaggtggcgttgagtcgcgtgcgttgtttgggtatcgaaattcgtttgatttagtgtaacgtgttcgcgattttgtaggagttcgcggggatttcgcgggacgtcggcgtggtgtgtttcggtgaggtcggaatcgcgttttttatggttcgtcgttacgggatttcgggcgttttgattttgtttttttatagggagttttagggtgcggttggtcgcggggtcggggcgttgtacgggggcgcgtggggtatcgtgtgtgacgatgtttgggatttgcgggacgcgtacgtggtttgtaggtagttgggttgtggtcgcgttttgagcgttttgggggtcgtatatttcggagtcggggtagggcgtatttggttggacgagttgg

SEQ ID NO: 34322 - DNA, 516 bp, Artificial Sequence
  chemically treated genomic DNA (Homo sapiens) CpG-island No: 34322
ccaactcgtccaaccaaatacgccctaccccgactccgaaatatacgacccccaaaacgctcaaaacgcgaccacaacccaactacctacaaaccacgtacgcgtcccgcaaatcccaaacatcgtcacacacgataccccacgcgcccccgtacaacgccccgaccccgcgaccaaccgcaccctaaaactccctataaaaaaacaaaatcaaaacgcccgaaatcccgtaacgacgaaccataaaaaacgcgattccgacctcaccgaaacacaccacgccgacgtcccgcgaaatccccgcgaactcctacaaaatcgcgaacacgttacactaaatcaaacgaatttcgatacccaaacaacgcacgcgactcaacgccacctaaacgaatccgcgactaaaaacaaatacgtcataaacttactaaacccctctacacccgaattaccgacacaccacgcccgcgccgcgcaaatcccaaacatcgtccaaaacgcgaccccacacgccat

SEQ ID NO: 34323 - DNA, 516 bp, Artificial Sequence
  chemically treated genomic DNA (Homo sapiens) CpG-island No: 34323
ttagttcgtttagttagatgcgttttgtttcggtttcgaagtgtgcggtttttagggcgtttagggcgcggttatagtttagttgtttgtagattacgtgcgcgtttcgtaggttttaggtatcgttatatacggtgttttacgcgttttcgtgtagcgtttcggtttcgcggttagtcgtattttgaggttttttgtggagagatagagttagggcgttcgggatttcgtggcgacgggttatgggggacgcggtttcgattttatcggagtatattacgtcggcgtttcgcgaggttttcgcgggtttttgtagggtcgcggatacgttgtattgagttaggcgggtttcggtgtttagatagcgtacgcggtttagcgttatttggacggattcgcggttgggggtaggtgcgttataggtttgttgggtttttttgtattcgagttgtcggtatattacgttcgcgtcgcgtaggttttaggtatcgtttaggacgcggttttatacgttat

SEQ ID NO: 34324 - DNA, 516 bp, Artificial Sequence
  chemically treated genomic DNA (Homo sapiens) CpG-island No: 34324
ataacgtataaaaccgcgtcctaaacgatacctaaaacctacgcgacgcgaacgtaatataccgacaactcgaatacaaaaaaacccaacaaacctataacgcacctacccccaaccgcgaatccgtccaaataacgctaaaccgcgtacgctatctaaacaccgaaacccgcctaactcaatacaacgtatccgcgaccctacaaaaacccgcgaaaacctcgcgaaacgccgacgtaatatactccgataaaatcgaaaccgcgtcccccataacccgtcgccacgaaatcccgaacgccctaactctatctctccacaaaaaacctcaaaatacgactaaccgcgaaaccgaaacgctacacgaaaacgcgtaaaacaccgtatataacgatacctaaaacctacgaaacgcgcacgtaatctacaaacaactaaactataaccgcgccctaaacgccctaaaaaccgcacacttcgaaaccgaaacaaaacgcatctaactaaacgaactaa

SEQ ID NO: 34325 - DNA, 563 bp, Artificial Sequence
  chemically treated genomic DNA (Homo sapiens) CpG-island No: 34325
cgcgtttgcgtaatgtatttttgcgcgcgtttggagatgtgaggtaatttttcggtaggtttgcgtggtattagtgcgtatgcgtaaaggcgcgagggttataaacgcggcgggaagttcgttagggttacgtgcggtcgtttaggtttgcgattggttcgttgtcgggtgttttcgcgtatgtgcgttggttttcgaggggatcggttttggttttggaggttttttttattaacgagtagtacgtatgtgtagcgtcgaagttttttgtgaagtgtgcgtgtttgacggatgacgattttataaggcgttgtggttttggtagttttatgaggttgcggttttgcgggattatatcgtcgcgggagtgtacgggttttagcgagtgaaatttgcggtagttttcgttgggttcgttgtttttgcgcgcgtagaggagcgtagtttgtttttaggtcgcgttttcgtgagttttatgtttatagtggtcgaggtcggttataagtttacggttttttttgtacggtttttgtcgcgttggggttatcgtggaggttcggagg

SEQ ID NO: 34326 - DNA, 563 bp, Artificial Sequence
  chemically treated genomic DNA (Homo sapiens) CpG-island No: 34326
cctccgaacctccacgataaccccaacgcgacaaaaaccgtacaaaaaaaaccgtaaacttataaccgacctcgaccactataaacataaaactcacgaaaacgcgacctaaaaacaaactacgctcctctacgcgcgcaaaaacaacgaacccaacgaaaactaccgcaaatttcactcgctaaaacccgtacactcccgcgacgatataatcccgcaaaaccgcaacctcataaaactaccaaaaccacaacgccttataaaatcgtcatccgtcaaacacgcacacttcacaaaaaacttcgacgctacacatacgtactactcgttaataaaaaaaacctccaaaaccaaaaccgatcccctcgaaaaccaacgcacatacgcgaaaacacccgacaacgaaccaatcgcaaacctaaacgaccgcacgtaaccctaacgaacttcccgccgcgtttataaccctcgcgcctttacgcatacgcactaataccacgcaaacctaccgaaaaattacctcacatctccaaacgcgcgcaaaaatacattacgcaaacgcg

SEQ ID NO: 34327 - DNA, 563 bp, Artificial Sequence
  chemically treated genomic DNA (Homo sapiens) CpG-island No: 34327
ttttcgggtttttacggtggttttagcgcggtagggatcgtgtagaagggatcgtgggtttgtggtcggtttcggttattgtgggtatggagtttacgggaacgcggtttaggggtaggttacgtttttttgcgcgcgtaggaatagcgggtttagcgggggttgtcgtagattttattcgttggggttcgtgtattttcgcggcggtgtggtttcgtagagtcgtaattttatgaggttgttagggttatagcgttttgtggagtcgttattcgttagatacgtatattttataggaagtttcggcgttatatatgcgtattgttcgttggtggggagggtttttagaattagggtcggttttttcggaagttagcgtatatgcgcgggggtattcggtagcgggttaatcgtaagtttggacggtcgtacgtggttttggcgggtttttcgtcgcgtttgtagttttcgcgtttttacgtatgcgtattagtgttacgtaggtttgtcggagaattattttatatttttaggcgcgcgtaggagtgtattgcgtaggcgcg

SEQ ID NO: 34328 - DNA, 563 bp, Artificial Sequence
  chemically treated genomic DNA (Homo sapiens) CpG-island No: 34328
cgcgcctacgcaatacactcctacgcgcgcctaaaaatataaaataattctccgacaaacctacgtaacactaatacgcatacgtaaaaacgcgaaaactacaaacgcgacgaaaaacccgccaaaaccacgtacgaccgtccaaacttacgattaacccgctaccgaatacccccgcgcatatacgctaacttccgaaaaaaccgaccctaattctaaaaaccctccccaccaacgaacaatacgcatatataacgccgaaacttcctataaaatatacgtatctaacgaataacgactccacaaaacgctataaccctaacaacctcataaaattacgactctacgaaaccacaccgccgcgaaaatacacgaaccccaacgaataaaatctacgacaacccccgctaaacccgctattcctacgcgcgcaaaaaaacgtaacctacccctaaaccgcgttcccgtaaactccatacccacaataaccgaaaccgaccacaaacccacgatcccttctacacgatccctaccgcgctaaaaccaccgtaaaaacccgaaaa

SEQ ID NO: 34329 - DNA, 571 bp, Artificial Sequence
  chemically treated genomic DNA (Homo sapiens) CpG-island No: 34329
ggtcgcggacggcgttttttttagggtcggtcgttagagggcgagcgcgttttttcgggcggggcggggacgggacggggacggggaggggacgggacggggacggggaggggacggggatacggatacgggaggttttcgttcgttcgcgggtggcgtttttgtttttattagagcgggttaggtttttgggtttcgttttttaagtatatagggagggtggtcgcgggttaggggcggtcgcgagattttacgtttacgtttcgggtagttttttcggaggttgggtcgcgcggttcggggagcggagcgttgcgtttttttgcgagtatttcggggtttttaggcgttttcgttttttcgttagtggggggcgcggtgtcgttttttcgcgggttaaattgttgaggaaggggcgagtttttgcggtttttgtttgtttcggttacgttttattttcgtttcgtcgcgttgcgcgttttcgcggggtttcgggtatttttggggtttcggggatttttgacgtttttttttttttaattttcgttgcgattttataggtggggtgaat

SEQ ID NO: 34330 - DNA, 571 bp, Artificial Sequence
  chemically treated genomic DNA (Homo sapiens) CpG-island No: 34330
attcaccccacctataaaatcgcaacgaaaattaaaaaaaaaaaaacgtcaaaaatccccgaaaccccaaaaatacccgaaaccccgcgaaaacgcgcaacgcgacgaaacgaaaataaaacgtaaccgaaacaaacaaaaaccgcaaaaactcgccccttcctcaacaatttaacccgcgaaaaaacgacaccgcgccccccactaacgaaaaaacgaaaacgcctaaaaaccccgaaatactcgcaaaaaaacgcaacgctccgctccccgaaccgcgcgacccaacctccgaaaaaactacccgaaacgtaaacgtaaaatctcgcgaccgcccctaacccgcgaccaccctccctatatacttaaaaaacgaaacccaaaaacctaacccgctctaataaaaacaaaaacgccacccgcgaacgaacgaaaacctcccgtatccgtatccccgtcccctccccgtccccgtcccgtcccctccccgtccccgtcccgtccccgccccgcccgaaaaaacgcgctcgccctctaacgaccgaccctaaaaaaaacgccgtccgcgacc

SEQ ID NO: 34331 - DNA, 571 bp, Artificial Sequence
  chemically treated genomic DNA (Homo sapiens) CpG-island No: 34331
gtttattttatttgtgggatcgtagcgggggttggagggaagggggcgttagagattttcggggttttaggggtgttcggggtttcgcgggaacgcgtaacgcggcggggcggaggtggggcgtggtcgggataggtaggggtcgtaggaattcgttttttttttagtagtttagttcgcggagaagcggtatcgcgttttttattgacgaggaaacgggggcgtttaaaggtttcggggtgttcgtagagaagcgtagcgtttcgtttttcgggtcgcgcggtttaattttcggagggattgttcgggacgtggacgtggagtttcgcggtcgtttttggttcgcggttattttttttgtgtgtttgagaaacggaatttagaggtttggttcgttttagtgggagtagagacgttattcgcgggcgagcggaagtttttcgtgttcgtgttttcgtttttttttcgttttcgtttcgtttttttttcgttttcgtttcgttttcgtttcgttcgggaaggcgcgttcgttttttggcggtcggttttggaagggacgtcgttcgcggtt

SEQ ID NO: 34332 - DNA, 571 bp, Artificial Sequence
  chemically treated genomic DNA (Homo sapiens) CpG-island No: 34332
aaccgcgaacgacgtcccttccaaaaccgaccgccaaaaaacgaacgcgccttcccgaacgaaacgaaaacgaaacgaaaacgaaaaaaaaacgaaacgaaaacgaaaaaaaaacgaaaacacgaacacgaaaaacttccgctcgcccgcgaataacgtctctactcccactaaaacgaaccaaacctctaaattccgtttctcaaacacacaaaaaaaataaccgcgaaccaaaaacgaccgcgaaactccacgtccacgtcccgaacaatccctccgaaaattaaaccgcgcgacccgaaaaacgaaacgctacgcttctctacgaacaccccgaaacctttaaacgcccccgtttcctcgtcaataaaaaacgcgataccgcttctccgcgaactaaactactaaaaaaaaaacgaattcctacgacccctacctatcccgaccacgccccacctccgccccgccgcgttacgcgttcccgcgaaaccccgaacacccctaaaaccccgaaaatctctaacgcccccttccctccaacccccgctacgatcccacaaataaaataaac

SEQ ID NO: 34333 - DNA, 675 bp, Artificial Sequence
  chemically treated genomic DNA (Homo sapiens) CpG-island No: 34333
tatcgttacgttatatcgagagaagcggagacgatatttttattcggtgggggcgggggcgaggtttttttagcgcggattcgggttcggggagtgtagggcgtattttttttgtgggtttttaagcgaaggtatagttcgggggtcggggtggagggcgcgttttagtaggtcgggcgtacgggtatttgtaggaggattatttgtttgttttcggatgggtggtatttgttgatgtgtcgcgtaaggtcgggcgagttgtagaaggtggtcgggtagtatttgtaggggaatatttgggcggcgtgtagtaggcgtaggtggcgtttttgagcgtttttgttggcgaacgatttttcgtatattgggtataggtggtattcggcggacgtatttaggtttagtacgtcggttttttcgtcgtcgtcggtcgttttttggggcgttttttcgtcgggttcggggtataaggttagtaggttttcggtcgggggcgttagcggcgcgtttttggtttgtagcgtttggtggtgcgttagtaggtgtttgcgtaggtaggtttgaaagaaaattttagtggtttagtgatggtattcgtttagttcgttttcggagttcgattcggatacgtcgacggggttcggcgtgtttcggtcgttgtcgtcgtcgggtgtt

SEQ ID NO: 34334 - DNA, 675 bp, Artificial Sequence
  chemically treated genomic DNA (Homo sapiens) CpG-island No: 34334
aacacccgacgacgacaacgaccgaaacacgccgaaccccgtcgacgtatccgaatcgaactccgaaaacgaactaaacgaataccatcactaaaccactaaaattttctttcaaacctacctacgcaaacacctactaacgcaccaccaaacgctacaaaccaaaaacgcgccgctaacgcccccgaccgaaaacctactaaccttataccccgaacccgacgaaaaaacgccccaaaaaacgaccgacgacgacgaaaaaaccgacgtactaaacctaaatacgtccgccgaataccacctatacccaatatacgaaaaatcgttcgccaacaaaaacgctcaaaaacgccacctacgcctactacacgccgcccaaatattcccctacaaatactacccgaccaccttctacaactcgcccgaccttacgcgacacatcaacaaataccacccatccgaaaacaaacaaataatcctcctacaaatacccgtacgcccgacctactaaaacgcgccctccaccccgacccccgaactataccttcgcttaaaaacccacaaaaaaaatacgccctacactccccgaacccgaatccgcgctaaaaaaacctcgcccccgcccccaccgaataaaaatatcgtctccgcttctctcgatataacgtaacgata

SEQ ID NO: 34335 - DNA, 675 bp, Artificial Sequence
  chemically treated genomic DNA (Homo sapiens) CpG-island No: 34335
ggtattcggcggcggtagcgatcgggatacgtcgagtttcgtcggcgtgttcgagtcgggtttcgaggacgggttaaacgagtgttattattgagttattaaagtttttttttaggtttatttacgtaagtatttgttggcgtattattaggcgttgtaggttaagggcgcgtcgttagcgttttcggtcgaggatttattggttttgtatttcgggttcgacgagaaggcgttttaggaggcggtcggcgacggcgagggggtcggcgtgttgggtttgagtgcgttcgtcgagtgttatttgtgtttagtgtgcggagagtcgttcgttagtaagggcgtttaggagcgttatttgcgtttgttgtacgtcgtttaggtgtttttttgtaagtattgttcggttattttttatagttcgttcggttttacgcggtatattaataagtgttatttattcgaaaatagataggtgatttttttgtaggtgttcgtgcgttcggtttgttagagcgcgttttttatttcggttttcgaattgtgttttcgtttggagatttataaagagagtgcgttttgtatttttcgaattcgagttcgcgttgggggagtttcgttttcgtttttatcgggtgaaagtgtcgttttcgtttttttcggtgtggcgtgacggta

SEQ ID NO: 34336 - DNA, 675 bp, Artificial Sequence
  chemically treated genomic DNA (Homo sapiens) CpG-island No: 34336
taccgtcacgccacaccgaaaaaaacgaaaacgacactttcacccgataaaaacgaaaacgaaactcccccaacgcgaactcgaattcgaaaaatacaaaacgcactctctttataaatctccaaacgaaaacacaattcgaaaaccgaaataaaaaacgcgctctaacaaaccgaacgcacgaacacctacaaaaaaatcacctatctattttcgaataaataacacttattaatataccgcgtaaaaccgaacgaactataaaaaataaccgaacaatacttacaaaaaaacacctaaacgacgtacaacaaacgcaaataacgctcctaaacgcccttactaacgaacgactctccgcacactaaacacaaataacactcgacgaacgcactcaaacccaacacgccgaccccctcgccgtcgccgaccgcctcctaaaacgccttctcgtcgaacccgaaatacaaaaccaataaatcctcgaccgaaaacgctaacgacgcgcccttaacctacaacgcctaataatacgccaacaaatacttacgtaaataaacctaaaaaaaaactttaataactcaataataacactcgtttaacccgtcctcgaaacccgactcgaacacgccgacgaaactcgacgtatcccgatcgctaccgccgccgaatacc

SEQ ID NO: 34337 - DNA, 585 bp, Artificial Sequence
  chemically treated genomic DNA (Homo sapiens) CpG-island No: 34337
gggggtcgggattcgggggtcgttcggtaggtgcggtagatgtatttgatggcgcggggttttcgcgcgcgtttttggtcgtttcgttcggcgtcgtcgtttcgttcggtttaggtatacgttcggtttcgtttttttttacggtttgttgtttttttatggggaggcgtacgtgtttgggttttgtgtttttttttcggggggcgcggagtcgttaaatgggttcgtttattagcgcgataatgtacgtttttttttcgcgcggggattattcgcgggtcgttagtaaaatagtaataaaggagaagaatggttttaaatatgttaggagggtttaattcgcgagtcggagtcgagggggaagttgtgcgcgttgattgggtgggggcgggggcgcgtcggggcggtgcgggggagatcgttgcggaggcgtagtggtttcgcgtggtgtttgggaaataaataagaattcgagagagtagtagggttcggacggttttcgttcggattttggacggatgggtcgttggatttaagaggttaagtaaaagggtttttcggggttttaagtgtggatagggggtt

SEQ ID NO: 34338 - DNA, 585 bp, Artificial Sequence
  chemically treated genomic DNA (Homo sapiens) CpG-island No: 34338
aaccccctatccacacttaaaaccccgaaaaacccttttacttaacctcttaaatccaacgacccatccgtccaaaatccgaacgaaaaccgtccgaaccctactactctctcgaattcttatttatttcccaaacaccacgcgaaaccactacgcctccgcaacgatctcccccgcaccgccccgacgcgcccccgcccccacccaatcaacgcgcacaacttccccctcgactccgactcgcgaattaaaccctcctaacatatttaaaaccattcttctcctttattactattttactaacgacccgcgaataatccccgcgcgaaaaaaaaacgtacattatcgcgctaataaacgaacccatttaacgactccgcgccccccgaaaaaaaaacacaaaacccaaacacgtacgcctccccataaaaaaacaacaaaccgtaaaaaaaaacgaaaccgaacgtatacctaaaccgaacgaaacgacgacgccgaacgaaacgaccaaaaacgcgcgcgaaaaccccgcgccatcaaatacatctaccgcacctaccgaacgacccccgaatcccgaccccc

SEQ ID NO: 34339 - DNA, 585 bp, Artificial Sequence
  chemically treated genomic DNA (Homo sapiens) CpG-island No: 34339
ggttttttgtttatatttggaatttcggggaatttttttgtttggttttttgggtttagcggtttattcgtttaaggttcgggcggaggtcgttcggattttgttgttttttcggatttttgtttattttttaaatattacgcggagttattgcgttttcgtaacgatttttttcgtatcgtttcggcgcgttttcgtttttatttaattagcgcgtataatttttttttcggtttcggttcgcggattgaatttttttgatatatttggggttattttttttttttgttgttattttgttagcgattcgcgggtaattttcgcgcgggaggggggcgtgtattgtcgcgttgatggacgggtttatttggcggtttcgcgtttttcggaggagagatataaagtttaggtacgtgcgtttttttatagagaagtagtagatcgtgaagggaggcggggtcgggcgtgtgtttggatcgggcggggcggcggcgtcgggcggggcgattaggggcgcgcgcgggggtttcgcgttattaggtatatttgtcgtatttatcgggcgattttcgagtttcggttttt

SEQ ID NO: 34340 - DNA, 585 bp, Artificial Sequence
  chemically treated genomic DNA (Homo sapiens) CpG-island No: 34340
aaaaaccgaaactcgaaaatcgcccgataaatacgacaaatatacctaataacgcgaaacccccgcgcgcgcccctaatcgccccgcccgacgccgccgccccgcccgatccaaacacacgcccgaccccgcctcccttcacgatctactacttctctataaaaaaacgcacgtacctaaactttatatctctcctccgaaaaacgcgaaaccgccaaataaacccgtccatcaacgcgacaatacacgcccccctcccgcgcgaaaattacccgcgaatcgctaacaaaataacaacaaaaaaaaaaaataaccccaaatatatcaaaaaaattcaatccgcgaaccgaaaccgaaaaaaaaattatacgcgctaattaaataaaaacgaaaacgcgccgaaacgatacgaaaaaaatcgttacgaaaacgcaataactccgcgtaatatttaaaaaataaacaaaaatccgaaaaaacaacaaaatccgaacgacctccgcccgaaccttaaacgaataaaccgctaaacccaaaaaaccaaacaaaaaaattccccgaaattccaaatataaacaaaaaacc

SEQ ID NO: 34341 - DNA, 546 bp, Artificial Sequence
  chemically treated genomic DNA (Homo sapiens) CpG-island No: 34341
cgtggttttttcgaatttattttacgttttatatcgaagttatttgttttggtattggtggtaaatattggatgtatgggtttgttgtttgtaaagcgttcgtgttttgtgcgtttttttgtatatttgtacggttttgcggtcgtttcgagttgtttttgagttttttttgcgagcgcgtcgtcgagaggatgggttatttatgaagtatcgaatatcgagggttggtaagaggttttagttcggttgtttttcgcgagggcgttgtcggttttgtgggtttcgtcgttttggttgttttcggagcgggggtgaagggagtttttgtgggtagtcgcgttgtcggcgcggttatatggggttcgggcggcggggaagaatgcgttttttgtgtttcgtcggtttgcgtaggtttaggtttttgcgttgcgttgtcgttgtatttgtcgaattttttcgggggcgtgttttcgagtttatttcgtatatttttatatggaaggtttggggcgggggagttgtttttttttttgtttcgtttttttt

SEQ ID NO: 34342 - DNA, 546 bp, Artificial Sequence
  chemically treated genomic DNA (Homo sapiens) CpG-island No: 34342
aaaaaaaacgaaacaaaaaaaaaaacaactcccccgccccaaaccttccatataaaaatatacgaaataaactcgaaaacacgcccccgaaaaaattcgacaaatacaacgacaacgcaacgcaaaaacctaaacctacgcaaaccgacgaaacacaaaaaacgcattcttccccgccgcccgaaccccatataaccgcgccgacaacgcgactacccacaaaaactcccttcacccccgctccgaaaacaaccaaaacgacgaaacccacaaaaccgacaacgccctcgcgaaaaacaaccgaactaaaacctcttaccaaccctcgatattcgatacttcataaataacccatcctctcgacgacgcgctcgcaaaaaaaactcaaaaacaactcgaaacgaccgcaaaaccgtacaaatatacaaaaaaacgcacaaaacacgaacgctttacaaacaacaaacccatacatccaatatttaccaccaataccaaaacaaataacttcgatataaaacgtaaaataaattcgaaaaaaccacg

SEQ ID NO: 34343 - DNA, 546 bp, Artificial Sequence
  chemically treated genomic DNA (Homo sapiens) CpG-island No: 34343
agaggaggcgagataggagaggaggtagttttttcgttttaaattttttatgtgggagtgtgcgaggtggattcggaaatacgttttcgaaagggttcgatagatataacggtagcgtagcgtaggggtttgggtttgcgtaggtcggcggagtataagggacgtattttttttcgtcgttcgggttttatgtgatcgcgtcgatagcgcggttgtttatagagattttttttattttcgtttcgggagtaattaaaacggcgaggtttatagggtcgatagcgttttcgcgggaggtagtcgggttggggttttttgttagttttcggtgttcgatgttttatgggtagtttattttttcggcggcgcgttcgtagggagggtttaaaggtagttcggagcggtcgtagggtcgtgtagatgtgtaaagagacgtatagagtacgggcgttttgtagatagtaagtttatatatttaatatttattattaatattagggtagatgatttcggtgtgagacgtgaggtgagttcgaaaaggttacg

SEQ ID NO: 34344 - DNA, 546 bp, Artificial Sequence
  chemically treated genomic DNA (Homo sapiens) CpG-island No: 34344
cgtaaccttttcgaactcacctcacgtctcacaccgaaatcatctaccctaatattaataataaatattaaatatataaacttactatctacaaaacgcccgtactctatacgtctctttacacatctacacgaccctacgaccgctccgaactacctttaaaccctccctacgaacgcgccgccgaaaaaataaactacccataaaacatcgaacaccgaaaactaacaaaaaaccccaacccgactacctcccgcgaaaacgctatcgaccctataaacctcgccgttttaattactcccgaaacgaaaataaaaaaaatctctataaacaaccgcgctatcgacgcgatcacataaaacccgaacgacgaaaaaaaatacgtcccttatactccgccgacctacgcaaacccaaacccctacgctacgctaccgttatatctatcgaaccctttcgaaaacgtatttccgaatccacctcgcacactcccacataaaaaatttaaaacgaaaaaactacctcctctcctatctcgcctcctct

SEQ ID NO: 34345 - DNA, 565 bp, Artificial Sequence
  chemically treated genomic DNA (Homo sapiens) CpG-island No: 34345
gtatacgtagatcgcgtttacgtttttaaagtgcgtaagcgtacggcgagatttcgtttttcgtttttttattaagacgaggcgcgcgtattagtaattagggttcgttggcgtcgtttcgggttttcgtttcggggttcgtcggtcgtcgttcggtttcggttttggtttcgtttttacgcgggaattttttagaagttttaatattcgggattagaggttggttgtagcgtatattttcggtaacgagcgtaaaggaagggattcggtgacgttttttttcgtttttttagcggtttaggttttggttttcggtgcggtagcgttatttggtgtcgagtttttcgttattcgcggaggtggtacgcgtttttttttcggaattttttagagaaatcgtggtttttgtttttttttttttcgttttggacggggagggattcgagttttcgtttcgtcgagttttcgcgcgggagggattttgtggcgattttgaagcggaagttgtttgtaggaggagttttataaatttaaaatggagcggaaattgttttttttttagttt

SEQ ID NO: 34346 - DNA, 565 bp, Artificial Sequence
  chemically treated genomic DNA (Homo sapiens) CpG-island No: 34346
aaactaaaaaaaaaacaatttccgctccattttaaatttataaaactcctcctacaaacaacttccgcttcaaaatcgccacaaaatccctcccgcgcgaaaactcgacgaaacgaaaactcgaatccctccccgtccaaaacgaaaaaaaaaaaaacaaaaaccacgatttctctaaaaaattccgaaaaaaaaacgcgtaccacctccgcgaataacgaaaaactcgacaccaaataacgctaccgcaccgaaaaccaaaacctaaaccgctaaaaaaacgaaaaaaaacgtcaccgaatcccttcctttacgctcgttaccgaaaatatacgctacaaccaacctctaatcccgaatattaaaacttctaaaaaattcccgcgtaaaaacgaaaccaaaaccgaaaccgaacgacgaccgacgaaccccgaaacgaaaacccgaaacgacgccaacgaaccctaattactaatacgcgcgcctcgtcttaataaaaaaacgaaaaacgaaatctcgccgtacgcttacgcactttaaaaacgtaaacgcgatctacgtatac

SEQ ID NO: 34347 - DNA, 565 bp, Artificial Sequence
  chemically treated genomic DNA (Homo sapiens) CpG-island No: 34347
aaattagagaaagaatagttttcgttttattttgggtttgtaaagttttttttataggtagttttcgttttagagtcgttataaagtttttttcgcgcgggaattcggcggggcggagattcgggttttttttcgtttagggcgggagaaaggaaagtaggggttacggtttttttggaaggtttcgagagaagggcgcgtgttattttcgcgggtggcgggagattcggtattagatggcgttgtcgtatcgagagttagagtttgggtcgttggggagacgggaagaggcgttatcggatttttttttttgcgttcgttgtcggaaatgtgcgttgtaattagtttttggtttcggatattaagatttttggagggttttcgcgtgagggcggggttagaatcggaatcgaacggcgatcgacgagtttcggagcggaaattcggggcggcgttagcgggttttggttgttggtgcgcgcgtttcgttttggtgggagggcgaggggcggggtttcgtcgtgcgtttgcgtattttggggacgtaggcgcggtttgcgtgtgt

SEQ ID NO: 34348 - DNA, 565 bp, Artificial Sequence
  chemically treated genomic DNA (Homo sapiens) CpG-island No: 34348
acacacgcaaaccgcgcctacgtccccaaaatacgcaaacgcacgacgaaaccccgcccctcgccctcccaccaaaacgaaacgcgcgcaccaacaaccaaaacccgctaacgccgccccgaatttccgctccgaaactcgtcgatcgccgttcgattccgattctaaccccgccctcacgcgaaaaccctccaaaaatcttaatatccgaaaccaaaaactaattacaacgcacatttccgacaacgaacgcaaaaaaaaaaatccgataacgcctcttcccgtctccccaacgacccaaactctaactctcgatacgacaacgccatctaataccgaatctcccgccacccgcgaaaataacacgcgcccttctctcgaaaccttccaaaaaaaccgtaacccctactttcctttctcccgccctaaacgaaaaaaaacccgaatctccgccccgccgaattcccgcgcgaaaaaaactttataacgactctaaaacgaaaactacctataaaaaaaactttacaaacccaaaataaaacgaaaactattctttctctaattt

SEQ ID NO: 34349 - DNA, 1084 bp, Artificial Sequence
  chemically treated genomic DNA (Homo sapiens) CpG-island No: 34349
tatcgtatcgttttacgggggttggattttttttttttttgcgggtgtgtgtgcgaggatggacgtggtaaatacgggttggtagaaggagcgaatcgcggtggaggaagtttttttgtttagttttcgtcgcggcgaggttcgcgggttaggcgcggcgacgaaggtgtacgaaggtgtttcgcgggtttggtggagttgtagcggcgcgtaggcgtattgagggtcgttcgcggtcggtttcgcggtataaagagcgttttcgcggggagtcgggcgttttttgggcggagggagtagtcggggtttcgtcggttcgcgtcgttttttttacgcgtcgtttcggggcgtagttatagttgtcgtttatcgcgggtgagaggtttgttggttcgtttcggttttttcgtttcggcggcggtcgtgcggttcgggttttaattttggcgtttgttagtcggggtcgatttcgttttttgcgtttcgttttttttcgagtttcgggttcgcggcggagcgagcgagcggtcggtaggttgggaggagcggtcgaaggtgagtgacgcggcggggtcgtgtcgcgtttcgtgtcgcggcgaggttgtttcggagcgcgaggtttttatttttgtttcgggttggtttcgcgcggagtcgatttggcgcgcgtcggggttgcgcggcggtcgtggcggtggcggagggtagttttcgcgggttttcgttcgtgcgggtgaattcggcggtttcggggcggttttgggggggggttcgagaggtggcgtcggtttcgcggtcgtcggagtttggcgcgttttgtagcggcggcgttcggtcggtttggaggagggagaggcgcgtcgggtacggagtagcgagaaagttcgggtcgggtcggtcggcgggagggtgcgggcgtttggttatttcggttcggcgttttgtttttcggatgtttttgggtttttttttagttcggggcggaacgggggattttttttgaagcggtttttcgtggagttggatgttgtttttcgcgggagggagtggcggttaagatttttttattttcggttttagaggg

SEQ ID NO: 34350 - DNA, 1084 bp, Artificial Sequence
  chemically treated genomic DNA (Homo sapiens) CpG-island No: 34350
ccctctaaaaccgaaaataaaaaaatcttaaccgccactccctcccgcgaaaaacaacatccaactccacgaaaaaccgcttcaaaaaaaatcccccgttccgccccgaactaaaaaaaaacccaaaaacatccgaaaaacaaaacgccgaaccgaaataaccaaacgcccgcaccctcccgccgaccgacccgacccgaactttctcgctactccgtacccgacgcgcctctccctcctccaaaccgaccgaacgccgccgctacaaaacgcgccaaactccgacgaccgcgaaaccgacgccacctctcgaacccccccccaaaaccgccccgaaaccgccgaattcacccgcacgaacgaaaacccgcgaaaactaccctccgccaccgccacgaccgccgcgcaaccccgacgcgcgccaaatcgactccgcgcgaaaccaacccgaaacaaaaataaaaacctcgcgctccgaaacaacctcgccgcgacacgaaacgcgacacgaccccgccgcgtcactcaccttcgaccgctcctcccaacctaccgaccgctcgctcgctccgccgcgaacccgaaactcgaaaaaaaacgaaacgcaaaaaacgaaatcgaccccgactaacaaacgccaaaattaaaacccgaaccgcacgaccgccgccgaaacgaaaaaaccgaaacgaaccaacaaacctctcacccgcgataaacgacaactataactacgccccgaaacgacgcgtaaaaaaaacgacgcgaaccgacgaaaccccgactactccctccgcccaaaaaacgcccgactccccgcgaaaacgctctttataccgcgaaaccgaccgcgaacgaccctcaatacgcctacgcgccgctacaactccaccaaacccgcgaaacaccttcgtacaccttcgtcgccgcgcctaacccgcgaacctcgccgcgacgaaaactaaacaaaaaaacttcctccaccgcgattcgctccttctaccaacccgtatttaccacgtccatcctcgcacacacacccgcaaaaaaaaaaaaaatccaacccccgtaaaacgatacgata

SEQ ID NO: 34351 - DNA, 1084 bp, Artificial Sequence
  chemically treated genomic DNA (Homo sapiens) CpG-island No: 34351
ttttttggggtcgaggataaaggggttttgatcgttattttttttcgcgaagggtaatatttaattttacggagagtcgttttagagagggtttttcgtttcgtttcgggttagggaagggtttagaggtattcgagggatagagcgtcgggtcggggtagttaggcgttcgtattttttcgtcggtcggttcggttcgaattttttcgttgtttcgtgttcggcgcgttttttttttttttagatcggtcgagcgtcgtcgttgtagagcgcgttaaatttcgacggtcgcggggtcgacgttatttttcggatttttttttaggatcgtttcgaggtcgtcgggtttattcgtacgagcgggagttcgcgggggttgtttttcgttatcgttacggtcgtcgcgtaatttcggcgcgcgttaagtcggtttcgcgcggggttagttcgaggtaggggtaggggtttcgcgtttcgggataatttcgtcgcggtacggggcgcggtacggtttcgtcgcgttatttattttcggtcgttttttttaatttgtcggtcgttcgttcgtttcgtcgcggattcggagttcggggaagggcggggcgtagggggcggagtcggtttcggttggtaagcgttagaattaaagttcgaatcgtacggtcgtcgtcggggcggggaagtcggggcggattagtaagttttttattcgcggtgggcgatagttgtggttgcgtttcggagcggcgcgtgagaagaacggcgcgggtcggcgaagtttcggttgtttttttcgtttagaggacgttcggtttttcgcgggggcgttttttgtatcgcggagtcggtcgcgggcggtttttagtgcgtttgcgcgtcgttgtaattttattaggttcgcggggtattttcgtgtattttcgtcgtcgcgtttggttcgcgggtttcgtcgcggcgagaattaagtagaagaattttttttatcgcggttcgttttttttgttaattcgtatttattacgtttattttcgtatatatattcgtaaggggagaagaaatttagttttcgtgagacggtgcggtg

SEQ ID NO: 34352 - DNA, 1084 bp, Artificial Sequence
  chemically treated genomic DNA (Homo sapiens) CpG-island No: 34352
caccgcaccgtctcacgaaaactaaatttcttctccccttacgaatatatatacgaaaataaacgtaataaatacgaattaacaaaaaaaacgaaccgcgataaaaaaaattcttctacttaattctcgccgcgacgaaacccgcgaaccaaacgcgacgacgaaaatacacgaaaataccccgcgaacctaataaaattacaacgacgcgcaaacgcactaaaaaccgcccgcgaccgactccgcgatacaaaaaacgcccccgcgaaaaaccgaacgtcctctaaacgaaaaaaacaaccgaaacttcgccgacccgcgccgttcttctcacgcgccgctccgaaacgcaaccacaactatcgcccaccgcgaataaaaaacttactaatccgccccgacttccccgccccgacgacgaccgtacgattcgaactttaattctaacgcttaccaaccgaaaccgactccgccccctacgccccgcccttccccgaactccgaatccgcgacgaaacgaacgaacgaccgacaaattaaaaaaaacgaccgaaaataaataacgcgacgaaaccgtaccgcgccccgtaccgcgacgaaattatcccgaaacgcgaaacccctacccctacctcgaactaaccccgcgcgaaaccgacttaacgcgcgccgaaattacgcgacgaccgtaacgataacgaaaaacaacccccgcgaactcccgctcgtacgaataaacccgacgacctcgaaacgatcctaaaaaaaaatccgaaaaataacgtcgaccccgcgaccgtcgaaatttaacgcgctctacaacgacgacgctcgaccgatctaaaaaaaaaaaaaacgcgccgaacacgaaacaacgaaaaaattcgaaccgaaccgaccgacgaaaaaatacgaacgcctaactaccccgacccgacgctctatccctcgaatacctctaaacccttccctaacccgaaacgaaacgaaaaaccctctctaaaacgactctccgtaaaattaaatattacccttcgcgaaaaaaaataacgatcaaaacccctttatcctcgaccccaaaaaa

SEQ ID NO: 34353 - DNA, 501 bp, Artificial Sequence
  chemically treated genomic DNA (Homo sapiens) CpG-island No: 34353
ggtttcgggtcgtttttcgttaatttcgaggtggtttcggtcggggttggagggcggggaggcgggggaggggcgtgggcgttgcggtttttggggcggtttaattcggcgcgggtagcgtgggttttcgaggtttcgcggttttaggtcgagggaaggtgtaggggttttgaagcgggttggttttcgaatgttgcgttttttgtgtcgttttgggtaatacgtagtggcgttcgcggtagttacggttttttgatcgtttattttttttattcgggtttcgtggaatttttagaggtaattgtttttggtggtttttgcgggttagtacgagtcgtgttgtacgagcgtgatttagtgaaggttttgggcgagttggcgttaataatttatggcgttcgttagcgttcgtttttcgtacgtggtttttgcggagggttagtttattttattaaatagtggattttattagattttgatattcgaggttaataaggaagt

SEQ ID NO: 34354 - DNA, 501 bp, Artificial Sequence
  chemically treated genomic DNA (Homo sapiens) CpG-island No: 34354
acttccttattaacctcgaatatcaaaatctaataaaatccactatttaataaaataaactaaccctccgcaaaaaccacgtacgaaaaacgaacgctaacgaacgccataaattattaacgccaactcgcccaaaaccttcactaaatcacgctcgtacaacacgactcgtactaacccgcaaaaaccaccaaaaacaattacctctaaaaattccacgaaacccgaataaaaaaaataaacgatcaaaaaaccgtaactaccgcgaacgccactacgtattacccaaaacgacacaaaaaacgcaacattcgaaaaccaacccgcttcaaaacccctacaccttccctcgacctaaaaccgcgaaacctcgaaaacccacgctacccgcgccgaattaaaccgccccaaaaaccgcaacgcccacgcccctcccccgcctccccgccctccaaccccgaccgaaaccacctcgaaattaacgaaaaacgacccgaaacc

SEQ ID NO: 34355 - DNA, 501 bp, Artificial Sequence
  chemically treated genomic DNA (Homo sapiens) CpG-island No: 34355
gtttttttattagtttcgggtattagggtttaatagaatttattatttaataagatgggttgatttttcgtagaggttacgtgcggaaagcgagcgttggcggacgttataaattgttaacgttaattcgtttaaggtttttattaggttacgttcgtgtagtacggttcgtgttgattcgtaagagttattaagaatagttgtttttgaaagttttacgggattcgggtgaaggagatgaacggttaaggagtcgtggttgtcgcgagcgttattgcgtgttgtttaaagcggtatagaaaacgtaatattcggggattagttcgttttagggtttttatattttttttcgatttggaatcgcgggatttcggaaatttacgttgttcgcgtcgggttgggtcgttttagaggtcgtagcgtttacgtttttttttcgttttttcgttttttagtttcggtcgaagttatttcggagttggcggagggcgattcgaggtt

SEQ ID NO: 34356 - DNA, 501 bp, Artificial Sequence
  chemically treated genomic DNA (Homo sapiens) CpG-island No: 34356
aacctcgaatcgccctccgccaactccgaaataacttcgaccgaaactaaaaaacgaaaaaacgaaaaaaaaacgtaaacgctacgacctctaaaacgacccaacccgacgcgaacaacgtaaatttccgaaatcccgcgattccaaatcgaaaaaaaatataaaaaccctaaaacgaactaatccccgaatattacgttttctataccgctttaaacaacacgcaataacgctcgcgacaaccacgactccttaaccgttcatctccttcacccgaatcccgtaaaactttcaaaaacaactattcttaataactcttacgaatcaacacgaaccgtactacacgaacgtaacctaataaaaaccttaaacgaattaacgttaacaatttataacgtccgccaacgctcgctttccgcacgtaacctctacgaaaaatcaacccatcttattaaataataaattctattaaaccctaatacccgaaactaataaaaaaac

SEQ ID NO: 34357 - DNA, 508 bp, Artificial Sequence
  chemically treated genomic DNA (Homo sapiens) CpG-island No: 34357
gggtcgcggagcggggtcgggagaggttagtttcggggcgtttttcggggcgcggtttaggcggatagcggtagcggcggcgggttcggggttttcggcgcgtagagtggttcgtttcggaggggtttcgcgttttcgtttcgttttcgtcgtttttttttattatatttcggtcggcgtagcgtttcgagtagattatagcgcggtttttgtcgggcgggtttggttttcggttaggcgtttaaataataaataatttttcgggtgcgggtagggggtttcgtcggtcgtagttaggttttaggtgtgcgttggcgaatatttttattaatcgcgaggagggatcgggtcgggggcgcgggcgtcgcggcgggcgtttttattttttatttatagttgttttacgttggtttcgagggtcgttgtttttaattttatcgcgaaggttttaaatatgaggaggtttataattaagaatttgtcgtagtttttttgaatgtaataattt

SEQ ID NO: 34358 - DNA, 508 bp, Artificial Sequence
  chemically treated genomic DNA (Homo sapiens) CpG-island No: 34358
aaattattacattcaaaaaaactacgacaaattcttaattataaacctcctcatatttaaaaccttcgcgataaaattaaaaacaacgaccctcgaaaccaacgtaaaacaactataaataaaaaataaaaacgcccgccgcgacgcccgcgcccccgacccgatccctcctcgcgattaataaaaatattcgccaacgcacacctaaaacctaactacgaccgacgaaaccccctacccgcacccgaaaaattatttattatttaaacgcctaaccgaaaaccaaacccgcccgacaaaaaccgcgctataatctactcgaaacgctacgccgaccgaaatataataaaaaaaaacgacgaaaacgaaacgaaaacgcgaaacccctccgaaacgaaccactctacgcgccgaaaaccccgaacccgccgccgctaccgctatccgcctaaaccgcgccccgaaaaacgccccgaaactaacctctcccgaccccgctccgcgaccc

SEQ ID NO: 34359 - DNA, 508 bp, Artificial Sequence
  chemically treated genomic DNA (Homo sapiens) CpG-island No: 34359
gggttgttatatttaaaaaaattgcggtaagtttttggttgtgggtttttttatatttggggttttcgcggtgggattaaaagtagcgattttcgagattaacgtggagtagttgtgggtggaaggtaagagcgttcgtcgcggcgttcgcgttttcggttcggttttttttcgcggttgatagagatattcgttagcgtatatttagagtttggttgcggtcggcgaaattttttgttcgtattcgggggattgtttattgtttgggcgtttggtcgggagttaggttcgttcgataaaggtcgcgttgtaatttattcggggcgttgcgtcggtcgaggtgtggtgggagagagcggcgggggcgggacgggggcgcggggttttttcgggacggattattttgcgcgtcgggggtttcgggttcgtcgtcgttgtcgttgttcgtttgggtcgcgtttcgagaggcgtttcggggttggtttttttcggtttcgtttcgcggttt

SEQ ID NO: 34360 - DNA, 508 bp, Artificial Sequence
  chemically treated genomic DNA (Homo sapiens) CpG-island No: 34360
aaaccgcgaaacgaaaccgaaaaaaaccaaccccgaaacgcctctcgaaacgcgacccaaacgaacaacgacaacgacgacgaacccgaaacccccgacgcgcaaaataatccgtcccgaaaaaaccccgcgcccccgtcccgcccccgccgctctctcccaccacacctcgaccgacgcaacgccccgaataaattacaacgcgacctttatcgaacgaacctaactcccgaccaaacgcccaaacaataaacaatcccccgaatacgaacaaaaaatttcgccgaccgcaaccaaactctaaatatacgctaacgaatatctctatcaaccgcgaaaaaaaaccgaaccgaaaacgcgaacgccgcgacgaacgctcttaccttccacccacaactactccacgttaatctcgaaaatcgctacttttaatcccaccgcgaaaaccccaaatataaaaaaacccacaaccaaaaacttaccgcaatttttttaaatataacaaccc

SEQ ID NO: 34361 - DNA, 1043 bp, Artificial Sequence
  chemically treated genomic DNA (Homo sapiens) CpG-island No: 34361
aaggcggcgtcgtagtagttgggtcggtgtagatagtttcggttcggcgcggtagtacggcgtagttttttcgttcgtttgcgtttttcgtttttagtcggtcgtttcggggtatcgatatagtcgttgtcgtcgtcgtcgcggttttggggttcggcggcgttattagtcgaggttatgttgtcgtcgtcgtcgtcgtcgtcgcggggacggaggtttttcgggcggttcggcgcgttgttgtcgttgttgcgggtttttggcgcgtttgggcgttcggtttgcgaggacgttgttggtcgtaggttgttcgggttcgggtttcggttgatagattagtcgttgttgttgtttatacggcgggcgttgttgtcgttgcggtcgcggtcgttgtcggggagttagattttgcgttttttattgttatattgcgcgggggtttcgaggtttttgcggtcgtcgttgtttatatttagttcgcggaagagcgagagtcggcgcgtcgagcgagtttgtttttcgggcgttttcgcggtattttttgcggtttttaattttttttattcgtttttcgtttcgcgtcgcgatttttttattgtagaaagagttagcgaattttcgttgttttcgtcggtcgcgttggttttttcggcgtttttcgggtcgttcgagcggtcgcggagggtaagcgtagagtcgtcgtcgtcgcggggttcgagggtgttcggcgggttttagcgttgtcgggttcgggtagtcgtagttgtcgttgttttcgcggtggttgttgttggcggtggcggttttaggagttgttgttcgggttgttcgggttttggttgttgggttcgcggtggttgttcggtttcggattttgtttttttgtgtttttcggtaattcgttggattattttgttttcgtgtagcgcgtttttttcgttttcgggatttggggatttcgttttgtgtgtgtgtagcgggtagcggtcgtagtagttttttgatttaatagatgagatggaagaagaaaaaaaagaattttt

SEQ ID NO: 34362 - DNA, 1043 bp, Artificial Sequence
  chemically treated genomic DNA (Homo sapiens) CpG-island No: 34362
aaaaattcttttttttcttcttccatctcatctattaaatcaaaaaactactacgaccgctacccgctacacacacacaaaacgaaatccccaaatcccgaaaacgaaaaaaacgcgctacacgaaaacaaaataatccaacgaattaccgaaaaacacaaaaaaacaaaatccgaaaccgaacaaccaccgcgaacccaacaaccaaaacccgaacaacccgaacaacaactcctaaaaccgccaccgccaacaacaaccaccgcgaaaacaacgacaactacgactacccgaacccgacaacgctaaaacccgccgaacaccctcgaaccccgcgacgacgacgactctacgcttaccctccgcgaccgctcgaacgacccgaaaaacgccgaaaaaaccaacgcgaccgacgaaaacaacgaaaattcgctaactctttctacaataaaaaaatcgcgacgcgaaacgaaaaacgaataaaaaaaattaaaaaccgcaaaaaataccgcgaaaacgcccgaaaaacaaactcgctcgacgcgccgactctcgctcttccgcgaactaaatataaacaacgacgaccgcaaaaacctcgaaacccccgcgcaatataacaataaaaaacgcaaaatctaactccccgacaacgaccgcgaccgcaacgacaacaacgcccgccgtataaacaacaacaacgactaatctatcaaccgaaacccgaacccgaacaacctacgaccaacaacgtcctcgcaaaccgaacgcccaaacgcgccaaaaacccgcaacaacgacaacaacgcgccgaaccgcccgaaaaacctccgtccccgcgacgacgacgacgacgacgacaacataacctcgactaataacgccgccgaaccccaaaaccgcgacgacgacgacaacgactatatcgataccccgaaacgaccgactaaaaacgaaaaacgcaaacgaacgaaaaaactacgccgtactaccgcgccgaaccgaaactatctacaccgacccaactactacgacgccgcctt

SEQ ID NO: 34363 - DNA, 1043 bp, Artificial Sequence
  chemically treated genomic DNA (Homo sapiens) CpG-island No: 34363
gagagtttttttttttttttttttattttatttattgaattaaggagttgttgcggtcgttgttcgttgtatatatatagagcggagtttttaggtttcgggagcgagagaggcgcgttgtacggggatagaatggtttagcgggttgtcgaggagtataagaaagtagagttcgggatcgagtagttatcgcgaatttagtagttagagttcgagtagttcgagtagtagtttttggagtcgttatcgttagtagtagttatcgcgggagtagcggtagttgcggttgttcgggttcggtagcgttgagattcgtcgggtattttcggatttcgcggcggcggcggttttgcgtttgtttttcgcggtcgttcgggcgattcgggaggcgtcgagagagttagcgcggtcggcgggagtagcggggattcgttggttttttttgtagtgaaggggtcgcggcgcggggcggggggcgggtagggggagttggggatcgtaaggagtgtcgcggaagcgttcgaaggataggttcgttcggcgcgtcggttttcgttttttcgcgaattggatgtgggtagcggcggtcgtagagatttcgggattttcgcgtaatgtggtaatggaaggcgtagggtttgatttttcggtagcggtcgcggtcgtagcggtagtagcgttcgtcgtgtgagtagtagtagcggttggtttgttaatcggagttcgagttcgagtagtttgcggttagtagcgttttcgtaagtcgagcgtttaggcgcgttaggagttcgtagtagcggtagtagcgcgtcgggtcgttcgggaagttttcgttttcgcggcggcggcggcggcggcggtaatatggtttcggttggtaacgtcgtcgagttttaggatcgcggcggcggcggtagcggttgtatcggtgtttcgggacggtcggttggaggcgggaggcgtagacggacgggggggttgcgtcgtgttgtcgcgtcggatcgggattatttgtatcggtttagttattgcgacgtcgtttt

SEQ ID NO: 34364 - DNA, 1043 bp, Artificial Sequence
  chemically treated genomic DNA (Homo sapiens) CpG-island No: 34364
aaaacgacgtcgcaataactaaaccgatacaaataatcccgatccgacgcgacaacacgacgcaacccccccgtccgtctacgcctcccgcctccaaccgaccgtcccgaaacaccgatacaaccgctaccgccgccgccgcgatcctaaaactcgacgacgttaccaaccgaaaccatattaccgccgccgccgccgccgccgcgaaaacgaaaacttcccgaacgacccgacgcgctactaccgctactacgaactcctaacgcgcctaaacgctcgacttacgaaaacgctactaaccgcaaactactcgaactcgaactccgattaacaaaccaaccgctactactactcacacgacgaacgctactaccgctacgaccgcgaccgctaccgaaaaatcaaaccctacgccttccattaccacattacgcgaaaatcccgaaatctctacgaccgccgctacccacatccaattcgcgaaaaaacgaaaaccgacgcgccgaacgaacctatccttcgaacgcttccgcgacactccttacgatccccaactccccctacccgccccccgccccgcgccgcgaccccttcactacaaaaaaaaccaacgaatccccgctactcccgccgaccgcgctaactctctcgacgcctcccgaatcgcccgaacgaccgcgaaaaacaaacgcaaaaccgccgccgccgcgaaatccgaaaatacccgacgaatctcaacgctaccgaacccgaacaaccgcaactaccgctactcccgcgataactactactaacgataacgactccaaaaactactactcgaactactcgaactctaactactaaattcgcgataactactcgatcccgaactctactttcttatactcctcgacaacccgctaaaccattctatccccgtacaacgcgcctctctcgctcccgaaacctaaaaactccgctctatatatatacaacgaacaacgaccgcaacaactccttaattcaataaataaaataaaaaaaaaaaaaaaaaaactctc

SEQ ID NO: 34365 - DNA, 551 bp, Artificial Sequence
  chemically treated genomic DNA (Homo sapiens) CpG-island No: 34365
acgtgatttcgcgttaggaggttcggtgcgcgcgcgcgttcggttttcggatttttcgcgttcgcgcggtcggggtagagtaggtagggaggcggatgcgtcgggtcggtttcgggtttttagcgcggtttttcgagagtttaggcgaggcgcgcgtttagtcggcgcggacggacgtgtcggacgcgtcgtagtatatttttgaaggcggatcggtttttttacgttgtttaatgttcgcgtcgttttttcgcgatcggttaatggtcgcgtttacgagtttttgtttatttagcggtttcgcgttggttgttcgggcgcgttgggggttgcggcggggcgcgtcggttatcggggcggtttacgcggttttcgtagggggttcgttcgtcggtttttttcgtttttttttttttttttcggcggtttttttttttcgtttttttttttcggtttgcgtttttttttttttttttcgtttcgtttttttttttaatttttttttttttattagtttggttattttttttttagttttttttttttttcgg

SEQ ID NO: 34366 - DNA, 551 bp, Artificial Sequence
  chemically treated genomic DNA (Homo sapiens) CpG-island No: 34366
ccgaaaaaaaaaaaaaactaaaaaaaaaataaccaaactaataaaaaaaaaaaaattaaaaaaaaaaacgaaacgaaaaaaaaaaaaaaaaacgcaaaccgaaaaaaaaaaacgaaaaaaaaaaaccgccgaaaaaaaaaaaaaaaaacgaaaaaaaccgacgaacgaaccccctacgaaaaccgcgtaaaccgccccgataaccgacgcgccccgccgcaacccccaacgcgcccgaacaaccaacgcgaaaccgctaaataaacaaaaactcgtaaacgcgaccattaaccgatcgcgaaaaaacgacgcgaacattaaacaacgtaaaaaaaccgatccgccttcaaaaatatactacgacgcgtccgacacgtccgtccgcgccgactaaacgcgcgcctcgcctaaactctcgaaaaaccgcgctaaaaacccgaaaccgacccgacgcatccgcctccctacctactctaccccgaccgcgcgaacgcgaaaaatccgaaaaccgaacgcgcgcgcgcaccgaacctcctaacgcgaaatcacgt

SEQ ID NO: 34367 - DNA, 551 bp, Artificial Sequence
  chemically treated genomic DNA (Homo sapiens) CpG-island No: 34367
tcggggaggaggagaggttggagggaaggtggttaggttggtgggggaggggagattgagggagggagcggggcgagggaggaaggagaaggcgtaggtcgaaggaaggaagcggggaggggaaatcgtcggggaggaaggaagggggcggggagagtcggcggacgggttttttgcgggagtcgcgtggatcgtttcggtggtcggcgcgtttcgtcgtagtttttagcgcgttcgggtagttagcgcggggtcgttgaatgggtagggattcgtgagcgcgattattggtcggtcgcggggaggcggcgcgggtattgggtagcgtaagggggtcggttcgtttttaggaatgtattacggcgcgttcggtacgttcgttcgcgtcggttgggcgcgcgtttcgtttgggttttcgggagatcgcgttggaggttcggagtcggttcggcgtattcgtttttttatttattttgtttcggtcgcgcgggcgcggggagttcgggagtcgggcgcgcgcgcgtatcgggttttttggcgcggggttacgt

SEQ ID NO: 34368 - DNA, 551 bp, Artificial Sequence
  chemically treated genomic DNA (Homo sapiens) CpG-island No: 34368
acgtaaccccgcgccaaaaaacccgatacgcgcgcgcgcccgactcccgaactccccgcgcccgcgcgaccgaaacaaaataaataaaaaaacgaatacgccgaaccgactccgaacctccaacgcgatctcccgaaaacccaaacgaaacgcgcgcccaaccgacgcgaacgaacgtaccgaacgcgccgtaatacattcctaaaaacgaaccgacccccttacgctacccaatacccgcgccgcctccccgcgaccgaccaataatcgcgctcacgaatccctacccattcaacgaccccgcgctaactacccgaacgcgctaaaaactacgacgaaacgcgccgaccaccgaaacgatccacgcgactcccgcaaaaaacccgtccgccgactctccccgcccccttccttcctccccgacgatttcccctccccgcttccttccttcgacctacgccttctccttcctccctcgccccgctccctccctcaatctcccctcccccaccaacctaaccaccttccctccaacctctcctcctccccga

SEQ ID NO: 34369 - DNA, 587 bp, Artificial Sequence
  chemically treated genomic DNA (Homo sapiens) CpG-island No: 34369
tttcggcgatttttttcgtgagaatttttttcggagtcgttttttagtcggggttcgtcgcggttagtttttttttcgttacgcggggttggtttcgggggcgggggttcgggcgtgcgagcgagcgtggaggcgcgggattcgcgttttcgcgtttaggcggcgtagtttattcggttttacggtttcggcgcgcggttcgttttttttgttcggcgttcggggttcgttttttcgttcgtcgcgcggggcgtttcgcgttttcgtgttttcgcgtcgttcgaggagtacggcgcgcgaggcgaggtggcgtcggcggtcgtcgcgttggttgtatttattatagtcggtcgttaatttttgttcggagcgcgggtgtcgatggcgcggacgttgggtttggattttatattaattttttttttttttttggttttttttttttcgtttttcgttttttcgtttttttttagttttttttcgttttttttttgttttgtcgttgcgggtttttttgttttttttgtcgttttttttttttttttcgttttttttttttttttttttttttttttcgtttttataaa

SEQ ID NO: 34370 - DNA, 587 bp, Artificial Sequence
  chemically treated genomic DNA (Homo sapiens) CpG-island No: 34370
tttataaaaacgaaaaaaaaaaaaaaaaaaaaaaaaaaaacgaaaaaaaaaaaaaaaacgacaaaaaaaacaaaaaaacccgcaacgacaaaacaaaaaaaaaacgaaaaaaaactaaaaaaaaacgaaaaaacgaaaaacgaaaaaaaaaaaaccaaaaaaaaaaaaaaaattaatataaaatccaaacccaacgtccgcgccatcgacacccgcgctccgaacaaaaattaacgaccgactataataaatacaaccaacgcgacgaccgccgacgccacctcgcctcgcgcgccgtactcctcgaacgacgcgaaaacacgaaaacgcgaaacgccccgcgcgacgaacgaaaaaacgaaccccgaacgccgaacaaaaaaaacgaaccgcgcgccgaaaccgtaaaaccgaataaactacgccgcctaaacgcgaaaacgcgaatcccgcgcctccacgctcgctcgcacgcccgaacccccgcccccgaaaccaaccccgcgtaacgaaaaaaaaactaaccgcgacgaaccccgactaaaaaacgactccgaaaaaaattctcacgaaaaaaatcgccgaaa

SEQ ID NO: 34371 - DNA, 587 bp, Artificial Sequence
  chemically treated genomic DNA (Homo sapiens) CpG-island No: 34371
tttgtaaagacggaggaggaggagaagaagaagaagaaaacggaggagaagaaaaagacgataggggagataaagagattcgtagcgataaggtaagggggagacgagggaagattgggagaagacggaggagcggaggacgaggaaaggggggttagggaaaaaaaaggaattgatgtgaaatttaagtttagcgttcgcgttatcggtattcgcgtttcgagtaggggttgacggtcggttatggtgagtgtagttagcgcggcggtcgtcgacgttatttcgtttcgcgcgtcgtgtttttcgggcggcgcggggatacggggacgcgggacgtttcgcgcggcggacggaggagcgagtttcgagcgtcgggtaggaggggcgggtcgcgcgtcggggtcgtggagtcgggtgggttgcgtcgtttgggcgcgggagcgcgggtttcgcgtttttacgttcgttcgtacgttcgggttttcgttttcgaggttagtttcgcgtggcggggagggggttggtcgcggcgggtttcggttgaggaacggtttcggggggaatttttacggagggggtcgtcggag

SEQ ID NO: 34372 - DNA, 587 bp, Artificial Sequence
  chemically treated genomic DNA (Homo sapiens) CpG-island No: 34372
ctccgacgaccccctccgtaaaaattccccccgaaaccgttcctcaaccgaaacccgccgcgaccaaccccctccccgccacgcgaaactaacctcgaaaacgaaaacccgaacgtacgaacgaacgtaaaaacgcgaaacccgcgctcccgcgcccaaacgacgcaacccacccgactccacgaccccgacgcgcgacccgcccctcctacccgacgctcgaaactcgctcctccgtccgccgcgcgaaacgtcccgcgtccccgtatccccgcgccgcccgaaaaacacgacgcgcgaaacgaaataacgtcgacgaccgccgcgctaactacactcaccataaccgaccgtcaacccctactcgaaacgcgaataccgataacgcgaacgctaaacttaaatttcacatcaattccttttttttccctaacccccctttcctcgtcctccgctcctccgtcttctcccaatcttccctcgtctcccccttaccttatcgctacgaatctctttatctcccctatcgtctttttcttctcctccgttttcttcttcttcttctcctcctcctccgtctttacaaa

SEQ ID NO: 34373 - DNA, 826 bp, Artificial Sequence
  chemically treated genomic DNA (Homo sapiens) CpG-island No: 34373
gcgtatcgaggaacgagtttttgggcgcgtttcggttcgtcgcggggtttcggggtaaattttggtttggcggggtttcggggtaaattttggtttggcggcgtcggcgagtttcgtggcgggtggtcggacgcgtttcggagttagcgcggcgttttttgcgtgtttcgcgttcggttggacggcggaagggtggttacgggttagggggtttgggcgggcgggggtcggcgggcgttttttattttgggtagtagtttcgcgtgcggttagtagtagcgcggttagtagcgttaggagcggcgggcgcgtttcgcggcggcgcggtcggtgtattttttttttcgttgaggcggcggcggcggcggtttttaggtcgcgcgtagaatatttacgggtttttttcgggttttcggtcgtttcgtttcggtcgttggcgttcgtaggacgtcggggacgtttgtaaagttttttgtttttttaatttgttttttcgttttcgtttggtcgtttttggatgtcgcgagcgcgatttttttttagttttttggttgtagtttcgtttgggtcggcgggttagttttaggttgttcgggtcgtattagtgggcgtgagtcgttttgggtcggatttcgagaatagcgtattttgcgtttaggggttgtcgtttcggggttttttcggcggcggcggtggcggttgttttagttttttacgttttttttttcgtttaatttgttattttttattaattttttagtttagcgttttagtttcgattaatgggagacgcggtttaggttggcgatttagcgttttttgttgt

SEQ ID NO: 34374 - DNA, 826 bp, Artificial Sequence
  chemically treated genomic DNA (Homo sapiens) CpG-island No: 34374
acaacaaaaaacgctaaatcgccaacctaaaccgcgtctcccattaatcgaaactaaaacgctaaactaaaaaattaataaaaaataacaaattaaacgaaaaaaaaaacgtaaaaaactaaaacaaccgccaccgccgccgccgaaaaaaccccgaaacgacaacccctaaacgcaaaatacgctattctcgaaatccgacccaaaacgactcacgcccactaatacgacccgaacaacctaaaactaacccgccgacccaaacgaaactacaaccaaaaaactaaaaaaaaatcgcgctcgcgacatccaaaaacgaccaaacgaaaacgaaaaaacaaattaaaaaaacaaaaaactttacaaacgtccccgacgtcctacgaacgccaacgaccgaaacgaaacgaccgaaaacccgaaaaaaacccgtaaatattctacgcgcgacctaaaaaccgccgccgccgccgcctcaacgaaaaaaaaaatacaccgaccgcgccgccgcgaaacgcgcccgccgctcctaacgctactaaccgcgctactactaaccgcacgcgaaactactacccaaaataaaaaacgcccgccgacccccgcccgcccaaaccccctaacccgtaaccacccttccgccgtccaaccgaacgcgaaacacgcaaaaaacgccgcgctaactccgaaacgcgtccgaccacccgccacgaaactcgccgacgccgccaaaccaaaatttaccccgaaaccccgccaaaccaaaatttaccccgaaaccccgcgacgaaccgaaacgcgcccaaaaactcgttcctcgatacgc

SEQ ID NO: 34375 - DNA, 826 bp, Artificial Sequence
  chemically treated genomic DNA (Homo sapiens) CpG-island No: 34375
gtagtagagggcgttgggtcgttagtttgggtcgcgttttttattggtcggggttggggcgttgggttggagagttggtggaaagtgataagttgagcgagagagggagcgtggagagttggagtagtcgttatcgtcgtcgtcgagggagtttcgggacggtagtttttgggcgtagggtgcgttgttttcggagttcgatttagggcgatttacgtttattggtgcgattcggatagtttgggattgattcgtcggtttaggcgaggttgtagttagagggttgggaagggatcgcgttcgcggtatttagaggcggttaggcggaggcgagggagtaggttagagggataaagagttttgtagacgttttcggcgttttgcgagcgttagcggtcgggacgaggcggtcgggagttcgggaagagttcgtggatgttttgcgcgcggtttgggagtcgtcgtcgtcgtcgttttagcgagaggaggaatgtatcggtcgcgtcgtcgcgggacgcgttcgtcgtttttggcgttgttggtcgcgttgttgttggtcgtacgcggggttgttgtttaaggtaagaggcgttcgtcggttttcgttcgtttagattttttgattcgtggttattttttcgtcgtttagtcgggcgcgggatacgtaggaagcgtcgcgttggtttcggggcgcgttcggttattcgttacggggttcgtcggcgtcgttaggttagggtttgtttcggagtttcgttaggttagggtttgtttcggagtttcgcggcgggtcggggcgcgtttagggattcgtttttcggtgcgt

SEQ ID NO: 34376 - DNA, 826 bp, Artificial Sequence
  chemically treated genomic DNA (Homo sapiens) CpG-island No: 34376
acgcaccgaaaaacgaatccctaaacgcgccccgacccgccgcgaaactccgaaacaaaccctaacctaacgaaactccgaaacaaaccctaacctaacgacgccgacgaaccccgtaacgaataaccgaacgcgccccgaaaccaacgcgacgcttcctacgtatcccgcgcccgactaaacgacgaaaaaataaccacgaatcaaaaaatctaaacgaacgaaaaccgacgaacgcctcttaccttaaacaacaaccccgcgtacgaccaacaacaacgcgaccaacaacgccaaaaacgacgaacgcgtcccgcgacgacgcgaccgatacattcctcctctcgctaaaacgacgacgacgacgactcccaaaccgcgcgcaaaacatccacgaactcttcccgaactcccgaccgcctcgtcccgaccgctaacgctcgcaaaacgccgaaaacgtctacaaaactctttatccctctaacctactccctcgcctccgcctaaccgcctctaaataccgcgaacgcgatcccttcccaaccctctaactacaacctcgcctaaaccgacgaatcaatcccaaactatccgaatcgcaccaataaacgtaaatcgccctaaatcgaactccgaaaacaacgcaccctacgcccaaaaactaccgtcccgaaactccctcgacgacgacgataacgactactccaactctccacgctccctctctcgctcaacttatcactttccaccaactctccaacccaacgccccaaccccgaccaataaaaaacgcgacccaaactaacgacccaacgccctctactac

SEQ ID NO: 34377 - DNA, 712 bp, Artificial Sequence
  chemically treated genomic DNA (Homo sapiens) CpG-island No: 34377
taagtacgacgaggagtcgtaggtcgagtacgaattcgaggagatttattatttcgagattcgcggtgacgagtacggtttagggatggtattttacgggatttatggtacgtcggatcgttttatttacgtggtagagatgatttcgaacggtgacgtagttttggtgtcgtatggttggtatgggtcgtgtgtagtcgttttcggttacgatttgtattattttaatgtgatggcggggttaggcgtcgttgagtggaaattagtcgacgattcgtattacgggtggattcgttaaatttggtaggattaagatatcgattcgcgtttgtcgttagcggtggacgatttaaaggagtgattatgattgagtagattgtgaggtttagcgtcggataggttatcgtgcgttatttgatttattagtatatcgagcgggacggggttgaacgtcgttttatacgcggagtttttgggattttcggttatggaaatgttattggtttgggttaggcgtttttgtagaatgaggcggttttcgacgatgaggaaggtcgatttgagtattggatgggtcggaacgagtaaggtatggtttacgtttgtttcgtttacgttcgcgttacgaatcggttgtaggcgttagttgttatcgcgtttattgggtcgggttcgtttaatatggttatcggtgcggttttcgttattatta

SEQ ID NO: 34378 - DNA, 712 bp, Artificial Sequence
  chemically treated genomic DNA (Homo sapiens) CpG-island No: 34378
taataataacgaaaaccgcaccgataaccatattaaacgaacccgacccaataaacgcgataacaactaacgcctacaaccgattcgtaacgcgaacgtaaacgaaacaaacgtaaaccataccttactcgttccgacccatccaatactcaaatcgaccttcctcatcgtcgaaaaccgcctcattctacaaaaacgcctaacccaaaccaataacatttccataaccgaaaatcccaaaaactccgcgtataaaacgacgttcaaccccgtcccgctcgatatactaataaatcaaataacgcacgataacctatccgacgctaaacctcacaatctactcaatcataatcactcctttaaatcgtccaccgctaacgacaaacgcgaatcgatatcttaatcctaccaaatttaacgaatccacccgtaatacgaatcgtcgactaatttccactcaacgacgcctaaccccgccatcacattaaaataatacaaatcgtaaccgaaaacgactacacacgacccataccaaccatacgacaccaaaactacgtcaccgttcgaaatcatctctaccacgtaaataaaacgatccgacgtaccataaatcccgtaaaataccatccctaaaccgtactcgtcaccgcgaatctcgaaataataaatctcctcgaattcgtactcgacctacgactcctcgtcgtactta

SEQ ID NO: 34379 - DNA, 712 bp, Artificial Sequence
  chemically treated genomic DNA (Homo sapiens) CpG-island No: 34379
tggtggtggcgagagtcgtatcggtgattatgttgagcgaattcggtttaatggacgcggtggtagttaacgtttgtaatcggttcgtagcgcgggcgtaggcggaataggcgtgaattatattttgttcgtttcggtttatttagtatttaagtcggttttttttatcgtcgggggtcgttttattttgtaaaagcgtttggtttaaattagtagtatttttatggtcgaagattttaaagatttcgcgtatgaagcggcgtttaatttcgtttcgttcggtgtattgatgagttagatagcgtacgatggtttgttcgacgttgagttttatagtttgtttagttataattatttttttgagtcgtttatcgttagcggtaggcgcgggtcgatattttggttttgttaagtttgacgaatttattcgtaatgcggatcgtcgattgatttttatttagcggcgtttggtttcgttattatattgaggtagtataagtcgtagtcgggggcggttgtatacggtttatgttagttatgcggtattagagttacgttatcgttcgaaattatttttgttacgtggatgggacggttcggcgtgttataggtttcgtggaatgttatttttgggtcgtgttcgttatcgcgaatttcgaaatagtagattttttcgagttcgtgttcgatttgcgatttttcgtcgtgtttg

SEQ ID NO: 34380 - DNA, 712 bp, Artificial Sequence
  chemically treated genomic DNA (Homo sapiens) CpG-island No: 34380
caaacacgacgaaaaatcgcaaatcgaacacgaactcgaaaaaatctactatttcgaaattcgcgataacgaacacgacccaaaaataacattccacgaaacctataacacgccgaaccgtcccatccacgtaacaaaaataatttcgaacgataacgtaactctaataccgcataactaacataaaccgtatacaaccgcccccgactacgacttatactacctcaatataataacgaaaccaaacgccgctaaataaaaatcaatcgacgatccgcattacgaataaattcgtcaaacttaacaaaaccaaaatatcgacccgcgcctaccgctaacgataaacgactcaaaaaaataattataactaaacaaactataaaactcaacgtcgaacaaaccatcgtacgctatctaactcatcaatacaccgaacgaaacgaaattaaacgccgcttcatacgcgaaatctttaaaatcttcgaccataaaaatactactaatttaaaccaaacgcttttacaaaataaaacgacccccgacgataaaaaaaaccgacttaaatactaaataaaccgaaacgaacaaaatataattcacgcctattccgcctacgcccgcgctacgaaccgattacaaacgttaactaccaccgcgtccattaaaccgaattcgctcaacataatcaccgatacgactctcgccaccacca

SEQ ID NO: 34381 - DNA, 932 bp, Artificial Sequence
  chemically treated genomic DNA (Homo sapiens) CpG-island No: 34381
ggcgggaacgtacgtgtcgaaatattgcgtacggtgacgtacgttttcgttattcgtcggggcgattttttggtagtggtcggtgttgagatcggtaagattttggtcgaaggtgacgtcgaggtttttgaggttatcgattttgttgtttggtatgtcgatcgagtcgaggagttcgagggcgtcgacggtgtttagtttgtgtcgttacgagtgatcgtcgttatttcgtcgtggaatttcgttttgtttattatcgtcggatttatttttgtcgttttggtcgtcggatcgttagtattatttaagttcgttttataggttcgttattgtgttgtcgttatttttgaatgtttgtgggaggttgggatttcgcgggacgttttgtagttcgtcgatgttgaggaaaatgaggttggtaaatatttggtgagttatttcgaggtcgatcgggttatttttacgggagtttgggaaacggttaagttgtttcggtcgtggcgttatgatttgttagtgttggtcgagattagtggtaagaattttattatcgttatagagaacgttgattacgatttggtcgtagtcgatattattaagtcggttttcggtaatgtcggatagaagtgttcggtagtatcgtttattattttggtgggttaggtttatcggttttagcgattgcgttattagatttttgacgtcgtttttttaattcgggtgggatcgtcgtcggatttgcgtttttagatgggttcgtttgtcgagttcgttagcggtaaattgttcgatggtttgacgaagtttgattcgggttaggaatgggttttggaatcggtgcgtatcgacgaggaaggtcggtattggtttttcggcgtgcgtagtggtattaaatcgggggattcgtattattttattgagtatttcggttt

SEQ ID NO: 34382 - DNA, 932 bp, Artificial Sequence
  chemically treated genomic DNA (Homo sapiens) CpG-island No: 34382
aaaccgaaatactcaataaaataatacgaatcccccgatttaataccactacgcacgccgaaaaaccaataccgaccttcctcgtcgatacgcaccgattccaaaacccattcctaacccgaatcaaacttcgtcaaaccatcgaacaatttaccgctaacgaactcgacaaacgaacccatctaaaaacgcaaatccgacgacgatcccacccgaattaaaaaaacgacgtcaaaaatctaataacgcaatcgctaaaaccgataaacctaacccaccaaaataataaacgatactaccgaacacttctatccgacattaccgaaaaccgacttaataatatcgactacgaccaaatcgtaatcaacgttctctataacgataataaaattcttaccactaatctcgaccaacactaacaaatcataacgccacgaccgaaacaacttaaccgtttcccaaactcccgtaaaaataacccgatcgacctcgaaataactcaccaaatatttaccaacctcattttcctcaacatcgacgaactacaaaacgtcccgcgaaatcccaacctcccacaaacattcaaaaataacgacaacacaataacgaacctataaaacgaacttaaataatactaacgatccgacgaccaaaacgacaaaaataaatccgacgataataaacaaaacgaaattccacgacgaaataacgacgatcactcgtaacgacacaaactaaacaccgtcgacgccctcgaactcctcgactcgatcgacataccaaacaacaaaatcgataacctcaaaaacctcgacgtcaccttcgaccaaaatcttaccgatctcaacaccgaccactaccaaaaaatcgccccgacgaataacgaaaacgtacgtcaccgtacgcaatatttcgacacgtacgttcccgcc

SEQ ID NO: 34383 - DNA, 932 bp, Artificial Sequence
  chemically treated genomic DNA (Homo sapiens) CpG-island No: 34383
gggtcgaagtatttagtgaggtggtacggatttttcggtttgatgttattgcgtacgtcgggagattagtatcggtttttttcgtcgatgcgtatcggttttagggtttatttttggttcgggttaagtttcgttaaattatcgagtaatttgtcgttggcgggttcggtaagcggatttatttgggagcgtaggttcgacggcgattttattcgaattgaggaggcggcgttaaggatttggtggcgtaatcgttgagatcgataggtttgatttattaggataatgagcgatgttgtcgagtatttttgttcggtattgtcgaaagtcgatttgatgatgtcggttgcggttaagtcgtagttagcgttttttgtgacgataatggagtttttgttattagtttcggttagtattggtaggttatgacgttacgatcggaatagtttggtcgttttttaagttttcgtgaggatgattcgatcgatttcggggtggtttattaggtgtttattagttttattttttttaatatcgacgagttgtagaacgtttcgcgggattttagttttttataggtatttagagatgacggtagtatagtggcgggtttgtggagcgggtttgagtagtattgacgattcggcggttagagcggtaagggtggattcggcggtaatagatagggcgaagttttacggcggggtgacgacggttattcgtggcggtataaattgggtatcgtcgacgttttcgagtttttcggttcggtcgatatattaagtagtaaagtcgatagttttagaaatttcgacgttattttcggttaggattttgtcggttttagtatcggttattgttaaaaggtcgtttcggcgagtagcgaaagcgtgcgttatcgtgcgtagtatttcggtacgtgcgttttcgtt

SEQ ID NO: 34384 - DNA, 932 bp, Artificial Sequence
  chemically treated genomic DNA (Homo sapiens) CpG-island No: 34384
aacgaaaacgcacgtaccgaaatactacgcacgataacgcacgctttcgctactcgccgaaacgaccttttaacaataaccgatactaaaaccgacaaaatcctaaccgaaaataacgtcgaaatttctaaaactatcgactttactacttaatatatcgaccgaaccgaaaaactcgaaaacgtcgacgatacccaatttataccgccacgaataaccgtcgtcaccccgccgtaaaacttcgccctatctattaccgccgaatccacccttaccgctctaaccgccgaatcgtcaatactactcaaacccgctccacaaacccgccactatactaccgtcatctctaaatacctataaaaaactaaaatcccgcgaaacgttctacaactcgtcgatattaaaaaaaataaaactaataaacacctaataaaccaccccgaaatcgatcgaatcatcctcacgaaaacttaaaaaacgaccaaactattccgatcgtaacgtcataacctaccaatactaaccgaaactaataacaaaaactccattatcgtcacaaaaaacgctaactacgacttaaccgcaaccgacatcatcaaatcgactttcgacaataccgaacaaaaatactcgacaacatcgctcattatcctaataaatcaaacctatcgatctcaacgattacgccaccaaatccttaacgccgcctcctcaattcgaataaaatcgccgtcgaacctacgctcccaaataaatccgcttaccgaacccgccaacgacaaattactcgataatttaacgaaacttaacccgaaccaaaaataaaccctaaaaccgatacgcatcgacgaaaaaaaccgatactaatctcccgacgtacgcaataacatcaaaccgaaaaatccgtaccacctcactaaatacttcgaccc

SEQ ID NO: 34385 - DNA, 572 bp, Artificial Sequence
  chemically treated genomic DNA (Homo sapiens) CpG-island No: 34385
gtcgtggttatagtgcgtggataggtcgtggttgtagtgtgtggatagatcgtggttgtagtgtgtggataggtcgtggttatagtgtgtggataggtcgtggttatagtgtgtggataggtcgtggttatagtgtgtggatagatcgtggttgtagtgtgtggataggtcgtggttatagtgtgtggataggtcgtggttatagtgtgtggataggtcgtggttgtagtgcgtggataggtcgtggttgtagtgcgtggataggtcgtggttgtagtgtgtggataggtcgtggttatagtgtgtggataggtcgtggttatagtgtgtggataggtcgtggttgtagcgtgtggatgggtcgtggttatagcgtgtggataggtcgtggttatagcgtgtggatgggtcgtggttatagcgtgtggatgggtcgtggttatagcgtgtggatgggtcgtggttatagcgtgtggatgggtcgtggttatagcgtgtggatgggtcgtggttatagtgtgtggatagatcgtggttacgttttgtggataaagtatggttatagtgtttag

SEQ ID NO: 34386 - DNA, 572 bp, Artificial Sequence
  chemically treated genomic DNA (Homo sapiens) CpG-island No: 34386
ctaaacactataaccatactttatccacaaaacgtaaccacgatctatccacacactataaccacgacccatccacacgctataaccacgacccatccacacgctataaccacgacccatccacacgctataaccacgacccatccacacgctataaccacgacccatccacacgctataaccacgacctatccacacgctataaccacgacccatccacacgctacaaccacgacctatccacacactataaccacgacctatccacacactataaccacgacctatccacacactacaaccacgacctatccacgcactacaaccacgacctatccacgcactacaaccacgacctatccacacactataaccacgacctatccacacactataaccacgacctatccacacactacaaccacgatctatccacacactataaccacgacctatccacacactataaccacgacctatccacacactataaccacgacctatccacacactacaaccacgatctatccacacactacaaccacgacctatccacgcactataaccacgac

SEQ ID NO: 34387 - DNA, 572 bp, Artificial Sequence
  chemically treated genomic DNA (Homo sapiens) CpG-island No: 34387
ttaaatattgtaattatgttttatttataaaacgtaattacggtttatttatatattgtaattacggtttatttatacgttgtgattacggtttatttatacgttgtgattacggtttatttatacgttgtgattacggtttatttatacgttgtaattacggtttatttatacgttgtaattacggtttatttatacgttgtaattacggtttatttatacgttgtaattacggtttatttatatattgtaattacggtttatttatatattgtaattacggtttatttatatattgtaattacggtttatttacgtattgtaattacggtttatttacgtattgtaattacggtttatttatatattgtaattacggtttatttatatattgtaattacggtttatttatatattgtagttacggtttatttatatattgtagttacggtttatttatatattgtagttacggtttatttatatattgtaattacggtttatttatatattgtagttacggtttatttatatattgtaattacggtttatttacgtattgtaattacggt

SEQ ID NO: 34388 - DNA, 572 bp, Artificial Sequence
  chemically treated genomic DNA (Homo sapiens) CpG-island No: 34388
accgtaattacaatacgtaaataaaccgtaattacaatatataaataaaccgtaactacaatatataaataaaccgtaattacaatatataaataaaccgtaactacaatatataaataaaccgtaactacaatatataaataaaccgtaactacaatatataaataaaccgtaattacaatatataaataaaccgtaattacaatatataaataaaccgtaattacaatacgtaaataaaccgtaattacaatacgtaaataaaccgtaattacaatatataaataaaccgtaattacaatatataaataaaccgtaattacaatatataaataaaccgtaattacaacgtataaataaaccgtaattacaacgtataaataaaccgtaattacaacgtataaataaaccgtaattacaacgtataaataaaccgtaatcacaacgtataaataaaccgtaatcacaacgtataaataaaccgtaatcacaacgtataaataaaccgtaattacaatatataaataaaccgtaattacgttttataaataaaacataattacaatatttaa

SEQ ID NO: 34389 - DNA, 528 bp, Artificial Sequence
  chemically treated genomic DNA (Homo sapiens) CpG-island No: 34389
tatatgtatttgttatatacgtgtattttttatatacgtgttttttttatatatatgtattttttatatacgtgtattttttatatacgtgtattttttatatatatgtattttttatatacgtgtattttttatatacgtgttttttttatatatatgtatttgttatatacgtgtattttttatatacgtgttttttttatatatatgtattttttatatacgtgttttttttatatatatgtattttttatatacgtgtatttttatatatatgtattttttatatacgtgtattttttttatacgtgtattttttatatacgtgtattttttatatatgtgtattttttatatacgtgttttttttatatacgtgtattttttatatacgtgttttttttatatacgtgtttattttttatatacgtgtattttttatatacgtgtattttttatatatgtgtattttttatatacgtgtatatttatattgatgtattttttatatacgtgttttttttatat

SEQ ID NO: 34390 - DNA, 528 bp, Artificial Sequence
  chemically treated genomic DNA (Homo sapiens) CpG-island No: 34390
atataaaaaaaacacgtatataaaaaatacatcaatataaatatacacgtatataaaaaatacacatatataaaaaatacacgtatataaaaaatacacgtatataaaaaataaacacgtatataaaaaaaacacgtatataaaaaatacacgtatataaaaaaaacacgtatataaaaaatacacatatataaaaaatacacgtatataaaaaatacacgtataaaaaaaatacacgtatataaaaaatacatatatataaaaatacacgtatataaaaaatacatatatataaaaaaaacacgtatataaaaaatacatatatataaaaaaaacacgtatataaaaaatacacgtatataacaaatacatatatataaaaaaaacacgtatataaaaaatacacgtatataaaaaatacatatatataaaaaatacacgtatataaaaaatacacgtatataaaaaatacatatatataaaaaaaacacgtatataaaaaatacacgtatataacaaatacatata

SEQ ID NO: 34391 - DNA, 528 bp, Artificial Sequence
  chemically treated genomic DNA (Homo sapiens) CpG-island No: 34391
gtgtgaagagagtacgtgtgtgaggggtgtattagtgtgggtgtgtacgtgtgtgaggggtgtatatgtatgaggggtgtacgtgtgtgaggggtgtacgtgtgtgaggggtgagtacgtgtgtgaggggagtacgtgtgtgaggggtgtacgtgtgtgaggggagtacgtgtgtgagggatgtatatgtgtgaggggtgtacgtgtgtgaggggtgtacgtgtgagaggggtgtacgtgtgtgaggggtgtatgtgtgtgggggtgtacgtgtgtgagggatgtatgtgtgtgaggagagtacgtgtgtgagggatgtatgtgtgtgaggagagtacgtgtgtgaggggtgtacgtgtgtgatagatgtatgtgtgtgaggagagtacgtgtgtgaggggtgtacgtgtgtgaggggtgtatgtgtgtgaggggtgtacgtgtgtgagggatgtacgtgtgtgaggggtgtatgtgtgtgaggagagtacgtgtgtgaggggtgtacgtgtgtgatagatgtatgtg

SEQ ID NO: 34392 - DNA, 528 bp, Artificial Sequence
  chemically treated genomic DNA (Homo sapiens) CpG-island No: 34392
cacatacatctatcacacacgtacacccctcacacacgtactctcctcacacacatacacccctcacacacgtacatccctcacacacgtacacccctcacacacatacacccctcacacacgtacacccctcacacacgtactctcctcacacacatacatctatcacacacgtacacccctcacacacgtactctcctcacacacatacatccctcacacacgtactctcctcacacacatacatccctcacacacgtacacccccacacacatacacccctcacacacgtacacccctctcacacgtacacccctcacacacgtacacccctcacacatatacatccctcacacacgtactcccctcacacacgtacacccctcacacacgtactcccctcacacacgtactcacccctcacacacgtacacccctcacacacgtacacccctcatacatatacacccctcacacacgtacacacccacactaatacacccctcacacacgtactctcttcacac

SEQ ID NO: 34393 - DNA, 500 bp, Artificial Sequence
  chemically treated genomic DNA (Homo sapiens) CpG-island No: 34393
  misc_feature (498)..(498): n is either a, c, g or t
attagttcgtttgtaaggagagaatcggaggttacgcggtcgtcgttaggaataatacgcgtagtatggaacggggataaggagagtagataagaagagggcgattagtgaaacgatatagatagttttataacgatttatatagtggagtttattaaacggtatattatcgataatcgagtagtatagacgtgtttttggatcgataattagtatcgataatattagtcggaatgtatatgtaacggttattttcgattcgcgtttcgtgagatcgtagtaagatttaaagtgtcgttttcgtttcgtatgttgagatcgtacgaaggcgatatacgaaattttttttaaatatttacgaattcggtttttatacgtagattagatagaacgtcggtttcgttatatcgttgtcgcgatcgtttgttataatatatataatacgaagaattgttacgagaatcgggcgcgcgacgttatataagtaaaaggattaanta

SEQ ID NO: 34394 - DNA, 500 bp, Artificial Sequence
  chemically treated genomic DNA (Homo sapiens) CpG-island No: 34394
  misc_feature (3)..(3): n is either a, c, g or t
tanttaatccttttacttatataacgtcgcgcgcccgattctcgtaacaattcttcgtattatatatattataacaaacgatcgcgacaacgatataacgaaaccgacgttctatctaatctacgtataaaaaccgaattcgtaaatatttaaaaaaaatttcgtatatcgccttcgtacgatctcaacatacgaaacgaaaacgacactttaaatcttactacgatctcacgaaacgcgaatcgaaaataaccgttacatatacattccgactaatattatcgatactaattatcgatccaaaaacacgtctatactactcgattatcgataatataccgtttaataaactccactatataaatcgttataaaactatctatatcgtttcactaatcgccctcttcttatctactctccttatccccgttccatactacgcgtattattcctaacgacgaccgcgtaacctccgattctctccttacaaacgaactaat

SEQ ID NO: 34395 - DNA, 500 bp, Artificial Sequence
  chemically treated genomic DNA (Homo sapiens) CpG-island No: 34395
  misc_feature (3)..(3): n is either a, c, g or t
tgnttaatttttttgtttgtgtggcgtcgcgcgttcggttttcgtaatagtttttcgtattatgtgtgttgtagtagacgatcgcggtagcggtgtaacggggtcgacgttttatttgatttgcgtgtagaggtcgggttcgtaggtgtttggagagagtttcgtgtgtcgttttcgtgcggttttagtatgcggagcgggagcgatattttgggttttgttgcggttttacggagcgcgggtcggagatggtcgttgtatgtatatttcggttagtgttgtcggtgttagttgtcggtttaggggtacgtttatattgttcgattgtcggtggtgtatcgtttggtgggttttattgtgtggatcgttgtggggttgtttgtgtcgttttattgatcgttttttttttgtttattttttttgttttcgttttatgttgcgcgtgttatttttggcggcggtcgcgtggttttcggttttttttttgtaggcggattggt

SEQ ID NO: 34396 - DNA, 500 bp, Artificial Sequence
  chemically treated genomic DNA (Homo sapiens) CpG-island No: 34396
  misc_feature (498)..(498): n is either a, c, g or t
accaatccgcctacaaaaaaaaaaccgaaaaccacgcgaccgccgccaaaaataacacgcgcaacataaaacgaaaacaaaaaaaataaacaaaaaaaaaacgatcaataaaacgacacaaacaaccccacaacgatccacacaataaaacccaccaaacgatacaccaccgacaatcgaacaatataaacgtacccctaaaccgacaactaacaccgacaacactaaccgaaatatacatacaacgaccatctccgacccgcgctccgtaaaaccgcaacaaaacccaaaatatcgctcccgctccgcatactaaaaccgcacgaaaacgacacacgaaactctctccaaacacctacgaacccgacctctacacgcaaatcaaataaaacgtcgaccccgttacaccgctaccgcgatcgtctactacaacacacataatacgaaaaactattacgaaaaccgaacgcgcgacgccacacaaacaaaaaaattaanca

SEQ ID NO: 34397 - DNA, 1050 bp, Artificial Sequence
  chemically treated genomic DNA (Homo sapiens) CpG-island No: 34397
gagtcgatattttagatttagtattttttcgggattttttcgcgaggacgaagggagtcgatattttatatttagtattttttcgggattttttcgcgaggaggaagggagtcgatattttagatttagtattttttcgggattttttcgcgaggacgaagggagtcgatattttagatttagtattttttcgggattttttcgcgaggacgaagggagtcgatattttagatttagtattttttcgtgattttttcgcgaggaggaagggagtcgatattttagatttagtattttttcgggattttttcgcgaggacgaagggagtcgatattttagatttagtattttttcgggattttttcgcgaggacgaagggagtcgatattttagatttagtattttttcgggattttttcgcgaggacgaagggagtcgatattttagatttagtattttttcgggattttttcgcgaggacgaagggagtcgatattttagatttagtattttttcgggattttttcgcgaggacgaagggagtcgatattttagatttagtattttttcgggattttttcgcgaggaggaagggagtcgatattttagatttagtattttttcgggattttttcgcgaggaggaagggagtcgatattttagatttagtattttttcgggattttttcgcgaggaggaagggagtcgatattttagatttagtattttttcgggattttttcgcgaggaggaagggagtcgatattttagatttagtattttttcgggattttttcgcgaggaggaagggagtcgatattttagatttagtattttttcgggattttttcgcgaggaggaagggagtcgatattttagatttagtattttttcgtgattttttcgcgaggaggaagggagtcgatattttagatttagtattttttcgggattttttcgcgaggaggaagggagtcgatattttagatttagtattttttcgggatggtttcgcgaggacgaagggagtcgagattttagatttagtat

SEQ ID NO: 34398 - DNA, 1050 bp, Artificial Sequence
  chemically treated genomic DNA (Homo sapiens) CpG-island No: 34398
atactaaatctaaaatctcgactcccttcgtcctcgcgaaaccatcccgaaaaaatactaaatctaaaatatcgactcccttcctcctcgcgaaaaaatcccgaaaaaatactaaatctaaaatatcgactcccttcctcctcgcgaaaaaatcacgaaaaaatactaaatctaaaatatcgactcccttcctcctcgcgaaaaaatcccgaaaaaatactaaatctaaaatatcgactcccttcctcctcgcgaaaaaatcccgaaaaaatactaaatctaaaatatcgactcccttcctcctcgcgaaaaaatcccgaaaaaatactaaatctaaaatatcgactcccttcctcctcgcgaaaaaatcccgaaaaaatactaaatctaaaatatcgactcccttcctcctcgcgaaaaaatcccgaaaaaatactaaatctaaaatatcgactcccttcctcctcgcgaaaaaatcccgaaaaaatactaaatctaaaatatcgactcccttcgtcctcgcgaaaaaatcccgaaaaaatactaaatctaaaatatcgactcccttcgtcctcgcgaaaaaatcccgaaaaaatactaaatctaaaatatcgactcccttcgtcctcgcgaaaaaatcccgaaaaaatactaaatctaaaatatcgactcccttcgtcctcgcgaaaaaatcccgaaaaaatactaaatctaaaatatcgactcccttcgtcctcgcgaaaaaatcccgaaaaaatactaaatctaaaatatcgactcccttcctcctcgcgaaaaaatcacgaaaaaatactaaatctaaaatatcgactcccttcgtcctcgcgaaaaaatcccgaaaaaatactaaatctaaaatatcgactcccttcgtcctcgcgaaaaaatcccgaaaaaatactaaatctaaaatatcgactcccttcctcctcgcgaaaaaatcccgaaaaaatactaaatataaaatatcgactcccttcgtcctcgcgaaaaaatcccgaaaaaatactaaatctaaaatatcgactc

SEQ ID NO: 34399 - DNA, 1050 bp, Artificial Sequence
  chemically treated genomic DNA (Homo sapiens) CpG-island No: 34399
gtgttgagtttggagtttcgatttttttcgttttcgcggggttatttcggggaagtgttgagtttggagtatcgatttttttttttttcgcggggaaatttcggggaagtgttgagtttggagtatcgatttttttttttttcgcggggaaattacggggaagtgttgagtttggagtatcgatttttttttttttcgcggggaaatttcggggaagtgttgagtttggagtatcgatttttttttttttcgcggggaaatttcggggaagtgttgagtttggagtatcgatttttttttttttcgcggggaaatttcggggaagtgttgagtttggagtatcgatttttttttttttcgcggggaaatttcggggaagtgttgagtttggagtatcgatttttttttttttcgcggggaaatttcggggaagtgttgagtttggagtatcgatttttttttttttcgcggggaaatttcggggaagtgttgagtttggagtatcgatttttttcgttttcgcggggaaatttcggggaagtgttgagtttggagtatcgatttttttcgttttcgcggggaaatttcggggaagtgttgagtttggagtatcgatttttttcgttttcgcggggaaatttcggggaagtgttgagtttggagtatcgatttttttcgttttcgcggggaaatttcggggaagtgttgagtttggagtatcgatttttttcgttttcgcggggaaatttcggggaagtgttgagtttggagtatcgatttttttttttttcgcggggaaattacggggaagtgttgagtttggagtatcgatttttttcgttttcgcggggaaatttcggggaagtgttgagtttggagtatcgatttttttcgttttcgcggggaaatttcggggaagtgttgagtttggagtatcgatttttttttttttcgcggggaaatttcggggaagtgttgagtatggagtatcgatttttttcgttttcgcggggaaatttcggggaagtgttgagtttggagtatcgattt

SEQ ID NO: 34400 - DNA, 1050 bp, Artificial Sequence
  chemically treated genomic DNA (Homo sapiens) CpG-island No: 34400
aaatcgatactccaaactcaacacttccccgaaatttccccgcgaaaacgaaaaaaatcgatactccatactcaacacttccccgaaatttccccgcgaaaaaaaaaaaaatcgatactccaaactcaacacttccccgaaatttccccgcgaaaacgaaaaaaatcgatactccaaactcaacacttccccgaaatttccccgcgaaaacgaaaaaaatcgatactccaaactcaacacttccccgtaatttccccgcgaaaaaaaaaaaaatcgatactccaaactcaacacttccccgaaatttccccgcgaaaacgaaaaaaatcgatactccaaactcaacacttccccgaaatttccccgcgaaaacgaaaaaaatcgatactccaaactcaacacttccccgaaatttccccgcgaaaacgaaaaaaatcgatactccaaactcaacacttccccgaaatttccccgcgaaaacgaaaaaaatcgatactccaaactcaacacttccccgaaatttccccgcgaaaacgaaaaaaatcgatactccaaactcaacacttccccgaaatttccccgcgaaaaaaaaaaaaatcgatactccaaactcaacacttccccgaaatttccccgcgaaaaaaaaaaaaatcgatactccaaactcaacacttccccgaaatttccccgcgaaaaaaaaaaaaatcgatactccaaactcaacacttccccgaaatttccccgcgaaaaaaaaaaaaatcgatactccaaactcaacacttccccgaaatttccccgcgaaaaaaaaaaaaatcgatactccaaactcaacacttccccgaaatttccccgcgaaaaaaaaaaaaatcgatactccaaactcaacacttccccgtaatttccccgcgaaaaaaaaaaaaatcgatactccaaactcaacacttccccgaaatttccccgcgaaaaaaaaaaaaatcgatactccaaactcaacacttccccgaaataaccccgcgaaaacgaaaaaaatcgaaactccaaactcaacac

SEQ ID NO: 34401 - DNA, 509 bp, Artificial Sequence
  chemically treated genomic DNA (Homo sapiens) CpG-island No: 34401
ttacggggattggcgaggcggcgagagcgcgggacgttttttcgggattgtatggtggagatggcgacgggcgttgacggcgagaaaggttgtaggattaggttttggtttttttttaattttttttcgttgacgttaagataagtcgcgttttggaatagattgcggtacgggtcgtatttttgaatttagttttatttcgcggtgaggtttttttttattgtatagatagtggttgatttatttttttttattttcgcgtttttttttcgttttcgttcgtttttataggattcgttggtttgtagtcgcggaagtttttattgtcgcgttggcgatttcgttaggcgttcgggagaattattgtttttaggttgtttttcgcgtttcgaggtttgttggggttttcggacggtcgggcggggatagagggaaagaaatcgttttgtatgttgggagtagtagtttgtgtaatatcgcgagttgttttttagttgattgttttaata

SEQ ID NO: 34402 - DNA, 509 bp, Artificial Sequence
  chemically treated genomic DNA (Homo sapiens) CpG-island No: 34402
tattaaaacaatcaactaaaaaacaactcgcgatattacacaaactactactcccaacatacaaaacgatttctttccctctatccccgcccgaccgtccgaaaaccccaacaaacctcgaaacgcgaaaaacaacctaaaaacaataattctcccgaacgcctaacgaaatcgccaacgcgacaataaaaacttccgcgactacaaaccaacgaatcctataaaaacgaacgaaaacgaaaaaaaaacgcgaaaataaaaaaaaataaatcaaccactatctatacaataaaaaaaaacctcaccgcgaaataaaactaaattcaaaaatacgacccgtaccgcaatctattccaaaacgcgacttatcttaacgtcaacgaaaaaaaattaaaaaaaaaccaaaacctaatcctacaacctttctcgccgtcaacgcccgtcgccatctccaccatacaatcccgaaaaaacgtcccgcgctctcgccgcctcgccaatccccgtaa

SEQ ID NO: 34403 - DNA, 509 bp, Artificial Sequence
  chemically treated genomic DNA (Homo sapiens) CpG-island No: 34403
tgttagagtagttaattaaaggatagttcgcgatattatataaattattatttttaatatgtaaagcggtttttttttttttgttttcgttcggtcgttcgagagttttagtaggtttcggggcgcgaaaggtaatttgggagtagtagttttttcgggcgtttagcgggatcgttagcgcggtagtgggggttttcgcggttgtaagttagcgggttttgtgagggcgagcggaggcggagaaagggcgcgggagtgagagagggtgagttagttattgtttatgtaataaagggaggttttatcgcgggatagggttgaatttagaagtgcggttcgtgtcgtagtttgttttaggacgcggtttgttttagcgttagcgagggaaggttgaggaggagttagagtttggttttgtagtttttttcgtcgttagcgttcgtcgttatttttattatgtagtttcgggaagacgtttcgcgttttcgtcgtttcgttagttttcgtgg

SEQ ID NO: 34404 - DNA, 509 bp, Artificial Sequence
  chemically treated genomic DNA (Homo sapiens) CpG-island No: 34404
ccacgaaaactaacgaaacgacgaaaacgcgaaacgtcttcccgaaactacataataaaaataacgacgaacgctaacgacgaaaaaaactacaaaaccaaactctaactcctcctcaaccttccctcgctaacgctaaaacaaaccgcgtcctaaaacaaactacgacacgaaccgcacttctaaattcaaccctatcccgcgataaaacctccctttattacataaacaataactaactcaccctctctcactcccgcgccctttctccgcctccgctcgccctcacaaaacccgctaacttacaaccgcgaaaacccccactaccgcgctaacgatcccgctaaacgcccgaaaaaactactactcccaaattacctttcgcgccccgaaacctactaaaactctcgaacgaccgaacgaaaacaaaaaaaaaaaaaccgctttacatattaaaaataataatttatataatatcgcgaactatcctttaattaactactctaaca

SEQ ID NO: 34405 - DNA, 511 bp, Artificial Sequence
  chemically treated genomic DNA (Homo sapiens) CpG-island No: 34405
tacggggattggttaggcggcgagagcgcggggcgttttttcgggattgtatggtggagatggcgacgggcgttgatggcgagaaacgttgtaggattcggttttggtttttttttaattttttttcgttgacgttaagatagtagcgttttcgaagagatagtagtacgagtttatttattgaatttaattttatttcgtagagtcgtttttcgttatcgtttagatagtggttgatttatttttttttattttcgcgtttttttttcgcgtttgttcgtttttataggattcgttggtttggagtcgtagaagtcgttattgtagcgtgggcgataatgttaggcgtttaggagaattatcgtttttaggttgtttttcgcgtttcgagggttgttgggattttcggattttcgggtcgagatcgagggaaagaattcgttttgtatgtcgggagtagtagtttgtgtaatatcgcgatttttttttggtgttttttgttttagttgat

SEQ ID NO: 34406 - DNA, 511 bp, Artificial Sequence
  chemically treated genomic DNA (Homo sapiens) CpG-island No: 34406
atcaactaaaacaaaaaacaccaaaaaaaaatcgcgatattacacaaactactactcccgacatacaaaacgaattctttccctcgatctcgacccgaaaatccgaaaatcccaacaaccctcgaaacgcgaaaaacaacctaaaaacgataattctcctaaacgcctaacattatcgcccacgctacaataacgacttctacgactccaaaccaacgaatcctataaaaacgaacaaacgcgaaaaaaaaacgcgaaaataaaaaaaaataaatcaaccactatctaaacgataacgaaaaacgactctacgaaataaaattaaattcaataaataaactcgtactactatctcttcgaaaacgctactatcttaacgtcaacgaaaaaaaattaaaaaaaaaccaaaaccgaatcctacaacgtttctcgccatcaacgcccgtcgccatctccaccatacaatcccgaaaaaacgccccgcgctctcgccgcctaaccaatccccgta

SEQ ID NO: 34407 - DNA, 511 bp, Artificial Sequence
  chemically treated genomic DNA (Homo sapiens) CpG-island No: 34407
gttagttaaaataaggaatattagagaaggatcgcgatattatataaattattattttcgatatgtaaagcggattttttttttcggtttcggttcgggagttcgagagttttagtagttttcggggcgcgaaaggtaatttgggagcggtagtttttttgggcgtttagtattgtcgtttacgttgtagtagcggtttttgcggttttaagttagcgggttttgtgaaggcgaatagacgcggagaaaggacgcgggagtgagagagggtgagttagttattgtttaaacgataacgggaggcggttttgcggggtagggttgaatttagtaaatgggttcgtgttgttgttttttcggagacgttgttattttagcgttagcgagggaaggttgaggaggagttagagtcgggttttgtagcgtttttcgttattagcgttcgtcgttatttttattatgtagtttcgggaagacgtttcgcgttttcgtcgtttagttagttttcgtg

SEQ ID NO: 34408 - DNA, 511 bp, Artificial Sequence
  chemically treated genomic DNA (Homo sapiens) CpG-island No: 34408
cacgaaaactaactaaacgacgaaaacgcgaaacgtcttcccgaaactacataataaaaataacgacgaacgctaataacgaaaaacgctacaaaacccgactctaactcctcctcaaccttccctcgctaacgctaaaataacaacgtctccgaaaaaacaacaacacgaacccatttactaaattcaaccctaccccgcaaaaccgcctcccgttatcgtttaaacaataactaactcaccctctctcactcccgcgtcctttctccgcgtctattcgccttcacaaaacccgctaacttaaaaccgcaaaaaccgctactacaacgtaaacgacaatactaaacgcccaaaaaaactaccgctcccaaattacctttcgcgccccgaaaactactaaaactctcgaactcccgaaccgaaaccgaaaaaaaaaatccgctttacatatcgaaaataataatttatataatatcgcgatccttctctaatattccttattttaactaac

SEQ ID NO: 34409 - DNA, 696 bp, Artificial Sequence
  chemically treated genomic DNA (Homo sapiens) CpG-island No: 34409
cggcgttagtttcggtttcgtttcgtaggtcgttgttacggaggcgttcgttcgttgtttcgttttttggcggtgtttgcgtgtgttcgggtgtgggtatatgtatttgtgtttgtaaattagggcgggttttttaaatcgaaagttgcgcggagttgggtttttgggattttagggttgcgggtaagggagatgggggattttttcgggatttcgatttcgatttgagtttagatttttcgcgttttggttttttgtttcgtatttttagggtcgtagtgttaatttcgtgtttttcgaagtggttcgttatttgtttcgtcgaggggagtcgttttttgggttaacgttgcgggagttcggacggttcgaagtatgttggttaggcgtaaggggagatcgatttataggggagagggtgggtaaggggacggcggttgggtttcggtatttcgcgaggggggttttgcgattttgatttagtagcggcgttttcgggttcgcgaggttttgacgattagcgggcgttttttcgggaattatatttgtttttcgttggtttcgagcgtttagagcgcgaagcggcggagtacggcgaatttacgattcgtgatgtttggtttaattttttgttttttatgggtgcgggtaggaacggagtagcggttgatgttttttttttaattttaaagtttt

SEQ ID NO: 34410 - DNA, 696 bp, Artificial Sequence
  chemically treated genomic DNA (Homo sapiens) CpG-island No: 34410
aaaactttaaaattaaaaaaaaaacatcaaccgctactccgttcctacccgcacccataaaaaacaaaaaattaaaccaaacatcacgaatcgtaaattcgccgtactccgccgcttcgcgctctaaacgctcgaaaccaacgaaaaacaaatataattcccgaaaaaacgcccgctaatcgtcaaaacctcgcgaacccgaaaacgccgctactaaatcaaaatcgcaaaacccccctcgcgaaataccgaaacccaaccgccgtccccttacccaccctctcccctataaatcgatctccccttacgcctaaccaacatacttcgaaccgtccgaactcccgcaacgttaacccaaaaaacgactcccctcgacgaaacaaataacgaaccacttcgaaaaacacgaaattaacactacgaccctaaaaatacgaaacaaaaaaccaaaacgcgaaaaatctaaactcaaatcgaaatcgaaatcccgaaaaaatcccccatctcccttacccgcaaccctaaaatcccaaaaacccaactccgcgcaactttcgatttaaaaaacccgccctaatttacaaacacaaatacatatacccacacccgaacacacgcaaacaccgccaaaaaacgaaacaacgaacgaacgcctccgtaacaacgacctacgaaacgaaaccgaaactaacgccg

SEQ ID NO: 34411 - DNA, 696 bp, Artificial Sequence
  chemically treated genomic DNA (Homo sapiens) CpG-island No: 34411
ggggttttgggattagggaggggatattagtcgttatttcgtttttgttcgtatttatgaagggtagaggattaggttaagtattacgaatcgtaggttcgtcgtgtttcgtcgtttcgcgttttggacgttcgagattagcgggaaataaatgtggttttcgagggggcgttcgttggtcgttaaaatttcgcgggttcggaggcgtcgttgttgggttagaatcgtagagtttttttcgcggggtatcgaggtttagtcgtcgtttttttgtttatttttttttttgtgagtcggtttttttttgcgtttggttagtatgtttcggatcgttcggattttcgtagcgttggtttaaggggcggtttttttcggcggagtaggtgacgaattatttcggaggatacggaattgatattgcggttttagagatacgggataaggggttagaacgcggggagtttaggtttagatcggagtcgggatttcgggaaaattttttattttttttgttcgtagttttagaattttagaaatttaatttcgcgtagttttcggtttggagagttcgttttggtttgtaagtatagatatatgtgtttatattcgaatatacgtagatatcgttagagagcgagatagcgagcgggcgttttcgtagtagcggtttgcggggcggaatcggagttggcgtcg

SEQ ID NO: 34412 - DNA, 696 bp, Artificial Sequence
  chemically treated genomic DNA (Homo sapiens) CpG-island No: 34412
cgacgccaactccgattccgccccgcaaaccgctactacgaaaacgcccgctcgctatctcgctctctaacgatatctacgtatattcgaatataaacacatatatctatacttacaaaccaaaacgaactctccaaaccgaaaactacgcgaaattaaatttctaaaattctaaaactacgaacaaaaaaaataaaaaattttcccgaaatcccgactccgatctaaacctaaactccccgcgttctaaccccttatcccgtatctctaaaaccgcaatatcaattccgtatcctccgaaataattcgtcacctactccgccgaaaaaaaccgccccttaaaccaacgctacgaaaatccgaacgatccgaaacatactaaccaaacgcaaaaaaaaaccgactcacaaaaaaaaaaataaacaaaaaaacgacgactaaacctcgataccccgcgaaaaaaactctacgattctaacccaacaacgacgcctccgaacccgcgaaattttaacgaccaacgaacgccccctcgaaaaccacatttatttcccgctaatctcgaacgtccaaaacgcgaaacgacgaaacacgacgaacctacgattcgtaatacttaacctaatcctctacccttcataaatacgaacaaaaacgaaataacgactaatatcccctccctaatcccaaaacccc

SEQ ID NO: 34413 - DNA, 580 bp, Artificial Sequence
  chemically treated genomic DNA (Homo sapiens) CpG-island No: 34413
ggaacgtcgtttcggtgtttggtaatattgttagtttttgtaattttttttaaaagtatttgtttggtcgagtagttaatttttttaaaaataaaaattcggtttgcgttcgtttaagtagcggggtttgtatatggagatgttataggtttcgcgtatagcgtagagggtcgcgatttttaagcgtatgttttaatagaaggtgcggttggaagattcgggttttcgggtttcgtttcggtttgttttttttcgtaggtgcgttggttagcgttcggcgtaggttgaagttttttttttttttttttaatttttataaaagtttggggcggcgcggtagtagtattgttgttttttcggtttttcgttttatttcggtcgggtcgggttcgttacgtttggcgcgttgagtaggttcggtcgcgtagcgtttatttttttttcgtttcgggtcggtagtgtggggcggcgcgttgggggcgcggcgtgtttggggatattttgtgatgttggcgagaataggatatgattttatatggcgagaagttttttagttttttaattattttacggtgttttt

SEQ ID NO: 34414 - DNA, 580 bp, Artificial Sequence
  chemically treated genomic DNA (Homo sapiens) CpG-island No: 34414
aaaaacaccgtaaaataattaaaaaactaaaaaacttctcgccatataaaatcatatcctattctcgccaacatcacaaaatatccccaaacacgccgcgcccccaacgcgccgccccacactaccgacccgaaacgaaaaaaaaataaacgctacgcgaccgaacctactcaacgcgccaaacgtaacgaacccgacccgaccgaaataaaacgaaaaaccgaaaaaacaacaatactactaccgcgccgccccaaacttttataaaaattaaaaaaaaaaaaaaaaaacttcaacctacgccgaacgctaaccaacgcacctacgaaaaaaaacaaaccgaaacgaaacccgaaaacccgaatcttccaaccgcaccttctattaaaacatacgcttaaaaatcgcgaccctctacgctatacgcgaaacctataacatctccatatacaaaccccgctacttaaacgaacgcaaaccgaatttttatttttaaaaaaattaactactcgaccaaacaaatacttttaaaaaaaattacaaaaactaacaatattaccaaacaccgaaacgacgttcc

SEQ ID NO: 34415 - DNA, 580 bp, Artificial Sequence
  chemically treated genomic DNA (Homo sapiens) CpG-island No: 34415
gaaggtatcgtgaaatgattaaggaattaaagagtttttcgttatgtgagattatgttttgttttcgttaatattataagatgtttttagatacgtcgcgtttttagcgcgtcgttttatattgtcggttcggagcgaggaaagggtaggcgttgcgcggtcgggtttgtttagcgcgttagacgtggcggattcggttcggtcggagtagagcgggaagtcgggagagtagtagtgttgttgtcgcgtcgttttagatttttataggggttggggggagggaaggaaggttttagtttgcgtcgggcgttagttagcgtatttacgggaaggggtagatcgaagcggagttcgggagttcgggttttttagtcgtattttttattaagatatgcgtttgggggtcgcggttttttgcgttgtgcgcggggtttgtgatatttttatgtgtaaatttcgttgtttagacgagcgtaggtcgggtttttgtttttgaagaaattaattgttcggttaagtaggtgtttttgaaaggggttgtaaaggttggtagtgttgttaggtatcgaggcgacgtttt

SEQ ID NO: 34416 - DNA, 580 bp, Artificial Sequence
  chemically treated genomic DNA (Homo sapiens) CpG-island No: 34416
aaaacgtcgcctcgatacctaacaacactaccaacctttacaacccctttcaaaaacacctacttaaccgaacaattaatttcttcaaaaacaaaaacccgacctacgctcgtctaaacaacgaaatttacacataaaaatatcacaaaccccgcgcacaacgcaaaaaaccgcgacccccaaacgcatatcttaataaaaaatacgactaaaaaacccgaactcccgaactccgcttcgatctaccccttcccgtaaatacgctaactaacgcccgacgcaaactaaaaccttccttccctccccccaacccctataaaaatctaaaacgacgcgacaacaacactactactctcccgacttcccgctctactccgaccgaaccgaatccgccacgtctaacgcgctaaacaaacccgaccgcgcaacgcctaccctttcctcgctccgaaccgacaatataaaacgacgcgctaaaaacgcgacgtatctaaaaacatcttataatattaacgaaaacaaaacataatctcacataacgaaaaactctttaattccttaatcatttcacgataccttc

SEQ ID NO: 34417 - DNA, 540 bp, Artificial Sequence
  chemically treated genomic DNA (Homo sapiens) CpG-island No: 34417
tttattcgcgtttcgggtattcgtttttggggcgttttcgtttgggacgtttttcgcgacgtagtggtcgcgcggacgggtagcgatagcgcgtatagcgttagggatagcgcgtaaagtaacgcgggcgcggggcggtgcggaattatggtggcgatagcggtaggggatttagtcggtagtcgcggtttcgggtcgtcgattttaagtagtcgttcgtttatttcgtttaagtcggggatcgtttttaagggagggcgcggggcggggatttgtttcggattttggagatatttgggtttttattcggatcgattcgatagggcgcggtagtttttgtattttagtttcggggcggagatttagtattaggtttgatatacggcgggcgttagttgtgtgtatattaaatgggcgtaggtacgagcggcggcgagtttagttgagttttttgcgacgtacgcgagttttttcgttttttcgtatttaatatttttagtaaaaaaataatatgaattaataatttttgaaagaaaaata

SEQ ID NO: 34418 - DNA, 540 bp, Artificial Sequence
  chemically treated genomic DNA (Homo sapiens) CpG-island No: 34418
tatttttctttcaaaaattattaattcatattatttttttactaaaaatattaaatacgaaaaaacgaaaaaactcgcgtacgtcgcaaaaaactcaactaaactcgccgccgctcgtacctacgcccatttaatatacacacaactaacgcccgccgtatatcaaacctaatactaaatctccgccccgaaactaaaatacaaaaactaccgcgccctatcgaatcgatccgaataaaaacccaaatatctccaaaatccgaaacaaatccccgccccgcgccctcccttaaaaacgatccccgacttaaacgaaataaacgaacgactacttaaaatcgacgacccgaaaccgcgactaccgactaaatcccctaccgctatcgccaccataattccgcaccgccccgcgcccgcgttactttacgcgctatccctaacgctatacgcgctatcgctacccgtccgcgcgaccactacgtcgcgaaaaacgtcccaaacgaaaacgccccaaaaacgaatacccgaaacgcgaataaa

SEQ ID NO: 34419 - DNA, 540 bp, Artificial Sequence
  chemically treated genomic DNA (Homo sapiens) CpG-island No: 34419
tgttttttttttaaaaattgttagtttatgttatttttttgttggaggtgttaggtgcggagaggcgagggggttcgcgtgcgtcgtaggaggtttagttgggttcgtcgtcgttcgtgtttgcgtttatttagtgtgtatatagttagcgttcgtcgtatgttaggtttggtgttgggttttcgtttcggagttggggtgtaggggttgtcgcgttttgtcgggtcgattcgggtgggaatttagatgtttttaagattcgagatagattttcgtttcgcgtttttttttgggggcggttttcggtttgggcgggatgggcgggcggttatttaaggtcggcgattcgaggtcgcggttgtcgattgggttttttgtcgttgtcgttattatggtttcgtatcgtttcgcgttcgcgttgttttgcgcgttgtttttggcgttgtgcgcgttgtcgttgttcgttcgcgcggttattgcgtcgcggggggcgttttaggcgggggcgttttaggggcgggtgttcgaggcgcgggtgag

SEQ ID NO: 34420 - DNA, 540 bp, Artificial Sequence
  chemically treated genomic DNA (Homo sapiens) CpG-island No: 34420
ctcacccgcgcctcgaacacccgcccctaaaacgcccccgcctaaaacgccccccgcgacgcaataaccgcgcgaacgaacaacgacaacgcgcacaacgccaaaaacaacgcgcaaaacaacgcgaacgcgaaacgatacgaaaccataataacgacaacgacaaaaaacccaatcgacaaccgcgacctcgaatcgccgaccttaaataaccgcccgcccatcccgcccaaaccgaaaaccgcccccaaaaaaaaacgcgaaacgaaaatctatctcgaatcttaaaaacatctaaattcccacccgaatcgacccgacaaaacgcgacaacccctacaccccaactccgaaacgaaaacccaacaccaaacctaacatacgacgaacgctaactatatacacactaaataaacgcaaacacgaacgacgacgaacccaactaaacctcctacgacgcacgcgaaccccctcgcctctccgcacctaacacctccaacaaaaaaataacataaactaacaatttttaaaaaaaaaaca

SEQ ID NO: 34421 - DNA, 663 bp, Artificial Sequence
  chemically treated genomic DNA (Homo sapiens) CpG-island No: 34421
cgcgtcgtggagggataggagggcggggattgggaggtgggtttttttcgattttgggcgttgattggttaatttttacgagggcgggatttcgattgggggcggggcggtaatttgggttttgtgtttttggttttttagggtattttcggcggtttcgggtttggtaacgaggacgggggagtgcgattgcgtttcgggtagtatggtcgagaagcggtatatacgggatttcgaagtttagcggtttttcgatttttttaagggtgagtttcgcgttttttgattttttttcgtggatcgagttttcgttcgtagcgtgcgtttcgaggtttgatagtcgggtttttggttagttttcgttgtttcgggttgggcgagattttaaagtcgcggtttttttttagtaaattgagtattacgaattttgtttggtagattgaggttacgatggaggggtggcgggttgttaacggtacgttttttatcgtacgggttttggttatttcgcggtcgttagatgttaagttttatgttagggttgtattatttcgtgttacgtacgcggattaggaaacgtagagggaattggtagttagcgaggcggggatcgggattttatattttattttttgtttatttttttttttttcgatttatttt

SEQ ID NO: 34422 - DNA, 663 bp, Artificial Sequence
  chemically treated genomic DNA (Homo sapiens) CpG-island No: 34422
aaaataaatcgaaaaaaaaaaaaataaacaaaaaataaaatataaaatcccgatccccgcctcgctaactaccaattccctctacgtttcctaatccgcgtacgtaacacgaaataatacaaccctaacataaaacttaacatctaacgaccgcgaaataaccaaaacccgtacgataaaaaacgtaccgttaacaacccgccacccctccatcgtaacctcaatctaccaaacaaaattcgtaatactcaatttactaaaaaaaaaccgcgactttaaaatctcgcccaacccgaaacaacgaaaactaaccaaaaacccgactatcaaacctcgaaacgcacgctacgaacgaaaactcgatccacgaaaaaaaatcaaaaaacgcgaaactcacccttaaaaaaatcgaaaaaccgctaaacttcgaaatcccgtatataccgcttctcgaccatactacccgaaacgcaatcgcactcccccgtcctcgttaccaaacccgaaaccgccgaaaataccctaaaaaaccaaaaacacaaaacccaaattaccgccccgcccccaatcgaaatcccgccctcgtaaaaattaaccaatcaacgcccaaaatcgaaaaaaacccacctcccaatccccgccctcctatccctccacgacgcg

SEQ ID NO: 34423 - DNA, 663 bp, Artificial Sequence
  chemically treated genomic DNA (Homo sapiens) CpG-island No: 34423
agagtgagtcgggaaaaaggggagtgggtaaagggtgagatgtggggtttcggttttcgtttcgttggttgttagttttttttgcgttttttagttcgcgtgcgtgatacgagatagtgtagttttggtatggggtttggtatttggcggtcgcgagataattagggttcgtgcgatgggaaacgtgtcgttggtagttcgttatttttttatcgtgattttagtttgttaaatagggttcgtgatgtttagtttattagggaggagtcgcggttttgagatttcgtttagttcgaagtagcggagattggttaggagttcggttgttagatttcggagcgtacgttgcgggcgggggttcggtttacgggggagggttaggggacgcgggatttatttttgaaggagtcggggagtcgttgggtttcggagtttcgtgtgtgtcgtttttcggttatgttgttcgagacgtagtcgtattttttcgttttcgttgttaaattcggagtcgtcgggaatgttttgaggagttagaggtataagatttagattgtcgtttcgtttttaatcgaggtttcgttttcgtgagagttggttaattaacgtttaggatcgaggaggatttattttttaattttcgtttttttgtttttttacggcgcg

SEQ ID NO: 34424 - DNA, 663 bp, Artificial Sequence
  chemically treated genomic DNA (Homo sapiens) CpG-island No: 34424
cgcgccgtaaaaaaacaaaaaaacgaaaattaaaaaataaatcctcctcgatcctaaacgttaattaaccaactctcacgaaaacgaaacctcgattaaaaacgaaacgacaatctaaatcttatacctctaactcctcaaaacattcccgacgactccgaatttaacaacgaaaacgaaaaaatacgactacgtctcgaacaacataaccgaaaaacgacacacacgaaactccgaaacccaacgactccccgactccttcaaaaataaatcccgcgtcccctaaccctcccccgtaaaccgaacccccgcccgcaacgtacgctccgaaatctaacaaccgaactcctaaccaatctccgctacttcgaactaaacgaaatctcaaaaccgcgactcctccctaataaactaaacatcacgaaccctatttaacaaactaaaatcacgataaaaaaataacgaactaccaacgacacgtttcccatcgcacgaaccctaattatctcgcgaccgccaaataccaaaccccataccaaaactacactatctcgtatcacgcacgcgaactaaaaaacgcaaaaaaaactaacaaccaacgaaacgaaaaccgaaaccccacatctcaccctttacccactcccctttttcccgactcactct

SEQ ID NO: 34425 - DNA, 530 bp, Artificial Sequence
  chemically treated genomic DNA (Homo sapiens) CpG-island No: 34425
tcgggatcgggtttggcgttcgtcgtcggttgtaagcgtaagtattattttggttaggaggaggaggaagacgacgaggaggatgcgggcgggttgggggtcgagtttttcgggggcgtttcgttcgttttttgtaagcgcgttcgtttcgaggatttttgttcggattcgttttcggacgcgtttaatattttaaatttgatttttatttttggtttcggtttttcggggttggtgagtcgatagtcggatttttcggagtagtcgtcgtcgtttaacgggtagttgtgcgttaagtaggcgttcgttagtttcggcgtttggattcgagttattgtcgttttttagggattttcgagggtatagggattcggggtttcgcggggttggggttagataaagattcggtaaaggggcgagaggagggaacgagcgggcgtcgggttattcggggttgagttgggggcgagcgggggtaggcggttgatgttttataaattgtaaaataaaaaaaaaagaaatttaaaatt

SEQ ID NO: 34426 - DNA, 530 bp, Artificial Sequence
  chemically treated genomic DNA (Homo sapiens) CpG-island No: 34426
aattttaaatttcttttttttttattttacaatttataaaacatcaaccgcctacccccgctcgcccccaactcaaccccgaataacccgacgcccgctcgttccctcctctcgcccctttaccgaatctttatctaaccccaaccccgcgaaaccccgaatccctataccctcgaaaatccctaaaaaacgacaataactcgaatccaaacgccgaaactaacgaacgcctacttaacgcacaactacccgttaaacgacgacgactactccgaaaaatccgactatcgactcaccaaccccgaaaaaccgaaaccaaaaataaaaatcaaatttaaaatattaaacgcgtccgaaaacgaatccgaacaaaaatcctcgaaacgaacgcgcttacaaaaaacgaacgaaacgcccccgaaaaactcgacccccaacccgcccgcatcctcctcgtcgtcttcctcctcctcctaaccaaaataatacttacgcttacaaccgacgacgaacgccaaacccgatcccga

SEQ ID NO: 34427 - DNA, 530 bp, Artificial Sequence
  chemically treated genomic DNA (Homo sapiens) CpG-island No: 34427
gattttagattttttttttttttattttataatttataaaatattagtcgtttgttttcgttcgtttttagtttagtttcgagtggttcggcgttcgttcgtttttttttttcgtttttttgtcgagtttttgtttggttttagtttcgcggggtttcgggtttttgtgttttcgggggtttttagaaggcgataatggttcgagtttaggcgtcgaggttggcgagcgtttgtttggcgtatagttgttcgttgagcggcggcggttgtttcgaggagttcggttgtcggtttattagtttcgagaagtcggagttaaagatggagattaagtttgagatgttggacgcgttcggggacgagttcgggtagaagttttcgaagcgggcgcgtttgtagggggcgaacggggcgttttcggggggttcggtttttagttcgttcgtatttttttcgtcgttttttttttttttttggttagggtaatatttgcgtttgtagtcggcggcggacgttaggttcggtttcgg

SEQ ID NO: 34428 - DNA, 530 bp, Artificial Sequence
  chemically treated genomic DNA (Homo sapiens) CpG-island No: 34428
ccgaaaccgaacctaacgtccgccgccgactacaaacgcaaatattaccctaaccaaaaaaaaaaaaaaaacgacgaaaaaaatacgaacgaactaaaaaccgaaccccccgaaaacgccccgttcgccccctacaaacgcgcccgcttcgaaaacttctacccgaactcgtccccgaacgcgtccaacatctcaaacttaatctccatctttaactccgacttctcgaaactaataaaccgacaaccgaactcctcgaaacaaccgccgccgctcaacgaacaactatacgccaaacaaacgctcgccaacctcgacgcctaaactcgaaccattatcgccttctaaaaacccccgaaaacacaaaaacccgaaaccccgcgaaactaaaaccaaacaaaaactcgacaaaaaaacgaaaaaaaaaaacgaacgaacgccgaaccactcgaaactaaactaaaaacgaacgaaaacaaacgactaatattttataaattataaaataaaaaaaaaaaaaatctaaaatc

SEQ ID NO: 34429 - DNA, 613 bp, Artificial Sequence
  chemically treated genomic DNA (Homo sapiens) CpG-island No: 34429
gaggttcgtagcgtcgtcggggttagaagagacgcgtagttttaggttgtcgttgaggagaaaaaattttggtggtttttgaagcggtagcgttcgtaggttttgttgaggagtgtggggcgtaggattttgggagcgagcggcgggttggagagggcgtttgcgaatgttgggtgagtgttggtcggggaggtttagtcgttcgcgtcgtagttgtcgtttttttttcgggtttgttttgaggaggagaggcgacggtagtggtagcgacgcgtttttttggttgcgttttgtaatggttttcgagacgtcgagattttcgtagttagcgtttcgagattattatatgatcgaggttgagggatttagtcgtcgtcgtcgcgtttgtagttgaagaaggggtaagaaggcgtcgtgtttcgttttcgtttttttttttatttcgtttcgggcgttttttatttatcgcgtttattattcgttcggtagtttttagttatttttcggtgcggcgggtggcgtaggttgttcgtcgggagggggtatagtttcgggtgtatttttcgtagttgcgttttattcgggttattaagtacggtggagggggaatagg

SEQ ID NO: 34430 - DNA, 613 bp, Artificial Sequence
  chemically treated genomic DNA (Homo sapiens) CpG-island No: 34430
cctattccccctccaccgtacttaataacccgaataaaacgcaactacgaaaaatacacccgaaactataccccctcccgacgaacaacctacgccacccgccgcaccgaaaaataactaaaaactaccgaacgaataataaacgcgataaataaaaaacgcccgaaacgaaataaaaaaaaaaacgaaaacgaaacacgacgccttcttaccccttcttcaactacaaacgcgacgacgacgactaaatccctcaacctcgatcatataataatctcgaaacgctaactacgaaaatctcgacgtctcgaaaaccattacaaaacgcaaccaaaaaaacgcgtcgctaccactaccgtcgcctctcctcctcaaaacaaacccgaaaaaaaaacgacaactacgacgcgaacgactaaacctccccgaccaacactcacccaacattcgcaaacgccctctccaacccgccgctcgctcccaaaatcctacgccccacactcctcaacaaaacctacgaacgctaccgcttcaaaaaccaccaaaattttttctcctcaacgacaacctaaaactacgcgtctcttctaaccccgacgacgctacgaacctc

SEQ ID NO: 34431 - DNA, 613 bp, Artificial Sequence
  chemically treated genomic DNA (Homo sapiens) CpG-island No: 34431
tttgttttttttttatcgtgtttggtggttcgggtggggcgtagttgcgggaaatgtattcggagttgtgttttttttcggcgaatagtttgcgttattcgtcgtatcgggaggtggttgggggttgtcgagcgagtggtgaacgcgatgggtggagagcgttcgaaacgaggtggaaaagggggcgggggcgaggtacggcgtttttttgttttttttttagttatagacgcggcggcggcggttgagttttttagtttcggttatgtgatagtttcgaagcgttagttgcgggggtttcggcgtttcggggattattataaaacgtagttaggagagcgcgtcgttgttattgtcgtcgttttttttttttaagataagttcgggagaaaggcggtagttgcggcgcggacggttgagttttttcggttagtatttatttagtattcgtagacgttttttttagttcgtcgttcgtttttagagttttgcgttttatattttttagtagaatttgcgggcgttgtcgttttagaaattattaaagttttttttttttagcgatagtttagggttgcgcgttttttttaatttcggcgacgttgcgagtttt

SEQ ID NO: 34432 - DNA, 613 bp, Artificial Sequence
  chemically treated genomic DNA (Homo sapiens) CpG-island No: 34432
aaaactcgcaacgtcgccgaaattaaaaaaaacgcgcaaccctaaactatcgctaaaaaaaaaaaactttaataatttctaaaacgacaacgcccgcaaattctactaaaaaatataaaacgcaaaactctaaaaacgaacgacgaactaaaaaaaacgtctacgaatactaaataaatactaaccgaaaaaactcaaccgtccgcgccgcaactaccgcctttctcccgaacttatcttaaaaaaaaaaaacgacgacaataacaacgacgcgctctcctaactacgttttataataatccccgaaacgccgaaacccccgcaactaacgcttcgaaactatcacataaccgaaactaaaaaactcaaccgccgccgccgcgtctataactaaaaaaaaaacaaaaaaacgccgtacctcgcccccgcccccttttccacctcgtttcgaacgctctccacccatcgcgttcaccactcgctcgacaacccccaaccacctcccgatacgacgaataacgcaaactattcgccgaaaaaaaacacaactccgaatacatttcccgcaactacgccccacccgaaccaccaaacacgataaaaaaaaaacaaa

SEQ ID NO: 34433 - DNA, 625 bp, Artificial Sequence
  chemically treated genomic DNA (Homo sapiens) CpG-island No: 34433
gtgttttggcggattataggatatacgtgttttggcggattttataggatatacgtgttttggcggattttataggatatacgtgttttggcggattataggatatacgtgttttggcggattttataggatatacgtgttttggcggattataggatatacgtgttttggcggattataggatatacgtgttttggcggattttataggatatacgtgttttggcggattttataggatatacgtgttttggcggattatataggatatacgtgttttggcggattttataggatatacgtgttttggcggattttataggatatacgtgttttggcggattataggatatacgtgttttggcggattataggatatacgtgttttggcggattttataggatatacgtgttttggcggattttataggatatacgtgttttggcggattataggatatacgtgttttggcggattttataggatatacgtgttttggcggattttataggatatacgtgttttggcggattttataggatatacgtgttttggcggattataggatatacgtgttttggcggattatataggatatacgtgttttggtagattttataggtat

SEQ ID NO: 34434 - DNA, 625 bp, Artificial Sequence
  chemically treated genomic DNA (Homo sapiens) CpG-island No: 34434
atacctataaaatctaccaaaacacgtatatcctatataatccgccaaaacacgtatatcctataatccgccaaaacacgtatatcctataaaatccgccaaaacacgtatatcctataaaatccgccaaaacacgtatatcctataaaatccgccaaaacacgtatatcctataatccgccaaaacacgtatatcctataaaatccgccaaaacacgtatatcctataaaatccgccaaaacacgtatatcctataatccgccaaaacacgtatatcctataatccgccaaaacacgtatatcctataaaatccgccaaaacacgtatatcctataaaatccgccaaaacacgtatatcctatataatccgccaaaacacgtatatcctataaaatccgccaaaacacgtatatcctataaaatccgccaaaacacgtatatcctataatccgccaaaacacgtatatcctataatccgccaaaacacgtatatcctataaaatccgccaaaacacgtatatcctataatccgccaaaacacgtatatcctataaaatccgccaaaacacgtatatcctataaaatccgccaaaacacgtatatcctataatccgccaaaacac

SEQ ID NO: 34435 - DNA, 625 bp, Artificial Sequence
  chemically treated genomic DNA (Homo sapiens) CpG-island No: 34435
gtgtttgtgagatttgttagagtacgtgtgttttgtgtgattcgttagagtacgtgtgttttgtgattcgttagagtacgtgtgttttgtgagattcgttagagtacgtgtgttttgtgaaattcgttagagtacgtgtgttttgtgagattcgttagagtacgtgtgttttgtgattcgttagagtacgtgtgttttgtgagattcgttagagtacgtgtgttttgtgagattcgttagagtacgtgtgttttgtgattcgttagagtacgtgtgttttgtgattcgttagagtacgtgtgttttgtgagattcgttagagtacgtgtgttttgtgagattcgttagagtacgtgtgttttgtgtgattcgttagagtacgtgtgttttgtgagattcgttagagtacgtgtgttttgtgagattcgttagagtacgtgtgttttgtgattcgttagagtacgtgtgttttgtgattcgttagagtacgtgtgttttgtgagattcgttagagtacgtgtgttttgtgattcgttagagtacgtgtgttttgtgagattcgttagagtacgtgtgttttgtgagattcgttagagtacgtgtgttttgtgattcgttagagtat

SEQ ID NO: 34436 - DNA, 625 bp, Artificial Sequence
  chemically treated genomic DNA (Homo sapiens) CpG-island No: 34436
atactctaacgaatcacaaaacacacgtactctaacgaatctcacaaaacacacgtactctaacgaatctcacaaaacacacgtactctaacgaatcacaaaacacacgtactctaacgaatctcacaaaacacacgtactctaacgaatcacaaaacacacgtactctaacgaatcacaaaacacacgtactctaacgaatctcacaaaacacacgtactctaacgaatctcacaaaacacacgtactctaacgaatcacacaaaacacacgtactctaacgaatctcacaaaacacacgtactctaacgaatctcacaaaacacacgtactctaacgaatcacaaaacacacgtactctaacgaatcacaaaacacacgtactctaacgaatctcacaaaacacacgtactctaacgaatctcacaaaacacacgtactctaacgaatcacaaaacacacgtactctaacgaatctcacaaaacacacgtactctaacgaatttcacaaaacacacgtactctaacgaatctcacaaaacacacgtactctaacgaatcacaaaacacacgtactctaacgaatcacacaaaacacacgtactctaacaaatctcacaaacac

SEQ ID NO: 34437 - DNA, 526 bp, Artificial Sequence
  chemically treated genomic DNA (Homo sapiens) CpG-island No: 34437
gtcgagtgacgttggttagaggttgggtgtggagttcgcgtttgtagggttttttttcgtttcgcgggcgtttttttttattttattcgtttcggtatcgtagtgatatcgcggcgacgtcgattataggtggttgtgaggatagcgagattttgaggggaaagaatgagagaagcgcgtatttattgggtagaaggttcgtttttgcgtcgttttgcggaggttttcgggtattttttattttagggaagagaaaatttaattttatttgttataggcgcgggatttgcgtattttttttgggagtataagaatcgaggtaggattcggatttaggttaggcggtaaaggcgtttttttttttttatttataggtcgcgcggaatttttagtttattttcgtttttgtttttttttatttatttttcgcgttttttattcggacgttaggagatgtcgggagtttttttcgttagagtgtcggggagaaaaataaatttggagttatatggtagatatgtttaga

SEQ ID NO: 34438 - DNA, 526 bp, Artificial Sequence
  chemically treated genomic DNA (Homo sapiens) CpG-island No: 34438
tctaaacatatctaccatataactccaaatttatttttctccccgacactctaacgaaaaaaactcccgacatctcctaacgtccgaataaaaaacgcgaaaaataaataaaaaaaaacaaaaacgaaaataaactaaaaattccgcgcgacctataaataaaaaaaaaaaaacgcctttaccgcctaacctaaatccgaatcctacctcgattcttatactcccaaaaaaaatacgcaaatcccgcgcctataacaaataaaattaaattttctcttccctaaaataaaaaatacccgaaaacctccgcaaaacgacgcaaaaacgaaccttctacccaataaatacgcgcttctctcattctttcccctcaaaatctcgctatcctcacaaccacctataatcgacgtcgccgcgatatcactacgataccgaaacgaataaaataaaaaaaaacgcccgcgaaacgaaaaaaaaccctacaaacgcgaactccacacccaacctctaaccaacgtcactcgac

SEQ ID NO: 34439 - DNA, 526 bp, Artificial Sequence
  chemically treated genomic DNA (Homo sapiens) CpG-island No: 34439
tttgggtatgtttgttatatggttttaggtttgttttttttttcggtattttgacggggagggttttcggtattttttggcgttcgggtagaggacgcggagggtgagtaagggagggtaggggcgagggtggattgggggtttcgcgcggtttatgggtgggagagagggaacgtttttgtcgtttggtttgggttcgaattttgtttcggtttttgtgtttttaaagggaatgcgtaagtttcgcgtttgtgataagtgaggttggatttttttttttttgaggtgaaggatgttcggaggttttcgtaggacggcgtaaaaacgggttttttgtttaatagatgcgcgttttttttattttttttttttagaatttcgttgtttttataattatttgtggtcggcgtcgtcgcggtgttattgcgatgtcgaggcgaatggggtggggggaagcgttcgcggggcggggagggattttgtaggcgcggattttatatttagtttttggttagcgttattcggt

SEQ ID NO: 34440 - DNA, 526 bp, Artificial Sequence
  chemically treated genomic DNA (Homo sapiens) CpG-island No: 34440
accgaataacgctaaccaaaaactaaatataaaatccgcgcctacaaaatccctccccgccccgcgaacgcttccccccaccccattcgcctcgacatcgcaataacaccgcgacgacgccgaccacaaataattataaaaacaacgaaattctaaaaaaaaaaaataaaaaaaacgcgcatctattaaacaaaaaacccgtttttacgccgtcctacgaaaacctccgaacatccttcacctcaaaaaaaaaaaaatccaacctcacttatcacaaacgcgaaacttacgcattccctttaaaaacacaaaaaccgaaacaaaattcgaacccaaaccaaacgacaaaaacgttccctctctcccacccataaaccgcgcgaaacccccaatccaccctcgcccctaccctcccttactcaccctccgcgtcctctacccgaacgccaaaaaataccgaaaaccctccccgtcaaaataccgaaaaaaaaaacaaacctaaaaccatataacaaacatacccaaa

SEQ ID NO: 34441 - DNA, 687 bp, Artificial Sequence
  chemically treated genomic DNA (Homo sapiens) CpG-island No: 34441
cggggagtcgattttggtcggtcgtcggggttttgttcggtttttttgaaattttcgttttttttagtagggggcgggtcggggtcgcgtttcggggggaaggcgattaggtcgttttttttttcgattttttcgttttttaggatagtttttagtttagaggggcggttcgggggcggggtcgtatcgttttttttcgtttttaatttcggggcggtcgggcgggggtgggtagggggcgtgaggtcgtttttgcgtttcgggggtttttcgaaaacgcgtttcgggtgttcggttttttcgttgcgttttgtcgtcgttttttcgggggtttcgggcggtcgcggtcgtgtttttcgcgtttcggcggcgcggcgggaggggtcggcgtgacgtagcggttgttacgggtcgtttttataaataatcgggtttaggagaaattttagcgagttagagtcgcgtacgggattgggaaggggatttattcgagggtttagttattagtttttttattaatagcggttatttcggtagcggcggtagtagtagtagcgacgtagcggcgatagtttagagtagggaggtcgcgttatttgcgggtcggtcggagcgggtagttttaggtttttttttcgggtattcgcgtttatgtaacgtttggtggtttgggatttagtatgtttt

SEQ ID NO: 34442 - DNA, 687 bp, Artificial Sequence
  chemically treated genomic DNA (Homo sapiens) CpG-island No: 34442
aaaacatactaaatcccaaaccaccaaacgttacataaacgcgaatacccgaaaaaaaaacctaaaactacccgctccgaccgacccgcaaataacgcgacctccctactctaaactatcgccgctacgtcgctactactactaccgccgctaccgaaataaccgctattaataaaaaaactaataactaaaccctcgaataaatccccttcccaatcccgtacgcgactctaactcgctaaaatttctcctaaacccgattatttataaaaacgacccgtaacaaccgctacgtcacgccgacccctcccgccgcgccgccgaaacgcgaaaaacacgaccgcgaccgcccgaaacccccgaaaaaacgacgacaaaacgcaacgaaaaaaccgaacacccgaaacgcgttttcgaaaaacccccgaaacgcaaaaacgacctcacgccccctacccacccccgcccgaccgccccgaaattaaaaacgaaaaaaaacgatacgaccccgcccccgaaccgcccctctaaactaaaaactatcctaaaaaacgaaaaaatcgaaaaaaaaaacgacctaatcgccttccccccgaaacgcgaccccgacccgccccctactaaaaaaaacgaaaatttcaaaaaaaccgaacaaaaccccgacgaccgaccaaaatcgactccccg

SEQ ID NO: 34443 - DNA, 687 bp, Artificial Sequence
  chemically treated genomic DNA (Homo sapiens) CpG-island No: 34443
gagatatgttgggttttaggttattaggcgttgtatgaacgcgggtgttcggggagggggtttggggttgttcgtttcggtcggttcgtaggtggcgcggtttttttgttttgagttgtcgtcgttgcgtcgttgttgttgttgtcgtcgttgtcggggtggtcgttattagtgagggggttggtggttggattttcgggtgggttttttttttagtttcgtgcgcggttttgattcgttaaagttttttttgagttcggttatttataagggcggttcgtagtaatcgttgcgttacgtcggtttttttcgtcgcgtcgtcgggacgcgaaggatacggtcgcggtcgttcgagattttcgggaggacggcggtagggcgtagcggagggatcgggtattcggagcgcgttttcggggggttttcgggacgtaggggcggttttacgttttttgtttattttcgttcggtcgtttcgggattgggagcgagagggggcggtgcgatttcgttttcggatcgtttttttgggttggaggttgttttggaaggcgggggaatcggaggagggggcgatttgatcgtttttttttcgagacgcggtttcggttcgttttttgttggaggaggcggaggttttaggagggtcgagtagagtttcgacggtcgattagggtcggtttttcg

SEQ ID NO: 34444 - DNA, 687 bp, Artificial Sequence
  chemically treated genomic DNA (Homo sapiens) CpG-island No: 34444
cgaaaaaccgaccctaatcgaccgtcgaaactctactcgaccctcctaaaacctccgcctcctccaacaaaaaacgaaccgaaaccgcgtctcgaaaaaaaaacgatcaaatcgccccctcctccgattcccccgccttccaaaacaacctccaacccaaaaaaacgatccgaaaacgaaatcgcaccgccccctctcgctcccaatcccgaaacgaccgaacgaaaataaacaaaaaacgtaaaaccgcccctacgtcccgaaaaccccccgaaaacgcgctccgaatacccgatccctccgctacgccctaccgccgtcctcccgaaaatctcgaacgaccgcgaccgtatccttcgcgtcccgacgacgcgacgaaaaaaaccgacgtaacgcaacgattactacgaaccgcccttataaataaccgaactcaaaaaaaactttaacgaatcaaaaccgcgcacgaaactaaaaaaaaaacccacccgaaaatccaaccaccaaccccctcactaataacgaccaccccgacaacgacgacaacaacaacaacgacgcaacgacgacaactcaaaacaaaaaaaccgcgccacctacgaaccgaccgaaacgaacaaccccaaaccccctccccgaacacccgcgttcatacaacgcctaataacctaaaacccaacatatctc

SEQ ID NO: 34445 - DNA, 1168 bp, Artificial Sequence
  chemically treated genomic DNA (Homo sapiens) CpG-island No: 34445
gtcgtcgtcgtcgtttgtttttaaatttatggaagtggttaatttttattacgaggcggattgtttggttgttgcgtacggcggtaaggcggttttcgcggcgtttttcgcggttagattcgggtcgcgttttttcgtcggcgagttgggtagtatcggcgattacgagcgcgttatcgattttagttcgtatttggagtcgttgggcgcgtcgtaggtttcggcgttcgttacggttacggatattttcgaggcggtttcgttcgcgttcgttttcgcgttcgtttttttcgggtagtattacgatttttttttcgatttttttttcgacgattacgggggtaagaattgtaagaagtcggtcgagtacggttacgtgagtttggggcgtttgggggtcgttaagggcgcgttgtatttcggttgtttcgcgtttttgtatttatcgttttcgtcgtcgtcgtcgttcgtcgagtttaaggcggagtcgggtttcgagttcgcggattgtaagcggaaggaggaggtcggggcgtcgggcggcggcgtaggtatggcggcgggtttttcgtacgcgttgcgcgtttatttcggttattaggcggtgtcgagcggtagtagcgggagtttttttacgtttttttcgtttagttcgttcggtacgtcgagtttcgttgacgttaaggcgttttcgatcgtttgttacgcgggggtcgcgtcggcgttttcgtaggttaagagtaaggttaagaagatcgtggataagtatagcgacgagtataagattcggcgcgagcgtaataatatcgtcgtgcgtaagagtcgcgataaggttaagatgcgtaatttggagacgtagtataaggttttggagtttacggtcgagaacgagcggttgtagaagaaggtggagtagttgtcgcgcgagtttagtattttgcggaatttgtttaagtagttgttcgagtttttgttcgtttttttcggttattgttagcgcggttttcgcgcgcgtttttttgtcggtcggggttgagatttcggggagcgttcgcgttcgcgttttcgttttcgttttcggcggcgtcggtaaaattttggtattggggtatttggtagcgcggggagttcgtcggtaattttaatattttattatatatatatattt

SEQ ID NO: 34446 - DNA, 1168 bp, Artificial Sequence
  chemically treated genomic DNA (Homo sapiens) CpG-island No: 34446
aaatatatatatataataaaatattaaaattaccgacgaactccccgcgctaccaaataccccaataccaaaattttaccgacgccgccgaaaacgaaaacgaaaacgcgaacgcgaacgctccccgaaatctcaaccccgaccgacaaaaaaacgcgcgcgaaaaccgcgctaacaataaccgaaaaaaacgaacaaaaactcgaacaactacttaaacaaattccgcaaaatactaaactcgcgcgacaactactccaccttcttctacaaccgctcgttctcgaccgtaaactccaaaaccttatactacgtctccaaattacgcatcttaaccttatcgcgactcttacgcacgacgatattattacgctcgcgccgaatcttatactcgtcgctatacttatccacgatcttcttaaccttactcttaacctacgaaaacgccgacgcgacccccgcgtaacaaacgatcgaaaacgccttaacgtcaacgaaactcgacgtaccgaacgaactaaacgaaaaaaacgtaaaaaaactcccgctactaccgctcgacaccgcctaataaccgaaataaacgcgcaacgcgtacgaaaaacccgccgccatacctacgccgccgcccgacgccccgacctcctccttccgcttacaatccgcgaactcgaaacccgactccgccttaaactcgacgaacgacgacgacgacgaaaacgataaatacaaaaacgcgaaacaaccgaaatacaacgcgcccttaacgacccccaaacgccccaaactcacgtaaccgtactcgaccgacttcttacaattcttacccccgtaatcgtcgaaaaaaaaatcgaaaaaaaaatcgtaatactacccgaaaaaaacgaacgcgaaaacgaacgcgaacgaaaccgcctcgaaaatatccgtaaccgtaacgaacgccgaaacctacgacgcgcccaacgactccaaatacgaactaaaatcgataacgcgctcgtaatcgccgatactacccaactcgccgacgaaaaaacgcgacccgaatctaaccgcgaaaaacgccgcgaaaaccgccttaccgccgtacgcaacaaccaaacaatccgcctcgtaataaaaattaaccacttccataaatttaaaaacaaacgacgacgacgac

SEQ ID NO: 34447 - DNA, 1168 bp, Artificial Sequence
  chemically treated genomic DNA (Homo sapiens) CpG-island No: 34447
agatatatatatataataaaatattaaaattatcgacgggtttttcgcgttgttaagtgttttagtgttaaagttttgtcggcgtcgtcgggggcgggggcgagggcgcgggcgcgggcgtttttcggagttttagtttcggtcggtagggggacgcgcgcgggggtcgcgttagtagtggtcggaggaggcgagtaggggttcgggtagttgtttgaataagtttcgtagggtgttgagttcgcgcgatagttgttttatttttttttgtagtcgttcgttttcggtcgtgagttttaggattttgtgttgcgtttttaggttgcgtattttggttttgtcgcggtttttgcgtacggcgatgttgttgcgttcgcgtcggattttgtattcgtcgttgtgtttgtttacggtttttttggttttgtttttgatttgcgagggcgtcggcgcggttttcgcgtagtaggcggtcgggggcgttttggcgttagcggggttcggcgtgtcgggcgggttggacgaggaggacgtggagaggttttcgttgttgtcgttcggtatcgtttggtagtcgaggtaagcgcgtagcgcgtacgggaagttcgtcgttatgtttgcgtcgtcgttcggcgtttcggtttttttttttcgtttgtagttcgcgggttcgaagttcggtttcgttttgagttcggcgggcggcggcggcggcgggggcggtgggtgtaggggcgcgaagtagtcggggtgtagcgcgtttttggcggtttttaggcgttttaggtttacgtagtcgtattcggtcggttttttgtagtttttgttttcgtagtcgtcggagaagaggtcggagaggaagtcgtggtgttgttcggaggaggcgggcgcgggggcgggcgcgggcggagtcgtttcgaaggtgttcgtggtcgtggcgggcgtcggggtttgcggcgcgtttagcggttttaggtacgggttgaagtcgatggcgcgttcgtggtcgtcgatgttgtttagttcgtcggcgggggggcgcggttcgggtttggtcgcggggggcgtcgcgggggtcgttttgtcgtcgtacgtagtagttaagtagttcgtttcgtagtagaagttggttatttttatggatttaaaggtaggcggcggcggcggt

SEQ ID NO: 34448 - DNA, 1168 bp, Artificial Sequence
  chemically treated genomic DNA (Homo sapiens) CpG-island No: 34448
accgccgccgccgcctacctttaaatccataaaaataaccaacttctactacgaaacgaactacttaactactacgtacgacgacaaaacgacccccgcgacgccccccgcgaccaaacccgaaccgcgcccccccgccgacgaactaaacaacatcgacgaccacgaacgcgccatcgacttcaacccgtacctaaaaccgctaaacgcgccgcaaaccccgacgcccgccacgaccacgaacaccttcgaaacgactccgcccgcgcccgcccccgcgcccgcctcctccgaacaacaccacgacttcctctccgacctcttctccgacgactacgaaaacaaaaactacaaaaaaccgaccgaatacgactacgtaaacctaaaacgcctaaaaaccgccaaaaacgcgctacaccccgactacttcgcgcccctacacccaccgcccccgccgccgccgccgcccgccgaactcaaaacgaaaccgaacttcgaacccgcgaactacaaacgaaaaaaaaaaaccgaaacgccgaacgacgacgcaaacataacgacgaacttcccgtacgcgctacgcgcttacctcgactaccaaacgataccgaacgacaacaacgaaaacctctccacgtcctcctcgtccaacccgcccgacacgccgaaccccgctaacgccaaaacgcccccgaccgcctactacgcgaaaaccgcgccgacgccctcgcaaatcaaaaacaaaaccaaaaaaaccgtaaacaaacacaacgacgaatacaaaatccgacgcgaacgcaacaacatcgccgtacgcaaaaaccgcgacaaaaccaaaatacgcaacctaaaaacgcaacacaaaatcctaaaactcacgaccgaaaacgaacgactacaaaaaaaaataaaacaactatcgcgcgaactcaacaccctacgaaacttattcaaacaactacccgaacccctactcgcctcctccgaccactactaacgcgacccccgcgcgcgtccccctaccgaccgaaactaaaactccgaaaaacgcccgcgcccgcgccctcgcccccgcccccgacgacgccgacaaaactttaacactaaaacacttaacaacgcgaaaaacccgtcgataattttaatattttattatatatatatatct

SEQ ID NO: 34449 - DNA, 664 bp, Artificial Sequence
  chemically treated genomic DNA (Homo sapiens) CpG-island No: 34449
tagttcggcgttttgttttcgcgttttttgtatatagtgggcgtttaacgttgtcggtttaagaaatgtttatttttgggttttgtttcggtttattgtatgggttcgtgaatcgaagtttagttgggcggcgacgcgtcgcgagtttttagtgggttggagtcgggagttttgtcggggttgagttgggaaggcgggtacgcgttttcgttttaagttttcgcgtttagttgcgtttagttgcgttttagttttcggttcgcggcggttggttgcggtttagcgacgttcgattggtttgcgcggtttcggcgcgagtttcgattggttgtgacgcgcggtcgggcgaggatttcgttcgcgtcgtcgtcgcgttcggcgttgggcggttattgggcggcgtgatttcgtcgcggtttcgcggttttgtcgtcgtcgtcgttagtagagcgtatcgggtcgatcgggcgagtggttatggcgggcgtcgaggattggtcgggttagtagttggagttggacgaggacgaggcgttttgttgtcgttggggcgcgtagtacgtcggggttcgcgagttggttgcgttttattcgttaggtaagatttttgggtttttttttaggtttgcggttattagtttcggttgcggatagcgattttaga

SEQ ID NO: 34450 - DNA, 664 bp, Artificial Sequence
  chemically treated genomic DNA (Homo sapiens) CpG-island No: 34450
tctaaaatcgctatccgcaaccgaaactaataaccgcaaacctaaaaaaaaacccaaaaatcttacctaacgaataaaacgcaaccaactcgcgaaccccgacgtactacgcgccccaacgacaacaaaacgcctcgtcctcgtccaactccaactactaacccgaccaatcctcgacgcccgccataaccactcgcccgatcgacccgatacgctctactaacgacgacgacgacaaaaccgcgaaaccgcgacgaaatcacgccgcccaataaccgcccaacgccgaacgcgacgacgacgcgaacgaaatcctcgcccgaccgcgcgtcacaaccaatcgaaactcgcgccgaaaccgcgcaaaccaatcgaacgtcgctaaaccgcaaccaaccgccgcgaaccgaaaactaaaacgcaactaaacgcaactaaacgcgaaaacttaaaacgaaaacgcgtacccgccttcccaactcaaccccgacaaaactcccgactccaacccactaaaaactcgcgacgcgtcgccgcccaactaaacttcgattcacgaacccatacaataaaccgaaacaaaacccaaaaataaacatttcttaaaccgacaacgttaaacgcccactatatacaaaaaacgcgaaaacaaaacgccgaacta

SEQ ID NO: 34451 - DNA, 664 bp, Artificial Sequence
  chemically treated genomic DNA (Homo sapiens) CpG-island No: 34451
tttggggtcgttgttcgtagtcggggttggtgatcgtaggtttggaggggggtttagaggttttatttggcgagtagagcgtagttagttcgcgggtttcggcgtgttgcgcgttttagcggtaataagacgtttcgttttcgtttagttttagttgttggttcggttagttttcggcgttcgttatggttattcgttcgatcggttcggtgcgttttgttggcggcggcggcggtagggtcgcggaatcgcggcgagattacgtcgtttaatgatcgtttagcgtcgggcgcggcggcggcgcgggcggggttttcgttcggtcgcgcgttatagttaatcggggttcgcgtcggagtcgcgtaggttaatcggacgtcgttgagtcgtagttaatcgtcgcgagtcggaggttgggacgtagttggacgtagttgggcgcggaagtttggggcggaggcgcgtgttcgtttttttagtttagtttcggtagggttttcggttttagtttattgggagttcgcggcgcgtcgtcgtttagttaggtttcggtttacgggtttatgtaatgggtcgaggtagggtttagaaatgggtattttttgagtcggtagcgttaagcgtttattgtgtgtaaggaacgcgagggtagggcgtcgggttg

SEQ ID NO: 34452 - DNA, 664 bp, Artificial Sequence
  chemically treated genomic DNA (Homo sapiens) CpG-island No: 34452
caacccgacgccctaccctcgcgttccttacacacaataaacgcttaacgctaccgactcaaaaaatacccatttctaaaccctacctcgacccattacataaacccgtaaaccgaaacctaactaaacgacgacgcgccgcgaactcccaataaactaaaaccgaaaaccctaccgaaactaaactaaaaaaacgaacacgcgcctccgccccaaacttccgcgcccaactacgtccaactacgtcccaacctccgactcgcgacgattaactacgactcaacgacgtccgattaacctacgcgactccgacgcgaaccccgattaactataacgcgcgaccgaacgaaaaccccgcccgcgccgccgccgcgcccgacgctaaacgatcattaaacgacgtaatctcgccgcgattccgcgaccctaccgccgccgccgccaacaaaacgcaccgaaccgatcgaacgaataaccataacgaacgccgaaaactaaccgaaccaacaactaaaactaaacgaaaacgaaacgtcttattaccgctaaaacgcgcaacacgccgaaacccgcgaactaactacgctctactcgccaaataaaacctctaaacccccctccaaacctacgatcaccaaccccgactacgaacaacgaccccaaa

SEQ ID NO: 34453 - DNA, 625 bp, Artificial Sequence
  chemically treated genomic DNA (Homo sapiens) CpG-island No: 34453
  misc_feature (37)..(38): n is either a, c, g or t
gggcggtgggggttagggtgggggcggggggttaggnntgttgtgtcgcggcgtttttcgttcgagttttcgtttcgcgttttttcggtcggtgtcgttttttttcggtgttcgtgtgtatatacgcgtatattcgcgcgtatttcggcgtgtacgcgtcgtttttgggtatttgtagttcgcgtacgtgtgggcgtacgtttttttttgttgttttcggtatttcgttattttttttcgaggcggtgttgcgttcgtttcgtttgcggcggggatttttaggcggtagtttcgggcgcggtataagtttttttgtatcgtagttgggatttgggtattgtcggtttgggtgtttcgcggataggtgttcgtcggcgggcgtttaggttgtagttgtcgttgtgttttcgcgtttcgtgtatttttatttttttttttttcgtttttgtttttttagttttcgaatggtaaagcgtatttattatcgggtgtttattttttgtttaggtttttttttttcgttgtcgtagcgtgatttttgaaatttggaattttaggggagttttaaaacgagcgtgttgttcgtgaggataagtgtttttagagaagtttgaatgggttgttt

SEQ ID NO: 34454 - DNA, 625 bp, Artificial Sequence
  chemically treated genomic DNA (Homo sapiens) CpG-island No: 34454
  misc_feature (588)..(589): n is either a, c, g or t
aaacaacccattcaaacttctctaaaaacacttatcctcacgaacaacacgctcgttttaaaactcccctaaaattccaaatttcaaaaatcacgctacgacaacgaaaaaaaaaaacctaaacaaaaaataaacacccgataataaatacgctttaccattcgaaaactaaaaaaacaaaaacgaaaaaaaaaaaaataaaaatacacgaaacgcgaaaacacaacgacaactacaacctaaacgcccgccgacgaacacctatccgcgaaacacccaaaccgacaatacccaaatcccaactacgatacaaaaaaacttataccgcgcccgaaactaccgcctaaaaatccccgccgcaaacgaaacgaacgcaacaccgcctcgaaaaaaaataacgaaataccgaaaacaacaaaaaaaaacgtacgcccacacgtacgcgaactacaaatacccaaaaacgacgcgtacacgccgaaatacgcgcgaatatacgcgtatatacacacgaacaccgaaaaaaaacgacaccgaccgaaaaaacgcgaaacgaaaactcgaacgaaaaacgccgcgacacaacanncctaaccccccgcccccaccctaacccccaccgccc

SEQ ID NO: 34455 - DNA, 625 bp, Artificial Sequence
  chemically treated genomic DNA (Homo sapiens) CpG-island No: 34455
  misc_feature (588)..(589): n is either a, c, g or t
gaatagtttatttagatttttttgaaggtatttatttttacggataatacgttcgttttagggtttttttagagttttaggttttaaaagttacgttgcggtagcgaaggaaggaaatttagataaggggtaaatattcgatggtgggtacgttttgttattcgggggttggggggataggggcgagaaggaaagaaatgagggtgtacggagcgcggaggtatagcggtagttgtagtttgagcgttcgtcgacgggtatttgttcgcgggatatttaggtcggtagtgtttaagttttagttgcggtgtagaggaatttgtgtcgcgttcggggttgtcgtttgggggttttcgtcgtaagcgaggcgaacgtagtatcgtttcgggagaaggtgacggggtgtcgagggtaatagagaggggcgtgcgtttatacgtgcgcgagttgtaggtgtttaggggcggcgcgtgtacgtcggagtgcgcgcgagtgtgcgcgtgtgtatatacggatatcggaaggaggcggtatcggtcgggagggcgcgaggcgggagttcgggcggagggcgtcgcggtataatanntttgatttttcgtttttattttaatttttatcgttt

SEQ ID NO: 34456 - DNA, 625 bp, Artificial Sequence
  chemically treated genomic DNA (Homo sapiens) CpG-island No: 34456
  misc_feature (37)..(38): n is either a, c, g or t
aaacgataaaaattaaaataaaaacgaaaaatcaaanntattataccgcgacgccctccgcccgaactcccgcctcgcgccctcccgaccgataccgcctccttccgatatccgtatatacacacgcgcacactcgcgcgcactccgacgtacacgcgccgcccctaaacacctacaactcgcgcacgtataaacgcacgcccctctctattaccctcgacaccccgtcaccttctcccgaaacgatactacgttcgcctcgcttacgacgaaaacccccaaacgacaaccccgaacgcgacacaaattcctctacaccgcaactaaaacttaaacactaccgacctaaatatcccgcgaacaaatacccgtcgacgaacgctcaaactacaactaccgctatacctccgcgctccgtacaccctcatttctttccttctcgcccctatccccccaacccccgaataacaaaacgtacccaccatcgaatatttaccccttatctaaatttccttccttcgctaccgcaacgtaacttttaaaacctaaaactctaaaaaaaccctaaaacgaacgtattatccgtaaaaataaataccttcaaaaaaatctaaataaactattc

SEQ ID NO: 34457 - DNA, 637 bp, Artificial Sequence
  chemically treated genomic DNA (Homo sapiens) CpG-island No: 34457
tcggtttcgtcgttttcgtttttatttatcggggtcgttcggggtcggcggattttatattgtcggttttgcgttgtttagcggagttcgagggtcggtttgttgggttgagggcggatagtatgtagcgttggttgagttgtcgagttgaggcgtgggcggcggcggcggcgcgtgggcggcggcggcgcgtgcgtttacgcgaggtttttttggtcggtaggtgggcgcgcgttgcgtttcgtttcgcgttttcgcgtttcgaggtattggtttttcgaattagttaggggtatcggcgtgtttacggtggggggacgcggaagtggggttttatgggttcggatgagtagtgggtttaggtgttagttggcgttttttacgagcgttttggattgcggcgcggggattgaaatagtcggttaattgtagtaagaatagtgttcgttcggagggggcgtagggttgaggtcgttaatattttgtttcgtttttgttcgtaagggtgagaatgatttttttagcgattttcgttttcgtgttttttcgttaagttgtttattttaggtttttaggtttacgacgttggtattcggatattttttgtagtattttataggttttcggaatgtttaaa

SEQ ID NO: 34458 - DNA, 637 bp, Artificial Sequence
  chemically treated genomic DNA (Homo sapiens) CpG-island No: 34458
tttaaacattccgaaaacctataaaatactacaaaaaatatccgaataccaacgtcgtaaacctaaaaacctaaaataaacaacttaacgaaaaaacacgaaaacgaaaatcgctaaaaaaatcattctcacccttacgaacaaaaacgaaacaaaatattaacgacctcaaccctacgccccctccgaacgaacactattcttactacaattaaccgactatttcaatccccgcgccgcaatccaaaacgctcgtaaaaaacgccaactaacacctaaacccactactcatccgaacccataaaaccccacttccgcgtccccccaccgtaaacacgccgatacccctaactaattcgaaaaaccaatacctcgaaacgcgaaaacgcgaaacgaaacgcaacgcgcgcccacctaccgaccaaaaaaacctcgcgtaaacgcacgcgccgccgccgcccacgcgccgccgccgccgcccacgcctcaactcgacaactcaaccaacgctacatactatccgccctcaacccaacaaaccgaccctcgaactccgctaaacaacgcaaaaccgacaatataaaatccgccgaccccgaacgaccccgataaataaaaacgaaaacgacgaaaccga

SEQ ID NO: 34459 - DNA, 637 bp, Artificial Sequence
  chemically treated genomic DNA (Homo sapiens) CpG-island No: 34459
tttggatatttcggaggtttgtggagtattgtagagagtgttcgaatgttagcgtcgtgagtttggaggtttagggtgggtagtttggcgagagagtacgagggcgaaagtcgttggaagagttatttttatttttacgggtaggagcggaataaagtgttagcggttttagttttgcgtttttttcgggcggatattgtttttgttgtagttggtcggttgttttagttttcgcgtcgtagtttagggcgttcgtagagggcgttaattggtatttgggtttattatttattcgagtttatggaattttattttcgcgtttttttatcgtaagtacgtcggtgtttttagttgattcgggaggttagtatttcggggcgcgggggcgcggggcggaacgtagcgcgcgtttatttgtcggttaagaaagtttcgcgtgggcgtacgcgtcgtcgtcgtttacgcgtcgtcgtcgtcgtttacgttttaattcggtagtttagttagcgttgtatgttgttcgtttttagtttagtaagtcggttttcgagtttcgttgggtagcgtagggtcggtagtatagagttcgtcggtttcggacggtttcggtaagtggggacgggggcggcgggatcgg

SEQ ID NO: 34460 - DNA, 637 bp, Artificial Sequence
  chemically treated genomic DNA (Homo sapiens) CpG-island No: 34460
ccgatcccgccgcccccgtccccacttaccgaaaccgtccgaaaccgacgaactctatactaccgaccctacgctacccaacgaaactcgaaaaccgacttactaaactaaaaacgaacaacatacaacgctaactaaactaccgaattaaaacgtaaacgacgacgacgacgcgtaaacgacgacgacgcgtacgcccacgcgaaactttcttaaccgacaaataaacgcgcgctacgttccgccccgcgcccccgcgccccgaaatactaacctcccgaatcaactaaaaacaccgacgtacttacgataaaaaaacgcgaaaataaaattccataaactcgaataaataataaacccaaataccaattaacgccctctacgaacgccctaaactacgacgcgaaaactaaaacaaccgaccaactacaacaaaaacaatatccgcccgaaaaaaacgcaaaactaaaaccgctaacactttattccgctcctacccgtaaaaataaaaataactcttccaacgactttcgccctcgtactctctcgccaaactacccaccctaaacctccaaactcacgacgctaacattcgaacactctctacaatactccacaaacctccgaaatatccaaa

SEQ ID NO: 34461 - DNA, 525 bp, Artificial Sequence
  chemically treated genomic DNA (Homo sapiens) CpG-island No: 34461
cgcggtttttggtacgagttcgtgtatcgcggtcgtttcgtttcggtgggagagagggacggaggaagttgtcggtataacgggaggagagcgttaggcggagttggggcgtttttttcgttcgttttttgattcgcgttgttgtcggtcgtttttcgcgtttagtgttcgggacgcgtttgaatttgtcgttttcgtgtttggggcggcgtcgcgcggtttcgagcgttttagaaagttgcggcgcgagttcgcggggtcgatttcggagacgtagttggggtcgggcgcggtttggcgggagggtttgtagcgtcgagggaggttgttagtgcgtgaggaagagagttagagattggataggggagatagagtagcgtcggagtcgcgtaggggacgggagtgagagcgggagtgagagtaggaacgacgtagagcggtcgtcgttttgttcgggttttagggcgtttggttgaagagagtatggttttagtggtttgggtcgtttttaaggtgttgttgttt

SEQ ID NO: 34462 - DNA, 525 bp, Artificial Sequence
  chemically treated genomic DNA (Homo sapiens) CpG-island No: 34462
aaacaacaacaccttaaaaacgacccaaaccactaaaaccatactctcttcaaccaaacgccctaaaacccgaacaaaacgacgaccgctctacgtcgttcctactctcactcccgctctcactcccgtcccctacgcgactccgacgctactctatctcccctatccaatctctaactctcttcctcacgcactaacaacctccctcgacgctacaaaccctcccgccaaaccgcgcccgaccccaactacgtctccgaaatcgaccccgcgaactcgcgccgcaactttctaaaacgctcgaaaccgcgcgacgccgccccaaacacgaaaacgacaaattcaaacgcgtcccgaacactaaacgcgaaaaacgaccgacaacaacgcgaatcaaaaaacgaacgaaaaaaacgccccaactccgcctaacgctctcctcccgttataccgacaacttcctccgtccctctctcccaccgaaacgaaacgaccgcgatacacgaactcgtaccaaaaaccgcg

SEQ ID NO: 34463 - DNA, 525 bp, Artificial Sequence
  chemically treated genomic DNA (Homo sapiens) CpG-island No: 34463
aagtagtagtattttgaggacggtttaggttattgaagttatgttttttttagttaggcgttttgagattcgggtaaggcgacggtcgttttgcgtcgtttttgtttttattttcgtttttattttcgttttttgcgcggtttcgacgttgttttgttttttttgtttagtttttagtttttttttttacgtattggtagtttttttcggcgttgtagattttttcgttaagtcgcgttcggttttagttgcgttttcgaggtcggtttcgcggattcgcgtcgtagttttttggagcgttcggggtcgcgcggcgtcgttttaggtacggaggcggtaggtttaggcgcgtttcggatattaggcgcgggaggcggtcggtagtaacgcgagttaagaagcgagcgggagggacgttttagtttcgtttggcgtttttttttcgttatatcggtagtttttttcgttttttttttttatcggggcggggcggtcgcggtgtacggattcgtgttaaagatcgcg

SEQ ID NO: 34464 - DNA, 525 bp, Artificial Sequence
  chemically treated genomic DNA (Homo sapiens) CpG-island No: 34464
cgcgatctttaacacgaatccgtacaccgcgaccgccccgccccgataaaaaaaaaaaacgaaaaaaactaccgatataacgaaaaaaaaacgccaaacgaaactaaaacgtccctcccgctcgcttcttaactcgcgttactaccgaccgcctcccgcgcctaatatccgaaacgcgcctaaacctaccgcctccgtacctaaaacgacgccgcgcgaccccgaacgctccaaaaaactacgacgcgaatccgcgaaaccgacctcgaaaacgcaactaaaaccgaacgcgacttaacgaaaaaatctacaacgccgaaaaaaactaccaatacgtaaaaaaaaaaactaaaaactaaacaaaaaaaacaaaacaacgtcgaaaccgcgcaaaaaacgaaaataaaaacgaaaataaaaacaaaaacgacgcaaaacgaccgtcgccttacccgaatctcaaaacgcctaactaaaaaaaacataacttcaataacctaaaccgtcctcaaaatactactactt

SEQ ID NO: 34465 - DNA, 1242 bp, Artificial Sequence
  chemically treated genomic DNA (Homo sapiens) CpG-island No: 34465
gggtgtatatatcgttatcgttaatgattatttggttcgagtgtagttagagtagatgggtcgtgtgtatcggtttttaggattgtcgatttcggcgattttgtcggatatgtcgtcgatggttcgtaaggaggtttataaggtcgacgttatttatggtacgaataacgagtttggtttcgattatttgcgtgataatatggttagttcgtttagcgagtgcgtgtagcgcggttattattacgcgattgttgacgaggttgattttattttcgttgacgaagttcgtatttcgttgattatttttggatttgtcgaggagaataagtagtggtattcggaattcgttaagatcgtttcgcggttcgaacgcgacgttgattacgaggtggacgagaagaaacgtatcgtttttgtatttgggtacggaattatcgtcgttgaggagaggttcggtatcgagaatttttacgagttagcgaatatttcgtttatcgggtattttaataacgttattaaggttaaggagtttttttatcgcgataaggattacgtcgtcgtcggtggtgaagtttttatcgttgacgagtatatcggtcggatttttgttggtcgtcgttataacgaaggtttttattaagtttttgaggttaaagaatacgtcgagattaaggacgagtattagattttcgttacgattattttgtagaattattttcgtatgtacgataagttcgtcggtatgacgggtatagttaagatcgaggaaagcgagttttagaagatttacggtttgggagttatttcgatttcgacgaatcgttcgatgattcgtaaagattagaaggattttatttatcgtatcgaggatgttaagttcgacgttattatcgtcgatgttgttgagcgttacgaggcgggttagtcgatttttatcggtattgcgtcggtggttaagtcggagttgtttttcgaaaagtttaagcgtgtcggtgtttcgtataaggtgttgaacgttaagtattatgagtttgaagtcgttattgtcgttttggttggtcgtaagggggtcgtgacggtgtcgacgaatatggttggtcgtggtatcgatattattttcggcggtaatttcgagttttttatcgagtttgatttgcgggaaaagggtttggattttttcgaggattaggacgcgtattagattgcgtggaataatattttggttaagtacgaggaatagtt

SEQ ID NO: 34466 - DNA, 1242 bp, Artificial Sequence
  chemically treated genomic DNA (Homo sapiens) CpG-island No: 34466
aactattcctcgtacttaaccaaaatattattccacgcaatctaatacgcgtcctaatcctcgaaaaaatccaaacccttttcccgcaaatcaaactcgataaaaaactcgaaattaccgccgaaaataatatcgataccacgaccaaccatattcgtcgacaccgtcacgacccccttacgaccaaccaaaacgacaataacgacttcaaactcataatacttaacgttcaacaccttatacgaaacaccgacacgcttaaacttttcgaaaaacaactccgacttaaccaccgacgcaataccgataaaaatcgactaacccgcctcgtaacgctcaacaacatcgacgataataacgtcgaacttaacatcctcgatacgataaataaaatccttctaatctttacgaatcatcgaacgattcgtcgaaatcgaaataactcccaaaccgtaaatcttctaaaactcgctttcctcgatcttaactatacccgtcataccgacgaacttatcgtacatacgaaaataattctacaaaataatcgtaacgaaaatctaatactcgtccttaatctcgacgtattctttaacctcaaaaacttaataaaaaccttcgttataacgacgaccaacaaaaatccgaccgatatactcgtcaacgataaaaacttcaccaccgacgacgacgtaatccttatcgcgataaaaaaactccttaaccttaataacgttattaaaatacccgataaacgaaatattcgctaactcgtaaaaattctcgataccgaacctctcctcaacgacgataattccgtacccaaatacaaaaacgatacgtttcttctcgtccacctcgtaatcaacgtcgcgttcgaaccgcgaaacgatcttaacgaattccgaataccactacttattctcctcgacaaatccaaaaataatcaacgaaatacgaacttcgtcaacgaaaataaaatcaacctcgtcaacaatcgcgtaataataaccgcgctacacgcactcgctaaacgaactaaccatattatcacgcaaataatcgaaaccaaactcgttattcgtaccataaataacgtcgaccttataaacctccttacgaaccatcgacgacatatccgacaaaatcgccgaaatcgacaatcctaaaaaccgatacacacgacccatctactctaactacactcgaaccaaataatcattaacgataacgatatatacaccc

SEQ ID NO: 34467 - DNA, 1242 bp, Artificial Sequence
  chemically treated genomic DNA (Homo sapiens) CpG-island No: 34467
gattgtttttcgtatttggttagggtgttgttttacgtagtttggtacgcgttttggttttcgagggggtttaagtttttttttcgtaggttaagttcggtgaggaattcggggttgtcgtcgaggataatgtcggtattacggttagttatattcgtcgatatcgttacggtttttttacggttagttagggcgataatagcggttttagatttatggtgtttggcgtttagtattttgtgcggaatatcggtacgtttgagtttttcggaaagtagtttcgatttggttatcgacgtagtgtcgataaggatcggttggttcgtttcgtgacgtttaataatatcggcgataatggcgtcgaatttggtattttcggtgcggtaaatgaggtttttttgatttttgcggattatcggacggttcgtcgggatcgggatgatttttagatcgtaaattttttggaattcgtttttttcggttttagttgtattcgttatgtcggcgagtttgtcgtatatgcggaagtaattttgtagggtgatcgtggcgagagtttgatattcgtttttgatttcgacgtgttttttggttttaggggtttggtggaggttttcgttgtaacgacggttagtaagagttcggtcggtgtgttcgttaacgataaggattttattatcgacgacgacgtagtttttgtcgcggtggaaaagttttttggttttgatggcgttgttgaggtattcgataagcggagtgttcgttgattcgtaaaggttttcgatatcgagtttttttttaacgacggtaatttcgtgtttaagtatagagacggtgcgttttttttcgtttatttcgtagttaacgtcgcgttcgagtcgcgagacgattttggcgaatttcgggtattattgtttgtttttttcggtaggtttagagatgattagcggggtacgagtttcgttaacgagaatggagttaatttcgttaataatcgcgtaatggtgatcgcgttgtacgtattcgttgagcgaattggttatattgttacgtaggtagtcgaagttaaattcgttgttcgtgttataggtgacgtcggttttataggtttttttgcgggttatcggcggtatgttcgataggatcgtcgagatcgataattttaggaatcggtgtatacggtttatttgttttgattgtattcgggttaggtagttattgacggtgacgatatgtatattt

SEQ ID NO: 34468 - DNA, 1242 bp, Artificial Sequence
  chemically treated genomic DNA (Homo sapiens) CpG-island No: 34468
aaatatacatatcgtcaccgtcaataactacctaacccgaatacaatcaaaacaaataaaccgtatacaccgattcctaaaattatcgatctcgacgatcctatcgaacataccgccgataacccgcaaaaaaacctataaaaccgacgtcacctataacacgaacaacgaatttaacttcgactacctacgtaacaatataaccaattcgctcaacgaatacgtacaacgcgatcaccattacgcgattattaacgaaattaactccattctcgttaacgaaactcgtaccccgctaatcatctctaaacctaccgaaaaaaacaaacaataatacccgaaattcgccaaaatcgtctcgcgactcgaacgcgacgttaactacgaaataaacgaaaaaaaacgcaccgtctctatacttaaacacgaaattaccgtcgttaaaaaaaaactcgatatcgaaaacctttacgaatcaacgaacactccgcttatcgaatacctcaacaacgccatcaaaaccaaaaaacttttccaccgcgacaaaaactacgtcgtcgtcgataataaaatccttatcgttaacgaacacaccgaccgaactcttactaaccgtcgttacaacgaaaacctccaccaaacccctaaaaccaaaaaacacgtcgaaatcaaaaacgaatatcaaactctcgccacgatcaccctacaaaattacttccgcatatacgacaaactcgccgacataacgaatacaactaaaaccgaaaaaaacgaattccaaaaaatttacgatctaaaaatcatcccgatcccgacgaaccgtccgataatccgcaaaaatcaaaaaaacctcatttaccgcaccgaaaataccaaattcgacgccattatcgccgatattattaaacgtcacgaaacgaaccaaccgatccttatcgacactacgtcgataaccaaatcgaaactactttccgaaaaactcaaacgtaccgatattccgcacaaaatactaaacgccaaacaccataaatctaaaaccgctattatcgccctaactaaccgtaaaaaaaccgtaacgatatcgacgaatataactaaccgtaataccgacattatcctcgacgacaaccccgaattcctcaccgaacttaacctacgaaaaaaaaacttaaaccccctcgaaaaccaaaacgcgtaccaaactacgtaaaacaacaccctaaccaaatacgaaaaacaatc

SEQ ID NO: 34469 - DNA, 919 bp, Artificial Sequence
  chemically treated genomic DNA (Homo sapiens) CpG-island No: 34469
ggtttcgaatatcgaggcgtcgggcgagttcgaggggttacggaaggtgtaggtgtgttcgttttacggtgtcggtatcggtaagtaattcgtcgatcggtttttggtgtatttgatcgtcgataacgataagggttttttgcgtttacgttagagttaggtcgacgtcgtgggtagttatcgttatcgttgttttatgatcgcgtagtcgatttagggtttttaatatttgggtgattttaatcgggttaagttcggcggtgggtttattaaggagtagtagattcgggcgtatggttacggtatcggtaatcgcgatttttttgcgtttattataggatagttgatacgtggtacgtttagttagatgattggtttcgagtagttttagggattcggagattcggttacgtatttcgttaattttgaggtttatatttatggggtcgaaggagatattttggttgatatcggcgttaaagagttggtcgttagggttttgtagtataagttggacggttcgacggtgtttacgaagttgagcgcgttcgtagttgataacgatgtcgttttttttgacgtgatttttggcgggtttgagggaatcggataggtagcgtatgagggtcgttttatcggatttattagtttttaggatcgttacgcgaatttcggcgcgaaaggagatattaacgtcggttagtattataggacggttcgggtgggtggcgtataggtgttcggtcgatagtaggattttggtatttatttgaaaattttttcggtcgtcgtttaattgattatttataggatagcgatgacgatgacgacgatgattttgtatcgtatcgaatcggtgcgtttgatgggtaaggtggttagcgcggtttcgaagtcgcgattaacgagtttatcgttg

SEQ ID NO: 34470 - DNA, 919 bp, Artificial Sequence
  chemically treated genomic DNA (Homo sapiens) CpG-island No: 34470
caacgataaactcgttaatcgcgacttcgaaaccgcgctaaccaccttacccatcaaacgcaccgattcgatacgatacaaaatcatcgtcgtcatcgtcatcgctatcctataaataatcaattaaacgacgaccgaaaaaattttcaaataaataccaaaatcctactatcgaccgaacacctatacgccacccacccgaaccgtcctataatactaaccgacgttaatatctcctttcgcgccgaaattcgcgtaacgatcctaaaaactaataaatccgataaaacgaccctcatacgctacctatccgattccctcaaacccgccaaaaatcacgtcaaaaaaaacgacatcgttatcaactacgaacgcgctcaacttcgtaaacaccgtcgaaccgtccaacttatactacaaaaccctaacgaccaactctttaacgccgatatcaaccaaaatatctccttcgaccccataaatataaacctcaaaattaacgaaatacgtaaccgaatctccgaatccctaaaactactcgaaaccaatcatctaactaaacgtaccacgtatcaactatcctataataaacgcaaaaaaatcgcgattaccgataccgtaaccatacgcccgaatctactactccttaataaacccaccgccgaacttaacccgattaaaatcacccaaatattaaaaaccctaaatcgactacgcgatcataaaacaacgataacgataactacccacgacgtcgacctaactctaacgtaaacgcaaaaaacccttatcgttatcgacgatcaaatacaccaaaaaccgatcgacgaattacttaccgataccgacaccgtaaaacgaacacacctacaccttccgtaacccctcgaactcgcccgacgcctcgatattcgaaacc

SEQ ID NO: 34471 - DNA, 919 bp, Artificial Sequence
  chemically treated genomic DNA (Homo sapiens) CpG-island No: 34471
taacgatggattcgttaatcgcggtttcgaggtcgcgttggttattttgtttattaaacgtatcggttcggtgcgatataagattatcgtcgttatcgttatcgttgttttgtgggtgattagttggacgacgatcggaaggatttttagatgagtgttaaggttttgttgtcgatcgagtatttgtacgttatttattcgggtcgttttatggtattgatcgacgttaatgttttttttcgcgtcggggttcgcgtagcgattttgggagttaatggattcggtaagacgatttttatgcgttgtttgttcggtttttttaaattcgttaagggttacgttaagaggggcgatatcgttgttagttacgggcgcgtttaatttcgtgagtatcgtcgagtcgtttagtttgtgttgtaagattttgacgattagttttttagcgtcgatgttagttaggatgtttttttcggttttatgaatatgggttttaaagttgacgaggtgcgtgatcgggttttcgagtttttagaattgttcggggttagttatttggttgagcgtgttacgtattaattgttttatggtgagcgtaagagggtcgcggttgtcggtgtcgtggttatgcgttcggatttgttgttttttgatgagtttatcgtcggatttgattcggttggagttatttagatgttggaggttttggatcggttgcgcgattatggaataacggtggcgatggttatttacgacgtcgatttggttttggcgtgggcgtaggaggtttttgtcgttgtcgacggttaggtgtattaaggatcgatcggcgagttatttgtcgatgtcgatatcgtgggacgggtatatttgtatttttcgtggtttttcgagttcgttcggcgtttcggtgttcgggatt

SEQ ID NO: 34472 - DNA, 919 bp, Artificial Sequence
  chemically treated genomic DNA (Homo sapiens) CpG-island No: 34472
aatcccgaacaccgaaacgccgaacgaactcgaaaaaccacgaaaaatacaaatatacccgtcccacgatatcgacatcgacaaataactcgccgatcgatccttaatacacctaaccgtcgacaacgacaaaaacctcctacgcccacgccaaaaccaaatcgacgtcgtaaataaccatcgccaccgttattccataatcgcgcaaccgatccaaaacctccaacatctaaataactccaaccgaatcaaatccgacgataaactcatcaaaaaacaacaaatccgaacgcataaccacgacaccgacaaccgcgaccctcttacgctcaccataaaacaattaatacgtaacacgctcaaccaaataactaaccccgaacaattctaaaaactcgaaaacccgatcacgcacctcgtcaactttaaaacccatattcataaaaccgaaaaaaacatcctaactaacatcgacgctaaaaaactaatcgtcaaaatcttacaacacaaactaaacgactcgacgatactcacgaaattaaacgcgcccgtaactaacaacgatatcgcccctcttaacgtaacccttaacgaatttaaaaaaaccgaacaaacaacgcataaaaatcgtcttaccgaatccattaactcccaaaatcgctacgcgaaccccgacgcgaaaaaaaacattaacgtcgatcaataccataaaacgacccgaataaataacgtacaaatactcgatcgacaacaaaaccttaacactcatctaaaaatccttccgatcgtcgtccaactaatcacccacaaaacaacgataacgataacgacgataatcttatatcgcaccgaaccgatacgtttaataaacaaaataaccaacgcgacctcgaaaccgcgattaacgaatccatcgtta

SEQ ID NO: 34473 - DNA, 671 bp, Artificial Sequence
  chemically treated genomic DNA (Homo sapiens) CpG-island No: 34473
ttttcgttttttcgtaggggtttcgtttttttttcggggtttttacgttttaatatcgtagttatgtttatatgttattatttttttttcgcgttcgtcggtttttttcgttttttaagatcgtatttttttcggtttttttttattatcgaaatttatcgaaggaaatagacgttagtgtttttttcggggttgttattacggtttcggtaggcgggtcggggatcggtcgaatttgagttgacggtggaggggttcgggttagttagatgggcggttggttagatgcgtaagcggtagtatgcgagtttagttcgttgttgttggttggttgtttagtcggtcgattcgtttgtttattcggtttgtttttttttgtttttcgtttgtagcggtcgttagtttttgttcggtgtttaaaataaaatggtcgttacgtttagtgtttgtttgatcggttaaaatggcgtttacgtaattacgttaggcgttagattcgcgtacgattagagggcgggaaagatttgagttacgtttgcgtagaggttagaggcggagttttagggcgaaggcggggttttttatgtagtgtttcgtttttaggggcgtggttaatggttttgttgttggggcgtgtcggggattttacgttttagtagtggttgcgttgt

SEQ ID NO: 34474 - DNA, 671 bp, Artificial Sequence
  chemically treated genomic DNA (Homo sapiens) CpG-island No: 34474
acaacgcaaccactactaaaacgtaaaatccccgacacgccccaacaacaaaaccattaaccacgcccctaaaaacgaaacactacataaaaaaccccgccttcgccctaaaactccgcctctaacctctacgcaaacgtaactcaaatctttcccgccctctaatcgtacgcgaatctaacgcctaacgtaattacgtaaacgccattttaaccgatcaaacaaacactaaacgtaacgaccattttattttaaacaccgaacaaaaactaacgaccgctacaaacgaaaaacaaaaaaaaacaaaccgaataaacaaacgaatcgaccgactaaacaaccaaccaacaacaacgaactaaactcgcatactaccgcttacgcatctaaccaaccgcccatctaactaacccgaacccctccaccgtcaactcaaattcgaccgatccccgacccgcctaccgaaaccgtaataacaaccccgaaaaaaacactaacgtctatttccttcgataaatttcgataataaaaaaaaaccgaaaaaaatacgatcttaaaaaacgaaaaaaaccgacgaacgcgaaaaaaaaataataacatataaacataactacgatattaaaacgtaaaaaccccgaaaaaaaaacgaaacccctacgaaaaaacgaaaa

SEQ ID NO: 34475 - DNA, 671 bp, Artificial Sequence
  chemically treated genomic DNA (Homo sapiens) CpG-island No: 34475
gtagcgtaattattattggaacgtgaagttttcggtacgttttaataataggattattggttacgtttttaggggcggggtattgtatggaaagtttcgttttcgttttaaggtttcgtttttgatttttgcgtaggcgtagtttaaatttttttcgttttttagtcgtgcgcggatttgacgtttgacgtaattgcgtagacgttattttagtcggttagataagtattggacgtggcggttattttgttttggatatcgagtaggagttggcggtcgttgtagacgaaaggtaggaaagggtaggtcgggtgagtagacggatcggtcgattagatagttaattagtaataacgaattgagttcgtatattatcgtttacgtatttaattaatcgtttatttagttaattcgagtttttttatcgttaatttaggttcggtcggttttcggttcgtttgtcggagtcgtggtggtagtttcgggaggagtattggcgtttgtttttttcggtgagtttcggtagtgagaaggagtcgggggaggtgcggttttgaggagcggaaggggtcggcggacgcggaaagggggtggtggtatgtggatatagttacggtgttggagcgtggaggtttcggggaggaggcggagtttttgcgaaggggcggggg

SEQ ID NO: 34476 - DNA, 671 bp, Artificial Sequence
  chemically treated genomic DNA (Homo sapiens) CpG-island No: 34476
cccccgccccttcgcaaaaactccgcctcctccccgaaacctccacgctccaacaccgtaactatatccacataccaccaccccctttccgcgtccgccgaccccttccgctcctcaaaaccgcacctcccccgactccttctcactaccgaaactcaccgaaaaaaacaaacgccaatactcctcccgaaactaccaccacgactccgacaaacgaaccgaaaaccgaccgaacctaaattaacgataaaaaaactcgaattaactaaataaacgattaattaaatacgtaaacgataatatacgaactcaattcgttattactaattaactatctaatcgaccgatccgtctactcacccgacctaccctttcctacctttcgtctacaacgaccgccaactcctactcgatatccaaaacaaaataaccgccacgtccaatacttatctaaccgactaaaataacgtctacgcaattacgtcaaacgtcaaatccgcgcacgactaaaaaacgaaaaaaatttaaactacgcctacgcaaaaatcaaaaacgaaaccttaaaacgaaaacgaaactttccatacaataccccgcccctaaaaacgtaaccaataatcctattattaaaacgtaccgaaaacttcacgttccaataataattacgctac

SEQ ID NO: 34477 - DNA, 862 bp, Artificial Sequence
  chemically treated genomic DNA (Homo sapiens) CpG-island No: 34477
gttaatggcgcgattttttaggtaatacggcggtcggcggcgggggagggtttggcgcgcgtttcggtcgcgtttttcgagtcggtagttatttttttttttcggttcggcgtttcgggtcgggtgatgagggtcgttttttcgtatattacggttacgttttttacgaagacgtagttcggaaggttttcgtcggtcggtagttttattatttgtagttttagtttgttgtttagtacgtttacgtagagttggtgttgtcgtttcgcgcgggcgacgtttattttttcgtttttggcgttttttagcgcgtgttggtcgagcgattcgggtagcgttcgtattacggcgtgggtggttcggtcgaaggcggcggggtggtcgagttcggttatggtttcgggaggtttaggggcggcggcggcggcggaggcggtcgggttttgtcgcgggtagcgcgcgttgagtttgcgagcgttcgtcggttttttttggtagtcgttgaatgtggtgtagaaggagtttagttcgcgttcggagttttgttcgcgcgattgagtatgtttagagtttcgggcgtcggttcgcgcgtatttcgcgcgtttatttcggcgttcgcgggtttcgcgttagtttaggcgggagttgtagcggcgagcgtcgggcgaggagtggggttaggagaggcggtcggggaagtagcgagggtaagaagtatgcggaggcgggggatttcggcgaaaagttatcgttattcggatttggcggtatttgtgttttgtcgtaggtgtatattttttatcgtttttagcgcggatttggagagtcggtttcggtttggatagagtagttggagggtttt

SEQ ID NO: 34478 - DNA, 862 bp, Artificial Sequence
  chemically treated genomic DNA (Homo sapiens) CpG-island No: 34478
aaaaccctccaactactctatccaaaccgaaaccgactctccaaatccgcgctaaaaacgataaaaaatatacacctacgacaaaacacaaataccgccaaatccgaataacgataacttttcgccgaaatcccccgcctccgcatacttcttaccctcgctacttccccgaccgcctctcctaaccccactcctcgcccgacgctcgccgctacaactcccgcctaaactaacgcgaaacccgcgaacgccgaaataaacgcgcgaaatacgcgcgaaccgacgcccgaaactctaaacatactcaatcgcgcgaacaaaactccgaacgcgaactaaactccttctacaccacattcaacgactaccaaaaaaaaccgacgaacgctcgcaaactcaacgcgcgctacccgcgacaaaacccgaccgcctccgccgccgccgccgcccctaaacctcccgaaaccataaccgaactcgaccaccccgccgccttcgaccgaaccacccacgccgtaatacgaacgctacccgaatcgctcgaccaacacgcgctaaaaaacgccaaaaacgaaaaaataaacgtcgcccgcgcgaaacgacaacaccaactctacgtaaacgtactaaacaacaaactaaaactacaaataataaaactaccgaccgacgaaaaccttccgaactacgtcttcgtaaaaaacgtaaccgtaatatacgaaaaaacgaccctcatcacccgacccgaaacgccgaaccgaaaaaaaaaaataactaccgactcgaaaaacgcgaccgaaacgcgcgccaaaccctcccccgccgccgaccgccgtattacctaaaaaatcgcgccattaac

SEQ ID NO: 34479 - DNA, 862 bp, Artificial Sequence
  chemically treated genomic DNA (Homo sapiens) CpG-island No: 34479
gaagttttttagttgttttgtttagatcgaggtcggttttttaagttcgcgttggggacgatgggaggtgtgtatttgcgatagaatataggtatcgttaggttcgggtagcggtggtttttcgtcgaggtttttcgttttcgtatattttttgttttcgttgttttttcggtcgttttttttggttttatttttcgttcggcgttcgtcgttataattttcgtttgggttggcgcgagattcgcgagcgtcggagtgggcgcgcgggatgcgcgcgggtcggcgttcggagttttgggtatgtttagtcgcgcgggtagggtttcgggcgcgagttgggttttttttgtattatatttagcggttgttaagaggagtcgacgggcgttcgtaggtttagcgcgcgttgttcgcggtaggattcggtcgttttcgtcgtcgtcgtcgtttttaagtttttcgaagttatggtcgggttcggttatttcgtcgttttcggtcgggttatttacgtcgtggtgcgggcgttattcgagtcgttcggttagtacgcgttgagaagcgttaagggcgaggaggtggacgtcgttcgcgcggaacggtagtattagttttacgtgggcgtgttgggtagtaagttggggttgtaggtggtggagttgtcggtcgacgagagtttttcggattgcgttttcgtggaggacgtggtcgtggtgtgcgaggagacggtttttattattcgattcggggcgtcgagtcggaggaaggaggtaattgtcgattcgaggggcgcggtcggggcgcgcgttaggttttttttcgtcgtcggtcgtcgtgttgtttggggagtcgcgttattggt

SEQ ID NO: 34480 - DNA, 862 bp, Artificial Sequence
  chemically treated genomic DNA (Homo sapiens) CpG-island No: 34480
accaataacgcgactccccaaacaacacgacgaccgacgacgaaaaaaaacctaacgcgcgccccgaccgcgcccctcgaatcgacaattacctccttcctccgactcgacgccccgaatcgaataataaaaaccgtctcctcgcacaccacgaccacgtcctccacgaaaacgcaatccgaaaaactctcgtcgaccgacaactccaccacctacaaccccaacttactacccaacacgcccacgtaaaactaatactaccgttccgcgcgaacgacgtccacctcctcgcccttaacgcttctcaacgcgtactaaccgaacgactcgaataacgcccgcaccacgacgtaaataacccgaccgaaaacgacgaaataaccgaacccgaccataacttcgaaaaacttaaaaacgacgacgacgacgaaaacgaccgaatcctaccgcgaacaacgcgcgctaaacctacgaacgcccgtcgactcctcttaacaaccgctaaatataatacaaaaaaaacccaactcgcgcccgaaaccctacccgcgcgactaaacatacccaaaactccgaacgccgacccgcgcgcatcccgcgcgcccactccgacgctcgcgaatctcgcgccaacccaaacgaaaattataacgacgaacgccgaacgaaaaataaaaccaaaaaaaacgaccgaaaaaacaacgaaaacaaaaaatatacgaaaacgaaaaacctcgacgaaaaaccaccgctacccgaacctaacgatacctatattctatcgcaaatacacacctcccatcgtccccaacgcgaacttaaaaaaccgacctcgatctaaacaaaacaactaaaaaacttc

SEQ ID NO: 34481 - DNA, 536 bp, Artificial Sequence
  chemically treated genomic DNA (Homo sapiens) CpG-island No: 34481
atagttttcgtagcggggttaaagtcgggcgaaggagggtaagcgttggtggattattttttacgatatatcgtttttgtttattttcgtgttcgttattcgtcgaagtagttttagagagcgattgagcgtttcgtttcggtgtatatagttcggtagagatgttagttttcgtggagttgtatttaataagtttattttttttttcgtcgttatttcggagacgtttatcgggttgagttgcgaataattaagagagaggttaagttaagtcgtggcgtttgtggtaatttcggatacgggtattagttagttagcggagtttttttattttcgttgttagcgaaggcgttcgttaggttttgggaagaggcgatcggaggcgatgttcgcgaatttgttaggggggtaagcggcgggtgaggttttcgagggcggtttcgtttgttgattgagcggtagagggaggcgatgttcgttgatttaataaggatagtaggtggagtaggtatagatggaaaattgttgtcggtgtt

SEQ ID NO: 34482 - DNA, 536 bp, Artificial Sequence
  chemically treated genomic DNA (Homo sapiens) CpG-island No: 34482
aacaccgacaacaattttccatctatacctactccacctactatccttattaaatcaacgaacatcgcctccctctaccgctcaatcaacaaacgaaaccgccctcgaaaacctcacccgccgcttacccccctaacaaattcgcgaacatcgcctccgatcgcctcttcccaaaacctaacgaacgccttcgctaacaacgaaaataaaaaaactccgctaactaactaatacccgtatccgaaattaccacaaacgccacgacttaacttaacctctctcttaattattcgcaactcaacccgataaacgtctccgaaataacgacgaaaaaaaaaataaacttattaaatacaactccacgaaaactaacatctctaccgaactatatacaccgaaacgaaacgctcaatcgctctctaaaactacttcgacgaataacgaacacgaaaataaacaaaaacgatatatcgtaaaaaataatccaccaacgcttaccctccttcgcccgactttaaccccgctacgaaaactat

SEQ ID NO: 34483 - DNA, 536 bp, Artificial Sequence
  chemically treated genomic DNA (Homo sapiens) CpG-island No: 34483
ggtatcggtagtagttttttatttgtgtttattttatttgttgtttttgttgggttagcgaatatcgtttttttttatcgtttaattagtaaacgggatcgttttcgaggattttattcgtcgtttatttttttaataaattcgcgggtatcgttttcggtcgtttttttttaaggtttaacgagcgttttcgttggtaacggaggtgaggaggtttcgttgattggttggtgttcgtgttcggggttgttataaacgttacgatttggtttggttttttttttagttattcgtagtttagttcgatgggcgttttcggggtggcgacgggaaagaaggtgggtttattgggtgtagttttacgggggttggtatttttgtcgggttgtgtatatcggagcgagacgtttagtcgttttttaaagttgtttcggcggatgacggatacggagataaataggaacggtgtgtcgtgagaggtggtttattagcgtttgttttttttcgttcggttttaatttcgttgcggagattgt

SEQ ID NO: 34484 - DNA, 536 bp, Artificial Sequence
  chemically treated genomic DNA (Homo sapiens) CpG-island No: 34484
acaatctccgcaacgaaattaaaaccgaacgaaaaaaaacaaacgctaataaaccacctctcacgacacaccgttcctatttatctccgtatccgtcatccgccgaaacaactttaaaaaacgactaaacgtctcgctccgatatacacaacccgacaaaaataccaacccccgtaaaactacacccaataaacccaccttctttcccgtcgccaccccgaaaacgcccatcgaactaaactacgaataactaaaaaaaaaaccaaaccaaatcgtaacgtttataacaaccccgaacacgaacaccaaccaatcaacgaaacctcctcacctccgttaccaacgaaaacgctcgttaaaccttaaaaaaaaacgaccgaaaacgatacccgcgaatttattaaaaaaataaacgacgaataaaatcctcgaaaacgatcccgtttactaattaaacgataaaaaaaaacgatattcgctaacccaacaaaaacaacaaataaaataaacacaaataaaaaactactaccgatacc

SEQ ID NO: 34485 - DNA, 590 bp, Artificial Sequence
  chemically treated genomic DNA (Homo sapiens) CpG-island No: 34485
gttcgttacgtttcgttttattcgttttagttgtgtttcggcgtttagtttggggtagtcgttttcgtgagtttcgcgaggggagtttgttttagttatttcgtcgttttaattttttttaggtttataggtttagttcggcgcgcgtcgttcgttttgcgatttttagggcgagcgcgttttcggggcggtcgtgtaagaggcgtgggaagcgcgcggggggttttgagcgtgtagtcgtcgtttgcggacggcgaaggggcgggtgaaacgagtttttagcgtcgagtttgtttcgttttaaggtggacgttatatgtaagttacgagcgcgtcgtcgtacggtgtacgtttacggttcgggtcgggcgttttgcgggtgttttcgttgcgtcgtaggttttagtggcgcgttcggggattggaaggttgagtcgttttttttttatgtgcgcgggagttttttcgttattgtgtttagatcgtcggcgaagcgtagggggaggttgggaagggtatcgggagatacgggtttgcgttttttattcgggtttcggtttatttgttcgtatatttgttcgaagttttaa

SEQ ID NO: 34486 - DNA, 590 bp, Artificial Sequence
  chemically treated genomic DNA (Homo sapiens) CpG-island No: 34486
ttaaaacttcgaacaaatatacgaacaaataaaccgaaacccgaataaaaaacgcaaacccgtatctcccgatacccttcccaacctccccctacgcttcgccgacgatctaaacacaataacgaaaaaactcccgcgcacataaaaaaaaaacgactcaaccttccaatccccgaacgcgccactaaaacctacgacgcaacgaaaacacccgcaaaacgcccgacccgaaccgtaaacgtacaccgtacgacgacgcgctcgtaacttacatataacgtccaccttaaaacgaaacaaactcgacgctaaaaactcgtttcacccgccccttcgccgtccgcaaacgacgactacacgctcaaaaccccccgcgcgcttcccacgcctcttacacgaccgccccgaaaacgcgctcgccctaaaaatcgcaaaacgaacgacgcgcgccgaactaaacctataaacctaaaaaaaattaaaacgacgaaataactaaaacaaactcccctcgcgaaactcacgaaaacgactaccccaaactaaacgccgaaacacaactaaaacgaataaaacgaaacgtaacgaac

SEQ ID NO: 34487 - DNA, 590 bp, Artificial Sequence
  chemically treated genomic DNA (Homo sapiens) CpG-island No: 34487
ttaaggtttcggataggtgtgcggataggtgggtcggggttcgggtagggggcgtaggttcgtgtttttcgatgttttttttagtttttttttgcgtttcgtcggcgatttgggtatagtggcggagggattttcgcgtatatgggaggagggcggtttagttttttagttttcgggcgcgttattgaggtttgcggcgtagcgggggtattcgtagaacgttcggttcggatcgtgggcgtatatcgtgcggcgacgcgttcgtggtttgtatgtggcgtttattttgaaacgaagtaggttcgacgttggaaattcgttttattcgttttttcgtcgttcgtaggcggcgattgtacgtttagaatttttcgcgcgttttttacgttttttgtacggtcgtttcggaagcgcgttcgttttggaggtcgtagaacgagcggcgcgcgtcgggttgggtttgtggatttggaggaaattgaagcggcgaggtggttgggataggtttttttcgcggggtttacggggacggttgttttaggttgggcgtcgagatatagttggggcgggtggggcggaacgtggcggat

SEQ ID NO: 34488 - DNA, 590 bp, Artificial Sequence
  chemically treated genomic DNA (Homo sapiens) CpG-island No: 34488
atccgccacgttccgccccacccgccccaactatatctcgacgcccaacctaaaacaaccgtccccgtaaaccccgcgaaaaaaacctatcccaaccacctcgccgcttcaatttcctccaaatccacaaacccaacccgacgcgcgccgctcgttctacgacctccaaaacgaacgcgcttccgaaacgaccgtacaaaaaacgtaaaaaacgcgcgaaaaattctaaacgtacaatcgccgcctacgaacgacgaaaaaacgaataaaacgaatttccaacgtcgaacctacttcgtttcaaaataaacgccacatacaaaccacgaacgcgtcgccgcacgatatacgcccacgatccgaaccgaacgttctacgaatacccccgctacgccgcaaacctcaataacgcgcccgaaaactaaaaaactaaaccgccctcctcccatatacgcgaaaatccctccgccactatacccaaatcgccgacgaaacgcaaaaaaaaactaaaaaaaacatcgaaaaacacgaacctacgccccctacccgaaccccgacccacctatccgcacacctatccgaaaccttaa

SEQ ID NO: 34489 - DNA, 766 bp, Artificial Sequence
  chemically treated genomic DNA (Homo sapiens) CpG-island No: 34489
tcgttttttcggcgcgttgggcgtaggaggtttataagaaggagagcgttaaggaggcgggcgcggtcgcggtgtcggcgtcggtgttcgtagttatcgagtcgtcgttcgtgttgtatttgttcgttatttagtcgtcgtcgttcgtgttgttcgggtttttttttatgtcgttcgatcgttttatcgagcgttgcgagatcgtattggaaggcgagattatttcgtgtttcgtggtgggaggcgagaagcgtttgtgtttgtcgtagatttttaattcggtgttgcgcgatttttcgttgtagtagattaacgcggtgtgcgacgagttttatatttattgttcgcgttgtacggtcgattagttggagatttttaaagttatgggtattttgtttttttcggcgttttcgtgcgggtttattattaagacggacgtcgagcgtttgtgtaacgcgttgttttacggcggcgtttattcgtcgttttgtaagaagggagttgtcgttagtttggcgttgggtttggagtttagcgagcgtagcgttcgcgtgtattacgagtgtttcggtaagtgtaaggggttgttggtgttcgagttttatagtagttcgagcgtcgtttgtatttagtgtttggattgtcgttttatgtattcgtcgtataagttcgtggtgtattcgtataaggttttggagaatcggatttgttattggggtttcgattcggttaattggcgggtttatattttgttgagttaggatta

SEQ ID NO: 34490 - DNA, 766 bp, Artificial Sequence
  chemically treated genomic DNA (Homo sapiens) CpG-island No: 34490
taatcctaactcaacaaaatataaacccgccaattaaccgaatcgaaaccccaataacaaatccgattctccaaaaccttatacgaatacaccacgaacttatacgacgaatacataaaacgacaatccaaacactaaatacaaacgacgctcgaactactataaaactcgaacaccaacaaccccttacacttaccgaaacactcgtaatacacgcgaacgctacgctcgctaaactccaaacccaacgccaaactaacgacaactcccttcttacaaaacgacgaataaacgccgccgtaaaacaacgcgttacacaaacgctcgacgtccgtcttaataataaacccgcacgaaaacgccgaaaaaaacaaaatacccataactttaaaaatctccaactaatcgaccgtacaacgcgaacaataaatataaaactcgtcgcacaccgcgttaatctactacaacgaaaaatcgcgcaacaccgaattaaaaatctacgacaaacacaaacgcttctcgcctcccaccacgaaacacgaaataatctcgccttccaatacgatctcgcaacgctcgataaaacgatcgaacgacataaaaaaaaacccgaacaacacgaacgacgacgactaaataacgaacaaatacaacacgaacgacgactcgataactacgaacaccgacgccgacaccgcgaccgcgcccgcctccttaacgctctccttcttataaacctcctacgcccaacgcgccgaaaaaacga

SEQ ID NO: 34491 - DNA, 766 bp, Artificial Sequence
  chemically treated genomic DNA (Homo sapiens) CpG-island No: 34491
taattttggtttagtaggatgtaggttcgttagttggtcgagtcgaagttttagtggtaggttcggttttttagggttttgtgcgagtgtattacgaatttgtgcggcgggtatatgaggcggtagtttaggtattggatgtaggcggcgttcgggttgttgtagagttcgggtattagtagttttttatatttgtcgaagtattcgtggtatacgcggacgttgcgttcgttgagttttaggtttagcgttaggttggcggtagttttttttttgtagggcggcgggtaggcgtcgtcgtagagtagcgcgttgtataggcgttcggcgttcgttttggtgatgagttcgtacgagggcgtcgagaagggtaggatgtttatgattttgaggatttttagttggtcggtcgtgtagcgcgagtagtagatgtggagttcgtcgtatatcgcgttgatttgttgtagcgagaagtcgcgtagtatcgagttgagaatttgcggtagatataggcgtttttcgttttttattacgaagtacgagatggtttcgttttttagtacggtttcgtagcgttcggtggagcggtcggacggtatgaagaagggttcgggtagtacgggcggcggcggttggatggcgggtaggtgtagtacgggcggcggttcggtggttgcgggtatcggcgtcggtatcgcggtcgcgttcgtttttttggcgtttttttttttgtaggttttttgcgtttagcgcgtcgagaaagcgg

SEQ ID NO: 34492 - DNA, 766 bp, Artificial Sequence
  chemically treated genomic DNA (Homo sapiens) CpG-island No: 34492
ccgctttctcgacgcgctaaacgcaaaaaacctacaaaaaaaaaaacgccaaaaaaacgaacgcgaccgcgataccgacgccgatacccgcaaccaccgaaccgccgcccgtactacacctacccgccatccaaccgccgccgcccgtactacccgaacccttcttcataccgtccgaccgctccaccgaacgctacgaaaccgtactaaaaaacgaaaccatctcgtacttcgtaataaaaaacgaaaaacgcctatatctaccgcaaattctcaactcgatactacgcgacttctcgctacaacaaatcaacgcgatatacgacgaactccacatctactactcgcgctacacgaccgaccaactaaaaatcctcaaaatcataaacatcctacccttctcgacgccctcgtacgaactcatcaccaaaacgaacgccgaacgcctatacaacgcgctactctacgacgacgcctacccgccgccctacaaaaaaaaaactaccgccaacctaacgctaaacctaaaactcaacgaacgcaacgtccgcgtataccacgaatacttcgacaaatataaaaaactactaatacccgaactctacaacaacccgaacgccgcctacatccaatacctaaactaccgcctcatatacccgccgcacaaattcgtaatacactcgcacaaaaccctaaaaaaccgaacctaccactaaaacttcgactcgaccaactaacgaacctacatcctactaaaccaaaatta

SEQ ID NO: 34493 - DNA, 607 bp, Artificial Sequence
  chemically treated genomic DNA (Homo sapiens) CpG-island No: 34493
aggcgcgaggttttttttcgtaaacgttttgaatatttagttagatttttatcgatatttgtttgataggaacgtagggttcgttttagtcgtcgagatttgcgaggtttgggttttgtatatgcgtatggagtatatttgattattgggttttcgtgcgtacgcgcgtggattttgttatttgaggtgcgtatgcgtatttgtgtttagcgggatcgtttgtttggtaattcggagggagagattggaaatcgcggagttttttttgggaggttgcggttagtcggggttgatttgttatgttgggtttcggaggtcgttaagagtcgagagagatatgaggtgtttttgaagttcggtcgtttgggttatgaagaagatttttagtaagaagggcgagtcgtttttgggttttttcgcgcggcggtagaggagtagcgcgggaggcgggggcgagtcgggggagggcgtttattcgtagttcggttattacgttcgagatcgagatttcggtaagatttataaagttgttagcgcgggtaatgtggcgaaagtgtagtagatttttttgtttaggaagaatggtttgaacgatagagataagatg

SEQ ID NO: 34494 - DNA, 607 bp, Artificial Sequence
  chemically treated genomic DNA (Homo sapiens) CpG-island No: 34494
catcttatctctatcgttcaaaccattcttcctaaacaaaaaaatctactacactttcgccacattacccgcgctaacaactttataaatcttaccgaaatctcgatctcgaacgtaataaccgaactacgaataaacgccctcccccgactcgcccccgcctcccgcgctactcctctaccgccgcgcgaaaaaacccaaaaacgactcgcccttcttactaaaaatcttcttcataacccaaacgaccgaacttcaaaaacacctcatatctctctcgactcttaacgacctccgaaacccaacataacaaatcaaccccgactaaccgcaacctcccaaaaaaaactccgcgatttccaatctctccctccgaattaccaaacaaacgatcccgctaaacacaaatacgcatacgcacctcaaataacaaaatccacgcgcgtacgcacgaaaacccaataatcaaatatactccatacgcatatacaaaacccaaacctcgcaaatctcgacgactaaaacgaaccctacgttcctatcaaacaaatatcgataaaaatctaactaaatattcaaaacgtttacgaaaaaaaacctcgcgcct

SEQ ID NO: 34495 - DNA, 607 bp, Artificial Sequence
  chemically treated genomic DNA (Homo sapiens) CpG-island No: 34495
tattttgtttttatcgtttaagttattttttttgagtaaaaggatttgttgtattttcgttatattattcgcgttggtagttttgtggattttgtcgagatttcggtttcggacgtggtagtcgggttgcgagtaggcgttttttttcggttcgttttcgtttttcgcgttgtttttttgtcgtcgcgcgaaggagtttaagggcgattcgttttttttattaaaaattttttttatggtttaggcgatcgggttttagagatattttatgtttttttcggtttttaacggttttcggagtttaatataataagttagtttcggttggtcgtagttttttaaaggaaatttcgcggtttttaattttttttttcgggttattaagtaagcgatttcgttagatataagtgcgtatgcgtattttagatggtaaggtttacgcgcgtgcgtacgaaggtttagtggttaagtgtgttttatgcgtatgtgtaaggtttagatttcgtaaatttcggcgattgggacgagttttgcgtttttgttaaataaatgtcggtgggagtttggttgagtgtttaggacgtttgcgaaaagaagtttcgcgttt

SEQ ID NO: 34496 - DNA, 607 bp, Artificial Sequence
  chemically treated genomic DNA (Homo sapiens) CpG-island No: 34496
aaacgcgaaacttcttttcgcaaacgtcctaaacactcaaccaaactcccaccgacatttatttaacaaaaacgcaaaactcgtcccaatcgccgaaatttacgaaatctaaaccttacacatacgcataaaacacacttaaccactaaaccttcgtacgcacgcgcgtaaaccttaccatctaaaatacgcatacgcacttatatctaacgaaatcgcttacttaataacccgaaaaaaaaaattaaaaaccgcgaaatttcctttaaaaaactacgaccaaccgaaactaacttattatattaaactccgaaaaccgttaaaaaccgaaaaaaacataaaatatctctaaaacccgatcgcctaaaccataaaaaaaatttttaataaaaaaaacgaatcgcccttaaactccttcgcgcgacgacaaaaaaacaacgcgaaaaacgaaaacgaaccgaaaaaaaacgcctactcgcaacccgactaccacgtccgaaaccgaaatctcgacaaaatccacaaaactaccaacgcgaataatataacgaaaatacaacaaatccttttactcaaaaaaaataacttaaacgataaaaacaaaata

SEQ ID NO: 34497 - DNA, 599 bp, Artificial Sequence
  chemically treated genomic DNA (Homo sapiens) CpG-island No: 34497
gtcgttcgcggttttttttttttttttaggaacggtttaagcgttttgggtattttatcgggttttgtatcgagttttgtattataaatacgattttcgtgtaggatttaagtgtgaatttttgtaggttttcggattttgaagtattcggggttagatatttcgagttcgcggcggtggaaggtacgtaaaagggcgaatcgagacgattttaggacgttgaggtagcgtaggttttattcggtttcgttttgtttcgttttgtttcggtcggttttttagtattagttttttggcgtcggtttttagtttttttcgtattttttttttcgcgtttcgtcgttagattttcgtgatagttgagatttttttcgttcgaatagtttttttcgtcggagaggttaatgggttagggtaacggttgcgacggttggattttgaaggagttaaaaggcgttcggagcggagagtttaagaggcgtaagttaggcgtgttaaagtcggtcggaattgtttcggagggtacggtaataggtggtggggttgagtcgaggtgggtcgtggttagggggagggggtgttaggtcggaaggggttgt

SEQ ID NO: 34498 - DNA, 599 bp, Artificial Sequence
  chemically treated genomic DNA (Homo sapiens) CpG-island No: 34498
acaaccccttccgacctaacaccccctccccctaaccacgacccacctcgactcaaccccaccacctattaccgtaccctccgaaacaattccgaccgactttaacacgcctaacttacgcctcttaaactctccgctccgaacgccttttaactccttcaaaatccaaccgtcgcaaccgttaccctaacccattaacctctccgacgaaaaaaactattcgaacgaaaaaaatctcaactatcacgaaaatctaacgacgaaacgcgaaaaaaaaaatacgaaaaaaactaaaaaccgacgccaaaaaactaatactaaaaaaccgaccgaaacaaaacgaaacaaaacgaaaccgaataaaacctacgctacctcaacgtcctaaaatcgtctcgattcgcccttttacgtaccttccaccgccgcgaactcgaaatatctaaccccgaatacttcaaaatccgaaaacctacaaaaattcacacttaaatcctacacgaaaatcgtatttataatacaaaactcgatacaaaacccgataaaatacccaaaacgcttaaaccgttcctaaaaaaaaaaaaaaaaccgcgaacgac

SEQ ID NO: 34499 - DNA, 599 bp, Artificial Sequence
  chemically treated genomic DNA (Homo sapiens) CpG-island No: 34499
gtagtttttttcggtttagtattttttttttttggttacggtttatttcggtttagttttattatttgttatcgtgtttttcggagtagtttcgatcggttttaatacgtttggtttacgttttttaaatttttcgtttcgagcgttttttggtttttttaaaatttaatcgtcgtaatcgttgttttagtttattggttttttcggcgaagggggttgttcgggcggggaaagttttagttattacgagagtttagcggcggagcgcgaggggaagggtacgagaggggttgggagtcggcgttagaggattagtattggaaagtcggtcgggatagggcggggtagggcggggtcgggtggggtttgcgttgttttagcgttttggagtcgtttcggttcgtttttttgcgtgttttttatcgtcgcgagttcggaatgtttggtttcgggtgttttagggttcgagaatttgtagaagtttatatttaaattttatacgagagtcgtatttatgatgtagaattcggtgtagaattcgatggagtgtttaaggcgtttgagtcgtttttagaaggggaaggagagtcgcgggcggt

SEQ ID NO: 34500 - DNA, 599 bp, Artificial Sequence
  chemically treated genomic DNA (Homo sapiens) CpG-island No: 34500
accgcccgcgactctccttccccttctaaaaacgactcaaacgccttaaacactccatcgaattctacaccgaattctacatcataaatacgactctcgtataaaatttaaatataaacttctacaaattctcgaaccctaaaacacccgaaaccaaacattccgaactcgcgacgataaaaaacacgcaaaaaaacgaaccgaaacgactccaaaacgctaaaacaacgcaaaccccacccgaccccgccctaccccgccctatcccgaccgactttccaatactaatcctctaacgccgactcccaacccctctcgtacccttcccctcgcgctccgccgctaaactctcgtaataactaaaactttccccgcccgaacaacccccttcgccgaaaaaaccaataaactaaaacaacgattacgacgattaaattttaaaaaaaccaaaaaacgctcgaaacgaaaaatttaaaaaacgtaaaccaaacgtattaaaaccgatcgaaactactccgaaaaacacgataacaaataataaaactaaaccgaaataaaccgtaaccaaaaaaaaaaaatactaaaccgaaaaaaactac

SEQ ID NO: 34501 - DNA, 1214 bp, Artificial Sequence
  chemically treated genomic DNA (Homo sapiens) CpG-island No: 34501
  misc_feature (262)..(262): n is either a, c, g or t
ttttttcgcgttttttcggttttcgcgtcgtttttttcgttttattttgtaggttttttttttgtatttcgggcgtttcgttttgcgatatggcgttagagggtaattgcggcgatcggagttcgcgtcgggttgcgggatgtgttttagttgcgggcggtgggaaagtcgaggtcggagcgtcgcggtttagttgcgttttcggattgagcggagtttcgtagttcggtcggaggaatttatagggtagggcggggtcggncggatttgcggtcgcgtcgtttattggtcgcgatttggggtttgcgcgtgcgtaggggcgtggggtgcgtgtggtacgtgcggcgcgtgcgcgggcgggttttgcggtgggcgaggggtataggttttcggtgcgcggtacgcgggcggggagaggggcggggcgaggggcgcgtaggcgcgagggcggtagcgatcgtttgaggtgagtcggttcgggttggacgtcgcgggtcgcgtgacgagtgggttgcgcggtcgtcgtcgcggcgggcggtgggtcgggtttttttttgaaggggcggtgggatcggcggattttttgggtattggttattacggagacgtcgttacgtttcggggcggggttcgtttttttattttgttagtggggaaattgaggcgcggggttggcggcgttcgtgcggggggcgtgaggacgtgtagggaagcggtcgttgcggtttcgagacggttcgtggggtcgggatttgcgttcggggcgggagttgcgagcggtgggtcggagttgagcgtttcgggacgggatcgcgttttcgggtttttgttcgtttcgtcggggcgtttttgcgtgaatagcggggttcgttgtgttcggggcgttcgttcgtaggaagaagcggaggttcgagtagagtcgaaagagtttgttcgagggaggcgcggattttaggggttcgggagaggcgcgtcgttcgtttttgcggtaaggggttttcggggtgtaaacgcggtgtggggcgggcgttttcggggtgggacgtttcgtttacggggcggagtggcgtttggtcggttcgggtgggtgttcggttttcgtgggagttagtttggcgtgggggtttcgtagtttcgggattgggaggtattttttagaggaaagtcgtttttttatttttcgtttttgattaaaagtttttttttttgaaagt

SEQ ID NO: 34502 - DNA, 1214 bp, Artificial Sequence
  chemically treated genomic DNA (Homo sapiens) CpG-island No: 34502
  misc_feature (953)..(953): n is either a, c, g or t
actttcaaaaaaaaaaacttttaatcaaaaacgaaaaataaaaaaacgactttcctctaaaaaatacctcccaatcccgaaactacgaaacccccacgccaaactaactcccacgaaaaccgaacacccacccgaaccgaccaaacgccactccgccccgtaaacgaaacgtcccaccccgaaaacgcccgccccacaccgcgtttacaccccgaaaaccccttaccgcaaaaacgaacgacgcgcctctcccgaacccctaaaatccgcgcctccctcgaacaaactctttcgactctactcgaacctccgcttcttcctacgaacgaacgccccgaacacaacgaaccccgctattcacgcaaaaacgccccgacgaaacgaacaaaaacccgaaaacgcgatcccgtcccgaaacgctcaactccgacccaccgctcgcaactcccgccccgaacgcaaatcccgaccccacgaaccgtctcgaaaccgcaacgaccgcttccctacacgtcctcacgccccccgcacgaacgccgccaaccccgcgcctcaatttccccactaacaaaataaaaaaacgaaccccgccccgaaacgtaacgacgtctccgtaataaccaatacccaaaaaatccgccgatcccaccgccccttcaaaaaaaaacccgacccaccgcccgccgcgacgacgaccgcgcaacccactcgtcacgcgacccgcgacgtccaacccgaaccgactcacctcaaacgatcgctaccgccctcgcgcctacgcgcccctcgccccgcccctctccccgcccgcgtaccgcgcaccgaaaacctatacccctcgcccaccgcaaaacccgcccgcgcacgcgccgcacgtaccacacgcaccccacgcccctacgcacgcgcaaaccccaaatcgcgaccaataaacgacgcgaccgcaaatccgnccgaccccgccctaccctataaattcctccgaccgaactacgaaactccgctcaatccgaaaacgcaactaaaccgcgacgctccgacctcgactttcccaccgcccgcaactaaaacacatcccgcaacccgacgcgaactccgatcgccgcaattaccctctaacgccatatcgcaaaacgaaacgcccgaaatacaaaaaaaaaacctacaaaataaaacgaaaaaaacgacgcgaaaaccgaaaaaacgcgaaaaaa

SEQ ID NO: 34503 - DNA, 1214 bp, Artificial Sequence
  chemically treated genomic DNA (Homo sapiens) CpG-island No: 34503
  misc_feature (953)..(953): n is either a, c, g or t
gtttttaagaagaaagatttttgattaaaagcgggaaatgagaaagcgatttttttttgaaaagtgttttttagtttcgaggttgcgaggtttttacgttaggttggtttttacggaagtcgggtatttattcggatcgattaagcgttatttcgtttcgtggacggggcgttttatttcggggacgttcgttttatatcgcgtttgtatttcggaggttttttgtcgtagaggcggacggcgcgtttttttcgggtttttggggttcgcgtttttttcgggtagattttttcgattttgttcgagttttcgtttttttttgcgggcggacgtttcggatataacgggtttcgttgtttacgtaggggcgtttcggcggggcgggtaaagattcggggacgcggtttcgtttcgagacgtttagtttcggtttatcgttcgtagttttcgtttcgggcgtaggtttcgattttacgggtcgtttcggagtcgtagcggtcgtttttttgtacgtttttacgtttttcgtacggacgtcgttagtttcgcgttttagtttttttattagtaggatggaaagacgggtttcgtttcgaagcgtagcggcgttttcgtggtagttagtgtttagagagttcgtcggttttatcgtttttttaaaggagaattcggtttatcgttcgtcgcggcggcgatcgcgtagtttattcgttacgcggttcgcggcgtttagttcgggtcggtttattttaggcggtcgttgtcgttttcgcgtttgcgcgtttttcgtttcgttttttttttcgttcgcgtgtcgcgtatcggaggtttatgtttttcgtttatcgtaggattcgttcgcgtacgcgtcgtacgtgttatacgtattttacgtttttgcgtacgcgtaggttttaagtcgcggttaatgggcgacgcggtcgtagattcgntcggtttcgttttgttttgtgagttttttcggtcgggttgcggggtttcgtttagttcgggagcgtagttgggtcgcggcgtttcgatttcggtttttttatcgttcgtagttgaagtatatttcgtagttcggcgcggatttcgatcgtcgtagttgttttttggcgttatgtcgtagaacggagcgttcgggatgtaggaggagagtttgtagggtgaggcggaggaggcggcgcgggagtcgagggggcgcggggggg

SEQ ID NO: 34504 - DNA, 1214 bp, Artificial Sequence
  chemically treated genomic DNA (Homo sapiens) CpG-island No: 34504
  misc_feature (262)..(262): n is either a, c, g or t
cccccccgcgccccctcgactcccgcgccgcctcctccgcctcaccctacaaactctcctcctacatcccgaacgctccgttctacgacataacgccaaaaaacaactacgacgatcgaaatccgcgccgaactacgaaatatacttcaactacgaacgataaaaaaaccgaaatcgaaacgccgcgacccaactacgctcccgaactaaacgaaaccccgcaacccgaccgaaaaaactcacaaaacaaaacgaaaccgancgaatctacgaccgcgtcgcccattaaccgcgacttaaaacctacgcgtacgcaaaaacgtaaaatacgtataacacgtacgacgcgtacgcgaacgaatcctacgataaacgaaaaacataaacctccgatacgcgacacgcgaacgaaaaaaaaaacgaaacgaaaaacgcgcaaacgcgaaaacgacaacgaccgcctaaaataaaccgacccgaactaaacgccgcgaaccgcgtaacgaataaactacgcgatcgccgccgcgacgaacgataaaccgaattctcctttaaaaaaacgataaaaccgacgaactctctaaacactaactaccacgaaaacgccgctacgcttcgaaacgaaacccgtctttccatcctactaataaaaaaactaaaacgcgaaactaacgacgtccgtacgaaaaacgtaaaaacgtacaaaaaaacgaccgctacgactccgaaacgacccgtaaaatcgaaacctacgcccgaaacgaaaactacgaacgataaaccgaaactaaacgtctcgaaacgaaaccgcgtccccgaatctttacccgccccgccgaaacgcccctacgtaaacaacgaaacccgttatatccgaaacgtccgcccgcaaaaaaaaacgaaaactcgaacaaaatcgaaaaaatctacccgaaaaaaacgcgaaccccaaaaacccgaaaaaaacgcgccgtccgcctctacgacaaaaaacctccgaaatacaaacgcgatataaaacgaacgtccccgaaataaaacgccccgtccacgaaacgaaataacgcttaatcgatccgaataaatacccgacttccgtaaaaaccaacctaacgtaaaaacctcgcaacctcgaaactaaaaaacacttttcaaaaaaaaatcgctttctcatttcccgcttttaatcaaaaatctttcttcttaaaaac

SEQ ID NO: 34505 - DNA, 620 bp, Artificial Sequence
  chemically treated genomic DNA (Homo sapiens) CpG-island No: 34505
gtcgtacgcgtgtagttttttcgtgttgcgtatggcgttgggatcggtttgagcggcgggtgagtttttttaagtcggcggcgttcggtgttcggttatttacgcgcgtttcgcggttttcgggttatttttagttacgtcgagttttgttttaggagtttgtatagcggtttcgcggagatcgggattgcgtgggggaggatcgcggcgggggtcgtcgtcgagtaaggagcgcggtcgcggggatcgttcgggagtgggggcggcggggcgggtcgggttcggggtttttgttcgcggtgatagtgacgcgcgttttcgttcgtcgtttttgttatggtcgattcggttcgtcggacgtcgtttagagtcgttcgcggggagtttcggtgagtagcggtcggggtggggtcgcgatcgggggtcgggtttttgcgttgcgtttggtacggtgcgttcgggacgcgggcgttttgacggtcgtggggcgggcgggggggcgacgtttcgagggagggggtttcgcggtaagaaacgtttttgtttggggcggggttttttttgtttttttcggcggttttttcgtgggcgggttttttttacggtattttttgttttgt

SEQ ID NO: 34506 - DNA, 620 bp, Artificial Sequence
  chemically treated genomic DNA (Homo sapiens) CpG-island No: 34506
acaaaacaaaaaataccgtaaaaaaaacccgcccacgaaaaaaccgccgaaaaaaacaaaaaaaaccccgccccaaacaaaaacgtttcttaccgcgaaaccccctccctcgaaacgtcgcccccccgcccgccccacgaccgtcaaaacgcccgcgtcccgaacgcaccgtaccaaacgcaacgcaaaaacccgacccccgatcgcgaccccaccccgaccgctactcaccgaaactccccgcgaacgactctaaacgacgtccgacgaaccgaatcgaccataacaaaaacgacgaacgaaaacgcgcgtcactatcaccgcgaacaaaaaccccgaacccgacccgccccgccgcccccactcccgaacgatccccgcgaccgcgctccttactcgacgacgacccccgccgcgatcctcccccacgcaatcccgatctccgcgaaaccgctatacaaactcctaaaacaaaactcgacgtaactaaaaataacccgaaaaccgcgaaacgcgcgtaaataaccgaacaccgaacgccgccgacttaaaaaaactcacccgccgctcaaaccgatcccaacgccatacgcaacacgaaaaaactacacgcgtacgac

SEQ ID NO: 34507 - DNA, 620 bp, Artificial Sequence
  chemically treated genomic DNA (Homo sapiens) CpG-island No: 34507
gtagggtagggggtgtcgtggagaggattcgtttacggggggatcgtcgggagaggtaaggaggatttcgttttagataggggcgttttttgtcgcgggattttttttttcgggacgtcgttttttcgttcgttttacggtcgttagggcgttcgcgtttcggacgtatcgtgttagacgtagcgtagaggttcggttttcggtcgcggttttatttcggtcgttgtttatcgaggtttttcgcgagcgattttgggcggcgttcgacggatcggatcgattatggtagaggcggcgggcgggggcgcgcgttattgttatcgcgggtaggagtttcgaattcggttcgtttcgtcgtttttattttcgggcggttttcgcggtcgcgttttttgttcggcgacggttttcgtcgcgatttttttttacgtagtttcggttttcgcggagtcgttgtgtaagtttttaaaatagggttcggcgtggttgaaaatagttcgggggtcgcggggcgcgcgtaggtagtcgggtatcgggcgtcgtcggtttagagggatttattcgtcgtttaggtcgattttagcgttatgcgtagtacgggggagttgtacgcgtgcggt

SEQ ID NO: 34508 - DNA, 620 bp, Artificial Sequence
  chemically treated genomic DNA (Homo sapiens) CpG-island No: 34508
accgcacgcgtacaactcccccgtactacgcataacgctaaaatcgacctaaacgacgaataaatccctctaaaccgacgacgcccgatacccgactacctacgcgcgccccgcgacccccgaactattttcaaccacgccgaaccctattttaaaaacttacacaacgactccgcgaaaaccgaaactacgtaaaaaaaaatcgcgacgaaaaccgtcgccgaacaaaaaacgcgaccgcgaaaaccgcccgaaaataaaaacgacgaaacgaaccgaattcgaaactcctacccgcgataacaataacgcgcgcccccgcccgccgcctctaccataatcgatccgatccgtcgaacgccgcccaaaatcgctcgcgaaaaacctcgataaacaacgaccgaaataaaaccgcgaccgaaaaccgaacctctacgctacgtctaacacgatacgtccgaaacgcgaacgccctaacgaccgtaaaacgaacgaaaaaacgacgtcccgaaaaaaaaaatcccgcgacaaaaaacgcccctatctaaaacgaaatcctccttacctctcccgacgatccccccgtaaacgaatcctctccacgacaccccctaccctac

SEQ ID NO: 34509 - DNA, 788 bp, Artificial Sequence
  chemically treated genomic DNA (Homo sapiens) CpG-island No: 34509
tttcggggagaagagtttttagtttttttcgtggatatttaaagacgtcgagtttcggtttttaatcgggagcggttttcgtggtcgggtcgtaggtatttatcgtcgttttcgtcgttgtgtcgtcgtcgcgatatgttgtttttcggtgcgtcgcggaatcgagaggttaggcggtaagcgttgtaggaattgtttggtcgttggtcgacgtaaggatagttgtaaggcgcgcggatgggtcggtacgtaggcgtattagttcgttacggtttcggaagcgtaggagaggtcgtcgggtggggttaggcgttgcgatagtcggcgtgaggaagtttagtgggttacgaacgtttggtatatatgtaatcgttttttcgggttgttttcgtttgtcggttatttttttttttcgtttttcgttttatgttttttcggggttacgtagaaagtgtcgtcgttttggttatttagagttttcgggtcgcggtcgtcgtacgtttgaaggcgggtcgtgtcggcggtcgttttagttttcgttttcgtttaggtcggtttttcggggttttttaatggtttttcggtggttttttaatggttttttcggtcggtttttgcgtcgacgttaggagattttcggagtttggtgacgttacgagcgagtttttttatttaaatacgcggcgggggaataggttcgagggcggtgagtagtgataattgttaggcggagatagtgtagggaagagagattttagaaaggattaggattggcgggtatgtgttta

SEQ ID NO: 34510 - DNA, 788 bp, Artificial Sequence
  chemically treated genomic DNA (Homo sapiens) CpG-island No: 34510
taaacacatacccgccaatcctaatcctttctaaaatctctcttccctacactatctccgcctaacaattatcactactcaccgccctcgaacctattcccccgccgcgtatttaaataaaaaaactcgctcgtaacgtcaccaaactccgaaaatctcctaacgtcgacgcaaaaaccgaccgaaaaaaccattaaaaaaccaccgaaaaaccattaaaaaaccccgaaaaaccgacctaaacgaaaacgaaaactaaaacgaccgccgacacgacccgccttcaaacgtacgacgaccgcgacccgaaaactctaaataaccaaaacgacgacactttctacgtaaccccgaaaaaacataaaacgaaaaacgaaaaaaaaaaataaccgacaaacgaaaacaacccgaaaaaacgattacatatataccaaacgttcgtaacccactaaacttcctcacgccgactatcgcaacgcctaaccccacccgacgacctctcctacgcttccgaaaccgtaacgaactaatacgcctacgtaccgacccatccgcgcgccttacaactatccttacgtcgaccaacgaccaaacaattcctacaacgcttaccgcctaacctctcgattccgcgacgcaccgaaaaacaacatatcgcgacgacgacacaacgacgaaaacgacgataaatacctacgacccgaccacgaaaaccgctcccgattaaaaaccgaaactcgacgtctttaaatatccacgaaaaaaactaaaaactcttctccccgaaa

SEQ ID NO: 34511 - DNA, 788 bp, Artificial Sequence
  chemically treated genomic DNA (Homo sapiens) CpG-island No: 34511
tgagtatatattcgttagttttgattttttttaaggttttttttttttgtattgttttcgtttagtaattgttattgtttatcgttttcgagtttattttttcgtcgcgtatttgggtagaaaagttcgttcgtgacgttattaagtttcggaagttttttggcgtcggcgtaagggtcggtcgggaaaattattgagaggttatcgggaaattattgagaagtttcggaggatcggtttgagcggaggcggagattagagcggtcgtcggtacgattcgtttttaggcgtacgacgatcgcggttcgggggttttgagtggttaaagcggcggtattttttgcgtggtttcggaaggatatagagcggaaggcgggagaaagaagtagtcggtaggcggaggtagttcgagggggcggttgtatgtgtgttagacgttcgtagtttattgagtttttttacgtcggttgtcgtagcgtttagttttattcggcggttttttttgcgttttcggggtcgtggcgagttagtgcgtttgcgtgtcggtttattcgcgcgttttgtagttgtttttgcgtcggttagcggttagatagtttttgtagcgtttatcgtttggtttttcggtttcgcggcgtatcggagggtagtatgtcgcggcggcggtatagcgacgagaacgacggtgagtgtttgcggttcggttacggaggtcgttttcggttgggagtcgaggttcggcgtttttgggtgtttacggaagagattggaagttttttttttcggga

SEQ ID NO: 34512 - DNA, 788 bp, Artificial Sequence
  chemically treated genomic DNA (Homo sapiens) CpG-island No: 34512
tcccgaaaaaaaaaacttccaatctcttccgtaaacacccaaaaacgccgaacctcgactcccaaccgaaaacgacctccgtaaccgaaccgcaaacactcaccgtcgttctcgtcgctataccgccgccgcgacatactaccctccgatacgccgcgaaaccgaaaaaccaaacgataaacgctacaaaaactatctaaccgctaaccgacgcaaaaacaactacaaaacgcgcgaataaaccgacacgcaaacgcactaactcgccacgaccccgaaaacgcaaaaaaaaccgccgaataaaactaaacgctacgacaaccgacgtaaaaaaactcaataaactacgaacgtctaacacacatacaaccgccccctcgaactacctccgcctaccgactacttctttctcccgccttccgctctatatccttccgaaaccacgcaaaaaataccgccgctttaaccactcaaaacccccgaaccgcgatcgtcgtacgcctaaaaacgaatcgtaccgacgaccgctctaatctccgcctccgctcaaaccgatcctccgaaacttctcaataatttcccgataacctctcaataattttcccgaccgacccttacgccgacgccaaaaaacttccgaaacttaataacgtcacgaacgaacttttctacccaaatacgcgacgaaaaaataaactcgaaaacgataaacaataacaattactaaacgaaaacaatacaaaaaaaaaaaaccttaaaaaaaatcaaaactaacgaatatatactca

SEQ ID NO: 34513 - DNA, 628 bp, Artificial Sequence
  chemically treated genomic DNA (Homo sapiens) CpG-island No: 34513
ttttagtttgggtttcgtatagcgcggcggagcgcgggaggggcggggcgggtttgttgacgtcgtcggatttgaattgcgtaggcgcggcgcgagatcgcgggagcgagcgcgcggtaatagttcgcggtagttcgcgcgggagcggggcgtttgggtggatgggcgtttgggcgtttgggttgtcggacggtgggaacggaagtcgttgtgggacgttgaggaagttaggatggcgatttcgagtaagaagacgttaattttaagtttttagttttttaagagagttttttcgagagatttttcgtcggaggtttcgagtaagaggaagaattcggtttcgtagttgtcgttgttgtagtcgttcgggtttttcgtggaaggttttatcgttcgtatttcgatggagaattttttgtaagttgttcggaggtcgcgtcgcgggtgtggaggtgtgttggttagtaggtttcggggtttcggtagcgcgcgggcgtgggcgtgtgggtgtgtatttggtttgtgggtttggttttgaattcgtgtcggggtttttttgaggatttttttacgtaggttgtggagattgacgtgtatgatgtaggagatgtgtgttttgggtgatgtg

SEQ ID NO: 34514 - DNA, 628 bp, Artificial Sequence
  chemically treated genomic DNA (Homo sapiens) CpG-island No: 34514
cacatcacccaaaacacacatctcctacatcatacacgtcaatctccacaacctacgtaaaaaaatcctcaaaaaaaccccgacacgaattcaaaaccaaacccacaaaccaaatacacacccacacgcccacgcccgcgcgctaccgaaaccccgaaacctactaaccaacacacctccacacccgcgacgcgacctccgaacaacttacaaaaaattctccatcgaaatacgaacgataaaaccttccacgaaaaacccgaacgactacaacaacgacaactacgaaaccgaattcttcctcttactcgaaacctccgacgaaaaatctctcgaaaaaactctcttaaaaaactaaaaacttaaaattaacgtcttcttactcgaaatcgccatcctaacttcctcaacgtcccacaacgacttccgttcccaccgtccgacaacccaaacgcccaaacgcccatccacccaaacgccccgctcccgcgcgaactaccgcgaactattaccgcgcgctcgctcccgcgatctcgcgccgcgcctacgcaattcaaatccgacgacgtcaacaaacccgccccgcccctcccgcgctccgccgcgctatacgaaacccaaactaaaa

SEQ ID NO: 34515 - DNA, 628 bp, Artificial Sequence
  chemically treated genomic DNA (Homo sapiens) CpG-island No: 34515
tatattatttaaggtatatattttttatattatatacgttaatttttatagtttacgtaggaaaatttttaagggaatttcggtacgaatttaaggttagatttataagttaggtatatatttatacgtttacgttcgcgcgttgtcggagtttcggggtttgttggttagtatatttttatattcgcggcgcggttttcgggtaatttataggaagttttttatcgagatgcggacgatagagttttttacgaaaggttcggacgattgtaatagcggtagttgcggggtcgaatttttttttttgttcgggattttcgacgaagggtttttcgggagagtttttttggaaggttgggggtttggagttgacgtttttttgttcggagtcgttattttggtttttttagcgttttatagcgattttcgtttttatcgttcggtagtttaggcgtttaagcgtttatttatttaggcgtttcgttttcgcgcgaattgtcgcgaattgttatcgcgcgttcgttttcgcgatttcgcgtcgcgtttgcgtagtttaggttcggcgacgttagtaggttcgtttcgtttttttcgcgtttcgtcgcgttgtgcgaggtttagattgagg

SEQ ID NO: 34516 - DNA, 628 bp, Artificial Sequence
  chemically treated genomic DNA (Homo sapiens) CpG-island No: 34516
cctcaatctaaacctcgcacaacgcgacgaaacgcgaaaaaaacgaaacgaacctactaacgtcgccgaacctaaactacgcaaacgcgacgcgaaatcgcgaaaacgaacgcgcgataacaattcgcgacaattcgcgcgaaaacgaaacgcctaaataaataaacgcttaaacgcctaaactaccgaacgataaaaacgaaaatcgctataaaacgctaaaaaaaccaaaataacgactccgaacaaaaaaacgtcaactccaaacccccaaccttccaaaaaaactctcccgaaaaacccttcgtcgaaaatcccgaacaaaaaaaaaaattcgaccccgcaactaccgctattacaatcgtccgaacctttcgtaaaaaactctatcgtccgcatctcgataaaaaacttcctataaattacccgaaaaccgcgccgcgaatataaaaatatactaaccaacaaaccccgaaactccgacaacgcgcgaacgtaaacgtataaatatatacctaacttataaatctaaccttaaattcgtaccgaaattcccttaaaaattttcctacgtaaactataaaaattaacgtatataatataaaaaatatataccttaaataatata

SEQ ID NO: 34517 - DNA, 778 bp, Artificial Sequence
  chemically treated genomic DNA (Homo sapiens) CpG-island No: 34517
gtagtcgtagtcgttcggcgttcggagcgattttatgtttcggtatcgtagcgcggttcgaaatggaaattagatattgggtagttacgaagtttatgtaggcggtcgcggatatggtgcgggcgacggtagtttaggcggcgcggataaatttggcggtggttgcggaggttcggttcgttttgttttggtttcggacgacgagcgcggcgcggcgcggtacggcgcggcggttaagggggcgggggcgcggggcgttttcgattcgtaggagcgtcgaggcgattttagttttttatttttacgtaatcggtagcgttttcgtacgtagtatttacggtttcgggtttcgtcgcgtcgtcgtttttagtcgtcgtttttgtttcgcgtcggtcgcgatttttcgacgggcgcgtcggtttttttgagtcggtttttttggaaagatgttatacgtggcggtcgtaagtttattcgattgaaaacgttttcgaggcgttgggagaggaaattgtaagagaggtgtacgttttcggtcgtttcgtcgtcgagttaaagttttaggatatttattcgattatttcgacgcgggtggcgagggtttcgtcgagcgttaggtttaagagatattttttttcgagtttattgacggtttttgaatttttgtttcggtcggttcgtatcgtttcggtatttttttgtttagtaataatttcgtagaattttattacgttataaattaaattttttttaattggttagtggggagggtgattta

SEQ ID NO: 34518 - DNA, 778 bp, Artificial Sequence
  chemically treated genomic DNA (Homo sapiens) CpG-island No: 34518
taaatcaccctccccactaaccaattaaaaaaaatttaatttataacgtaataaaattctacgaaattattactaaacaaaaaaataccgaaacgatacgaaccgaccgaaacaaaaattcaaaaaccgtcaataaactcgaaaaaaaatatctcttaaacctaacgctcgacgaaaccctcgccacccgcgtcgaaataatcgaataaatatcctaaaactttaactcgacgacgaaacgaccgaaaacgtacacctctcttacaatttcctctcccaacgcctcgaaaacgttttcaatcgaataaacttacgaccgccacgtataacatctttccaaaaaaaccgactcaaaaaaaccgacgcgcccgtcgaaaaatcgcgaccgacgcgaaacaaaaacgacgactaaaaacgacgacgcgacgaaacccgaaaccgtaaatactacgtacgaaaacgctaccgattacgtaaaaataaaaaactaaaatcgcctcgacgctcctacgaatcgaaaacgccccgcgcccccgcccccttaaccgccgcgccgtaccgcgccgcgccgcgctcgtcgtccgaaaccaaaacaaaacgaaccgaacctccgcaaccaccgccaaatttatccgcgccgcctaaactaccgtcgcccgcaccatatccgcgaccgcctacataaacttcgtaactacccaatatctaatttccatttcgaaccgcgctacgataccgaaacataaaatcgctccgaacgccgaacgactacgactac

SEQ ID NO: 34519 - DNA, 778 bp, Artificial Sequence
  chemically treated genomic DNA (Homo sapiens) CpG-island No: 34519
tgaattattttttttattggttaattggagggggtttggtttgtgacgtgatgggattttgcgaaattgttattgagtaagagaatgtcggaacggtgcggatcggtcggagtaggggtttagaagtcgttagtggattcgggaaaaagtgttttttagatttggcgttcggcgggattttcgttattcgcgtcggggtgatcgggtgaatgttttggggttttggttcgacggcgaggcggtcgagggcgtgtattttttttgtagtttttttttttagcgtttcgggggcgtttttagtcgaataaatttgcgatcgttacgtgtggtatttttttaagggagtcggtttagaggggtcggcgcgttcgtcgggggatcgcggtcggcgcggggtaggggcggcggttagaggcggcggcgcggcggagttcggggtcgtggatgttgcgtgcggaggcgttgtcggttacgtaaagatgaggggttgaggtcgtttcggcgtttttgcgagtcggaagcgtttcgcgttttcgtttttttggtcgtcgcgtcgtgtcgcgtcgcgtcgcgttcgtcgttcgaggttagggtagggcgagtcgaattttcgtagttatcgttaagtttgttcgcgtcgtttgggttgtcgtcgttcgtattatgttcgcggtcgtttatatggatttcgtggttgtttagtgtttggtttttatttcgaatcgcgttgcggtgtcggagtatggggtcgtttcggacgtcgagcggttgcgattat

SEQ ID NO: 34520 - DNA, 778 bp, Artificial Sequence
  chemically treated genomic DNA (Homo sapiens) CpG-island No: 34520
ataatcgcaaccgctcgacgtccgaaacgaccccatactccgacaccgcaacgcgattcgaaataaaaaccaaacactaaacaaccacgaaatccatataaacgaccgcgaacataatacgaacgacgacaacccaaacgacgcgaacaaacttaacgataactacgaaaattcgactcgccctaccctaacctcgaacgacgaacgcgacgcgacgcgacacgacgcgacgaccaaaaaaacgaaaacgcgaaacgcttccgactcgcaaaaacgccgaaacgacctcaacccctcatctttacgtaaccgacaacgcctccgcacgcaacatccacgaccccgaactccgccgcgccgccgcctctaaccgccgcccctaccccgcgccgaccgcgatcccccgacgaacgcgccgacccctctaaaccgactcccttaaaaaaataccacacgtaacgatcgcaaatttattcgactaaaaacgcccccgaaacgctaaaaaaaaaaactacaaaaaaaatacacgccctcgaccgcctcgccgtcgaaccaaaaccccaaaacattcacccgatcaccccgacgcgaataacgaaaatcccgccgaacgccaaatctaaaaaacactttttcccgaatccactaacgacttctaaacccctactccgaccgatccgcaccgttccgacattctcttactcaataacaatttcgcaaaatcccatcacgtcacaaaccaaaccccctccaattaaccaataaaaaaaataattca

SEQ ID NO: 34521 - DNA, 581 bp, Artificial Sequence
  chemically treated genomic DNA (Homo sapiens) CpG-island No: 34521
ggttcgcgggagaagacggtgttaggagataggaggtcgggtttgcgggagaggacggtgttaggagataggaggtcgggttagcgcgagaggacggtgttaggagataggaggtcgggttagcgcgagaggacggtgttaggagataggaggtcgggtttgcgggagaggacggtgttaggagataggaggtcgggttcgcgggagaggacggtgttaggagataggaggtcgggttagcgcgagaggacggtgttaggagataggaggtcgggtttgcgggagaggacggtgttaggagataggaggtcgggtttgcgggagaggacggtgttaggagataggaggtcgggtttgcgggagaggacggtgttaggagataggaggtcgggtttgcgcgagaggacggtgttaggagataggaggtcgggtttgcgggagaggacggtgttaggagatagtaggtcgggtttgcgggagaggacggtgttaggagacgggagttcgggttcgcgggagaggacggtgttaggagacgggagttcgggttcgcgggagaggacggtgttaggagataggag

SEQ ID NO: 34522 - DNA, 581 bp, Artificial Sequence
  chemically treated genomic DNA (Homo sapiens) CpG-island No: 34522
ctcctatctcctaacaccgtcctctcccgcgaacccgaactcccgtctcctaacaccgtcctctcccgcgaacccgaactcccgtctcctaacaccgtcctctcccgcaaacccgacctactatctcctaacaccgtcctctcccgcaaacccgacctcctatctcctaacaccgtcctctcgcgcaaacccgacctcctatctcctaacaccgtcctctcccgcaaacccgacctcctatctcctaacaccgtcctctcccgcaaacccgacctcctatctcctaacaccgtcctctcccgcaaacccgacctcctatctcctaacaccgtcctctcgcgctaacccgacctcctatctcctaacaccgtcctctcccgcgaacccgacctcctatctcctaacaccgtcctctcccgcaaacccgacctcctatctcctaacaccgtcctctcgcgctaacccgacctcctatctcctaacaccgtcctctcgcgctaacccgacctcctatctcctaacaccgtcctctcccgcaaacccgacctcctatctcctaacaccgtcttctcccgcgaacc

SEQ ID NO: 34523 - DNA, 581 bp, Artificial Sequence
  chemically treated genomic DNA (Homo sapiens) CpG-island No: 34523
tttttgttttttagtatcgttttttttcgcgaattcgagttttcgttttttagtatcgttttttttcgcgaattcgagttttcgttttttagtatcgttttttttcgtaaattcgatttgttgttttttagtatcgttttttttcgtaaattcgattttttgttttttagtatcgttttttcgcgtaaattcgattttttgttttttagtatcgttttttttcgtaaattcgattttttgttttttagtatcgttttttttcgtaaattcgattttttgttttttagtatcgttttttttcgtaaattcgattttttgttttttagtatcgttttttcgcgttaattcgattttttgttttttagtatcgttttttttcgcgaattcgattttttgttttttagtatcgttttttttcgtaaattcgattttttgttttttagtatcgttttttcgcgttaattcgattttttgttttttagtatcgttttttcgcgttaattcgattttttgttttttagtatcgttttttttcgtaaattcgattttttgttttttagtatcgttttttttcgcgaatt

SEQ ID NO: 34524 - DNA, 581 bp, Artificial Sequence
  chemically treated genomic DNA (Homo sapiens) CpG-island No: 34524
aattcgcgaaaaaaaacgatactaaaaaacaaaaaatcgaatttacgaaaaaaaacgatactaaaaaacaaaaaatcgaattaacgcgaaaaaacgatactaaaaaacaaaaaatcgaattaacgcgaaaaaacgatactaaaaaacaaaaaatcgaatttacgaaaaaaaacgatactaaaaaacaaaaaatcgaattcgcgaaaaaaaacgatactaaaaaacaaaaaatcgaattaacgcgaaaaaacgatactaaaaaacaaaaaatcgaatttacgaaaaaaaacgatactaaaaaacaaaaaatcgaatttacgaaaaaaaacgatactaaaaaacaaaaaatcgaatttacgaaaaaaaacgatactaaaaaacaaaaaatcgaatttacgcgaaaaaacgatactaaaaaacaaaaaatcgaatttacgaaaaaaaacgatactaaaaaacaacaaatcgaatttacgaaaaaaaacgatactaaaaaacgaaaactcgaattcgcgaaaaaaaacgatactaaaaaacgaaaactcgaattcgcgaaaaaaaacgatactaaaaaacaaaaa

SEQ ID NO: 34525 - DNA, 824 bp, Artificial Sequence
  chemically treated genomic DNA (Homo sapiens) CpG-island No: 34525
tttttgaattttttttttagcgtgaaaatgatattttcgaggggttgggggattgggggagggtagaagggagtcggggagcgggcgcggggggcgcggggagggtagggcgcggcgcgggaaagtttgggggggcgggtgtgtcgcggtattggggttggcggacgggagggcgggcgcgtttttggatcggtcggttttgtgtgttacgcggaggtcggtagcgcggaggtcgaggtcgaggtttcgagttcgcgggtcgtacggcgaggtcggttcgggggcgggtagggcggcggggggcggcggcggtttcgcgaggggcggttcggcggtagcggttgtcgcggcgcggtcggtgcgggtcgggggtgggggcgagggtcggcgtttttttcgcgcgtttttagcgttttcgttttttcggtttgagcggggcgggcggaggagggagcggcggcggcggcggcggcggcggcggcggtattgtgcgcgtattagtagttcggttcgggaggagtaggacgcgtcggggtcgttttttttcgtacggatttatgaattagtcgggcggcgcggcggtttcgtaggtacgacggggggtcgggggtatgtatcgcgcgggggatttcggggggtcggggttcggggcgttgcgttattttattgtaagatttgtaaaatgtaaagtgtttgggtacgtttgcgggttttttgtgggcgtaatcgggagggtcggggttcggagagtattttttcgggcgttgcggggtgcgaggagggtgggggtgacgagggggttttttggggtttttatttagcgt

SEQ ID NO: 34526 - DNA, 824 bp, Artificial Sequence
  chemically treated genomic DNA (Homo sapiens) CpG-island No: 34526
acgctaaataaaaaccccaaaaaaccccctcgtcacccccaccctcctcgcaccccgcaacgcccgaaaaaatactctccgaaccccgaccctcccgattacgcccacaaaaaacccgcaaacgtacccaaacactttacattttacaaatcttacaataaaataacgcaacgccccgaaccccgaccccccgaaatcccccgcgcgatacatacccccgaccccccgtcgtacctacgaaaccgccgcgccgcccgactaattcataaatccgtacgaaaaaaaacgaccccgacgcgtcctactcctcccgaaccgaactactaatacgcgcacaataccgccgccgccgccgccgccgccgccgccgctccctcctccgcccgccccgctcaaaccgaaaaaacgaaaacgctaaaaacgcgcgaaaaaaacgccgaccctcgcccccacccccgacccgcaccgaccgcgccgcgacaaccgctaccgccgaaccgcccctcgcgaaaccgccgccgccccccgccgccctacccgcccccgaaccgacctcgccgtacgacccgcgaactcgaaacctcgacctcgacctccgcgctaccgacctccgcgtaacacacaaaaccgaccgatccaaaaacgcgcccgccctcccgtccgccaaccccaataccgcgacacacccgcccccccaaactttcccgcgccgcgccctaccctccccgcgccccccgcgcccgctccccgactcccttctaccctcccccaatcccccaacccctcgaaaatatcattttcacgctaaaaaaaaaattcaaaaa

SEQ ID NO: 34527 - DNA, 824 bp, Artificial Sequence
  chemically treated genomic DNA (Homo sapiens) CpG-island No: 34527
gcgttgggtgggggttttaaaagattttttcgttatttttatttttttcgtatttcgtagcgttcgggggggtgtttttcggatttcgattttttcgattgcgtttataaaaagttcgtaaacgtgtttaggtattttgtattttgtaaattttgtaatgaagtggcgtagcgtttcgggtttcggtttttcggggtttttcgcgcggtgtatgttttcggtttttcgtcgtatttgcggagtcgtcgcgtcgttcggttggtttatgggttcgtgcgggaggaggcggtttcggcgcgttttgtttttttcgggtcgggttgttggtgcgcgtataatgtcgtcgtcgtcgtcgtcgtcgtcgtcgtcgttttttttttcgttcgtttcgtttaggtcgggggggcgggggcgttgggggcgcgcggggggggcgtcggttttcgtttttattttcggttcgtatcggtcgcgtcgcggtagtcgttgtcgtcgagtcgtttttcgcggggtcgtcgtcgtttttcgtcgttttgttcgttttcgggtcggtttcgtcgtgcggttcgcgagttcggggtttcggtttcggttttcgcgttgtcggttttcgcgtggtatataaagtcggtcggtttaggggcgcgttcgttttttcgttcgttagttttagtgtcgcggtatattcgtttttttaaattttttcgcgtcgcgttttgtttttttcgcgtttttcgcgttcgtttttcggtttttttttgtttttttttagttttttagtttttcggaaatgttatttttacgttggaaaaaaagtttaggga

SEQ ID NO: 34528 - DNA, 824 bp, Artificial Sequence
  chemically treated genomic DNA (Homo sapiens) CpG-island No: 34528
tccctaaactttttttccaacgtaaaaataacatttccgaaaaactaaaaaactaaaaaaaaacaaaaaaaaaccgaaaaacgaacgcgaaaaacgcgaaaaaaacaaaacgcgacgcgaaaaaatttaaaaaaacgaatataccgcgacactaaaactaacgaacgaaaaaacgaacgcgcccctaaaccgaccgactttatataccacgcgaaaaccgacaacgcgaaaaccgaaaccgaaaccccgaactcgcgaaccgcacgacgaaaccgacccgaaaacgaacaaaacgacgaaaaacgacgacgaccccgcgaaaaacgactcgacgacaacgactaccgcgacgcgaccgatacgaaccgaaaataaaaacgaaaaccgacgccccccccgcgcgcccccaacgcccccgcccccccgacctaaacgaaacgaacgaaaaaaaaaacgacgacgacgacgacgacgacgacgacgacattatacgcgcaccaacaacccgacccgaaaaaaacaaaacgcgccgaaaccgcctcctcccgcacgaacccataaaccaaccgaacgacgcgacgactccgcaaatacgacgaaaaaccgaaaacatacaccgcgcgaaaaaccccgaaaaaccgaaacccgaaacgctacgccacttcattacaaaatttacaaaatacaaaatacctaaacacgtttacgaactttttataaacgcaatcgaaaaaatcgaaatccgaaaaacacccccccgaacgctacgaaatacgaaaaaaataaaaataacgaaaaaatcttttaaaacccccacccaacgc

SEQ ID NO: 34529 - DNA, 532 bp, Artificial Sequence
  chemically treated genomic DNA (Homo sapiens) CpG-island No: 34529
tttacggcggtatgatacgagttaaattatttgtttatagtatgtaaatattaggttgcgaatcggcggaaatttgtgacgggttgtacggttttaggttttaaatcgggttaatggtgaagatatcggcgaatagggcgagaatatcgaaggtgaataagtttatggagatagttttggtatcgaatacgggtagaatacggacgtcgatgacgttgtttttcgtgcggtcgggattcgggtattgcgtgtgtttttggaattatataagtgtaacgtgagttgcgattagggtaaggataatgttaggaacgagtaggacgtgtgcgatgtagaagcggtttagtattagattagacgggaagtttttatcgaagatgaattagtgtgtttacgtatcgatgatcgggatggatagaataatcgcggatatgattcgtaggtcgatatcggagagtagatcgttcgggagggagtaatttatgaagtttttaattatgtagaggaggagtagggttatatcgatgagtta

SEQ ID NO: 34530 - DNA, 532 bp, Artificial Sequence
  chemically treated genomic DNA (Homo sapiens) CpG-island No: 34530
taactcatcgatataaccctactcctcctctacataattaaaaacttcataaattactccctcccgaacgatctactctccgatatcgacctacgaatcatatccgcgattattctatccatcccgatcatcgatacgtaaacacactaattcatcttcgataaaaacttcccgtctaatctaatactaaaccgcttctacatcgcacacgtcctactcgttcctaacattatccttaccctaatcgcaactcacgttacacttatataattccaaaaacacacgcaatacccgaatcccgaccgcacgaaaaacaacgtcatcgacgtccgtattctacccgtattcgataccaaaactatctccataaacttattcaccttcgatattctcgccctattcgccgatatcttcaccattaacccgatttaaaacctaaaaccgtacaacccgtcacaaatttccgccgattcgcaacctaatatttacatactataaacaaataatttaactcgtatcataccgccgtaaa

SEQ ID NO: 34531 - DNA, 532 bp, Artificial Sequence
  chemically treated genomic DNA (Homo sapiens) CpG-island No: 34531
tggtttatcggtgtgattttgttttttttttgtatggttgagggttttatgggttattttttttcggacgatttgtttttcggtgtcggtttgcgaattatgttcgcgattattttgtttatttcgattatcggtacgtggatatattggtttattttcggtggagatttttcgtttgatttgatgttggatcgtttttatatcgtatacgttttgttcgtttttggtattatttttgttttgatcgtagtttacgttgtatttgtatggttttagaagtatacgtagtattcgggtttcggtcgtacggagaataacgttatcggcgttcgtattttgttcgtattcggtattaaggttatttttatgggtttgtttattttcggtgttttcgttttgttcgtcggtatttttattattaattcgatttggaatttggggtcgtataattcgttataggttttcgtcggttcgtagtttgatatttatatgttgtggatagatggtttggttcgtattatgtcgtcgtggg

SEQ ID NO: 34532 - DNA, 532 bp, Artificial Sequence
  chemically treated genomic DNA (Homo sapiens) CpG-island No: 34532
cccacgacgacataatacgaaccaaaccatctatccacaacatataaatatcaaactacgaaccgacgaaaacctataacgaattatacgaccccaaattccaaatcgaattaataataaaaataccgacgaacaaaacgaaaacaccgaaaataaacaaacccataaaaataaccttaataccgaatacgaacaaaatacgaacgccgataacgttattctccgtacgaccgaaacccgaatactacgtatacttctaaaaccatacaaatacaacgtaaactacgatcaaaacaaaaataataccaaaaacgaacaaaacgtatacgatataaaaacgatccaacatcaaatcaaacgaaaaatctccaccgaaaataaaccaatatatccacgtaccgataatcgaaataaacaaaataatcgcgaacataattcgcaaaccgacaccgaaaaacaaatcgtccgaaaaaaaataacccataaaaccctcaaccatacaaaaaaaaaacaaaatcacaccgataaacca

SEQ ID NO: 34533 - DNA, 518 bp, Artificial Sequence
  chemically treated genomic DNA (Homo sapiens) CpG-island No: 34533
cgtgtatattcgtacgcgcgtatttcgttcggatttcgtgttcgttcgtcggttttcgttcggttttcgttacgtcgcgtttcgtttagtttttattcggatttttagatttcgttcggttttcgttcgttttatcggatttcgggatttcgcgttcggttcgtcggttttatttggatttatggatttcgttcggatttcgggacgtcgcgtttcgtttattttgttcgcgggttttcgcgtcggtcggtggatttcgttcgttttttatttatttcgcggggattcgggacgtcgcgttcggttcgttggtttttattcggattcgcggatttcgttcggttttcgggacgtcgcgtttcgttcgttttttcgggaagtttcgcgttttgtatcgtcggcgttgttcgttcgtattcgtttttttttttcgcgtttcgtgtcggttttcgaaggtcgagggaggcgacggattcgaagcggtcgagtcgcgttcgggagttgcgggcgacgttcgt

SEQ ID NO: 34534 - DNA, 518 bp, Artificial Sequence
  chemically treated genomic DNA (Homo sapiens) CpG-island No: 34534
acgaacgtcgcccgcaactcccgaacgcgactcgaccgcttcgaatccgtcgcctccctcgaccttcgaaaaccgacacgaaacgcgaaaaaaaaaaacgaatacgaacgaacaacgccgacgatacaaaacgcgaaacttcccgaaaaaacgaacgaaacgcgacgtcccgaaaaccgaacgaaatccgcgaatccgaataaaaaccaacgaaccgaacgcgacgtcccgaatccccgcgaaataaataaaaaacgaacgaaatccaccgaccgacgcgaaaacccgcgaacaaaataaacgaaacgcgacgtcccgaaatccgaacgaaatccataaatccaaataaaaccgacgaaccgaacgcgaaatcccgaaatccgataaaacgaacgaaaaccgaacgaaatctaaaaatccgaataaaaactaaacgaaacgcgacgtaacgaaaaccgaacgaaaaccgacgaacgaacacgaaatccgaacgaaatacgcgcgtacgaatatacacg

SEQ ID NO: 34535 - DNA, 518 bp, Artificial Sequence
  chemically treated genomic DNA (Homo sapiens) CpG-island No: 34535
acgggcgtcgttcgtagttttcgggcgcgattcggtcgtttcggattcgtcgtttttttcggttttcggaggtcggtacgggacgcgggaggagggagcgggtgcggacgagtagcgtcggcggtgtagggcgcggggtttttcggagggacgagcggagcgcggcgtttcggggatcgggcggggttcgcgagttcgggtgaggattagcgggtcgagcgcggcgtttcgggttttcgcggggtgagtgggggacgggcggggtttatcgatcggcgcgaggattcgcgagtagggtgagcggggcgcggcgtttcggggttcgggcggggtttatgagtttaagtgggatcggcgagtcgggcgcggagtttcggggttcggtggggcgggcggggatcgggcggggtttgggggttcgggtgaggattgagcggagcgcggcgtgacggggatcgggcggggatcggcgagcgggtacggggttcgggcggggtgcgcgcgtgcgagtgtgtacg

SEQ ID NO: 34536 - DNA, 518 bp, Artificial Sequence
  chemically treated genomic DNA (Homo sapiens) CpG-island No: 34536
cgtacacactcgcacgcgcgcaccccgcccgaaccccgtacccgctcgccgatccccgcccgatccccgtcacgccgcgctccgctcaatcctcacccgaacccccaaaccccgcccgatccccgcccgccccaccgaaccccgaaactccgcgcccgactcgccgatcccacttaaactcataaaccccgcccgaaccccgaaacgccgcgccccgctcaccctactcgcgaatcctcgcgccgatcgataaaccccgcccgtcccccactcaccccgcgaaaacccgaaacgccgcgctcgacccgctaatcctcacccgaactcgcgaaccccgcccgatccccgaaacgccgcgctccgctcgtccctccgaaaaaccccgcgccctacaccgccgacgctactcgtccgcacccgctccctcctcccgcgtcccgtaccgacctccgaaaaccgaaaaaaacgacgaatccgaaacgaccgaatcgcgcccgaaaactacgaacgacgcccgt

SEQ ID NO: 34537 - DNA, 706 bp, Artificial Sequence
  chemically treated genomic DNA (Homo sapiens) CpG-island No: 34537
gacgttggcggcgcgggagatggcgtttcgggtttttttggagatgttgatatcgttcgggagttgcgaggagatcgggggtgagtaaagttgtcgttttagtatttgttttttttttgttcgttcgttcgtttttttcgagttgtttatcgtttttttgatgattttggtgattacggtattgggtaggtttaggttttcgggttttttcgttattgtcgtcgttggggtttaaattttttttcgttttcgttttagggagttattgcgttcggatttttcgcgtcgttacggtttgattttgcgaggttttcgtttcgttttacgtggtttatagtgttttatagtgttttgagcgttatagttttttttttttttttatagattcgttttcgttttaaatatcggcgtattcggattttgaagtcgtagtggttttggttcgttaaggtttttatttaattttatagtatttcgtacgtttttttttaggtttatttttttgtttttcgttatcgtcgcgtcgggaatttttttattaatttatttggtttaatggagttttcgttcgttttttatggtgttttgcgtcgttgttgggtgacggcgcggtcgggcgtagcgcgtgggagacgaaagcgtgttgattcggtagggcggatttttttaggattttaggtaggtttgggggttcgtcgggttcgtt

SEQ ID NO: 34538 - DNA, 706 bp, Artificial Sequence
  chemically treated genomic DNA (Homo sapiens) CpG-island No: 34538
aacgaacccgacgaacccccaaacctacctaaaatcctaaaaaaatccgccctaccgaatcaacacgctttcgtctcccacgcgctacgcccgaccgcgccgtcacccaacaacgacgcaaaacaccataaaaaacgaacgaaaactccattaaaccaaataaattaataaaaaaattcccgacgcgacgataacgaaaaacaaaaaaataaacctaaaaaaaaacgtacgaaatactataaaattaaataaaaaccttaacgaaccaaaaccactacgacttcaaaatccgaatacgccgatatttaaaacgaaaacgaatctataaaaaaaaaaaaaaaactataacgctcaaaacactataaaacactataaaccacgtaaaacgaaacgaaaacctcgcaaaatcaaaccgtaacgacgcgaaaaatccgaacgcaataactccctaaaacgaaaacgaaaaaaaatttaaaccccaacgacgacaataacgaaaaaacccgaaaacctaaacctacccaataccgtaatcaccaaaatcatcaaaaaaacgataaacaactcgaaaaaaacgaacgaacgaacaaaaaaaaaacaaatactaaaacgacaactttactcacccccgatctcctcgcaactcccgaacgatatcaacatctccaaaaaaacccgaaacgccatctcccgcgccgccaacgtc

SEQ ID NO: 34539 - DNA, 706 bp, Artificial Sequence
  chemically treated genomic DNA (Homo sapiens) CpG-island No: 34539
aacggattcggcgggtttttaagtttgtttagggttttaaagggattcgttttgtcgagttagtacgttttcgttttttacgcgttgcgttcggtcgcgtcgttatttagtagcggcgtagggtattatgggaaacggacggaagttttattgagttaaataagttggtgagaaggttttcgacgcggcgatggcgagaagtagagaaatggatttgggaaggggcgtgcggggtgttgtagggttggatggaagttttggcgggttaaaattattgcggttttaaaattcggatgcgtcggtatttgaggcggaggcgggtttgtggggggaggagggaggttatggcgtttagagtattgtgggatattgtaggttacgtggggcggaacggaaatttcgtagggttagatcgtagcgacgcgggaagttcggacgtagtagttttttgaagcggaggcgaaggggagtttaagttttagcggcggtaatggcggagaggttcgaggatttaaatttgtttaatgtcgtgattattaggattattaaggaggcggtgagtagttcggggggggcggacgaacgggtaggagggaagtaggtgttggaacggtagttttgtttattttcggttttttcgtagttttcggacggtgttaatatttttaaggaggttcggagcgttatttttcgcgtcgttagcgtt

SEQ ID NO: 34540 - DNA, 706 bp, Artificial Sequence
  chemically treated genomic DNA (Homo sapiens) CpG-island No: 34540
aacgctaacgacgcgaaaaataacgctccgaacctccttaaaaatattaacaccgtccgaaaactacgaaaaaaccgaaaataaacaaaactaccgttccaacacctacttccctcctacccgttcgtccgccccccccgaactactcaccgcctccttaataatcctaataatcacgacattaaacaaatttaaatcctcgaacctctccgccattaccgccgctaaaacttaaactccccttcgcctccgcttcaaaaaactactacgtccgaacttcccgcgtcgctacgatctaaccctacgaaatttccgttccgccccacgtaacctacaatatcccacaatactctaaacgccataacctccctcctccccccacaaacccgcctccgcctcaaataccgacgcatccgaattttaaaaccgcaataattttaacccgccaaaacttccatccaaccctacaacaccccgcacgccccttcccaaatccatttctctacttctcgccatcgccgcgtcgaaaaccttctcaccaacttatttaactcaataaaacttccgtccgtttcccataataccctacgccgctactaaataacgacgcgaccgaacgcaacgcgtaaaaaacgaaaacgtactaactcgacaaaacgaatccctttaaaaccctaaacaaacttaaaaacccgccgaatccgtt

SEQ ID NO: 34541 - DNA, 522 bp, Artificial Sequence
  chemically treated genomic DNA (Homo sapiens) CpG-island No: 34541
ttttacgtttcggttttagtcgtttacgtgcgttttttcgcgtttttttttcgtaggtttagcggttttcggcgttgcggttatttatttttaatgtagtcgtgtagggtgattatgcgcgttcgttcggggttgttgaacggggtgtagtggatgtcgtcggatagggcggagggaaggcgggacgggggcgttttcgagggcggtattgggtgttgcggcgtgtgttttttatgacgcgttcggtagttttgaaattatatttggaacgatagtttcggtagttttagtttcgaggaaaagagtcggacgcgtcgtcgggagattttaggcgggattgtttcgtcgttttttggagaaggatggttacgtgtacgtattatttttcgcgtcgagtttagttacgagtttcggggcgtgttcgcggtttttaggtttcgtttattttcgttttatttggatgatttttcggttgaggttcgttatgttcgttagtttttgtagtcgttgagcgtgagggtt

SEQ ID NO: 34542 - DNA, 522 bp, Artificial Sequence
  chemically treated genomic DNA (Homo sapiens) CpG-island No: 34542
aaccctcacgctcaacgactacaaaaactaacgaacataacgaacctcaaccgaaaaatcatccaaataaaacgaaaataaacgaaacctaaaaaccgcgaacacgccccgaaactcgtaactaaactcgacgcgaaaaataatacgtacacgtaaccatccttctccaaaaaacgacgaaacaatcccgcctaaaatctcccgacgacgcgtccgactcttttcctcgaaactaaaactaccgaaactatcgttccaaatataatttcaaaactaccgaacgcgtcataaaaaacacacgccgcaacacccaataccgccctcgaaaacgcccccgtcccgccttccctccgccctatccgacgacatccactacaccccgttcaacaaccccgaacgaacgcgcataatcaccctacacgactacattaaaaataaataaccgcaacgccgaaaaccgctaaacctacgaaaaaaaaacgcgaaaaaacgcacgtaaacgactaaaaccgaaacgtaaaa

SEQ ID NO: 34543 - DNA, 522 bp, Artificial Sequence
  chemically treated genomic DNA (Homo sapiens) CpG-island No: 34543
aatttttacgtttagcggttgtaggagttggcggatatgacgggttttagtcggagagttatttaggtgggacgggggtgggcggggtttggggatcgcgggtacgtttcggagttcgtagttgggttcggcgcggagggtggtgcgtgtacgtggttatttttttttaggaggcgacgaggtagtttcgtttggggtttttcggcggcgcgttcgattttttttttcgaggttgaggttgtcgaggttgtcgttttaggtgtggttttaaaattgtcgggcgcgttataaaaagtatacgtcgtaatatttagtgtcgttttcgggggcgttttcgtttcgtttttttttcgttttgttcgacgatatttattatatttcgtttagtagtttcgagcgggcgcgtatggttattttgtacggttatattgagagtaagtaatcgtagcgtcgggagtcgttgggtttgcggggagggggcgcggaggagcgtacgtgggcggttgaggtcgaggcgtgggg

SEQ ID NO: 34544 - DNA, 522 bp, Artificial Sequence
  chemically treated genomic DNA (Homo sapiens) CpG-island No: 34544
ccccacgcctcgacctcaaccgcccacgtacgctcctccgcgccccctccccgcaaacccaacgactcccgacgctacgattacttactctcaatataaccgtacaaaataaccatacgcgcccgctcgaaactactaaacgaaatataataaatatcgtcgaacaaaacgaaaaaaaaacgaaacgaaaacgcccccgaaaacgacactaaatattacgacgtatactttttataacgcgcccgacaattttaaaaccacacctaaaacgacaacctcgacaacctcaacctcgaaaaaaaaaatcgaacgcgccgccgaaaaaccccaaacgaaactacctcgtcgcctcctaaaaaaaaataaccacgtacacgcaccaccctccgcgccgaacccaactacgaactccgaaacgtacccgcgatccccaaaccccgcccacccccgtcccacctaaataactctccgactaaaacccgtcatatccgccaactcctacaaccgctaaacgtaaaaatt

SEQ ID NO: 34545 - DNA, 573 bp, Artificial Sequence
  chemically treated genomic DNA (Homo sapiens) CpG-island No: 34545
agtcggcgattcgggattcgaatttgcgttttaaagtcgaggggcggagtcgggagtgaacgtcggggttagcggagtacgggatcgcgtttttttcgttcgttcgggtcgtttcgcgggcgttttttttttttttatgttcgcgcggggtcgggaattttttgtcgggtcgcggttcgcgaataatgcgcgttttttgttcgttcggtcgggtcgcggttcgtttatttttcgttttgcggtcgtcgggaaatgatagtagttcgggatcgtcgcgcgggtatacggggtcgcgtttcgggagacggacggggtcgtttatcgagggtcgtcgggcgagggtgcgaggtgatttagcgacgggtaagcggtagcgggtaggcggtcgttatgtatttaggcgcgcgtataagttttttgtcggtcgtattttttgtaatatgcgtgtttgtgttatgtatttaagtttttattgtacgttgtacgtgttttatatagtcgtattgtttgcgtcgatatttacgtgttgtttttatacgtggtggttgagtgggtgggtatttgttagggatt

SEQ ID NO: 34546 - DNA, 573 bp, Artificial Sequence
  chemically treated genomic DNA (Homo sapiens) CpG-island No: 34546
aatccctaacaaatacccacccactcaaccaccacgtataaaaacaacacgtaaatatcgacgcaaacaatacgactatataaaacacgtacaacgtacaataaaaacttaaatacataacacaaacacgcatattacaaaaaatacgaccgacaaaaaacttatacgcgcgcctaaatacataacgaccgcctacccgctaccgcttacccgtcgctaaatcacctcgcaccctcgcccgacgaccctcgataaacgaccccgtccgtctcccgaaacgcgaccccgtatacccgcgcgacgatcccgaactactatcatttcccgacgaccgcaaaacgaaaaataaacgaaccgcgacccgaccgaacgaacaaaaaacgcgcattattcgcgaaccgcgacccgacaaaaaattcccgaccccgcgcgaacataaaaaaaaaaaaaacgcccgcgaaacgacccgaacgaacgaaaaaaacgcgatcccgtactccgctaaccccgacgttcactcccgactccgcccctcgactttaaaacgcaaattcgaatcccgaatcgccgact

SEQ ID NO: 34547 - DNA, 573 bp, Artificial Sequence
  chemically treated genomic DNA (Homo sapiens) CpG-island No: 34547
ggtttttggtagatgtttatttatttagttattacgtgtggaagtaatacgtggatgtcggcgtaggtaatgcggttgtgtggggtacgtgtagcgtgtagtggagatttaggtgtatggtatagatacgtatgttataaggggtgcgatcggtagaaggtttgtgcgcgcgtttgaatatatgacggtcgtttgttcgttgtcgtttgttcgtcgttaggttatttcgtattttcgttcggcggttttcggtgggcggtttcgttcgtttttcggggcgcgatttcgtgtattcgcgcggcggtttcgggttgttgttatttttcggcggtcgtagggcggggagtgagcgggtcgcggttcggtcgggcgggtaggaagcgcgtattgttcgcgggtcgcggttcggtagggagttttcggtttcgcgcggatataaaaggagaaagagcgttcgcggagcggttcgggcggacgggggaagcgcggtttcgtgtttcgttgatttcggcgtttattttcggtttcgtttttcggttttgaggcgtagattcgaatttcgggtcgtcgatt

SEQ ID NO: 34548 - DNA, 573 bp, Artificial Sequence
  chemically treated genomic DNA (Homo sapiens) CpG-island No: 34548
aatcgacgacccgaaattcgaatctacgcctcaaaaccgaaaaacgaaaccgaaaataaacgccgaaatcaacgaaacacgaaaccgcgcttcccccgtccgcccgaaccgctccgcgaacgctctttctccttttatatccgcgcgaaaccgaaaactccctaccgaaccgcgacccgcgaacaatacgcgcttcctacccgcccgaccgaaccgcgacccgctcactccccgccctacgaccgccgaaaaataacaacaacccgaaaccgccgcgcgaatacacgaaatcgcgccccgaaaaacgaacgaaaccgcccaccgaaaaccgccgaacgaaaatacgaaataacctaacgacgaacaaacgacaacgaacaaacgaccgtcatatattcaaacgcgcgcacaaaccttctaccgatcgcaccccttataacatacgtatctataccatacacctaaatctccactacacgctacacgtaccccacacaaccgcattacctacgccgacatccacgtattacttccacacgtaataactaaataaataaacatctaccaaaaacc

SEQ ID NO: 34549 - DNA, 621 bp, Artificial Sequence
  chemically treated genomic DNA (Homo sapiens) CpG-island No: 34549
  misc_feature (224)..(224): n is either a, c, g or t
  misc_feature (288)..(289): n is either a, c, g or t
  misc_feature (302)..(302): n is either a, c, g or t
  misc_feature (325)..(325): n is either a, c, g or t
  misc_feature (362)..(362): n is either a, c, g or t
  misc_feature (375)..(375): n is either a, c, g or t
  misc_feature (400)..(400): n is either a, c, g or t
  misc_feature (459)..(459): n is either a, c, g or t
  misc_feature (533)..(533): n is either a, c, g or t
gaattgttaggcgacgaaaaaaattatttattttaggtgtttttgcgttagaggcgggttttttttttgtttttttttgttcgtttttaaattttttttcggattttaattttcgtcgtgttttgcgttgagatttttgcggtaaagaatcgggttgtgtttaaagtgttttttggaagttgtagtttttgtattggtgaggtaaggaggaagcggagtgattncgcggttattagttgtgtgtagttgttcgggattaggagtttaagtgaagaggtacgttttgtnntcgtggaattagncgtagttatgagtttttgtcggngttagtttttagagtacggagtagcggattttttcgntttttcgtttcgntaggtggcggggtttattaggtttncggggtatttttcgttttaagtaggttttatttgtcggtaagggcgttcgaaacgcggnaggcgttatgtcgttggttgtttacgttagtagcgatgagagcgagtcggatgaggttgagttcgagtcggagnaagaggaggcggtggtttttatatttgggttcgttttagggggtttgttcgtttttttttttgcgtttaagggttcggttttgttgtt

SEQ ID NO: 34550 - DNA, 621 bp, Artificial Sequence
  chemically treated genomic DNA (Homo sapiens) CpG-island No: 34550
  misc_feature (89)..(89): n is either a, c, g or t
  misc_feature (163)..(163): n is either a, c, g or t
  misc_feature (222)..(222): n is either a, c, g or t
  misc_feature (247)..(247): n is either a, c, g or t
  misc_feature (260)..(260): n is either a, c, g or t
  misc_feature (297)..(297): n is either a, c, g or t
  misc_feature (320)..(320): n is either a, c, g or t
  misc_feature (333)..(334): n is either a, c, g or t
  misc_feature (398)..(398): n is either a, c, g or t
aacaacaaaaccgaacccttaaacgcaaaaaaaaaaacgaacaaaccccctaaaacgaacccaaatataaaaaccaccgcctcctcttnctccgactcgaactcaacctcatccgactcgctctcatcgctactaacgtaaacaaccaacgacataacgcctnccgcgtttcgaacgcccttaccgacaaataaaacctacttaaaacgaaaaataccccgnaaacctaataaaccccgccacctancgaaacgaaaaancgaaaaaatccgctactccgtactctaaaaactaacnccgacaaaaactcataactacgnctaattccacgannacaaaacgtacctcttcacttaaactcctaatcccgaacaactacacacaactaataaccgcgnaatcactccgcttcctccttacctcaccaatacaaaaactacaacttccaaaaaacactttaaacacaacccgattctttaccgcaaaaatctcaacgcaaaacacgacgaaaattaaaatccgaaaaaaaatttaaaaacgaacaaaaaaaaacaaaaaaaaaacccgcctctaacgcaaaaacacctaaaataaataatttttttcgtcgcctaacaattc

SEQ ID NO: 34551 - DNA, 621 bp, Artificial Sequence
  chemically treated genomic DNA (Homo sapiens) CpG-island No: 34551
  misc_feature (89)..(89): n is either a, c, g or t
  misc_feature (163)..(163): n is either a, c, g or t
  misc_feature (222)..(222): n is either a, c, g or t
  misc_feature (247)..(247): n is either a, c, g or t
  misc_feature (260)..(260): n is either a, c, g or t
  misc_feature (297)..(297): n is either a, c, g or t
  misc_feature (320)..(320): n is either a, c, g or t
  misc_feature (333)..(334): n is either a, c, g or t
  misc_feature (398)..(398): n is either a, c, g or t
ggtagtaaggtcggatttttgggcgtagggagagaagcgaataagttttttaaagcgggtttagatgtaggagttatcgtttttttttntttcggttcgggtttagttttattcggttcgtttttatcgttgttggcgtaagtaattagcgatatggcgtttntcgcgtttcgggcgtttttgtcggtagatgaggtttatttgagacgggggatgtttcgnaggtttagtaggtttcgttatttgncggggcggggaancgaaaaagttcgttgtttcgtattttaggggttagtntcggtagaaatttatggttacgnttgattttacgannataaggcgtatttttttatttaagtttttagtttcgggtaattatatatagttaatggtcgcgnagttatttcgttttttttttgttttattaatataggaattataatttttagagaatattttggatatagttcggttttttgtcgtagggattttagcgtaaggtacggcgggagttggagttcgaggaaggatttaggggcgagtaaagggagataggagagaaattcgtttttgacgtagggatatttggggtgagtagtttttttcgtcgtttaataattt

SEQ ID NO: 34552 - DNA, 621 bp, Artificial Sequence
  chemically treated genomic DNA (Homo sapiens) CpG-island No: 34552
  misc_feature (224)..(224): n is either a, c, g or t
  misc_feature (288)..(289): n is either a, c, g or t
  misc_feature (302)..(302): n is either a, c, g or t
  misc_feature (325)..(325): n is either a, c, g or t
  misc_feature (362)..(362): n is either a, c, g or t
  misc_feature (375)..(375): n is either a, c, g or t
  misc_feature (400)..(400): n is either a, c, g or t
  misc_feature (459)..(459): n is either a, c, g or t
  misc_feature (533)..(533): n is either a, c, g or t
aaattattaaacgacgaaaaaaactactcaccccaaatatccctacgtcaaaaacgaatttctctcctatctccctttactcgcccctaaatccttcctcgaactccaactcccgccgtaccttacgctaaaatccctacgacaaaaaaccgaactatatccaaaatattctctaaaaattataattcctatattaataaaacaaaaaaaaaacgaaataactncgcgaccattaactatatataattacccgaaactaaaaacttaaataaaaaaatacgccttatnntcgtaaaatcaancgtaaccataaatttctaccganactaacccctaaaatacgaaacaacgaactttttcgnttccccgccccgncaaataacgaaacctactaaacctncgaaacatcccccgtctcaaataaacctcatctaccgacaaaaacgcccgaaacgcganaaacgccatatcgctaattacttacgccaacaacgataaaaacgaaccgaataaaactaaacccgaaccgaaanaaaaaaaaacgataactcctacatctaaacccgctttaaaaaacttattcgcttctctccctacgcccaaaaatccgaccttactacc

SEQ ID NO: 34553 - DNA, 1111 bp, Artificial Sequence
  chemically treated genomic DNA (Homo sapiens) CpG-island No: 34553
gcgtcgacgtgtgaaattgattttaaagaaaataggcggtggtttttttttcggttttacgtggtttagtagcgtttatttttcgttttttttttcgcgtttagtaattaatttaggtcgtttttgtagaattcgggtttttgtttatcggtttatagcgtttatttgaggtttcgtttttttagtaaaggtcgttttttcggaacgcgttttttgcggtttttttagagtttttttcgcgcgtttttttagtttcgttcgttttttttcggggtttttttttttcgtttgtttttaggttcgttttttttcgcgggttgaggtaggttcgggtagtacggtcgtttcggggcgggggttattttttattatcgcgtggtgtttatagtttacggcgttttcgggtgacggttttttcggttgtagggcgttttgaagagcggtttgttcggagttgagcgtacggggttgtttcgttttgggcgtttttggtttttattagtttcgtttttttatgggtaaaacggcggttttgtttgtttataagtaatcgtcggggttacggaggggttaggagttgcggcggggggttgtgtttttaggatcggttttaggaggattcgcgcgaggtttggagtttttaggggtcgcgggggatagaggggttttaagcggaggcggggaaggcggtagaagtttaggatcgttaagagttggcgaggaagttcggggttcgttgtcgggggagtcgggtaggggtcgcgtttcggattaggacggaggtttggggaaggcggatttggtcgtcggagacgcggtgcgggtggagacgagggatttggattttcgcgggcggttgtacggatttttacgcgcggtttacgtgggttttaggggggtgttcggtattcggggtcgcgtcgtttttttttcgtcggtatcgattcgtagttttacgtttacgcggcggcgttcgtagtttttttcggttcggttttcgcgcgtgttttcgagcgcgttttcgggattagttttcggaagtagagaggttaggtcgggaaggatgggcgacgggggtggttgattcgggagtacggtagggaggatattt

SEQ ID NO: 34554 - DNA, 1111 bp, Artificial Sequence
  chemically treated genomic DNA (Homo sapiens) CpG-island No: 34554
aaatatcctccctaccgtactcccgaatcaaccacccccgtcgcccatccttcccgacctaacctctctacttccgaaaactaatcccgaaaacgcgctcgaaaacacgcgcgaaaaccgaaccgaaaaaaactacgaacgccgccgcgtaaacgtaaaactacgaatcgataccgacgaaaaaaaaacgacgcgaccccgaataccgaacacccccctaaaacccacgtaaaccgcgcgtaaaaatccgtacaaccgcccgcgaaaatccaaatccctcgtctccacccgcaccgcgtctccgacgaccaaatccgccttccccaaacctccgtcctaatccgaaacgcgacccctacccgactcccccgacaacgaaccccgaacttcctcgccaactcttaacgatcctaaacttctaccgccttccccgcctccgcttaaaacccctctatcccccgcgacccctaaaaactccaaacctcgcgcgaatcctcctaaaaccgatcctaaaaacacaaccccccgccgcaactcctaacccctccgtaaccccgacgattacttataaacaaacaaaaccgccgttttacccataaaaaaacgaaactaataaaaaccaaaaacgcccaaaacgaaacaaccccgtacgctcaactccgaacaaaccgctcttcaaaacgccctacaaccgaaaaaaccgtcacccgaaaacgccgtaaactataaacaccacgcgataataaaaaataacccccgccccgaaacgaccgtactacccgaacctacctcaacccgcgaaaaaaaacgaacctaaaaacaaacgaaaaaaaaaaaccccgaaaaaaaacgaacgaaactaaaaaaacgcgcgaaaaaaactctaaaaaaaccgcaaaaaacgcgttccgaaaaaacgacctttactaaaaaaacgaaacctcaaataaacgctataaaccgataaacaaaaacccgaattctacaaaaacgacctaaattaattactaaacgcgaaaaaaaaaacgaaaaataaacgctactaaaccacgtaaaaccgaaaaaaaaaccaccgcctattttctttaaaatcaatttcacacgtcgacgc

SEQ ID NO: 34555 - DNA, 1111 bp, Artificial Sequence
  chemically treated genomic DNA (Homo sapiens) CpG-island No: 34555
gggtgttttttttgtcgtgttttcgggttagttattttcgtcgtttatttttttcggtttggtttttttgttttcgggggttgatttcgagggcgcgttcgggggtacgcgcggaagtcgggtcgaagggggttgcgggcgtcgtcgcgtaaacgtgaggttgcgggtcgatgtcggcgaggagaaggcggcgcggtttcgggtgtcgggtatttttttggggtttacgtgaatcgcgcgtggaaattcgtgtagtcgttcgcggaaatttaaatttttcgtttttattcgtatcgcgttttcggcggttagattcgttttttttaggttttcgttttggttcgaggcgcggtttttgttcggttttttcgatagcgagtttcgggttttttcgttagtttttggcggttttgggtttttgtcgtttttttcgttttcgtttggggtttttttgtttttcgcgatttttgagagttttagatttcgcgcggatttttttggggtcggttttgagagtatagtttttcgtcgtagtttttggttttttcgtaatttcgacggttatttgtggataaataggatcgtcgttttgtttatgggaagacggggttggtgagggttagagacgtttagggcgaggtaatttcgtgcgtttagtttcgagtaggtcgttttttaggacgttttatagtcgaggggatcgttattcgggagcgtcgtgagttgtgggtattacgcggtggtggagagtgattttcgtttcggggcggtcgtgttgttcgaatttgttttagttcgcgaggggagacgggtttgggggtaggcgggagagggaggtttcgggaggaggcgagcggggttgagaggacgcgcgggaggggttttggagaggtcgtaggaggcgcgtttcggagggacgatttttgttgggaggacgaggttttaggtggacgttgtgggtcggtgggtaggagttcgagttttgtaggagcggtttaaattggttattgagcgcggaagaagggacggaaggtgagcgttattgggttacgtggggtcgagagaaaggttatcgtttgttttttttaaaattagttttatacgtcgacgt

SEQ ID NO: 34556 - DNA, 1111 bp, Artificial Sequence
  chemically treated genomic DNA (Homo sapiens) CpG-island No: 34556
acgtcgacgtataaaactaattttaaaaaaaacaaacgataacctttctctcgaccccacgtaacccaataacgctcaccttccgtcccttcttccgcgctcaataaccaatttaaaccgctcctacaaaactcgaactcctacccaccgacccacaacgtccacctaaaacctcgtcctcccaacaaaaatcgtccctccgaaacgcgcctcctacgacctctccaaaacccctcccgcgcgtcctctcaaccccgctcgcctcctcccgaaacctccctctcccgcctacccccaaacccgtctcccctcgcgaactaaaacaaattcgaacaacacgaccgccccgaaacgaaaatcactctccaccaccgcgtaatacccacaactcacgacgctcccgaataacgatcccctcgactataaaacgtcctaaaaaacgacctactcgaaactaaacgcacgaaattacctcgccctaaacgtctctaaccctcaccaaccccgtcttcccataaacaaaacgacgatcctatttatccacaaataaccgtcgaaattacgaaaaaaccaaaaactacgacgaaaaactatactctcaaaaccgaccccaaaaaaatccgcgcgaaatctaaaactctcaaaaatcgcgaaaaacaaaaaaaccccaaacgaaaacgaaaaaaacgacaaaaacccaaaaccgccaaaaactaacgaaaaaacccgaaactcgctatcgaaaaaaccgaacaaaaaccgcgcctcgaaccaaaacgaaaacctaaaaaaaacgaatctaaccgccgaaaacgcgatacgaataaaaacgaaaaatttaaatttccgcgaacgactacacgaatttccacgcgcgattcacgtaaaccccaaaaaaatacccgacacccgaaaccgcgccgccttctcctcgccgacatcgacccgcaacctcacgtttacgcgacgacgcccgcaacccccttcgacccgacttccgcgcgtacccccgaacgcgccctcgaaatcaacccccgaaaacaaaaaaaccaaaccgaaaaaaataaacgacgaaaataactaacccgaaaacacgacaaaaaaaacaccc

SEQ ID NO: 34557 - DNA, 612 bp, Artificial Sequence
  chemically treated genomic DNA (Homo sapiens) CpG-island No: 34557
gcgagtagcgtcgttttttttttttaggacgggcgggaatttgcgatgttttcgtcgcgtgggtcgtggggcggttttcgaggtattgggcggggtacgcggtgggcgttttacggaattcgtattttttagttttcgtaatttaggaggaagtttacggcgttttgtatcggcgtcggcgcgttaacgcgtttttggaggagttgcggtcgggttttttggagagggagtgtaaggaggagtagtgttttttcgaggaggttcgggagatttttaaggacgcggagaggacggtgagtttagtttcggggcgtttcgcgtcgcggatattgtaggcggcggtgaattaggtcgcgtggggttatttgcgtttttttggttgcggttgtgggcggcgaatacgtagcggcgttcgcgcggcgttttttgcgggggtcgtttttcgttcggggtgatttcgtttttttgggcgatgttttttatttttaggtacgcgtttttttcgtgcggtcgtatcgcgtatgtcggtttttatattagaaaatacgatttgtaaagtatatttagggtgttttttttaattttttaagggagtttttttagttttcgaag

SEQ ID NO: 34558 - DNA, 612 bp, Artificial Sequence
  chemically treated genomic DNA (Homo sapiens) CpG-island No: 34558
cttcgaaaactaaaaaaactcccttaaaaaattaaaaaaaacaccctaaatatactttacaaatcgtattttctaatataaaaaccgacatacgcgatacgaccgcacgaaaaaaacgcgtacctaaaaataaaaaacatcgcccaaaaaaacgaaatcaccccgaacgaaaaacgacccccgcaaaaaacgccgcgcgaacgccgctacgtattcgccgcccacaaccgcaaccaaaaaaacgcaaataaccccacgcgacctaattcaccgccgcctacaatatccgcgacgcgaaacgccccgaaactaaactcaccgtcctctccgcgtccttaaaaatctcccgaacctcctcgaaaaaacactactcctccttacactccctctccaaaaaacccgaccgcaactcctccaaaaacgcgttaacgcgccgacgccgatacaaaacgccgtaaacttcctcctaaattacgaaaactaaaaaatacgaattccgtaaaacgcccaccgcgtaccccgcccaatacctcgaaaaccgccccacgacccacgcgacgaaaacatcgcaaattcccgcccgtcctaaaaaaaaaaaacgacgctactcgc

SEQ ID NO: 34559 - DNA, 612 bp, Artificial Sequence
  chemically treated genomic DNA (Homo sapiens) CpG-island No: 34559
tttcggggattggggggatttttttgggaagttaagggggatattttaagtgtgttttgtaaatcgtattttttgatgtgaaaatcggtatgcgcggtgcggtcgtacggggagagcgcgtgtttgggggtggggggtatcgtttaggaaagcggagttatttcgggcggaaagcgattttcgtagaaagcgtcgcgcgggcgtcgttgcgtgttcgtcgtttatagtcgtagttaaagagacgtaggtggttttacgcggtttggtttatcgtcgtttgtagtgttcgcggcgcggggcgtttcgaggttgggtttatcgtttttttcgcgtttttgaagatttttcgggttttttcgaaggagtattgtttttttttgtattttttttttagggagttcggtcgtagtttttttaggaacgcgttggcgcgtcggcgtcggtgtaggacgtcgtgggtttttttttgggttacgaagattgggaaatgcgagtttcgtgaagcgtttatcgcgtgtttcgtttagtgtttcggagatcgttttacggtttacgcggcgggggtatcgtaggttttcgttcgttttggaggaggggagcggcgttgttcgt

SEQ ID NO: 34560 - DNA, 612 bp, Artificial Sequence
  chemically treated genomic DNA (Homo sapiens) CpG-island No: 34560
acgaacaacgccgctcccctcctccaaaacgaacgaaaacctacgatacccccgccgcgtaaaccgtaaaacgatctccgaaacactaaacgaaacacgcgataaacgcttcacgaaactcgcatttcccaatcttcgtaacccaaaaaaaaacccacgacgtcctacaccgacgccgacgcgccaacgcgttcctaaaaaaactacgaccgaactccctaaaaaaaaaatacaaaaaaaaacaatactccttcgaaaaaacccgaaaaatcttcaaaaacgcgaaaaaaacgataaacccaacctcgaaacgccccgcgccgcgaacactacaaacgacgataaaccaaaccgcgtaaaaccacctacgtctctttaactacgactataaacgacgaacacgcaacgacgcccgcgcgacgctttctacgaaaatcgctttccgcccgaaataactccgctttcctaaacgataccccccacccccaaacacgcgctctccccgtacgaccgcaccgcgcataccgattttcacatcaaaaaatacgatttacaaaacacacttaaaatatcccccttaacttcccaaaaaaatccccccaatccccgaaa

SEQ ID NO: 34561 - DNA, 510 bp, Artificial Sequence
  chemically treated genomic DNA (Homo sapiens) CpG-island No: 34561
gagcgcgattttaatttcgtcgggagggaaggagatcgggtttttttttttgatcggtttttagatatggagtttttcgaggtttttatagagtatttggatcgggtgatgttggttcgcggcggcggtcgcgaggttattattatttatttttgagaattaggatttgttattcgggttcgagcgcgttcggttcgcggtttcggagttttcgtcgcgtttttcgtcgttgttatcgtttatatatagattttgtgttcgtgttttggttttttatttcgttgtttgaagttcggaggttacgtttgttggggttgattcggagagggcgtttcgtcgcgtagagattagagttttttagtgttagtttggtttttgggttttcgttgttttttttttaagttcggtttcgtttcgtcggaggagacgttgtaataaaggttgggagaaggcgcggaaaggagaggagttggggttttggggatttttaggtagtttatgcggtttatt

SEQ ID NO: 34562 - DNA, 510 bp, Artificial Sequence
  chemically treated genomic DNA (Homo sapiens) CpG-island No: 34562
aataaaccgcataaactacctaaaaatccccaaaaccccaactcctctcctttccgcgccttctcccaacctttattacaacgtctcctccgacgaaacgaaaccgaacttaaaaaaaaaacaacgaaaacccaaaaaccaaactaacactaaaaaactctaatctctacgcgacgaaacgccctctccgaatcaaccccaacaaacgtaacctccgaacttcaaacaacgaaataaaaaaccaaaacacgaacacaaaatctatatataaacgataacaacgacgaaaaacgcgacgaaaactccgaaaccgcgaaccgaacgcgctcgaacccgaataacaaatcctaattctcaaaaataaataataataacctcgcgaccgccgccgcgaaccaacatcacccgatccaaatactctataaaaacctcgaaaaactccatatctaaaaaccgatcaaaaaaaaaaacccgatctccttccctcccgacgaaattaaaatcgcgctc

SEQ ID NO: 34563 - DNA, 510 bp, Artificial Sequence
  chemically treated genomic DNA (Homo sapiens) CpG-island No: 34563
aatgggtcgtatggattatttgggggtttttaaggttttagtttttttttttttcgcgtttttttttaatttttattgtagcgtttttttcggcgagacgaggtcgggtttagaaaaagggtagcgaagatttaggggttaaattggtattgaggagttttggtttttgcgcggcggggcgtttttttcgaattagttttaataggcgtggttttcgggttttaggtagcggggtaaggggttaggatacgggtatagggtttgtatgtaaacggtgatagcggcggggggcgcggcgagggtttcggagtcgcgggtcgggcgcgttcgggttcgggtggtaggttttggtttttaggagtagatggtgatgatttcgcggtcgtcgtcgcggattagtattattcggtttaggtgttttgtgaggatttcgagaaattttatgtttgagagtcggttaaggagaaagattcggtttttttttttttcgacgaaattggggtcgcgttt

SEQ ID NO: 34564 - DNA, 510 bp, Artificial Sequence
  chemically treated genomic DNA (Homo sapiens) CpG-island No: 34564
aaacgcgaccccaatttcgtcgaaaaaaaaaaaaaccgaatctttctccttaaccgactctcaaacataaaatttctcgaaatcctcacaaaacacctaaaccgaataatactaatccgcgacgacgaccgcgaaatcatcaccatctactcctaaaaaccaaaacctaccacccgaacccgaacgcgcccgacccgcgactccgaaaccctcgccgcgccccccgccgctatcaccgtttacatacaaaccctatacccgtatcctaaccccttaccccgctacctaaaacccgaaaaccacgcctattaaaactaattcgaaaaaaacgccccgccgcgcaaaaaccaaaactcctcaataccaatttaacccctaaatcttcgctaccctttttctaaacccgacctcgtctcgccgaaaaaaacgctacaataaaaattaaaaaaaaacgcgaaaaaaaaaaaaactaaaaccttaaaaacccccaaataatccatacgacccatt

SEQ ID NO: 34565 - DNA, 828 bp, Artificial Sequence
  chemically treated genomic DNA (Homo sapiens) CpG-island No: 34565
  misc_feature (181)..(181): n is either a, c, g or t
attagaagttagagttcgagttcgggattggaggtacgtggggcgggattattttcgtaatgtattaattagaatttttcggtttagtagggaggagttaaagggcgaataaagtacgtaggcgcgacggcgtacgaaggcgagaggcgagtttagcggcggcgcgcgcgcgcgtattttnttttttttttattttagcgagggtgggttgtttggcgcgcgcgcgcgcgtcggtttatttttcgggtttcgtttttcgtttcgtcgcgcgttttcgttttcgggttgaggcgatttagagtcggagttcgatataaaggcggtggcggcggtagtagcggaggggttttagagttcgtttcgttggggtttttcgggtttattttttttatttcggttatcggcgcggtcgtttattcgcgggtttaagatggcggcggtaatagagatagggtaagcggtagtttcgagtagaaagcgtcggaggggtcgtcgttttttagtttcggatttttagattttggcgcggttcgttgcgggattatggttttttgggatttttatttgttcggagcggattggaggggacgcggttatacgttttgttcgatcgttcgttttgtcgttttcgtttcgttttttttagcgtcgttgtcgttattttgtgtttcgggtcgggatttcgcgttgcgtatgcgttggtatcgtttttgagggatttcgtcgcggtcgcgtcgttattttgagtgtggtagggtcggttggtttttcgtatttagtttgttttcggttttttttttttttttttattcgtttttgttgtttttt

SEQ ID NO: 34566 - DNA, 828 bp, Artificial Sequence
  chemically treated genomic DNA (Homo sapiens) CpG-island No: 34566
  misc_feature (648)..(648): n is either a, c, g or t
aaaaaacaacaaaaacgaataaaaaaaaaaaaaaaaaaccgaaaacaaactaaatacgaaaaaccaaccgaccctaccacactcaaaataacgacgcgaccgcgacgaaatccctcaaaaacgataccaacgcatacgcaacgcgaaatcccgacccgaaacacaaaataacgacaacgacgctaaaaaaaacgaaacgaaaacgacaaaacgaacgatcgaacaaaacgtataaccgcgtcccctccaatccgctccgaacaaataaaaatcccaaaaaaccataatcccgcaacgaaccgcgccaaaatctaaaaatccgaaactaaaaaacgacgacccctccgacgctttctactcgaaactaccgcttaccctatctctattaccgccgccatcttaaacccgcgaataaacgaccgcgccgataaccgaaataaaaaaaataaacccgaaaaaccccaacgaaacgaactctaaaacccctccgctactaccgccgccaccgcctttatatcgaactccgactctaaatcgcctcaacccgaaaacgaaaacgcgcgacgaaacgaaaaacgaaacccgaaaaataaaccgacgcgcgcgcgcgcgccaaacaacccaccctcgctaaaataaaaaaaaaanaaaatacgcgcgcgcgcgccgccgctaaactcgcctctcgccttcgtacgccgtcgcgcctacgtactttattcgccctttaactcctccctactaaaccgaaaaattctaattaatacattacgaaaataatcccgccccacgtacctccaatcccgaactcgaactctaacttctaat

SEQ ID NO: 34567 - DNA, 828 bp, Artificial Sequence
  chemically treated genomic DNA (Homo sapiens) CpG-island No: 34567
  misc_feature (648)..(648): n is either a, c, g or t
aaggaatagtagggacggatgggaagaaggggagggggtcgaaagtaagttgggtgcgaggagttagtcgattttgttatatttaagatggcggcgcggtcgcggcgaggttttttagaggcggtattagcgtatgcgtagcgcggagtttcggttcgggatataagatggcggtagcggcgttggggagggcgaggcggaggcggtaaaacgggcggtcgagtagaacgtgtagtcgcgttttttttagttcgtttcgggtaggtaagagttttaggaagttatggtttcgtagcgagtcgcgttagggtttggggattcgaagttggggggcggcggttttttcggcgttttttgttcgggattgtcgtttgttttgtttttgttgtcgtcgttattttagattcgcgggtgggcggtcgcgtcggtggtcgaagtgagggaggtgggttcggagagttttagcggagcgggttttagggttttttcgttgttgtcgtcgttatcgtttttgtgtcgggtttcgattttgagtcgttttagttcgggggcgggagcgcgcggcggggcggggggcggagttcgagagatgggtcggcgcgcgcgcgcgcgttaaatagtttattttcgttggggtaggggaagggnaaggtgcgcgcgcgcgcgtcgtcgttgagttcgtttttcgttttcgtgcgtcgtcgcgtttgcgtattttgttcgttttttgatttttttttattgggtcggagaattttgattggtatattgcggagatggtttcgttttacgtgtttttaatttcggattcggattttggtttttggt

SEQ ID NO: 34568 - DNA, 828 bp, Artificial Sequence
  chemically treated genomic DNA (Homo sapiens) CpG-island No: 34568
  misc_feature (181)..(181): n is either a, c, g or t
accaaaaaccaaaatccgaatccgaaattaaaaacacgtaaaacgaaaccatctccgcaatataccaatcaaaattctccgacccaataaaaaaaaatcaaaaaacgaacaaaatacgcaaacgcgacgacgcacgaaaacgaaaaacgaactcaacgacgacgcgcgcgcgcgcaccttncccttcccctaccccaacgaaaataaactatttaacgcgcgcgcgcgcgccgacccatctctcgaactccgccccccgccccgccgcgcgctcccgcccccgaactaaaacgactcaaaatcgaaacccgacacaaaaacgataacgacgacaacaacgaaaaaaccctaaaacccgctccgctaaaactctccgaacccacctccctcacttcgaccaccgacgcgaccgcccacccgcgaatctaaaataacgacgacaacaaaaacaaaacaaacgacaatcccgaacaaaaaacgccgaaaaaaccgccgccccccaacttcgaatccccaaaccctaacgcgactcgctacgaaaccataacttcctaaaactcttacctacccgaaacgaactaaaaaaaacgcgactacacgttctactcgaccgcccgttttaccgcctccgcctcgccctccccaacgccgctaccgccatcttatatcccgaaccgaaactccgcgctacgcatacgctaataccgcctctaaaaaacctcgccgcgaccgcgccgccatcttaaatataacaaaatcgactaactcctcgcacccaacttactttcgaccccctccccttcttcccatccgtccctactattcctt

SEQ ID NO: 34569 - DNA, 774 bp, Artificial Sequence
  chemically treated genomic DNA (Homo sapiens) CpG-island No: 34569
aggaggggcgcggttaagttatcgggagttacgttttttattgggagttacgttttaagagagcggggcgcgtattcgtcgcgtttaattttgcggtttagggaagggattagaatgacgttataattattttttacgtaatatttcgtcgagataaagtagtttttaaattatagtgggtttagtgttaaatatcgggcgacgtataaagttttagagtttgttgagattcgattatggttttgaggtttcggagcgatttttcggaatattgaaaatgtgtttttttcggggttagcgggggaagtagtttcggtttataataggtcgatgggttttttcgtagcggaggaaagaggatggcgatttcgtcgatgtcggagttagagaggaacgtggttacgaaagtttcgggtgagtttcgggtagagttaggcggttttatcgtattttgtcgtggagtgaggttatattgcggggatattcggaggcgaggttttaggtcggcggggttgttcgaatagggtttcggggttttaggttttttagtcgttttcgtatttgtttgagcggaaattcggcgttattataagatggcgtcgggtttggagtataggtagcgtcggggatagttttaaatcgttaggtttcgagaatcgtcgttgttagtcgttttcgtaggggaatcgggggggagcgaattattgatttagggggttagcgggttgtattatcgttttgtaattcggggggacgcgggggtcgaagggttga

SEQ ID NO: 34570 - DNA, 774 bp, Artificial Sequence
  chemically treated genomic DNA (Homo sapiens) CpG-island No: 34570
tcaacccttcgacccccgcgtccccccgaattacaaaacgataatacaacccgctaaccccctaaatcaataattcgctcccccccgattcccctacgaaaacgactaacaacgacgattctcgaaacctaacgatttaaaactatccccgacgctacctatactccaaacccgacgccatcttataataacgccgaatttccgctcaaacaaatacgaaaacgactaaaaaacctaaaaccccgaaaccctattcgaacaaccccgccgacctaaaacctcgcctccgaatatccccgcaatataacctcactccacgacaaaatacgataaaaccgcctaactctacccgaaactcacccgaaactttcgtaaccacgttcctctctaactccgacatcgacgaaatcgccatcctctttcctccgctacgaaaaaacccatcgacctattataaaccgaaactacttcccccgctaaccccgaaaaaaacacattttcaatattccgaaaaatcgctccgaaacctcaaaaccataatcgaatctcaacaaactctaaaactttatacgtcgcccgatatttaacactaaacccactataatttaaaaactactttatctcgacgaaatattacgtaaaaaataattataacgtcattctaatcccttccctaaaccgcaaaattaaacgcgacgaatacgcgccccgctctcttaaaacgtaactcccaataaaaaacgtaactcccgataacttaaccgcgcccctcct

SEQ ID NO: 34571 - DNA, 774 bp, Artificial Sequence
  chemically treated genomic DNA (Homo sapiens) CpG-island No: 34571
ttagtttttcggttttcgcgttttttcgggttgtagggcggtggtatagttcgttggttttttgggttagtggttcgttttttttcggtttttttgcggaggcggttgatagcgacggttttcggggtttggcgatttggggttgttttcggcgttgtttgtgttttaggttcgacgttattttgtggtggcgtcgggttttcgtttaggtaagtgcgagagcgattaaagggtttgggatttcggggttttgttcggatagtttcgtcggtttgggatttcgttttcgggtattttcgtagtgtgattttattttacggtagggtacggtggggtcgtttaattttattcgaagtttattcgaggttttcgtagttacgtttttttttgatttcggtatcgacgaggtcgttattttttttttttcgttgcggaggaatttatcggtttattgtaggtcggaattatttttttcgttggtttcgggaaagatatatttttagtgtttcggaaggtcgtttcgaggttttaaaattataatcgggttttaatagattttgggattttatacgtcgttcggtgtttggtattgagtttattatggtttggggattattttatttcggcggagtgttacgtaggaagtggttgtgacgttattttggttttttttttaggtcgtagggttgggcgcggcgaatgcgcgtttcgtttttttggggcgtggtttttagtggggggcgtggttttcggtggtttggtcgcgtttttttt

SEQ ID NO: 34572 - DNA, 774 bp, Artificial Sequence
  chemically treated genomic DNA (Homo sapiens) CpG-island No: 34572
aaaaaaaacgcgaccaaaccaccgaaaaccacgccccccactaaaaaccacgccccaaaaaaacgaaacgcgcattcgccgcgcccaaccctacgacctaaaaaaaaaaccaaaataacgtcacaaccacttcctacgtaacactccgccgaaataaaataatccccaaaccataataaactcaataccaaacaccgaacgacgtataaaatcccaaaatctattaaaacccgattataattttaaaacctcgaaacgaccttccgaaacactaaaaatatatctttcccgaaaccaacgaaaaaaataattccgacctacaataaaccgataaattcctccgcaacgaaaaaaaaaaaataacgacctcgtcgataccgaaatcaaaaaaaaacgtaactacgaaaacctcgaataaacttcgaataaaattaaacgaccccaccgtaccctaccgtaaaataaaatcacactacgaaaatacccgaaaacgaaatcccaaaccgacgaaactatccgaacaaaaccccgaaatcccaaaccctttaatcgctctcgcacttacctaaacgaaaacccgacgccaccacaaaataacgtcgaacctaaaacacaaacaacgccgaaaacaaccccaaatcgccaaaccccgaaaaccgtcgctatcaaccgcctccgcaaaaaaaccgaaaaaaaacgaaccactaacccaaaaaaccaacgaactataccaccgccctacaacccgaaaaaacgcgaaaaccgaaaaactaa

SEQ ID NO: 34573 - DNA, 1216 bp, Artificial Sequence
  chemically treated genomic DNA (Homo sapiens) CpG-island No: 34573
ttcggggttcgtttgtcgtcgttcgcgttttttttgttggcgtcggcggtttcgtttttttcgtttttgttcgttagtagttcggtttcgtcgttgggtttaggtatttcgggtattagtagcgatagtcggtagcggttttcgtttttcgattatatgaatttcgattttagtttttttaagttttttaagtcgggcgtttcgagcggttatttcgtgggttttttggacggttttttgtttttcgaggtttttttttcgtattcgtcgttgttttcgcgttcgttcgcgttttcgtcgtcgtttttgtagtcgtcgttatcgtcgtcggtttcgggggagttgtatcgtttgtttttcgtttcggtcgttgttatcgtttagggttcgggcgtcgttttatcgttgttttcggatatcggggataatggtgattatatcgagatggtttttggtgtggtcgttatttcgtcgtaatttatcgcggttttttcgaagttagaagttgttcgcgtggttagttcgacgtcgggcgtgaagaggttgagttttatggagtaggtgtcgggagtcgaggtttttttgtaggttagttagttttcggatttttatcgcggcgttaaggttattcgcgtagattcgtaggggggtcgtcgtcgttatagtttcgagatttttttttttattacgacggttattttcgtgttttcgtttttcgtttataattttaagcgttataattcggttttcgtggaaaatgttttttttaggaaaagtagcgagggcggcgtgggtgtcggttttggagggggcgacgagtcgtttatttttttacgatagttgtagtcggcgttttttttggtatcgtagggtcggtcgtggatttcgggttagttcgggggtttggtcggttgttttgggagcggtggatcgtttatgcgtagagagatttttgtcggtttttagaatggttttaattatatcgttatcgacgtgagggaggagttcgggttgttattttagtcgtagtcgtcgtcgtcgtcgtttttttagtcgggagataagagtttttggggtcggattcgaagtttcgggggttttattagcgttgtgggcgtcggtagtatcggcggcgggtgcggggggtcgggtttcggtgttttgttttttgttaatatttacgttagtattgattttttgttttattatttgaagg

SEQ ID NO: 34574 - DNA, 1216 bp, Artificial Sequence
  chemically treated genomic DNA (Homo sapiens) CpG-island No: 34574
ccttcaaataataaaacaaaaaatcaatactaacgtaaatattaacaaaaaacaaaacaccgaaacccgaccccccgcacccgccgccgatactaccgacgcccacaacgctaataaaacccccgaaacttcgaatccgaccccaaaaactcttatctcccgactaaaaaaacgacgacgacgacgactacgactaaaataacaacccgaactcctccctcacgtcgataacgatataattaaaaccattctaaaaaccgacaaaaatctctctacgcataaacgatccaccgctcccaaaacaaccgaccaaacccccgaactaacccgaaatccacgaccgaccctacgataccaaaaaaaacgccgactacaactatcgtaaaaaaataaacgactcgtcgccccctccaaaaccgacacccacgccgccctcgctacttttcctaaaaaaaacattttccacgaaaaccgaattataacgcttaaaattataaacgaaaaacgaaaacacgaaaataaccgtcgtaataaaaaaaaaaatctcgaaactataacgacgacgacccccctacgaatctacgcgaataaccttaacgccgcgataaaaatccgaaaactaactaacctacaaaaaaacctcgactcccgacacctactccataaaactcaacctcttcacgcccgacgtcgaactaaccacgcgaacaacttctaacttcgaaaaaaccgcgataaattacgacgaaataacgaccacaccaaaaaccatctcgatataatcaccattatccccgatatccgaaaacaacgataaaacgacgcccgaaccctaaacgataacaacgaccgaaacgaaaaacaaacgatacaactcccccgaaaccgacgacgataacgacgactacaaaaacgacgacgaaaacgcgaacgaacgcgaaaacaacgacgaatacgaaaaaaaaacctcgaaaaacaaaaaaccgtccaaaaaacccacgaaataaccgctcgaaacgcccgacttaaaaaacttaaaaaaactaaaatcgaaattcatataatcgaaaaacgaaaaccgctaccgactatcgctactaatacccgaaatacctaaacccaacgacgaaaccgaactactaacgaacaaaaacgaaaaaaacgaaaccgccgacgccaacaaaaaaaacgcgaacgacgacaaacgaaccccgaa

SEQ ID NO: 34575 - DNA, 1216 bp, Artificial Sequence
  chemically treated genomic DNA (Homo sapiens) CpG-island No: 34575
tttttaagtggtgggataagaagttaatgttggcgtaggtgttggtagggggtagggtatcgggattcggtttttcgtattcgtcgtcggtgttgtcgacgtttatagcgttgatgagattttcgaggtttcgggttcggttttaggagtttttgtttttcggttgaggaagcggcggcggcggcggttgcggttggggtggtagttcgggttttttttttacgtcgatggcgatgtagttgagattattttggaagtcggtagaggtttttttgcgtatgggcgatttatcgtttttaggataatcgattaagttttcgggttgattcggggtttacggtcggttttgcggtgttaaagggggcgtcggttgtaattgtcgtggggaggtgggcggttcgtcgttttttttagggtcgatatttacgtcgttttcgttgttttttttgagagagatattttttacggaggtcgagttgtggcgtttggggttgtgggcgaaggacggggatacgggggtgatcgtcgtggtggaggagaaggtttcggaattgtggcggcggcggtttttttgcgggtttgcgcggatgattttggcgtcgcggtgggggttcgggggttggttggtttgtaggaaggtttcgattttcgatatttgttttatgaggtttagtttttttacgttcgacgtcgggttggttacgcgggtagtttttggtttcgggggggtcgcgataggttgcggcggggtggcggttatattaaaagttatttcggtgtagttattattgttttcggtgttcgaggataacgatgaggcggcgttcgggttttgggcggtggtaacggtcgaggcggggggtaggcggtatagttttttcggggtcggcggcggtggcggcggttgtagagacgacgacggggacgcggacggacgcgggggtaacggcggatacggggaggaggtttcgggggataggaggtcgtttaaggagtttacggggtggtcgttcggggcgttcggtttaggagatttgggggagttgaagtcgaggtttatgtagtcggagagcggagatcgttgtcggttgtcgttgttggtgttcggggtgtttgagtttagcgacgaggtcgggttgttggcggataagagcgaggaggacgaggtcgtcgacgttagtaggggaggcgcgggcggcgataggcgggtttcggg

SEQ ID NO: 34576 - DNA, 1216 bp, Artificial Sequence
  chemically treated genomic DNA (Homo sapiens) CpG-island No: 34576
cccgaaacccgcctatcgccgcccgcgcctcccctactaacgtcgacgacctcgtcctcctcgctcttatccgccaacaacccgacctcgtcgctaaactcaaacaccccgaacaccaacaacgacaaccgacaacgatctccgctctccgactacataaacctcgacttcaactcccccaaatctcctaaaccgaacgccccgaacgaccaccccgtaaactccttaaacgacctcctatcccccgaaacctcctccccgtatccgccgttacccccgcgtccgtccgcgtccccgtcgtcgtctctacaaccgccgccaccgccgccgaccccgaaaaaactataccgcctaccccccgcctcgaccgttaccaccgcccaaaacccgaacgccgcctcatcgttatcctcgaacaccgaaaacaataataactacaccgaaataacttttaatataaccgccaccccgccgcaacctatcgcgacccccccgaaaccaaaaactacccgcgtaaccaacccgacgtcgaacgtaaaaaaactaaacctcataaaacaaatatcgaaaatcgaaaccttcctacaaaccaaccaacccccgaacccccaccgcgacgccaaaatcatccgcgcaaacccgcaaaaaaaccgccgccgccacaattccgaaaccttctcctccaccacgacgatcacccccgtatccccgtccttcgcccacaaccccaaacgccacaactcgacctccgtaaaaaatatctctctcaaaaaaaacaacgaaaacgacgtaaatatcgaccctaaaaaaaacgacgaaccgcccacctccccacgacaattacaaccgacgccccctttaacaccgcaaaaccgaccgtaaaccccgaatcaacccgaaaacttaatcgattatcctaaaaacgataaatcgcccatacgcaaaaaaacctctaccgacttccaaaataatctcaactacatcgccatcgacgtaaaaaaaaaacccgaactaccaccccaaccgcaaccgccgccgccgccgcttcctcaaccgaaaaacaaaaactcctaaaaccgaacccgaaacctcgaaaatctcatcaacgctataaacgtcgacaacaccgacgacgaatacgaaaaaccgaatcccgataccctaccccctaccaacacctacgccaacattaacttcttatcccaccacttaaaaa

SEQ ID NO: 34577 - DNA, 728 bp, Artificial Sequence
  chemically treated genomic DNA (Homo sapiens) CpG-island No: 34577
tttttttcgtttcggatttaattaattgggtttgagttttcgtcggggagggggcgtcgggcggggtcgcggttgggcggggcgggggatcgggatcggcggcgggggttgcggttttgtagtggaagtatgggcggcgagtcgggtcgtgttttcggggcgcggggtttttattttgggcgagggcggtcgttttcgcgttcggggtgggcgcgttttattttcgtttttcgtttttcgttttcgtttttcggtcgtattttcgttttttcgtagtcgcgaaacgcggggaggttttagggttcgcggtcgcgggttcgcgagtatcgcgttttagatcgagagcggcgcgcgttttttcgtggaggatagaggggcgcggagggggcgtttgtgttttattcgttcgcgggcgttttacggggcgttttttgcgttatttatttgttagtttgtcgggaagttgaaatcgcgtttgggaggtaataggagaaagagatcggggacggtaggcggagaaagtgcggtttttatagcgtcggggagagggcggattcgcgagttagcggtttttgagtcgggagatcgcgcgggcgtttttttagttttcgtaggagcgtcgtttttttttcgtaggggcgttttttttttttatcgttgtaggagtattttttttttttttcggaagcgtttttttattatatcgttttaagagttttttttttttt

SEQ ID NO: 34578 - DNA, 728 bp, Artificial Sequence
  chemically treated genomic DNA (Homo sapiens) CpG-island No: 34578
aaaaaaaaaaaaactcttaaaacgatataataaaaaaacgcttccgaaaaaaaaaaaaaatactcctacaacgataaaaaaaaaaaacgcccctacgaaaaaaaaacgacgctcctacgaaaactaaaaaaacgcccgcgcgatctcccgactcaaaaaccgctaactcgcgaatccgccctctccccgacgctataaaaaccgcactttctccgcctaccgtccccgatctctttctcctattacctcccaaacgcgatttcaacttcccgacaaactaacaaataaataacgcaaaaaacgccccgtaaaacgcccgcgaacgaataaaacacaaacgccccctccgcgcccctctatcctccacgaaaaaacgcgcgccgctctcgatctaaaacgcgatactcgcgaacccgcgaccgcgaaccctaaaacctccccgcgtttcgcgactacgaaaaaacgaaaatacgaccgaaaaacgaaaacgaaaaacgaaaaacgaaaataaaacgcgcccaccccgaacgcgaaaacgaccgccctcgcccaaaataaaaaccccgcgccccgaaaacacgacccgactcgccgcccatacttccactacaaaaccgcaacccccgccgccgatcccgatcccccgccccgcccaaccgcgaccccgcccgacgccccctccccgacgaaaactcaaacccaattaattaaatccgaaacgaaaaaaa

SEQ ID NO: 34579 - DNA, 728 bp, Artificial Sequence
  chemically treated genomic DNA (Homo sapiens) CpG-island No: 34579
aaggaagggggggtttttgaagcggtgtggtgagaggacgttttcgaggaaggaagggggtgtttttgtagcggtggggggagaggacgtttttgcggaaggaaggcggcgtttttgcgggggttggagagacgttcgcgcggtttttcggtttagggatcgttggttcgcgggttcgtttttttttcggcgttatggaaatcgtatttttttcgtttgtcgttttcgattttttttttttattattttttaaacgcgattttaatttttcgataagttgataagtgaatggcgtagaggacgtttcgtaaagcgttcgcgagcgggtgggatataggcgtttttttcgcgtttttttgttttttacggaagggcgcgcgtcgttttcgatttggagcgcggtgttcgcgaattcgcggtcgcgggttttggaattttttcgcgtttcgcggttgcggggggacggagatgcggtcgggagacggggacgggaaacgggggacggggatggggcgcgtttatttcgagcgcgggagcggtcgttttcgtttaaaatggggatttcgcgtttcgagagtacggttcggttcgtcgtttatgtttttattgtaaggtcgtagttttcgtcgtcgatttcgatttttcgtttcgtttagtcgcggtttcgttcggcgtttttttttcggcggaagtttaagtttaattaattgagttcgaggcgggaggga

SEQ ID NO: 34580 - DNA, 728 bp, Artificial Sequence
  chemically treated genomic DNA (Homo sapiens) CpG-island No: 34580
tccctcccgcctcgaactcaattaattaaacttaaacttccgccgaaaaaaaaacgccgaacgaaaccgcgactaaacgaaacgaaaaatcgaaatcgacgacgaaaactacgaccttacaataaaaacataaacgacgaaccgaaccgtactctcgaaacgcgaaatccccattttaaacgaaaacgaccgctcccgcgctcgaaataaacgcgccccatccccgtcccccgtttcccgtccccgtctcccgaccgcatctccgtccccccgcaaccgcgaaacgcgaaaaaattccaaaacccgcgaccgcgaattcgcgaacaccgcgctccaaatcgaaaacgacgcgcgcccttccgtaaaaaacaaaaaaacgcgaaaaaaacgcctatatcccacccgctcgcgaacgctttacgaaacgtcctctacgccattcacttatcaacttatcgaaaaattaaaatcgcgtttaaaaaataataaaaaaaaaaaatcgaaaacgacaaacgaaaaaaatacgatttccataacgccgaaaaaaaaacgaacccgcgaaccaacgatccctaaaccgaaaaaccgcgcgaacgtctctccaacccccgcaaaaacgccgccttccttccgcaaaaacgtcctctccccccaccgctacaaaaacacccccttccttcctcgaaaacgtcctctcaccacaccgcttcaaaaacccccccttcctt

SEQ ID NO: 34581 - DNA, 600 bp, Artificial Sequence
  chemically treated genomic DNA (Homo sapiens) CpG-island No: 34581
attttcgtttgagttatttaagttttcgacgcggggtagttaagaggttatcggttttttcggcggtagcgagtggagcgttttttgggttgtaggcgtcgtcgttattacgcgggcgttcgttttttttttgacgttcgcgggggtaattcgggaggattcgtcgatatcgcggttgtagcgtagttaaagaagggtaggcgcggcgttcgcggggttcggggacgtcgggtttgggagggggttgtagcggttggagttagaggttcgcgagttatacgggttcgaggatgggtcgataggggttcgggtttggggagcgtaagtttttgaggtacgggaggggcggacgtagagatcgagcgtttaatgtggttagcggatcgtttgtttttcggatttaggaattattcgaagttcgcgcggatttatagattatttttagtttcgtttcgcgaggtttcgtttttttatgtaatttaaaagtaattaattttttttacgcgaaggtttttatcggtcgacgggttgtgggtgtattgtttagtgacggtttcgtttagttttttttagtatttataatttaaagtaagaataacg

SEQ ID NO: 34582 - DNA, 600 bp, Artificial Sequence
  chemically treated genomic DNA (Homo sapiens) CpG-island No: 34582
cgttattcttactttaaattataaatactaaaaaaaactaaacgaaaccgtcactaaacaatacacccacaacccgtcgaccgataaaaaccttcgcgtaaaaaaaattaattacttttaaattacataaaaaaacgaaacctcgcgaaacgaaactaaaaataatctataaatccgcgcgaacttcgaataattcctaaatccgaaaaacaaacgatccgctaaccacattaaacgctcgatctctacgtccgcccctcccgtacctcaaaaacttacgctccccaaacccgaacccctatcgacccatcctcgaacccgtataactcgcgaacctctaactccaaccgctacaaccccctcccaaacccgacgtccccgaaccccgcgaacgccgcgcctacccttctttaactacgctacaaccgcgatatcgacgaatcctcccgaattacccccgcgaacgtcaaaaaaaaaacgaacgcccgcgtaataacgacgacgcctacaacccaaaaaacgctccactcgctaccgccgaaaaaaccgataacctcttaactaccccgcgtcgaaaacttaaataactcaaacgaaaat

SEQ ID NO: 34583 - DNA, 600 bp, Artificial Sequence
  chemically treated genomic DNA (Homo sapiens) CpG-island No: 34583
cgttgtttttgttttgaattatgggtgttgggagaaattaaacgaagtcgttattgagtaatatatttatagttcgtcgatcgataggaattttcgcgtggggggagttggttatttttaggttgtatgaagaggcggggtttcgcggggcggagttgggggtggtttgtgggttcgcgcgggtttcgggtagtttttgggttcggggagtagacgattcgttagttatattaggcgttcggtttttgcgttcgtttttttcgtgttttagagatttgcgttttttaggttcgagtttttgtcggtttattttcgagttcgtgtggttcgcgaatttttaattttagtcgttgtagtttttttttaggttcggcgttttcgagtttcgcgggcgtcgcgtttgtttttttttggttacgttgtagtcgcggtgtcggcgagttttttcgggttgttttcgcgggcgttagagggagggcgggcgttcgcgtggtgacggcgacgtttgtagtttaaggagcgttttattcgttgtcgtcggaggggtcggtgattttttggttatttcgcgtcggaggtttagatggtttaggcgaagat

SEQ ID NO: 34584 - DNA, 600 bp, Artificial Sequence
  chemically treated genomic DNA (Homo sapiens) CpG-island No: 34584
atcttcgcctaaaccatctaaacctccgacgcgaaataaccaaaaaatcaccgacccctccgacgacaacgaataaaacgctccttaaactacaaacgtcgccgtcaccacgcgaacgcccgccctccctctaacgcccgcgaaaacaacccgaaaaaactcgccgacaccgcgactacaacgtaaccaaaaaaaaacaaacgcgacgcccgcgaaactcgaaaacgccgaacctaaaaaaaaactacaacgactaaaattaaaaattcgcgaaccacacgaactcgaaaataaaccgacaaaaactcgaacctaaaaaacgcaaatctctaaaacacgaaaaaaacgaacgcaaaaaccgaacgcctaatataactaacgaatcgtctactccccgaacccaaaaactacccgaaacccgcgcgaacccacaaaccacccccaactccgccccgcgaaaccccgcctcttcatacaacctaaaaataaccaactccccccacgcgaaaattcctatcgatcgacgaactataaatatattactcaataacgacttcgtttaatttctcccaacacccataattcaaaacaaaaacaacg

SEQ ID NO: 34585 - DNA, 957 bp, Artificial Sequence
  chemically treated genomic DNA (Homo sapiens) CpG-island No: 34585
agttttcgggaggaaaaatcgtgttttttttaggatgttcggaataagagttaggttttcggagttaggtagttatttatgttcgtgagtcggcgggagggagatcgtcgggaggcgaagtggggcggggttatttttttttttgttttgttgttgtcggggagtttttggttggcgtttaagcggtaggaggtcgtcgttttgtagggcgtcgtagagtttgcggtgtagagtcgggatcgtttttggggtagagggttcgagtttttttaaggcgagggtgttggttttcgtgcgtatttaagggtttttaggagcgggcgtaaagggcggcgggttcgcgggttagggtttcgtagttagtaggttgtcgagcgtggttagcgtttagtgtagggcggtttcggcgtgcgttagttgttaggtgagttaggcgcgttgcgaggcgttgggttgcgtgtcgtcggcgggtttcgggaggaaggcgtttttcggggttcgaagttcgtttagggttacgtttagttcgtttaggtggttgacgattcgcgagagcgggtacgggagggagatttaggtttttggggagtggcgtcggcggcgttttggggaggtgggtcgtttttttcggacgttaacgcggcgttgcgggtcgttcgttttttttggcgatttaggtcggtgttttggtttttttaggcgtttcgggttgggaatagaatttgcgcgggagatagagcgggaggtgttagagggattgcgcgtagcgttaggggatttatttttaaggtttcgaagtcgttttcgatttcgtttttttttgttttttattttttattttttcgcggttcgttttcgcgttttattttttcggtttttttttgtattttggggatttcggtgtttcgttcggggtgttttttttttcgttcgtttaaatttgaagtatattttatt

SEQ ID NO: 34586 - DNA, 957 bp, Artificial Sequence
  chemically treated genomic DNA (Homo sapiens) CpG-island No: 34586
aataaaatatacttcaaatttaaacgaacgaaaaaaaaaacaccccgaacgaaacaccgaaatccccaaaatacaaaaaaaaaccgaaaaaataaaacgcgaaaacgaaccgcgaaaaaataaaaaataaaaaacaaaaaaaaacgaaatcgaaaacgacttcgaaaccttaaaaataaatcccctaacgctacgcgcaatccctctaacacctcccgctctatctcccgcgcaaattctattcccaacccgaaacgcctaaaaaaaccaaaacaccgacctaaatcgccaaaaaaaacgaacgacccgcaacgccgcgttaacgtccgaaaaaaacgacccacctccccaaaacgccgccgacgccactccccaaaaacctaaatctccctcccgtacccgctctcgcgaatcgtcaaccacctaaacgaactaaacgtaaccctaaacgaacttcgaaccccgaaaaacgccttcctcccgaaacccgccgacgacacgcaacccaacgcctcgcaacgcgcctaactcacctaacaactaacgcacgccgaaaccgccctacactaaacgctaaccacgctcgacaacctactaactacgaaaccctaacccgcgaacccgccgccctttacgcccgctcctaaaaacccttaaatacgcacgaaaaccaacaccctcgccttaaaaaaactcgaaccctctaccccaaaaacgatcccgactctacaccgcaaactctacgacgccctacaaaacgacgacctcctaccgcttaaacgccaaccaaaaactccccgacaacaacaaaacaaaaaaaaaaataaccccgccccacttcgcctcccgacgatctccctcccgccgactcacgaacataaataactacctaactccgaaaacctaactcttattccgaacatcctaaaaaaaacacgatttttcctcccgaaaact

SEQ ID NO: 34587 - DNA, 957 bp, Artificial Sequence
  chemically treated genomic DNA (Homo sapiens) CpG-island No: 34587
gatgagatgtgttttaagtttgaacgggcggaggggagggtatttcggacggggtatcggagtttttaggatgtagggaggggtcgagaggatggggcgcggaggcgagtcgcggaggggtgggggatggagggtagggggaggcggggtcgggagcggtttcgggattttggaaatgggttttttagcgttgcgcgtagtttttttgatatttttcgttttgtttttcgcgtaggttttgtttttagttcgaggcgtttggaggagttaaagtatcggtttagatcgttagggaggacgagcggttcgtaacgtcgcgttgacgttcgggaggagcgatttatttttttaaagcgtcgtcgacgttattttttagaagtttgggtttttttttcgtgttcgttttcgcgagtcgttaattatttgggcgggttggacgtggttttgggcgagtttcgggtttcggggggcgtttttttttcggggttcgtcggcggtacgtagtttagcgtttcgtagcgcgtttggtttatttggtagttggcgtacgtcggggtcgttttgtattgggcgttggttacgttcgatagtttgttggttgcggggttttggttcgcgggttcgtcgttttttgcgttcgtttttgggggtttttaggtgcgtacgggagttagtattttcgttttggaaaagttcgaattttttgttttagaggcgatttcgattttgtatcgtaaattttacggcgttttgtaggacggcggttttttgtcgtttggacgttagttaggagtttttcggtagtagtagagtagaaagaaggatggtttcgttttatttcgtttttcggcggtttttttttcgtcggtttacggatatagatggttgtttagtttcggaagtttagtttttgtttcgggtattttaaggaagatacggttttttttttcgggggtt

SEQ ID NO: 34588 - DNA, 957 bp, Artificial Sequence
  chemically treated genomic DNA (Homo sapiens) CpG-island No: 34588
aacccccgaaaaaaaaaaccgtatcttccttaaaatacccgaaacaaaaactaaacttccgaaactaaacaaccatctatatccgtaaaccgacgaaaaaaaaaccgccgaaaaacgaaataaaacgaaaccatccttctttctactctactactaccgaaaaactcctaactaacgtccaaacgacaaaaaaccgccgtcctacaaaacgccgtaaaatttacgatacaaaatcgaaatcgcctctaaaacaaaaaattcgaacttttccaaaacgaaaatactaactcccgtacgcacctaaaaacccccaaaaacgaacgcaaaaaacgacgaacccgcgaaccaaaaccccgcaaccaacaaactatcgaacgtaaccaacgcccaatacaaaacgaccccgacgtacgccaactaccaaataaaccaaacgcgctacgaaacgctaaactacgtaccgccgacgaaccccgaaaaaaaaacgccccccgaaacccgaaactcgcccaaaaccacgtccaacccgcccaaataattaacgactcgcgaaaacgaacacgaaaaaaaaacccaaacttctaaaaaataacgtcgacgacgctttaaaaaaataaatcgctcctcccgaacgtcaacgcgacgttacgaaccgctcgtcctccctaacgatctaaaccgatactttaactcctccaaacgcctcgaactaaaaacaaaacctacgcgaaaaacaaaacgaaaaatatcaaaaaaactacgcgcaacgctaaaaaacccatttccaaaatcccgaaaccgctcccgaccccgcctccccctaccctccatcccccacccctccgcgactcgcctccgcgccccatcctctcgacccctccctacatcctaaaaactccgataccccgtccgaaataccctcccctccgcccgttcaaacttaaaacacatctcatc

SEQ ID NO: 34589 - DNA, 696 bp, Artificial Sequence
  chemically treated genomic DNA (Homo sapiens) CpG-island No: 34589
cgtaggttcgtcgtgtttcgtcgtttcgcgttttggacgttcgagattagcgggaaataaatgtggttttcgagggggcgttcgttggtcgttaaaatttcgcgggttcggaggcgtcgttgttgggttagaatcgtagagtttttttcgcggggtatcgaggtttagtcgtcgtttttttgtttatttttttttttgtgagtcggtttttttttgcgtttggttagtatgtttcggatcgttcggattttcgtagcgttggtttaaggggcggtttttttcggcggagtaggtgacgaattatttcggaggatacggaattgatattgcggttttagagatacgggataaggggttagaacgcggggagtttaggtttagatcggagtcgggatttcgggaaaattttttattttttttgttcgtagttttagaattttagaaatttaatttcgcgtagttttcggtttggagagttcgttttggtttgtaagtatagatatatgtgtttatattcgaatatacgtagatatcgttagagagcgagatagcgagcgggcgttttcgtagtagcggtttgcggggcggaatcggagttggcgtcgttttaaggggaaatcgaattgtagtgatcggaaatgtttttaggatagaataagttattttttttgtttacgttgttaggatttttttagt

SEQ ID NO: 34590 - DNA, 696 bp, Artificial Sequence
  chemically treated genomic DNA (Homo sapiens) CpG-island No: 34590
actaaaaaaatcctaacaacgtaaacaaaaaaaataacttattctatcctaaaaacatttccgatcactacaattcgatttccccttaaaacgacgccaactccgattccgccccgcaaaccgctactacgaaaacgcccgctcgctatctcgctctctaacgatatctacgtatattcgaatataaacacatatatctatacttacaaaccaaaacgaactctccaaaccgaaaactacgcgaaattaaatttctaaaattctaaaactacgaacaaaaaaaataaaaaattttcccgaaatcccgactccgatctaaacctaaactccccgcgttctaaccccttatcccgtatctctaaaaccgcaatatcaattccgtatcctccgaaataattcgtcacctactccgccgaaaaaaaccgccccttaaaccaacgctacgaaaatccgaacgatccgaaacatactaaccaaacgcaaaaaaaaaccgactcacaaaaaaaaaaataaacaaaaaaacgacgactaaacctcgataccccgcgaaaaaaactctacgattctaacccaacaacgacgcctccgaacccgcgaaattttaacgaccaacgaacgccccctcgaaaaccacatttatttcccgctaatctcgaacgtccaaaacgcgaaacgacgaaacacgacgaacctacg

SEQ ID NO: 34591 - DNA, 696 bp, Artificial Sequence
  chemically treated genomic DNA (Homo sapiens) CpG-island No: 34591
gttggagaagttttggtaacgtggatagaaggaatggtttattttgttttggggatattttcggttattatagttcggtttttttttgaggcggcgttagtttcggtttcgtttcgtaggtcgttgttacggaggcgttcgttcgttgtttcgttttttggcggtgtttgcgtgtgttcgggtgtgggtatatgtatttgtgtttgtaaattagggcgggttttttaaatcgaaagttgcgcggagttgggtttttgggattttagggttgcgggtaagggagatgggggattttttcgggatttcgatttcgatttgagtttagatttttcgcgttttggttttttgtttcgtatttttagggtcgtagtgttaatttcgtgtttttcgaagtggttcgttatttgtttcgtcgaggggagtcgttttttgggttaacgttgcgggagttcggacggttcgaagtatgttggttaggcgtaaggggagatcgatttataggggagagggtgggtaaggggacggcggttgggtttcggtatttcgcgaggggggttttgcgattttgatttagtagcggcgttttcgggttcgcgaggttttgacgattagcgggcgttttttcgggaattatatttgtttttcgttggtttcgagcgtttagagcgcgaagcggcggagtacggcgaatttacg

SEQ ID NO: 34592 - DNA, 696 bp, Artificial Sequence
  chemically treated genomic DNA (Homo sapiens) CpG-island No: 34592
cgtaaattcgccgtactccgccgcttcgcgctctaaacgctcgaaaccaacgaaaaacaaatataattcccgaaaaaacgcccgctaatcgtcaaaacctcgcgaacccgaaaacgccgctactaaatcaaaatcgcaaaacccccctcgcgaaataccgaaacccaaccgccgtccccttacccaccctctcccctataaatcgatctccccttacgcctaaccaacatacttcgaaccgtccgaactcccgcaacgttaacccaaaaaacgactcccctcgacgaaacaaataacgaaccacttcgaaaaacacgaaattaacactacgaccctaaaaatacgaaacaaaaaaccaaaacgcgaaaaatctaaactcaaatcgaaatcgaaatcccgaaaaaatcccccatctcccttacccgcaaccctaaaatcccaaaaacccaactccgcgcaactttcgatttaaaaaacccgccctaatttacaaacacaaatacatatacccacacccgaacacacgcaaacaccgccaaaaaacgaaacaacgaacgaacgcctccgtaacaacgacctacgaaacgaaaccgaaactaacgccgcctcaaaaaaaaaccgaactataataaccgaaaatatccccaaaacaaaataaaccattccttctatccacgttaccaaaacttctccaac

SEQ ID NO: 34593 - DNA, 540 bp, Artificial Sequence
  chemically treated genomic DNA (Homo sapiens) CpG-island No: 34593
tacgtagtttagcgtttcgtagcgcgtttggtttatttggtagttggcgtacgtcggggtcgttttgtattgggcgttggttacgttcgatagtttgttggttgcggggttttggttcgcgggttcgtcgttttttgcgttcgtttttggggggttttaggtgcgtacgggagttagtattttcgttttggaaaagttcgaattttttgttttagaggcgatttcgattttgtatcgtaaattttacggcgttttgtaggacggcggttttttgtcgtttggacgttagttaggagtttttcggtagtagtagagtagaaagaaggatggtttcgttttatttcgtttttcggcggtttttttttcgttggtttacggagatagatggttgtttagtttcggaagtttagtttttgtttcggatattttaaggacgatatcgttttttttttcgggggtttattatatttgggattttgatgattcgggattttttttttattgaatttttgcgcgttttttgggaagggatgaggtgtg

SEQ ID NO: 34594 - DNA, 540 bp, Artificial Sequence
  chemically treated genomic DNA (Homo sapiens) CpG-island No: 34594
cacacctcatcccttcccaaaaaacgcgcaaaaattcaataaaaaaaaaatcccgaatcatcaaaatcccaaatataataaacccccgaaaaaaaaaacgatatcgtccttaaaatatccgaaacaaaaactaaacttccgaaactaaacaaccatctatctccgtaaaccaacgaaaaaaaaaccgccgaaaaacgaaataaaacgaaaccatccttctttctactctactactaccgaaaaactcctaactaacgtccaaacgacaaaaaaccgccgtcctacaaaacgccgtaaaatttacgatacaaaatcgaaatcgcctctaaaacaaaaaattcgaacttttccaaaacgaaaatactaactcccgtacgcacctaaaaccccccaaaaacgaacgcaaaaaacgacgaacccgcgaaccaaaaccccgcaaccaacaaactatcgaacgtaaccaacgcccaatacaaaacgaccccgacgtacgccaactaccaaataaaccaaacgcgctacgaaacgctaaactacgta

SEQ ID NO: 34595 - DNA, 540 bp, Artificial Sequence
  chemically treated genomic DNA (Homo sapiens) CpG-island No: 34595
tatattttatttttttttagaaaacgcgtaaaaatttaatgggagagaggtttcgagttattaaagttttagatgtggtgagttttcggaaggaaaaacggtgtcgtttttaggatgttcggaataagagttaggttttcggagttaggtagttatttattttcgtgagttagcgggagggagatcgtcgggaggcgaagtggggcggggttatttttttttttgttttgttgttgtcggggagtttttggttggcgtttaagcggtaggaggtcgtcgttttgtagggcgtcgtagagtttgcggtgtagagtcgggatcgtttttggggtagagggttcgagtttttttaaggcgagggtgttggttttcgtgcgtatttaaggttttttaggagcgggcgtaaagggcggcgggttcgcgggttagggtttcgtagttagtaggttgtcgagcgtggttagcgtttagtgtagggcggtttcggcgtgcgttagttgttaggtgagttaggcgcgttgcgaggcgttgggttgcgtg

SEQ ID NO: 34596 - DNA, 540 bp, Artificial Sequence
  chemically treated genomic DNA (Homo sapiens) CpG-island No: 34596
cacgcaacccaacgcctcgcaacgcgcctaactcacctaacaactaacgcacgccgaaaccgccctacactaaacgctaaccacgctcgacaacctactaactacgaaaccctaacccgcgaacccgccgccctttacgcccgctcctaaaaaaccttaaatacgcacgaaaaccaacaccctcgccttaaaaaaactcgaaccctctaccccaaaaacgatcccgactctacaccgcaaactctacgacgccctacaaaacgacgacctcctaccgcttaaacgccaaccaaaaactccccgacaacaacaaaacaaaaaaaaaaataaccccgccccacttcgcctcccgacgatctccctcccgctaactcacgaaaataaataactacctaactccgaaaacctaactcttattccgaacatcctaaaaacgacaccgtttttccttccgaaaactcaccacatctaaaactttaataactcgaaacctctctcccattaaatttttacgcgttttctaaaaaaaaataaaatata

SEQ ID NO: 34597 - DNA, 573 bp, Artificial Sequence
  chemically treated genomic DNA (Homo sapiens) CpG-island No: 34597
tatcgtcgcgtcggtcggacgtgcggtaatcgaataatatagaagtatttatttcgtttttttttatttttcgttcgtttgattttttcgttttttcgaataattttttaagaattttatattcgaagaaagatatcgatttcgttaaacgaaatcgaattattaattatacgatattaattatttttatttttttcgattcgttttttaatttttttaaagttttttagtcgggagtcgcgttcgcggggtttacgttatcggacggcgtacggcggcgaggacggacgcgttcgtatcgtatcgcgaattcgcgttattttatagtttttattaattttttcgtagggtacggattcgacgatacgtcgttcgcgtttatcgtaattttagtaacgaaattttttatgcgttcgttttttttttttttttttttttattttatcgattaaaatataggtttatcgcgttttttttaatttttatattcgagatattcgtttcgttttaaaacgagttttttttcgtttcggcggttcgcgagcgcgcgagggtaaatagtttcgacgtata

SEQ ID NO: 34598 - DNA, 573 bp, Artificial Sequence
  chemically treated genomic DNA (Homo sapiens) CpG-island No: 34598
tatacgtcgaaactatttaccctcgcgcgctcgcgaaccgccgaaacgaaaaaaaactcgttttaaaacgaaacgaatatctcgaatataaaaattaaaaaaaacgcgataaacctatattttaatcgataaaataaaaaaaaaaaaaaaaaaaaaacgaacgcataaaaaatttcgttactaaaattacgataaacgcgaacgacgtatcgtcgaatccgtaccctacgaaaaaattaataaaaactataaaataacgcgaattcgcgatacgatacgaacgcgtccgtcctcgccgccgtacgccgtccgataacgtaaaccccgcgaacgcgactcccgactaaaaaactttaaaaaaattaaaaaacgaatcgaaaaaaataaaaataattaatatcgtataattaataattcgatttcgtttaacgaaatcgatatctttcttcgaatataaaattcttaaaaaattattcgaaaaaacgaaaaaatcaaacgaacgaaaaataaaaaaaaacgaaataaatacttctatattattcgattaccgcacgtccgaccgacgcgacgata

SEQ ID NO: 34599 - DNA, 573 bp, Artificial Sequence
  chemically treated genomic DNA (Homo sapiens) CpG-island No: 34599
tgtgcgtcggggttgtttattttcgcgcgttcgcgggtcgtcggggcgggggggggttcgttttggggcggggcggatatttcgggtgtgggggttggggggagcgcggtgggtttatgttttggtcggtaaggtggggggggggggggggggggggcgggcgtatggggggtttcgttgttggggttgcggtgggcgcgggcggcgtgtcgtcgggttcgtgttttgcgggggggttggtggaggttatgaggtggcgcgggttcgcggtgcggtgcgggcgcgttcgttttcgtcgtcgtacgtcgttcggtggcgtgggtttcgcgggcgcggttttcggttggggggttttaggggggttggagggcggatcggggggggtggaggtggttggtgtcgtgtgattgatgattcggtttcgtttggcggggtcggtgttttttttcgggtgtggggtttttggggggttgttcggaggggcggaagggttaaacgggcggggggtgggggggagcggggtgggtgtttttgtgttgttcggttgtcgtacgttcggtcggcgcgacgatg

SEQ ID NO: 34600 - DNA, 573 bp, Artificial Sequence
  chemically treated genomic DNA (Homo sapiens) CpG-island No: 34600
catcgtcgcgccgaccgaacgtacgacaaccgaacaacacaaaaacacccaccccgctcccccccaccccccgcccgtttaacccttccgcccctccgaacaaccccccaaaaaccccacacccgaaaaaaaacaccgaccccgccaaacgaaaccgaatcatcaatcacacgacaccaaccacctccaccccccccgatccgccctccaacccccctaaaaccccccaaccgaaaaccgcgcccgcgaaacccacgccaccgaacgacgtacgacgacgaaaacgaacgcgcccgcaccgcaccgcgaacccgcgccacctcataacctccaccaacccccccgcaaaacacgaacccgacgacacgccgcccgcgcccaccgcaaccccaacaacgaaaccccccatacgcccgccccccccccccccccccccccaccttaccgaccaaaacataaacccaccgcgctccccccaacccccacacccgaaatatccgccccgccccaaaacgaacccccccccgccccgacgacccgcgaacgcgcgaaaataaacaaccccgacgcaca

SEQ ID NO: 34601 - DNA, 594 bp, Artificial Sequence
  chemically treated genomic DNA (Homo sapiens) CpG-island No: 34601
agagggcgcgggaggtgggtcgggcgtaatcgggatgggggcgggggcgcgggatgtttgcgggttttagtgagggggagggcgcgggagtgtggtcggggtttagtgggggagggagcgggagtgtgcgcggggcgtagtgaggggaaattgtggaatgtgggcgaggcgtagttggagaagagtgcgggaatgtgggcggggcgtagtgaggggaaattgtggaatgtgggcgaggcgtagttggaggagagtgcggggatgtgggcggggtgcggtgggggagggtgcggagatgtgggcggggcgtagtgggtggagagtgtagggatgtgggtttagcgtagtgggggatagtgtggggatgcgggcgaggcgtagtgggggcgggggcggggatgtgggcggggcgtagtgggtggagagtgcgggatgtgggcggggcgtagtgggtggagagtgcggaatgtgggcggggcgtagttggggagtttgcggggaatgtgggcggggcgtagtggtgggagggcgtaggagtgtgggcggggcgtagttgggggagggtgtagagatttgagggtttgaggttgtttg

SEQ ID NO: 34602 - DNA, 594 bp, Artificial Sequence
  chemically treated genomic DNA (Homo sapiens) CpG-island No: 34602
caaacaacctcaaaccctcaaatctctacaccctcccccaactacgccccgcccacactcctacgccctcccaccactacgccccgcccacattccccgcaaactccccaactacgccccgcccacattccgcactctccacccactacgccccgcccacatcccgcactctccacccactacgccccgcccacatccccgcccccgcccccactacgcctcgcccgcatccccacactatcccccactacgctaaacccacatccctacactctccacccactacgccccgcccacatctccgcaccctcccccaccgcaccccgcccacatccccgcactctcctccaactacgcctcgcccacattccacaatttcccctcactacgccccgcccacattcccgcactcttctccaactacgcctcgcccacattccacaatttcccctcactacgccccgcgcacactcccgctccctcccccactaaaccccgaccacactcccgcgccctccccctcactaaaacccgcaaacatcccgcgcccccgcccccatcccgattacgcccgacccacctcccgcgccctct

SEQ ID NO: 34603 - DNA, 594 bp, Artificial Sequence
  chemically treated genomic DNA (Homo sapiens) CpG-island No: 34603
taggtaattttaagtttttaggtttttgtatttttttttaattgcgtttcgtttatatttttgcgtttttttattattgcgtttcgtttatatttttcgtaagttttttaattgcgtttcgtttatatttcgtattttttatttattgcgtttcgtttatatttcgtattttttatttattgcgtttcgtttatattttcgttttcgtttttattgcgtttcgttcgtatttttatattgttttttattgcgttgggtttatatttttatattttttatttattgcgtttcgtttatattttcgtatttttttttatcgtatttcgtttatattttcgtatttttttttaattgcgtttcgtttatattttatagtttttttttattgcgtttcgtttatattttcgtatttttttttaattgcgtttcgtttatattttatagtttttttttattgcgtttcgcgtatattttcgtttttttttttattgggtttcggttatattttcgcgtttttttttttattggggttcgtagatatttcgcgttttcgtttttatttcgattgcgttcggtttatttttcgcgtttttt

SEQ ID NO: 34604 - DNA, 594 bp, Artificial Sequence
  chemically treated genomic DNA (Homo sapiens) CpG-island No: 34604
aaaaaacgcgaaaaataaaccgaacgcaatcgaaataaaaacgaaaacgcgaaatatctacgaaccccaataaaaaaaaaaacgcgaaaatataaccgaaacccaataaaaaaaaaaacgaaaatatacgcgaaacgcaataaaaaaaaactataaaatataaacgaaacgcaattaaaaaaaaatacgaaaatataaacgaaacgcaataaaaaaaaactataaaatataaacgaaacgcaattaaaaaaaaatacgaaaatataaacgaaatacgataaaaaaaaatacgaaaatataaacgaaacgcaataaataaaaaatataaaaatataaacccaacgcaataaaaaacaatataaaaatacgaacgaaacgcaataaaaacgaaaacgaaaatataaacgaaacgcaataaataaaaaatacgaaatataaacgaaacgcaataaataaaaaatacgaaatataaacgaaacgcaattaaaaaacttacgaaaaatataaacgaaacgcaataataaaaaaacgcaaaaatataaacgaaacgcaattaaaaaaaaatacaaaaacctaaaaacttaaaattaccta

SEQ ID NO: 34605 - DNA, 537 bp, Artificial Sequence
  chemically treated genomic DNA (Homo sapiens) CpG-island No: 34605
tggattttcgggcgtcgcgtagtagtcggttttttggcgttatttagtttagtttaggtttagatttttattcgggtttcgcggtcggtagagttggttttattttgcggtcgtcgtggtttgcgtatcgatatcgatgcgatttgtacgtttcgtcgcgtagtaagtattcgcgtcgggaatagtcgcgggtcgtacgtcgcgggtcgtacgtcgtacgtttgcgtagggaggcgtcgcgtacgtcggggtcgtttcgggtacgcgcgttggattagtttatttcgtttttttttagggcggttcggcggaagcggttttgtaatttttttttttggttttttcggttgtatttatattggtttttgtttttcgaagtaaaaggggatattttgttttgcggtgcgattgcgggttaaggtacgggcgaaggtagggtaggttggtggaggggatcggtttcgaggggtgtgcggttgtttttatgtttgttatttttttgcgataatttgttttagtaatattaatagatggtat

SEQ ID NO: 34606 - DNA, 537 bp, Artificial Sequence
  chemically treated genomic DNA (Homo sapiens) CpG-island No: 34606
ataccatctattaatattactaaaacaaattatcgcaaaaaaataacaaacataaaaacaaccgcacacccctcgaaaccgatcccctccaccaacctaccctaccttcgcccgtaccttaacccgcaatcgcaccgcaaaacaaaatatccccttttacttcgaaaaacaaaaaccaatataaatacaaccgaaaaaaccaaaaaaaaaaattacaaaaccgcttccgccgaaccgccctaaaaaaaaacgaaataaactaatccaacgcgcgtacccgaaacgaccccgacgtacgcgacgcctccctacgcaaacgtacgacgtacgacccgcgacgtacgacccgcgactattcccgacgcgaatacttactacgcgacgaaacgtacaaatcgcatcgatatcgatacgcaaaccacgacgaccgcaaaataaaaccaactctaccgaccgcgaaacccgaataaaaatctaaacctaaactaaactaaataacgccaaaaaaccgactactacgcgacgcccgaaaatcca

SEQ ID NO: 34607 - DNA, 537 bp, Artificial Sequence
  chemically treated genomic DNA (Homo sapiens) CpG-island No: 34607
atattatttattaatattattgaaataagttatcgtagagaagtgataagtatggagatagtcgtatatttttcggaatcggttttttttattagtttgttttgttttcgttcgtgttttgattcgtagtcgtatcgtaggataaaatgtttttttttatttcggaaagtagaagttagtgtaaatgtaatcgggagaattagagaagggagttgtaaggtcgttttcgtcgggtcgttttgagaaggagcggggtgagttagtttagcgcgcgtattcggagcgatttcggcgtgcgcggcgtttttttgcgtaggcgtgcggcgtgcggttcgcggcgtgcggttcgcggttgttttcggcgcggatatttattgcgcggcggggcgtgtaggtcgtatcgatgtcggtgcgtaggttacggcggtcgtagagtggggttaattttgtcggtcgcgggattcgggtgagggtttgggtttgggttgggttgggtgacgttaggaggtcggttattgcgcggcgttcgagagttta

SEQ ID NO: 34608 - DNA, 537 bp, Artificial Sequence
  chemically treated genomic DNA (Homo sapiens) CpG-island No: 34608
taaactctcgaacgccgcgcaataaccgacctcctaacgtcacccaacccaacccaaacccaaaccctcacccgaatcccgcgaccgacaaaattaaccccactctacgaccgccgtaacctacgcaccgacatcgatacgacctacacgccccgccgcgcaataaatatccgcgccgaaaacaaccgcgaaccgcacgccgcgaaccgcacgccgcacgcctacgcaaaaaaacgccgcgcacgccgaaatcgctccgaatacgcgcgctaaactaactcaccccgctccttctcaaaacgacccgacgaaaacgaccttacaactcccttctctaattctcccgattacatttacactaacttctactttccgaaataaaaaaaaacattttatcctacgatacgactacgaatcaaaacacgaacgaaaacaaaacaaactaataaaaaaaaccgattccgaaaaatatacgactatctccatacttatcacttctctacgataacttatttcaataatattaataaataatat

SEQ ID NO: 34609 - DNA, 641 bp, Artificial Sequence
  chemically treated genomic DNA (Homo sapiens) CpG-island No: 34609
gaatatagcggcgcgaggagaaatttttagagatagggaaaaggtggacgtagcggttgacgttgtttagacgttaggcgtcgataggagtttgattgttatcgtacgattagtgagggggcggggcggagttgtgttttaaagcgtttgcgcggagagtttgtaattagggattaggtttgggaggcgacgaagaggaacgttgggcgtaggaggtttattgtatacgtaggcgtattcggcgatttcggttttttcgcgcgtagttttcgtataggtatcggggggggtaggggcggggtaggggcggggataaatgcggagggacggtttagttttagttttttgttcgtcgtcgtcgttgtcgtcgttattttttttgatttacgaaagttatgttatttaatatcgggtaagggggtaggggcggcgcggggagagattttgtcgggcgaaggacgcgtttcggtggggtcgtcgcggatcgttcgggttggtcggttcggttgtgggaggttaaggatattgtttgggtacgttttgagttttggttcgcgttgggtattgtgtatcgagaatttgcggtaacgtgtgaaaaggaatataaatttttgtattataggatggtagtagtgtagaaa

SEQ ID NO: 34610 - DNA, 641 bp, Artificial Sequence
  chemically treated genomic DNA (Homo sapiens) CpG-island No: 34610
tttctacactactaccatcctataatacaaaaatttatattccttttcacacgttaccgcaaattctcgatacacaatacccaacgcgaaccaaaactcaaaacgtacccaaacaatatccttaacctcccacaaccgaaccgaccaacccgaacgatccgcgacgaccccaccgaaacgcgtccttcgcccgacaaaatctctccccgcgccgcccctacccccttacccgatattaaataacataactttcgtaaatcaaaaaaaataacgacgacaacgacgacgacgaacaaaaaactaaaactaaaccgtccctccgcatttatccccgcccctaccccgcccctaccccccccgatacctatacgaaaactacgcgcgaaaaaaccgaaatcgccgaatacgcctacgtatacaataaacctcctacgcccaacgttcctcttcgtcgcctcccaaacctaatccctaattacaaactctccgcgcaaacgctttaaaacacaactccgccccgccccctcactaatcgtacgataacaatcaaactcctatcgacgcctaacgtctaaacaacgtcaaccgctacgtccaccttttccctatctctaaaaatttctcctcgcgccgctatattc

SEQ ID NO: 34611 - DNA, 641 bp, Artificial Sequence
  chemically treated genomic DNA (Homo sapiens) CpG-island No: 34611
tttttatattgttgttattttgtaatataaaagtttgtgtttttttttatacgttatcgtagattttcggtgtatagtgtttagcgcggattagagtttagagcgtgtttaggtagtatttttgattttttatagtcgggtcggttagttcgggcgattcgcggcggttttatcgagacgcgtttttcgttcgatagggttttttttcgcgtcgtttttatttttttattcggtgttgggtaatatgattttcgtagattagaggaggtggcggcgatagcggcggcggcgagtagagagttaaagttggatcgttttttcgtatttattttcgtttttgtttcgtttttgtttttttcgatgtttgtgcgggaattgcgcgcggaaaagtcgggatcgtcgagtgcgtttgcgtatgtagtgggttttttgcgtttagcgttttttttcgtcgttttttaagtttggtttttgattgtaggtttttcgcgtaggcgttttgaggtatagtttcgtttcgtttttttattggtcgtacggtgataattaggtttttgtcggcgtttagcgtttgggtagcgttagtcgttacgtttattttttttttgtttttaggggttttttttcgcgtcgttgtgttt

SEQ ID NO: 34612 - DNA, 641 bp, Artificial Sequence
  chemically treated genomic DNA (Homo sapiens) CpG-island No: 34612
aaacacaacgacgcgaaaaaaaacccctaaaaacaaaaaaaaaataaacgtaacgactaacgctacccaaacgctaaacgccgacaaaaacctaattatcaccgtacgaccaataaaaaaacgaaacgaaactatacctcaaaacgcctacgcgaaaaacctacaatcaaaaaccaaacttaaaaaacgacgaaaaaaaacgctaaacgcaaaaaacccactacatacgcaaacgcactcgacgatcccgacttttccgcgcgcaattcccgcacaaacatcgaaaaaaacaaaaacgaaacaaaaacgaaaataaatacgaaaaaacgatccaactttaactctctactcgccgccgccgctatcgccgccacctcctctaatctacgaaaatcatattacccaacaccgaataaaaaaataaaaacgacgcgaaaaaaaaccctatcgaacgaaaaacgcgtctcgataaaaccgccgcgaatcgcccgaactaaccgacccgactataaaaaatcaaaaatactacctaaacacgctctaaactctaatccgcgctaaacactatacaccgaaaatctacgataacgtataaaaaaaaacacaaacttttatattacaaaataacaacaatataaaaa

SEQ ID NO: 34613 - DNA, 1078 bp, Artificial Sequence
  chemically treated genomic DNA (Homo sapiens) CpG-island No: 34613
gtttgtagtcgtcgttgagattcgagttgtcgggcggcggggcggttcggggtaggcggatcggagtcgttatcgggggtttttgcgtttcgtatttttaagttcggcgttgtcgacgagcggtcgttcgggtttttgttttcgtttcggtttcgttttttcgagaggagataaaaggaaggtttagtcgggttatcgcgcggtcgttgacggggaagtagagtcgatttcggcgcggtcgttttttatataaaggggtttttcgtttgggtcgcggcgtcggcgtattcgttttcgtttcgcgcgcgggtttttatttatttgtaggtgtttgtgcgtttgtttataggaacgcggtcggcgcgggggggtttgcgagagtcgggtagttcgggttggacgggacgggtcgaaggggcgcgagggcgggaggagagcggttagagggtcgggtattaaaggtaagtggagcggggaaggcgttcggcgggcggcggatcgtagatcgattcgtgtggttttgattttagtttggatagaacgatcgtcgtgtttcgatttattttttttaagttttacgcgtttatatatgaattttgcgtacggattgagggtaaagtgcgggtatatacgagttgttattaagagcgaggttgaaatttaggatttcgggttttagtcggtatcggaaacgcgtcgtggtcggcgagatttataggaagtgtgtaacgatattttttacggtacgtatcgagttcgtagtcgttgttgtttcgaggaggtgtagatcgagttttttgtcgtatatacgttcgtacgcggcggtcggcgcgttggatcgagaggttggagtaatttatttttcgcgcgtacgagtttagtttttattgtttcgataggtgtggaattcgtcgttttcgttatggttcgaggaagtgtatagtattgttttttattatacgttttgggttcgcggttttcgatgtttttcggagttttgtgtatttttattgaaacgtaaggagtagatagaatttatattattcgtgaggtgtgtgattttttttataacgtattg

SEQ ID NO: 34614 - DNA, 1078 bp, Artificial Sequence
  chemically treated genomic DNA (Homo sapiens) CpG-island No: 34614
caatacgttataaaaaaaatcacacacctcacgaataatataaattctatctactccttacgtttcaataaaaatacacaaaactccgaaaaacatcgaaaaccgcgaacccaaaacgtataataaaaaacaatactatacacttcctcgaaccataacgaaaacgacgaattccacacctatcgaaacaataaaaactaaactcgtacgcgcgaaaaataaattactccaacctctcgatccaacgcgccgaccgccgcgtacgaacgtatatacgacaaaaaactcgatctacacctcctcgaaacaacaacgactacgaactcgatacgtaccgtaaaaaatatcgttacacacttcctataaatctcgccgaccacgacgcgtttccgataccgactaaaacccgaaatcctaaatttcaacctcgctcttaataacaactcgtatatacccgcactttaccctcaatccgtacgcaaaattcatatataaacgcgtaaaacttaaaaaaaataaatcgaaacacgacgatcgttctatccaaactaaaatcaaaaccacacgaatcgatctacgatccgccgcccgccgaacgccttccccgctccacttacctttaatacccgaccctctaaccgctctcctcccgccctcgcgccccttcgacccgtcccgtccaacccgaactacccgactctcgcaaacccccccgcgccgaccgcgttcctataaacaaacgcacaaacacctacaaataaataaaaacccgcgcgcgaaacgaaaacgaatacgccgacgccgcgacccaaacgaaaaacccctttatataaaaaacgaccgcgccgaaatcgactctacttccccgtcaacgaccgcgcgataacccgactaaaccttccttttatctcctctcgaaaaaacgaaaccgaaacgaaaacaaaaacccgaacgaccgctcgtcgacaacgccgaacttaaaaatacgaaacgcaaaaacccccgataacgactccgatccgcctaccccgaaccgccccgccgcccgacaactcgaatctcaacgacgactacaaac

SEQ ID NO: 34615 - DNA, 1078 bp, Artificial Sequence
  chemically treated genomic DNA (Homo sapiens) CpG-island No: 34615
taatgcgttataagggaaattatatattttacggatggtgtaggttttgtttgttttttgcgttttagtggaggtgtatagagtttcggggggtatcggggatcgcgggtttaggacgtgtagtagggagtagtgttgtatattttttcggattatagcggggacggcgggttttatatttgtcggggtagtagggattgagttcgtgcgcgcggaggatggattgttttaatttttcggtttagcgcgtcggtcgtcgcgtgcgaacgtgtgtgcggtaggaggttcgatttatattttttcggggtagtaacgattgcgagttcggtgcgtgtcgtaggaggtgtcgttatatattttttgtgggtttcgtcgattacggcgcgttttcggtgtcggttggagttcggggttttagattttagtttcgtttttggtagtagttcgtgtgtgttcgtattttgtttttagttcgtacgtaagatttatatatgggcgcgtaaagtttggggagaatggatcggagtacgacggtcgttttatttaaattggagttagggttatacgaatcgatttacggttcgtcgttcgtcgggcgtttttttcgttttatttatttttggtgttcggttttttggtcgtttttttttcgttttcgcgttttttcggttcgtttcgtttagttcgggttgttcggttttcgtaggttttttcgcgtcgatcgcgtttttatggatagacgtatagatatttgtaggtgggtgagagttcgcgcgcggggcggggacgagtgcgtcgacgtcgcgatttaggcggggagtttttttgtgtggggggcggtcgcgtcggggtcgattttgttttttcgttagcggtcgcgcggtgattcggttgaattttttttttgttttttttcgggggagcgaggtcggagcgagggtagggattcgggcggtcgttcgtcggtagcgtcgggtttgggggtgcgaggcgtagagattttcggtggcggtttcggttcgtttgtttcgggtcgtttcgtcgttcggtagttcgggttttagcggcggttgtaggt

SEQ ID NO: 34616 - DNA, 1078 bp, Artificial Sequence
  chemically treated genomic DNA (Homo sapiens) CpG-island No: 34616
acctacaaccgccgctaaaacccgaactaccgaacgacgaaacgacccgaaacaaacgaaccgaaaccgccaccgaaaatctctacgcctcgcacccccaaacccgacgctaccgacgaacgaccgcccgaatccctaccctcgctccgacctcgctcccccgaaaaaaaacaaaaaaaaaattcaaccgaatcaccgcgcgaccgctaacgaaaaaacaaaatcgaccccgacgcgaccgccccccacacaaaaaaactccccgcctaaatcgcgacgtcgacgcactcgtccccgccccgcgcgcgaactctcacccacctacaaatatctatacgtctatccataaaaacgcgatcgacgcgaaaaaacctacgaaaaccgaacaacccgaactaaacgaaacgaaccgaaaaaacgcgaaaacgaaaaaaaaacgaccaaaaaaccgaacaccaaaaataaataaaacgaaaaaaacgcccgacgaacgacgaaccgtaaatcgattcgtataaccctaactccaatttaaataaaacgaccgtcgtactccgatccattctccccaaactttacgcgcccatatataaatcttacgtacgaactaaaaacaaaatacgaacacacacgaactactaccaaaaacgaaactaaaatctaaaaccccgaactccaaccgacaccgaaaacgcgccgtaatcgacgaaacccacaaaaaatatataacgacacctcctacgacacgcaccgaactcgcaatcgttactaccccgaaaaaatataaatcgaacctcctaccgcacacacgttcgcacgcgacgaccgacgcgctaaaccgaaaaattaaaacaatccatcctccgcgcgcacgaactcaatccctactaccccgacaaatataaaacccgccgtccccgctataatccgaaaaaatatacaacactactccctactacacgtcctaaacccgcgatccccgataccccccgaaactctatacacctccactaaaacgcaaaaaacaaacaaaacctacaccatccgtaaaatatataatttcccttataacgcatta

SEQ ID NO: 34617 - DNA, 678 bp, Artificial Sequence
  chemically treated genomic DNA (Homo sapiens) CpG-island No: 34617
aaacgttttgtggtcgacgttttttttttttttatacgttattggcgtgatcgttcgcgttatatattgcgtttgcgtaagggttgtggttttttttttattttttagcgtcgttgggtttgtaggtttttgtcgagtacgcggacgtcggtttttgtttcgtaggatggtgagtggatgtttcggtttcggggttttagatgtatggaggttttttttttttgttcgtatgttagtttagggttcgtttcgcgcgtcgtaggggtcggatggcgttagattgttagttttgatttggtcgaggtgtagtttttagcgtggttttaaatggttgtcgttcggtgcgcgaatttggggggaggggttggcgaagaagggttgcgtgagtttggacggcggattggggagaagggtgagtttagtagatagtttgagtgcggatattgtcgtttagtgtgagggggcgttggtaagcggtcgggcgtgagaggtcgtaagtagtcgattttagtttagttggggaacgttagaatggaggggggttgtaggttttcgggttttattcgattttcgagtatcgagtatttcgtgggttttttaggagaatgtcggagtcggtaagttttagatttaggaagtttgtgttcgtgggttgagtaagtggtttttaagttaaaa

SEQ ID NO: 34618 - DNA, 678 bp, Artificial Sequence
  chemically treated genomic DNA (Homo sapiens) CpG-island No: 34618
ttttaacttaaaaaccacttactcaacccacgaacacaaacttcctaaatctaaaacttaccgactccgacattctcctaaaaaacccacgaaatactcgatactcgaaaatcgaataaaacccgaaaacctacaacccccctccattctaacgttccccaactaaactaaaatcgactacttacgacctctcacgcccgaccgcttaccaacgccccctcacactaaacgacaatatccgcactcaaactatctactaaactcacccttctccccaatccgccgtccaaactcacgcaacccttcttcgccaacccctccccccaaattcgcgcaccgaacgacaaccatttaaaaccacgctaaaaactacacctcgaccaaatcaaaactaacaatctaacgccatccgacccctacgacgcgcgaaacgaaccctaaactaacatacgaacaaaaaaaaaaaacctccatacatctaaaaccccgaaaccgaaacatccactcaccatcctacgaaacaaaaaccgacgtccgcgtactcgacaaaaacctacaaacccaacgacgctaaaaaataaaaaaaaaaccacaacccttacgcaaacgcaatatataacgcgaacgatcacgccaataacgtataaaaaaaaaaaaaacgtcgaccacaaaacgttt

SEQ ID NO: 34619 - DNA, 678 bp, Artificial Sequence
  chemically treated genomic DNA (Homo sapiens) CpG-island No: 34619
ttttggtttaaaagttatttgtttagtttacgggtataagttttttaaatttaagatttgtcggtttcgatatttttttggaaaatttacgaagtattcggtattcggaggtcgagtgggattcgaggatttgtagtttttttttattttggcgttttttagttaggttgaggtcgattgtttgcgattttttacgttcggtcgtttgttagcgtttttttatattagacggtagtattcgtatttaggttgtttattaaatttatttttttttttaattcgtcgtttaagtttacgtaattttttttcgttaatttttttttttaagttcgcgtatcgggcggtagttatttaaggttacgttgggaattgtatttcgattaagttagagttagtaatttaacgttattcggtttttgcgacgcgcgagacgggttttaggttggtatacgggtaagaaaagggaatttttatgtatttaaagtttcgagatcgaggtatttatttattattttgcggaatagagatcggcgttcgcgtgttcgatagagatttgtaggtttagcggcgttagggggtgggaaaagggttatagtttttgcgtaggcgtagtatgtagcgcggacggttacgttagtgacgtgtgaaagagagaggggcgtcggttataaggcgttt

SEQ ID NO: 34620 - DNA, 678 bp, Artificial Sequence
  chemically treated genomic DNA (Homo sapiens) CpG-island No: 34620
aaacgccttataaccgacgcccctctctctttcacacgtcactaacgtaaccgtccgcgctacatactacgcctacgcaaaaactataacccttttcccaccccctaacgccgctaaacctacaaatctctatcgaacacgcgaacgccgatctctattccgcaaaataataaataaatacctcgatctcgaaactttaaatacataaaaattcccttttcttacccgtataccaacctaaaacccgtctcgcgcgtcgcaaaaaccgaataacgttaaattactaactctaacttaatcgaaatacaattcccaacgtaaccttaaataactaccgcccgatacgcgaacttaaaaaaaaaaattaacgaaaaaaaattacgtaaacttaaacgacgaattaaaaaaaaaaataaatttaataaacaacctaaatacgaatactaccgtctaatataaaaaaacgctaacaaacgaccgaacgtaaaaaatcgcaaacaatcgacctcaacctaactaaaaaacgccaaaataaaaaaaaactacaaatcctcgaatcccactcgacctccgaataccgaatacttcgtaaattttccaaaaaaatatcgaaaccgacaaatcttaaatttaaaaaacttatacccgtaaactaaacaaataacttttaaaccaaaa

SEQ ID NO: 34621 - DNA, 1347 bp, Artificial Sequence
  chemically treated genomic DNA (Homo sapiens) CpG-island No: 34621
gagtagagatacgggacggagtagagatacgggacggagtagagatacgggatggagtagagatacgggacggagtagggatacgggacggagtagagatacgggacggagtagagatacgggacggagtagagatacgggacggagtagagatacgggacggagtagagatacgggggacggggtagagatacgggacggagtagagatacgggggacggagtagagatacgggacggagtagagatacgggacggagtagagatacgggacggagtagagatacgggggacggagtagagattcgggggacggggtagagatacgggggacggggtagagatacgggacggagtagagatacgggacggagtagagatacgggacggagtagggatacgggacggggtagagatacgggacggggtagagatacgggggacggggtagagatacgggacggagtagagatacgggggacggggtagagattcgggacggagtagggatacgggacggagtagagatacgggacggggtagagatacgggacggagtagagatacgggacggagtagagatatgggacggagtagggatacgggacggggtagagatacgggacggagtagagatacgggacggagtagagatacgggacggagtagggatacgggacggggtagagatacgggacggggtagagatacgggggacggggtagagatacgggacggagtagagatacgggggacggggtagagatacgggacggagtagggatacgggacggggtagagatacgggacggggtagagatacgggacggagtagagatattgggacggagtagagatacgggggacggagtagagattcgggggacggggtagagatacgggggacggggtagagatacgggacggggtagagatacgggggacggggtagagatacgggacggagtagggatacgggacggagtagagatacgggggacggagtagagatacgggggacggggtagagatacgggacggggtagagatacgggacggggtagagatacgggacggagtagagatacgggacggagtagagatacgggacggggtagagatacgggacggagtagagatacgggacggggtagagatacgggacggagtagagatacgggggacggagtagagatacgggacggagtagagatacgggacggagtagatacgggacggagtagggatacgggacggagtagatataggacggggtagagatatagggaatggagcggggatacgggggatggagtgcgggtttttacggggattgtttcgtttttag

SEQ ID NO: 34622 - DNA, 1347 bp, Artificial Sequence
  chemically treated genomic DNA (Homo sapiens) CpG-island No: 34622
ctaaaaacgaaacaatccccgtaaaaacccgcactccatcccccgtatccccgctccattccctatatctctaccccgtcctatatctactccgtcccgtatccctactccgtcccgtatctactccgtcccgtatctctactccgtcccgtatctctactccgtcccccgtatctctactccgtcccgtatctctaccccgtcccgtatctctactccgtcccgtatctctaccccgtcccgtatctctactccgtcccgtatctctactccgtcccgtatctctaccccgtcccgtatctctaccccgtcccgtatctctaccccgtcccccgtatctctactccgtcccccgtatctctactccgtcccgtatccctactccgtcccgtatctctaccccgtcccccgtatctctaccccgtcccgtatctctaccccgtcccccgtatctctaccccgtcccccgaatctctactccgtcccccgtatctctactccgtcccaatatctctactccgtcccgtatctctaccccgtcccgtatctctaccccgtcccgtatccctactccgtcccgtatctctaccccgtcccccgtatctctactccgtcccgtatctctaccccgtcccccgtatctctaccccgtcccgtatctctaccccgtcccgtatccctactccgtcccgtatctctactccgtcccgtatctctactccgtcccgtatctctaccccgtcccgtatccctactccgtcccatatctctactccgtcccgtatctctactccgtcccgtatctctaccccgtcccgtatctctactccgtcccgtatccctactccgtcccgaatctctaccccgtcccccgtatctctactccgtcccgtatctctaccccgtcccccgtatctctaccccgtcccgtatctctaccccgtcccgtatccctactccgtcccgtatctctactccgtcccgtatctctactccgtcccgtatctctaccccgtcccccgtatctctaccccgtcccccgaatctctactccgtcccccgtatctctactccgtcccgtatctctactccgtcccgtatctctactccgtcccgtatctctactccgtcccccgtatctctactccgtcccgtatctctaccccgtcccccgtatctctactccgtcccgtatctctactccgtcccgtatctctactccgtcccgtatctctactccgtcccgtatctctactccgtcccgtatccctactccgtcccgtatctctactccatcccgtatctctactccgtcccgtatctctactccgtcccgtatctctactc

SEQ ID NO: 34623 - DNA, 1347 bp, Artificial Sequence
  chemically treated genomic DNA (Homo sapiens) CpG-island No: 34623
ttgggaacggggtagttttcgtggaggttcgtattttatttttcgtgttttcgttttattttttgtgtttttgtttcgttttgtgtttgtttcgtttcgtgtttttgtttcgtttcgtgtttgtttcgtttcgtgtttttgtttcgtttcgtgtttttgtttcgtttttcgtgtttttgtttcgtttcgtgtttttgtttcgtttcgtgtttttgtttcgtttcgtgtttttgtttcgtttcgtgtttttgtttcgtttcgtgtttttgtttcgtttcgtgtttttgtttcgtttcgtgtttttgtttcgtttcgtgtttttgtttcgtttttcgtgtttttgtttcgtttttcgtgtttttgtttcgtttcgtgtttttgtttcgtttcgtgtttttgtttcgtttttcgtgtttttgtttcgtttcgtgtttttgtttcgtttttcgtgtttttgtttcgtttttcgagtttttgtttcgtttttcgtgtttttgtttcgttttagtgtttttgtttcgtttcgtgtttttgtttcgtttcgtgtttttgtttcgtttcgtgtttttgtttcgtttcgtgtttttgtttcgtttttcgtgtttttgtttcgtttcgtgtttttgtttcgtttttcgtgtttttgtttcgtttcgtgtttttgtttcgtttcgtgtttttgtttcgtttcgtgtttttgtttcgtttcgtgtttttgtttcgtttcgtgtttttgtttcgtttcgtgtttttgtttcgttttatgtttttgtttcgtttcgtgtttttgtttcgtttcgtgtttttgtttcgtttcgtgtttttgtttcgtttcgtgtttttgtttcgtttcgagtttttgtttcgtttttcgtgtttttgtttcgtttcgtgtttttgtttcgtttttcgtgtttttgtttcgtttcgtgtttttgtttcgtttcgtgtttttgtttcgtttcgtgtttttgtttcgtttcgtgtttttgtttcgtttcgtgtttttgtttcgtttttcgtgtttttgtttcgtttttcgagtttttgtttcgtttttcgtgtttttgtttcgtttcgtgtttttgtttcgtttcgtgtttttgtttcgtttcgtgtttttgtttcgtttttcgtgtttttgtttcgtttcgtgtttttgtttcgtttttcgtgtttttgtttcgtttcgtgtttttgtttcgtttcgtgtttttgtttcgtttcgtgtttttgtttcgtttcgtgtttttgtttcgtttcgtgtttttgtttcgtttcgtgtttttgttttatttcgtgtttttgtttcgtttcgtgtttttgtttcgtttcgtgtttttgttt

SEQ ID NO: 34624 - DNA, 1347 bp, Artificial Sequence
  chemically treated genomic DNA (Homo sapiens) CpG-island No: 34624
aaacaaaaacacgaaacgaaacaaaaacacgaaacgaaacaaaaacacgaaataaaacaaaaacacgaaacgaaacaaaaacacgaaacgaaacaaaaacacgaaacgaaacaaaaacacgaaacgaaacaaaaacacgaaacgaaacaaaaacacgaaacgaaacaaaaacacgaaaaacgaaacaaaaacacgaaacgaaacaaaaacacgaaaaacgaaacaaaaacacgaaacgaaacaaaaacacgaaacgaaacaaaaacacgaaacgaaacaaaaacacgaaaaacgaaacaaaaactcgaaaaacgaaacaaaaacacgaaaaacgaaacaaaaacacgaaacgaaacaaaaacacgaaacgaaacaaaaacacgaaacgaaacaaaaacacgaaacgaaacaaaaacacgaaacgaaacaaaaacacgaaaaacgaaacaaaaacacgaaacgaaacaaaaacacgaaaaacgaaacaaaaactcgaaacgaaacaaaaacacgaaacgaaacaaaaacacgaaacgaaacaaaaacacgaaacgaaacaaaaacacgaaacgaaacaaaaacataaaacgaaacaaaaacacgaaacgaaacaaaaacacgaaacgaaacaaaaacacgaaacgaaacaaaaacacgaaacgaaacaaaaacacgaaacgaaacaaaaacacgaaacgaaacaaaaacacgaaaaacgaaacaaaaacacgaaacgaaacaaaaacacgaaaaacgaaacaaaaacacgaaacgaaacaaaaacacgaaacgaaacaaaaacacgaaacgaaacaaaaacacgaaacgaaacaaaaacactaaaacgaaacaaaaacacgaaaaacgaaacaaaaactcgaaaaacgaaacaaaaacacgaaaaacgaaacaaaaacacgaaacgaaacaaaaacacgaaaaacgaaacaaaaacacgaaacgaaacaaaaacacgaaacgaaacaaaaacacgaaaaacgaaacaaaaacacgaaaaacgaaacaaaaacacgaaacgaaacaaaaacacgaaacgaaacaaaaacacgaaacgaaacaaaaacacgaaacgaaacaaaaacacgaaacgaaacaaaaacacgaaacgaaacaaaaacacgaaacgaaacaaaaacacgaaacgaaacaaaaacacgaaaaacgaaacaaaaacacgaaacgaaacaaaaacacgaaacgaaacaaacacgaaacgaaacaaaaacacgaaacgaaacaaacacaaaacgaaacaaaaacacaaaaaataaaacgaaaacacgaaaaataaaatacgaacctccacgaaaactaccccgttcccaa

SEQ ID NO: 34625 - DNA, 690 bp, Artificial Sequence
  chemically treated genomic DNA (Homo sapiens) CpG-island No: 34625
tttttcgtgtttttgtttcgtttcgtgtttttgtttcgtttcgtgtttttgtttcgtttcgtgtttttgtttcgtttttcgtgtttttgtttcgtttcgtgtttttgtttcgttttcgtgtttttgtttcgtttcgtgtttttgtttcgttttcgtgtttttgtttcgtttcgtgtttttgtttcgtttttagtgtttttgtttcgtttcgtgtttttgtttcgttttcgtgtttttgtttcgtttttcgtgtttttgtttcgtttttcgtgtttttgtttcgtttttcgtgtttttgtttcgtttcgtgtttttgtttcgtttttcgtgtttttgtttcgtttcgtgtttttgtttcgtttcgtgtttttgtttcgtttcgtgtttttgtttcgtttcgtgtttttgtttcgtttcgtgtttttgtttcgtttcgtgtttttgtttcgtttcgtgtttttgtttcgtttcgtgtttttgtttcgtttcgtgtttttgtttcgtttcgtgtttttgtttcgttttcgtgtttttgtttcgtttttcgtgtttttgtttcgtttcgtgtttttgtttcgtttcgtgtttttgtttcgtttcgtgtttttgtttcgtttcgtgtttttgtttcgttttttatgttttcgttttattttatgtttttgtttattttttttgtttttaggtttg

SEQ ID NO: 34626 - DNA, 690 bp, Artificial Sequence
  chemically treated genomic DNA (Homo sapiens) CpG-island No: 34626
caaacctaaaaacaaaaaaaataaacaaaaacataaaataaaacgaaaacataaaaaacgaaacaaaaacacgaaacgaaacaaaaacacgaaacgaaacaaaaacacgaaacgaaacaaaaacacgaaacgaaacaaaaacacgaaaaacgaaacaaaaacacgaaaacgaaacaaaaacacgaaacgaaacaaaaacacgaaacgaaacaaaaacacgaaacgaaacaaaaacacgaaacgaaacaaaaacacgaaacgaaacaaaaacacgaaacgaaacaaaaacacgaaacgaaacaaaaacacgaaacgaaacaaaaacacgaaacgaaacaaaaacacgaaacgaaacaaaaacacgaaaaacgaaacaaaaacacgaaacgaaacaaaaacacgaaaaacgaaacaaaaacacgaaaaacgaaacaaaaacacgaaaaacgaaacaaaaacacgaaaacgaaacaaaaacacgaaacgaaacaaaaacactaaaaacgaaacaaaaacacgaaacgaaacaaaaacacgaaaacgaaacaaaaacacgaaacgaaacaaaaacacgaaaacgaaacaaaaacacgaaacgaaacaaaaacacgaaaaacgaaacaaaaacacgaaacgaaacaaaaacacgaaacgaaacaaaaacacgaaacgaaacaaaaacacgaaaaa

SEQ ID NO: 34627 - DNA, 690 bp, Artificial Sequence
  chemically treated genomic DNA (Homo sapiens) CpG-island No: 34627
taggtttggggataggggggatgagtagggatatgggatggagcggagatatgggggacggggtagagatacgggacggagtagggatacgggacggagtagggatacgggacggagtagagatacgggacggagtagagatacgggggacggagtagagatacggggacggagtagagatacgggacggagtagagatacgggacggagtagagatacgggacggagtagggatacgggacggagtagagatacgggacggagtagggatacgggacggagtagagatacgggacggagtagagatacgggacggagtagagatacgggacggagtagagatacgggacggagtagagatacgggggacggagtagggatacgggacggagtagagatacgggggacggagtagagatacgggggacggagtagagatacgggggacggagtagagatacggggacggagtagagatacgggacggggtagagatattggggacggagtagagatacgggacggagtagggatacggggacggagtagagatacgggacggagtagagatacggggacggagtagagatacgggacggagtagagatacgggggacggggtagagatacgggacggggtagagatacgggacggggtagagatacgggacggggtagagatacggggga

SEQ ID NO: 34628 - DNA, 690 bp, Artificial Sequence
  chemically treated genomic DNA (Homo sapiens) CpG-island No: 34628
tcccccgtatctctaccccgtcccgtatctctaccccgtcccgtatctctaccccgtcccgtatctctaccccgtcccccgtatctctactccgtcccgtatctctactccgtccccgtatctctactccgtcccgtatctctactccgtccccgtatccctactccgtcccgtatctctactccgtccccaatatctctaccccgtcccgtatctctactccgtccccgtatctctactccgtcccccgtatctctactccgtcccccgtatctctactccgtcccccgtatctctactccgtcccgtatccctactccgtcccccgtatctctactccgtcccgtatctctactccgtcccgtatctctactccgtcccgtatctctactccgtcccgtatctctactccgtcccgtatccctactccgtcccgtatctctactccgtcccgtatccctactccgtcccgtatctctactccgtcccgtatctctactccgtcccgtatctctactccgtccccgtatctctactccgtcccccgtatctctactccgtcccgtatctctactccgtcccgtatccctactccgtcccgtatccctactccgtcccgtatctctaccccgtcccccatatctccgctccatcccatatccctactcatcccccctatccccaaaccta

SEQ ID NO: 34629 - DNA, 899 bp, Artificial Sequence
  chemically treated genomic DNA (Homo sapiens) CpG-island No: 34629
cgggttcggattaggttattgttattttttttgcgggcgggggcggtgcgaacgggcgcgattttacggaggggacgtcggcgttattatttttttttcgggcggaagcggtcgcggggtcgtttcgaggttgattaatgataagggtgttcgaggttacgtgacggtcgtcgattggtcgtcggttttcgagcgtttcggggttcggcgtttgcggaaggtttcggcgcgtttttaggagcgtcgtgcgtacgcgtatcgtttcgagtcggcggcgtttgcgtattcgcgagttcggtttgggtcgtcggttcggcgcgggcgttatgaagttgttgcggcgggcgtggcggcggcgggcggcgttaggtttgggtacgttggcgttgtgcggggcggcgttgttttatttggcgcgttgcgcggtcgagttcggggattttagggcgatgtcgggtcgtagttcgttttttttcgcgttcgcgcgcgtcgtcgtttttttggtagtgttggtggttagcgcgtttcgcgtcgtcgagcgtcgtagcgtgattcgtagtacgtggtttgcgcggcgcggggtttcgggcgacgtgtgggcgcgttttgtcgtgggtacggtcggtttgggcgtcgaggagcggcgcgttttggagcgggagtaggcgcggtacggggatttgttgttgttgttcgcgttgcgcgacgtttacgaaaattttacggttaaggtgttggttatgttggtttggttggacgagtacgtggttttcgagttcgtgtttaaggcggacgacgattttttcgcgcggttgacgcgttgttggtcgagttgcgcgttcgcgagttcgcgcgtcgtcgtcgtttttattggggttttttttcgggtcgcgtcgcgt

SEQ ID NO: 34630 - DNA, 899 bp, Artificial Sequence
  chemically treated genomic DNA (Homo sapiens) CpG-island No: 34630
acgcgacgcgacccgaaaaaaaaccccaataaaaacgacgacgacgcgcgaactcgcgaacgcgcaactcgaccaacaacgcgtcaaccgcgcgaaaaaatcgtcgtccgccttaaacacgaactcgaaaaccacgtactcgtccaaccaaaccaacataaccaacaccttaaccgtaaaattttcgtaaacgtcgcgcaacgcgaacaacaacaacaaatccccgtaccgcgcctactcccgctccaaaacgcgccgctcctcgacgcccaaaccgaccgtacccacgacaaaacgcgcccacacgtcgcccgaaaccccgcgccgcgcaaaccacgtactacgaatcacgctacgacgctcgacgacgcgaaacgcgctaaccaccaacactaccaaaaaaacgacgacgcgcgcgaacgcgaaaaaaaacgaactacgacccgacatcgccctaaaatccccgaactcgaccgcgcaacgcgccaaataaaacaacgccgccccgcacaacgccaacgtacccaaacctaacgccgcccgccgccgccacgcccgccgcaacaacttcataacgcccgcgccgaaccgacgacccaaaccgaactcgcgaatacgcaaacgccgccgactcgaaacgatacgcgtacgcacgacgctcctaaaaacgcgccgaaaccttccgcaaacgccgaaccccgaaacgctcgaaaaccgacgaccaatcgacgaccgtcacgtaacctcgaacacccttatcattaatcaacctcgaaacgaccccgcgaccgcttccgcccgaaaaaaaaataataacgccgacgtcccctccgtaaaatcgcgcccgttcgcaccgcccccgcccgcaaaaaaaataacaataacctaatccgaacccg

SEQ ID NO: 34631 - DNA, 899 bp, Artificial Sequence
  chemically treated genomic DNA (Homo sapiens) CpG-island No: 34631
acgcggcgcggttcgagaagaagttttagtagaggcggcggcggcgcgcgggttcgcgggcgcgtagttcggttagtagcgcgttagtcgcgcgaaggagtcgtcgttcgttttgagtacgaattcgaaggttacgtgttcgtttagttaggttagtatggttagtattttggtcgtgaggttttcgtaggcgtcgcgtagcgcgggtagtagtagtaggttttcgtgtcgcgtttgttttcgttttagggcgcgtcgtttttcggcgtttaggtcggtcgtgtttacggtaaagcgcgtttatacgtcgttcggggtttcgcgtcgcgtaagttacgtgttgcggattacgttgcggcgttcggcggcgcggggcgcgttggttattagtattgttaggaaggcggcggcgcgcgcgggcgcggggggaggcgggttgcggttcgatatcgttttggggttttcgggttcggtcgcgtagcgcgttaggtagagtagcgtcgtttcgtatagcgttagcgtgtttaggtttagcgtcgttcgtcgtcgttacgttcgtcgtagtagttttatggcgttcgcgtcgggtcggcggtttaggtcggattcgcgagtgcgtaggcgtcgtcggttcggggcggtgcgcgtgcgtacggcgtttttgggagcgcgtcggggtttttcgtagacgtcgagtttcggggcgttcggaggtcggcggttaatcggcggtcgttacgtggtttcgggtatttttgttattggttaatttcggagcggtttcgcgatcgttttcgttcggaggagagatggtggcgtcggcgtttttttcgtgaggtcgcgttcgttcgtatcgttttcgttcgtaagaaagatggtagtggtttgattcgggttcg

SEQ ID NO: 34632 - DNA, 899 bp, Artificial Sequence
  chemically treated genomic DNA (Homo sapiens) CpG-island No: 34632
cgaacccgaatcaaaccactaccatctttcttacgaacgaaaacgatacgaacgaacgcgacctcacgaaaaaaacgccgacgccaccatctctcctccgaacgaaaacgatcgcgaaaccgctccgaaattaaccaataacaaaaatacccgaaaccacgtaacgaccgccgattaaccgccgacctccgaacgccccgaaactcgacgtctacgaaaaaccccgacgcgctcccaaaaacgccgtacgcacgcgcaccgccccgaaccgacgacgcctacgcactcgcgaatccgacctaaaccgccgacccgacgcgaacgccataaaactactacgacgaacgtaacgacgacgaacgacgctaaacctaaacacgctaacgctatacgaaacgacgctactctacctaacgcgctacgcgaccgaacccgaaaaccccaaaacgatatcgaaccgcaacccgcctccccccgcgcccgcgcgcgccgccgccttcctaacaatactaataaccaacgcgccccgcgccgccgaacgccgcaacgtaatccgcaacacgtaacttacgcgacgcgaaaccccgaacgacgtataaacgcgctttaccgtaaacacgaccgacctaaacgccgaaaaacgacgcgccctaaaacgaaaacaaacgcgacacgaaaacctactactactacccgcgctacgcgacgcctacgaaaacctcacgaccaaaatactaaccatactaacctaactaaacgaacacgtaaccttcgaattcgtactcaaaacgaacgacgactccttcgcgcgactaacgcgctactaaccgaactacgcgcccgcgaacccgcgcgccgccgccgcctctactaaaacttcttctcgaaccgcgccgcgt

SEQ ID NO: 34633 - DNA, 784 bp, Artificial Sequence
  chemically treated genomic DNA (Homo sapiens) CpG-island No: 34633
gacgagtaggcggttgttaggttagggaggtttagttcgttatttttttcgttgcggggtcgttcgtttttttagtcgttcgcgggttgcgcgtttttggtttcgggtcgcgggggttttttcgtcggtttgttgggttcgggtcgcggcggatttcgttcggggaatttattgttgtatttggcgtttcgcggttttttcgtcggtgttcgtatagggtttttttttatggattcgtcgtagtcgttgtcgttcgggaaggatttcggggcgtttcgaggtttgcggttaaatttcgtcggtggtcgcggataatgggttgtggtcggagttatttgaggaaggtacgcgatttgtttagattatatttcgagtcgggagcggttataggttggaaagttcggtcgcgttttttttttatggttcggcggtttagtttgcgtcgcggacgtttttattggtcggtttcgtttcgcgttacggttttcgtcgcgtttttcggtttttcgttttcggggtttttagtaggggtcgcggtttcggagacgttcggaggggttcgtaagcgtagggagggaaggaaaagggcgtcggtttttaggattaggcgggatttttttatttattgcggaatgagtcgaattcgaaaagaggtagtcgtttaggagttgggattttagtgagaaagacgcggtttgggcgtttagtcgttttttttttaggttaagagggcgttgtattgaagggtttcggttttttcgttttgtgaaagattagtaaatag

SEQ ID NO: 34634 - DNA, 784 bp, Artificial Sequence
  chemically treated genomic DNA (Homo sapiens) CpG-island No: 34634
ctatttactaatctttcacaaaacgaaaaaaccgaaacccttcaatacaacgccctcttaacctaaaaaaaaaacgactaaacgcccaaaccgcgtctttctcactaaaatcccaactcctaaacgactacctcttttcgaattcgactcattccgcaataaataaaaaaatcccgcctaatcctaaaaaccgacgcccttttccttccctccctacgcttacgaacccctccgaacgtctccgaaaccgcgacccctactaaaaaccccgaaaacgaaaaaccgaaaaacgcgacgaaaaccgtaacgcgaaacgaaaccgaccaataaaaacgtccgcgacgcaaactaaaccgccgaaccataaaaaaaaaacgcgaccgaactttccaacctataaccgctcccgactcgaaatataatctaaacaaatcgcgtaccttcctcaaataactccgaccacaacccattatccgcgaccaccgacgaaatttaaccgcaaacctcgaaacgccccgaaatccttcccgaacgacaacgactacgacgaatccataaaaaaaaaccctatacgaacaccgacgaaaaaaccgcgaaacgccaaatacaacaataaattccccgaacgaaatccgccgcgacccgaacccaacaaaccgacgaaaaaacccccgcgacccgaaaccaaaaacgcgcaacccgcgaacgactaaaaaaacgaacgaccccgcaacgaaaaaaataacgaactaaacctccctaacctaacaaccgcctactcgtc

SEQ ID NO: 34635 - DNA, 784 bp, Artificial Sequence
  chemically treated genomic DNA (Homo sapiens) CpG-island No: 34635
ttgtttgttgattttttatagggcgaggggatcggagttttttaatgtagcgtttttttggtttgaagagggggcgattgggcgtttagatcgcgttttttttattgagattttagtttttggacgattgttttttttcgggttcggtttatttcgtaataagtggaggggtttcgtttgattttaggggtcggcgtttttttttttttttttttgcgtttgcgaattttttcgggcgttttcggagtcgcgatttttgttggggatttcgggggcgggaggtcgaggggcgcggcgagggtcgtgacgcgaggcggggtcggttaatgggagcgttcgcggcgtaggttgagtcgtcgggttataaaaaggaggcgcggtcgggttttttagtttgtggtcgttttcggttcggagtgtgatttaagtaggtcgcgtattttttttaggtgatttcggttatagtttattgttcgcggttatcggcggagtttagtcgtagatttcgaagcgtttcggggtttttttcgaacggtagcggttgcggcgggtttatggagaagggttttgtgcgggtatcggcggagaagtcgcggggcgttaggtgtagtaatgggtttttcgagcgggattcgtcgcggttcgggtttagtaggtcggcggagaagttttcgcggttcgaggttaagagcgcgtagttcgcggacggttggaagggcgagcggtttcgtagcgaggaggataacgagttgaatttttttaatttggtagtcgtttattcgtt

SEQ ID NO: 34636 - DNA, 784 bp, Artificial Sequence
  chemically treated genomic DNA (Homo sapiens) CpG-island No: 34636
aacgaataaacgactaccaaattaaaaaaattcaactcgttatcctcctcgctacgaaaccgctcgcccttccaaccgtccgcgaactacgcgctcttaacctcgaaccgcgaaaacttctccgccgacctactaaacccgaaccgcgacgaatcccgctcgaaaaacccattactacacctaacgccccgcgacttctccgccgatacccgcacaaaacccttctccataaacccgccgcaaccgctaccgttcgaaaaaaaccccgaaacgcttcgaaatctacgactaaactccgccgataaccgcgaacaataaactataaccgaaatcacctaaaaaaaatacgcgacctacttaaatcacactccgaaccgaaaacgaccacaaactaaaaaacccgaccgcgcctcctttttataacccgacgactcaacctacgccgcgaacgctcccattaaccgaccccgcctcgcgtcacgaccctcgccgcgcccctcgacctcccgcccccgaaatccccaacaaaaatcgcgactccgaaaacgcccgaaaaaattcgcaaacgcaaaaaaaaaaaaaaaaaaacgccgacccctaaaatcaaacgaaacccctccacttattacgaaataaaccgaacccgaaaaaaaacaatcgtccaaaaactaaaatctcaataaaaaaaacgcgatctaaacgcccaatcgccccctcttcaaaccaaaaaaacgctacattaaaaaactccgatcccctcgccctataaaaaatcaacaaacaa

SEQ ID NO: 34637 - DNA, 727 bp, Artificial Sequence
  chemically treated genomic DNA (Homo sapiens) CpG-island No: 34637
ttgcgggaggcgtacgcggcgcggtttgaggggagggggagaacgggcggaggcggtgcgttcggcgttttttgtttcggcgttaggaggagtcgcgcgttgttggtgttgttgtcgtcgttgttttagttgtcgttagttaggttgcgttcgcgtttttagggtttagtttttcggatttatcgtcgtttttagattttattgcggtttcggatattgtcgggtgaggttgtttcggtattagtgggagtcgtgaaggggaatcggggagttggggttgcggagttcgcgggcgcggttaagcgggaagcgggcgcggtgatcgaggtgtatcgagttacgtttagtgttcgggtcgtggtcgtttgtttggtattaggattaagcgtttttatcggtcgtttttttttacgttgcgggttgtttggggatcgttttttagggagaaggtgtcggaggtcgttgacgtcgcgttcgacgggtttttgggcgtttgacgttaggtttggttgcggggcggggcgggcgcgggtcggttttttttttattttttttcggcgggcgcgattcgttaggaggtcggttcgtttcggttgatttcggattttttttgttcgtgcgtttttaaacggttgtcggtttcgcgttttttggtttcgattttttttttatttttattttattatatttatttattaatttttaataaaaagggaaaggtttgaaa

SEQ ID NO: 34638 - DNA, 727 bp, Artificial Sequence
  chemically treated genomic DNA (Homo sapiens) CpG-island No: 34638
tttcaaacctttccctttttattaaaaattaataaataaatataataaaataaaaataaaaaaaaaatcgaaaccaaaaaacgcgaaaccgacaaccgtttaaaaacgcacgaacaaaaaaaatccgaaatcaaccgaaacgaaccgacctcctaacgaatcgcgcccgccgaaaaaaaataaaaaaaaaaccgacccgcgcccgccccgccccgcaaccaaacctaacgtcaaacgcccaaaaacccgtcgaacgcgacgtcaacgacctccgacaccttctccctaaaaaacgatccccaaacaacccgcaacgtaaaaaaaaacgaccgataaaaacgcttaatcctaataccaaacaaacgaccacgacccgaacactaaacgtaactcgatacacctcgatcaccgcgcccgcttcccgcttaaccgcgcccgcgaactccgcaaccccaactccccgattccccttcacgactcccactaataccgaaacaacctcacccgacaatatccgaaaccgcaataaaatctaaaaacgacgataaatccgaaaaactaaaccctaaaaacgcgaacgcaacctaactaacgacaactaaaacaacgacgacaacaacaccaacaacgcgcgactcctcctaacgccgaaacaaaaaacgccgaacgcaccgcctccgcccgttctccccctcccctcaaaccgcgccgcgtacgcctcccgcaa

SEQ ID NO: 34639 - DNA, 727 bp, Artificial Sequence
  chemically treated genomic DNA (Homo sapiens) CpG-island No: 34639
ttttaggtttttttttttttattaaaaattaatgaatgagtgtaatagggtgggggtagaggggaaatcggggttaaggggcgcgaggtcggtagtcgtttagggacgtacgaataaagggagttcgggattaatcggagcgaatcggttttttagcgggtcgcgttcgtcgggaaggggtgggggaggggtcggttcgcgttcgtttcgtttcgtagttagatttgacgttaggcgtttagaaattcgtcgggcgcgacgttagcggttttcgatattttttttttggggggcgatttttaggtagttcgtagcgtggaggaaggcgatcgatagaaacgtttagttttggtgttaggtaggcgattacggttcgagtattggacgtgattcgatgtatttcggttatcgcgttcgtttttcgtttggtcgcgttcgcgggtttcgtaattttagtttttcgatttttttttacgatttttattagtatcgaagtagttttattcggtaatattcgagatcgtagtagggtttagaagcggcgatgggttcgagggattgggttttgaagacgcgggcgtagtttgattgacggtagttagagtagcggcggtaatagtattagtagcgcgcggttttttttggcgtcggaataggaagcgtcgagcgtatcgttttcgttcgttttttttttttttttaggtcgcgtcgcgtgcgtttttcgtag

SEQ ID NO: 34640 - DNA, 727 bp, Artificial Sequence
  chemically treated genomic DNA (Homo sapiens) CpG-island No: 34640
ctacgaaaaacgcacgcgacgcgacctaaaaaaaaaaaaaaaacgaacgaaaacgatacgctcgacgcttcctattccgacgccaaaaaaaaccgcgcgctactaatactattaccgccgctactctaactaccgtcaatcaaactacgcccgcgtcttcaaaacccaatccctcgaacccatcgccgcttctaaaccctactacgatctcgaatattaccgaataaaactacttcgatactaataaaaatcgtaaaaaaaaatcgaaaaactaaaattacgaaacccgcgaacgcgaccaaacgaaaaacgaacgcgataaccgaaatacatcgaatcacgtccaatactcgaaccgtaatcgcctacctaacaccaaaactaaacgtttctatcgatcgccttcctccacgctacgaactacctaaaaatcgccccccaaaaaaaaaatatcgaaaaccgctaacgtcgcgcccgacgaatttctaaacgcctaacgtcaaatctaactacgaaacgaaacgaacgcgaaccgacccctcccccaccccttcccgacgaacgcgacccgctaaaaaaccgattcgctccgattaatcccgaactccctttattcgtacgtccctaaacgactaccgacctcgcgccccttaaccccgatttcccctctacccccaccctattacactcattcattaatttttaataaaaaaaaaaaaacctaaaa

SEQ ID NO: 34641 - DNA, 1373 bp, Artificial Sequence
  chemically treated genomic DNA (Homo sapiens) CpG-island No: 34641
gagcgggaggcgggataagcggggaggtcgttatttggtattgagtgatgcgttttttagttaatgaacgcgaggaatttcggcgtcggggcgggaggtcgggggcgggtttagtggggaggaggaggttgtaggcgcgtaagaggcgggggtcgggaggaggaaggggaggaggcggaggcgggcgcggtgttggcggcggcggcggcggcggaggggggtaggttgtgttcgggattgtgtttgtcgagttcggcggttgtgttttggtgagtggaggagcggcgcggggaggtagaggcgagcgcgggcgatcgcggcggcgggacgttttcggcggtcgcggtattagcggcggcgttttgtgtggagaagtaggggtagcggtagtagtaatagcggtagcggtagtagtagcggtagtagcggcggtcgttttttcgtcgtcggggacgttaaggtgcggttggtggtattgatatcggcggttttgttttttttttttcgttttcggttttttttatgtgatcggttttaattttggtcgtgtgtgcgcgcgtggggttttatttcgcggtgttgggttttcgtgtcggggtgggtgttcgtgtgtgcgttttttttttttatttttttttttttaagaataaaagaagaatcgggaggcgtgtttagaaaataaataaataattattatatacgcgtagttcggagcgagtcggcggggttggcggtagcggcggaggaggagtgaaggcggcggcggcggaggagggacgcgcggaaaaggtagtaattttaaagttagtttagagtttagatttttagtcgagcggtttgtagcgcggcggcggcggcggcggcggcggcgttgagtgtttggttcgtcggttcggtcggggtgtgtagtcggacggacgagtagcgcgtcgttgtttttcggtagttggagatgttcgagtttaaggtaattgattttaagttgtcgacgatcgatagggtggtgaaaggtaagcggagcgtcgcggtggtttgggtgtatcgtgtgtcgtaggcgttagggtagtttgtttcgtttcgtttttttttttttttttcgttttaggtttttttttgttcgttttagtcgcggattttttaggatattgtgtaattcgcgaatttcgcgaatttttcgttttcgcggcgttttttttttacgcgttttatttagttttatttggggtatttttattgacgggggcgttagttggtaaatggttgagtcgcggggaggtggcggcgggggtggcggtggtgggagggggcgttcggggggtggttgttggtagggtgtagttgttgtgatagaaataggaagtgggtggttttgt

SEQ ID NO: 34642 - DNA, 1373 bp, Artificial Sequence
  chemically treated genomic DNA (Homo sapiens) CpG-island No: 34642
acaaaaccacccacttcctatttctatcacaacaactacaccctaccaacaaccaccccccgaacgccccctcccaccaccgccacccccgccgccacctccccgcgactcaaccatttaccaactaacgcccccgtcaataaaaataccccaaataaaactaaataaaacgcgtaaaaaaaaaacgccgcgaaaacgaaaaattcgcgaaattcgcgaattacacaatatcctaaaaaatccgcgactaaaacgaacaaaaaaaaacctaaaacgaaaaaaaaaaaaaaaaacgaaacgaaacaaactaccctaacgcctacgacacacgatacacccaaaccaccgcgacgctccgcttacctttcaccaccctatcgatcgtcgacaacttaaaatcaattaccttaaactcgaacatctccaactaccgaaaaacaacgacgcgctactcgtccgtccgactacacaccccgaccgaaccgacgaaccaaacactcaacgccgccgccgccgccgccgccgccgcgctacaaaccgctcgactaaaaatctaaactctaaactaactttaaaattactaccttttccgcgcgtccctcctccgccgccgccgccttcactcctcctccgccgctaccgccaaccccgccgactcgctccgaactacgcgtatataataattatttatttattttctaaacacgcctcccgattcttcttttattcttaaaaaaaaaaaaataaaaaaaaaaaacgcacacacgaacacccaccccgacacgaaaacccaacaccgcgaaataaaaccccacgcgcgcacacacgaccaaaattaaaaccgatcacataaaaaaaaccgaaaacgaaaaaaaaaaaacaaaaccgccgatatcaataccaccaaccgcaccttaacgtccccgacgacgaaaaaacgaccgccgctactaccgctactactaccgctaccgctattactactaccgctacccctacttctccacacaaaacgccgccgctaataccgcgaccgccgaaaacgtcccgccgccgcgatcgcccgcgctcgcctctacctccccgcgccgctcctccactcaccaaaacacaaccgccgaactcgacaaacacaatcccgaacacaacctacccccctccgccgccgccgccgccgccaacaccgcgcccgcctccgcctcctccccttcctcctcccgacccccgcctcttacgcgcctacaacctcctcctccccactaaacccgcccccgacctcccgccccgacgccgaaattcctcgcgttcattaactaaaaaacgcatcactcaataccaaataacgacctccccgcttatcccgcctcccgctc

SEQ ID NO: 34643 - DNA, 1373 bp, Artificial Sequence
  chemically treated genomic DNA (Homo sapiens) CpG-island No: 34643
gtagagttatttattttttatttttgttatagtagttatattttattagtaattatttttcgggcgtttttttttattatcgttattttcgtcgttattttttcgcggtttagttatttgttaattgacgttttcgttaataaaaatgttttaagtgaggttgggtgggacgcgtgggggaagggcgtcgcgggggcggggggttcgcggggttcgcgggttgtataatattttagaaggttcgcggttggagcggatagaggagaatttggggcgggggaggggaggaaaggcgaggcgaggtaagttgttttggcgtttgcggtatacggtgtatttaggttatcgcggcgtttcgtttattttttattattttgtcggtcgtcgataatttgggattaattgttttgggttcggatatttttagttgtcggaggatagcgacgcgttgttcgttcgttcgattgtatatttcgatcggatcggcgggttagatatttaacgtcgtcgtcgtcgtcgtcgtcgtcgcgttgtaaatcgttcggttggaggtttaggttttgagttggttttaaagttgttgtttttttcgcgcgtttttttttcgtcgtcgtcgtttttatttttttttcgtcgttgtcgttagtttcgtcgattcgtttcgggttgcgcgtgtgtggtggttatttatttattttttgagtacgtttttcggttttttttttatttttgggggaagggggatggggaggagaagcgtatatacgagtatttatttcggtacggagatttagtatcgcggaatggagttttacgcgcgtatatacggttaggattaagatcgattatatggggaaggtcgggggcgagggaggagaggtagggtcgtcgatgttagtgttattagtcgtattttggcgttttcggcggcggagaggcggtcgtcgttgttgtcgttgttgttgtcgttgtcgttgttgttgttgtcgttgtttttgtttttttatatagagcgtcgtcgttggtgtcgcggtcgtcggagacgtttcgtcgtcgcgatcgttcgcgttcgtttttgttttttcgcgtcgtttttttatttattaaggtatagtcgtcgagttcggtagatatagtttcgggtataatttattttttttcgtcgtcgtcgtcgtcgttaatatcgcgttcgttttcgttttttttttttttttttttcggttttcgttttttgcgcgtttgtagtttttttttttttattgagttcgttttcgatttttcgtttcgacgtcggagtttttcgcgtttattggttagagggcgtattatttagtgttaggtggcggttttttcgtttgtttcgtttttcgttt

SEQ ID NO: 34644 - DNA, 1373 bp, Artificial Sequence
  chemically treated genomic DNA (Homo sapiens) CpG-island No: 34644
aaacgaaaaacgaaacaaacgaaaaaaccgccacctaacactaaataatacgccctctaaccaataaacgcgaaaaactccgacgtcgaaacgaaaaatcgaaaacgaactcaataaaaaaaaaaaaactacaaacgcgcaaaaaacgaaaaccgaaaaaaaaaaaaaaaaaaaacgaaaacgaacgcgatattaacgacgacgacgacgacgaaaaaaaataaattatacccgaaactatatctaccgaactcgacgactataccttaataaataaaaaaacgacgcgaaaaaacaaaaacgaacgcgaacgatcgcgacgacgaaacgtctccgacgaccgcgacaccaacgacgacgctctatataaaaaaacaaaaacaacgacaacaacaacaacgacaacgacaacaacaacgacaacaacgacgaccgcctctccgccgccgaaaacgccaaaatacgactaataacactaacatcgacgaccctacctctcctccctcgcccccgaccttccccatataatcgatcttaatcctaaccgtatatacgcgcgtaaaactccattccgcgatactaaatctccgtaccgaaataaatactcgtatatacgcttctcctccccatcccccttcccccaaaaataaaaaaaaaaccgaaaaacgtactcaaaaaataaataaataaccaccacacacgcgcaacccgaaacgaatcgacgaaactaacgacaacgacgaaaaaaaaataaaaacgacgacgacgaaaaaaaaacgcgcgaaaaaaacaacaactttaaaaccaactcaaaacctaaacctccaaccgaacgatttacaacgcgacgacgacgacgacgacgacgacgttaaatatctaacccgccgatccgatcgaaatatacaatcgaacgaacgaacaacgcgtcgctatcctccgacaactaaaaatatccgaacccaaaacaattaatcccaaattatcgacgaccgacaaaataataaaaaataaacgaaacgccgcgataacctaaatacaccgtataccgcaaacgccaaaacaacttacctcgcctcgcctttcctcccctcccccgccccaaattctcctctatccgctccaaccgcgaaccttctaaaatattatacaacccgcgaaccccgcgaaccccccgcccccgcgacgcccttcccccacgcgtcccacccaacctcacttaaaacatttttattaacgaaaacgtcaattaacaaataactaaaccgcgaaaaaataacgacgaaaataacgataataaaaaaaaacgcccgaaaaataattactaataaaatataactactataacaaaaataaaaaataaataactctac

SEQ ID NO: 34645 - DNA, 539 bp, Artificial Sequence
  chemically treated genomic DNA (Homo sapiens) CpG-island No: 34645
cgtagaggtcgtttttttttaggattggcgggttttggcgggtatgagggaggttagcggggagggttttgttttaagaggttcggagcgtggatagcgtacggggtgttgaattaggtacggggaggaggagtgtcggtaagggcgtcggttcggggaggacgaggtgagtcgaggcgtgattcgtgggggattacgggtcgcgggaggaggttgtggacgcgtaatcgcggtcggtagggtttcgagcgtttttttcgggagcgttgacgggaggcgcggtttttatttggttaaaggcggagttgagtatggggcgtagtcggtggaggaacgggttcgtttcggacgcggcggttggaacggagttttcgcggtttcgggttcgtagagagtttcggaggtcgagcgtcggggatagttttcgtttttttttatttcgttcgcgggtcggcggtagcggcgataacggcgaaagtcgggacgtcgcggtttgtagcgtttttcggggtttgtattgcgtttgggggagtatacgt

SEQ ID NO: 34646 - DNA, 539 bp, Artificial Sequence
  chemically treated genomic DNA (Homo sapiens) CpG-island No: 34646
acgtatactcccccaaacgcaatacaaaccccgaaaaacgctacaaaccgcgacgtcccgactttcgccgttatcgccgctaccgccgacccgcgaacgaaataaaaaaaaacgaaaactatccccgacgctcgacctccgaaactctctacgaacccgaaaccgcgaaaactccgttccaaccgccgcgtccgaaacgaacccgttcctccaccgactacgccccatactcaactccgcctttaaccaaataaaaaccgcgcctcccgtcaacgctcccgaaaaaaacgctcgaaaccctaccgaccgcgattacgcgtccacaacctcctcccgcgacccgtaatcccccacgaatcacgcctcgactcacctcgtcctccccgaaccgacgcccttaccgacactcctcctccccgtacctaattcaacaccccgtacgctatccacgctccgaacctcttaaaacaaaaccctccccgctaacctccctcatacccgccaaaacccgccaatcctaaaaaaaaacgacctctacg

SEQ ID NO: 34647 - DNA, 539 bp, Artificial Sequence
  chemically treated genomic DNA (Homo sapiens) CpG-island No: 34647
gcgtgtgtttttttaggcgtaatgtaggtttcgggaggcgttgtagatcgcggcgtttcgattttcgtcgttgtcgtcgttgtcgtcggttcgcgggcgggatggggaggaacggggattgttttcggcgttcggttttcggggttttttgcgagttcggggtcgcggggatttcgttttagtcgtcgcgttcgaggcggattcgtttttttatcggttgcgttttatgtttagtttcgtttttggttaggtaagggtcgcgtttttcgttagcgttttcgggaaaggcgttcgggattttgtcggtcgcggttgcgcgtttatagttttttttcgcggttcgtggttttttacggattacgtttcggtttatttcgtttttttcgggtcggcgtttttgtcggtatttttttttttcgtgtttgatttagtatttcgtgcgttgtttacgtttcgggttttttggggtaaggtttttttcgttagttttttttatattcgttagaattcgttagttttggaagagagcgatttttacg

SEQ ID NO: 34648 - DNA, 539 bp, Artificial Sequence
  chemically treated genomic DNA (Homo sapiens) CpG-island No: 34648
cgtaaaaatcgctctcttccaaaactaacgaattctaacgaatataaaaaaaactaacgaaaaaaaccttaccccaaaaaacccgaaacgtaaacaacgcacgaaatactaaatcaaacacgaaaaaaaaaaataccgacaaaaacgccgacccgaaaaaaacgaaataaaccgaaacgtaatccgtaaaaaaccacgaaccgcgaaaaaaaactataaacgcgcaaccgcgaccgacaaaatcccgaacgcctttcccgaaaacgctaacgaaaaacgcgacccttacctaaccaaaaacgaaactaaacataaaacgcaaccgataaaaaaacgaatccgcctcgaacgcgacgactaaaacgaaatccccgcgaccccgaactcgcaaaaaaccccgaaaaccgaacgccgaaaacaatccccgttcctccccatcccgcccgcgaaccgacgacaacgacgacaacgacgaaaatcgaaacgccgcgatctacaacgcctcccgaaacctacattacgcctaaaaaaacacacgc

SEQ ID NO: 34649 - DNA, 747 bp, Artificial Sequence
  chemically treated genomic DNA (Homo sapiens) CpG-island No: 34649
tttgagcgaattggtacgggagtaattgttcgttgcggaataggcggcgttggcgtagtttgttgcgtggggaattgtgtcgtaatcggttaatgaatcgcgttgttttaattatgattgtttgtcgatggaaaattacgaaggcgttcgtttgcgttagtatcggatgatataggaggagtagggatgagtaacgatacgttatttgatgcgttgtggtaacgaatgttggcgcgcggttggacgttagttagtgaatttcgttttgacgattggtttacgtaagcgttagacggcgtggtgttattaagtagtgattcgaaacgtacgttagaggttagcgataattcggtaatgattggcgaattattgcgcgagtttttcgattatatatggtaggtggcgattgttgattttgagtagagcggacgtatcggcgatcgttttggcgtttttcgtttttttgttattttagtgtttatcggcggaaattatcgcggcgtgttgaatggtatttattcgttggcggaattgataaatttgatgcgttggtttgtcgaatcgtagtaggagcgtgttttatgagcgaaatttttttttatttgttgggggtaggaacgtaatcgaacgatgatagttttagtatggatttattggcgatttattgttaggtgaatgattgatcgagtatggcggttttgagtaatgttttatagtcgtagtgattcgcgtgtatcgatttatata

SEQ ID NO: 34650 - DNA, 747 bp, Artificial Sequence
  chemically treated genomic DNA (Homo sapiens) CpG-island No: 34650
tatataaatcgatacacgcgaatcactacgactataaaacattactcaaaaccgccatactcgatcaatcattcacctaacaataaatcgccaataaatccatactaaaactatcatcgttcgattacgttcctacccccaacaaataaaaaaaaatttcgctcataaaacacgctcctactacgattcgacaaaccaacgcatcaaatttatcaattccgccaacgaataaataccattcaacacgccgcgataatttccgccgataaacactaaaataacaaaaaaacgaaaaacgccaaaacgatcgccgatacgtccgctctactcaaaatcaacaatcgccacctaccatatataatcgaaaaactcgcgcaataattcgccaatcattaccgaattatcgctaacctctaacgtacgtttcgaatcactacttaataacaccacgccgtctaacgcttacgtaaaccaatcgtcaaaacgaaattcactaactaacgtccaaccgcgcgccaacattcgttaccacaacgcatcaaataacgtatcgttactcatccctactcctcctatatcatccgatactaacgcaaacgaacgccttcgtaattttccatcgacaaacaatcataattaaaacaacgcgattcattaaccgattacgacacaattccccacgcaacaaactacgccaacgccgcctattccgcaacgaacaattactcccgtaccaattcgctcaaa

SEQ ID NO: 34651 - DNA, 747 bp, Artificial Sequence
  chemically treated genomic DNA (Homo sapiens) CpG-island No: 34651
tgtgtaaatcggtatacgcgaattattgcggttgtgagatattgtttaaggtcgttatattcggttaattatttatttgatagtgaatcgttagtggatttatgttgaaattgttatcgttcggttgcgtttttgtttttagtagatggaaaaaagtttcgtttatgaggtacgtttttgttgcggttcgataagttagcgtattaggtttattagtttcgttaacgggtgaatattatttagtacgtcgcgatagttttcgtcggtaaatattaaagtggtaggaaagcgaaagacgttaaagcgatcgtcgatgcgttcgttttgtttaaggttagtaatcgttatttgttatgtatagtcgggaaattcgcgtagtaattcgttaattattatcggattatcgttgatttttggcgtgcgtttcgggttattgtttaataatattacgtcgtttggcgtttgcgtaagttagtcgttaagacgggatttattgattggcgtttagtcgcgcgttagtattcgttgttataacgtattaaatggcgtgtcgttgtttatttttgttttttttgtgttattcggtattggcgtaagcgaacgttttcgtaattttttatcgatagatagttataattgagatagcgcgatttattagtcggttgcggtataattttttacgtagtaagttgcgttagcgtcgtttgtttcgtagcgggtagttgttttcgtgttagttcgtttagg

SEQ ID NO: 34652 - DNA, 747 bp, Artificial Sequence
  chemically treated genomic DNA (Homo sapiens) CpG-island No: 34652
cctaaacgaactaacacgaaaacaactacccgctacgaaacaaacgacgctaacgcaacttactacgtaaaaaattataccgcaaccgactaataaatcgcgctatctcaattataactatctatcgataaaaaattacgaaaacgttcgcttacgccaataccgaataacacaaaaaaaacaaaaataaacaacgacacgccatttaatacgttataacaacgaatactaacgcgcgactaaacgccaatcaataaatcccgtcttaacgactaacttacgcaaacgccaaacgacgtaatattattaaacaataacccgaaacgcacgccaaaaatcaacgataatccgataataattaacgaattactacgcgaatttcccgactatacataacaaataacgattactaaccttaaacaaaacgaacgcatcgacgatcgctttaacgtctttcgctttcctaccactttaatatttaccgacgaaaactatcgcgacgtactaaataatattcacccgttaacgaaactaataaacctaatacgctaacttatcgaaccgcaacaaaaacgtacctcataaacgaaacttttttccatctactaaaaacaaaaacgcaaccgaacgataacaatttcaacataaatccactaacgattcactatcaaataaataattaaccgaatataacgaccttaaacaatatctcacaaccgcaataattcgcgtataccgatttacaca

SEQ ID NO: 34653 - DNA, 575 bp, Artificial Sequence
  chemically treated genomic DNA (Homo sapiens) CpG-island No: 34653
  misc_feature (305)..(305): n is either a, c, g or t
attttttacgagtggggtagaggttgcggcggcggcgaagagataattttcgtcggaagacggtttttggcgcggggtacgttgggagttgcggacggcgggcgcgggttgggtcgggtttagtggcggtcgtatatttcgcgtcgtttggggtagtgttgcgcgtgcgttgatgataggttcgatacgttttttttacgttcgcgaattcgttttcgtttagtttttcgtagttttgcgttcgtgggagagtttcgtttttttttgcgaatcgtattatttagatttcggggtgcgcggagggncgcgtttttgacggaagtcggggcggacggtcggagttcggaagaaaaatagttcgcgatagttaggcgcgtgagatcgatcgtcgcgtagggttgttttggtcgggattcgttggtcgggagacgcgaatttgtcggattatcgcgcggggacgacggcggttatgagttcgcggaagttgagcgggtcgaaaggtaggaggtttaggtgagggtattttggcggtagaggtaggtttgttcggggggatcggcgttttttgggttgcg

SEQ ID NO: 34654 - DNA, 575 bp, Artificial Sequence
  chemically treated genomic DNA (Homo sapiens) CpG-island No: 34654
  misc_feature (271)..(271): n is either a, c, g or t
cgcaacccaaaaaacgccgatccccccgaacaaacctacctctaccgccaaaataccctcacctaaacctcctacctttcgacccgctcaacttccgcgaactcataaccgccgtcgtccccgcgcgataatccgacaaattcgcgtctcccgaccaacgaatcccgaccaaaacaaccctacgcgacgatcgatctcacgcgcctaactatcgcgaactatttttcttccgaactccgaccgtccgccccgacttccgtcaaaaacgcgnccctccgcgcaccccgaaatctaaataatacgattcgcaaaaaaaaacgaaactctcccacgaacgcaaaactacgaaaaactaaacgaaaacgaattcgcgaacgtaaaaaaaacgtatcgaacctatcatcaacgcacgcgcaacactaccccaaacgacgcgaaatatacgaccgccactaaacccgacccaacccgcgcccgccgtccgcaactcccaacgtaccccgcgccaaaaaccgtcttccgacgaaaattatctcttcgccgccgccgcaacctctaccccactcgtaaaaaat

SEQ ID NO: 34655 - DNA, 575 bp, Artificial Sequence
  chemically treated genomic DNA (Homo sapiens) CpG-island No: 34655
  misc_feature (271)..(271): n is either a, c, g or t
cgtagtttaaggggcgtcgattttttcgagtaggtttgtttttgtcgttagggtgtttttatttgagttttttgtttttcggttcgtttagttttcgcgagtttatggtcgtcgtcgttttcgcgcggtggttcggtaggttcgcgtttttcggttagcgggtttcggttagagtagttttgcgcggcggtcggttttacgcgtttagttgtcgcggattgtttttttttcggatttcgatcgttcgtttcggttttcgttagagacgcgntttttcgcgtatttcgggatttgggtggtgcggttcgtagaaggaggcgggatttttttacgagcgtaaagttgcgagaggttgagcgaagacgggttcgcggacgtaagaggggcgtgtcgggtttgttattagcgtacgcgtaatattgttttagacgacgcgaggtgtgcggtcgttattagattcggtttagttcgcgttcgtcgttcgtagtttttagcgtgtttcgcgttaggggtcgtttttcggcggaagttgttttttcgtcgtcgtcgtagtttttgttttattcgtgagggat

SEQ ID NO: 34656 - DNA, 575 bp, Artificial Sequence
  chemically treated genomic DNA (Homo sapiens) CpG-island No: 34656
  misc_feature (305)..(305): n is either a, c, g or t
atccctcacgaataaaacaaaaactacgacgacgacgaaaaaacaacttccgccgaaaaacgacccctaacgcgaaacacgctaaaaactacgaacgacgaacgcgaactaaaccgaatctaataacgaccgcacacctcgcgtcgtctaaaacaatattacgcgtacgctaataacaaacccgacacgcccctcttacgtccgcgaacccgtcttcgctcaacctctcgcaactttacgctcgtaaaaaaatcccgcctccttctacgaaccgcaccacccaaatcccgaaatacgcgaaaaancgcgtctctaacgaaaaccgaaacgaacgatcgaaatccgaaaaaaaaacaatccgcgacaactaaacgcgtaaaaccgaccgccgcgcaaaactactctaaccgaaacccgctaaccgaaaaacgcgaacctaccgaaccaccgcgcgaaaacgacgacgaccataaactcgcgaaaactaaacgaaccgaaaaacaaaaaactcaaataaaaacaccctaacgacaaaaacaaacctactcgaaaaaatcgacgccccttaaactacg

SEQ ID NO: 34657 - DNA, 701 bp, Artificial Sequence
  chemically treated genomic DNA (Homo sapiens) CpG-island No: 34657
gaattggaggtgcgattcgtcggggagtcggggcggcgtttcgcgtttttttttttttttttttatcgcgaggggtaggggcgtcggttttcggcgagagttacgcgtttttcgtgtttaattatcggtttttgttaggatgaggcgggtaggcgggggcgtttcgggagttacggtcggcgtcgtttttatcgtcgttttttgtttcgttcgtttgcggtagagtcgggattttttttagttttcgtttatttgttagggtcgtcgtcgtcgtcgttatcgcgggttaaatcgtagtcgcgtttatattttcggggttcgttaggttcgttttttatcggatgtgatttttttgtaacgttcggcgttttagtggcgcgcgtgttcgtttcgcgatttcgttggtcgtttcgtttcgcgcgtttttgagttattacgatatcgtgttatatatatacgttcgcggtcgttcgggttataattacgggagcgtttacgagatttttttagcgttcgtcgtacgtttcggtttcgttttcggtaagaggtttcgtttattgggcggagattaggtcgttttgggttagtgcgtcggcgcggacgttcgtcgtttttcgagtggttagcgaggattcgttttgtatatagttcgattttgggaggttttttagagggatttaaaaggagggggaagtagatgg

SEQ ID NO: 34658 - DNA, 701 bp, Artificial Sequence
  chemically treated genomic DNA (Homo sapiens) CpG-island No: 34658
ccatctacttccccctccttttaaatccctctaaaaaacctcccaaaatcgaactatatacaaaacgaatcctcgctaaccactcgaaaaacgacgaacgtccgcgccgacgcactaacccaaaacgacctaatctccgcccaataaacgaaacctcttaccgaaaacgaaaccgaaacgtacgacgaacgctaaaaaaatctcgtaaacgctcccgtaattataacccgaacgaccgcgaacgtatatatataacacgatatcgtaataactcaaaaacgcgcgaaacgaaacgaccaacgaaatcgcgaaacgaacacgcgcgccactaaaacgccgaacgttacaaaaaaatcacatccgataaaaaacgaacctaacgaaccccgaaaatataaacgcgactacgatttaacccgcgataacgacgacgacgacgaccctaacaaataaacgaaaactaaaaaaaatcccgactctaccgcaaacgaacgaaacaaaaaacgacgataaaaacgacgccgaccgtaactcccgaaacgcccccgcctacccgcctcatcctaacaaaaaccgataattaaacacgaaaaacgcgtaactctcgccgaaaaccgacgcccctacccctcgcgataaaaaaaaaaaaaaaaaaacgcgaaacgccgccccgactccccgacgaatcgcacctccaattc

SEQ ID NO: 34659 - DNA, 701 bp, Artificial Sequence
  chemically treated genomic DNA (Homo sapiens) CpG-island No: 34659
ttatttgtttttttttttttttgggtttttttgagaagttttttaagatcgagttgtgtatagagcgagttttcgttggttattcggaaggcggcggacgttcgcgtcggcgtattagtttagagcggtttggttttcgtttagtgggcggggttttttatcgggggcggggtcgaggcgtgcggcgagcgttggaggggtttcgtgggcgttttcgtggttgtggttcgggcggtcgcgagcgtgtgtgtgtggtacgatgtcgtggtaatttagaggcgcgcgaggcggggcggttaacggggtcgcggggcgagtacgcgcgttattggggcgtcggacgttgtaagggggttatattcggtagggggcgggtttggcggatttcggaagtgtgggcgcggttgcggtttaattcgcggtggcggcggcgacggcggttttggtaggtgagcggagattggggagggtttcggttttgtcgtaggcgggcggggtagaggacgacggtgggggcggcgtcggtcgtggttttcggagcgttttcgtttgttcgttttattttggtagaggtcggtgattgggtacgaggggcgcgtgattttcgtcgggggtcggcgtttttgtttttcgcggtgggagggagggagggagagcgcgaggcgtcgtttcggtttttcggcgggtcgtatttttagttt

SEQ ID NO: 34660 - DNA, 701 bp, Artificial Sequence
  chemically treated genomic DNA (Homo sapiens) CpG-island No: 34660
aaactaaaaatacgacccgccgaaaaaccgaaacgacgcctcgcgctctccctccctccctcccaccgcgaaaaacaaaaacgccgacccccgacgaaaatcacgcgcccctcgtacccaatcaccgacctctaccaaaataaaacgaacaaacgaaaacgctccgaaaaccacgaccgacgccgcccccaccgtcgtcctctaccccgcccgcctacgacaaaaccgaaaccctccccaatctccgctcacctaccaaaaccgccgtcgccgccgccaccgcgaattaaaccgcaaccgcgcccacacttccgaaatccgccaaacccgccccctaccgaatataacccccttacaacgtccgacgccccaataacgcgcgtactcgccccgcgaccccgttaaccgccccgcctcgcgcgcctctaaattaccacgacatcgtaccacacacacacgctcgcgaccgcccgaaccacaaccacgaaaacgcccacgaaacccctccaacgctcgccgcacgcctcgaccccgcccccgataaaaaaccccgcccactaaacgaaaaccaaaccgctctaaactaatacgccgacgcgaacgtccgccgccttccgaataaccaacgaaaactcgctctatacacaactcgatcttaaaaaacttctcaaaaaaacccaaaaaaaaaaaaaaacaaataa

SEQ ID NO: 34661 - DNA, 559 bp, Artificial Sequence
  chemically treated genomic DNA (Homo sapiens) CpG-island No: 34661
gtgcggtgaggacggagcgtgttttttcgtgtgcggtgaggacggagcgggtgttttcgtgtgcggtgaggacggagcgtgttttttcgtgtgcggtgaggacggagcgggtgttttcgtgtgcggtgaggacggagcgtgttttttcgtgtgcggtgaggatggagcgtgttttttcgtgtgcggtgaggacggagcgtgttttttcgtgtgcggtgaggacggagcgggtgttttcgtgtgcggtgaggacggagcgtgttttttcgtgtgcggtgaggacggagcgtgttttttcgtgtgcggtgaggacggagcgtgttttttcgtgtgcggtgaggacggagcgtgttttttcgtgtgcggtgaggacggagcgtgttttttcgtgtgcggtgaggacggagcgtgttttttcgtgtgcggtgaggacggagcgtgttttttcgtgtgcggtgagtatggagcgtgtgttttcgtgtgtggtgagtatggagcgggtgttttcgtgtgatgatgagaatgaaattgtgtaatttaaagattgagaaaaatcgtg

SEQ ID NO: 34662 - DNA, 559 bp, Artificial Sequence
  chemically treated genomic DNA (Homo sapiens) CpG-island No: 34662
cacgatttttctcaatctttaaattacacaatttcattctcatcatcacacgaaaacacccgctccatactcaccacacacgaaaacacacgctccatactcaccgcacacgaaaaaacacgctccgtcctcaccgcacacgaaaaaacacgctccgtcctcaccgcacacgaaaaaacacgctccgtcctcaccgcacacgaaaaaacacgctccgtcctcaccgcacacgaaaaaacacgctccgtcctcaccgcacacgaaaaaacacgctccgtcctcaccgcacacgaaaaaacacgctccgtcctcaccgcacacgaaaacacccgctccgtcctcaccgcacacgaaaaaacacgctccgtcctcaccgcacacgaaaaaacacgctccatcctcaccgcacacgaaaaaacacgctccgtcctcaccgcacacgaaaacacccgctccgtcctcaccgcacacgaaaaaacacgctccgtcctcaccgcacacgaaaacacccgctccgtcctcaccgcacacgaaaaaacacgctccgtcctcaccgcac

SEQ ID NO: 34663 - DNA, 559 bp, Artificial Sequence
  chemically treated genomic DNA (Homo sapiens) CpG-island No: 34663
tacggttttttttagtttttgggttatatagttttatttttattattatacggaggtattcgttttatatttattatatacggaggtatacgttttatatttatcgtatacggagggatacgtttcgtttttatcgtatacggagggatacgtttcgtttttatcgtatacggagggatacgtttcgtttttatcgtatacggagggatacgtttcgtttttatcgtatacggagggatacgtttcgtttttatcgtatacggagggatacgtttcgtttttatcgtatacggagggatacgtttcgtttttatcgtatacggaggtattcgtttcgtttttatcgtatacggagggatacgtttcgtttttatcgtatacggagggatacgttttatttttatcgtatacggagggatacgtttcgtttttatcgtatacggaggtattcgtttcgtttttatcgtatacggagggatacgtttcgtttttatcgtatacggaggtattcgtttcgtttttatcgtatacggagggatacgtttcgtttttatcgtat

SEQ ID NO: 34664 - DNA, 559 bp, Artificial Sequence
  chemically treated genomic DNA (Homo sapiens) CpG-island No: 34664
atacgataaaaacgaaacgtatccctccgtatacgataaaaacgaaacgaatacctccgtatacgataaaaacgaaacgtatccctccgtatacgataaaaacgaaacgaatacctccgtatacgataaaaacgaaacgtatccctccgtatacgataaaaataaaacgtatccctccgtatacgataaaaacgaaacgtatccctccgtatacgataaaaacgaaacgaatacctccgtatacgataaaaacgaaacgtatccctccgtatacgataaaaacgaaacgtatccctccgtatacgataaaaacgaaacgtatccctccgtatacgataaaaacgaaacgtatccctccgtatacgataaaaacgaaacgtatccctccgtatacgataaaaacgaaacgtatccctccgtatacgataaaaacgaaacgtatccctccgtatacgataaatataaaacgtatacctccgtatataataaatataaaacgaatacctccgtataataataaaaataaaactatataacccaaaaactaaaaaaaaccgta

SEQ ID NO: 34665 - DNA, 917 bp, Artificial Sequence
  chemically treated genomic DNA (Homo sapiens) CpG-island No: 34665
tatgtgtgcgcgcgagagtgtgtgtgttaaacgtttatcgtattttttcgtttaggcggttttaggtgttcgcgggaggggattaggatttcgtcgtgtttttgttttcggttttttgtgtcgagtttagagtagcgcgaggttagttttttagtttatattttcggtttcgattttgggtgggagttttcgttttcgtttttttcgtagtcgttcgagttcggtttttgttcgtttgtttttatttcggcgtacgttttcgtcgtgtcgggcggtcggagagttgttagtcggcgtttgggattcggatttcggtcggcggttgtcggtgcgaaaatttattggagcggagaaagatagcgcgcggcgtattaagcggtcgtattggcgtcgtttttgttttttttcgcgtcgttttcgtttggagcgcgtttttcgggatgtttcgtttttcggttatttattagtattacggagtttcgtacggttttagatacgttttgtcggagtttagtcgtcgtgttaggtttgttgagtcgtttggtgaatttgcgtatttcggttatggtagcggcggcgggcgggtttcggcgggcgggcggatttcggcgggcgggtggatttattgtttcggttcgcggcggtcgcggtcgttgttgttttttttgtttattcgtcggtcggtcggttatatcgtagttcggcggcggcgcggtttacgttgttttttttttttattttttattcgttgtttttttttcgttttttttttttttttttttttcgttcgtttcgttcgtttattgttttgttttacggcgtcggcggcggtagtttttttttttagagggttcgagtttcgatcgttattagtcgaagtaggagggtgtgtttgatggggaagggtgtgtagaggg

SEQ ID NO: 34666 - DNA, 917 bp, Artificial Sequence
  chemically treated genomic DNA (Homo sapiens) CpG-island No: 34666
ccctctacacacccttccccatcaaacacaccctcctacttcgactaataacgatcgaaactcgaaccctctaaaaaaaaaaactaccgccgccgacgccgtaaaacaaaacaataaacgaacgaaacgaacgaaaaaaaaaaaaaaaaaaaaaacgaaaaaaaaacaacgaataaaaaataaaaaaaaaaaacaacgtaaaccgcgccgccgccgaactacgatataaccgaccgaccgacgaataaacaaaaaaaacaacaacgaccgcgaccgccgcgaaccgaaacaataaatccacccgcccgccgaaatccgcccgcccgccgaaacccgcccgccgccgctaccataaccgaaatacgcaaattcaccaaacgactcaacaaacctaacacgacgactaaactccgacaaaacgtatctaaaaccgtacgaaactccgtaatactaataaataaccgaaaaacgaaacatcccgaaaaacgcgctccaaacgaaaacgacgcgaaaaaaaacaaaaacgacgccaatacgaccgcttaatacgccgcgcgctatctttctccgctccaataaattttcgcaccgacaaccgccgaccgaaatccgaatcccaaacgccgactaacaactctccgaccgcccgacacgacgaaaacgtacgccgaaataaaaacaaacgaacaaaaaccgaactcgaacgactacgaaaaaaacgaaaacgaaaactcccacccaaaatcgaaaccgaaaatataaactaaaaaactaacctcgcgctactctaaactcgacacaaaaaaccgaaaacaaaaacacgacgaaatcctaatcccctcccgcgaacacctaaaaccgcctaaacgaaaaaatacgataaacgtttaacacacacactctcgcgcgcacacata

SEQ ID NO: 34667 - DNA, 917 bp, Artificial Sequence
  chemically treated genomic DNA (Homo sapiens) CpG-island No: 34667
ttttttatatatttttttttattagatatatttttttgtttcggttggtggcgatcggagttcgggttttttaggggagggagttgtcgtcgtcgacgtcgtggggtaggatagtgagcgggcgaagcgagcgagaaaaggagggaaggagggaacgagggaggagtagcgggtgggaggtgggagggaggagtagcgtgagtcgcgtcgtcgtcgagttgcgatgtggtcggtcggtcggcgagtaaatagagggagtagtagcggtcgcggtcgtcgcgggtcggggtagtgagtttattcgttcgtcgaggttcgttcgttcgtcgagattcgttcgtcgtcgttgttatggtcgaagtgcgtaaatttattaaacggtttagtaagtttggtacggcggttgagtttcggtagagcgtgtttgaggtcgtgcggggtttcgtggtgttggtgagtggtcgggggacggggtatttcgggggacgcgttttaggcgggagcgacgcgggaaggggtaggaacggcgttagtgcggtcgtttggtgcgtcgcgcgttgttttttttcgttttagtaagttttcgtatcggtagtcgtcggtcggggttcgagttttaggcgtcggttgatagtttttcggtcgttcggtacggcggaggcgtgcgtcgggatggaagtagacgggtaaaagtcgggttcggacggttgcggaggaggcggaggcggaggtttttatttagggtcggggtcgggggtgtgagttaaagagttgatttcgcgttgttttggattcggtataaagagtcggggataagggtacgacgagattttgattttttttcgcgagtatttgaggtcgtttaggcggaaggatgcgatgagcgtttggtatatatattttcgcgcgtatatata

SEQ ID NO: 34668 - DNA, 917 bp, Artificial Sequence
  chemically treated genomic DNA (Homo sapiens) CpG-island No: 34668
tatatatacgcgcgaaaatatatataccaaacgctcatcgcatccttccgcctaaacgacctcaaatactcgcgaaaaaaaatcaaaatctcgtcgtacccttatccccgactctttataccgaatccaaaacaacgcgaaatcaactctttaactcacacccccgaccccgaccctaaataaaaacctccgcctccgcctcctccgcaaccgtccgaacccgacttttacccgtctacttccatcccgacgcacgcctccgccgtaccgaacgaccgaaaaactatcaaccgacgcctaaaactcgaaccccgaccgacgactaccgatacgaaaacttactaaaacgaaaaaaaacaacgcgcgacgcaccaaacgaccgcactaacgccgttcctaccccttcccgcgtcgctcccgcctaaaacgcgtcccccgaaataccccgtcccccgaccactcaccaacaccacgaaaccccgcacgacctcaaacacgctctaccgaaactcaaccgccgtaccaaacttactaaaccgtttaataaatttacgcacttcgaccataacaacgacgacgaacgaatctcgacgaacgaacgaacctcgacgaacgaataaactcactaccccgacccgcgacgaccgcgaccgctactactccctctatttactcgccgaccgaccgaccacatcgcaactcgacgacgacgcgactcacgctactcctccctcccacctcccacccgctactcctccctcgttccctccttccctccttttctcgctcgcttcgcccgctcactatcctaccccacgacgtcgacgacgacaactccctcccctaaaaaacccgaactccgatcgccaccaaccgaaacaaaaaaatatatctaataaaaaaaaatatataaaaaa

SEQ ID NO: 34669 - DNA, 503 bp, Artificial Sequence
  chemically treated genomic DNA (Homo sapiens) CpG-island No: 34669
  misc_feature (470)..(470): n is either a, c, g or t
tgttttttcgttaagtaataataattcgaggagcgaggcggggaggttcgtgaaacgttatagcgtattgtttaatgggaatcggcgttggtagacgcgcgcgttttgtgtttaattagcgaaggcggttcgaatggtttttttattttgttggttgtgggcggagcggtttgaggaggcggcggtggagtagggggcggtttggttgcgcggtattagcggtgttcgtcgaagggggaggaggcgaggagcgagtcgtgcggttagagcgggaaagagattcgtttttgcgttcgagttttggagtcgtcgtatttcgatttttggggtcgcggtagcggttgcgaggggacgggcgttcgttgttttttgggtttttttcgtagcgattcgcgggatcggaaaaaaaggagaagatggaggaggagggtggtagtagttgcggtgtcgcgttgattagtgcggacggngggtattgaggagagtagttttttattgttaag

SEQ ID NO: 34670 - DNA, 503 bp, Artificial Sequence
  chemically treated genomic DNA (Homo sapiens) CpG-island No: 34670
  misc_feature (34)..(34): n is either a, c, g or t
cttaacaataaaaaactactctcctcaatacccnccgtccgcactaatcaacgcgacaccgcaactactaccaccctcctcctccatcttctcctttttttccgatcccgcgaatcgctacgaaaaaaacccaaaaaacaacgaacgcccgtcccctcgcaaccgctaccgcgaccccaaaaatcgaaatacgacgactccaaaactcgaacgcaaaaacgaatctctttcccgctctaaccgcacgactcgctcctcgcctcctcccccttcgacgaacaccgctaataccgcgcaaccaaaccgccccctactccaccgccgcctcctcaaaccgctccgcccacaaccaacaaaataaaaaaaccattcgaaccgccttcgctaattaaacacaaaacgcgcgcgtctaccaacgccgattcccattaaacaatacgctataacgtttcacgaacctccccgcctcgctcctcgaattattattacttaacgaaaaaaca

SEQ ID NO: 34671 - DNA, 503 bp, Artificial Sequence
  chemically treated genomic DNA (Homo sapiens) CpG-island No: 34671
  misc_feature (34)..(34): n is either a, c, g or t
tttgatagtgaggaattgttttttttagtatttntcgttcgtattggttaacgcggtatcgtagttgttgttattttttttttttattttttttttttttttcgatttcgcgggtcgttacgaggggaatttaggagatagcggacgttcgttttttcgtagtcgttgtcgcggttttaggagtcggggtgcggcggttttagaattcggacgtaaagacgagtttttttttcgttttggtcgtacggttcgtttttcgtttttttttttttcggcgggtatcgttagtatcgcgtaattaaatcgttttttgttttatcgtcgtttttttaggtcgtttcgtttatagttagtaaggtaagggagttattcgagtcgttttcgttgattggatatagggcgcgcgcgtttgttaacgtcggtttttattgggtagtacgttgtgacgttttacgagttttttcgtttcgtttttcgaattgttgttgtttggcggggaggta

SEQ ID NO: 34672 - DNA, 503 bp, Artificial Sequence
  chemically treated genomic DNA (Homo sapiens) CpG-island No: 34672
  misc_feature (470)..(470): n is either a, c, g or t
tacctccccgccaaacaacaacaattcgaaaaacgaaacgaaaaaactcgtaaaacgtcacaacgtactacccaataaaaaccgacgttaacaaacgcgcgcgccctatatccaatcaacgaaaacgactcgaataactcccttaccttactaactataaacgaaacgacctaaaaaaacgacgataaaacaaaaaacgatttaattacgcgatactaacgatacccgccgaaaaaaaaaaaaacgaaaaacgaaccgtacgaccaaaacgaaaaaaaaactcgtctttacgtccgaattctaaaaccgccgcaccccgactcctaaaaccgcgacaacgactacgaaaaaacgaacgtccgctatctcctaaattcccctcgtaacgacccgcgaaatcgaaaaaaaaaaaaaaaataaaaaaaaaaaataacaacaactacgataccgcgttaaccaatacgaacganaaatactaaaaaaaacaattcctcactatcaaa

SEQ ID NO: 34673 - DNA, 844 bp, Artificial Sequence
  chemically treated genomic DNA (Homo sapiens) CpG-island No: 34673
gcgggttttggttagtatatttttttaacgttggttgttcgggttatttttttgcgaagagcgtttttatttgaggcgaaattaaaatttttttttcgcgttcgtttttcgtttttttgttgagagaaatttaaataatttttatggcgtcgaaattttttttatgtcgataagttcgttttgggcgtacgagtggatgtttggttagttttttttgggatcgatttcgtcgtcgtgtttagtttttattacgtttttattttattttacgttttatagtcggggtttttggttagtttcggaagttatcgagaaataggatttcgtgcgttcgagagaatttttttaggggttaaggaatcggttagtcggaggcgcgagaaaagttttgggaaggcggttgtatttaggatgggtggatgttacggggttttcgtttaggttgtttcgttcgtacgggtcgattggttattttggaattttttttgtaggttttagcgtttttcgggaattcgtagttttcgcggagagcgtgggtttttttttatcgttggggcgtagcgtagtgtacgtttgagggtggtcgtcgggggttgggtacgtttttagttttgcgtcgtcgggggttgcggcggtgttgtttattttagagagttttcggtttggggtttcggcgaagtaagtgttttttcggcgtcggtcgttaggggggcgcgggagtagttagatgcgtcgtagcgttgggaaggcggcgaaggataggggttaggggagtgaggggcgttcggtaggtagttttagttttggttttgcgcgggagaagggatagtagagatcgttcgtg

SEQ ID NO: 34674 - DNA, 844 bp, Artificial Sequence
  chemically treated genomic DNA (Homo sapiens) CpG-island No: 34674
cacgaacgatctctactatcccttctcccgcgcaaaaccaaaactaaaactacctaccgaacgcccctcactcccctaacccctatccttcgccgccttcccaacgctacgacgcatctaactactcccgcgcccccctaacgaccgacgccgaaaaaacacttacttcgccgaaaccccaaaccgaaaactctctaaaataaacaacaccgccgcaacccccgacgacgcaaaactaaaaacgtacccaacccccgacgaccaccctcaaacgtacactacgctacgccccaacgataaaaaaaaacccacgctctccgcgaaaactacgaattcccgaaaaacgctaaaacctacaaaaaaaattccaaaataaccaatcgacccgtacgaacgaaacaacctaaacgaaaaccccgtaacatccacccatcctaaatacaaccgccttcccaaaacttttctcgcgcctccgactaaccgattccttaacccctaaaaaaattctctcgaacgcacgaaatcctatttctcgataacttccgaaactaaccaaaaaccccgactataaaacgtaaaataaaataaaaacgtaataaaaactaaacacgacgacgaaatcgatcccaaaaaaaactaaccaaacatccactcgtacgcccaaaacgaacttatcgacataaaaaaaatttcgacgccataaaaattatttaaatttctctcaacaaaaaaacgaaaaacgaacgcgaaaaaaaaattttaatttcgcctcaaataaaaacgctcttcgcaaaaaaataacccgaacaaccaacgttaaaaaaatatactaaccaaaacccgc

SEQ ID NO: 34675 - DNA, 844 bp, Artificial Sequence
  chemically treated genomic DNA (Homo sapiens) CpG-island No: 34675
tacgggcggtttttgttgttttttttttcgcgtagggttagggttgaggttgtttgtcgagcgttttttatttttttagtttttgtttttcgtcgtttttttagcgttgcggcgtatttggttgttttcgcgtttttttggcgatcggcgtcgggaaggtatttgtttcgtcggagttttaggtcgagggttttttggggtgggtagtatcgtcgtagttttcggcggcgtaggattgggggcgtgtttagttttcggcgattatttttaggcgtgtattgcgttgcgttttagcggtagggagaggtttacgtttttcgcggaggttgcgggttttcggggggcgttgggatttgtaaaggggattttaaggtgattagtcgattcgtgcggacgggatagtttggacggaggtttcgtggtatttatttattttaggtgtaatcgtttttttagaatttttttcgcgttttcggttggtcgattttttagtttttggaaaagttttttcgggcgtacggaattttatttttcggtggttttcgaagttggttaggaatttcggttgtgaggcgtggggtgggatggggacgtggtgagggttgagtacggcggcggggtcgattttaggaaaggttggttaagtatttattcgtgcgtttagggcgggtttgtcggtatggaaaggatttcggcgttatgagggttgtttgggttttttttagtaggagggcgggaggcgggcgcgaaggggggattttaatttcgttttaaatgaaaacgtttttcgtaaagaaatagttcgggtagttagcgttggagagatgtgttggttaggattcgt

SEQ ID NO: 34676 - DNA, 844 bp, Artificial Sequence
  chemically treated genomic DNA (Homo sapiens) CpG-island No: 34676
acgaatcctaaccaacacatctctccaacgctaactacccgaactatttctttacgaaaaacgttttcatttaaaacgaaattaaaatccccccttcgcgcccgcctcccgccctcctactaaaaaaaacccaaacaaccctcataacgccgaaatcctttccataccgacaaacccgccctaaacgcacgaataaatacttaaccaacctttcctaaaatcgaccccgccgccgtactcaaccctcaccacgtccccatcccaccccacgcctcacaaccgaaattcctaaccaacttcgaaaaccaccgaaaaataaaattccgtacgcccgaaaaaacttttccaaaaactaaaaaatcgaccaaccgaaaacgcgaaaaaaattctaaaaaaacgattacacctaaaataaataaataccacgaaacctccgtccaaactatcccgtccgcacgaatcgactaatcaccttaaaatcccctttacaaatcccaacgccccccgaaaacccgcaacctccgcgaaaaacgtaaacctctccctaccgctaaaacgcaacgcaatacacgcctaaaaataatcgccgaaaactaaacacgcccccaatcctacgccgccgaaaactacgacgatactacccaccccaaaaaaccctcgacctaaaactccgacgaaacaaataccttcccgacgccgatcgccaaaaaaacgcgaaaacaaccaaatacgccgcaacgctaaaaaaacgacgaaaaacaaaaactaaaaaaataaaaaacgctcgacaaacaacctcaaccctaaccctacgcgaaaaaaaaaacaacaaaaaccgcccgta

SEQ ID NO: 34677 - DNA, 867 bp, Artificial Sequence
  chemically treated genomic DNA (Homo sapiens) CpG-island No: 34677
ggtggaggcgtcgcgtagggacggaggtttattcgtttagatgtggggagattcgcgggaggggatttcgttcggttcggtgagtttcgttgggagagtggtgtgcggcgttggttggtaataggcgtttacggtcgagagagaggtagaggggttgtgttattcgtcgtcgcgtttcgtttttttggcgtatatttggtaggcgttttagcgtttcggtagcggttagttttttttttttcggggtcggttttgtcgcgtgatttttttttcgtcgaggtagtttttattcgtattttcgggcgttcgtgtagtttttatttggtaaataggacggtgtcgtgttttagcgggttgcggtttattgttcgttagttttgtcggattagttcgggtttcgggcgttttatgttgtttcggggacgcggagcgcggggttgggatttttagggttcgggtgtcgttatcgtacgtgtcgcgttatttttttcgcgacgcggtttttttcgtttttcgtacgtttttcgtgttttcgttcggcgggggtcgtagtcgttttttttttggcgcgggagagaaaaggcgcgcggttagtcgtaggtggagatattttagttgtgttttcggggatttcgtttggtcgttgcgttttgcgtttcgtagtcgttagagtcgttttatttcgcgacgtttgggttgggcgttttaaagtcgttacggttttcgttttttttaggttagtaaggcgcgcgtttttttcgttagtcgttatggtggtttgggaaaggttcggtttgtagaacgtaattgatatcgcggaggttttttgggttttagttttttttttcgagtttcgagggtattgtg

SEQ ID NO: 34678 - DNA, 867 bp, Artificial Sequence
  chemically treated genomic DNA (Homo sapiens) CpG-island No: 34678
cacaataccctcgaaactcgaaaaaaaaaactaaaacccaaaaaacctccgcgatatcaattacgttctacaaaccgaacctttcccaaaccaccataacgactaacgaaaaaaacgcgcgccttactaacctaaaaaaaacgaaaaccgtaacgactttaaaacgcccaacccaaacgtcgcgaaataaaacgactctaacgactacgaaacgcaaaacgcaacgaccaaacgaaatccccgaaaacacaactaaaatatctccacctacgactaaccgcgcgccttttctctcccgcgccaaaaaaaaaacgactacgacccccgccgaacgaaaacacgaaaaacgtacgaaaaacgaaaaaaaccgcgtcgcgaaaaaaataacgcgacacgtacgataacgacacccgaaccctaaaaatcccaaccccgcgctccgcgtccccgaaacaacataaaacgcccgaaacccgaactaatccgacaaaactaacgaacaataaaccgcaacccgctaaaacacgacaccgtcctatttaccaaataaaaactacacgaacgcccgaaaatacgaataaaaactacctcgacgaaaaaaaaatcacgcgacaaaaccgaccccgaaaaaaaaaaaactaaccgctaccgaaacgctaaaacgcctaccaaatatacgccaaaaaaacgaaacgcgacgacgaataacacaacccctctacctctctctcgaccgtaaacgcctattaccaaccaacgccgcacaccactctcccaacgaaactcaccgaaccgaacgaaatcccctcccgcgaatctccccacatctaaacgaataaacctccgtccctacgcgacgcctccacc

SEQ ID NO: 34679 - DNA, 867 bp, Artificial Sequence
  chemically treated genomic DNA (Homo sapiens) CpG-island No: 34679
tatagtgttttcggggttcgggaggagaaattgaggtttagagagttttcgcgatgttagttacgttttgtaggtcgggttttttttaggttattatagcggttggcggagggagcgcgcgttttgttggtttggagggggcgggggtcgtggcggttttaaagcgtttagtttaggcgtcgcggggtggggcggttttggcggttgcggggcgtagggcgtagcggttaagcggggttttcggaagtatagttggggtgtttttatttacgattggtcgcgcgttttttttttttcgcgttagggaaggagcggttgcggttttcgtcgggcggaggtacggggggcgtacgaggggcggaggggatcgcgtcgcggaggagatggcgcggtacgtgcggtgacggtattcgagttttgagggttttagtttcgcgtttcgcgttttcgggatagtatggagcgttcggagttcgagttgattcggtagagttggcgggtagtgagtcgtagttcgttggagtacggtatcgttttgtttgttaggtgagggttatacgagcgttcggggatgcgggtggaggttgtttcggcgggaaaggggttacgcggtaggatcggtttcgaaggagggaaaattggtcgttgtcggggcgttggggcgtttgttagatgtgcgttagaggagcggggcgcggcgacgggtggtatagtttttttgtttttttttcgatcgtgggcgtttgttgttaattagcgtcgtatattatttttttagcggggtttatcgggtcgggcgggattttttttcgcggatttttttatatttgggcgggtggattttcgtttttgcgcggcgtttttatt

SEQ ID NO: 34680 - DNA, 867 bp, Artificial Sequence
  chemically treated genomic DNA (Homo sapiens) CpG-island No: 34680
aataaaaacgccgcgcaaaaacgaaaatccacccgcccaaatataaaaaaatccgcgaaaaaaaatcccgcccgacccgataaaccccgctaaaaaaataatatacgacgctaattaacaacaaacgcccacgatcgaaaaaaaaacaaaaaaactataccacccgtcgccgcgccccgctcctctaacgcacatctaacaaacgccccaacgccccgacaacgaccaattttccctccttcgaaaccgatcctaccgcgtaacccctttcccgccgaaacaacctccacccgcatccccgaacgctcgtataaccctcacctaacaaacaaaacgataccgtactccaacgaactacgactcactacccgccaactctaccgaatcaactcgaactccgaacgctccatactatcccgaaaacgcgaaacgcgaaactaaaaccctcaaaactcgaataccgtcaccgcacgtaccgcgccatctcctccgcgacgcgatcccctccgcccctcgtacgccccccgtacctccgcccgacgaaaaccgcaaccgctccttccctaacgcgaaaaaaaaaaaacgcgcgaccaatcgtaaataaaaacaccccaactatacttccgaaaaccccgcttaaccgctacgccctacgccccgcaaccgccaaaaccgccccaccccgcgacgcctaaactaaacgctttaaaaccgccacgacccccgccccctccaaaccaacaaaacgcgcgctccctccgccaaccgctataataacctaaaaaaaacccgacctacaaaacgtaactaacatcgcgaaaactctctaaacctcaatttctcctcccgaaccccgaaaacactata

SEQ ID NO: 34681 - DNA, 732 bp, Artificial Sequence
  chemically treated genomic DNA (Homo sapiens) CpG-island No: 34681
  misc_feature (228)..(228): n is either a, c, g or t
  misc_feature (326)..(326): n is either a, c, g or t
  misc_feature (390)..(390): n is either a, c, g or t
  misc_feature (510)..(510): n is either a, c, g or t
  misc_feature (654)..(654): n is either a, c, g or t
ttggttttcgtattttttttgacgttaaatttttattagggttgtaacgttacgttgttttggatgtttgcgtgagtggagtcgcgattcggggttcgcgttttgagagacgcgttttttttcgtttttcgttttcggatcgtaggggtcgaagtcgtttatttttggtttcgcgggtagcggggtcgtggcgttcggacggtttgggattcgggttcgtcgcgcggnaatcggaataagaagggagagcgttcggttcggttttcggtttttatcgcggttcggaaagaattcggcgagtttttcgcggaggtgagtgtcgcggnttgggggcggggcgcggtcggggcgacgcgcggggcgggtttgttcgtcgggcgttcgggtttnttttttcgagggacgttaggatcgttcgttgggttttcgcggtcgtttcgtaggttttcggtttttttttatttcgcgtttttttttgtttttgttgcgtgagaggtgtcggcggttttnggtcgggatcgaggtggcggggcgagggaaggaggtggggcgtaggttgtattgcgtttttgttcggggttttgggttagaggggtcggcggacgaggtttcgggttcgggtttggggagggggcggtttgcggggtcggattngagggtcgggaattcgcggagttttgtttttgggtatttgtggggtcgagatttcgagttatttgtttatatattttt

SEQ ID NO: 34682 - DNA, 732 bp, Artificial Sequence
  chemically treated genomic DNA (Homo sapiens) CpG-island No: 34682
  misc_feature (79)..(79): n is either a, c, g or t
  misc_feature (223)..(223): n is either a, c, g or t
  misc_feature (343)..(343): n is either a, c, g or t
  misc_feature (407)..(407): n is either a, c, g or t
  misc_feature (505)..(505): n is either a, c, g or t
aaaaatatataaacaaataactcgaaatctcgaccccacaaatacccaaaaacaaaactccgcgaattcccgaccctcnaatccgaccccgcaaaccgccccctccccaaacccgaacccgaaacctcgtccgccgacccctctaacccaaaaccccgaacaaaaacgcaatacaacctacgccccacctccttccctcgccccgccacctcgatcccgaccnaaaaccgccgacacctctcacgcaacaaaaacaaaaaaaaacgcgaaataaaaaaaaaccgaaaacctacgaaacgaccgcgaaaacccaacgaacgatcctaacgtccctcgaaaaaanaaacccgaacgcccgacgaacaaacccgccccgcgcgtcgccccgaccgcgccccgcccccaanccgcgacactcacctccgcgaaaaactcgccgaattctttccgaaccgcgataaaaaccgaaaaccgaaccgaacgctctcccttcttattccgattnccgcgcgacgaacccgaatcccaaaccgtccgaacgccacgaccccgctacccgcgaaaccaaaaataaacgacttcgacccctacgatccgaaaacgaaaaacgaaaaaaaacgcgtctctcaaaacgcgaaccccgaatcgcgactccactcacgcaaacatccaaaacaacgtaacgttacaaccctaataaaaatttaacgtcaaaaaaaatacgaaaaccaa

SEQ ID NO: 34683 - DNA, 732 bp, Artificial Sequence
  chemically treated genomic DNA (Homo sapiens) CpG-island No: 34683
  misc_feature (79)..(79): n is either a, c, g or t
  misc_feature (223)..(223): n is either a, c, g or t
  misc_feature (343)..(343): n is either a, c, g or t
  misc_feature (407)..(407): n is either a, c, g or t
  misc_feature (505)..(505): n is either a, c, g or t
gggggtgtgtggataggtggttcgggatttcggttttataggtgtttaggggtaagatttcgcgggttttcggtttttnaattcgatttcgtagatcgttttttttttaagttcggattcgaggtttcgttcgtcggtttttttgatttagggtttcggatagaagcgtaatgtagtttgcgttttatttttttttttcgtttcgttatttcgatttcggttnggagtcgtcgatattttttacgtagtaggggtagaaagggacgcggggtggggggaagtcgaggatttgcgaggcggtcgcgggagtttagcgagcggttttggcgtttttcgggaaganaagttcgggcgttcggcgagtaggttcgtttcgcgcgtcgtttcggtcgcgtttcgtttttagntcgcggtatttattttcgcgagaggttcgtcggatttttttcgggtcgcggtggagatcgaggatcgagtcgggcgttttttttttttatttcggttntcgcgcggcgggttcgaattttagatcgttcgagcgttacggtttcgttgttcgcggagttagaaataggcgatttcggtttttgcggttcggaggcgagaagcgggggggagcgcgttttttaggacgcgggtttcgagtcgcgattttatttacgtaggtatttaaggtaacgtggcgttgtaattttgatggaggtttgacgttagggaaggtgcgaaaattag

SEQ ID NO: 34684 - DNA, 732 bp, Artificial Sequence
  chemically treated genomic DNA (Homo sapiens) CpG-island No: 34684
  misc_feature (228)..(228): n is either a, c, g or t
  misc_feature (326)..(326): n is either a, c, g or t
  misc_feature (390)..(390): n is either a, c, g or t
  misc_feature (510)..(510): n is either a, c, g or t
  misc_feature (654)..(654): n is either a, c, g or t
ctaattttcgcaccttccctaacgtcaaacctccatcaaaattacaacgccacgttaccttaaatacctacgtaaataaaatcgcgactcgaaacccgcgtcctaaaaaacgcgctcccccccgcttctcgcctccgaaccgcaaaaaccgaaatcgcctatttctaactccgcgaacaacgaaaccgtaacgctcgaacgatctaaaattcgaacccgccgcgcganaaccgaaataaaaaaaaaaaacgcccgactcgatcctcgatctccaccgcgacccgaaaaaaatccgacgaacctctcgcgaaaataaataccgcganctaaaaacgaaacgcgaccgaaacgacgcgcgaaacgaacctactcgccgaacgcccgaacttntcttcccgaaaaacgccaaaaccgctcgctaaactcccgcgaccgcctcgcaaatcctcgacttccccccaccccgcgtccctttctacccctactacgtaaaaaatatcgacgactccnaaccgaaatcgaaataacgaaacgaaaaaaaaaaataaaacgcaaactacattacgcttctatccgaaaccctaaatcaaaaaaaccgacgaacgaaacctcgaatccgaacttaaaaaaaaaacgatctacgaaatcgaattnaaaaaccgaaaacccgcgaaatcttacccctaaacacctataaaaccgaaatcccgaaccacctatccacacaccccc

SEQ ID NO: 34685 - DNA, 509 bp, Artificial Sequence
  chemically treated genomic DNA (Homo sapiens) CpG-island No: 34685
  misc_feature (61)..(61): n is either a, c, g or t
  misc_feature (66)..(66): n is either a, c, g or t
  misc_feature (69)..(69): n is either a, c, g or t
  misc_feature (205)..(205): n is either a, c, g or t
  misc_feature (221)..(222): n is either a, c, g or t
  misc_feature (230)..(230): n is either a, c, g or t
gacgttcggtttcgaggttggggttattttcggcggaattgcgggtttaagttgttttttntcgtnttncgggttgggtcgattttagtttcgttttttggtcggttgacggaaattgtcgataaatttgtcgaatgtaaggattttagttttttcgggtttttcgttttttaggttcggttgatagagttagtcgaggtcgttnatattgaataagcgannttcggttnttttagggggtcgtcgtggtttagatagtttagtagaatagttttcgcggtttcggggagaaggtgaggttttgtatggatgggaagggtgaggtgcgtcggttagaggtttatttattgacgggattgttttttttggtttacgcgacgtagttttttgttgtttttgattaggcgtcgtttttcgtttcgtcgtttcggaagtttttgagagtcggtagatgggggtttttagttacggtttttggtttgatgaagtagaaaagaagatgaggatta

SEQ ID NO: 34686 - DNA, 509 bp, Artificial Sequence
  chemically treated genomic DNA (Homo sapiens) CpG-island No: 34686
  misc_feature (280)..(280): n is either a, c, g or t
  misc_feature (288)..(289): n is either a, c, g or t
  misc_feature (305)..(305): n is either a, c, g or t
  misc_feature (441)..(441): n is either a, c, g or t
  misc_feature (444)..(444): n is either a, c, g or t
  misc_feature (449)..(449): n is either a, c, g or t
taatcctcatcttcttttctacttcatcaaaccaaaaaccgtaactaaaaacccccatctaccgactctcaaaaacttccgaaacgacgaaacgaaaaacgacgcctaatcaaaaacaacaaaaaactacgtcgcgtaaaccaaaaaaaacaatcccgtcaataaataaacctctaaccgacgcacctcacccttcccatccatacaaaacctcaccttctccccgaaaccgcgaaaactattctactaaactatctaaaccacgacgaccccctaaaanaaccgaanntcgcttattcaatatnaacgacctcgactaactctatcaaccgaacctaaaaaacgaaaaacccgaaaaaactaaaatccttacattcgacaaatttatcgacaatttccgtcaaccgaccaaaaaacgaaactaaaatcgacccaacccgnaanacganaaaaaacaacttaaacccgcaattccgccgaaaataaccccaacctcgaaaccgaacgtc

SEQ ID NO: 34687 - DNA, 509 bp, Artificial Sequence
  chemically treated genomic DNA (Homo sapiens) CpG-island No: 34687
  misc_feature (280)..(280): n is either a, c, g or t
  misc_feature (288)..(289): n is either a, c, g or t
  misc_feature (305)..(305): n is either a, c, g or t
  misc_feature (441)..(441): n is either a, c, g or t
  misc_feature (444)..(444): n is either a, c, g or t
  misc_feature (449)..(449): n is either a, c, g or t
tgatttttatttttttttttgttttattagattagagatcgtggttaaaagtttttatttgtcggtttttaggggttttcgaggcggcggggcgggaggcggcgtttagttaaggataatagaagattacgtcgcgtgggttaaaggaaatagtttcgttaataaataagtttttggtcgacgtattttattttttttatttatataagattttatttttttttcggagtcgcggaggttgttttgttaaattgtttggattacgacgattttttagganggtcgggnntcgtttatttaatatnggcggtttcggttaattttgttagtcgggtttggagaacggaaagttcggagggattagaatttttgtattcgataagtttgtcggtaattttcgttagtcgattagagggcggagttgaggtcggtttagttcgngangcggngaaggataatttggattcgtagtttcgtcggaagtggttttagtttcgaggtcgggcgtt

SEQ ID NO: 34688 - DNA, 509 bp, Artificial Sequence
  chemically treated genomic DNA (Homo sapiens) CpG-island No: 34688
  misc_feature (61)..(61): n is either a, c, g or t
  misc_feature (66)..(66): n is either a, c, g or t
  misc_feature (69)..(69): n is either a, c, g or t
  misc_feature (205)..(205): n is either a, c, g or t
  misc_feature (221)..(222): n is either a, c, g or t
  misc_feature (230)..(230): n is either a, c, g or t
aacgcccgacctcgaaactaaaaccacttccgacgaaactacgaatccaaattatccttcnccgcntcncgaactaaaccgacctcaactccgccctctaatcgactaacgaaaattaccgacaaacttatcgaatacaaaaattctaatccctccgaactttccgttctccaaacccgactaacaaaattaaccgaaaccgccnatattaaataaacganncccgaccntcctaaaaaatcgtcgtaatccaaacaatttaacaaaacaacctccgcgactccgaaaaaaaaataaaatcttatataaataaaaaaaataaaatacgtcgaccaaaaacttatttattaacgaaactatttcctttaacccacgcgacgtaatcttctattatccttaactaaacgccgcctcccgccccgccgcctcgaaaacccctaaaaaccgacaaataaaaacttttaaccacgatctctaatctaataaaacaaaaaaaaaaataaaaatca

SEQ ID NO: 34689 - DNA, 519 bp, Artificial Sequence
  chemically treated genomic DNA (Homo sapiens) CpG-island No: 34689
gtttggcgaaatcggttggatagtgatattgatgatgcgacgttttagggcggggatttttttattttatttatgttttataggatttgtttaaatcgggtttcgttattttgcgatgttacgtttattcggaaacgcgtgtatacgttggtgatcgcgggtatttatatagtagggggaggggggaagtttttttattatttgttatttagaggatttgttagtaattcgtttacgttgtcgcggatttaacggtttgtcgtttgcgttaattttacgtttggcgatttttgtttagtattgtttattttcgtggggtacgcgtatataggggggtgcggggcgggtatattagtgagagtgtggatcgtagtagaatgtttgagggggggtggcgattgtatgaaattggtggttatcgacgggtatcgatagaagaggtacgtgagggttgtttgtgcgggcgtgggagattagataatagtaagaaatattagttagggggatggggtggttttg

SEQ ID NO: 34690 - DNA, 519 bp, Artificial Sequence
  chemically treated genomic DNA (Homo sapiens) CpG-island No: 34690
caaaaccaccccatccccctaactaatatttcttactattatctaatctcccacgcccgcacaaacaaccctcacgtacctcttctatcgatacccgtcgataaccaccaatttcatacaatcgccaccccccctcaaacattctactacgatccacactctcactaatatacccgccccgcacccccctatatacgcgtaccccacgaaaataaacaatactaaacaaaaatcgccaaacgtaaaattaacgcaaacgacaaaccgttaaatccgcgacaacgtaaacgaattactaacaaatcctctaaataacaaataataaaaaaacttcccccctccccctactatataaatacccgcgatcaccaacgtatacacgcgtttccgaataaacgtaacatcgcaaaataacgaaacccgatttaaacaaatcctataaaacataaataaaataaaaaaatccccgccctaaaacgtcgcatcatcaatatcactatccaaccgatttcgccaaac

SEQ ID NO: 34691 - DNA, 519 bp, Artificial Sequence
  chemically treated genomic DNA (Homo sapiens) CpG-island No: 34691
taaggttattttatttttttaattggtgttttttattattgtttgattttttacgttcgtataggtaatttttacgtgttttttttgtcggtattcgtcggtaattattagttttatgtaatcgttatttttttttaagtattttattgcggtttatatttttattggtgtgttcgtttcgtatttttttatgtacgcgtgttttacgagggtaagtaatattggataagagtcgttaagcgtggagttggcgtaggcggtaaatcgttagattcgcggtagcgtaggcgggttattagtaaattttttaagtgataggtggtgaaggaattttttttttttttttattatgtgaatattcgcggttattaacgtatgtacgcgttttcgggtaggcgtaatatcgtagggtggcgaagttcggtttaagtaaattttgtaagatataggtgaagtggaagggttttcgttttgggacgtcgtattattaatgttattatttagtcggtttcgttaagt

SEQ ID NO: 34692 - DNA, 519 bp, Artificial Sequence
  chemically treated genomic DNA (Homo sapiens) CpG-island No: 34692
acttaacgaaaccgactaaataataacattaataatacgacgtcccaaaacgaaaacccttccacttcacctatatcttacaaaatttacttaaaccgaacttcgccaccctacgatattacgcctacccgaaaacgcgtacatacgttaataaccgcgaatattcacataataaaaaaaaaaaaaaaattccttcaccacctatcacttaaaaaatttactaataacccgcctacgctaccgcgaatctaacgatttaccgcctacgccaactccacgcttaacgactcttatccaatattacttaccctcgtaaaacacgcgtacataaaaaaatacgaaacgaacacaccaataaaaatataaaccgcaataaaatacttaaaaaaaaataacgattacataaaactaataattaccgacgaataccgacaaaaaaaacacgtaaaaattacctatacgaacgtaaaaaatcaaacaataataaaaaacaccaattaaaaaaataaaataacctta

SEQ ID NO: 34693 - DNA, 527 bp, Artificial Sequence
  chemically treated genomic DNA (Homo sapiens) CpG-island No: 34693
ttgtttttgtttatatatattcgtaatttcgttacggtcgtggtcgttgtttaatttttgtattcgtagtgtttataattacggtcgcggtggtttttttttatttgtgataatgtttatatattttttcgttttcgtttttgcgcggtttttattatattagtatttattatcgtttttttaattttcgtttatttatatcgttagttatatgtattgttttcgcgtttttggttatagttttattgttttaatcgttgtcgtcgttatcgttattagtgtaattgttagttttttttcgttttttttattttttatattttgttggttacgtttattttataattattatcgtcgcggtcgtggattttttttttattacgtgttatcgtacggtttattgttacggtttttttgttacgttcgcgattattatttatttatttttttttttagtattatttcggttattttttgtatcgttttgtatttttagtggttttatttaaatgagtcgttattgtttg

SEQ ID NO: 34694 - DNA, 527 bp, Artificial Sequence
  chemically treated genomic DNA (Homo sapiens) CpG-island No: 34694
caaacaataacgactcatttaaataaaaccactaaaaatacaaaacgatacaaaaaataaccgaaataatactaaaaaaaaaaataaataaataataatcgcgaacgtaacaaaaaaaccgtaacaataaaccgtacgataacacgtaataaaaaaaaaatccacgaccgcgacgataataattataaaataaacgtaaccaacaaaatataaaaaataaaaaaaacgaaaaaaaactaacaattacactaataacgataacgacgacaacgattaaaacaataaaactataaccaaaaacgcgaaaacaatacatataactaacgatataaataaacgaaaattaaaaaaacgataataaatactaatataataaaaaccgcgcaaaaacgaaaacgaaaaaatatataaacattatcacaaataaaaaaaaaccaccgcgaccgtaattataaacactacgaatacaaaaattaaacaacgaccacgaccgtaacgaaattacgaatatatataaacaaaaacaa

SEQ ID NO: 34695 - DNA, 527 bp, Artificial Sequence
  chemically treated genomic DNA (Homo sapiens) CpG-island No: 34695
taagtagtagcgatttatttaggtgagattattagggatataagacggtgtagagagtggtcggggtggtgttgaggaagagggtggatgagtagtggtcgcgagcgtggtaagaggatcgtgatagtgggtcgtacggtaatacgtagtagaggaagagtttacgatcgcgacggtagtgattgtggagtagacgtgattagtagggtataagaagtgagggagacgagagagagttggtaattgtattagtagcggtagcggcgataacggttgaagtagtagaattgtggttaggagcgcggagatagtgtatgtgattagcgatgtagataagcgagggttggaggagcggtggtagatattaatgtggtaaagatcgcgtagagacggagacgggagagtatgtggatattattataagtagggaagaattatcgcggtcgtgattgtggatattgcgaatgtagagattgagtaacgattacgatcgtgacgaagttgcggatgtatgtggatagggataa

SEQ ID NO: 34696 - DNA, 527 bp, Artificial Sequence
  chemically treated genomic DNA (Homo sapiens) CpG-island No: 34696
ttatccctatccacatacatccgcaacttcgtcacgatcgtaatcgttactcaatctctacattcgcaatatccacaatcacgaccgcgataattcttccctacttataataatatccacatactctcccgtctccgtctctacgcgatctttaccacattaatatctaccaccgctcctccaaccctcgcttatctacatcgctaatcacatacactatctccgcgctcctaaccacaattctactacttcaaccgttatcgccgctaccgctactaatacaattaccaactctctctcgtctccctcacttcttataccctactaatcacgtctactccacaatcactaccgtcgcgatcgtaaactcttcctctactacgtattaccgtacgacccactatcacgatcctcttaccacgctcgcgaccactactcatccaccctcttcctcaacaccaccccgaccactctctacaccgtcttatatccctaataatctcacctaaataaatcgctactactta

SEQ ID NO: 34697 - DNA, 648 bp, Artificial Sequence
  chemically treated genomic DNA (Homo sapiens) CpG-island No: 34697
gggataggcggatgggtagaggggtcgtagtggcggggtgaatttcgggtatatttcgggatgtatattttgggggaaataacgtaggagttttgtggatgtgttcggtgggtcgggggggatcgagagattcgatgtgatggtaagggggttaatatgtgcggggttgggtggatggtgggtacggcgcgtggtttgtgcgaacggcggggagaaagtggatagtttgataggtggtacgacggaggttgcggaagcggtcgttatgggtggtatagagcgggggggggataggaggataggaaaggggattttggggcgtaacggagcgataaatatggggcggcgtgagtggagttgggtgttagagtcggggcgagtatggtgatgtacgaggatgcggggattgggatggggtagtggacgcgagatgataagttgtgtaaggggattaaaagattgggacgtgtttggaggggggattatcgcgttacggggggttcgggtaaatagtgaataattattcggatagggaagtagtggttgtagtcgcggtgtaaatcgtaaatattggggtttggggaacgttagttgttattttgcggatttgattagttatcgaattaataattgggcgttcggatttaa

SEQ ID NO: 34698 - DNA, 648 bp, Artificial Sequence
  chemically treated genomic DNA (Homo sapiens) CpG-island No: 34698
ttaaatccgaacgcccaattattaattcgataactaatcaaatccgcaaaataacaactaacgttccccaaaccccaatatttacgatttacaccgcgactacaaccactacttccctatccgaataattattcactatttacccgaaccccccgtaacgcgataatcccccctccaaacacgtcccaatcttttaatccccttacacaacttatcatctcgcgtccactaccccatcccaatccccgcatcctcgtacatcaccatactcgccccgactctaacacccaactccactcacgccgccccatatttatcgctccgttacgccccaaaatcccctttcctatcctcctatcccccccccgctctataccacccataacgaccgcttccgcaacctccgtcgtaccacctatcaaactatccactttctccccgccgttcgcacaaaccacgcgccgtacccaccatccacccaaccccgcacatattaacccccttaccatcacatcgaatctctcgatcccccccgacccaccgaacacatccacaaaactcctacgttatttcccccaaaatatacatcccgaaatatacccgaaattcaccccgccactacgacccctctacccatccgcctatccc

SEQ ID NO: 34699 - DNA, 648 bp, Artificial Sequence
  chemically treated genomic DNA (Homo sapiens) CpG-island No: 34699
ttggattcgaacgtttaattattaattcggtggttagttaaattcgtaaagtagtaattagcgttttttaagttttaatatttgcggtttgtatcgcggttatagttattgtttttttgttcgggtggttgtttattgtttattcgggtttttcgtggcgcggtagttttttttttaggtacgttttaattttttagtttttttgtataatttattatttcgcgtttattattttattttagttttcgtattttcgtatattattatattcgtttcggttttggtatttagttttatttacgtcgttttatatttgtcgtttcgttgcgttttagggtttttttttttatttttttatttttttttcgttttatattatttatagcggtcgttttcgtaattttcgtcgtgttatttattaaattatttatttttttttcgtcgttcgtataaattacgcgtcgtgtttattatttatttagtttcgtatatattaatttttttattattatatcgggtttttcggtttttttcggtttatcgggtatatttataaaatttttgcgttattttttttagggtatgtatttcggaatatattcggggtttatttcgttattacgatttttttatttattcgtttatttt

SEQ ID NO: 34700 - DNA, 648 bp, Artificial Sequence
  chemically treated genomic DNA (Homo sapiens) CpG-island No: 34700
aaaataaacgaataaataaaaaaatcgtaataacgaaataaaccccgaatatattccgaaatacataccctaaaaaaaataacgcaaaaattttataaatatacccgataaaccgaaaaaaaccgaaaaacccgatataataataaaaaaattaatatatacgaaactaaataaataataaacacgacgcgtaatttatacgaacgacgaaaaaaaaataaataatttaataaataacacgacgaaaattacgaaaacgaccgctataaataatataaaacgaaaaaaaaataaaaaaataaaaaaaaaaaccctaaaacgcaacgaaacgacaaatataaaacgacgtaaataaaactaaataccaaaaccgaaacgaatataataatatacgaaaatacgaaaactaaaataaaataataaacgcgaaataataaattatacaaaaaaactaaaaaattaaaacgtacctaaaaaaaaaactaccgcgccacgaaaaacccgaataaacaataaacaaccacccgaacaaaaaaacaataactataaccgcgatacaaaccgcaaatattaaaacttaaaaaacgctaattactactttacgaatttaactaaccaccgaattaataattaaacgttcgaatccaa

SEQ ID NO: 34701 - DNA, 550 bp, Artificial Sequence
  chemically treated genomic DNA (Homo sapiens) CpG-island No: 34701
cgattttgggtataaggggaggcgttggtgtagtggggtcgcgaggcggcgttgtgagttatgttgtaagaagatgtagttttattttttgttttataggttcgttgagttcgtcggtatttcgtcggttgggcggcggtataatatatgcgagttataagttatgttttggcggcgggagattgtttattcgggggtattgttagcgttatgtgttttcgagtttggaatgcgtaggagggtatacgaggatggtttatatggacgacgtcggtaggtttttcgagatgttatgtgacgtcggttcggcgcggtcgggatggtatacgtgggtattttatgggaaatttaattaaggggaagtgtaatgggggtagacgcggggattgattgtttacggtcgggtgtggggtatacgtgggaagtttatgtagttatgcggtgggatacgtcggtgtttatgggatatacgtgcgaggtttatgcgtagattatattatgatcgtacgagattttcggtcggggagtcgagacgtattatattttttta

SEQ ID NO: 34702 - DNA, 550 bp, Artificial Sequence
  chemically treated genomic DNA (Homo sapiens) CpG-island No: 34702
taaaaaaatataatacgtctcgactccccgaccgaaaatctcgtacgatcataatataatctacgcataaacctcgcacgtatatcccataaacaccgacgtatcccaccgcataactacataaacttcccacgtataccccacacccgaccgtaaacaatcaatccccgcgtctacccccattacacttccccttaattaaatttcccataaaatacccacgtataccatcccgaccgcgccgaaccgacgtcacataacatctcgaaaaacctaccgacgtcgtccatataaaccatcctcgtataccctcctacgcattccaaactcgaaaacacataacgctaacaatacccccgaataaacaatctcccgccgccaaaacataacttataactcgcatatattataccgccgcccaaccgacgaaataccgacgaactcaacgaacctataaaacaaaaaataaaactacatcttcttacaacataactcacaacgccgcctcgcgaccccactacaccaacgcctccccttatacccaaaatcg

SEQ ID NO: 34703 - DNA, 550 bp, Artificial Sequence
  chemically treated genomic DNA (Homo sapiens) CpG-island No: 34703
taaggaggtatgatgcgtttcgatttttcggtcggagatttcgtgcggttatgatgtaatttacgtataaatttcgtacgtgtattttataaatatcgacgtgttttatcgtatggttgtataaattttttacgtgtattttatattcggtcgtaggtagttaattttcgcgtttgtttttattgtatttttttttaattaggttttttataaagtatttacgtgtattatttcggtcgcgtcgggtcgacgttatatggtatttcgaaaaatttatcgacgtcgtttatataaattattttcgtgtatttttttgcgtattttaagttcggagatatatggcgttggtaatattttcgggtgaataatttttcgtcgttagagtataatttatagttcgtatgtattgtatcgtcgtttagtcggcgaggtatcgacgagtttagcgaatttgtgaagtagaagatagagttatatttttttatagtataatttatagcgtcgtttcgcggttttattatattagcgtttttttttgtgtttaaaatcg

SEQ ID NO: 34704 - DNA, 550 bp, Artificial Sequence
  chemically treated genomic DNA (Homo sapiens) CpG-island No: 34704
cgattttaaacacaaaaaaaaacgctaatataataaaaccgcgaaacgacgctataaattatactataaaaaaatataactctatcttctacttcacaaattcgctaaactcgtcgatacctcgccgactaaacgacgatacaatacatacgaactataaattatactctaacgacgaaaaattattcacccgaaaatattaccaacgccatatatctccgaacttaaaatacgcaaaaaaatacacgaaaataatttatataaacgacgtcgataaatttttcgaaataccatataacgtcgacccgacgcgaccgaaataatacacgtaaatactttataaaaaacctaattaaaaaaaaatacaataaaaacaaacgcgaaaattaactacctacgaccgaatataaaatacacgtaaaaaatttatacaaccatacgataaaacacgtcgatatttataaaatacacgtacgaaatttatacgtaaattacatcataaccgcacgaaatctccgaccgaaaaatcgaaacgcatcatacctcctta

SEQ ID NO: 34705 - DNA, 550 bp, Artificial Sequence
  chemically treated genomic DNA (Homo sapiens) CpG-island No: 34705
  misc_feature (132)..(132): n is either a, c, g or t
ttcgtacggtatcgtttttttcgtggttcgtcggtttttttttattagggtttaagttttagtggttggttttttggtttggcgttcgtcgtgttcgtcgattggaacggtgttgtttataaatattgttanaggtcggtggtggtgtgtggggggtagtgtcggtttggggggttgtggggttgggtggtggtgtggggggtggggtgtgttgaggggagttgttgtacgaatgtgatatggggggcgatcgagacgatgacggcggtggggagtaatatcgtcggttatttatggttttttatgatgttgaaatagcgcgagggtaagatcgaagagcgggcgagggtgaaagggtgataaaaggtatgggaggaagacgagaagggagaatatgattagaaaaacggagtgaggggtggaggtcggatcgtcgtgtgggatgcggaggcggggacggagtcgagggcggtaattaatggggaacgcggcgaaacgttaatatgaggtcgagaagaatgatgacgattaattttaggcgaaaggtaaa

SEQ ID NO: 34706 - DNA, 550 bp, Artificial Sequence
  chemically treated genomic DNA (Homo sapiens) CpG-island No: 34706
  misc_feature (419)..(419): n is either a, c, g or t
tttacctttcgcctaaaattaatcgtcatcattcttctcgacctcatattaacgtttcgccgcgttccccattaattaccgccctcgactccgtccccgcctccgcatcccacacgacgatccgacctccacccctcactccgtttttctaatcatattctcccttctcgtcttcctcccataccttttatcaccctttcaccctcgcccgctcttcgatcttaccctcgcgctatttcaacatcataaaaaaccataaataaccgacgatattactccccaccgccgtcatcgtctcgatcgccccccatatcacattcgtacaacaactcccctcaacacaccccaccccccacaccaccacccaaccccacaaccccccaaaccgacactaccccccacacaccaccaccgacctntaacaatatttataaacaacaccgttccaatcgacgaacacgacgaacgccaaaccaaaaaaccaaccactaaaacttaaaccctaataaaaaaaaaccgacgaaccacgaaaaaaacgataccgtacgaa

SEQ ID NO: 34707 - DNA, 550 bp, Artificial Sequence
  chemically treated genomic DNA (Homo sapiens) CpG-island No: 34707
  misc_feature (419)..(419): n is either a, c, g or t
tttatttttcgtttggaattaatcgttattatttttttcggttttatattaacgtttcgtcgcgttttttattagttatcgttttcggtttcgttttcgttttcgtattttatacggcggttcggtttttattttttatttcgtttttttggttatgtttttttttttcgttttttttttatattttttgttatttttttattttcgttcgtttttcgattttattttcgcgttgttttaatattataggaaattataagtagtcgacggtgttgttttttatcgtcgttatcgtttcggtcgttttttatattatattcgtataataattttttttaatatattttattttttatattattatttaattttataattttttaaatcgatattattttttatatattattatcgatttntgataatgtttatggataatatcgttttagtcgacggatacggcgagcgttaagttaaagaattagttattggggtttaaattttggtaaaagaggatcggcgagttacgaagaggacggtgtcgtgcgga

SEQ ID NO: 34708 - DNA, 550 bp, Artificial Sequence
  chemically treated genomic DNA (Homo sapiens) CpG-island No: 34708
  misc_feature (132)..(132): n is either a, c, g or t
tccgcacgacaccgtcctcttcgtaactcgccgatcctcttttaccaaaatttaaaccccaataactaattctttaacttaacgctcgccgtatccgtcgactaaaacgatattatccataaacattatcanaaatcgataataatatataaaaaataatatcgatttaaaaaattataaaattaaataataatataaaaaataaaatatattaaaaaaaattattatacgaatataatataaaaaacgaccgaaacgataacgacgataaaaaacaacaccgtcgactacttataatttcctataatattaaaacaacgcgaaaataaaatcgaaaaacgaacgaaaataaaaaaataacaaaaaatataaaaaaaaaacgaaaaaaaaaaacataaccaaaaaaacgaaataaaaaataaaaaccgaaccgccgtataaaatacgaaaacgaaaacgaaaccgaaaacgataactaataaaaaacgcgacgaaacgttaatataaaaccgaaaaaaataataacgattaattccaaacgaaaaataaa

SEQ ID NO: 34709 - DNA, 656 bp, Artificial Sequence
  chemically treated genomic DNA (Homo sapiens) CpG-island No: 34709
gcgaggataaaagaacgcgtatataacgggcgagcgtggtgaaaagttggcgggtataaggcgcgtaggtagtcggtggtattgtgtagagattataggaacggtcgaagcgttgttcgcgaatacggtttgtcgggttagaaataaaaaaggagggaagttagtggtaggatcgcgtaagggaagatttgtagcgggacggaacgggggcgtagagtggcgtttgtatttgggtagcggttgtttgcgaggacgtgcgtatgagtgggacgaggcgcgggggtggggtagcggtaacgtatatgtaaaaagtaaataatggtacgcggcgacgtgaatttgaaggttggttattgcggtgttaatcgcgggtgtaaatatatagaaacgttgttagttcggatcgcgaggtgaaaggcggggataagtaaacggtattaggcgcggagtttaatacgatcgggagatttatatcgatatgcggcgcgaagaacgagagcgaaaatcggtggtattaaagtgcgggggggaggattgacgtgcggaggggattttgcgtgcgtaaacggtgtacgggggtgaatatattgttagtaagttatttcgtatatttcgaattatatttattagaggtgggcggtgtggtatttttatag

SEQ ID NO: 34710 - DNA, 656 bp, Artificial Sequence
  chemically treated genomic DNA (Homo sapiens) CpG-island No: 34710
ctataaaaataccacaccgcccacctctaataaatataattcgaaatatacgaaataacttactaacaatatattcacccccgtacaccgtttacgcacgcaaaatcccctccgcacgtcaatcctcccccccgcactttaataccaccgattttcgctctcgttcttcgcgccgcatatcgatataaatctcccgatcgtattaaactccgcgcctaataccgtttacttatccccgcctttcacctcgcgatccgaactaacaacgtttctatatatttacacccgcgattaacaccgcaataaccaaccttcaaattcacgtcgccgcgtaccattatttactttttacatatacgttaccgctaccccacccccgcgcctcgtcccactcatacgcacgtcctcgcaaacaaccgctacccaaatacaaacgccactctacgcccccgttccgtcccgctacaaatcttcccttacgcgatcctaccactaacttccctccttttttatttctaacccgacaaaccgtattcgcgaacaacgcttcgaccgttcctataatctctacacaataccaccgactacctacgcgccttatacccgccaacttttcaccacgctcgcccgttatatacgcgttcttttatcctcgc

SEQ ID NO: 34711 - DNA, 656 bp, Artificial Sequence
  chemically treated genomic DNA (Homo sapiens) CpG-island No: 34711
ttgtgggggtattatatcgtttatttttggtgggtgtaattcgaggtgtgcggggtggtttattggtaatgtgtttattttcgtgtatcgtttacgtacgtagggtttttttcgtacgttaattttttttttcgtattttaatattatcggttttcgttttcgtttttcgcgtcgtatatcggtatgggtttttcggtcgtgttgaatttcgcgtttaatgtcgtttatttgttttcgttttttatttcgcggttcgggttggtagcgtttttgtgtgtttgtattcgcggttggtatcgtagtaattaatttttaagtttacgtcgtcgcgtattattgtttgttttttatatatacgttgtcgttgttttattttcgcgtttcgttttatttatacgtacgttttcgtaagtagtcgttgtttaggtataggcgttattttacgttttcgtttcgtttcgttgtaggtttttttttacgcggttttgttattggtttttttttttttttatttttagttcggtaggtcgtgttcgcgggtagcgtttcggtcgtttttgtggtttttgtatagtattatcggttgtttgcgcgttttgtgttcgttaattttttattacgttcgttcgttatgtgcgcgtttttttgttttcgt

SEQ ID NO: 34712 - DNA, 656 bp, Artificial Sequence
  chemically treated genomic DNA (Homo sapiens) CpG-island No: 34712
acgaaaacaaaaaaacgcgcacataacgaacgaacgtaataaaaaattaacgaacacaaaacgcgcaaacaaccgataatactatacaaaaaccacaaaaacgaccgaaacgctacccgcgaacacgacctaccgaactaaaaataaaaaaaaaaaaaaaccaataacaaaaccgcgtaaaaaaaaacctacaacgaaacgaaacgaaaacgtaaaataacgcctatacctaaacaacgactacttacgaaaacgtacgtataaataaaacgaaacgcgaaaataaaacaacgacaacgtatatataaaaaacaaacaataatacgcgacgacgtaaacttaaaaattaattactacgataccaaccgcgaatacaaacacacaaaaacgctaccaacccgaaccgcgaaataaaaaacgaaaacaaataaacgacattaaacgcgaaattcaacacgaccgaaaaacccataccgatatacgacgcgaaaaacgaaaacgaaaaccgataatattaaaatacgaaaaaaaaaattaacgtacgaaaaaaaccctacgtacgtaaacgatacacgaaaataaacacattaccaataaaccaccccgcacacctcgaattacacccaccaaaaataaacgatataatacccccacaa

SEQ ID NO: 34713 - DNA, 511 bp, Artificial Sequence
  chemically treated genomic DNA (Homo sapiens) CpG-island No: 34713
ggaggtaagttcgggggagggggaaggggggggattagtacggattgcggtgtcgacgaagagggcggtgttgattaggggtattggggagatgcgtgtgtgcggggatacggggcgtttgggtcggggagggtgcggagttaaagggtcggacgtgaaagcgaagtgttagggaataacgtgttggtggatcgggttgtagcgtgtatcggagagaaagtagatattatatttttatgtgttaggcgaagagtttatgcgggggattaaaatggaggaagacgacgggagggcgtgaaaatgcgggggtgggttacgggatgaattatgttgttgataaatcgtagggtcgggtatatggaagaataggtgatcgggcgtggaggatttacgacgggttatgcgtttttgcggtaggtcggcgcgggtggggtattagggagataggtagtgaaagggtggataacgaatagaggggaggagtaggagataagattttaaaaggggaaaa

SEQ ID NO: 34714 - DNA, 511 bp, Artificial Sequence
  chemically treated genomic DNA (Homo sapiens) CpG-island No: 34714
ttttccccttttaaaatcttatctcctactcctcccctctattcgttatccaccctttcactacctatctccctaataccccacccgcgccgacctaccgcaaaaacgcataacccgtcgtaaatcctccacgcccgatcacctattcttccatatacccgaccctacgatttatcaacaacataattcatcccgtaacccacccccgcattttcacgccctcccgtcgtcttcctccattttaatcccccgcataaactcttcgcctaacacataaaaatataatatctactttctctccgatacacgctacaacccgatccaccaacacgttattccctaacacttcgctttcacgtccgaccctttaactccgcaccctccccgacccaaacgccccgtatccccgcacacacgcatctccccaatacccctaatcaacaccgccctcttcgtcgacaccgcaatccgtactaatccccccccttccccctcccccgaacttacctcc

SEQ ID NO: 34715 - DNA, 511 bp, Artificial Sequence
  chemically treated genomic DNA (Homo sapiens) CpG-island No: 34715
ttttttttttttggggttttattttttattttttttttttgttcgttgtttatttttttattgtttgtttttttggtattttattcgcgtcggtttgtcgtaggggcgtatggttcgtcgtaaattttttacgttcggttatttatttttttatatattcggttttacggtttattagtaatataatttatttcgtaatttattttcgtatttttacgttttttcgtcgtttttttttattttagtttttcgtataaatttttcgtttaatatatgggggtgtagtgtttatttttttttcggtatacgttgtaattcggtttattagtacgttattttttagtatttcgtttttacgttcggttttttaatttcgtatttttttcggtttaagcgtttcgtattttcgtatatacgtatttttttagtatttttggttagtatcgtttttttcgtcggtatcgtaattcgtattaatttttttttttttttttttttcggatttattttt

SEQ ID NO: 34716 - DNA, 511 bp, Artificial Sequence
  chemically treated genomic DNA (Homo sapiens) CpG-island No: 34716
aaaaataaatccgaaaaaaaaaaaaaaaaaaaaattaatacgaattacgataccgacgaaaaaaacgatactaaccaaaaatactaaaaaaatacgtatatacgaaaatacgaaacgcttaaaccgaaaaaaatacgaaattaaaaaaccgaacgtaaaaacgaaatactaaaaaataacgtactaataaaccgaattacaacgtataccgaaaaaaaaataaacactacacccccatatattaaacgaaaaatttatacgaaaaactaaaataaaaaaaaacgacgaaaaaacgtaaaaatacgaaaataaattacgaaataaattatattactaataaaccgtaaaaccgaatatataaaaaaataaataaccgaacgtaaaaaatttacgacgaaccatacgcccctacgacaaaccgacgcgaataaaataccaaaaaaacaaacaataaaaaaataaacaacgaacaaaaaaaaaaaataaaaaataaaaccccaaaaaaaaaaaa

SEQ ID NO: 34717 - DNA, 609 bp, Artificial Sequence
  chemically treated genomic DNA (Homo sapiens) CpG-island No: 34717
  misc_feature (569)..(569): n is either a, c, g or t
taaatataggcgcgttgttatttgtgtttatataatgatggtgatttgtgcgttttttgagcgggtaggtagttcgtcgttcgagttgtaagtattagtaggtgggtggcgcgttgttcgcgatttagtttttttttaatattaatttcgggtattcgttgtcgttaattcgcgatttatgtttaggcgaaagtgttgattggggtttaggttgtagtttagtatttattgtttttttcgtcgttattttgggtattcgggagagtaaagcgggttcgggcgttaggaattcggggatgtgtagttgtacgttatcggaggtacggaggtagtcgtattggtgttaggacgtgaatcgatttgtgtaatttagggttattatataggacgagttagagtagaagttggttgtcggtgattagagcgagtcgatataatgcgtgtaaattacggaatgtcgagggtagaggaacgagtatggggggaatcgtggaaagtagacggtattcgggttggcgaggaaaaatgtcggatttggatataggacgtttggtttttttgttgtgttnacgtacggagaggtatatagatatgtattgggtaagtaaa

SEQ ID NO: 34718 - DNA, 609 bp, Artificial Sequence
  chemically treated genomic DNA (Homo sapiens) CpG-island No: 34718
  misc_feature (41)..(41): n is either a, c, g or t
tttacttacccaatacatatctatatacctctccgtacgtnaacacaacaaaaaaaccaaacgtcctatatccaaatccgacatttttcctcgccaacccgaataccgtctactttccacgattccccccatactcgttcctctaccctcgacattccgtaatttacacgcattatatcgactcgctctaatcaccgacaaccaacttctactctaactcgtcctatataataaccctaaattacacaaatcgattcacgtcctaacaccaatacgactacctccgtacctccgataacgtacaactacacatccccgaattcctaacgcccgaacccgctttactctcccgaatacccaaaataacgacgaaaaaaacaataaatactaaactacaacctaaaccccaatcaacactttcgcctaaacataaatcgcgaattaacgacaacgaatacccgaaattaatattaaaaaaaaactaaatcgcgaacaacgcgccacccacctactaatacttacaactcgaacgacgaactacctacccgctcaaaaaacgcacaaatcaccatcattatataaacacaaataacaacgcgcctatattta

SEQ ID NO: 34719 - DNA, 609 bp, Artificial Sequence
  chemically treated genomic DNA (Homo sapiens) CpG-island No: 34719
  misc_feature (41)..(41): n is either a, c, g or t
tttgtttgtttaatatatgtttgtatgttttttcgtgcgtnaatataataaaaggattaagcgttttgtatttaagttcggtattttttttcgttagttcgagtgtcgtttattttttacggttttttttatgttcgtttttttattttcgatatttcgtgatttatacgtattgtgtcgattcgttttgattatcgatagttaatttttgttttgattcgttttgtgtgatgattttgagttgtatagatcgatttacgttttgatattagtgcgattattttcgtgttttcggtgacgtgtagttgtatattttcgagtttttgacgttcgagttcgttttattttttcgaatgtttaagatgacgacgagggaagtaatggatattaagttatagtttaagttttagttagtattttcgtttggatatggatcgcgggttgacggtagcgaatattcggagttggtgttggagaaagattggatcgcgaatagcgcgttatttatttgttggtgtttatagttcggacggcgggttatttgttcgtttaggagacgtataagttattattattgtgtggatataaatgataacgcgtttgtatttg

SEQ ID NO: 34720 - DNA, 609 bp, Artificial Sequence
  chemically treated genomic DNA (Homo sapiens) CpG-island No: 34720
  misc_feature (569)..(569): n is either a, c, g or t
caaatacaaacgcgttatcatttatatccacacaataataataacttatacgtctcctaaacgaacaaataacccgccgtccgaactataaacaccaacaaataaataacgcgctattcgcgatccaatctttctccaacaccaactccgaatattcgctaccgtcaacccgcgatccatatccaaacgaaaatactaactaaaacttaaactataacttaatatccattacttccctcgtcgtcatcttaaacattcgaaaaaataaaacgaactcgaacgtcaaaaactcgaaaatatacaactacacgtcaccgaaaacacgaaaataatcgcactaatatcaaaacgtaaatcgatctatacaactcaaaatcatcacacaaaacgaatcaaaacaaaaattaactatcgataatcaaaacgaatcgacacaatacgtataaatcacgaaatatcgaaaataaaaaaacgaacataaaaaaaaccgtaaaaaataaacgacactcgaactaacgaaaaaaaataccgaacttaaatacaaaacgcttaatccttttattatattnacgcacgaaaaaacatacaaacatatattaaacaaacaaa

SEQ ID NO: 34721 - DNA, 714 bp, Artificial Sequence
  chemically treated genomic DNA (Homo sapiens) CpG-island No: 34721
agtcggtagcgcggtagagtttaattagtacgtagggataaaaaaggggtaattagtcgtttataaaggcgtagatgtgtatatttattacgcggatatcggaaggtggcgttatttaatgggaaaggagcgagggagggttaggcgattagtgagggagtcgacgagtaggggttggcggagaataggcgttatagcgggttagtgatgagtataagaatcggaatcgggggggataaatttaaaatttaataacggtcgcgtttacggcgtatgacgataaaagtattaagggggatcgggcgtaaaatttattcgcggagatcgcgtaggtgttagaatacgcggcgcgtaggtaaggtacgtagagtgcggggaattgggatagttacgggacgtcggagtattgtaaatttagggttgtgattaatttgaggcgtcgtatacgagagggttggcggggtaggagacgcgggggttaaaatagagtaaacgtagtagcgtcgtaggaaaacgtgtataatgggtatgaaacgggtatatgggggtatacggttggagtcggagggggtagaaggttcggcgattattggtcgaagggacggtcgcggacgggagtcggatcgtgttaagtttggatgtttggttatgtattggagtgtttgtcgcgttgttgggaattgagggtgtaatgaaatgtttgggtgtttgatt

SEQ ID NO: 34722 - DNA, 714 bp, Artificial Sequence
  chemically treated genomic DNA (Homo sapiens) CpG-island No: 34722
aatcaaacacccaaacatttcattacaccctcaattcccaacaacgcgacaaacactccaatacataaccaaacatccaaacttaacacgatccgactcccgtccgcgaccgtcccttcgaccaataatcgccgaaccttctaccccctccgactccaaccgtatacccccatatacccgtttcatacccattatacacgttttcctacgacgctactacgtttactctattttaacccccgcgtctcctaccccgccaaccctctcgtatacgacgcctcaaattaatcacaaccctaaatttacaatactccgacgtcccgtaactatcccaattccccgcactctacgtaccttacctacgcgccgcgtattctaacacctacgcgatctccgcgaataaattttacgcccgatcccccttaatacttttatcgtcatacgccgtaaacgcgaccgttattaaattttaaatttatcccccccgattccgattcttatactcatcactaacccgctataacgcctattctccgccaacccctactcgtcgactccctcactaatcgcctaaccctccctcgctcctttcccattaaataacgccaccttccgatatccgcgtaataaatatacacatctacgcctttataaacgactaattaccccttttttatccctacgtactaattaaactctaccgcgctaccgact

SEQ ID NO: 34723 - DNA, 714 bp, Artificial Sequence
  chemically treated genomic DNA (Homo sapiens) CpG-island No: 34723
aattaagtatttaggtattttattatatttttaatttttagtagcgcggtaaatattttagtatatagttagatatttaaatttggtacggttcggttttcgttcgcggtcgttttttcggttagtagtcgtcggattttttgtttttttcgattttagtcgtgtgtttttatgtattcgttttatgtttattatatacgtttttttgcgacgttattgcgtttattttgttttaattttcgcgttttttgtttcgttagttttttcgtgtgcggcgttttaaattggttatagttttgggtttataatgtttcggcgtttcgtaattgttttaatttttcgtattttgcgtgttttatttgcgcgtcgcgtattttggtatttacgcggttttcgcgggtaaattttgcgttcggttttttttggtatttttgtcgttatgcgtcgtgaacgcggtcgttgttaaattttaagtttatttttttcggtttcggtttttgtgtttattattggttcgttgtggcgtttgtttttcgttagtttttgttcgtcgatttttttattaatcgtttggttttttttcgttttttttttattaggtaacgttatttttcgatattcgcgtagtaagtgtatatatttgcgtttttatgggcggttaattgttttttttttgtttttgcgtgttagttgagttttatcgcgttgtcggtt

SEQ ID NO: 34724 - DNA, 714 bp, Artificial Sequence
  chemically treated genomic DNA (Homo sapiens) CpG-island No: 34724
aaccgacaacgcgataaaactcaactaacacgcaaaaacaaaaaaaaaacaattaaccgcccataaaaacgcaaatatatacacttactacgcgaatatcgaaaaataacgttacctaataaaaaaaaaacgaaaaaaaaccaaacgattaataaaaaaatcgacgaacaaaaactaacgaaaaacaaacgccacaacgaaccaataataaacacaaaaaccgaaaccgaaaaaaataaacttaaaatttaacaacgaccgcgttcacgacgcataacgacaaaaataccaaaaaaaaccgaacgcaaaatttacccgcgaaaaccgcgtaaataccaaaatacgcgacgcgcaaataaaacacgcaaaatacgaaaaattaaaacaattacgaaacgccgaaacattataaacccaaaactataaccaatttaaaacgccgcacacgaaaaaactaacgaaacaaaaaacgcgaaaattaaaacaaaataaacgcaataacgtcgcaaaaaaacgtatataataaacataaaacgaatacataaaaacacacgactaaaatcgaaaaaaacaaaaaatccgacgactactaaccgaaaaaacgaccgcgaacgaaaaccgaaccgtaccaaatttaaatatctaactatatactaaaatatttaccgcgctactaaaaattaaaaatataataaaatacctaaatacttaatt

SEQ ID NO: 34725 - DNA, 560 bp, Artificial Sequence
  chemically treated genomic DNA (Homo sapiens) CpG-island No: 34725
  misc_feature (525)..(526): n is either a, c, g or t
  misc_feature (536)..(538): n is either a, c, g or t
  misc_feature (545)..(545): n is either a, c, g or t
  misc_feature (548)..(548): n is either a, c, g or t
  misc_feature (553)..(553): n is either a, c, g or t
  misc_feature (559)..(559): n is either a, c, g or t
tgtcggttaaaaattttatcgatatttattttttgtttttattgtaaattcgattttcgtatacgattttaattcgattacggtggaagattacgcggagggatttaattttaaagagatcgggatatcggacgtatcgagattataaaaatatataagggtgcgcggttatttataagatgtacgcggttcggtcgggtgtatttcggggatatttgaagattagcgtattttgaagaaggatatgtcgtttatatagtttaaagagtcggtagtatatatatgacgatttattggttttaggtcggggtcgaaacggagatttaagtcggtggagcgggataattattttataagttaacggtatcgtttcgaaatatgttggatcgtgcggtggttaggacggtgtgcggttgacgatattaatattaaaagtgtttgtagtattattttttgtatcgttcgtgttttcggtttatcgtacgttcgtcggttgttgtttcggtgttgtaagagagaagaaanntttaagtgtnnngtcgatnttnattangcgggng

SEQ ID NO: 34726 - DNA, 560 bp, Artificial Sequence
  chemically treated genomic DNA (Homo sapiens) CpG-island No: 34726
  misc_feature (2)..(2): n is either a, c, g or t
  misc_feature (8)..(8): n is either a, c, g or t
  misc_feature (13)..(13): n is either a, c, g or t
  misc_feature (16)..(16): n is either a, c, g or t
  misc_feature (23)..(25): n is either a, c, g or t
  misc_feature (35)..(36): n is either a, c, g or t
cncccgcntaatnaanatcgacnnnacacttaaanntttcttctctcttacaacaccgaaacaacaaccgacgaacgtacgataaaccgaaaacacgaacgatacaaaaaataatactacaaacacttttaatattaatatcgtcaaccgcacaccgtcctaaccaccgcacgatccaacatatttcgaaacgataccgttaacttataaaataattatcccgctccaccgacttaaatctccgtttcgaccccgacctaaaaccaataaatcgtcatatatatactaccgactctttaaactatataaacgacatatccttcttcaaaatacgctaatcttcaaatatccccgaaatacacccgaccgaaccgcgtacatcttataaataaccgcgcacccttatatatttttataatctcgatacgtccgatatcccgatctctttaaaattaaatccctccgcgtaatcttccaccgtaatcgaattaaaatcgtatacgaaaatcgaatttacaataaaaacaaaaaataaatatcgataaaatttttaaccgaca

SEQ ID NO: 34727 - DNA, 560 bp, Artificial Sequence
  chemically treated genomic DNA (Homo sapiens) CpG-island No: 34727
  misc_feature (2)..(2): n is either a, c, g or t
  misc_feature (8)..(8): n is either a, c, g or t
  misc_feature (13)..(13): n is either a, c, g or t
  misc_feature (16)..(16): n is either a, c, g or t
  misc_feature (23)..(25): n is either a, c, g or t
  misc_feature (35)..(36): n is either a, c, g or t
tnttcgtntgatnaangtcgatnnnatatttgagnntttttttttttttatagtatcggggtaatagtcggcgagcgtgcgataaatcgagggtacgagcgatgtagaagatagtgttgtaagtatttttaatgttggtgtcgttaatcgtatatcgttttaattatcgtacggtttagtatgtttcggagcggtgtcgttgatttgtggagtgattatttcgttttatcggtttaagttttcgtttcgatttcgatttggagttagtaagtcgttatgtatgtgttgtcggttttttgagttgtgtaagcggtatatttttttttagaatgcgttgatttttaaatattttcgggatgtattcgatcgagtcgcgtatattttgtaggtagtcgcgtatttttgtatgtttttgtagtttcggtgcgttcggtgtttcggtttttttaaggttaagttttttcgcgtaattttttatcgtagtcgagttggagtcgtatgcggaagtcgagtttgtagtgggaatagaaagtaggtgtcggtagagtttttggtcgata

SEQ ID NO: 34728 - DNA, 560 bp, Artificial Sequence
  chemically treated genomic DNA (Homo sapiens) CpG-island No: 34728
  misc_feature (525)..(526): n is either a, c, g or t
  misc_feature (536)..(538): n is either a, c, g or t
  misc_feature (545)..(545): n is either a, c, g or t
  misc_feature (548)..(548): n is either a, c, g or t
  misc_feature (553)..(553): n is either a, c, g or t
  misc_feature (559)..(559): n is either a, c, g or t
tatcgaccaaaaactctaccgacacctactttctattcccactacaaactcgacttccgcatacgactccaactcgactacgataaaaaattacgcgaaaaaacttaaccttaaaaaaaccgaaacaccgaacgcaccgaaactacaaaaacatacaaaaatacgcgactacctacaaaatatacgcgactcgatcgaatacatcccgaaaatatttaaaaatcaacgcattctaaaaaaaaatataccgcttacacaactcaaaaaaccgacaacacatacataacgacttactaactccaaatcgaaatcgaaacgaaaacttaaaccgataaaacgaaataatcactccacaaatcaacgacaccgctccgaaacatactaaaccgtacgataattaaaacgatatacgattaacgacaccaacattaaaaatacttacaacactatcttctacatcgctcgtaccctcgatttatcgcacgctcgccgactattaccccgatactataaaaaaaaaaaaannctcaaatatnnnatcgacnttnatcanacgaana

SEQ ID NO: 34729 - DNA, 513 bp, Artificial Sequence
  chemically treated genomic DNA (Homo sapiens) CpG-island No: 34729
  misc_feature (56)..(56): n is either a, c, g or t
ggtagattatggggggaaagcggtacgcgggaaaaacggggtacgaagatatattnagcgtaatttcggtttcgaggaggttaaatacggtattttcgtgggtcgtatcgcgtaggatttggattggagttggcggagttggtgtcgcgtttgtttcgggtggcgtttaaggtcgcggaggttttttggaggtaaatttgtagaatggtattttgtttgtaattttcggatcgatcgggaggagttgtgtcggcggagcgcggagtgtatatttatttggaggtgatcgtagataggtcgttgtaggttttttatgtgacgtggaggtgagggatattaacgataattcgtcggtgtttttagtaattaaaagaatttgtttatcgcggaatttaggtcgtttgattttcggttttattagagggcgtttcggatgtagatatcggggagaacgttttgtttattatagattgagtttaaatgaatatttttttttggaaaaattatttgatg

SEQ ID NO: 34730 - DNA, 513 bp, Artificial Sequence
  chemically treated genomic DNA (Homo sapiens) CpG-island No: 34730
  misc_feature (458)..(458): n is either a, c, g or t
catcaaataatttttccaaaaaaaaatattcatttaaactcaatctataataaacaaaacgttctccccgatatctacatccgaaacgccctctaataaaaccgaaaatcaaacgacctaaattccgcgataaacaaattcttttaattactaaaaacaccgacgaattatcgttaatatccctcacctccacgtcacataaaaaacctacaacgacctatctacgatcacctccaaataaatatacactccgcgctccgccgacacaactcctcccgatcgatccgaaaattacaaacaaaataccattctacaaatttacctccaaaaaacctccgcgaccttaaacgccacccgaaacaaacgcgacaccaactccgccaactccaatccaaatcctacgcgatacgacccacgaaaataccgtatttaacctcctcgaaaccgaaattacgctnaatatatcttcgtaccccgtttttcccgcgtaccgctttccccccataatctacc

SEQ ID NO: 34731 - DNA, 513 bp, Artificial Sequence
  chemically treated genomic DNA (Homo sapiens) CpG-island No: 34731
  misc_feature (458)..(458): n is either a, c, g or t
tattaggtggtttttttagagaaaagtatttatttgggtttagtttgtagtgagtagggcgtttttttcgatatttgtattcgaggcgttttttagtgaaatcgagagttaagcggtttggatttcgcgatggataggtttttttggttgttgggaatatcggcgggttatcgttaatgttttttatttttacgttatatggaaaatttgtagcggtttgtttacgattatttttaggtggatgtgtatttcgcgtttcgtcggtatagtttttttcggtcgattcgagaattataaataaaatgttattttgtagatttatttttagaaggttttcgcggttttggacgttattcggaataggcgcggtattagtttcgttagttttagtttaggttttgcgcgatgcggtttacgaaggtgtcgtgtttggttttttcgagatcggagttacgttnggtatgttttcgtatttcgtttttttcgcgtgtcgttttttttttatggtttgtt

SEQ ID NO: 34732 - DNA, 513 bp, Artificial Sequence
  chemically treated genomic DNA (Homo sapiens) CpG-island No: 34732
  misc_feature (56)..(56): n is either a, c, g or t
aacaaaccataaaaaaaaaacgacacgcgaaaaaaacgaaatacgaaaacataccnaacgtaactccgatctcgaaaaaaccaaacacgacaccttcgtaaaccgcatcgcgcaaaacctaaactaaaactaacgaaactaataccgcgcctattccgaataacgtccaaaaccgcgaaaaccttctaaaaataaatctacaaaataacattttatttataattctcgaatcgaccgaaaaaaactataccgacgaaacgcgaaatacacatccacctaaaaataatcgtaaacaaaccgctacaaattttccatataacgtaaaaataaaaaacattaacgataacccgccgatattcccaacaaccaaaaaaacctatccatcgcgaaatccaaaccgcttaactctcgatttcactaaaaaacgcctcgaatacaaatatcgaaaaaaacgccctactcactacaaactaaacccaaataaatacttttctctaaaaaaaccacctaata

SEQ ID NO: 34733 - DNA, 555 bp, Artificial Sequence
  chemically treated genomic DNA (Homo sapiens) CpG-island No: 34733
  misc_feature (487)..(488): n is either a, c, g or t
  misc_feature (494)..(495): n is either a, c, g or t
  misc_feature (500)..(500): n is either a, c, g or t
  misc_feature (504)..(504): n is either a, c, g or t
  misc_feature (506)..(507): n is either a, c, g or t
  misc_feature (512)..(513): n is either a, c, g or t
  misc_feature (519)..(520): n is either a, c, g or t
  misc_feature (528)..(528): n is either a, c, g or t
  misc_feature (533)..(534): n is either a, c, g or t
  misc_feature (540)..(541): n is either a, c, g or t
  misc_feature (549)..(550): n is either a, c, g or t
cgagagcgtgttatttatgagttggtggtgatcgcgcgagacgggggttcgttttcgttgtggttacggttagtgtttttgtggaggtggttgatgtgaacgataacgttcggcgttcgcgtagttcgagtatatagtgttcgtgaaggagaataattcgcgggttgttatatttttattgtgtttgcgtgggacgcggacgcgtaggaaacgcgttggtgttttattcgttggtagagcggcgggtaggggagcgcggttgtcgagttacgtttcggtgtatgcggagagcggtaaggtgtacgcgtgtagtcgttggattacgaggagttagagttgttgtagttttaggtgacgttcgcgatgtcggcgtgttatttttgggtagtaacgtgacgttgtagggttcgtgttggacgaaaacgataacgcgttagtattgttagcgtttcggcgggtggtattggtggcgtagtgagcgagttgnngtgttnnatggntttngnntgggnntgttgnnggttacgnttggnntggtannaaggtgtnngttcg

SEQ ID NO: 34734 - DNA, 555 bp, Artificial Sequence
  chemically treated genomic DNA (Homo sapiens) CpG-island No: 34734
  misc_feature (6)..(7): n is either a, c, g or t
  misc_feature (15)..(16): n is either a, c, g or t
  misc_feature (22)..(23): n is either a, c, g or t
  misc_feature (28)..(28): n is either a, c, g or t
  misc_feature (36)..(37): n is either a, c, g or t
  misc_feature (43)..(44): n is either a, c, g or t
  misc_feature (49)..(50): n is either a, c, g or t
  misc_feature (52)..(52): n is either a, c, g or t
  misc_feature (56)..(56): n is either a, c, g or t
  misc_feature (61)..(62): n is either a, c, g or t
  misc_feature (68)..(69): n is either a, c, g or t
cgaacnnacaccttnntaccannccaancgtaaccnncaacanncccanncnaaanccatnnaacacnncaactcgctcactacgccaccaataccacccgccgaaacgctaacaatactaacgcgttatcgttttcgtccaacacgaaccctacaacgtcacgttactacccaaaaataacacgccgacatcgcgaacgtcacctaaaactacaacaactctaactcctcgtaatccaacgactacacgcgtacaccttaccgctctccgcatacaccgaaacgtaactcgacaaccgcgctcccctacccgccgctctaccaacgaataaaacaccaacgcgtttcctacgcgtccgcgtcccacgcaaacacaataaaaatataacaacccgcgaattattctccttcacgaacactatatactcgaactacgcgaacgccgaacgttatcgttcacatcaaccacctccacaaaaacactaaccgtaaccacaacgaaaacgaacccccgtctcgcgcgatcaccaccaactcataaataacacgctctcg

SEQ ID NO: 34735 - DNA, 555 bp, Artificial Sequence
  chemically treated genomic DNA (Homo sapiens) CpG-island No: 34735
  misc_feature (6)..(7): n is either a, c, g or t
  misc_feature (15)..(16): n is either a, c, g or t
  misc_feature (22)..(23): n is either a, c, g or t
  misc_feature (28)..(28): n is either a, c, g or t
  misc_feature (36)..(37): n is either a, c, g or t
  misc_feature (43)..(44): n is either a, c, g or t
  misc_feature (49)..(50): n is either a, c, g or t
  misc_feature (52)..(52): n is either a, c, g or t
  misc_feature (56)..(56): n is either a, c, g or t
  misc_feature (61)..(62): n is either a, c, g or t
  misc_feature (68)..(69): n is either a, c, g or t
cgggtnngtattttnntgttannttaancgtggttnntaatanntttanntngganttatnnggtatnntagttcgtttattgcgttattagtgttattcgtcgaggcgttagtagtgttggcgcgttgtcgttttcgtttagtacgaattttgtagcgttacgttgttgtttagaggtggtacgtcggtatcgcgagcgttatttgaaattgtagtagttttagtttttcgtggtttagcggttgtacgcgtatattttgtcgtttttcgtatgtatcgaaacgtagttcgatagtcgcgtttttttattcgtcgttttattagcgagtaggatattagcgcgttttttgcgcgttcgcgttttacgtagatatagtgaagatgtggtagttcgcgggttgtttttttttacgaatattgtgtattcgggttgcgcgaacgtcgagcgttgtcgtttatattagttatttttatagaaatattggtcgtggttatagcgaaggcgagttttcgtttcgcgcggttattattagtttataggtgatacgttttcg

SEQ ID NO: 34736 - DNA, 555 bp, Artificial Sequence
  chemically treated genomic DNA (Homo sapiens) CpG-island No: 34736
  misc_feature (487)..(488): n is either a, c, g or t
  misc_feature (494)..(495): n is either a, c, g or t
  misc_feature (500)..(500): n is either a, c, g or t
  misc_feature (504)..(504): n is either a, c, g or t
  misc_feature (506)..(507): n is either a, c, g or t
  misc_feature (512)..(513): n is either a, c, g or t
  misc_feature (519)..(520): n is either a, c, g or t
  misc_feature (528)..(528): n is either a, c, g or t
  misc_feature (533)..(534): n is either a, c, g or t
  misc_feature (540)..(541): n is either a, c, g or t
  misc_feature (549)..(550): n is either a, c, g or t
cgaaaacgtatcacctataaactaataataaccgcgcgaaacgaaaactcgccttcgctataaccacgaccaatatttctataaaaataactaatataaacgacaacgctcgacgttcgcgcaacccgaatacacaatattcgtaaaaaaaaacaacccgcgaactaccacatcttcactatatctacgtaaaacgcgaacgcgcaaaaaacgcgctaatatcctactcgctaataaaacgacgaataaaaaaacgcgactatcgaactacgtttcgatacatacgaaaaacgacaaaatatacgcgtacaaccgctaaaccacgaaaaactaaaactactacaatttcaaataacgctcgcgataccgacgtaccacctctaaacaacaacgtaacgctacaaaattcgtactaaacgaaaacgacaacgcgccaacactactaacgcctcgacgaataacactaataacgcaataaacgaactannataccnnataantccnanntaaanntattannaaccacgnttaanntaacannaaaatacnnacccg

SEQ ID NO: 34737 - DNA, 936 bp, Artificial Sequence
  chemically treated genomic DNA (Homo sapiens) CpG-island No: 34737
gtttatgagttggggtaatcgcgcgggacgggggttcgttttcgttgtgggttatcgttagttgtttgtggaggtggtcgacgtgaacgataatgtttcggcgttcgcgtattcgagtatacggtgttcgtgaaggagaataattcgtcgggttgttatattttacggtgtttgcgcgagacgcggacgcgtaggagaacgcgttggtgtttattcgtttgtggagcggcgggtgggcgagcgttcgttgtcgagttaatttcggtgtatacggagagcggtaaggtgtacgcgttgtagtcgttggttacgaggagttagagttgttgtagttttaggtgagcgcgcgcgacgcggcgtgtcgtttttgggtagtaacgtgacgttgtaggtgttcgtgttggagagaatgataacgcgtcggtattgttggagtttcgggtgggtggtattgtggcgtagcgagtaagttggtgtcgcggtttgtgggcgcgggttacgtgtagcgaaggtgcgcgtagtggacgtcgattcgggttataacgcgtggtttcgtatgagttgtagttagttgtaagtagttttcgtatttcgtttcgcgggggttgtatacgggcgagattagtattattcgtgttttggacgaagcgatttttcgcgttatcgtttgttggttttggtgaaggattatggtgaatcgcgttgatcgttacggttacggttttggtgtcgttggtggagagcggtcggttttaaaagcgttatcgaggtagtcggttggcgttttgggttcggaacggcgttggtggatgttaacgtgtatttgattatcgttatttgcgcggttttagtttgttggtgtttacgttgttgttgtatattgcgttgcggtgttagtattgtttattgagggcgggtgtcgggcgggtaagttta

SEQ ID NO: 34738 - DNA, 936 bp, Artificial Sequence
  chemically treated genomic DNA (Homo sapiens) CpG-island No: 34738
taaacttacccgcccgacacccgccctcaataaacaatactaacaccgcaacgcaatatacaacaacaacgtaaacaccaacaaactaaaaccgcgcaaataacgataatcaaatacacgttaacatccaccaacgccgttccgaacccaaaacgccaaccgactacctcgataacgcttttaaaaccgaccgctctccaccaacgacaccaaaaccgtaaccgtaacgatcaacgcgattcaccataatccttcaccaaaaccaacaaacgataacgcgaaaaatcgcttcgtccaaaacacgaataatactaatctcgcccgtatacaacccccgcgaaacgaaatacgaaaactacttacaactaactacaactcatacgaaaccacgcgttataacccgaatcgacgtccactacgcgcaccttcgctacacgtaacccgcgcccacaaaccgcgacaccaacttactcgctacgccacaataccacccacccgaaactccaacaataccgacgcgttatcattctctccaacacgaacacctacaacgtcacgttactacccaaaaacgacacgccgcgtcgcgcgcgctcacctaaaactacaacaactctaactcctcgtaaccaacgactacaacgcgtacaccttaccgctctccgtatacaccgaaattaactcgacaacgaacgctcgcccacccgccgctccacaaacgaataaacaccaacgcgttctcctacgcgtccgcgtctcgcgcaaacaccgtaaaatataacaacccgacgaattattctccttcacgaacaccgtatactcgaatacgcgaacgccgaaacattatcgttcacgtcgaccacctccacaaacaactaacgataacccacaacgaaaacgaacccccgtcccgcgcgattaccccaactcataaac

SEQ ID NO: 34739 - DNA, 936 bp, Artificial Sequence
  chemically treated genomic DNA (Homo sapiens) CpG-island No: 34739
tgggtttgttcgttcggtattcgtttttagtgggtagtgttagtatcgtagcgtagtgtatagtagtagcgtgagtattagtaggttggaatcgcgtagatggcgatgattaggtatacgttgatatttattagcgtcgtttcggatttaaaacgttagtcgattgtttcgatgacgtttttggagtcggtcgttttttattagcgatattagaatcgtggtcgtggcggttagcgcggtttattatgattttttattaggattagtagacggtggcgcggagagtcgtttcgtttaggatacgagtggtgttgatttcgttcgtgtatagttttcgcggaacgggatgcgagggttgtttgtagttggttgtagtttatacgaagttacgcgttgtagttcgagtcggcgtttattgcgcgtattttcgttatacgtggttcgcgtttatagatcgcggtattagtttgttcgttgcgttatagtgttatttattcgaggttttagtagtgtcggcgcgttgttattttttttagtacgaatatttgtagcgttacgttgttgtttagaggcggtacgtcgcgtcgcgcgcgtttatttggaattgtagtagttttagtttttcgtggttagcggttgtagcgcgtatattttgtcgtttttcgtgtgtatcgaaattagttcgatagcgagcgttcgtttattcgtcgttttataagcgagtaggtattagcgcgtttttttgcgcgttcgcgtttcgcgtagatatcgtgaagtgtggtagttcggcgggttgtttttttttacgaatatcgtgtattcgggtgcgcgaacgtcggagtattgtcgtttacgtcggttatttttatagatagttggcggtggtttatagcgaaggcgagttttcgtttcgcgcggttattttaatttataggt

SEQ ID NO: 34740 - DNA, 936 bp, Artificial Sequence
  chemically treated genomic DNA (Homo sapiens) CpG-island No: 34740
acctataaattaaaataaccgcgcgaaacgaaaactcgccttcgctataaaccaccgccaactatctataaaaataaccgacgtaaacgacaatactccgacgttcgcgcacccgaatacacgatattcgtaaaaaaaaacaacccgccgaactaccacacttcacgatatctacgcgaaacgcgaacgcgcaaaaaaacgcgctaatacctactcgcttataaaacgacgaataaacgaacgctcgctatcgaactaatttcgatacacacgaaaaacgacaaaatatacgcgctacaaccgctaaccacgaaaaactaaaactactacaattccaaataaacgcgcgcgacgcgacgtaccgcctctaaacaacaacgtaacgctacaaatattcgtactaaaaaaaataacaacgcgccgacactactaaaacctcgaataaataacactataacgcaacgaacaaactaataccgcgatctataaacgcgaaccacgtataacgaaaatacgcgcaataaacgccgactcgaactacaacgcgtaacttcgtataaactacaaccaactacaaacaaccctcgcatcccgttccgcgaaaactatacacgaacgaaatcaacaccactcgtatcctaaacgaaacgactctccgcgccaccgtctactaatcctaataaaaaatcataataaaccgcgctaaccgccacgaccacgattctaatatcgctaataaaaaacgaccgactccaaaaacgtcatcgaaacaatcgactaacgttttaaatccgaaacgacgctaataaatatcaacgtatacctaatcatcgccatctacgcgattccaacctactaatactcacgctactactatacactacgctacgatactaacactacccactaaaaacgaataccgaacgaacaaaccca

SEQ ID NO: 34741 - DNA, 1229 bp, Artificial Sequence
  chemically treated genomic DNA (Homo sapiens) CpG-island No: 34741
tgttaacgggtaggttatttgttttcgacgttttacgttttttttaagttggtgtttatttataagaattattatcgttggtgttggatagagttttggatcgcgagagtgtgttcgtttacgattggtggttatcgcgcgggatcggggttcgtttttattgtgggttacggtagggtgtttgtggaggtggtcgacgtgaacgataacgtattagcgtttcgtagttcgagtatacggtgttcgtgaaggagaataattcgtcgggttgtatatttttacggtgtttgcgcgggacgcggacgcgtaggagaacgttcggtgttttattcgttggtggagcggcggttgggcgagcgttcgttgtcggttacgtgttagtgtacgcggagagcggtaaggtgtacgcgttgtagttttggattacgaggagttggagttgttatagttttaggtgagcgcgcgcgcgcgggcgtgtcgtttttgggtagtaacgtgacgttgtaggtgttcgtgtggacgagaacgataatgcgtcggcgttgttgatatttcggatgaggggattgacggcgtagtgagcgagatggtgttgcggtcggtgggcgtcggcgagtggtggggaaggtgcgcgtagtggacgtcgattcgggttataacgcgggtttttatacgagttgtagttagaaacggttagcgcgagtatttcgttcgcgtggggttgtatacgggcgagattagtataacgcgtgttttggacgaacggacgtatcgcgttagcgtttattggtgttggtgaaagattacgggagttagcgttgacggttacggttattgtgttggtgtcgttggtggagagggttaggcgttaaagttatcgtcgcgggcgtagtgggtgttacgggttcgaggtgacgttggtggatgttaacgtgtatttgattatcgttatttgcgggtgtttagtttgttggtttttacgttgttgttgtatattgtgttgcgggttcggcgatgtttatcgagggcgagtgcgcgtttggtaagtcgacgttgtgtgttttagcgcggtggggagttggtcgtattcgtagtagaggaggcgagggtgtgttttggcgagggttcgtagaagatcgattttatggttttcgttcgggtttttttttttgtgttggatttatagagcgaacgggagaatttttgtttttttagatttaattgggaag

SEQ ID NO: 34742 - DNA, 1229 bp, Artificial Sequence
  chemically treated genomic DNA (Homo sapiens) CpG-island No: 34742
cttcccaattaaatctaaaaaaacaaaaattctcccgttcgctctataaatccaacacaaaaaaaaaaacccgaacgaaaaccataaaatcgatcttctacgaaccctcgccaaaacacaccctcgcctcctctactacgaatacgaccaactccccaccgcgctaaaacacacaacgtcgacttaccaaacgcgcactcgccctcgataaacatcgccgaacccgcaacacaatatacaacaacaacgtaaaaaccaacaaactaaacacccgcaaataacgataatcaaatacacgttaacatccaccaacgtcacctcgaacccgtaacacccactacgcccgcgacgataactttaacgcctaaccctctccaccaacgacaccaacacaataaccgtaaccgtcaacgctaactcccgtaatctttcaccaacaccaataaacgctaacgcgatacgtccgttcgtccaaaacacgcgttatactaatctcgcccgtatacaaccccacgcgaacgaaatactcgcgctaaccgtttctaactacaactcgtataaaaacccgcgttataacccgaatcgacgtccactacgcgcaccttccccaccactcgccgacgcccaccgaccgcaacaccatctcgctcactacgccgtcaatcccctcatccgaaatatcaacaacgccgacgcattatcgttctcgtccacacgaacacctacaacgtcacgttactacccaaaaacgacacgcccgcgcgcgcgcgctcacctaaaactataacaactccaactcctcgtaatccaaaactacaacgcgtacaccttaccgctctccgcgtacactaacacgtaaccgacaacgaacgctcgcccaaccgccgctccaccaacgaataaaacaccgaacgttctcctacgcgtccgcgtcccgcgcaaacaccgtaaaaatatacaacccgacgaattattctccttcacgaacaccgtatactcgaactacgaaacgctaatacgttatcgttcacgtcgaccacctccacaaacaccctaccgtaacccacaataaaaacgaaccccgatcccgcgcgataaccaccaatcgtaaacgaacacactctcgcgatccaaaactctatccaacaccaacgataataattcttataaataaacaccaacttaaaaaaaacgtaaaacgtcgaaaacaaataacctacccgttaaca

SEQ ID NO: 34743 - DNA, 1229 bp, Artificial Sequence
  chemically treated genomic DNA (Homo sapiens) CpG-island No: 34743
ttttttagttgaatttgaggaagtagaggttttttcgttcgttttgtagatttagtataaggagaaaggttcgggcgaaggttatgaggtcggttttttgcggattttcgttagagtatattttcgttttttttgttgcgagtacgattaattttttatcgcgttagaatatatagcgtcggtttgttaggcgcgtattcgttttcggtgggtatcgtcgagttcgtagtatagtgtatagtagtagcgtgagaattaataggttagatattcgtagatggcgatgattaggtatacgttgatatttattagcgttatttcgggttcgtggtatttattacgttcgcgacgatgattttggcgtttggttttttttattagcgatattagtatagtggtcgtggtcgttagcgttggttttcgtggttttttattagtattagtaggcgttggcgcggtgcgttcgttcgtttagggtacgcgttgtgttgatttcgttcgtgtatagttttacgcgaacgggatgttcgcgttggtcgtttttggttgtagttcgtatgaaagttcgcgttgtagttcgagtcggcgtttattgcgcgtattttttttattattcgtcggcgtttatcgatcgtagtattatttcgtttattgcgtcgttagtttttttattcgaggtgttagtagcgtcggcgtattgtcgttttcgtttatacgaatatttgtagcgttacgttgttgtttagaggcggtacgttcgcgcgcgcgcgtttatttggaattgtagtagttttagtttttcgtggtttaaggttgtagcgcgtatattttgtcgtttttcgcgtgtattgatacgtagtcgatagcgagcgttcgtttaatcgtcgttttattagcgagtaggatatcgggcgtttttttgcgcgttcgcgtttcgcgtagatatcgtgaagatgtgtagttcggcgggttgtttttttttacgaatatcgtgtattcggattgcggaacgttggtgcgttgtcgtttacgtcggttatttttatagatattttgtcgtggtttatagtgaaggcgagtttcggtttcgcgcggtaattattagtcgtaggcggatatattttcgcggtttagagttttgtttagtattaacggtagtaatttttgtaggtggatattagtttgaaggggacgtggggcgtcgggagtaggtaatttgttcgttggta

SEQ ID NO: 34744 - DNA, 1229 bp, Artificial Sequence
  chemically treated genomic DNA (Homo sapiens) CpG-island No: 34744
taccaacgaacaaattacctactcccgacgccccacgtccccttcaaactaatatccacctacaaaaattactaccgttaatactaaacaaaactctaaaccgcgaaaatatatccgcctacgactaataattaccgcgcgaaaccgaaactcgccttcactataaaccacgacaaaatatctataaaaataaccgacgtaaacgacaacgcaccaacgttccgcaatccgaatacacgatattcgtaaaaaaaaacaacccgccgaactacacatcttcacgatatctacgcgaaacgcgaacgcgcaaaaaaacgcccgatatcctactcgctaataaaacgacgattaaacgaacgctcgctatcgactacgtatcaatacacgcgaaaaacgacaaaatatacgcgctacaaccttaaaccacgaaaaactaaaactactacaattccaaataaacgcgcgcgcgcgaacgtaccgcctctaaacaacaacgtaacgctacaaatattcgtataaacgaaaacgacaatacgccgacgctactaacacctcgaataaaaaaactaacgacgcaataaacgaaataatactacgatcgataaacgccgacgaataataaaaaaaatacgcgcaataaacgccgactcgaactacaacgcgaactttcatacgaactacaaccaaaaacgaccaacgcgaacatcccgttcgcgtaaaactatacacgaacgaaatcaacacaacgcgtaccctaaacgaacgaacgcaccgcgccaacgcctactaatactaataaaaaaccacgaaaaccaacgctaacgaccacgaccactatactaatatcgctaataaaaaaaaccaaacgccaaaatcatcgtcgcgaacgtaataaataccacgaacccgaaataacgctaataaatatcaacgtatacctaatcatcgccatctacgaatatctaacctattaattctcacgctactactatacactatactacgaactcgacgatacccaccgaaaacgaatacgcgcctaacaaaccgacgctatatattctaacgcgataaaaaattaatcgtactcgcaacaaaaaaaacgaaaatatactctaacgaaaatccgcaaaaaaccgacctcataaccttcgcccgaacctttctccttatactaaatctacaaaacgaacgaaaaaacctctacttcctcaaattcaactaaaaaa

SEQ ID NO: 34745 - DNA, 1069 bp, Artificial Sequence
  chemically treated genomic DNA (Homo sapiens) CpG-island No: 34745
tttttgtcgcgttggagtatattagagtgggtttgttcggcgcgtacgcgtttcggtgggcggtgtcgagtatcgtagcgtagtatatagtagtaacgtgagattaataggttggatatcgcgtagatggtaatgattaagtaaatattgaatttattagcgtcgtttttggatttatagcgtttgtcgacgttttcgataagtttgtggcgtttggtcgttttttattagcgataatagtatcgttgcgtggtcgttagcgcgggtttatcgtggttttttattagtattagaaggcgtggtgcggcgcgtttatttcgtttagagggcgcgtcgtgttgatttcgtagtgtatagttttacgcggaacgggatgcgcgcgtcgatcgtcgttagtgtaatttatacgaaagttacgtattgtagttcgaatcggcgtttatcggcgtattttcgttattacgtggtttgtatttatcgatcgcggtattagtcgtttattgtgtttttcgcgttgttagtttcgggcgttagtagcgtcgggcgttgtcgttttcgtttagtacgaatatttgtagcgttacgttgttgttagaggcggtacgttagagtcgcgcgcgtttatttggaattgtaatagtttagtttttcgtggtttaacggttgtagcgcgtatattttgtcgttttcgcgtgtatcgatacgtagttcgatagcgtacgttcgtttattcgtcgtttattagcgagtaggagattagcgcgtttttttgtgcgttcgcgttttgttagatatcgtgaagatgtggtagttcggcggattgtttttttttacgaaatcgtgtattcgggttgcgcgaacgtcggcgcgttgtcgtttacgtcggtatttttatcgatacgttggtcgtggtttatagcgaaggcgagttttcgttcgcgcggttattattagtttataggttgatacgttttcgcggtttagcgttgtttagtattaatgagtagtagtttttgtaggtggatattagtttaaggggatatgcggcgttaaggtgtaggtgatttgt

SEQ ID NO: 34746 - DNA, 1069 bp, Artificial Sequence
  chemically treated genomic DNA (Homo sapiens) CpG-island No: 34746
acaaatcacctacaccttaacgccgcatatccccttaaactaatatccacctacaaaaactactactcattaatactaaacaacgctaaaccgcgaaaacgtatcaacctataaactaataataaccgcgcgaacgaaaactcgccttcgctataaaccacgaccaacgtatcgataaaaataccgacgtaaacgacaacgcgccgacgttcgcgcaacccgaatacacgatttcgtaaaaaaaaacaatccgccgaactaccacatcttcacgatatctaacaaaacgcgaacgcacaaaaaaacgcgctaatctcctactcgctaataaacgacgaataaacgaacgtacgctatcgaactacgtatcgatacacgcgaaaacgacaaaatatacgcgctacaaccgttaaaccacgaaaaactaaactattacaattccaaataaacgcgcgcgactctaacgtaccgcctctaacaacaacgtaacgctacaaatattcgtactaaacgaaaacgacaacgcccgacgctactaacgcccgaaactaacaacgcgaaaaacacaataaacgactaataccgcgatcgataaatacaaaccacgtaataacgaaaatacgccgataaacgccgattcgaactacaatacgtaactttcgtataaattacactaacgacgatcgacgcgcgcatcccgttccgcgtaaaactatacactacgaaatcaacacgacgcgccctctaaacgaaataaacgcgccgcaccacgccttctaatactaataaaaaaccacgataaacccgcgctaacgaccacgcaacgatactattatcgctaataaaaaacgaccaaacgccacaaacttatcgaaaacgtcgacaaacgctataaatccaaaaacgacgctaataaattcaatatttacttaatcattaccatctacgcgatatccaacctattaatctcacgttactactatatactacgctacgatactcgacaccgcccaccgaaacgcgtacgcgccgaacaaacccactctaatatactccaacgcgacaaaaa

SEQ ID NO: 34747 - DNA, 1069 bp, Artificial Sequence
  chemically treated genomic DNA (Homo sapiens) CpG-island No: 34747
ataggttatttgtattttgacgtcgtatgtttttttaagttggtgtttatttataagaattattatttattagtgttggatagcgttggatcgcgagagcgtattagtttatgaattggtggtgatcgcgcgggcgggggttcgttttcgttgtgggttacggttagcgtgtcggtgggggtgtcgacgtgaacgataacgcgtcggcgttcgcgtagttcgagtatacggtttcgtgaaggaaaataattcgtcgggttgttatatttttacggtgtttggtaggacgcggacgtataggagaacgcgttggttttttattcgttggtgagcggcgggtgggcgagcgtgcgttgtcgagttacgtgtcggtgtacgcgagagcggtaaggtgtacgcgttgtagtcgttggattacgaggagttgggttgttgtagttttaggtgagcgcgcgcgattttggcgtgtcgtttttggtagtaacgtgacgttgtaggtgttcgtgttggacgagaacgataacgttcggcgttgttgacgttcggggttggtagcgcgggaggtatagtgagcggttgatgtcgcggtcggtgggtgtaggttacgtggtggcgaaggtgcgtcggtggacgtcgattcgggttataatgcgtggttttcgtatgaattgtattggcggcggtcggcgcgcgtatttcgtttcgcgtggggttgtatattgcgagattagtacgacgcgttttttggacgaggtggacgcgtcgtattacgttttttggtgttggtgaaggattacggtgagttcgcgttgacggttacgtaacggtgttgttgtcgttggtggagagcggttaagcgttataggtttgtcgagggcgtcggtaggcgttgtgggtttagaagcggcgttggtggatttaatgtttatttgattattgttatttgcgcggtgtttagtttgttggttttacgttgttgttgtatattgcgttgcggtgttcggtatcgtttatcggggcgcgtgcgcgtcgggtaagtttattttagtgtgttttagcgcggtaggag

SEQ ID NO: 34748 - DNA, 1069 bp, Artificial Sequence
  chemically treated genomic DNA (Homo sapiens) CpG-island No: 34748
ctcctaccgcgctaaaacacactaaaataaacttacccgacgcgcacgcgccccgataaacgataccgaacaccgcaacgcaatatacaacaacaacgtaaaaccaacaaactaaacaccgcgcaaataacaataatcaaataaacattaaatccaccaacgccgcttctaaacccacaacgcctaccgacgccctcgacaaacctataacgcttaaccgctctccaccaacgacaacaacaccgttacgtaaccgtcaacgcgaactcaccgtaatccttcaccaacaccaaaaaacgtaatacgacgcgtccacctcgtccaaaaaacgcgtcgtactaatctcgcaatatacaaccccacgcgaaacgaaatacgcgcgccgaccgccgccaatacaattcatacgaaaaccacgcattataacccgaatcgacgtccaccgacgcaccttcgccaccacgtaacctacacccaccgaccgcgacatcaaccgctcactatacctcccgcgctaccaaccccgaacgtcaacaacgccgaacgttatcgttctcgtccaacacgaacacctacaacgtcacgttactaccaaaaacgacacgccaaaatcgcgcgcgctcacctaaaactacaacaacccaactcctcgtaatccaacgactacaacgcgtacaccttaccgctctcgcgtacaccgacacgtaactcgacaacgcacgctcgcccacccgccgctcaccaacgaataaaaaaccaacgcgttctcctatacgtccgcgtcctaccaaacaccgtaaaaatataacaacccgacgaattattttccttcacgaaaccgtatactcgaactacgcgaacgccgacgcgttatcgttcacgtcgacacccccaccgacacgctaaccgtaacccacaacgaaaacgaacccccgcccgcgcgatcaccaccaattcataaactaatacgctctcgcgatccaacgctatccaacactaataaataataattcttataaataaacaccaacttaaaaaaacatacgacgtcaaaatacaaataacctat

SEQ ID NO: 34749 - DNA, 1106 bp, Artificial Sequence
  chemically treated genomic DNA (Homo sapiens) CpG-island No: 34749
tttttgacgttttacgtttcgtttagttggtgtttatttataagaattattatttattggtgttggatagcgtttggatcgcgagagggtgtcggtttatgagttggtggtgatcgcgcgggagggggttcgttttcgttgtgggttacggttaggtgtttgtggaggtggcgacgtgaacgataacgcgtttgcgttcgcgtagttcgagtatacggtgtcgtgaaggagaataattcgttaggttgttatatttttacggtgtttgcggggacgcggacgcgtaggagaacgttttggtgttttattcgttggtggacggcggttgggcgagcgttcgttgtcgagttacgtgtcggtgtacgcgggagcggtaaggtgtattgcgttgtagtcgttggattacgaggagttggattgttatagttttaggtgagcgcgcgcgatgggggcgtgtcgtttttggtagtaatttgacgttgtaggtgttcgtgttggacgagaacgataacgtttcgcgttgttggcgtttttcgttggtagcgcgggcggtgtagttagtgattggtgttgcggtcggtgggtgcgggttacgtggtggttaaggtgcgcgagtggacgttgattttggatataacgcgtggttgtcgtatgaattgtagcggcggcggttggtgttacgtatttcgtttcgcgtgtgggtttgtatacggcgagattagtacgacgcgcgttttggatgaggttgattcgttacgtcgcgtttattggtgttggtgaaggattatggcgagtcgtcgttgacggttcggttattgtgtttgtgtcgtttgtggagggtagttaggtatttaaggttcgtcgcgggttttagtgggcgtggcgttcgaggtggttttggtggatgtaacgtgtatttgattatcgttatttgcgcggtgtttagtttgttggtgttacgttgttgttgtatattgtattgaggtgttcggcggcgtttatcgaggcgtatgtgggtcggtgaagtttacgttggtgtgttttagcgcggtgggagttggttttattcgtagtagaggcggtagagggtgtgttttggggaggtt

SEQ ID NO: 34750 - DNA, 1106 bp, Artificial Sequence
  chemically treated genomic DNA (Homo sapiens) CpG-island No: 34750
aacctccccaaaacacaccctctaccgcctctactacgaataaaaccaactcccaccgcgctaaaacacaccaacgtaaacttcaccgacccacatacgcctcgataaacgccgccgaacacctcaatacaatatacaacaacaacgtaacaccaacaaactaaacaccgcgcaaataacgataatcaaatacacgttacatccaccaaaaccacctcgaacgccacgcccactaaaacccgcgacgaaccttaaatacctaactaccctccacaaacgacacaaacacaataaccgaaccgtcaacgacgactcgccataatccttcaccaacaccaataaacgcgacgtaacgaatcaacctcatccaaaacgcgcgtcgtactaatctcgccgtatacaaacccacacgcgaaacgaaatacgtaacaccaaccgccgccgctacaattcatacgacaaccacgcgttatatccaaaatcaacgtccactcgcgcaccttaaccaccacgtaacccgcacccaccgaccgcaacaccaatcactaactacaccgcccgcgctaccaacgaaaaacgccaacaacgcgaaacgttatcgttctcgtccaacacgaacacctacaacgtcaaattactaccaaaaacgacacgcccccatcgcgcgcgctcacctaaaactataacaatccaactcctcgtaatccaacgactacaacgcaatacaccttaccgctcccgcgtacaccgacacgtaactcgacaacgaacgctcgcccaaccgccgtccaccaacgaataaaacaccaaaacgttctcctacgcgtccgcgtccccgcaaacaccgtaaaaatataacaacctaacgaattattctccttcacgacaccgtatactcgaactacgcgaacgcaaacgcgttatcgttcacgtcgccacctccacaaacacctaaccgtaacccacaacgaaaacgaaccccctcccgcgcgatcaccaccaactcataaaccgacaccctctcgcgatccaaacgctatccaacaccaataaataataattcttataaataaacaccaactaaacgaaacgtaaaacgtcaaaaa

SEQ ID NO: 34751 - DNA, 1106 bp, Artificial Sequence
  chemically treated genomic DNA (Homo sapiens) CpG-island No: 34751
ggtttttttagaatatattttttgtcgtttttgttgcgagtaagattagtttttatcgcgttagagtatattagcgtgggttttatcggtttatatgcgtttcggtgggcgtcgtcgagtattttagtgtagtgtatagtagtagcgtgatattagtaagttggatatcgcgtagatggcgatgattaggtatacgttgtatttattagggttatttcgggcgttacgtttattgaagttcgcgacgagttttgggtgtttggttgttttttataagcgatataagtatagtggtcgggtcgttagcgacggttcgttatggttttttattagtattagtaggcgcggcgtggcgagttagttttatttagagcgcgcgtcgtattgatttcgtcgtgtataagtttatacgcgaaacgggatgcgtggtattaatcgtcgtcgttgtaatttatacgatagttacgcgttgtatttagagttagcgtttattcgcgtattttagttattacgtgattcgtatttatcgatcgtagtattagttattgattgtatcgttcgcgttgttagcgggagacgttagtagcgcggagcgttgtcgttttcgtttagtacgaatatttgtagcgttaagttgttgttagaggcggtacgtttttatcgcgcgcgtttatttggaattgtagtagtttagtttttcgtggtttagcggttgtagcgtagtatattttgtcgttttcgcgtgtatcgatacgtagttcgatagcgagcgttcgtttaatcgtcgtttattagcgagtaggatattagggcgtttttttgcgcgttcgcgttttcgtagatatcgtgaagatgtggtagtttggcgggttgtttttttttacgatatcgtgtattcggattgcgcgaacgtaggcgcgttgtcgtttacgtcgttatttttatagatatttggtcgtggtttatagcggaggcgagttttttttcgcgcggttattattagtttataggtcgatattttttcgcggtttaagcgttgtttagtattaatgagtagtaatttttgtaggtggatattagttgaacggaacgtgaggcgttagaga

SEQ ID NO: 34752 - DNA, 1106 bp, Artificial Sequence
  chemically treated genomic DNA (Homo sapiens) CpG-island No: 34752
tctctaacgcctcacgttccgttcaactaatatccacctacaaaaattactactcattaatactaaacaacgcttaaaccgcgaaaaaatatcgacctataaactaataataaccgcgcgaaaaaaaactcgcctccgctataaaccacgaccaaatatctataaaaataacgacgtaaacgacaacgcgcctacgttcgcgcaatccgaatacacgatatcgtaaaaaaaaacaacccgccaaactaccacatcttcacgatatctacgaaaacgcgaacgcgcaaaaaaacgccctaatatcctactcgctaataaacgacgattaaacgaacgctcgctatcgaactacgtatcgatacacgcgaaaacgacaaaatatactacgctacaaccgctaaaccacgaaaaactaaactactacaattccaaataaacgcgcgcgataaaaacgtaccgcctctaacaacaacttaacgctacaaatattcgtactaaacgaaaacgacaacgctccgcgctactaacgtctcccgctaacaacgcgaacgatacaatcaataactaatactacgatcgataaatacgaatcacgtaataactaaaatacgcgaataaacgctaactctaaatacaacgcgtaactatcgtataaattacaacgacgacgattaataccacgcatcccgtttcgcgtataaacttatacacgacgaaatcaatacgacgcgcgctctaaataaaactaactcgccacgccgcgcctactaatactaataaaaaaccataacgaaccgtcgctaacgacccgaccactatacttatatcgcttataaaaaacaaccaaacacccaaaactcgtcgcgaacttcaataaacgtaacgcccgaaataaccctaataaatacaacgtatacctaatcatcgccatctacgcgatatccaacttactaatatcacgctactactatacactacactaaaatactcgacgacgcccaccgaaacgcatataaaccgataaaacccacgctaatatactctaacgcgataaaaactaatcttactcgcaacaaaaacgacaaaaaatatattctaaaaaaacc

SEQ ID NO: 34753 - DNA, 1046 bp, Artificial Sequence
  chemically treated genomic DNA (Homo sapiens) CpG-island No: 34753
cgcgagagcgtgtcggtttatgagttggtggtatcgcgcgggacgggggttcgttttcgttgtgggttatcgttagcgtgttgtggaagtggtcgacgtgaacgataacgtttcggcgttcgcgtagtttagtatatcgtgttcgtgaaggagaataatttattaggttgttatattttatagtgtcggcgcgggacgcggacgcgtaggagaacgcgttggtgttttttcgttggtggagcggcggttgggcgatcgcgcgttgtcgagttacgtgcggtgtacgcggagagcggtaaggtgtacgcgttgtagtcgttggattagaggagttggagttgttatagttttaggtgagcgcgcgcgatgcgggcggtcgtttttgagtagtaacgtgacgttgtaggtgttcgtgttggacgagacgataacgcgtcggtattgttggcgatttaggttggtagcgcgggagggtagttaataagttagtatcgcggtcggtgggtgcgggttacgtggtgggaaggtgcgcgtagtggatgcggatttaggttataacgcgtggtttttaatgaattgtagtcggcggcgggcggttcgcgtatttcgtttcgcgtgggttgtatacgggcgagataagtataacgcgtgttttggacgaggtagattgtcgcgttatcgatttttagtattggtgaaggattacggtgagtcggcgtgacggttacggttatcgtgttggtgtcgttggtggagagcggataggtttaaaggttttttttcggattttggcgggcgtcgcgagtttagaggttggttggtggatgttaacgtgtatttgattatcgttatttgcgtggtgttcgttttttggtatttacgttgttgttgtatacggcgttgtggtggtcggtacgtttattgagggcgcgtgcgcgtcggggaagtttacgttggtgtgtttcgcgcggtggggagttggttatattcgtagtagaggcggtagagggtggttttgaggagggtttatttaagacggattttat

SEQ ID NO: 34754 - DNA, 1046 bp, Artificial Sequence
  chemically treated genomic DNA (Homo sapiens) CpG-island No: 34754
ataaaatccgtcttaaataaaccctcctcaaaaccaccctctaccgcctctactacgaatataaccaactccccaccgcgcgaaacacaccaacgtaaacttccccgacgcgcacgcgccctcaataaacgtaccgaccaccacaacgccgtatacaacaacaacgtaaataccaaaaaacgaacaccacgcaaataacgataatcaaatacacgttaacatccaccaaccaacctctaaactcgcgacgcccgccaaaatccgaaaaaaaacctttaaacctatccgctctccaccaacgacaccaacacgataaccgtaaccgtcacgccgactcaccgtaatccttcaccaatactaaaaatcgataacgcgacaatctacctcgtccaaaacacgcgttatacttatctcgcccgtatacaacccacgcgaaacgaaatacgcgaaccgcccgccgccgactacaattcattaaaaaccacgcgttataacctaaatccgcatccactacgcgcaccttcccaccacgtaacccgcacccaccgaccgcgatactaacttattaactaccctcccgcgctaccaacctaaatcgccaacaataccgacgcgttatcgtctcgtccaacacgaacacctacaacgtcacgttactactcaaaaacgaccgcccgcatcgcgcgcgctcacctaaaactataacaactccaactcctctaatccaacgactacaacgcgtacaccttaccgctctccgcgtacaccgcacgtaactcgacaacgcgcgatcgcccaaccgccgctccaccaacgaaaaaacaccaacgcgttctcctacgcgtccgcgtcccgcgccgacactataaaatataacaacctaataaattattctccttcacgaacacgatatactaaactacgcgaacgccgaaacgttatcgttcacgtcgaccacttccacaacacgctaacgataacccacaacgaaaacgaacccccgtcccgcgcgataccaccaactcataaaccgacacgctctcgcg

SEQ ID NO: 34755 - DNA, 1046 bp, Artificial Sequence
  chemically treated genomic DNA (Homo sapiens) CpG-island No: 34755
atgaggttcgttttaggtgggttttttttagagttattttttgtcgtttttgttgcgagtatgattagttttttatcgcgcggagtatattagcgtgggttttttcggcgcgtacgcgtttttagtgggcgtgtcgattattatagcgtcgtatatagtagtagcgtgagtattaggaggcggatattacgtagatggcgatgattaggtatacgttgatatttattagttagtttttgggttcgcggcgttcgttaaagttcgggaagaggtttttgggtttgttcgttttttattaacgatattagtacggtggtcgtggtcgttacgtcggtttatcgtgattttttattagtattagaagtcggtggcgcggtagtttgtttcgtttagggtacgcgttgtgtttatttcgttcgtgtatagtttacgcggaacgggatgcgcgagtcgttcgtcgtcggttgtaatttattgaaagttacgcgttgtagtttgagttcgtatttattgcgcgtatttttttattacgtggttcgtatttatcgatcgcggtattagtttgttaattgttttttcgcgttgttagtttgagtcgttagtagtgtcggcgcgttgtcgtttcgtttagtacgaatatttgtagcgttacgttgttgtttagaggcggtcgttcgtatcgcgcgcgtttatttggaattgtagtagttttagtttttttggtttagcggttgtagcgcgtatattttgtcgtttttcgcgtgtatcgtacgtagttcgatagcgcgcggtcgtttaatcgtcgttttattagcgagaggatattagcgcgtttttttgcgcgttcgcgtttcgcgtcgatattgtaagatgtggtagtttggtgggttgtttttttttacgaatacggtatattgggttgcgcgaacgtcggagcgttgtcgtttacgtcggttatttttataatacgttggcggtggtttatagcgaaggcgagttttcgtttcgcgcggtattattagtttatagatcgatacgttttcgcg

SEQ ID NO: 34756 - DNA, 1046 bp, Artificial Sequence
  chemically treated genomic DNA (Homo sapiens) CpG-island No: 34756
cgcgaaaacgtatcgatctataaactaataataccgcgcgaaacgaaaactcgccttcgctataaaccaccgccaacgtattataaaaataaccgacgtaaacgacaacgctccgacgttcgcgcaacccaatataccgtattcgtaaaaaaaaacaacccaccaaactaccacatcttacaatatcgacgcgaaacgcgaacgcgcaaaaaaacgcgctaatatcctctcgctaataaaacgacgattaaacgaccgcgcgctatcgaactacgtacgatacacgcgaaaaacgacaaaatatacgcgctacaaccgctaaaccaaaaaaactaaaactactacaattccaaataaacgcgcgcgatacgaacgaccgcctctaaacaacaacgtaacgctacaaatattcgtactaaacgaaacgacaacgcgccgacactactaacgactcaaactaacaacgcgaaaaaacaattaacaaactaataccgcgatcgataaatacgaaccacgtaataaaaaaatacgcgcaataaatacgaactcaaactacaacgcgtaactttcaataaattacaaccgacgacgaacgactcgcgcatcccgttccgcgtaaactatacacgaacgaaataaacacaacgcgtaccctaaacgaaacaaactaccgcgccaccgacttctaatactaataaaaaatcacgataaaccgacgtaacgaccacgaccaccgtactaatatcgttaataaaaaacgaacaaacccaaaaacctcttcccgaactttaacgaacgccgcgaacccaaaaactaactaataaatatcaacgtatacctaatcatcgccatctacgtaatatccgcctcctaatactcacgctactactatatacgacgctataataatcgacacgcccactaaaaacgcgtacgcgccgaaaaaacccacgctaatatactccgcgcgataaaaaactaatcatactcgcaacaaaaacgacaaaaaataactctaaaaaaaacccacctaaaacgaacctcat

SEQ ID NO: 34757 - DNA, 1131 bp, Artificial Sequence
  chemically treated genomic DNA (Homo sapiens) CpG-island No: 34757
ggtgttaacgggtagtgaattgttcgttgacgttttacgttttttttaagttggtgtttattttaagaattattattcgttggtgttggatagtgttttggatcgcgagagcggtcggtttatgagttggtggtaatcgcgcgggacgggggttcgttttcgtgtgggttatcgttagtttgtttgtggaggtggtcgatatgaatgataagtttcggcgttcgcgtagttcgagtatatagtgttcgtgaaggagaatattcgtcgggttgttatatttttacggtgtttgcgcgagacgcggacgcgaggagaacgcgttggtgttttattcgttggtggagcggcgggtgggcgacgcgcgttgtcgagttatatttcggtgtacgcggagagcggtaaggtgtcgcgttgtagtcgttggattacgaggagttagagttgttgtagttttagtgagcgcgcgcgacgcgggcgtgtcgtttttgggtagtaacgtgacgtttaggtgttcgtgttggacgagaacgataacgcgtcggcgttgttggcgttcgggtgggtggtattggtggtgtagtgagcgagttggtgtcgcggttatgggtgtaggttaagtggtggcgaaggtgcgcgtagttgacgtcgattcggttataacgcgtggttttcgtatgagttgtagttttcggtaagtagcgtcgtttttcgtttcgcgtggggttgtatacgggcgagattagtattattgtgttttggacgaagcggatttttcgcgttatcggttgttggtgttggtaaagattacggtgagtcggcgttgatagcgacggttacggttttggtgtgttggtggagagtggttaggttttaaaggcgttattacgggcgtcggtggcgtcgcgggtttagaggcggcgttggtggatgttaacgtgtatttgatatcgttatttgcgcggtatttagtttgttggtttttacgttattgttgttatagcgttgcggtgttcggcgttatttatcgagggcgcgtgtacggcgataagtttacgttggtgtgttttagcgtagtggggagttggtcgtattttagtagaggcggtagagggtgtgtttcggggagggttt

SEQ ID NO: 34758 - DNA, 1131 bp, Artificial Sequence
  chemically treated genomic DNA (Homo sapiens) CpG-island No: 34758
aaaccctccccgaaacacaccctctaccgcctctactaaaatacgaccaactccccactacgctaaaacacaccaacgtaaacttatcgccgtacacgcgccctcgataaataacgccgaacaccgcaacgctataacaacaataacgtaaaaaccaacaaactaaataccgcgcaaataacgatatcaaatacacgttaacatccaccaacgccgcctctaaacccgcgacgccaccgacgcccgtaataacgcctttaaaacctaaccactctccaccaacacaccaaaaccgtaaccgtcgctatcaacgccgactcaccgtaatctttaccaacaccaacaaccgataacgcgaaaaatccgcttcgtccaaaacacaataatactaatctcgcccgtatacaaccccacgcgaaacgaaaaacgacgctacttaccgaaaactacaactcatacgaaaaccacgcgttataaccgaatcgacgtcaactacgcgcaccttcgccaccacttaacctacacccataaccgcgacaccaactcgctcactacaccaccaataccacccacccgaacgccaacaacgccgacgcgttatcgttctcgtccaacacgaacacctaaacgtcacgttactacccaaaaacgacacgcccgcgtcgcgcgcgctcactaaaactacaacaactctaactcctcgtaatccaacgactacaacgcgacaccttaccgctctccgcgtacaccgaaatataactcgacaacgcgcgtcgcccacccgccgctccaccaacgaataaaacaccaacgcgttctcctcgcgtccgcgtctcgcgcaaacaccgtaaaaatataacaacccgacgaatattctccttcacgaacactatatactcgaactacgcgaacgccgaaacttatcattcatatcgaccacctccacaaacaaactaacgataacccacacgaaaacgaacccccgtcccgcgcgattaccaccaactcataaaccgaccgctctcgcgatccaaaacactatccaacaccaacgaataataattcttaaaataaacaccaacttaaaaaaaacgtaaaacgtcaacgaacaattcactacccgttaacacc

SEQ ID NO: 34759 - DNA, 1131 bp, Artificial Sequence
  chemically treated genomic DNA (Homo sapiens) CpG-island No: 34759
gggtttttttcggagtatattttttgtcgtttttgttggagtacgattagttttttattgcgttggagtatattagcgtgggtttgtcgtcgtgtacgcgttttcggtgggtggcgtcgagtatcgtagcgttgtgatagtagtagcgtgaggattagtaggttggatatcgcgtagatggcgatattaggtatacgttgatatttattagcgtcgtttttgggttcgcggcgttatcgacgttcgtgatgacgtttttggagtttggttattttttattagtatattagaatcgtggtcgtcgttgttagcgtcggtttatcgtggtttttattagtattagtagtcggtggcgcggagagttcgtttcgtttaggatatagtggtgttgatttcgttcgtgtatagttttacgcgaaacgggaagcgacgttgtttgtcgggggttgtagtttatacgaaagttacgcgttgtagtcgagtcggcgttaattgcgcgtattttcgttattatttggtttgtatttatgatcgcggtattagttcgtttattgtattattagtattatttattcgagcgttagtagcgtcggcgcgttgtcgttttcgtttagtacgaatatttgagcgttacgttgttgtttagaggcggtacgttcgcgtcgcgcgcgtttattgaaattgtagtagttttagtttttcgtggtttagcggttgtagcgcgatattttgtcgtttttcgcgtgtatcgaaatgtagttcgataacgcgcgtcgtttattcgtcgttttattagcgagtaggatattagcgcgtttttttcgcgttcgcgtttcgcgtagatatcgtgaagatgtggtagttcggcgggtgtttttttttacgaatattgtgtattcgggttgcgcgaacgtcggagtttgttatttatgtcggttatttttatagataagttggcggtggtttatacgaaggcgagttttcgtttcgcgcggttattattaatttataggtcgatcgttttcgcggtttagggtattgtttagtattaacgagtagtaatttttaaggtggatattagtttgaaagggacgtgaggcgttagcgagtagtttattgttcgttggtatt

SEQ ID NO: 34760 - DNA, 1131 bp, Artificial Sequence
  chemically treated genomic DNA (Homo sapiens) CpG-island No: 34760
aataccaacgaacaataaactactcgctaacgcctcacgtccctttcaaactaatatccaccttaaaaattactactcgttaatactaaacaataccctaaaccgcgaaaacgatcgacctataaattaataataaccgcgcgaaacgaaaactcgccttcgtataaaccaccgccaacttatctataaaaataaccgacataaataacaaactccgacgttcgcgcaacccgaatacacaatattcgtaaaaaaaaacacccgccgaactaccacatcttcacgatatctacgcgaaacgcgaacgcgaaaaaaacgcgctaatatcctactcgctaataaaacgacgaataaacgacgcgcgttatcgaactacatttcgatacacgcgaaaaacgacaaaatatcgcgctacaaccgctaaaccacgaaaaactaaaactactacaatttcaataaacgcgcgcgacgcgaacgtaccgcctctaaacaacaacgtaacgctcaaatattcgtactaaacgaaaacgacaacgcgccgacgctactaacgctcgaataaataatactaataatacaataaacgaactaataccgcgatcataaatacaaaccaaataataacgaaaatacgcgcaattaacgccgactcgactacaacgcgtaactttcgtataaactacaacccccgacaaacaacgtcgcttcccgtttcgcgtaaaactatacacgaacgaaatcaacaccactatatcctaaacgaaacgaactctccgcgccaccgactactaatactaataaaaaccacgataaaccgacgctaacaacgacgaccacgattctaatatactaataaaaaataaccaaactccaaaaacgtcatcacgaacgtcgataacgccgcgaacccaaaaacgacgctaataaatatcaacgtatacctaatatcgccatctacgcgatatccaacctactaatcctcacgctactactatcacaacgctacgatactcgacgccacccaccgaaaacgcgtacacgacgacaaacccacgctaatatactccaacgcaataaaaaactaatcgtactccaacaaaaacgacaaaaaatatactccgaaaaaaaccc

SEQ ID NO: 34761 - DNA, 1116 bp, Artificial Sequence
  chemically treated genomic DNA (Homo sapiens) CpG-island No: 34761
gagattttggagttaacggataggttatttgtttttgacgtttcgcgttttttttaagttggtgtttatttttaagaattttatttattggtgttggatagcgttttggatcgcgagagtgtgttcgttatgagttggtggttatcgcgcgggacgggggttcgttttttttgtgggtattgttagcgtgttcgtggaggtggtcgacgtgaacgataacgtttcgggttcgcgtagttcgagtatacggtgttcgtgaaggagaataattcgtcggttgttatatttttattgtgtcggcgggggacgcggacgcgtagaagaagcgttggtgttttattcgttggtggagttgcgggtgggcgagcgcgcgcgtcgagttacgtgttagtgtacgcggagagcggtaaggtgtacgcgttgagtcgttggattacgaggagttggagttgttgtagttttaggtgagcgtcgcgatgcgggcgtgtcgtttttgggtagtaacgtgacgttgtaggtgtcgtgttggacgagaacgataacgcgtcggtattgttggcgtttcgggtggtggtattggtggcgtagtgagagagtttgtgtcgcggtttgtgggcgcggttatgtggtggcgaaggtacgtgtagttgacgttgatttaggttatacgcgtggttttcgtatgagttgtaatcggtggcggtcggtgcgagtattcgtttcgcgtggggttgtatattggtgagattagtacgatacgagttttgatgagacggacgtatcgcgttatcgttttttggtgtttgtgaaggattcggggagttttcgttgatagttatagttatcgtgttggtgtcgttggtgaaagcggttaggtattaaaggcgtcgtcgcgggtatcgttgggtattgcggtttagagatcgagttggtggatgttaacgtgtatttgattatcgttattgcgcggtgtttagtttgttggtgtttattttgttgttgtatacggcgtgcggtgtttagcgtcgttttttgagggcgtatgtagtttggtaaagttattttggtgtgttttagcgcggtggggagttggttatttttttagtagagcggtag

SEQ ID NO: 34762 - DNA, 1116 bp, Artificial Sequence
  chemically treated genomic DNA (Homo sapiens) CpG-island No: 34762
ctaccgctctactaaaaaaataaccaactccccaccgcgctaaaacacaccaaaataactttaccaaactacatacgccctcaaaaaacgacgctaaacaccgcacgccgtatacaacaacaaaataaacaccaacaaactaaacaccgcgcaataacgataatcaaatacacgttaacatccaccaactcgatctctaaaccgcaatacccaacgatacccgcgacgacgcctttaatacctaaccgctttcaccaacgacaccaacacgataactataactatcaacgaaaactccccgaatccttcacaaacaccaaaaaacgataacgcgatacgtccgtctcatcaaaactcgtatcgtactaatctcaccaatatacaaccccacgcgaaacgaatactcgcaccgaccgccaccgattacaactcatacgaaaaccacgcgtataacctaaatcaacgtcaactacacgtaccttcgccaccacataaccgcgcccacaaaccgcgacacaaactctctcactacgccaccaataccaccacccgaaacgccaacaataccgacgcgttatcgttctcgtccaacacgacacctacaacgtcacgttactacccaaaaacgacacgcccgcatcgcgacgctcacctaaaactacaacaactccaactcctcgtaatccaacgactcaacgcgtacaccttaccgctctccgcgtacactaacacgtaactcgacgcgcgcgctcgcccacccgcaactccaccaacgaataaaacaccaacgcttcttctacgcgtccgcgtcccccgccgacacaataaaaatataacaaccgacgaattattctccttcacgaacaccgtatactcgaactacgcgaacccgaaacgttatcgttcacgtcgaccacctccacgaacacgctaacaatacccacaaaaaaaacgaacccccgtcccgcgcgataaccaccaactcataacgaacacactctcgcgatccaaaacgctatccaacaccaataaataaaattcttaaaaataaacaccaacttaaaaaaaacgcgaaacgtcaaaaacaaataacctatccgttaactccaaaatctc

SEQ ID NO: 34763 - DNA, 1116 bp, Artificial Sequence
  chemically treated genomic DNA (Homo sapiens) CpG-island No: 34763
ttgtcgttttgttgggagaatgattagttttttatcgcgttggagtatattagagtggttttattaaattatatgcgtttttagaggacggcgttgagtatcgtacgtcgtgtatagtagtagggtaagtattaatagattggatatcgcgtagtggcgatgattaggtatacgttgatatttattagttcggtttttgggtcgtaatgtttaacgatgttcgcgacgacgtttttggtgtttggtcgtttttattagcgatattagtacggtggttgtggttgttagcgagggtttttcgggttttttataagtattagaaggcggtggcgcggtgcgttcgttttattagggttcgtgtcgtgttgattttattagtgtatagttttacgcggaacggatgttcgtatcggtcgttatcggttgtaatttatacgaaagttacgcgtgtagtttgagttagcgttaattgtacgtattttcgttattatatggtcgcgtttatagatcgcggtataagtttttttattgcgttattagtgttattattcgaggcgttagtagtgtcggcgcgttgtcgttttcgtttagtacgatatttgtagcgttacgttgttgtttagaggcggtacgttcgtatcgcggcgtttatttggaattgtaatagttttagtttttcgtggtttaacggtttagcgcgtatattttgtcgtttttcgcgtgtattgatacgtagttcgacgcgcgcgttcgtttattcgtagttttattagcgagtaggatattagcgttttttttgcgcgttcgcgtttttcgtcgatatagtgaagatgtggtagtcggcgggttgtttttttttacgaatatcgtatattcgggttgcgcgaattcggggcgttgtcgtttacgtcggttatttttacggatacgttagtagtgtttatagagaaggcgagttttcgtttcgcgcggtaattattagtttatggcggatatattttcgcggtttagagcgttgtttagtattaatgaatagaatttttgaaggtggatattaatttgaagggaacgcggggcgttagggataggtaatttgttcgttgattttaaaatttt

SEQ ID NO: 34764 - DNA, 1116 bp, Artificial Sequence
  chemically treated genomic DNA (Homo sapiens) CpG-island No: 34764
aaaattttaaaatcaacgaacaaattacctatccctaacgccccgcgttcccttcaaattaatatccaccttcaaaaattctattcattaatactaaacaacgctctaaaccgcgaaaatatatccgccataaactaataattaccgcgcgaaacgaaaactcgccttctctataaacactactaacgtatccgtaaaaataaccgacgtaaacgacaacgccccgaattcgcgcaacccgaatatacgatattcgtaaaaaaaaacaacccgccgactaccacatcttcactatatcgacgaaaaacgcgaacgcgcaaaaaaaacgctaatatcctactcgctaataaaactacgaataaacgaacgcgcgcgtcgaactacgtatcaatacacgcgaaaaacgacaaaatatacgcgctaaaccgttaaaccacgaaaaactaaaactattacaattccaaataaacgccgcgatacgaacgtaccgcctctaaacaacaacgtaacgctacaaatatcgtactaaacgaaaacgacaacgcgccgacactactaacgcctcgaataataacactaataacgcaataaaaaaacttataccgcgatctataaacgcgaccatataataacgaaaatacgtacaattaacgctaactcaaactacacgcgtaactttcgtataaattacaaccgataacgaccgatacgaacatccgttccgcgtaaaactatacactaataaaatcaacacgacacgaaccctaataaaacgaacgcaccgcgccaccgccttctaatacttataaaaaacccgaaaaaccctcgctaacaaccacaaccaccgtactaatatcgctaataaaaacgaccaaacaccaaaaacgtcgtcgcgaacatcgttaaacattacgacccaaaaaccgaactaataaatatcaacgtatacctaatcatcgccactacgcgatatccaatctattaatacttaccctactactatacacgacgtacgatactcaacgccgtcctctaaaaacgcatataatttaataaaaccactctaatatactccaacgcgataaaaaactaatcattctcccaacaaaacgacaa

SEQ ID NO: 34765 - DNA, 558 bp, Artificial Sequence
  chemically treated genomic DNA (Homo sapiens) CpG-island No: 34765
gttatcgcgttttgttttgatttttgttagttcgcgtttcgttttttttcgcgttttgtttttgttcgcgttttgtatttgttcgcgtttcgtttttacgcgtgcgtcgtttttattcgtgtttcgtttttagttaagttcggttcgtgtttatttttattcgtcgttttgcgttgtttttttcggtttttcgttagtagtcggtattcgtttagtttaatagtgatagagtagggcgcgtagtcgttgagtgttttggagtttttgtttcgaggtgttacgtttacgtcggttttattcgggtaggtatggggcggtcgggtttagcgtcgtatttcgtcggttagagttattgtttttttagacgcggttttagcgtttattggggatggtaaagacgatattcggtgcgtcgaggttgtttataaaagtaagttttgttggttgtaggcgttcgtatcggttagtgtaaaggtggtttagagtgttaagcggcggagtcgaggttttgagaagtatttttttgtttgcgttgggtagcgggttgcgtgtgattgg

SEQ ID NO: 34766 - DNA, 558 bp, Artificial Sequence
  chemically treated genomic DNA (Homo sapiens) CpG-island No: 34766
ccaatcacacgcaacccgctacccaacgcaaacaaaaaaatacttctcaaaacctcgactccgccgcttaacactctaaaccacctttacactaaccgatacgaacgcctacaaccaacaaaacttacttttataaacaacctcgacgcaccgaatatcgtctttaccatccccaataaacgctaaaaccgcgtctaaaaaaacaataactctaaccgacgaaatacgacgctaaacccgaccgccccatacctacccgaataaaaccgacgtaaacgtaacacctcgaaacaaaaactccaaaacactcaacgactacgcgccctactctatcactattaaactaaacgaataccgactactaacgaaaaaccgaaaaaaacaacgcaaaacgacgaataaaaataaacacgaaccgaacttaactaaaaacgaaacacgaataaaaacgacgcacgcgtaaaaacgaaacgcgaacaaatacaaaacgcgaacaaaaacaaaacgcgaaaaaaaacgaaacgcgaactaacaaaaatcaaaacaaaacgcgataac

SEQ ID NO: 34767 - DNA, 558 bp, Artificial Sequence
  chemically treated genomic DNA (Homo sapiens) CpG-island No: 34767
ttagttatacgtagttcgttgtttagcgtaagtagaaaggtgttttttaaagtttcggtttcgtcgtttggtattttgggttatttttgtattggtcgatgcgggcgtttgtagttagtaagatttatttttgtgagtagtttcggcgtatcggatgtcgtttttgttatttttagtgggcgttggggtcgcgtttggagagatagtggttttggtcggcggggtgcggcgttaagttcgatcgttttatgtttgttcgggtgaggtcgacgtgggcgtggtatttcggggtagggattttagagtatttagcggttgcgcgttttgttttgttattgttgggttaggcgggtgtcggttgttggcgaggagtcggaaggggtagcgtaaggcggcgggtgggagtgggtacgggtcgggtttagttaggagcggggtacggataggagcggcgtacgcgtaggagcggggcgcgggtaggtatagaacgcgggtaggagtaggacgcggaggggagcggggcgcgggttggtagaggttagaataggacgcggtagt

SEQ ID NO: 34768 - DNA, 558 bp, Artificial Sequence
  chemically treated genomic DNA (Homo sapiens) CpG-island No: 34768
actaccgcgtcctattctaacctctaccaacccgcgccccgctcccctccgcgtcctactcctacccgcgttctatacctacccgcgccccgctcctacgcgtacgccgctcctatccgtaccccgctcctaactaaacccgacccgtacccactcccacccgccgccttacgctaccccttccgactcctcgccaacaaccgacacccgcctaacccaacaataacaaaacaaaacgcgcaaccgctaaatactctaaaatccctaccccgaaataccacgcccacgtcgacctcacccgaacaaacataaaacgatcgaacttaacgccgcaccccgccgaccaaaaccactatctctccaaacgcgaccccaacgcccactaaaaataacaaaaacgacatccgatacgccgaaactactcacaaaaataaatcttactaactacaaacgcccgcatcgaccaatacaaaaataacccaaaataccaaacgacgaaaccgaaactttaaaaaacacctttctacttacgctaaacaacgaactacgtataactaa

SEQ ID NO: 34769 - DNA, 642 bp, Artificial Sequence
  chemically treated genomic DNA (Homo sapiens) CpG-island No: 34769
  misc_feature (270)..(270): n is either a, c, g or t
  misc_feature (376)..(376): n is either a, c, g or t
  misc_feature (421)..(421): n is either a, c, g or t
cgtcgattgattcgcgaggatcgttagtagaattatatatagtatatcggttaagggtaaaaaaatcgttagcgtattgttcggtaataaaggcgtggtaggtttgcgaacgttatttacgcggggaatagtgcgtttttagttgcgttatagtagatagtttattaaaacgtaggcggttagtaatagtattaatagtaggttggtaagcgcgttttttgtttgtaggttaatgtcgttttgggttaattattgttagttaattatcgntagcgttcggggattatttggttcgagaataattgttatatttacgatcgatagcgattaggtaataatcggtagtatcgttattgttagcgtaggcgcgacgganggtaatagtagttagttagcggtttatttgtatattaatcgtttnttatagacgacgaattttacggttattgttttcggttagagttacgttgtattattggttgattttttcgtcgtcgttgaatttgatggttttaaaagttgtcggattattttttaattgtacgttacgatttaaattacgtagtttcgcgtcgttaatttgattaaatatacgtacggtatatttacgtttaattttacggtttgggtgtattaaacggt

SEQ ID NO: 34770 - DNA, 642 bp, Artificial Sequence
  chemically treated genomic DNA (Homo sapiens) CpG-island No: 34770
  misc_feature (222)..(222): n is either a, c, g or t
  misc_feature (267)..(267): n is either a, c, g or t
  misc_feature (373)..(373): n is either a, c, g or t
accgtttaatacacccaaaccgtaaaattaaacgtaaatataccgtacgtatatttaatcaaattaacgacgcgaaactacgtaatttaaatcgtaacgtacaattaaaaaataatccgacaacttttaaaaccatcaaattcaacgacgacgaaaaaatcaaccaataatacaacgtaactctaaccgaaaacaataaccgtaaaattcgtcgtctataanaaacgattaatatacaaataaaccgctaactaactactattaccntccgtcgcgcctacgctaacaataacgatactaccgattattacctaatcgctatcgatcgtaaatataacaattattctcgaaccaaataatccccgaacgctancgataattaactaacaataattaacccaaaacgacattaacctacaaacaaaaaacgcgcttaccaacctactattaatactattactaaccgcctacgttttaataaactatctactataacgcaactaaaaacgcactattccccgcgtaaataacgttcgcaaacctaccacgcctttattaccgaacaatacgctaacgatttttttacccttaaccgatatactatatataattctactaacgatcctcgcgaatcaatcgacg

SEQ ID NO: 34771 - DNA, 642 bp, Artificial Sequence
  chemically treated genomic DNA (Homo sapiens) CpG-island No: 34771
  misc_feature (222)..(222): n is either a, c, g or t
  misc_feature (267)..(267): n is either a, c, g or t
  misc_feature (373)..(373): n is either a, c, g or t
atcgtttaatgtatttaagtcgtgaagttgaacgtgaatatgtcgtgcgtgtatttggttaggttgacgacgcgaaattgcgtgatttgagtcgtggcgtgtagttggaagatggttcggtagtttttaaaattattaagtttagcggcggcgaagggattaattagtggtataacgtgattttgatcgaaggtagtaatcgtgaagttcgtcgtttgtggnaagcggttggtgtgtaggtgagtcgttaattggttgttgttgttnttcgtcgcgtttgcgttggtaatggcgatgttgtcgattgttgtttggtcgttgtcggtcgtgaatgtggtaattattttcgggttaggtaattttcggacgttgncggtaattagttggtagtggttaatttagggcgatattgatttataaataaaaggcgcgtttgttagtttgttgttgatgttgttattggtcgtttacgttttgatgagttatttgttatggcgtagttgaaggcgtattatttttcgcgtagatggcgttcgtaagtttgttacgtttttattgtcgggtaatacgttggcgatttttttatttttaatcggtgtgttgtgtgtggttttgttggcgattttcgcggattagtcgacg

SEQ ID NO: 34772 - DNA, 642 bp, Artificial Sequence
  chemically treated genomic DNA (Homo sapiens) CpG-island No: 34772
  misc_feature (270)..(270): n is either a, c, g or t
  misc_feature (376)..(376): n is either a, c, g or t
  misc_feature (421)..(421): n is either a, c, g or t
cgtcgactaatccgcgaaaatcgccaacaaaaccacacacaacacaccgattaaaaataaaaaaatcgccaacgtattacccgacaataaaaacgtaacaaacttacgaacgccatctacgcgaaaaataatacgccttcaactacgccataacaaataactcatcaaaacgtaaacgaccaataacaacatcaacaacaaactaacaaacgcgccttttatttataaatcaatatcgccctaaattaaccactaccaactaattaccgncaacgtccgaaaattacctaacccgaaaataattaccacattcacgaccgacaacgaccaaacaacaatcgacaacatcgccattaccaacgcaaacgcgacgaanaacaacaacaaccaattaacgactcacctacacaccaaccgcttnccacaaacgacgaacttcacgattactaccttcgatcaaaatcacgttataccactaattaatcccttcgccgccgctaaacttaataattttaaaaactaccgaaccatcttccaactacacgccacgactcaaatcacgcaatttcgcgtcgtcaacctaaccaaatacacgcacgacatattcacgttcaacttcacgacttaaatacattaaacgat

SEQ ID NO: 34773 - DNA, 607 bp, Artificial Sequence
  chemically treated genomic DNA (Homo sapiens) CpG-island No: 34773
gggtttttgttttttatattttttttgtcgtttttttcgatttttagcgttgtttcgtttttgatttcgaataatttgttggttttttttcgggttttgtttttcgggggttatcgtttcggggacgtcgggtagtcgtttcggttttcgtgggttttgtatttgatatttttttcggttttcgttttttattcgttcggagataggggttaaaggtagttcgcgttacgtggtcgtcgagtagtatcgaatcggtcgggagggtcgagggagaattcgggtggaagtcgagaaatttagtttcgatagtagcgttcggtttcgtttcggttttcgtttcggggcgtttatcgtacgttcgtcggtcgtttcggttttcggagtttttttttggtcggtatttacgcggtattacgggatcgaatttcgtttttagcggtcgcgattcggggaggtaggcgttgggtcgaggaggtaaggggagacgggtttgggggttttcggcgtacgggtacgtttttttgggttagggggcgaggtagcgcgttttaatttttagtttttagggagattttttttcgttgcgggacgagggggaggttgcgag

SEQ ID NO: 34774 - DNA, 607 bp, Artificial Sequence
  chemically treated genomic DNA (Homo sapiens) CpG-island No: 34774
ctcgcaacctccccctcgtcccgcaacgaaaaaaaatctccctaaaaactaaaaattaaaacgcgctacctcgccccctaacccaaaaaaacgtacccgtacgccgaaaacccccaaacccgtctccccttacctcctcgacccaacgcctacctccccgaatcgcgaccgctaaaaacgaaattcgatcccgtaataccgcgtaaataccgaccaaaaaaaaactccgaaaaccgaaacgaccgacgaacgtacgataaacgccccgaaacgaaaaccgaaacgaaaccgaacgctactatcgaaactaaatttctcgacttccacccgaattctccctcgaccctcccgaccgattcgatactactcgacgaccacgtaacgcgaactacctttaacccctatctccgaacgaataaaaaacgaaaaccgaaaaaaatatcaaatacaaaacccacgaaaaccgaaacgactacccgacgtccccgaaacgataacccccgaaaaacaaaacccgaaaaaaaaccaacaaattattcgaaatcaaaaacgaaacaacgctaaaaatcgaaaaaaacgacaaaaaaaatataaaaaacaaaaaccc

SEQ ID NO: 34775 - DNA, 607 bp, Artificial Sequence
  chemically treated genomic DNA (Homo sapiens) CpG-island No: 34775
ttcgtagtttttttttcgtttcgtagcggggaggggtttttttggagattgaaggttggggcgcgttgtttcgttttttagtttagaggggcgtattcgtgcgtcgagagtttttaagttcgtttttttttattttttcggtttagcgtttattttttcgaatcgcggtcgttgggagcggggttcgatttcgtgatgtcgcgtgggtgtcggttagagaagagtttcggaggtcggggcggtcggcgggcgtgcggtgagcgtttcggggcgggggtcggggcgggatcgagcgttgttatcggggttggatttttcgatttttattcggattttttttcggttttttcggtcgattcggtgttgttcggcgattacgtgacgcgggttgtttttgatttttattttcgagcgggtagggggcgggggtcggagggggtgttagatgtaggatttacgagggtcggggcggttgttcggcgttttcgaggcggtgattttcgggaaataaagttcggggggaaattaataagttattcggggttagagacgaaatagcgttgggggtcgggagaggcggtagagagaatgtgggagataaagattt

SEQ ID NO: 34776 - DNA, 607 bp, Artificial Sequence
  chemically treated genomic DNA (Homo sapiens) CpG-island No: 34776
aaatctttatctcccacattctctctaccgcctctcccgacccccaacgctatttcgtctctaaccccgaataacttattaatttccccccgaactttatttcccgaaaatcaccgcctcgaaaacgccgaacaaccgccccgaccctcgtaaatcctacatctaacaccccctccgacccccgccccctacccgctcgaaaataaaaatcaaaaacaacccgcgtcacgtaatcgccgaacaacaccgaatcgaccgaaaaaaccgaaaaaaaatccgaataaaaatcgaaaaatccaaccccgataacaacgctcgatcccgccccgacccccgccccgaaacgctcaccgcacgcccgccgaccgccccgacctccgaaactcttctctaaccgacacccacgcgacatcacgaaatcgaaccccgctcccaacgaccgcgattcgaaaaaataaacgctaaaccgaaaaaataaaaaaaaacgaacttaaaaactctcgacgcacgaatacgcccctctaaactaaaaaacgaaacaacgcgccccaaccttcaatctccaaaaaaacccctccccgctacgaaacgaaaaaaaaactacgaa

SEQ ID NO: 34777 - DNA, 588 bp, Artificial Sequence
  chemically treated genomic DNA (Homo sapiens) CpG-island No: 34777
gtcggagcgttaatttttatgatatgataattcgtcgataggttagtaatatattatcgggagtattttttattattatatatttttgcggcgtaagtttagtagttgcgcgtttaatagatacgtattaggttttggtttttcgcgtttattcgtttagcggttataaatatttttggtgcgggaagtttagttatttatggcgcgttcgcgttatcggtatggagttagaagttataatggttacggaatatttgttttatttaaatgattgagtaaggcgattgttttcggagcgcggtaatattttcggttttcgtggtttcgatgtgttttagacgcgaaattcggcggtaatattagtttcggatttgttcgttataaaatggcgcgagaggtgatcgtttgtttatcgtgaatgaaagttagtatttttttcgggttaatttatgacgtttggtttatttgttttacgttcgttttatcgtacgttagggaatttattagcgttttattaagattaaatagaaaatttttgttcgtacgcgggtttttttaggtagtgataatttgataatttcgttgcga

SEQ ID NO: 34778 - DNA, 588 bp, Artificial Sequence
  chemically treated genomic DNA (Homo sapiens) CpG-island No: 34778
tcgcaacgaaattatcaaattatcactacctaaaaaaacccgcgtacgaacaaaaattttctatttaatcttaataaaacgctaataaattccctaacgtacgataaaacgaacgtaaaacaaataaaccaaacgtcataaattaacccgaaaaaaatactaactttcattcacgataaacaaacgatcacctctcgcgccattttataacgaacaaatccgaaactaatattaccgccgaatttcgcgtctaaaacacatcgaaaccacgaaaaccgaaaatattaccgcgctccgaaaacaatcgccttactcaatcatttaaataaaacaaatattccgtaaccattataacttctaactccataccgataacgcgaacgcgccataaataactaaacttcccgcaccaaaaatatttataaccgctaaacgaataaacgcgaaaaaccaaaacctaatacgtatctattaaacgcgcaactactaaacttacgccgcaaaaatatataataataaaaaatactcccgataatatattactaacctatcgacgaattatcatatcataaaaattaacgctccgac

SEQ ID NO: 34779 - DNA, 588 bp, Artificial Sequence
  chemically treated genomic DNA (Homo sapiens) CpG-island No: 34779
tcgtaacgaaattattaaattattattgtttgaggaggttcgcgtgcgggtaaaggttttttgtttgattttgatggaacgttggtggattttttggcgtgcggtagaacgggcgtggagtaagtgggttagacgttatgggttagttcggaagaggtgttggtttttatttacggtaaataggcgattatttttcgcgttattttatggcgggtaaattcgaggttgatattgtcgtcgagtttcgcgtttggagtatatcgaggttacggaaatcgaaggtattatcgcgtttcgggggtaatcgttttatttagttatttgaataaagtaggtatttcgtggttattgtgatttttggttttatgtcggtagcgcgagcgcgttataaatagttgggtttttcgtattagaggtgtttgtaatcgttgagcgagtgaacgcggaaaattagaatttgatgcgtatttgttaggcgcgtagttgttgggtttgcgtcgtaggagtgtgtggtggtggaagatgttttcggtggtgtgttattggtttgtcggcgggttgttatgttatgggggttaacgtttcggt

SEQ ID NO: 34780 - DNA, 588 bp, Artificial Sequence
  chemically treated genomic DNA (Homo sapiens) CpG-island No: 34780
accgaaacgttaacccccataacataacaacccgccgacaaaccaataacacaccaccgaaaacatcttccaccaccacacactcctacgacgcaaacccaacaactacgcgcctaacaaatacgcatcaaattctaattttccgcgttcactcgctcaacgattacaaacacctctaatacgaaaaacccaactatttataacgcgctcgcgctaccgacataaaaccaaaaatcacaataaccacgaaatacctactttattcaaataactaaataaaacgattacccccgaaacgcgataataccttcgatttccgtaacctcgatatactccaaacgcgaaactcgacgacaatatcaacctcgaatttacccgccataaaataacgcgaaaaataatcgcctatttaccgtaaataaaaaccaacacctcttccgaactaacccataacgtctaacccacttactccacgcccgttctaccgcacgccaaaaaatccaccaacgttccatcaaaatcaaacaaaaaacctttacccgcacgcgaacctcctcaaacaataataatttaataatttcgttacga

SEQ ID NO: 34781 - DNA, 540 bp, Artificial Sequence
  chemically treated genomic DNA (Homo sapiens) CpG-island No: 34781
tttcgggtcgtagggtcgcggggacgggtgtgatgtaatcgcgttatagtcgttgcgttaaggggcggtttcgggatgcgggtattgcggtagagtcggttttgttttcgtcgttcgtcgttcgtcgttcgttttcgttgttaaattcgcggataatcgtcgggacgattatttagagttattagagttttttgatattcgtttcgaggtatcggtaatttacggtattcgtttcggtgcgtgttatgaagtcggtcgcgagttttttcgggggcggtgggggtagacgtaggggtcgcggttggggtattttgggcggggggcgaagcggcggttgtggttcgggtaaggcggggggggtaatagtggcggttaagggggtaagggtcggtttttgggtttcggtcgcgcggtttttgtggggggtcgtcggtgttcgtgggttcggtcgtcggtaacggtatggattttgggtgggggggaataatggatatgtatacgtattatgttttgtgttttaaaatagggattatttaggtt

SEQ ID NO: 34782 - DNA, 540 bp, Artificial Sequence
  chemically treated genomic DNA (Homo sapiens) CpG-island No: 34782
aacctaaataatccctattttaaaacacaaaacataatacgtatacatatccattattcccccccacccaaaatccataccgttaccgacgaccgaacccacgaacaccgacgaccccccacaaaaaccgcgcgaccgaaacccaaaaaccgacccttacccccttaaccgccactattaccccccccgccttacccgaaccacaaccgccgcttcgccccccgcccaaaataccccaaccgcgacccctacgtctacccccaccgcccccgaaaaaactcgcgaccgacttcataacacgcaccgaaacgaataccgtaaattaccgatacctcgaaacgaatatcaaaaaactctaataactctaaataatcgtcccgacgattatccgcgaatttaacaacgaaaacgaacgacgaacgacgaacgacgaaaacaaaaccgactctaccgcaatacccgcatcccgaaaccgccccttaacgcaacgactataacgcgattacatcacacccgtccccgcgaccctacgacccgaaa

SEQ ID NO: 34783 - DNA, 540 bp, Artificial Sequence
  chemically treated genomic DNA (Homo sapiens) CpG-island No: 34783
aatttggatgatttttattttagagtatagggtatgatacgtatatatatttattgtttttttttatttagaatttatatcgttatcggcgatcgggtttacgggtatcggcggttttttataaaaatcgcgcggtcggagtttaaaaatcggtttttgtttttttggtcgttattgttgtttttttcgttttgttcgggttatagtcgtcgtttcgtttttcgtttaaggtgttttagtcgcggtttttgcgtttgtttttatcgttttcgggagagttcgcggtcgattttatggtacgtatcggggcgggtgtcgtgggttatcggtgtttcggggcgggtgttagggggttttggtggttttgggtggtcgtttcggcggttgttcgcgggtttagtagcgaaggcgggcggcgggcggcgggcggcgggggtaggatcggttttatcgtagtgttcgtatttcggagtcgttttttgacgtagcggttgtggcgcgattgtattatattcgttttcgcgattttgcggttcggaa

SEQ ID NO: 34784 - DNA, 540 bp, Artificial Sequence
  chemically treated genomic DNA (Homo sapiens) CpG-island No: 34784
ttccgaaccgcaaaatcgcgaaaacgaatataatacaatcgcgccacaaccgctacgtcaaaaaacgactccgaaatacgaacactacgataaaaccgatcctacccccgccgcccgccgcccgccgcccgccttcgctactaaacccgcgaacaaccgccgaaacgaccacccaaaaccaccaaaaccccctaacacccgccccgaaacaccgataacccacgacacccgccccgatacgtaccataaaatcgaccgcgaactctcccgaaaacgataaaaacaaacgcaaaaaccgcgactaaaacaccttaaacgaaaaacgaaacgacgactataacccgaacaaaacgaaaaaaacaacaataacgaccaaaaaaacaaaaaccgatttttaaactccgaccgcgcgatttttataaaaaaccgccgatacccgtaaacccgatcgccgataacgatataaattctaaataaaaaaaaacaataaatatatatacgtatcataccctatactctaaaataaaaatcatccaaatt

SEQ ID NO: 34785 - DNA, 781 bp, Artificial Sequence
  chemically treated genomic DNA (Homo sapiens) CpG-island No: 34785
gtaggaaggtgtgggcgtttagggttacgatgcgggattggttcggttgggttacgtcggcgaagattacgtttattatttcgatgagtatgcggtatttgagcgggtgtcgcgcgttttttaggatcggaatgatgttggtgcgttttttggttacgttgattagatcgcggtcggcgcggtgggagaattcgacggcgtagattaggtcgtttgggttaatgatgtcggagatatgggagacggtggtgttcgacgcggcgtttaggtatagtattttggatttgggtttgatgtggatttggtttatttcgtttaggatggtcgcggttagtttagagcggaacgggttttacgtgcggtatttttgttttacgtcgttttcggttatcgtgacgcgtttttcgtcgtatatagattggttcggtattatgtttagcgtgattagcgcgtttttcgtttcgcggtagatgaagacgttttcgtgtcggtgcggttttatcgatattattatgggttttattttgcggcgggttttgtttttggttacgtcggttatatcgatgtttatcgttttttgagatttttgtttgaagtcggcgaacgtgttattgggttcgggtcgaatttaacggaaaattttacgcgggaagtaagttaagatagtttttttttgtcgaatggtttgtcgtttatttttaacgtgggagatgtatgttaagttttttcgcgttgggggttgggggtagttaaaaggaagttgatttatgatttattgttt

SEQ ID NO: 34786 - DNA, 781 bp, Artificial Sequence
  chemically treated genomic DNA (Homo sapiens) CpG-island No: 34786
aaacaataaatcataaatcaacttccttttaactacccccaacccccaacgcgaaaaaacttaacatacatctcccacgttaaaaataaacgacaaaccattcgacaaaaaaaaactatcttaacttacttcccgcgtaaaattttccgttaaattcgacccgaacccaataacacgttcgccgacttcaaacaaaaatctcaaaaaacgataaacatcgatataaccgacgtaaccaaaaacaaaacccgccgcaaaataaaacccataataatatcgataaaaccgcaccgacacgaaaacgtcttcatctaccgcgaaacgaaaaacgcgctaatcacgctaaacataataccgaaccaatctatatacgacgaaaaacgcgtcacgataaccgaaaacgacgtaaaacaaaaataccgcacgtaaaacccgttccgctctaaactaaccgcgaccatcctaaacgaaataaaccaaatccacatcaaacccaaatccaaaatactatacctaaacgccgcgtcgaacaccaccgtctcccatatctccgacatcattaacccaaacgacctaatctacgccgtcgaattctcccaccgcgccgaccgcgatctaatcaacgtaaccaaaaaacgcaccaacatcattccgatcctaaaaaacgcgcgacacccgctcaaataccgcatactcatcgaaataataaacgtaatcttcgccgacgtaacccaaccgaaccaatcccgcatcgtaaccctaaacgcccacaccttcctac

SEQ ID NO: 34787 - DNA, 781 bp, Artificial Sequence
  chemically treated genomic DNA (Homo sapiens) CpG-island No: 34787
aaataataaattatgggttagtttttttttggttatttttaatttttaacgcggaggggtttaatatatattttttacgttaaggataagcggtaggttattcggtaaaaaaaagttgttttagtttgtttttcgcgtggagtttttcgttgggttcgattcgagtttagtggtacgttcgtcggttttaggtaaggattttaggaggcggtagatatcgatgtggtcggcgtggttaagagtaagattcgtcgtagaatggggtttatggtggtgtcggtggagtcgtatcggtacgagggcgtttttatttatcgcggggcggaggacgcgttggttacgttgaatatggtgtcgggttagtttgtgtacggcgagaggcgcgttacggtgatcgagggcggcgtgaagtaggagtatcgtacgtggaattcgtttcgttttaagttggtcgcggttattttgggcggggtggattagatttatattaagtttaagtttaaggtgttgtatttgggcgtcgcgtcgggtattatcgttttttatgttttcgatattattggtttagacggtttggtttacgtcgtcgagtttttttatcgcgtcggtcgcgatttggttaacgtggttaagaagcgtattaatattatttcggttttggaggacgcgcggtattcgtttaagtatcgtatgtttatcgggatggtggacgtgattttcgtcgacgtggtttagtcggattagtttcgtatcgtggttttgaacgtttatatttttttgt

SEQ ID NO: 34788 - DNA, 781 bp, Artificial Sequence
  chemically treated genomic DNA (Homo sapiens) CpG-island No: 34788
acaaaaaaatataaacgttcaaaaccacgatacgaaactaatccgactaaaccacgtcgacgaaaatcacgtccaccatcccgataaacatacgatacttaaacgaataccgcgcgtcctccaaaaccgaaataatattaatacgcttcttaaccacgttaaccaaatcgcgaccgacgcgataaaaaaactcgacgacgtaaaccaaaccgtctaaaccaataatatcgaaaacataaaaaacgataatacccgacgcgacgcccaaatacaacaccttaaacttaaacttaatataaatctaatccaccccgcccaaaataaccgcgaccaacttaaaacgaaacgaattccacgtacgatactcctacttcacgccgccctcgatcaccgtaacgcgcctctcgccgtacacaaactaacccgacaccatattcaacgtaaccaacgcgtcctccgccccgcgataaataaaaacgccctcgtaccgatacgactccaccgacaccaccataaaccccattctacgacgaatcttactcttaaccacgccgaccacatcgatatctaccgcctcctaaaatccttacctaaaaccgacgaacgtaccactaaactcgaatcgaacccaacgaaaaactccacgcgaaaaacaaactaaaacaacttttttttaccgaataacctaccgcttatccttaacgtaaaaaatatatattaaacccctccgcgttaaaaattaaaaataaccaaaaaaaaactaacccataatttattattt

SEQ ID NO: 34789 - DNA, 771 bp, Artificial Sequence
  chemically treated genomic DNA (Homo sapiens) CpG-island No: 34789
tttcgatattggatagttttgcgacgtattcgtttaattttcgcggagtttgggtttaattttttttcgtttcgattttttttcggcgataggggaatatttatagtgattatttttgtgtgttcggcgggcgcggttcgtgttgaggggggtttcgggggtggtgtatttttaggggggcgttcgatgtttacgttggggtttcgttcgggcggtttttggtgcggtcgttgtagatgtggcgatgaaagcggcggttttttcgagggttagggacgggttcgaattcggggatgcgcgcgcggatggtcgggtttcggggtggtttgcgggcggtaggggatggaaagagggagcgggcgcggggttgaggacgttttttgcgcggtttcgcggggttcggggaggttgcgtttatcgatagagatcgcggcgttttgtttttcgtcgtcggttttcggtcggtttaagatcggtttcgtgtgtttaagtttttttttatggtttatttttttttttttttttcggttcgcgttgcgcgtttcgcgttttggatcgcgtcgtcgtcgtttttagttttttatagtagtagttgttagcgtcggcgtcgtttattggttgcggcgatcgagtttcgttttttcgcggttttcgacggcgcggtaggtggaagtgagcgcgtattggtcgggattttgaattttttaaaagcgtattttaggtgttcgggttgttagatttgggttttttttttttcgaggtttttgtttt

SEQ ID NO: 34790 - DNA, 771 bp, Artificial Sequence
  chemically treated genomic DNA (Homo sapiens) CpG-island No: 34790
aaaacaaaaacctcgaaaaaaaaaaaacccaaatctaacaacccgaacacctaaaatacgcttttaaaaaattcaaaatcccgaccaatacgcgctcacttccacctaccgcgccgtcgaaaaccgcgaaaaaacgaaactcgatcgccgcaaccaataaacgacgccgacgctaacaactactactataaaaaactaaaaacgacgacgacgcgatccaaaacgcgaaacgcgcaacgcgaaccgaaaaaaaaaaaaaaaaataaaccataaaaaaaaacttaaacacacgaaaccgatcttaaaccgaccgaaaaccgacgacgaaaaacaaaacgccgcgatctctatcgataaacgcaacctccccgaaccccgcgaaaccgcgcaaaaaacgtcctcaaccccgcgcccgctccctctttccatcccctaccgcccgcaaaccaccccgaaacccgaccatccgcgcgcgcatccccgaattcgaacccgtccctaaccctcgaaaaaaccgccgctttcatcgccacatctacaacgaccgcaccaaaaaccgcccgaacgaaaccccaacgtaaacatcgaacgcccccctaaaaatacaccacccccgaaacccccctcaacacgaaccgcgcccgccgaacacacaaaaataatcactataaatattcccctatcgccgaaaaaaaatcgaaacgaaaaaaaattaaacccaaactccgcgaaaattaaacgaatacgtcgcaaaactatccaatatcgaaa

SEQ ID NO: 34791 - DNA, 771 bp, Artificial Sequence
  chemically treated genomic DNA (Homo sapiens) CpG-island No: 34791
gaagtaagggtttcgagggaaggagggtttaaatttggtaattcgagtatttaggatgcgtttttgggggatttagagtttcgattagtgcgcgtttatttttatttgtcgcgtcgtcgggagtcgcgaggaggcggagttcggtcgtcgtagttaatgagcgacgtcggcgttggtagttgttgttataaagggttgggggcggcggcggcgcggtttagagcgcggagcgcgtagcgcgggtcggagggagggagggagggtgggttatgggaaaagatttgaatatacgggatcggttttggatcgatcgagggtcggcggcgaaaggtagagcgtcgcgatttttgtcggtaagcgtaattttttcgggtttcgcggggtcgcgtagggggcgtttttaatttcgcgttcgttttttttttttattttttgtcgttcgtaggttatttcggggttcggttattcgcgcgcgtattttcgggttcgggttcgtttttggttttcgagggagtcgtcgtttttatcgttatatttgtagcggtcgtattagaggtcgttcgggcgggattttagcgtgagtatcgggcgtttttttaggagtgtattattttcggagttttttttaatacggatcgcgttcgtcgggtatataagaatggttattgtaggtatttttttgtcgtcgaaagggaatcgggacggggaggagttgggtttaggtttcgcggagattgggcgggtgcgtcgtagggttatttagtatcggag

SEQ ID NO: 34792 - DNA, 771 bp, Artificial Sequence
  chemically treated genomic DNA (Homo sapiens) CpG-island No: 34792
ctccgatactaaataaccctacgacgcacccgcccaatctccgcgaaacctaaacccaactcctccccgtcccgattccctttcgacgacaaaaaaatacctacaataaccattcttatatacccgacgaacgcgatccgtattaaaaaaaactccgaaaataatacactcctaaaaaaacgcccgatactcacgctaaaatcccgcccgaacgacctctaatacgaccgctacaaatataacgataaaaacgacgactccctcgaaaaccaaaaacgaacccgaacccgaaaatacgcgcgcgaataaccgaaccccgaaataacctacgaacgacaaaaaataaaaaaaaaaaacgaacgcgaaattaaaaacgccccctacgcgaccccgcgaaacccgaaaaaattacgcttaccgacaaaaatcgcgacgctctacctttcgccgccgaccctcgatcgatccaaaaccgatcccgtatattcaaatcttttcccataacccaccctccctccctccctccgacccgcgctacgcgctccgcgctctaaaccgcgccgccgccgcccccaaccctttataacaacaactaccaacgccgacgtcgctcattaactacgacgaccgaactccgcctcctcgcgactcccgacgacgcgacaaataaaaataaacgcgcactaatcgaaactctaaatcccccaaaaacgcatcctaaatactcgaattaccaaatttaaaccctccttccctcgaaacccttacttc

SEQ ID NO: 34793 - DNA, 1929 bp, Artificial Sequence
  chemically treated genomic DNA (Homo sapiens) CpG-island No: 34793
  misc_feature (465)..(465): n is either a, c, g or t
  misc_feature (1733)..(1733): n is either a, c, g or t
tataagaatatatacgaatttcgtttcggatcgagagtaggggcgaatacgtaaatttatttagaatttattatttattatgcgtaggatacgtggtatttattgggtagatgtaattttatttatacggtgcgtattaaagtatcgggggcgttaatatgggacgcgggtaggtgacgatattggggtaggagtaaatcggtcgttttagcggtaattgtaatttggggaatattacggagtaggggtgagtattatttcgtcgtacgaggttaggggtcgaaattcggagtcgatacgtcgtttaacgtaggggagtaatttagcgggagaatacgaacgttttcgtcgagtataatacgatatcgtacgattttataacgttgggggacggcgatagtattatagcgggatattgtacgataagcgtagttattatatatataaggttttagcgggggtttnattatagggggcgatttacgataatacgatacgatatatgtatcgagcgcgtcgacgggtacgttaggttattgggggcgagggcgttatcgtagtatttatcgacgtatatatacgtttagttcgtagcgttcgataataaatcgaagttcgtatagcgcggtaatttgggtgggggtgattatatacgtacgtatagattagttagtacgtcgcgttgataatatagaacgtttagcgagatagcgtacggtatagataaaagatagacgacgacgagcgagagacgtaattaagtagtagtagtacgtacgaatagggacgcgatagatagtgatgaatattaagagcggttacgtaattaagttcggcgatataacggggcgaaacgtgtataatcggcgtatttaatattttacgagaataatcgatgatgtttatatcgaggggggttttatattaattgggcggtaaagcggtattaattattagtatagatcgaattagtatagaattcgataatcgaagcgattatacggggtggagaggacgttagatattacgtagtatagatcgtataagtggagcgagtaagtataattttataattaatcggtaatacgaacgttattagaggagggggtaaatattacgtacgtatttaagatattagttggggcgtcgttaacgtacggcgtttataatataagaacgttcgttagacgagtgatgttattaagaattataagagcggacgttcgggggttattttaatatatcgcggtttttaggttgggtagatttttacgatattatttatgagtggttgtcgcgcgtagcgggtacgtagtggttggcgttttatttataattatttaattacgagttaacgtgagagatgttatatataaggatggacgtattatttaatacgatatcggtaattgatagatttttttaaagggcggtacgttcgtcgacggcgaattattagtaaggatgtcgaattttatcgacgtaaacgtcgacgatagcgttagatatagtaaatattataagcgagtatagaggttgtacgacgtatttaagataaataagtgggtgatatcgggagggattacgtatacgaagtaagtaggtatgacgttaaattagatattgcgagagcggggcgaggtaattcgatttacgtattttagtgagcgagtttcgtagataatacgcgaagagggttttagacgttcgtagtacggagttatcgtcgatanatatcggagatagtagtatattcgattcgtttcgagatatttacgttttattcgcgtattatttttatagcgtatattttagaattagagtttttataggattcgtgtataatatcgttttagcgagatatttgcgtattataggtttattagtttttttttggcgtcgtgcgtttaaataaaagtaaggtaaagt

SEQ ID NO: 34794 - DNA, 1929 bp, Artificial Sequence
  chemically treated genomic DNA (Homo sapiens) CpG-island No: 34794
  misc_feature (197)..(197): n is either a, c, g or t
  misc_feature (1465)..(1465): n is either a, c, g or t
actttaccttacttttatttaaacgcacgacgccaaaaaaaaactaataaacctataatacgcaaatatctcgctaaaacgatattatacacgaatcctataaaaactctaattctaaaatatacgctataaaaataatacgcgaataaaacgtaaatatctcgaaacgaatcgaatatactactatctccgatatntatcgacgataactccgtactacgaacgtctaaaaccctcttcgcgtattatctacgaaactcgctcactaaaatacgtaaatcgaattacctcgccccgctctcgcaatatctaatttaacgtcatacctacttacttcgtatacgtaatccctcccgatatcacccacttatttatcttaaatacgtcgtacaacctctatactcgcttataatatttactatatctaacgctatcgtcgacgtttacgtcgataaaattcgacatccttactaataattcgccgtcgacgaacgtaccgccctttaaaaaaatctatcaattaccgatatcgtattaaataatacgtccatccttatatataacatctctcacgttaactcgtaattaaataattataaataaaacgccaaccactacgtacccgctacgcgcgacaaccactcataaataatatcgtaaaaatctacccaacctaaaaaccgcgatatattaaaataacccccgaacgtccgctcttataattcttaataacatcactcgtctaacgaacgttcttatattataaacgccgtacgttaacgacgccccaactaatatcttaaatacgtacgtaatatttaccccctcctctaataacgttcgtattaccgattaattataaaattatacttactcgctccacttatacgatctatactacgtaatatctaacgtcctctccaccccgtataatcgcttcgattatcgaattctatactaattcgatctatactaataattaataccgctttaccgcccaattaatataaaacccccctcgatataaacatcatcgattattctcgtaaaatattaaatacgccgattatacacgtttcgccccgttatatcgccgaacttaattacgtaaccgctcttaatattcatcactatctatcgcgtccctattcgtacgtactactactacttaattacgtctctcgctcgtcgtcgtctatcttttatctataccgtacgctatctcgctaaacgttctatattatcaacgcgacgtactaactaatctatacgtacgtatataatcacccccacccaaattaccgcgctatacgaacttcgatttattatcgaacgctacgaactaaacgtatatatacgtcgataaatactacgataacgccctcgcccccaataacctaacgtacccgtcgacgcgctcgatacatatatcgtatcgtattatcgtaaatcgccccctataatnaaacccccgctaaaaccttatatatataataactacgcttatcgtacaatatcccgctataatactatcgccgtcccccaacgttataaaatcgtacgatatcgtattatactcgacgaaaacgttcgtattctcccgctaaattactcccctacgttaaacgacgtatcgactccgaatttcgacccctaacctcgtacgacgaaataatactcacccctactccgtaatattccccaaattacaattaccgctaaaacgaccgatttactcctaccccaatatcgtcacctacccgcgtcccatattaacgcccccgatactttaatacgcaccgtataaataaaattacatctacccaataaataccacgtatcctacgcataataaataataaattctaaataaatttacgtattcgcccctactctcgatccgaaacgaaattcgtatatattcttata

SEQ ID NO: 34795 - DNA, 1929 bp, Artificial Sequence
  chemically treated genomic DNA (Homo sapiens) CpG-island No: 34795
  misc_feature (197)..(197): n is either a, c, g or t
  misc_feature (1465)..(1465): n is either a, c, g or t
attttgttttgtttttgtttaaacgtacgacgttaggagaaaattggtgagtttgtgatacgtaggtgtttcgttgagacgatgttgtatacgagttttgtggagattttgattttggagtgtgcgttgtaaaaatggtacgcgggtaagacgtgggtatttcgaagcgggtcgagtgtgttgttgttttcggtgtntgtcggcggtggtttcgtattgcgagcgtttgaggtttttttcgcgtgttgtttacgaggttcgtttattgagatgcgtgggtcgggttgtttcgtttcgttttcgtaatgtttggtttggcgttatatttgtttgtttcgtatgcgtagtttttttcgatgttatttatttgtttgttttgggtacgtcgtgtaatttttgtgttcgtttgtggtgtttgttgtgtttggcgttgtcgtcggcgtttgcgtcggtggagttcgatatttttgttggtaattcgtcgtcggcgggcgtgtcgttttttggggggatttattagttgtcggtgtcgtattaggtggtgcgtttatttttgtgtgtggtattttttacgttagttcgtagttgggtggttgtgggtgaggcgttagttattgcgtattcgttgcgcgcggtagttatttatgggtggtgtcgtgggggtttatttaatttgggagtcgcggtgtgttggggtaattttcggacgttcgtttttgtggtttttggtggtattattcgtttggcgggcgtttttgtgttgtagacgtcgtgcgttgacggcgttttagttggtgttttaggtgcgtgcgtggtgtttgtttttttttttagtggcgttcgtgttgtcggttggttgtggagttgtgtttgttcgttttatttgtgcggtttgtgttgcgtggtgtttggcgttttttttatttcgtgtagtcgtttcggttgtcgggttttgtgttagttcggtttgtgttggtggttggtgtcgttttgtcgtttagttagtgtggggtttttttcggtgtgggtattatcggttgttttcgtggggtgttgggtgcgtcggttgtgtacgtttcgtttcgttgtgtcgtcgggtttggttgcgtagtcgtttttggtgtttattattgtttgtcgcgtttttgttcgtgcgtgttgttgttgtttggttgcgtttttcgttcgtcgtcgtttattttttgtttgtgtcgtgcgttgtttcgttgaacgttttgtgttgttagcgcggcgtgttggttggtttgtgcgtgcgtgtatggttatttttatttaggttgtcgcgttgtgcgggtttcggtttgttatcggacgttgcgggttgggcgtgtatgtacgtcggtgggtgttacggtggcgttttcgtttttaatgatttggcgtgttcgtcggcgcgttcggtgtatatgtcgtgtcgtgttgtcgtgggtcgttttttatggtngggttttcgttgggattttgtgtgtgtagtggttgcgtttgtcgtgtagtatttcgttgtggtgttgtcgtcgttttttagcgttgtggggtcgtgcgatatcgtgttgtgttcggcgggagcgttcgtgttttttcgttggattgtttttttgcgttaaacggcgtgtcggtttcgagtttcggtttttggtttcgtgcggcggggtagtgtttatttttgtttcgtggtgttttttaagttgtagttgtcgttgaagcggtcggtttgtttttgttttagtgtcgttatttgttcgcgttttatgttggcgttttcgatattttagtgcgtatcgtgtgggtggggttatatttgtttagtgggtattacgtgttttgcgtatggtgagtgatagattttgggtggatttgcgtgttcgtttttgttttcggttcgggacgggattcgtgtatgtttttata

SEQ ID NO: 34796 - DNA, 1929 bp, Artificial Sequence
  chemically treated genomic DNA (Homo sapiens) CpG-island No: 34796
  misc_feature (465)..(465): n is either a, c, g or t
  misc_feature (1733)..(1733): n is either a, c, g or t
tataaaaacatacacgaatcccgtcccgaaccgaaaacaaaaacgaacacgcaaatccacccaaaatctatcactcaccatacgcaaaacacgtaatacccactaaacaaatataaccccacccacacgatacgcactaaaatatcgaaaacgccaacataaaacgcgaacaaataacgacactaaaacaaaaacaaaccgaccgcttcaacgacaactacaacttaaaaaacaccacgaaacaaaaataaacactaccccgccgcacgaaaccaaaaaccgaaactcgaaaccgacacgccgtttaacgcaaaaaaacaatccaacgaaaaaacacgaacgctcccgccgaacacaacacgatatcgcacgaccccacaacgctaaaaaacgacgacaacaccacaacgaaatactacacgacaaacgcaaccactacacacacaaaatcccaacgaaaacccnaccataaaaaacgacccacgacaacacgacacgacatatacaccgaacgcgccgacgaacacgccaaatcattaaaaacgaaaacgccaccgtaacacccaccgacgtacatacacgcccaacccgcaacgtccgataacaaaccgaaacccgcacaacgcgacaacctaaataaaaataaccatacacgcacgcacaaaccaaccaacacgccgcgctaacaacacaaaacgttcaacgaaacaacgcacgacacaaacaaaaaataaacgacgacgaacgaaaaacgcaaccaaacaacaacaacacgcacgaacaaaaacgcgacaaacaataataaacaccaaaaacgactacgcaaccaaacccgacgacacaacgaaacgaaacgtacacaaccgacgcacccaacaccccacgaaaacaaccgataatacccacaccgaaaaaaaccccacactaactaaacgacaaaacgacaccaaccaccaacacaaaccgaactaacacaaaacccgacaaccgaaacgactacacgaaataaaaaaaacgccaaacaccacgcaacacaaaccgcacaaataaaacgaacaaacacaactccacaaccaaccgacaacacgaacgccactaaaaaaaaaaacaaacaccacgcacgcacctaaaacaccaactaaaacgccgtcaacgcacgacgtctacaacacaaaaacgcccgccaaacgaataataccaccaaaaaccacaaaaacgaacgtccgaaaattaccccaacacaccgcgactcccaaattaaataaacccccacgacaccacccataaataactaccgcgcgcaacgaatacgcaataactaacgcctcacccacaaccacccaactacgaactaacgtaaaaaataccacacacaaaaataaacgcaccacctaatacgacaccgacaactaataaatccccccaaaaaacgacacgcccgccgacgacgaattaccaacaaaaatatcgaactccaccgacgcaaacgccgacgacaacgccaaacacaacaaacaccacaaacgaacacaaaaattacacgacgtacccaaaacaaacaaataaataacatcgaaaaaaactacgcatacgaaacaaacaaatataacgccaaaccaaacattacgaaaacgaaacgaaacaacccgacccacgcatctcaataaacgaacctcgtaaacaacacgcgaaaaaaacctcaaacgctcgcaatacgaaaccaccgccgacanacaccgaaaacaacaacacactcgacccgcttcgaaatacccacgtcttacccgcgtaccatttttacaacgcacactccaaaatcaaaatctccacaaaactcgtatacaacatcgtctcaacgaaacacctacgtatcacaaactcaccaattttctcctaacgtcgtacgtttaaacaaaaacaaaacaaaat

SEQ ID NO: 34797 - DNA, 579 bp, Artificial Sequence
  chemically treated genomic DNA (Homo sapiens) CpG-island No: 34797
ttgtgttttttcggaattttttttcggtgcgttttttttggttgcgaatttgggcggtttttcggataattgtttcggttatgttttttttcgggtagcggtggggcgtcgttttatttcgggttttgttattttagttcgcgttaggtttatcgggtgtagttgtcgtgttttttagttttcggtatattcgtagatatcgttatcggattatgtttgtttgattcgggttattacgtattttttcgggggtttcgttatacgtagtttttagtgttgggtggtaatttttttcgtattttttcgcgtgggttttttttatacgacgatataatagtatacgatataatataaagggggataaataatcgtaaaaagataattcgtaggtgggagacgcggtaagatatttattatattaataattattatatatatacgatacgaggcgtaattttttttattaattattcgtggggtgggtgaggaatatacgcgtttagaaaataaagtcgttcgatataataatattgttttttttatattgggtgtggtgcgtatatattatatttgttttta

SEQ ID NO: 34798 - DNA, 579 bp, Artificial Sequence
  chemically treated genomic DNA (Homo sapiens) CpG-island No: 34798
taaaaacaaatataatatatacgcaccacacccaatataaaaaaaacaatattattatatcgaacgactttattttctaaacgcgtatattcctcacccaccccacgaataattaataaaaaaaattacgcctcgtatcgtatatatataataattattaatataataaatatcttaccgcgtctcccacctacgaattatctttttacgattatttatccccctttatattatatcgtatactattatatcgtcgtataaaaaaaacccacgcgaaaaaatacgaaaaaaattaccacccaacactaaaaactacgtataacgaaacccccgaaaaaatacgtaataacccgaatcaaacaaacataatccgataacgatatctacgaatataccgaaaactaaaaaacacgacaactacacccgataaacctaacgcgaactaaaataacaaaacccgaaataaaacgacgccccaccgctacccgaaaaaaaacataaccgaaacaattatccgaaaaaccgcccaaattcgcaaccaaaaaaaacgcaccgaaaaaaaattccgaaaaaacacaa

SEQ ID NO: 34799 - DNA, 579 bp, Artificial Sequence
  chemically treated genomic DNA (Homo sapiens) CpG-island No: 34799
taagaatagatgtggtgtgtgcgtattatatttagtatagaaagaatagtgttgttgtgtcgggcggttttattttttgggcgcgtgtgttttttatttattttacgagtggttggtaagagaagttgcgtttcgtgtcgtgtgtgtgtggtggttgttggtgtgataggtgttttgtcgcgttttttatttgcgggttgtttttttgcggttgtttgtttttttttgtattgtatcgtgtgttgttgtgtcgtcgtgtggggaaaatttacgcgagagagtgcgggggggattattatttagtattaggggttgcgtgtgacggggttttcgagaaagtacgtggtaattcgggttaagtaggtatagttcgatagcggtatttgcgggtatatcgagggttaggaaatacgatagttgtattcggtgggtttaacgcgggttgagataataaagttcgggataaggcgacgttttatcgttgttcgagaggggatatagtcgggatagttattcggaagatcgtttaggttcgtaattaggaggagcgtatcgaggaggaatttcgagggggtataa

SEQ ID NO: 34800 - DNA, 579 bp, Artificial Sequence
  chemically treated genomic DNA (Homo sapiens) CpG-island No: 34800
ttataccccctcgaaattcctcctcgatacgctcctcctaattacgaacctaaacgatcttccgaataactatcccgactatatcccctctcgaacaacgataaaacgtcgccttatcccgaactttattatctcaacccgcgttaaacccaccgaatacaactatcgtatttcctaaccctcgatatacccgcaaataccgctatcgaactatacctacttaacccgaattaccacgtactttctcgaaaaccccgtcacacgcaacccctaatactaaataataatcccccccgcactctctcgcgtaaattttccccacacgacgacacaacaacacacgatacaatacaaaaaaaaacaaacaaccgcaaaaaaacaacccgcaaataaaaaacgcgacaaaacacctatcacaccaacaaccaccacacacacacgacacgaaacgcaacttctcttaccaaccactcgtaaaataaataaaaaacacacgcgcccaaaaaataaaaccgcccgacacaacaacactattctttctatactaaatataatacgcacacaccacatctattctta

SEQ ID NO: 34801 - DNA, 546 bp, Artificial Sequence
  chemically treated genomic DNA (Homo sapiens) CpG-island No: 34801
ttcgcggttgttttattattagttaattgttcggtgttgcgatcgatatttatcgttataaattcggtggcggcgttagcggttgtttcggtatatttttaagaacggttttatataagcgttttatgtaggttgggtatttttggtatcgttttcgtatttgagatttgatttttaatcgtttcggaagtcgttgtatgatcgagatacgacggtgattattaaagttaatttagatcgaggttataacgttcggacgtaattcgagaattacgtatttttcgaattgttagtggtttcggtttttcgtcgatatcgcgacgttgtaaattacgatttgtacgttaggtagtatttggtagtttgggttagtaaagatttaggtggtttaaggtattttaatcgggatgttacgggacgttatgattttcgggcgtaaatttgaggttagtttttatataagttggatgtcggtttatttatttttatcgtttattatttcgtagtattatttgttggtagaagtgtcgtgttggataataacgg

SEQ ID NO: 34802 - DNA, 546 bp, Artificial Sequence
  chemically treated genomic DNA (Homo sapiens) CpG-island No: 34802
ccgttattatccaacacgacacttctaccaacaaataatactacgaaataataaacgataaaaataaataaaccgacatccaacttatataaaaactaacctcaaatttacgcccgaaaatcataacgtcccgtaacatcccgattaaaataccttaaaccacctaaatctttactaacccaaactaccaaatactacctaacgtacaaatcgtaatttacaacgtcgcgatatcgacgaaaaaccgaaaccactaacaattcgaaaaatacgtaattctcgaattacgtccgaacgttataacctcgatctaaattaactttaataatcaccgtcgtatctcgatcatacaacgacttccgaaacgattaaaaatcaaatctcaaatacgaaaacgataccaaaaatacccaacctacataaaacgcttatataaaaccgttcttaaaaatataccgaaacaaccgctaacgccgccaccgaatttataacgataaatatcgatcgcaacaccgaacaattaactaataataaaacaaccgcgaa

SEQ ID NO: 34803 - DNA, 546 bp, Artificial Sequence
  chemically treated genomic DNA (Homo sapiens) CpG-island No: 34803
tcgttattatttagtacggtatttttgttagtaggtagtattgcggaataatgaacgatggaggtgagtgaatcggtatttagtttatgtggaaattggttttaggtttacgttcgaaggttataacgtttcgtggtatttcgattaagatgttttgaattatttaaatttttgttgatttagattgttaggtattgtttggcgtgtaggtcgtgatttgtagcgtcgcgatatcggcggaaaatcgggattattaatagttcgaaagatgcgtggttttcgggttacgttcgggcgttgtgatttcggtttggattggttttgatgattatcgtcgtatttcggttatataacggttttcggagcgattaaagattagattttaggtacgaaggcggtgttaagagtgtttagtttgtatgggacgtttatatgaagtcgtttttgaaggtgtgtcggagtagtcgttgacgtcgttatcgggtttgtgacggtgaatatcgatcgtagtatcgggtagttagttaatggtggaatagtcgcgaa

SEQ ID NO: 34804 - DNA, 546 bp, Artificial Sequence
  chemically treated genomic DNA (Homo sapiens) CpG-island No: 34804
ttcgcgactattccaccattaactaactacccgatactacgatcgatattcaccgtcacaaacccgataacgacgtcaacgactactccgacacaccttcaaaaacgacttcatataaacgtcccatacaaactaaacactcttaacaccgccttcgtacctaaaatctaatctttaatcgctccgaaaaccgttatataaccgaaatacgacgataatcatcaaaaccaatccaaaccgaaatcacaacgcccgaacgtaacccgaaaaccacgcatctttcgaactattaataatcccgattttccgccgatatcgcgacgctacaaatcacgacctacacgccaaacaatacctaacaatctaaatcaacaaaaatttaaataattcaaaacatcttaatcgaaataccacgaaacgttataaccttcgaacgtaaacctaaaaccaatttccacataaactaaataccgattcactcacctccatcgttcattattccgcaatactacctactaacaaaaataccgtactaaataataacga

SEQ ID NO: 34805 - DNA, 679 bp, Artificial Sequence
  chemically treated genomic DNA (Homo sapiens) CpG-island No: 34805
  misc_feature (344)..(344): n is either a, c, g or t
gcgcggttatcgtcgttttttttagagtaaatttgtttttgttagtatttgttttatttcgcgatagttttgtaatattttattgcgttgtttttcgggttatatagtattggaagtacgttgtttacggttgtgtgttttcgtttgtcgttttttttggtcgtgtttcggttttcgtttcgttgcgtgtgtgtcgttttgtatcgcgtgtgggcgcgtgtcgttttcgtggtttttcgcgggttttttattttacgatttttttttcgtttggtttgcgttacgtgttggtttcgcgtatgtgtcgtcgcgttgttggcgttttttttcgttgcgtttttttntcgtgcgttttttgtcgagtttggttggttgttgttttgttttttgcgtttttttttgtcgtcgcgtttttttttttgtttttttgtttttttttgttttcgacgtttttggttagtcggcgttgttttttttttggcgcgttgtttttattttttttttcgtttttttatttgtttcgtagttttcgtttagcgcgtttttttttgtgtcggtttcgcgtttttgttgtgttttgttttgcgcgtttttttttcgtttttgttgtttttattttttgttgtgattgtatatcgggttgtgttttcgtgtttttattttttgggttttttttggg

SEQ ID NO: 34806 - DNA, 679 bp, Artificial Sequence
  chemically treated genomic DNA (Homo sapiens) CpG-island No: 34806
  misc_feature (336)..(336): n is either a, c, g or t
cccaaaaaaaacccaaaaaataaaaacacgaaaacacaacccgatatacaatcacaacaaaaaataaaaacaacaaaaacgaaaaaaaaacgcgcaaaacaaaacacaacaaaaacgcgaaaccgacacaaaaaaaaacgcgctaaacgaaaactacgaaacaaataaaaaaacgaaaaaaaaaataaaaacaacgcgccaaaaaaaaaacaacgccgactaaccaaaaacgtcgaaaacaaaaaaaaacaaaaaaacaaaaaaaaaaacgcgacgacaaaaaaaaacgcaaaaaacaaaacaacaaccaaccaaactcgacaaaaaacgcacganaaaaaaacgcaacgaaaaaaaacgccaacaacgcgacgacacatacgcgaaaccaacacgtaacgcaaaccaaacgaaaaaaaaatcgtaaaataaaaaacccgcgaaaaaccacgaaaacgacacgcgcccacacgcgatacaaaacgacacacacgcaacgaaacgaaaaccgaaacacgaccaaaaaaaacgacaaacgaaaacacacaaccgtaaacaacgtacttccaatactatataacccgaaaaacaacgcaataaaatattacaaaactatcgcgaaataaaacaaatactaacaaaaacaaatttactctaaaaaaaacgacgataaccgcgc

SEQ ID NO: 34807 - DNA, 679 bp, Artificial Sequence
  chemically treated genomic DNA (Homo sapiens) CpG-island No: 34807
  misc_feature (336)..(336): n is either a, c, g or t
tttaggaaaaatttaaagaatgagaatacgaagatatagttcgatgtgtagttataatagaaggtaggagtagtagaggcgggggaggagcgcgtaaggtaagatatagtagagacgcggagtcgatatagaagagggcgcgttgagcgaggattgcgaaatagatagaggggcgagaggagaagtgagaataacgcgttagaagaggagtagcgtcggttagttagagacgtcgaaagtaggagagagtagggagatagggaggaaggcgcgacgataaggaggaacgtagagagtagaatagtagttagttaggttcgatagagagcgtacgangaagagacgtagcggaaaagagcgttagtagcgcggcggtatatgcgcggaattagtacgtagcgtaggttagacgaggaagggatcgtgagatgaaggattcgcgagaagttacgaaaacgatacgcgtttatacgcgatgtagaacgatatatacgtagcgagacgagagtcgaagtacgattagagaaggcggtagacgagagtatatagtcgtaagtagcgtgtttttaatgttgtatggttcggaaggtagcgtaatgaagtgttgtagggttatcgcgaaatggggtagatgttggtaaagatagatttattttgaaggaagcggcgatgatcgcgt

SEQ ID NO: 34808 - DNA, 679 bp, Artificial Sequence
  chemically treated genomic DNA (Homo sapiens) CpG-island No: 34808
  misc_feature (344)..(344): n is either a, c, g or t
acgcgatcatcgccgcttccttcaaaataaatctatctttaccaacatctaccccatttcgcgataaccctacaacacttcattacgctaccttccgaaccatacaacattaaaaacacgctacttacgactatatactctcgtctaccgccttctctaatcgtacttcgactctcgtctcgctacgtatatatcgttctacatcgcgtataaacgcgtatcgttttcgtaacttctcgcgaatccttcatctcacgatcccttcctcgtctaacctacgctacgtactaattccgcgcatataccgccgcgctactaacgctcttttccgctacgtctcttcntcgtacgctctctatcgaacctaactaactactattctactctctacgttcctccttatcgtcgcgccttcctccctatctccctactctctcctactttcgacgtctctaactaaccgacgctactcctcttctaacgcgttattctcacttctcctctcgcccctctatctatttcgcaatcctcgctcaacgcgccctcttctatatcgactccgcgtctctactatatcttaccttacgcgctcctcccccgcctctactactcctaccttctattataactacacatcgaactatatcttcgtattctcattctttaaatttttcctaaa

SEQ ID NO: 34809 - DNA, 699 bp, Artificial Sequence
  chemically treated genomic DNA (Homo sapiens) CpG-island No: 34809
  misc_feature (7)..(7): n is either a, c, g or t
  misc_feature (61)..(61): n is either a, c, g or t
  misc_feature (123)..(123): n is either a, c, g or t
  misc_feature (127)..(127): n is either a, c, g or t
  misc_feature (153)..(153): n is either a, c, g or t
  misc_feature (265)..(265): n is either a, c, g or t
  misc_feature (324)..(324): n is either a, c, g or t
  misc_feature (335)..(335): n is either a, c, g or t
  misc_feature (354)..(354): n is either a, c, g or t
  misc_feature (463)..(463): n is either a, c, g or t
  misc_feature (478)..(478): n is either a, c, g or t
  misc_feature (490)..(490): n is either a, c, g or t
  misc_feature (499)..(499): n is either a, c, g or t
  misc_feature (526)..(526): n is either a, c, g or t
  misc_feature (632)..(632): n is either a, c, g or t
cgttagngagtgtcgggtttttagatcggtagtttggagggttcgattttttttattcgtntatatttttgtcggttttgtacgtttttttatttttggttcgcgcgtttttcgcgttagttntcgngcggggatatagttttggtcgcgatngcgcgtagatttcgagttatttttatattgtaatatagcgggcgcgttaaaacggcgcgcgtgtgtgatagttagagaacgggattttcgggcggttgatattgggcggcgnatttgttataacgcgaatttattcgttttgtacgtttataatatttggattttatcgtntatagataggncgtttcgaagttgtagatntcggtgatttatgattgtggtacggacggttgttggttatttcgaaggcgttttattttttttaattaaggggtcgtgtttagatttattcgcgttttgattcgtagtnaagtataatttacgnggcgtattgaancggtttcgngggtacgaaaatagttgtggagagtanaatacgcgcgttaggtagttaatgtgtcgagtgatattcgggtagataatacggcgcgtgggtatggttgcggcgtttttgttcgtatttgggttgttcggtttanttttttgagcgaagttatttcgaataatttcggaacggttttagtttttttatggttgggaaaaatt

SEQ ID NO: 34810 - DNA, 699 bp, Artificial Sequence
  chemically treated genomic DNA (Homo sapiens) CpG-island No: 34810
  misc_feature (68)..(68): n is either a, c, g or t
  misc_feature (174)..(174): n is either a, c, g or t
  misc_feature (201)..(201): n is either a, c, g or t
  misc_feature (210)..(210): n is either a, c, g or t
  misc_feature (222)..(222): n is either a, c, g or t
  misc_feature (237)..(237): n is either a, c, g or t
  misc_feature (346)..(346): n is either a, c, g or t
  misc_feature (365)..(365): n is either a, c, g or t
  misc_feature (376)..(376): n is either a, c, g or t
  misc_feature (435)..(435): n is either a, c, g or t
  misc_feature (547)..(547): n is either a, c, g or t
  misc_feature (573)..(573): n is either a, c, g or t
  misc_feature (577)..(577): n is either a, c, g or t
  misc_feature (639)..(639): n is either a, c, g or t
  misc_feature (693)..(693): n is either a, c, g or t
aatttttcccaaccataaaaaaactaaaaccgttccgaaattattcgaaataacttcgctcaaaaaantaaaccgaacaacccaaatacgaacaaaaacgccgcaaccatacccacgcgccgtattatctacccgaatatcactcgacacattaactacctaacgcgcgtattntactctccacaactattttcgtacccncgaaaccgnttcaatacgccncgtaaattatacttnactacgaatcaaaacgcgaataaatctaaacacgaccccttaattaaaaaaaataaaacgccttcgaaataaccaacaaccgtccgtaccacaatcataaatcaccganatctacaacttcgaaacgncctatctatanacgataaaatccaaatattataaacgtacaaaacgaataaattcgcgttataacaaatncgccgcccaatatcaaccgcccgaaaatcccgttctctaactatcacacacgcgcgccgttttaacgcgcccgctatattacaatataaaaataactcgaaatctacgcgcnatcgcgaccaaaactatatccccgcncganaactaacgcgaaaaacgcgcgaaccaaaaataaaaaaacgtacaaaaccgacaaaaatatanacgaataaaaaaaatcgaaccctccaaactaccgatctaaaaacccgacactcnctaacg

SEQ ID NO: 34811 - DNA, 699 bp, Artificial Sequence
  chemically treated genomic DNA (Homo sapiens) CpG-island No: 34811
  misc_feature (68)..(68): n is either a, c, g or t
  misc_feature (174)..(174): n is either a, c, g or t
  misc_feature (201)..(201): n is either a, c, g or t
  misc_feature (210)..(210): n is either a, c, g or t
  misc_feature (222)..(222): n is either a, c, g or t
  misc_feature (237)..(237): n is either a, c, g or t
  misc_feature (346)..(346): n is either a, c, g or t
  misc_feature (365)..(365): n is either a, c, g or t
  misc_feature (376)..(376): n is either a, c, g or t
  misc_feature (435)..(435): n is either a, c, g or t
  misc_feature (547)..(547): n is either a, c, g or t
  misc_feature (573)..(573): n is either a, c, g or t
  misc_feature (577)..(577): n is either a, c, g or t
  misc_feature (639)..(639): n is either a, c, g or t
  misc_feature (693)..(693): n is either a, c, g or t
ggttttttttaattatggggaaattaggatcgtttcgaagttattcggggtgatttcgtttaaggggntgggtcggatagtttagatgcggataaagacgtcgtagttatatttacgcgtcgtattatttattcgggtgttattcggtatattagttgtttggcgcgcgtgttntgttttttataattgttttcgtatttncgaggtcgntttagtacgttncgtggattgtatttngttgcgaattaaagcgcgggtgagtttgagtacggttttttaattggggaagatggaacgttttcgaaatgattaatagtcgttcgtgttatagttataggttatcganatttgtagtttcgggacgntttgtttatgngcggtagggtttagatgttgtaggcgtgtaaggcgaataggttcgcgttatagtaagtncgtcgtttaatattaatcgttcgaaaatttcgttttttggttattatatacgcgcgtcgttttagcgcgttcgttatgttgtaatgtgaaaatggttcgagatttgcgcgtnatcgcgattaaggttatgttttcgtncganagttagcgcgaagagcgcgcgagttagagatgggagagcgtgtaagatcggtagagatatanacgggtagagagagtcgagttttttaaattatcgatttaagggttcgatatttnttagcg

SEQ ID NO: 34812 - DNA, 699 bp, Artificial Sequence
  chemically treated genomic DNA (Homo sapiens) CpG-island No: 34812
  misc_feature (7)..(7): n is either a, c, g or t
  misc_feature (61)..(61): n is either a, c, g or t
  misc_feature (123)..(123): n is either a, c, g or t
  misc_feature (127)..(127): n is either a, c, g or t
  misc_feature (153)..(153): n is either a, c, g or t
  misc_feature (265)..(265): n is either a, c, g or t
  misc_feature (324)..(324): n is either a, c, g or t
  misc_feature (335)..(335): n is either a, c, g or t
  misc_feature (354)..(354): n is either a, c, g or t
  misc_feature (463)..(463): n is either a, c, g or t
  misc_feature (478)..(478): n is either a, c, g or t
  misc_feature (490)..(490): n is either a, c, g or t
  misc_feature (499)..(499): n is either a, c, g or t
  misc_feature (526)..(526): n is either a, c, g or t
  misc_feature (632)..(632): n is either a, c, g or t
cgctaanaaatatcgaacccttaaatcgataatttaaaaaactcgactctctctacccgtntatatctctaccgatcttacacgctctcccatctctaactcgcgcgctcttcgcgctaactntcgnacgaaaacataaccttaatcgcgatnacgcgcaaatctcgaaccattttcacattacaacataacgaacgcgctaaaacgacgcgcgtatataataaccaaaaaacgaaattttcgaacgattaatattaaacgacgnacttactataacgcgaacctattcgccttacacgcctacaacatctaaaccctaccgcncataaacaaancgtcccgaaactacaaatntcgataacctataactataacacgaacgactattaatcatttcgaaaacgttccatcttccccaattaaaaaaccgtactcaaactcacccgcgctttaattcgcaacnaaatacaatccacgnaacgtactaaancgacctcgnaaatacgaaaacaattataaaaaacanaacacgcgcgccaaacaactaatataccgaataacacccgaataaataatacgacgcgtaaatataactacgacgtctttatccgcatctaaactatccgacccanccccttaaacgaaatcaccccgaataacttcgaaacgatcctaatttccccataattaaaaaaaacc

SEQ ID NO: 34813 - DNA, 513 bp, Artificial Sequence
  chemically treated genomic DNA (Homo sapiens) CpG-island No: 34813
aggttttcgggtcgcgagatcgtcgttagagtaaagttaggttattatcgtaggtattaagatagtggtatcgttcgcgttttcggaataggaaatcgagggaattaaaaagtaaatttgagaaagttgggttaagggagggaaaattttttagtttatcgtagggttttgtgcgcggtgattggcgcgttaacgaaagcgatggacgtttagattaatcgttagtaaaagattttttggagttcgcgttttttttttttacgttttttaattcgaaaacgtaatcgggtgagggagcgttttcgttcggagagagttggtcgggatgaggcgtcggttttttcgggttttttttagttgttatcgttttattgtaaaattgacgggcgtaaaaatatgagtgatttcgcgggagggcgcgttggttttcggcgttattttaagtttttagtgtgggtggtggaggattattaggaggtgagcggacggtaatagggttttggggtagaatta

SEQ ID NO: 34814 - DNA, 513 bp, Artificial Sequence
  chemically treated genomic DNA (Homo sapiens) CpG-island No: 34814
taattctaccccaaaaccctattaccgtccgctcacctcctaataatcctccaccacccacactaaaaacttaaaataacgccgaaaaccaacgcgccctcccgcgaaatcactcatatttttacgcccgtcaattttacaataaaacgataacaactaaaaaaaacccgaaaaaaccgacgcctcatcccgaccaactctctccgaacgaaaacgctccctcacccgattacgttttcgaattaaaaaacgtaaaaaaaaaaaacgcgaactccaaaaaatcttttactaacgattaatctaaacgtccatcgctttcgttaacgcgccaatcaccgcgcacaaaaccctacgataaactaaaaaattttccctcccttaacccaactttctcaaatttactttttaattccctcgatttcctattccgaaaacgcgaacgataccactatcttaatacctacgataataacctaactttactctaacgacgatctcgcgacccgaaaacct

SEQ ID NO: 34815 - DNA, 513 bp, Artificial Sequence
  chemically treated genomic DNA (Homo sapiens) CpG-island No: 34815
tgattttgttttagagttttgttgtcgttcgtttattttttgatgattttttattatttatattgggagtttggggtaacgtcggagattagcgcgttttttcgcggagttatttatgtttttgcgttcgttagttttgtagtaaagcggtggtagttggagaagattcgggaaagtcggcgttttatttcggttagtttttttcgggcggaagcgtttttttattcggttgcgttttcggattggaggacgtagggggagggggcgcgggttttaaagggttttttgttgacgattggtttagacgtttatcgttttcgttgacgcgttaattatcgcgtataaggttttgcggtgggttgaagagtttttttttttttggtttagtttttttaggtttgttttttaattttttcggttttttgtttcggaggcgcgggcggtgttattgttttggtatttgcggtagtagtttggttttgttttgacggcgatttcgcggttcgagagttt

SEQ ID NO: 34816 - DNA, 513 bp, Artificial Sequence
  chemically treated genomic DNA (Homo sapiens) CpG-island No: 34816
aaactctcgaaccgcgaaatcgccgtcaaaacaaaaccaaactactaccgcaaataccaaaacaataacaccgcccgcgcctccgaaacaaaaaaccgaaaaaattaaaaaacaaacctaaaaaaactaaaccaaaaaaaaaaaaactcttcaacccaccgcaaaaccttatacgcgataattaacgcgtcaacgaaaacgataaacgtctaaaccaatcgtcaacaaaaaaccctttaaaacccgcgccccctccccctacgtcctccaatccgaaaacgcaaccgaataaaaaaacgcttccgcccgaaaaaaactaaccgaaataaaacgccgactttcccgaatcttctccaactaccaccgctttactacaaaactaacgaacgcaaaaacataaataactccgcgaaaaaacgcgctaatctccgacgttaccccaaactcccaatataaataataaaaaatcatcaaaaaataaacgaacgacaacaaaactctaaaacaaaatca

SEQ ID NO: 34817 - DNA, 694 bp, Artificial Sequence
  chemically treated genomic DNA (Homo sapiens) CpG-island No: 34817
ttagttgcgggtagcgttgtattaatttattaatatcgattagtagcgttagtaaaattcgcgtattcggcgaggcgttgttttgtttttaataacggtgcgattaattattcgtggcggtttagcgcgtcgttggtatcgagtatcgtttttatgtcgtttgttagttgatagcgtttattttgtttacggcgacgagtaatgcgatcggtaaacgtttcggtaagtagcggcgcgataagcgaattgtttgttttatcgttacgtacgtttaagcgttttaatagttgttgattacgttgttgttaggttggttgattgcgcgaaaacgttacgtttaggttattattgtttattcgtggcggtttttcgagaatggcggtaatttttgtcgcggtagtagtttcgtcgtcgtttttcgcgttaattagtattgtcgttaaacgcggatcgttatttagcgttgttattttttgtttttgcgtattaagtcgtttattttttagtgtttttagtatttgtaatagacgtttcgcggttagtagatttattattggcggttgttttagttagtttatttgcgtcggatcgttgtatttttattgtagtaattttattagtaaatcggaaagatcgttttgtaagattttcggtttattttgcgtcgcggcgcgttttgtttgttttttggcga

SEQ ID NO: 34818 - DNA, 694 bp, Artificial Sequence
  chemically treated genomic DNA (Homo sapiens) CpG-island No: 34818
tcgccaaaaaacaaacaaaacgcgccgcgacgcaaaataaaccgaaaatcttacaaaacgatctttccgatttactaataaaattactacaataaaaatacaacgatccgacgcaaataaactaactaaaacaaccgccaataataaatctactaaccgcgaaacgtctattacaaatactaaaaacactaaaaaataaacgacttaatacgcaaaaacaaaaaataacaacgctaaataacgatccgcgtttaacgacaatactaattaacgcgaaaaacgacgacgaaactactaccgcgacaaaaattaccgccattctcgaaaaaccgccacgaataaacaataataacctaaacgtaacgttttcgcgcaatcaaccaacctaacaacaacgtaatcaacaactattaaaacgcttaaacgtacgtaacgataaaacaaacaattcgcttatcgcgccgctacttaccgaaacgtttaccgatcgcattactcgtcgccgtaaacaaaataaacgctatcaactaacaaacgacataaaaacgatactcgataccaacgacgcgctaaaccgccacgaataattaatcgcaccgttattaaaaacaaaacaacgcctcgccgaatacgcgaattttactaacgctactaatcgatattaataaattaatacaacgctacccgcaactaa

SEQ ID NO: 34819 - DNA, 694 bp, Artificial Sequence
  chemically treated genomic DNA (Homo sapiens) CpG-island No: 34819
tcgttaaagaataagtagaacgcgtcgcggcgtaaagtgaatcggagattttataaagcgattttttcggtttgttgatggaattattgtaatggggatgtagcgattcggcgtagatgagttggttggaataatcgttagtagtgaatttattggtcgcgaaacgtttgttataaatgttgggggtattggagggtgaacggtttagtgcgtaagggtaaaaaatggtagcgttgggtaacgattcgcgtttagcggtaatgttggttagcgcgaagaacgacgacgaagttgttatcgcggtaaaaattgtcgttattttcgaagagtcgttacggatgggtaatagtgatttgggcgtggcgttttcgcgtaattaattagtttggtagtaacgtagttagtaattgttaaaacgtttaaacgtacgtggcggtgaggtagatagttcgtttatcgcgtcgttatttgtcggggcgtttgtcgatcgtattgttcgtcgtcgtgggtaagatggacgttattaattggtaaacggtatgggagcgatgttcgatgttaacgacgcgttaagtcgttacgaatggttgatcgtatcgttattaaagataaggtagcgtttcgtcggatgcgcggattttattggcgttgttggtcgatattgatgagttagtataacgttgttcgtagttgg

SEQ ID NO: 34820 - DNA, 694 bp, Artificial Sequence
  chemically treated genomic DNA (Homo sapiens) CpG-island No: 34820
ccaactacgaacaacgttatactaactcatcaatatcgaccaacaacgccaataaaatccgcgcatccgacgaaacgctaccttatctttaataacgatacgatcaaccattcgtaacgacttaacgcgtcgttaacatcgaacatcgctcccataccgtttaccaattaataacgtccatcttacccacgacgacgaacaatacgatcgacaaacgccccgacaaataacgacgcgataaacgaactatctacctcaccgccacgtacgtttaaacgttttaacaattactaactacgttactaccaaactaattaattacgcgaaaacgccacgcccaaatcactattacccatccgtaacgactcttcgaaaataacgacaatttttaccgcgataacaacttcgtcgtcgttcttcgcgctaaccaacattaccgctaaacgcgaatcgttacccaacgctaccattttttacccttacgcactaaaccgttcaccctccaatacccccaacatttataacaaacgtttcgcgaccaataaattcactactaacgattattccaaccaactcatctacgccgaatcgctacatccccattacaataattccatcaacaaaccgaaaaaatcgctttataaaatctccgattcactttacgccgcgacgcgttctacttattctttaacga

SEQ ID NO: 34821 - DNA, 815 bp, Artificial Sequence
  chemically treated genomic DNA (Homo sapiens) CpG-island No: 34821
  misc_feature (646)..(646): n is either a, c, g or t
gggttacgagaaatcggtcgagtagttcgggttaagtttttcggaattttcggtcgtcgtaattttcgacgttagggttgaagcgtcgggtattgtcgtttttttcggtcgttcgttcgtacgttcggagcggggaagtacgtcgtttttttacgtattagtatggtatttcgtataagtagcgtcgttaaagtttttttacgagggggttgagggataaaagtttttttcgaaattcgttcgaatttcgagggttttcgatttgtacggttttacgtttaggcggcggtttcgagcgtcgggggttcgtacgggtatatgtagttttttgttttttgtttagtcgggcgttgtttacgtgtagtattagggatgtcggagcgtttcgtaggggtcggatattggacgattattttgggtaggggttcggatttcgcgtttcgaagagttcggagtttggtttttcgatttttttttcgggagtaggtttatttaattaaagtttgtagtgtttttgatgagaaacgttcggagtattcgtttcgtacgggcggagagttggcgaattttattttgttttttaaattggtaagacgttattattagtaaattatattggttttgtcggtcggatttgttcgacggngggcgtattttaggtttacgcggggttgaatatttcgatagggatagggttcgtattcgagtacgtgggttgttacgtaaagtataaaaggtaggttttgggggattaattgatttcggggggtaaaaaaggcggcggtttatttttagttaaggtggtttttttgtta

SEQ ID NO: 34822 - DNA, 815 bp, Artificial Sequence
  chemically treated genomic DNA (Homo sapiens) CpG-island No: 34822
  misc_feature (170)..(170): n is either a, c, g or t
taacaaaaaaaccaccttaactaaaaataaaccgccgccttttttaccccccgaaatcaattaatcccccaaaacctaccttttatactttacgtaacaacccacgtactcgaatacgaaccctatccctatcgaaatattcaaccccgcgtaaacctaaaatacgcccnccgtcgaacaaatccgaccgacaaaaccaatataatttactaataataacgtcttaccaatttaaaaaacaaaataaaattcgccaactctccgcccgtacgaaacgaatactccgaacgtttctcatcaaaaacactacaaactttaattaaataaacctactcccgaaaaaaaaatcgaaaaaccaaactccgaactcttcgaaacgcgaaatccgaacccctacccaaaataatcgtccaatatccgacccctacgaaacgctccgacatccctaatactacacgtaaacaacgcccgactaaacaaaaaacaaaaaactacatatacccgtacgaacccccgacgctcgaaaccgccgcctaaacgtaaaaccgtacaaatcgaaaaccctcgaaattcgaacgaatttcgaaaaaaacttttatccctcaaccccctcgtaaaaaaactttaacgacgctacttatacgaaataccatactaatacgtaaaaaaacgacgtacttccccgctccgaacgtacgaacgaacgaccgaaaaaaacgacaatacccgacgcttcaaccctaacgtcgaaaattacgacgaccgaaaattccgaaaaacttaacccgaactactcgaccgatttctcgtaaccc

SEQ ID NO: 34823 - DNA, 815 bp, Artificial Sequence
  chemically treated genomic DNA (Homo sapiens) CpG-island No: 34823
  misc_feature (170)..(170): n is either a, c, g or t
tggtagggaaattattttggttgaaaataagtcgtcgttttttttatttttcggagttaattaattttttaaggtttgttttttgtgttttacgtgatagtttacgtgttcgggtgcggattttgtttttgtcgaaatgtttagtttcgcgtaagtttgggatgcgtttntcgtcgggtaggttcggtcggtaggattaatgtggtttgttgatgatggcgttttgttagtttaaaaagtagagtgaagttcgttaatttttcgttcgtgcggggcggatatttcgggcgttttttattaaggatattgtaaattttgattaaatgggtttgttttcgaggggagggtcggggggttaggtttcggatttttcggggcgcggggttcggatttttatttagggtgatcgtttagtgttcggtttttgcgaaacgtttcgatatttttgatgttgtacgtaggtagcgttcggttggatagaaaataaagggttgtatgtgttcgtgcgggttttcggcgttcggggtcgtcgtttgggcgtagggtcgtgtaggtcggaggttttcgaagttcgggcgagtttcgggaggggtttttgttttttagttttttcgtggggaaattttggcggcgttatttgtgcgaggtgttatgttggtgcgtagggaggcggcgtgttttttcgtttcgggcgtgcgggcgggcgatcgagggaggcggtagtgttcggcgttttagttttggcgtcgggggttgcgacggtcgagggtttcggggagtttggttcggattgttcggtcggtttttcgtggttt

SEQ ID NO: 34824 - DNA, 815 bp, Artificial Sequence
  chemically treated genomic DNA (Homo sapiens) CpG-island No: 34824
  misc_feature (646)..(646): n is either a, c, g or t
aaaccacgaaaaaccgaccgaacaatccgaaccaaactccccgaaaccctcgaccgtcgcaacccccgacgccaaaactaaaacgccgaacactaccgcctccctcgatcgcccgcccgcacgcccgaaacgaaaaaacacgccgcctccctacgcaccaacataacacctcgcacaaataacgccgccaaaatttccccacgaaaaaactaaaaaacaaaaacccctcccgaaactcgcccgaacttcgaaaacctccgacctacacgaccctacgcccaaacgacgaccccgaacgccgaaaacccgcacgaacacatacaaccctttattttctatccaaccgaacgctacctacgtacaacatcaaaaatatcgaaacgtttcgcaaaaaccgaacactaaacgatcaccctaaataaaaatccgaaccccgcgccccgaaaaatccgaaacctaaccccccgaccctcccctcgaaaacaaacccatttaatcaaaatttacaatatccttaataaaaaacgcccgaaatatccgccccgcacgaacgaaaaattaacgaacttcactctactttttaaactaacaaaacgccatcatcaacaaaccacattaatcctaccgaccgaacctacccgacganaaacgcatcccaaacttacgcgaaactaaacatttcgacaaaaacaaaatccgcacccgaacacgtaaactatcacgtaaaacacaaaaaacaaaccttaaaaaattaattaactccgaaaaataaaaaaaacgacgacttattttcaaccaaaataatttccctacca

SEQ ID NO: 34825 - DNA, 580 bp, Artificial Sequence
  chemically treated genomic DNA (Homo sapiens) CpG-island No: 34825
gcgcgtgtggggcgcgtgtggggcgcgtgtggggcgcgtgtggagcgggtgtggggcgcgtgtggaacgtgtgtggggcgggtgtggggcgggtgtggggcgggtgtggggcgcgtgtggggcgggtgtggggcgcgtgtggggcgggtgtggggcgcgtgtggggcgggtgtggggcgcgtgtggggcgggtgtggggcgcgtgtggggcgggtgtggggcgcgtgtggaacgtgtgtggggcgcgtgtggagcgggtgtggggcgggtgtggggcgcgtgtggggcgggtgtggggcgcgtgtggggcgggtgtggggtacgtgtggaacgtgtgtggaacgtgtgtggggcgcgtgtggggcgggtgtggggcgcgtgtggggcgggtgtggagcgcgtgaggggcgcgtgtggggcgggtgtggggcgggtgtggggcgcgtgtggggcggatgtggggcgcgtgttgggaatagcgttcgggatgtatagagtatagcgcggtggggaggcggtaggggcggtttttattttttttagtattttaattttatcgtttgggttttttgtgaaaaat

SEQ ID NO: 34826 - DNA, 580 bp, Artificial Sequence
  chemically treated genomic DNA (Homo sapiens) CpG-island No: 34826
atttttcacaaaaaacccaaacgataaaattaaaatactaaaaaaaataaaaaccgcccctaccgcctccccaccgcgctatactctatacatcccgaacgctattcccaacacgcgccccacatccgccccacacgcgccccacacccgccccacacccgccccacacgcgcccctcacgcgctccacacccgccccacacgcgccccacacccgccccacacgcgccccacacacgttccacacacgttccacacgtaccccacacccgccccacacgcgccccacacccgccccacacgcgccccacacccgccccacacccgctccacacgcgccccacacacgttccacacgcgccccacacccgccccacacgcgccccacacccgccccacacgcgccccacacccgccccacacgcgccccacacccgccccacacgcgccccacacccgccccacacgcgccccacacccgccccacacccgccccacacccgccccacacacgttccacacgcgccccacacccgctccacacgcgccccacacgcgccccacacgcgccccacacgcgc

SEQ ID NO: 34827 - DNA, 580 bp, Artificial Sequence
  chemically treated genomic DNA (Homo sapiens) CpG-island No: 34827
gttttttataagaaatttagacggtgggattgggatgttggaggaagtggaagtcgtttttgtcgtttttttatcgcgttgtgttttgtgtatttcggacgttgtttttaatacgcgttttatattcgttttatacgcgttttatattcgttttatattcgttttatacgcgttttttacgcgttttatattcgttttatacgcgttttatattcgttttatacgcgttttatatacgttttatatacgttttatacgtgttttatattcgttttatacgcgttttatattcgttttatacgcgttttatattcgttttatattcgttttatacgcgttttatatacgttttatacgcgttttatattcgttttatacgcgttttatattcgttttatacgcgttttatattcgttttatacgcgttttatattcgttttatacgcgttttatattcgttttatacgcgttttatattcgttttatattcgttttatattcgttttatatacgttttatacgcgttttatattcgttttatacgcgttttatacgcgttttatacgcgttttatacgcgt

SEQ ID NO: 34828 - DNA, 580 bp, Artificial Sequence
  chemically treated genomic DNA (Homo sapiens) CpG-island No: 34828
acgcgtataaaacgcgtataaaacgcgtataaaacgcgtataaaacgaatataaaacgcgtataaaacgtatataaaacgaatataaaacgaatataaaacgaatataaaacgcgtataaaacgaatataaaacgcgtataaaacgaatataaaacgcgtataaaacgaatataaaacgcgtataaaacgaatataaaacgcgtataaaacgaatataaaacgcgtataaaacgtatataaaacgcgtataaaacgaatataaaacgaatataaaacgcgtataaaacgaatataaaacgcgtataaaacgaatataaaacacgtataaaacgtatataaaacgtatataaaacgcgtataaaacgaatataaaacgcgtataaaacgaatataaaacgcgtaaaaaacgcgtataaaacgaatataaaacgaatataaaacgcgtataaaacgaatataaaacgcgtattaaaaacaacgtccgaaatacacaaaacacaacgcgataaaaaaacgacaaaaacgacttccacttcctccaacatcccaatcccaccgtctaaatttcttataaaaaac

SEQ ID NO: 34829 - DNA, 716 bp, Artificial Sequence
  chemically treated genomic DNA (Homo sapiens) CpG-island No: 34829
ttcgaggtcgtatttattgttggcgatgtcgttttttattttatatttggttacgattaggtttttagcgatagtttgtttttgttgttcgttttcgttcgatatttttttattattattattgtagtttcgttttttttgagtcgtcgtcgtttttgtttttttttttagttataggttgtggttagagttttttcgattttcgaggagagggcgagcgaaagcgcgagtaagtaagggagcgggtaggtaggcgagagcgagaagttgcgagcgcgcgggttgaggcgtagggtacgttgggataattagttttttcggtcgttagattttagtcgttttcgagggttttcgaattataatttttagtttgtttttcgcgtttttaagttaggttttggggttttgttttttaagggtttcgtacgtcggaatcgtcgggtattttgggaagggttaggtttcggcgggaaggcggagtcgttggggagtttgaggggaagcgtggtttttttcggaaaaattatttttatcgagaacgttgagcgagagttagtaatagagaggggcgggttgaggggagaggggcggagttacggcggggaaataggtttaaagtcgaataggtaggggtggagtagagtggagtcgtagcgggtgggtagtgtttatatttaggtcggggaggttgggtgcgttttttttcggatttttgg

SEQ ID NO: 34830 - DNA, 716 bp, Artificial Sequence
  chemically treated genomic DNA (Homo sapiens) CpG-island No: 34830
ccaaaaatccgaaaaaaaacgcacccaacctccccgacctaaatataaacactacccacccgctacgactccactctactccacccctacctattcgactttaaacctatttccccgccgtaactccgcccctctcccctcaacccgcccctctctattactaactctcgctcaacgttctcgataaaaataatttttccgaaaaaaaccacgcttcccctcaaactccccaacgactccgccttcccgccgaaacctaacccttcccaaaatacccgacgattccgacgtacgaaacccttaaaaaacaaaaccccaaaacctaacttaaaaacgcgaaaaacaaactaaaaattataattcgaaaaccctcgaaaacgactaaaatctaacgaccgaaaaaactaattatcccaacgtaccctacgcctcaacccgcgcgctcgcaacttctcgctctcgcctacctacccgctcccttacttactcgcgctttcgctcgccctctcctcgaaaatcgaaaaaactctaaccacaacctataactaaaaaaaaaaacaaaaacgacgacgactcaaaaaaaacgaaactacaataataataataaaaaaatatcgaacgaaaacgaacaacaaaaacaaactatcgctaaaaacctaatcgtaaccaaatataaaataaaaaacgacatcgccaacaataaatacgacctcgaa

SEQ ID NO: 34831 - DNA, 716 bp, Artificial Sequence
  chemically treated genomic DNA (Homo sapiens) CpG-island No: 34831
ttagggattcgaagaagggcgtatttagttttttcgatttaggtgtagatattgtttattcgttgcggttttattttattttatttttgtttgttcgattttaaatttattttttcgtcgtagtttcgtttttttttttttagttcgtttttttttgttattggttttcgtttagcgttttcggtggaagtggttttttcgggagagattacgtttttttttaagttttttaacggtttcgttttttcgtcggagtttgattttttttagagtgttcggcgatttcggcgtgcgaggtttttggagggtaaggttttagggtttggtttaagagcgcgagaggtaggttgggaattgtagttcgaaggttttcgagagcggttagagtttggcggtcgagaggattagttgttttagcgtgttttgcgttttagttcgcgcgttcgtagtttttcgttttcgtttgtttgttcgtttttttgtttgttcgcgttttcgttcgtttttttttcgaggatcgaggggattttgattatagtttgtggttgggaagggagatagaggcggcggcggtttaggggaaacgaggttgtagtggtggtagtaggaagatgtcgggcgaggacgagtaataggagtaaattatcgttgaggatttggtcgtgattaagtataagatggggggcgatatcgttaatagtgagtgcggtttcggg

SEQ ID NO: 34832 - DNA, 716 bp, Artificial Sequence
  chemically treated genomic DNA (Homo sapiens) CpG-island No: 34832
cccgaaaccgcactcactattaacgatatcgccccccatcttatacttaatcacgaccaaatcctcaacgataatttactcctattactcgtcctcgcccgacatcttcctactaccaccactacaacctcgtttcccctaaaccgccgccgcctctatctcccttcccaaccacaaactataatcaaaatcccctcgatcctcgaaaaaaaaacgaacgaaaacgcgaacaaacaaaaaaacgaacaaacaaacgaaaacgaaaaactacgaacgcgcgaactaaaacgcaaaacacgctaaaacaactaatcctctcgaccgccaaactctaaccgctctcgaaaaccttcgaactacaattcccaacctacctctcgcgctcttaaaccaaaccctaaaaccttaccctccaaaaacctcgcacgccgaaatcgccgaacactctaaaaaaaatcaaactccgacgaaaaaacgaaaccgttaaaaaacttaaaaaaaaacgtaatctctcccgaaaaaaccacttccaccgaaaacgctaaacgaaaaccaataacaaaaaaaaacgaactaaaaaaaaaaaaacgaaactacgacgaaaaaataaatttaaaatcgaacaaacaaaaataaaataaaataaaaccgcaacgaataaacaatatctacacctaaatcgaaaaaactaaatacgcccttcttcgaatccctaa

SEQ ID NO: 34833 - DNA, 805 bp, Artificial Sequence
  chemically treated genomic DNA (Homo sapiens) CpG-island No: 34833
gttattgtattttttttcgatttttcgttttttattttcgtcgtcgaggaacggtggtttattttttcgttttatattggtttttgtttggttcgggttagcgttaattcggttttcgtggaagtcgtggcgaaaggcgagaggggtaaaaagttgagaaataggcgagcgggagagataagtaggaaggttcgggtgggttcgggtaaggaagaagaagagagggtcgggttgcgcgttacgtttcgcgtcgcgcgttatttttcgcggggttttcgtaaaagtggtcgtcgttgagggtcgggtcgggttcgaggttttgtaggtatttggcgggcggtttggtcggttttgggaggtagggttttaggggttcgtaggtcggaaagcgggttagtcgcgggtcgcggggcggcgcggggtgtaggtgaggcgtaacggcgggggttttttgcgggttcggaggttcgtttttcgaggttatataggggtcgggtgtaggttttacgcggaaaggcgcgtagtgttcggggtttatgtcggtttagggcgtataggttttcggggtttcggggttcgcgttgttcgcgtcgtttgtgagcgttcgttaagggggagggatttgggcgcgggggcgcggagttttcgggagcggcgcgcgtcgcggggggcggggggcggggggtaggggaaggggtcgcgtttttgatttaatgttggaattatttacgttacgtgtggtttcgtgcgggttaatttttcggagttcgggaattttttttttttatttatttagagtttagtt

SEQ ID NO: 34834 - DNA, 805 bp, Artificial Sequence
  chemically treated genomic DNA (Homo sapiens) CpG-island No: 34834
aactaaactctaaataaataaaaaaaaaaaattcccgaactccgaaaaattaacccgcacgaaaccacacgtaacgtaaataattccaacattaaatcaaaaacgcgaccccttcccctaccccccgccccccgccccccgcgacgcgcgccgctcccgaaaactccgcgcccccgcgcccaaatccctcccccttaacgaacgctcacaaacgacgcgaacaacgcgaaccccgaaaccccgaaaacctatacgccctaaaccgacataaaccccgaacactacgcgcctttccgcgtaaaacctacacccgacccctatataacctcgaaaaacgaacctccgaacccgcaaaaaacccccgccgttacgcctcacctacaccccgcgccgccccgcgacccgcgactaacccgctttccgacctacgaacccctaaaaccctacctcccaaaaccgaccaaaccgcccgccaaatacctacaaaacctcgaacccgacccgaccctcaacgacgaccacttttacgaaaaccccgcgaaaaataacgcgcgacgcgaaacgtaacgcgcaacccgaccctctcttcttcttccttacccgaacccacccgaaccttcctacttatctctcccgctcgcctatttctcaactttttacccctctcgcctttcgccacgacttccacgaaaaccgaattaacgctaacccgaaccaaacaaaaaccaatataaaacgaaaaaataaaccaccgttcctcgacgacgaaaataaaaaacgaaaaatcgaaaaaaaatacaataac

SEQ ID NO: 34835 - DNA, 805 bp, Artificial Sequence
  chemically treated genomic DNA (Homo sapiens) CpG-island No: 34835
gattgggttttgggtgaatggggggagggggttttcgggtttcgaggggttaattcgtacggggttatacgtgacgtggatggttttagtattaagttagaggcgcggtttttttttttgtttttcgtttttcgtttttcgcggcgcgcgtcgttttcgggggtttcgcgttttcgcgtttaggttttttttttttggcgggcgtttataggcggcgcgggtagcgcgagtttcggagtttcggaggtttgtgcgttttgagtcggtatggatttcgagtattgcgcgttttttcgcgtggggtttgtattcggtttttatgtggtttcgggggacgagttttcgggttcgtagggaattttcgtcgttgcgttttatttgtatttcgcgtcgtttcgcggttcgcggttgattcgtttttcggtttgcgggtttttggagttttattttttagagtcggttaagtcgttcgttaagtatttgtaggatttcgggttcggttcggtttttaacggcggttatttttacgagggtttcgcggaaggtaacgcgcggcgcggggcgtagcgcgtagttcgatttttttttttttttttttattcgggtttattcgggtttttttgtttatttttttcgttcgtttattttttaattttttgtttttttcgtttttcgttacggtttttacggaagtcgggttggcgttggttcgggttaggtaaaggttagtgtggggcgggagggtgaattatcgtttttcggcggcgggaatgggaggcgggaggtcgagggaaggtgtagtggt

SEQ ID NO: 34836 - DNA, 805 bp, Artificial Sequence
  chemically treated genomic DNA (Homo sapiens) CpG-island No: 34836
accactacaccttccctcgacctcccgcctcccattcccgccgccgaaaaacgataattcaccctcccgccccacactaacctttacctaacccgaaccaacgccaacccgacttccgtaaaaaccgtaacgaaaaacgaaaaaaacaaaaaattaaaaaataaacgaacgaaaaaaataaacaaaaaaacccgaataaacccgaataaaaaaaaaaaaaaaaaaatcgaactacgcgctacgccccgcgccgcgcgttaccttccgcgaaaccctcgtaaaaataaccgccgttaaaaaccgaaccgaacccgaaatcctacaaatacttaacgaacgacttaaccgactctaaaaaataaaactccaaaaacccgcaaaccgaaaaacgaatcaaccgcgaaccgcgaaacgacgcgaaatacaaataaaacgcaacgacgaaaattccctacgaacccgaaaactcgtcccccgaaaccacataaaaaccgaatacaaaccccacgcgaaaaaacgcgcaatactcgaaatccataccgactcaaaacgcacaaacctccgaaactccgaaactcgcgctacccgcgccgcctataaacgcccgccaaaaaaaaaaaacctaaacgcgaaaacgcgaaacccccgaaaacgacgcgcgccgcgaaaaacgaaaaacgaaaaacaaaaaaaaaaaccgcgcctctaacttaatactaaaaccatccacgtcacgtataaccccgtacgaattaacccctcgaaacccgaaaaccccctccccccattcacccaaaacccaatc

SEQ ID NO: 34837 - DNA, 568 bp, Artificial Sequence
  chemically treated genomic DNA (Homo sapiens) CpG-island No: 34837
gttacgcgtgggtagtcgcgtagattcggttcgtgtatttcggtcgagtagttgcggttttcgacgggtcgcggacgtatagtttttttttcgggttataggttttcggttggggttggggcgattcggagttgcgcgtcggcgtacgcgatttcgttcgttttttattttttgttttattattagttttaatttggttttcgttcgtcgcgcgttcggggtttaggggagcggcgcgggaatttaggttttacggcggagagagcgcgcgggattgcgaagattggggtcgagtgtcgttttttttgcgttttggtagcgtcggttttgcggagtagaacggagttgggcggagcgttgcgcgtattgttttttcgtttttcgaaaggttattttggcggcggggcgtcgtgacgtaggtttgatttacgcgcgggtcggcgttaatgcgaggttttcgggtagcgagcgaggttttgatggtcgacgtaggcggaaagggtgggcgtggggcgggaaagggagttgtaagggggtttagttttttgaggtttttggttaggggatg

SEQ ID NO: 34838 - DNA, 568 bp, Artificial Sequence
  chemically treated genomic DNA (Homo sapiens) CpG-island No: 34838
catcccctaaccaaaaacctcaaaaaactaaacccccttacaactccctttcccgccccacgcccaccctttccgcctacgtcgaccatcaaaacctcgctcgctacccgaaaacctcgcattaacgccgacccgcgcgtaaatcaaacctacgtcacgacgccccgccgccaaaataacctttcgaaaaacgaaaaaacaatacgcgcaacgctccgcccaactccgttctactccgcaaaaccgacgctaccaaaacgcaaaaaaaacgacactcgaccccaatcttcgcaatcccgcgcgctctctccgccgtaaaacctaaattcccgcgccgctcccctaaaccccgaacgcgcgacgaacgaaaaccaaattaaaactaataataaaacaaaaaataaaaaacgaacgaaatcgcgtacgccgacgcgcaactccgaatcgccccaaccccaaccgaaaacctataacccgaaaaaaaaactatacgtccgcgacccgtcgaaaaccgcaactactcgaccgaaatacacgaaccgaatctacgcgactacccacgcgtaac

SEQ ID NO: 34839 - DNA, 568 bp, Artificial Sequence
  chemically treated genomic DNA (Homo sapiens) CpG-island No: 34839
tattttttgattaggggttttaagaagttaagtttttttgtaattttttttttcgttttacgtttatttttttcgtttacgtcggttattagagtttcgttcgttgttcgagagtttcgtattgacgtcggttcgcgcgtgagttaagtttgcgttacggcgtttcgtcgttagggtggtttttcggaaagcgagggaatagtgcgcgtagcgtttcgtttagtttcgttttgtttcgtaaagtcggcgttgttagggcgtagggagggcggtattcggttttagttttcgtaatttcgcgcgtttttttcgtcgtgggatttgggttttcgcgtcgtttttttgagtttcgagcgcgcggcgggcgggagttaggttgggattggtggtgaggtagggagtgaggagcgagcggagtcgcgtgcgtcggcgcgtagtttcgggtcgttttagttttagtcgggggtttgtggttcgggggaggagttgtgcgttcgcgattcgtcggggatcgtagttgttcggtcggagtgtacgggtcgagtttgcgcgattatttacgcgtgat

SEQ ID NO: 34840 - DNA, 568 bp, Artificial Sequence
  chemically treated genomic DNA (Homo sapiens) CpG-island No: 34840
atcacgcgtaaataatcgcgcaaactcgacccgtacactccgaccgaacaactacgatccccgacgaatcgcgaacgcacaactcctcccccgaaccacaaacccccgactaaaactaaaacgacccgaaactacgcgccgacgcacgcgactccgctcgctcctcactccctacctcaccaccaatcccaacctaactcccgcccgccgcgcgctcgaaactcaaaaaaacgacgcgaaaacccaaatcccacgacgaaaaaaacgcgcgaaattacgaaaactaaaaccgaataccgccctccctacgccctaacaacgccgactttacgaaacaaaacgaaactaaacgaaacgctacgcgcactattccctcgctttccgaaaaaccaccctaacgacgaaacgccgtaacgcaaacttaactcacgcgcgaaccgacgtcaatacgaaactctcgaacaacgaacgaaactctaataaccgacgtaaacgaaaaaaataaacgtaaaacgaaaaaaaaaattacaaaaaaacttaacttcttaaaacccctaatcaaaaaata

SEQ ID NO: 34841 - DNA, 827 bp, Artificial Sequence
  chemically treated genomic DNA (Homo sapiens) CpG-island No: 34841
gcggcgtttaggtcgtttaacgcgcgtttttcgttcggcgtttcgaagcggtttcgaggggcgggagtcgaggcgagcggtaaggtcgggtcgggggcgtatagcgtttttagaagtgcgggttttttttattttcggtagcgattttatttttcgttttcgttgcgtgcgcgcgtgtgttcgtttgtttgtatgttttttcgacgttagtgggaatttttagttaggaagtgagagagtgagcgagatagaaagagagagaagtgtattagcgagtcggggtaggaagaggaggtttcgttatcggagcggttcggcgacgcgttgatagttttttttgtttttttcgtcggtcgggtcgttagtcgtcgtagttttcggtttgtacgtagttatcggtttcgttttcggagtttagcgtcgtcgaggtcgtagtcgttcggttagtaaggcggcgtcgtcgttcggttatcgcgcgttttgcgttttttttcgttcgcgttgcggttatggcgcggcgttgattggtttggttcggtttcgtcgcgttttcgttcgtttcgattcgtattcgggttcgttcgggtttcggtttgtcgtcgttttttttttttttagtcggtaggttcgcgtcgtttaggagggagagtttattcgcgttaggaggtcgaacgcggattcgttattcgggtaagttaaattcgggcgagtgggggttcggtaggggacgcgtggtttaagttttgtcgtttagtttttcgtattttttttagttttattcggatttttttatttttgcgttaatcgttgggttagatcgtgggagg

SEQ ID NO: 34842 - DNA, 827 bp, Artificial Sequence
  chemically treated genomic DNA (Homo sapiens) CpG-island No: 34842
cctcccacgatctaacccaacgattaacgcaaaaataaaaaaatccgaataaaactaaaaaaaatacgaaaaactaaacgacaaaacttaaaccacgcgtcccctaccgaacccccactcgcccgaatttaacttacccgaataacgaatccgcgttcgacctcctaacgcgaataaactctccctcctaaacgacgcgaacctaccgactaaaaaaaaaaaaaacgacgacaaaccgaaacccgaacgaacccgaatacgaatcgaaacgaacgaaaacgcgacgaaaccgaaccaaaccaatcaacgccgcgccataaccgcaacgcgaacgaaaaaaaacgcaaaacgcgcgataaccgaacgacgacgccgccttactaaccgaacgactacgacctcgacgacgctaaactccgaaaacgaaaccgataactacgtacaaaccgaaaactacgacgactaacgacccgaccgacgaaaaaaacaaaaaaaactatcaacgcgtcgccgaaccgctccgataacgaaacctcctcttcctaccccgactcgctaatacacttctctctctttctatctcgctcactctctcacttcctaactaaaaattcccactaacgtcgaaaaaacatacaaacaaacgaacacacgcgcgcacgcaacgaaaacgaaaaataaaatcgctaccgaaaataaaaaaaacccgcacttctaaaaacgctatacgcccccgacccgaccttaccgctcgcctcgactcccgcccctcgaaaccgcttcgaaacgccgaacgaaaaacgcgcgttaaacgacctaaacgccgc

SEQ ID NO: 34843 - DNA, 827 bp, Artificial Sequence
  chemically treated genomic DNA (Homo sapiens) CpG-island No: 34843
ttttttacggtttagtttagcggttagcgtaggaatgaggaagttcgagtggggttggagggggtgcggagggttgggcggtaggatttgggttacgcgttttttgtcgggtttttattcgttcgagtttggtttattcgggtggcgagttcgcgttcggttttttggcgcgggtgggtttttttttttaagcggcgcgggtttgtcggttggagaaggaagaggcggcggtaggtcggagttcgggcgggttcgagtgcgggtcggggcgagcgggagcgcggcggggtcgggttaggttagttagcgtcgcgttatggtcgtagcgcgggcggagggaagcgtagggcgcgcggtggtcgggcggcggcgtcgttttattggtcgggcggttgcggtttcggcggcgttgggtttcgggagcggggtcggtggttgcgtgtaggtcgagggttgcggcggttggcggttcgatcgacgggaagggtaggggaagttgttagcgcgtcgtcgggtcgtttcggtggcgaaattttttttttttgtttcggttcgttggtgtatttttttttttttttgtttcgtttatttttttattttttggttggaaatttttattgacgtcgagagagtatatagatagacggatatacgcgcgtacgtagcgggggcgggaggtagggtcgttgtcgggggtgggggaagttcgtatttttaggggcgttgtgcgttttcggttcggttttgtcgttcgtttcggttttcgtttttcggggtcgtttcggggcgtcgggcgaggggcgcgcgttaggcggtttggacgtcgt

SEQ ID NO: 34844 - DNA, 827 bp, Artificial Sequence
  chemically treated genomic DNA (Homo sapiens) CpG-island No: 34844
acgacgtccaaaccgcctaacgcgcgcccctcgcccgacgccccgaaacgaccccgaaaaacgaaaaccgaaacgaacgacaaaaccgaaccgaaaacgcacaacgcccctaaaaatacgaacttcccccacccccgacaacgaccctacctcccgcccccgctacgtacgcgcgtatatccgtctatctatatactctctcgacgtcaataaaaatttccaaccaaaaaataaaaaaataaacgaaacaaaaaaaaaaaaaaatacaccaacgaaccgaaacaaaaaaaaaaaatttcgccaccgaaacgacccgacgacgcgctaacaacttcccctacccttcccgtcgatcgaaccgccaaccgccgcaaccctcgacctacacgcaaccaccgaccccgctcccgaaacccaacgccgccgaaaccgcaaccgcccgaccaataaaacgacgccgccgcccgaccaccgcgcgccctacgcttccctccgcccgcgctacgaccataacgcgacgctaactaacctaacccgaccccgccgcgctcccgctcgccccgacccgcactcgaacccgcccgaactccgacctaccgccgcctcttccttctccaaccgacaaacccgcgccgcttaaaaaaaaaaacccacccgcgccaaaaaaccgaacgcgaactcgccacccgaataaaccaaactcgaacgaataaaaacccgacaaaaaacgcgtaacccaaatcctaccgcccaaccctccgcaccccctccaaccccactcgaacttcctcattcctacgctaaccgctaaactaaaccgtaaaaaa

SEQ ID NO: 34845 - DNA, 504 bp, Artificial Sequence
  chemically treated genomic DNA (Homo sapiens) CpG-island No: 34845
agcgtttgttttcgagtttttatcgtcggtttatcggtgggtacgggtagttcgggtgcggtttcgttgataatttttcgtatcgttcgtagcgttattttgttttttttgtttcgattggtttagtagcgacgtcgcgtacgcgtagatatattaaggcggttcgcggttcgaggtttcgtttatgcgcgttgcggcgtttcggtttcgtttcgtttttttcgtcgtcggtcgtttttagtttcgtgatttcgcgtcgttggggttagatttgtttgcgagtaagaggagttgattagcgtgttgggaggcgcgcgcgggcgtagagggaagggaagcgaaagaggggagatggaaggagagaggaaagttagtcgaaagagaggcgtataagcggagtgaggggaggaaggtaaacgcgtgtaggttaacgttagttgatatttatttcgaatgggttttcgtgacgttgaatggagagaatttaagttgtgaaaatcgttt

SEQ ID NO: 34846 - DNA, 504 bp, Artificial Sequence
  chemically treated genomic DNA (Homo sapiens) CpG-island No: 34846
aaacgattttcacaacttaaattctctccattcaacgtcacgaaaacccattcgaaataaatatcaactaacgttaacctacacgcgtttaccttcctcccctcactccgcttatacgcctctctttcgactaactttcctctctccttccatctcccctctttcgcttcccttccctctacgcccgcgcgcgcctcccaacacgctaatcaactcctcttactcgcaaacaaatctaaccccaacgacgcgaaatcacgaaactaaaaacgaccgacgacgaaaaaaacgaaacgaaaccgaaacgccgcaacgcgcataaacgaaacctcgaaccgcgaaccgccttaatatatctacgcgtacgcgacgtcgctactaaaccaatcgaaacaaaaaaaacaaaataacgctacgaacgatacgaaaaattatcaacgaaaccgcacccgaactacccgtacccaccgataaaccgacgataaaaactcgaaaacaaacgct

SEQ ID NO: 34847 - DNA, 504 bp, Artificial Sequence
  chemically treated genomic DNA (Homo sapiens) CpG-island No: 34847
aagcggtttttatagtttgagttttttttatttagcgttacgaaagtttattcgaaatggatattagttgacgttggtttgtacgcgtttgtttttttttttttatttcgtttgtgcgtttttttttcggttggtttttttttttttttttattttttttttttcgttttttttttttttgcgttcgcgcgcgttttttagtacgttggttagttttttttgttcgtaagtaggtttggttttagcggcgcgaagttacgaggttgggggcggtcggcggcgaagggggcggggcgaggtcggggcgtcgtagcgcgtataggcggagtttcgggtcgcgggtcgttttggtatatttgcgcgtgcgcggcgtcgttgttgggttagtcgggatagaggagataagatggcgttgcgggcgatgcgggggattgttaacggggtcgtattcgagttattcgtgtttatcggtgggtcggcggtgggagttcgggagtaggcgtt

SEQ ID NO: 34848 - DNA, 504 bp, Artificial Sequence
  chemically treated genomic DNA (Homo sapiens) CpG-island No: 34848
aacgcctactcccgaactcccaccgccgacccaccgataaacacgaataactcgaatacgaccccgttaacaatcccccgcatcgcccgcaacgccatcttatctcctctatcccgactaacccaacaacgacgccgcgcacgcgcaaatataccaaaacgacccgcgacccgaaactccgcctatacgcgctacgacgccccgacctcgccccgcccccttcgccgccgaccgcccccaacctcgtaacttcgcgccgctaaaaccaaacctacttacgaacaaaaaaaactaaccaacgtactaaaaaacgcgcgcgaacgcaaaaaaaaaaaaaacgaaaaaaaaaaaataaaaaaaaaaaaaaaaaccaaccgaaaaaaaaacgcacaaacgaaataaaaaaaaaaaaacaaacgcgtacaaaccaacgtcaactaatatccatttcgaataaactttcgtaacgctaaataaaaaaaactcaaactataaaaaccgctt

SEQ ID NO: 34849 - DNA, 634 bp, Artificial Sequence
  chemically treated genomic DNA (Homo sapiens) CpG-island No: 34849
ttcgtcggcgggatggtttggggtagcggcgtgttgtttataggtcggggttttggtggttgtatacgacgttcgtattttcgtcgtgttcgtagttgtgggtgtttacgtcgttgtgttggtattttagtaggtttcgtttttagttcgcgtagcgtatatcgtttagtagaatgggtagcgagtcgttttggtcgaattcggtttttttgacggcgcgtacggcgtaggtaaattttagttggcgatatacgacggcggcgtcgttgatgttttaggagtcgtcgtatacggtgttttagcgttcgtttacgaatatttttacgcgttcgttgttagagtttaggttcgcgggtcgtattaggcgtatttcgttatttcggaacgttcggttcgtcgagtttagtcgttttcgtcgtcgttcgtcgttttttcggttttttggttgttgggtgggtcgcgttggtcgcggggttggcgcggggggagcggtcgtggggcgttttcggcgggcgttcgcgtgggcgttcgcgttgtaggtcgcggggtgtttcgtgttttcgggatgaattttgcgtagaggaagagtatgtcgttagagggatttaggcgtttttgtttagttttgttgttt

SEQ ID NO: 34850 - DNA, 634 bp, Artificial Sequence
  chemically treated genomic DNA (Homo sapiens) CpG-island No: 34850
aaacaacaaaactaaacaaaaacgcctaaatccctctaacgacatactcttcctctacgcaaaattcatcccgaaaacacgaaacaccccgcgacctacaacgcgaacgcccacgcgaacgcccgccgaaaacgccccacgaccgctccccccgcgccaaccccgcgaccaacgcgacccacccaacaaccaaaaaaccgaaaaaacgacgaacgacgacgaaaacgactaaactcgacgaaccgaacgttccgaaataacgaaatacgcctaatacgacccgcgaacctaaactctaacaacgaacgcgtaaaaatattcgtaaacgaacgctaaaacaccgtatacgacgactcctaaaacatcaacgacgccgccgtcgtatatcgccaactaaaatttacctacgccgtacgcgccgtcaaaaaaaccgaattcgaccaaaacgactcgctacccattctactaaacgatatacgctacgcgaactaaaaacgaaacctactaaaataccaacacaacgacgtaaacacccacaactacgaacacgacgaaaatacgaacgtcgtatacaaccaccaaaaccccgacctataaacaacacgccgctaccccaaaccatcccgccgacgaa

SEQ ID NO: 34851 - DNA, 634 bp, Artificial Sequence
  chemically treated genomic DNA (Homo sapiens) CpG-island No: 34851
gggtagtagggttggataggggcgtttgggtttttttgacggtatattttttttttgcgtagagtttatttcgaagatacggagtatttcgcggtttatagcgcgggcgtttacgcgggcgttcgtcgagggcgttttacggtcgtttttttcgcgttaatttcgcggttagcgcggtttatttagtagttagggagtcggaggggcggcgggcggcggcgggggcggttgaattcggcgagtcgggcgtttcgggatggcgaggtgcgtttggtgcggttcgcgggtttgagttttggtagcgggcgcgtggaggtgttcgtgggcggacgttggggtatcgtgtgcgacgatttttggaatattagcggcgtcgtcgtcgtgtgtcgttagttggggtttgtttacgtcgtgcgcgtcgttaagagagtcgagttcggttagggcggttcgttgtttattttgttggacgatgtgcgttgcgcgggttgggagcggaatttgttggagtgttagtataacggcgtgggtatttataattgcgagtacgacgaggatgcgggcgtcgtgtgtagttattagaatttcgatttgtaggtaatacgtcgttgttttaggttatttcgtcggcggg

SEQ ID NO: 34852 - DNA, 634 bp, Artificial Sequence
  chemically treated genomic DNA (Homo sapiens) CpG-island No: 34852
cccgccgacgaaataacctaaaacaacgacgtattacctacaaatcgaaattctaataactacacacgacgcccgcatcctcgtcgtactcgcaattataaatacccacgccgttatactaacactccaacaaattccgctcccaacccgcgcaacgcacatcgtccaacaaaataaacaacgaaccgccctaaccgaactcgactctcttaacgacgcgcacgacgtaaacaaaccccaactaacgacacacgacgacgacgccgctaatattccaaaaatcgtcgcacacgataccccaacgtccgcccacgaacacctccacgcgcccgctaccaaaactcaaacccgcgaaccgcaccaaacgcacctcgccatcccgaaacgcccgactcgccgaattcaaccgcccccgccgccgcccgccgcccctccgactccctaactactaaataaaccgcgctaaccgcgaaattaacgcgaaaaaaacgaccgtaaaacgccctcgacgaacgcccgcgtaaacgcccgcgctataaaccgcgaaatactccgtatcttcgaaataaactctacgcaaaaaaaaaatataccgtcaaaaaaacccaaacgcccctatccaaccctactaccc

SEQ ID NO: 34853 - DNA, 510 bp, Artificial Sequence
  chemically treated genomic DNA (Homo sapiens) CpG-island No: 34853
atagcgttcgcgtttttagtcggggtaagcggaagaaaataaaggttcggttttattagggtattaatttcgttcgtcggtttttttttcggtttttaatgagtttttagagtgttattacgttagttttttttcgcgattgattggtcggggtttttttagtgtgagcggttttggttaattagcgttcgttagtttattttacgaggtcgtagttagtttcgttggcggtcgaggtcggttgaagtgggcggagcggcgggcggggcgtcgtcgtattaggtttgttttttgttcggttagtttttcgaagtatttattttataggtttagtcggtcggtgagcgtttggggatcgtagaggtgagagtcgcgttcgggagttcgtcgtttgcgttaggatggagttcgtgaaatgttttggttatttcgaagagttttataatttggtgcgttttcggatcgggggtaagcggaaggtgatgtttaagatggattaggtgggtcgag

SEQ ID NO: 34854 - DNA, 510 bp, Artificial Sequence
  chemically treated genomic DNA (Homo sapiens) CpG-island No: 34854
ctcgacccacctaatccatcttaaacatcaccttccgcttacccccgatccgaaaacgcaccaaattataaaactcttcgaaataaccaaaacatttcacgaactccatcctaacgcaaacgacgaactcccgaacgcgactctcacctctacgatccccaaacgctcaccgaccgactaaacctataaaataaatacttcgaaaaactaaccgaacaaaaaacaaacctaatacgacgacgccccgcccgccgctccgcccacttcaaccgacctcgaccgccaacgaaactaactacgacctcgtaaaataaactaacgaacgctaattaaccaaaaccgctcacactaaaaaaaccccgaccaatcaatcgcgaaaaaaaactaacgtaataacactctaaaaactcattaaaaaccgaaaaaaaaaccgacgaacgaaattaataccctaataaaaccgaacctttattttcttccgcttaccccgactaaaaacgcgaacgctat

SEQ ID NO: 34855 - DNA, 510 bp, Artificial Sequence
  chemically treated genomic DNA (Homo sapiens) CpG-island No: 34855
ttcggtttatttggtttattttgggtattatttttcgtttgttttcgattcggaagcgtattaggttgtagaatttttcggggtggttaaggtattttacgaattttattttggcgtaggcggcggattttcgggcgcgatttttatttttgcggtttttaggcgtttatcggtcggttggatttgtggagtaggtgtttcgaggggttggtcggatagggggtaggtttagtacggcgacgtttcgttcgtcgtttcgtttattttaatcggtttcggtcgttagcggggttagttgcggtttcgtggggtgggttgacgggcgttgattggttagggtcgtttatattaggaagatttcggttaattagtcgcggaaggagattggcgtgataatattttagaagtttattggaggtcgagaaagaggtcgacgagcgggattggtgttttgatggagtcgggtttttgttttttttcgtttatttcggttgggagcgcgaacgttgt

SEQ ID NO: 34856 - DNA, 510 bp, Artificial Sequence
  chemically treated genomic DNA (Homo sapiens) CpG-island No: 34856
acaacgttcgcgctcccaaccgaaataaacgaaaaaaaacaaaaacccgactccatcaaaacaccaatcccgctcgtcgacctctttctcgacctccaataaacttctaaaatattatcacgccaatctccttccgcgactaattaaccgaaatcttcctaatataaacgaccctaaccaatcaacgcccgtcaacccaccccacgaaaccgcaactaaccccgctaacgaccgaaaccgattaaaataaacgaaacgacgaacgaaacgtcgccgtactaaacctaccccctatccgaccaacccctcgaaacacctactccacaaatccaaccgaccgataaacgcctaaaaaccgcaaaaataaaaatcgcgcccgaaaatccgccgcctacgccaaaataaaattcgtaaaataccttaaccaccccgaaaaattctacaacctaatacgcttccgaatcgaaaacaaacgaaaaataatacccaaaataaaccaaataaaccgaa

SEQ ID NO: 34857 - DNA, 833 bp, Artificial Sequence
  chemically treated genomic DNA (Homo sapiens) CpG-island No: 34857
tcggtagtttggttcggagatatcgaggtttaggcgttgggagcgcggttttaggtagtagttttcggattcggtcgagttttttttcgtaggcgtttttttcggcggttttggtcgcgttttcgtttcgagggtcggggttcggcgtatagttcggggaggggagcggagggtagagggttggcgggcggagttgttttttgtttttttcgtcgacgtttcggagcgcgcggatttttattttagttcgttcgttagggatagtttcgagggtttcggtttttcgtcggtttttagggacgtcgcggggtcgcgtttgggttcgattgagggcgtagaggaattcgtttcggcggtcgggtagtatcgttttcgttaaggttatttacgttgcggtggtttcgggtttttagtatttatttagcgttgtagtcgagagtttgtagtttagtttgcgcgtagcggagcggttggcgttgtcggagcggttgtcggagttttgtagtcgtcgtagtttgggttagtttcggttttaagtattttttcggtttcgttttacgtgattatcgcgtagtttcgttcgggttttttcgtcgttcgcgtacggtgttttttagtttttattttttttcgttatttttcgtcgttcgcgtttttcgtttttcggtttcgtatatttttcgttttttttcgttcggggttcggggttatcgtcgggggcgggcgggggtttgagcgcgcgggttggggaagaagggtttggagttttgcgggttttgggtggcgaaacgttgcgaattggggttaggggatggggaaaaagtttttaaagg

SEQ ID NO: 34858 - DNA, 833 bp, Artificial Sequence
  chemically treated genomic DNA (Homo sapiens) CpG-island No: 34858
cctttaaaaactttttccccatcccctaaccccaattcgcaacgtttcgccacccaaaacccgcaaaactccaaacccttcttccccaacccgcgcgctcaaacccccgcccgcccccgacgataaccccgaaccccgaacgaaaaaaaacgaaaaatatacgaaaccgaaaaacgaaaaacgcgaacgacgaaaaataacgaaaaaaaataaaaactaaaaaacaccgtacgcgaacgacgaaaaaacccgaacgaaactacgcgataatcacgtaaaacgaaaccgaaaaaatacttaaaaccgaaactaacccaaactacgacgactacaaaactccgacaaccgctccgacaacgccaaccgctccgctacgcgcaaactaaactacaaactctcgactacaacgctaaataaatactaaaaacccgaaaccaccgcaacgtaaataaccttaacgaaaacgatactacccgaccgccgaaacgaattcctctacgccctcaatcgaacccaaacgcgaccccgcgacgtccctaaaaaccgacgaaaaaccgaaaccctcgaaactatccctaacgaacgaactaaaataaaaatccgcgcgctccgaaacgtcgacgaaaaaaacaaaaaacaactccgcccgccaaccctctaccctccgctcccctccccgaactatacgccgaaccccgaccctcgaaacgaaaacgcgaccaaaaccgccgaaaaaaacgcctacgaaaaaaaactcgaccgaatccgaaaactactacctaaaaccgcgctcccaacgcctaaacctcgatatctccgaaccaaactaccga

SEQ ID NO: 34859 - DNA, 833 bp, Artificial Sequence
  chemically treated genomic DNA (Homo sapiens) CpG-island No: 34859
tttttaggggttttttttttattttttggttttaattcgtagcgtttcgttatttagggttcgtagggttttaagttttttttttttagttcgcgcgtttaggttttcgttcgttttcggcggtggtttcggatttcgagcggaagggggcggggggtgtgcggggtcgggaagcggggagcgcgggcggcggaaggtggcgggagggggtgggggttgggaagtatcgtgcgcgggcggcgggagggttcgggcggggttgcgcggtggttacgtggggcggggtcgggagggtatttagggtcggggttggtttaggttacggcggttgtagggtttcggtaatcgtttcggtaacgttaatcgtttcgttgcgcgtaggttgggttgtaggttttcggttgtagcgttgggtgagtgttggggattcggggttatcgtagcgtaagtgattttggcggggacggtgttattcggtcgtcgagacgggtttttttgcgtttttagtcgggtttaggcgcggtttcgcggcgtttttgggggtcggcggggagtcgggattttcgggattgtttttgacgggcgggttggggtgggagttcgcgcgtttcgaagcgtcggcgagaaaagtagaaaatagtttcgttcgttagttttttgtttttcgttttttttttcgggttgtgcgtcggatttcggttttcggagcggggacgcggttaggatcgtcgagggaggcgtttgcgaggaagagttcggtcgggttcggagattgttgtttgggatcgcgtttttagcgtttgggtttcggtgttttcgggttaaattgtcga

SEQ ID NO: 34860 - DNA, 833 bp, Artificial Sequence
  chemically treated genomic DNA (Homo sapiens) CpG-island No: 34860
tcgacaatttaacccgaaaacaccgaaacccaaacgctaaaaacgcgatcccaaacaacaatctccgaacccgaccgaactcttcctcgcaaacgcctccctcgacgatcctaaccgcgtccccgctccgaaaaccgaaatccgacgcacaacccgaaaaaaaaaacgaaaaacaaaaaactaacgaacgaaactattttctacttttctcgccgacgcttcgaaacgcgcgaactcccaccccaacccgcccgtcaaaaacaatcccgaaaatcccgactccccgccgacccccaaaaacgccgcgaaaccgcgcctaaacccgactaaaaacgcaaaaaaacccgtctcgacgaccgaataacaccgtccccgccaaaatcacttacgctacgataaccccgaatccccaacactcacccaacgctacaaccgaaaacctacaacccaacctacgcgcaacgaaacgattaacgttaccgaaacgattaccgaaaccctacaaccgccgtaacctaaaccaaccccgaccctaaataccctcccgaccccgccccacgtaaccaccgcgcaaccccgcccgaaccctcccgccgcccgcgcacgatacttcccaacccccaccccctcccgccaccttccgccgcccgcgctccccgcttcccgaccccgcacaccccccgcccccttccgctcgaaatccgaaaccaccgccgaaaacgaacgaaaacctaaacgcgcgaactaaaaaaaaaaaacttaaaaccctacgaaccctaaataacgaaacgctacgaattaaaaccaaaaaataaaaaaaaaacccctaaaaa

SEQ ID NO: 34861 - DNA, 648 bp, Artificial Sequence
  chemically treated genomic DNA (Homo sapiens) CpG-island No: 34861
agcgaagcgattcgagggttagcgaataagcgttggattttcgtaggtttcggcgattttagattcggtttttcggcgaagataggaaaacgtgtgtcgagagtcgttggagggaatcgttcgtaaatcgaagaagaaattaaattagtagcgaatatttgtaaattagtgttaagttgtgagtttttcgagattaatacgataagcgatgcgacgattttacggaggatcgagggaggaggttttattcgttttaggaagagttttttgtttttttttattaaatcgttgaggagagacgagcgtttcgtttcggattttttcgcgttatcggggcgtaaacggatagtgtttagcgaggtgttcgagcggttttcgagttttttttaaattttagagtcgggtagcgttttttttcgagagaaggagtttttaggtagtcgggaggaggtaggtttcgttggttttgcgttttagacgcggtttttagcgtagtcgtgcgtttcgaggcgcgttcgtttttaatcgtgatttcggttagtcggttttcgtaatttaagtgtttcggaaatcgggggtcggatcggggcgagtattggttttatttaacgggttaattttagttcgggtggttgtagtagtgggttt

SEQ ID NO: 34862 - DNA, 648 bp, Artificial Sequence
  chemically treated genomic DNA (Homo sapiens) CpG-island No: 34862
aaacccactactacaaccacccgaactaaaattaacccgttaaataaaaccaatactcgccccgatccgacccccgatttccgaaacacttaaattacgaaaaccgactaaccgaaatcacgattaaaaacgaacgcgcctcgaaacgcacgactacgctaaaaaccgcgtctaaaacgcaaaaccaacgaaacctacctcctcccgactacctaaaaactccttctctcgaaaaaaaacgctacccgactctaaaatttaaaaaaaactcgaaaaccgctcgaacacctcgctaaacactatccgtttacgccccgataacgcgaaaaaatccgaaacgaaacgctcgtctctcctcaacgatttaataaaaaaaaacaaaaaactcttcctaaaacgaataaaacctcctccctcgatcctccgtaaaatcgtcgcatcgcttatcgtattaatctcgaaaaactcacaacttaacactaatttacaaatattcgctactaatttaatttcttcttcgatttacgaacgattccctccaacgactctcgacacacgttttcctatcttcgccgaaaaaccgaatctaaaatcgccgaaacctacgaaaatccaacgcttattcgctaaccctcgaatcgcttcgct

SEQ ID NO: 34863 - DNA, 648 bp, Artificial Sequence
  chemically treated genomic DNA (Homo sapiens) CpG-island No: 34863
aaatttattgttgtagttattcgggttggagttggttcgttgggtggagttagtgttcgtttcggttcgattttcggttttcgggatatttgggttgcggaggtcggttggtcggagttacggttggggacgggcgcgtttcggagcgtacggttgcgttggaagtcgcgtttggggcgtaggattaacgggatttattttttttcggttatttaaagattttttttttcgggaaagagcgttgttcggttttgggatttgggaggagttcggaggtcgttcgggtatttcgttggatattattcgtttgcgtttcggtggcgcgggagggttcggagcggagcgttcgtttttttttagcggtttagtggagaaaagtagagagttttttttggggcgaatgggattttttttttcggtttttcgtggagtcgtcgtatcgtttgtcgtgttggtttcgaggggtttatagtttggtattaatttgtaggtgttcgttgttgatttggtttttttttcgatttgcggacggttttttttagcgattttcgatatacgtttttttgttttcgtcggagggtcgggtttggggtcgtcggagtttgcgggaatttagcgtttattcgttgattttcgagtcgtttcgtt

SEQ ID NO: 34864 - DNA, 648 bp, Artificial Sequence
  chemically treated genomic DNA (Homo sapiens) CpG-island No: 34864
aacgaaacgactcgaaaatcaacgaataaacgctaaattcccgcaaactccgacgaccccaaacccgaccctccgacgaaaacaaaaaaacgtatatcgaaaatcgctaaaaaaaaccgtccgcaaatcgaaaaaaaaaccaaatcaacaacgaacacctacaaattaataccaaactataaacccctcgaaaccaacacgacaaacgatacgacgactccacgaaaaaccgaaaaaaaaaatcccattcgccccaaaaaaaactctctacttttctccactaaaccgctaaaaaaaaacgaacgctccgctccgaaccctcccgcgccaccgaaacgcaaacgaataatatccaacgaaatacccgaacgacctccgaactcctcccaaatcccaaaaccgaacaacgctctttcccgaaaaaaaaaatctttaaataaccgaaaaaaaataaatcccgttaatcctacgccccaaacgcgacttccaacgcaaccgtacgctccgaaacgcgcccgtccccaaccgtaactccgaccaaccgacctccgcaacccaaatatcccgaaaaccgaaaatcgaaccgaaacgaacactaactccacccaacgaaccaactccaacccgaataactacaacaataaattt

SEQ ID NO: 34865 - DNA, 711 bp, Artificial Sequence
  chemically treated genomic DNA (Homo sapiens) CpG-island No: 34865
gcgtgttcgttacgtgggtcgttattgagcgagcgcgttttcgacgtttttttaaaagtttttttcgttttttttttcgttcgcgtatacgtgcgcgcgtattttcgttttacgtgggggtttcgtcgtcgtagtcgtcgtagtcgtcgtttttagtttattttttttcggtatttggttttaaattcgggttttaagtcgatcgttttttatttttattttttttttttttattttttttttttcgtgtttggtttttattacgtgtttcgagtttttgtttattttttacgcggggtcggacgtaacgggttatttggggaggcgtcgtcgtcgtggtcgtttttcgttttcgttacggtatttgttcgggtggttatcgttgtaggaagttcgatagcggcgtcgcggcgtttttaggtgggttttcgtttttcgtttttgttatttttcgtagtattagcggtttttttcggttttttttttttttttcgttgggattggcgggcggcggcggcggcggcgatcgttgttgttgttgttgttgttgttgtaggcgcgtttattatatcgtttgttggtaatcgcggttcgtgtagcgttcgcgggtcgggcgtcgtcgaggtttttttcggttagtttttgtttttgggcgaagtttggtttttcgagggcgggttgtagtttattttttgtaatcgtttaatttgg

SEQ ID NO: 34866 - DNA, 711 bp, Artificial Sequence
  chemically treated genomic DNA (Homo sapiens) CpG-island No: 34866
ccaaattaaacgattacaaaaaataaactacaacccgccctcgaaaaaccaaacttcgcccaaaaacaaaaactaaccgaaaaaaacctcgacgacgcccgacccgcgaacgctacacgaaccgcgattaccaacaaacgatataataaacgcgcctacaacaacaacaacaacaacaacaacgatcgccgccgccgccgccgcccgccaatcccaacgaaaaaaaaaaaaaaaaccgaaaaaaaccgctaatactacgaaaaataacaaaaacgaaaaacgaaaacccacctaaaaacgccgcgacgccgctatcgaacttcctacaacgataaccacccgaacaaataccgtaacgaaaacgaaaaacgaccacgacgacgacgcctccccaaataacccgttacgtccgaccccgcgtaaaaaataaacaaaaactcgaaacacgtaataaaaaccaaacacgaaaaaaaaaaaataaaaaaaaaaaaaataaaaataaaaaacgatcgacttaaaacccgaatttaaaaccaaataccgaaaaaaaataaactaaaaacgacgactacgacgactacgacgacgaaacccccacgtaaaacgaaaatacgcgcgcacgtatacgcgaacgaaaaaaaaaacgaaaaaaacttttaaaaaaacgtcgaaaacgcgctcgctcaataacgacccacgtaacgaacacgc

SEQ ID NO: 34867 - DNA, 711 bp, Artificial Sequence
  chemically treated genomic DNA (Homo sapiens) CpG-island No: 34867
ttaggttggacggttgtaagggatggattgtaattcgttttcggaagattaaatttcgtttaggggtagggattggtcggggagggtttcggcggcgttcgattcgcgggcgttgtacgggtcgcggttattagtaggcggtgtagtgagcgcgtttgtagtagtagtaatagtagtagtagcggtcgtcgtcgtcgtcgtcgttcgttagttttaacgaggagaaaggaggggatcggaaggagtcgttggtgttgcgggaagtggtaggagcgggaggcggggatttatttggaagcgtcgcggcgtcgttatcgagttttttgtagcggtggttattcgagtaagtgtcgtggcgggggcggagagcggttacggcggcggcgtttttttaagtggttcgttgcgttcgatttcgcgtgaaaggtgagtaagagttcgggatacgtggtgagggttagatacgggggagggagaatgaagggggagggaatgggggtgggaaacgatcggtttgggattcggatttggagttaagtatcgggagggggtgggttggaggcgacgattgcgacggttgcgacggcgaagtttttacgtggggcgggggtgcgcgcgtacgtgtgcgcgggcgaaagggggggcggggagggtttttgggagggcgtcgggagcgcgttcgtttagtagcggtttacgtgacgggtacgt

SEQ ID NO: 34868 - DNA, 711 bp, Artificial Sequence
  chemically treated genomic DNA (Homo sapiens) CpG-island No: 34868
acgtacccgtcacgtaaaccgctactaaacgaacgcgctcccgacgccctcccaaaaaccctccccgccccccctttcgcccgcgcacacgtacgcgcgcacccccgccccacgtaaaaacttcgccgtcgcaaccgtcgcaatcgtcgcctccaacccaccccctcccgatacttaactccaaatccgaatcccaaaccgatcgtttcccacccccattccctcccccttcattctccctcccccgtatctaaccctcaccacgtatcccgaactcttactcacctttcacgcgaaatcgaacgcaacgaaccacttaaaaaaacgccgccgccgtaaccgctctccgcccccgccacgacacttactcgaataaccaccgctacaaaaaactcgataacgacgccgcgacgcttccaaataaatccccgcctcccgctcctaccacttcccgcaacaccaacgactccttccgatcccctcctttctcctcgttaaaactaacgaacgacgacgacgacgacgaccgctactactactattactactactacaaacgcgctcactacaccgcctactaataaccgcgacccgtacaacgcccgcgaatcgaacgccgccgaaaccctccccgaccaatccctacccctaaacgaaatttaatcttccgaaaacgaattacaatccatcccttacaaccgtccaacctaa

SEQ ID NO: 34869 - DNA, 855 bp, Artificial Sequence
  chemically treated genomic DNA (Homo sapiens) CpG-island No: 34869
  misc_feature (573)..(573): n is either a, c, g or t
  misc_feature (737)..(737): n is either a, c, g or t
tttcgttattcgcgtttgtattttatcgatttcgtttattcgattcgagagttcgtagttacgtttttttttttcgttattatttttagttcgttttttaacgttatatatttttttttatcgttacgcgtttaatcgagacgcgcgttcgaatgtttttttaacgttaatttcgttttttttttttacgtttatcgttaattttaatcgtcgtgatattcgtatttaacgtttgtttatttttttttatcgttatttttttgttttatttttttaaatttttttatttttttttttcgtcgtcgttcgttcgcgcgcgttttcgtcgtttcgtttcgttttttttttatttattagtatttagtatttatatttttattatatttttcgtttgtttcgttttttatttcggtttttggcgttttcgttcgtcgtcgtcgttttcgcgtcgtttttttttttatgagttacgttttttttttttttttttttttttttttttttttttcgtttttcgatattttttttacgcgcgtgtttttacgcgtttttcgtgtgttttatatttcgttnttcgaatttttttttttttattcgttttttttgttgtttttttacgattcgttcgtattaatcgcgttatcgtttcgggataatcgttttattcggtttattcgcgcgatagcgttcgagaattattcgtcgcgttgagaatcgtcggtttttagatatcgttntatttattattatatagatagtagtttatttattatttatcgtatttattttcgatttttatttttatttttatcgtcgtatcgacgtattaattatattttttcgttattttttaag

SEQ ID NO: 34870 - DNA, 855 bp, Artificial Sequence
  chemically treated genomic DNA (Homo sapiens) CpG-island No: 34870
  misc_feature (119)..(119): n is either a, c, g or t
  misc_feature (283)..(283): n is either a, c, g or t
cttaaaaaataacgaaaaaatataattaatacgtcgatacgacgataaaaataaaaataaaaatcgaaaataaatacgataaataataaataaactactatctatataataataaatanaacgatatctaaaaaccgacgattctcaacgcgacgaataattctcgaacgctatcgcgcgaataaaccgaataaaacgattatcccgaaacgataacgcgattaatacgaacgaatcgtaaaaaaacaacaaaaaaaacgaataaaaaaaaaaaaattcgaanaacgaaatataaaacacacgaaaaacgcgtaaaaacacgcgcgtaaaaaaaatatcgaaaaacgaaaaaaaaaaaaaaaaaaaaaaaaaaaaaaaaaaaacgtaactcataaaaaaaaaaacgacgcgaaaacgacgacgacgaacgaaaacgccaaaaaccgaaataaaaaacgaaacaaacgaaaaatataataaaaatataaatactaaatactaataaataaaaaaaaaacgaaacgaaacgacgaaaacgcgcgcgaacgaacgacgacgaaaaaaaaaaataaaaaaatttaaaaaaataaaacaaaaaaataacgataaaaaaaaataaacaaacgttaaatacgaatatcacgacgattaaaattaacgataaacgtaaaaaaaaaaaacgaaattaacgttaaaaaaacattcgaacgcgcgtctcgattaaacgcgtaacgataaaaaaaaatatataacgttaaaaaacgaactaaaaataataacgaaaaaaaaaaacgtaactacgaactctcgaatcgaataaacgaaatcgataaaatacaaacgcgaataacgaaa

SEQ ID NO: 34871 - DNA, 855 bp, Artificial Sequence
  chemically treated genomic DNA (Homo sapiens) CpG-island No: 34871
  misc_feature (119)..(119): n is either a, c, g or t
  misc_feature (283)..(283): n is either a, c, g or t
tttggaaagtagcgaggaagtgtgattagtacgtcggtacgacggtggaggtggagataggggtcggggataagtacggtgagtaatgaatgagttgttgtttgtgtggtagtggatgnggcggtgtttgagagtcgacggtttttaacgcggcgagtggttttcgagcgttgtcgcgcgggtgagtcgggtggggcggttgtttcggggcggtggcgcggttagtgcgggcgggtcgtagaaagatagtaggggaagcggatgagggggaggagattcggangacgaagtgtggggtatacgggagacgcgtgaaaatacgcgcgtggagggggtgtcggggggcggggagagggggggggggggggagaggagggaggagacgtaatttatgggagggggggcggcgcgggggcggcgacggcgggcgggggcgttagggatcggggtggggggcggggtaggcggggggtgtggtgggagtgtgagtattggatgttggtgagtggggagggggcggggcggggcggcgggggcgcgcgcgggcggacggcggcgggaaaggggggtaggggggtttggaaggatggggtaaaaaggtggcgataagggaggatggatagacgttggatacgaatattacgacggttgggattgacgatgggcgtgagagggggggacgggattggcgttgggggggtattcgggcgcgcgtttcgattaagcgcgtggcggtggggagggatatatggcgttagggagcgagttgagggtggtggcggggggggggggcgtgattgcgagttttcgggtcgggtgggcggggtcggtagaatatagacgcgggtggcgggg

SEQ ID NO: 34872 - DNA, 855 bp, Artificial Sequence
  chemically treated genomic DNA (Homo sapiens) CpG-island No: 34872
  misc_feature (573)..(573): n is either a, c, g or t
  misc_feature (737)..(737): n is either a, c, g or t
ccccgccacccgcgtctatattctaccgaccccgcccacccgacccgaaaactcgcaatcacgccccccccccccgccaccaccctcaactcgctccctaacgccatatatccctccccaccgccacgcgcttaatcgaaacgcgcgcccgaatacccccccaacgccaatcccgtccccccctctcacgcccatcgtcaatcccaaccgtcgtaatattcgtatccaacgtctatccatcctcccttatcgccacctttttaccccatccttccaaacccccctacccccctttcccgccgccgtccgcccgcgcgcgcccccgccgccccgccccgccccctccccactcaccaacatccaatactcacactcccaccacaccccccgcctaccccgccccccaccccgatccctaacgcccccgcccgccgtcgccgcccccgcgccgccccccctcccataaattacgtctcctccctcctctccccccccccccccctctccccgccccccgacaccccctccacgcgcgtattttcacgcgtctcccgtataccccacacttcgtcntccgaatctcctccccctcatccgcttcccctactatctttctacgacccgcccgcactaaccgcgccaccgccccgaaacaaccgccccacccgactcacccgcgcgacaacgctcgaaaaccactcgccgcgttaaaaaccgtcgactctcaaacaccgccncatccactaccacacaaacaacaactcattcattactcaccgtacttatccccgacccctatctccacctccaccgtcgtaccgacgtactaatcacacttcctcgctactttccaaa

SEQ ID NO: 34873 - DNA, 843 bp, Artificial Sequence
  chemically treated genomic DNA (Homo sapiens) CpG-island No: 34873
gaggaggcggtgcgaggcgcgggttggtcggagtcgcgtattacgtttttcggttcgggtggaacgaggataggtgttgttttttcgcggtcgtttcggcgtagtgtaatttcgcgtcgcggttgcgtagtgtcgttttttggcggtttcgttttttttttttatcggtttcggtttgcgggttttttaaatatggaggagcgggagcggggggcgaggtcggttggcgtcgggagtttcgcgcgttcgtttagttcgcggttggatgttagttttgatagtttcgattcgttgttggttttgtacgcgtttcgtttgttttttattttttattttaatgttttttgttttaataacgtggcggagtacgagagtttttttaggatcggagttcggggcggcgggcgcgggcgcgggcgggttcggggcgcggtcgcgggttttggggttttcgtcgtattcgggttttcgggtaggattcgtcgtcgttcggacgcgttcgtttcggatttcgagcgtatttagcgttttcgtcgttttatggtggttaaagaggaaggggacggggtcgtaggagcgggtcggaggggttcgggtcggagtaggaaggcgttacgtaacgtgtttacgcgaatgttttgtgagttcgcgggtcgggcgggaagcggggtagtcgtcgttcggaagttggttgtcgagggggcgtttgcggggcggcggtggtcgggcgcgggtttgtacgtattgcgggagcgttttggtgaaaatttgcggggattattagtgattatggggtggatttgtttgagtaatgtgggtaatgagggcgtggggagggttatt

SEQ ID NO: 34874 - DNA, 843 bp, Artificial Sequence
  chemically treated genomic DNA (Homo sapiens) CpG-island No: 34874
aataaccctccccacgccctcattacccacattactcaaacaaatccaccccataatcactaataatccccgcaaattttcaccaaaacgctcccgcaatacgtacaaacccgcgcccgaccaccgccgccccgcaaacgccccctcgacaaccaacttccgaacgacgactaccccgcttcccgcccgacccgcgaactcacaaaacattcgcgtaaacacgttacgtaacgccttcctactccgacccgaacccctccgacccgctcctacgaccccgtccccttcctctttaaccaccataaaacgacgaaaacgctaaatacgctcgaaatccgaaacgaacgcgtccgaacgacgacgaatcctacccgaaaacccgaatacgacgaaaaccccaaaacccgcgaccgcgccccgaacccgcccgcgcccgcgcccgccgccccgaactccgatcctaaaaaaactctcgtactccgccacgttattaaaacaaaaaacattaaaataaaaaataaaaaacaaacgaaacgcgtacaaaaccaacaacgaatcgaaactatcaaaactaacatccaaccgcgaactaaacgaacgcgcgaaactcccgacgccaaccgacctcgccccccgctcccgctcctccatatttaaaaaacccgcaaaccgaaaccgataaaaaaaaaaaacgaaaccgccaaaaaacgacactacgcaaccgcgacgcgaaattacactacgccgaaacgaccgcgaaaaaacaacacctatcctcgttccacccgaaccgaaaaacgtaatacgcgactccgaccaacccgcgcctcgcaccgcctcctc

SEQ ID NO: 34875 - DNA, 843 bp, Artificial Sequence
  chemically treated genomic DNA (Homo sapiens) CpG-island No: 34875
ggtgattttttttacgtttttattatttatattatttaagtagatttattttatagttattgatgattttcgtaaatttttattaaggcgttttcgtaatacgtgtagattcgcgttcggttatcgtcgtttcgtagacgttttttcggtagttagttttcggacggcggttgtttcgtttttcgttcggttcgcggatttatagggtattcgcgtgagtacgttgcgtggcgtttttttgtttcgattcggattttttcggttcgtttttgcggtttcgttttttttttttttggttattatgagacggcggaggcgttggatgcgttcggggttcggggcgggcgcgttcgggcggcgacgagttttgttcgagggttcgggtgcggcgggaattttagagttcgcggtcgcgtttcgagttcgttcgcgttcgcgttcgtcgtttcggatttcggttttgaggaagttttcgtatttcgttacgttgttgaagtagggggtattggggtagggaatgggaggtaggcggggcgcgtatagggttagtagcgggtcgaagttgttagagttgatatttagtcgcgggttgggcgggcgcgcggggttttcggcgttagtcgatttcgtttttcgttttcgtttttttatgtttgaaaggttcgtaagtcgaggtcgatgggaagaaggaacgaagtcgttagagggcggtattgcgtagtcgcggcgcggggttgtattgcgtcgaagcggtcgcgggagggtagtatttgttttcgttttattcgggtcggggggcgtggtacgcggtttcgattagttcgcgtttcgtatcgttttttt

SEQ ID NO: 34876 - DNA, 843 bp, Artificial Sequence
  chemically treated genomic DNA (Homo sapiens) CpG-island No: 34876
aaaaaaacgatacgaaacgcgaactaatcgaaaccgcgtaccacgccccccgacccgaataaaacgaaaacaaatactaccctcccgcgaccgcttcgacgcaatacaaccccgcgccgcgactacgcaataccgccctctaacgacttcgttccttcttcccatcgacctcgacttacgaacctttcaaacataaaaaaacgaaaacgaaaaacgaaatcgactaacgccgaaaaccccgcgcgcccgcccaacccgcgactaaatatcaactctaacaacttcgacccgctactaaccctatacgcgccccgcctacctcccattccctaccccaataccccctacttcaacaacgtaacgaaatacgaaaacttcctcaaaaccgaaatccgaaacgacgaacgcgaacgcgaacgaactcgaaacgcgaccgcgaactctaaaattcccgccgcacccgaaccctcgaacaaaactcgtcgccgcccgaacgcgcccgccccgaaccccgaacgcatccaacgcctccgccgtctcataataaccaaaaaaaaaaaaaacgaaaccgcaaaaacgaaccgaaaaaatccgaatcgaaacaaaaaaacgccacgcaacgtactcacgcgaataccctataaatccgcgaaccgaacgaaaaacgaaacaaccgccgtccgaaaactaactaccgaaaaaacgtctacgaaacgacgataaccgaacgcgaatctacacgtattacgaaaacgccttaataaaaatttacgaaaatcatcaataactataaaataaatctacttaaataatataaataataaaaacgtaaaaaaaatcacc

SEQ ID NO: 34877 - DNA, 1198 bp, Artificial Sequence
  chemically treated genomic DNA (Homo sapiens) CpG-island No: 34877
gtcgcgaggagaggcgtaaagggtgatatattaggaaaggtgaacgtagagggagcgggagttcgcggcggggtagggtgggggcggaacggacgaggtatttaaggtgcggagagaggggtaatcgggcggagggtagtttcgaggttgtaggcgggacgggcggggttttcggcgtagttcggatcgtcgtcgttaagtaaagttaatatttatttagtttcgtaattgcgtcgttttcgtaggtcgtttagaggggtcggtcggggcgttggggacgcggcggtattcggagtttcgcggtcgtttagcgttcgttttcgcgtcgtatttttcggtatttttcggcgtttttcgcgtcgcgcgtttcgtatcggttggaggtttcggtttttcggcgtttttttttcgcgtatttttcggttcgcgttaggtgagtgtggacgttattggcgggggtgtcgcggtgcgcgagcgttcggttagcggtagagacgtcgcgggagtcgtttttagcgttaacgtcgtcgcgggcgggaagggcgaggttcggcgaggttgggcgaggagttgggcggtagacgttgagcggggcgcggcgcggggcgtcggacgagcgcgggcgtaggaggagcgcgggcgtaggagtcggcgattcgttcgttttcgcggtcggtgtttttgggttgggggtcgggttgggggtcgggtcgggtcgggtcgggtcgggcggttaggcggtttcgttttttcgtcgggtagcggttgagcgcgcgagaggagcggcgcgggggcgtttttttcggtcgggcgttcgggttttagtcgtcgttttttcgcgtttcgttcgcgtttggttcgttcgtcggcgtcgggagagatttcgtaacggaattgggacgttagcgttgtattgtgggagtttttaaagcggcggggagttcggcgcgattttcgggtttatcgggttacgttcgttcggttcgcgacgttttttcgttgtcgtttggttcgcgacgtatcgaggtttgaggattcgaaagtcgggcgcggggagatgatcggtggttcgtgacggttttacgggtaaaattttttatcgttcggggttgagatttgttaaattgttttttacggttattcggaaagtaggaggttttttttgtagaggggaaaaaaattaaaaagagtcgtttta

SEQ ID NO: 34878 - DNA, 1198 bp, Artificial Sequence
  chemically treated genomic DNA (Homo sapiens) CpG-island No: 34878
taaaacgactctttttaatttttttcccctctacaaaaaaaacctcctactttccgaataaccgtaaaaaacaatttaacaaatctcaaccccgaacgataaaaaattttacccgtaaaaccgtcacgaaccaccgatcatctccccgcgcccgactttcgaatcctcaaacctcgatacgtcgcgaaccaaacgacaacgaaaaaacgtcgcgaaccgaacgaacgtaacccgataaacccgaaaatcgcgccgaactccccgccgctttaaaaactcccacaatacaacgctaacgtcccaattccgttacgaaatctctcccgacgccgacgaacgaaccaaacgcgaacgaaacgcgaaaaaacgacgactaaaacccgaacgcccgaccgaaaaaaacgcccccgcgccgctcctctcgcgcgctcaaccgctacccgacgaaaaaacgaaaccgcctaaccgcccgacccgacccgacccgacccgacccccaacccgacccccaacccaaaaacaccgaccgcgaaaacgaacgaatcgccgactcctacgcccgcgctcctcctacgcccgcgctcgtccgacgccccgcgccgcgccccgctcaacgtctaccgcccaactcctcgcccaacctcgccgaacctcgcccttcccgcccgcgacgacgttaacgctaaaaacgactcccgcgacgtctctaccgctaaccgaacgctcgcgcaccgcgacacccccgccaataacgtccacactcacctaacgcgaaccgaaaaatacgcgaaaaaaaaacgccgaaaaaccgaaacctccaaccgatacgaaacgcgcgacgcgaaaaacgccgaaaaataccgaaaaatacgacgcgaaaacgaacgctaaacgaccgcgaaactccgaataccgccgcgtccccaacgccccgaccgacccctctaaacgacctacgaaaacgacgcaattacgaaactaaataaatattaactttacttaacgacgacgatccgaactacgccgaaaaccccgcccgtcccgcctacaacctcgaaactaccctccgcccgattacccctctctccgcaccttaaatacctcgtccgttccgcccccaccctaccccgccgcgaactcccgctccctctacgttcacctttcctaatatatcaccctttacgcctctcctcgcgac

SEQ ID NO: 34879 - DNA, 1198 bp, Artificial Sequence
  chemically treated genomic DNA (Homo sapiens) CpG-island No: 34879
tggaacggttttttttgattttttttttttttgtagaaaaagttttttatttttcgggtgatcgtagagggtagtttgataagttttagtttcgggcgatggaagattttgttcgtgggatcgttacgagttatcggttattttttcgcgttcggttttcgggtttttaggtttcggtgcgtcgcgggttaggcgatagcgggggggcgtcgcgggtcgggcgagcgtggttcggtgggttcgagggtcgcgtcgagtttttcgtcgttttaaaagtttttataatgtagcgttggcgttttagtttcgttacgaggtttttttcggcgtcggcgagcgggttaggcgcgggcggggcgcggaggagcggcggttgaaattcgagcgttcggtcgaggggggcgttttcgcgtcgtttttttcgcgcgtttagtcgttgttcggcgaaggggcggagtcgtttggtcgttcggttcggttcggttcggttcggtttttagttcggtttttagtttagaggtatcggtcgcgggagcgagcgggtcgtcgatttttacgttcgcgttttttttacgttcgcgttcgttcggcgtttcgcgtcgcgtttcgtttagcgtttgtcgtttagtttttcgtttagtttcgtcgagtttcgtttttttcgttcgcggcggcgttggcgttgggggcggttttcgcggcgtttttgtcgttggtcgagcgttcgcgtatcgcggtattttcgttagtggcgtttatatttatttagcgcgggtcgggaggtgcgcggagagggaacgtcggggggtcggggtttttagtcggtgcggggcgcgcggcgcggggagcgtcggggagtgtcggggagtgcggcgcggggacgggcgttgggcggtcgcggagtttcgggtgtcgtcgcgtttttagcgtttcggtcggtttttttgggcggtttgcgggggcggcgtagttgcgaaattgagtaagtattaattttatttagcggcggcgattcgggttgcgtcggggatttcgttcgtttcgtttgtagtttcggagttgtttttcgttcggttgttttttttttcgtattttgggtatttcgttcgtttcgtttttattttgtttcgtcgcgggttttcgttttttttgcgtttattttttttggtgtgttattttttgcgttttttttcgcggt

SEQ ID NO: 34880 - DNA, 1198 bp, Artificial Sequence
  chemically treated genomic DNA (Homo sapiens) CpG-island No: 34880
accgcgaaaaaaaacgcaaaaaataacacaccaaaaaaaataaacgcaaaaaaaacgaaaacccgcgacgaaacaaaataaaaacgaaacgaacgaaatacccaaaatacgaaaaaaaaaacaaccgaacgaaaaacaactccgaaactacaaacgaaacgaacgaaatccccgacgcaacccgaatcgccgccgctaaataaaattaatacttactcaatttcgcaactacgccgcccccgcaaaccgcccaaaaaaaccgaccgaaacgctaaaaacgcgacgacacccgaaactccgcgaccgcccaacgcccgtccccgcgccgcactccccgacactccccgacgctccccgcgccgcgcgccccgcaccgactaaaaaccccgaccccccgacgttccctctccgcgcacctcccgacccgcgctaaataaatataaacgccactaacgaaaataccgcgatacgcgaacgctcgaccaacgacaaaaacgccgcgaaaaccgcccccaacgccaacgccgccgcgaacgaaaaaaacgaaactcgacgaaactaaacgaaaaactaaacgacaaacgctaaacgaaacgcgacgcgaaacgccgaacgaacgcgaacgtaaaaaaaacgcgaacgtaaaaatcgacgacccgctcgctcccgcgaccgatacctctaaactaaaaaccgaactaaaaaccgaaccgaaccgaaccgaaccgaacgaccaaacgactccgccccttcgccgaacaacgactaaacgcgcgaaaaaaacgacgcgaaaacgcccccctcgaccgaacgctcgaatttcaaccgccgctcctccgcgccccgcccgcgcctaacccgctcgccgacgccgaaaaaaacctcgtaacgaaactaaaacgccaacgctacattataaaaacttttaaaacgacgaaaaactcgacgcgaccctcgaacccaccgaaccacgctcgcccgacccgcgacgcccccccgctatcgcctaacccgcgacgcaccgaaacctaaaaacccgaaaaccgaacgcgaaaaaataaccgataactcgtaacgatcccacgaacaaaatcttccatcgcccgaaactaaaacttatcaaactaccctctacgatcacccgaaaaataaaaaactttttctacaaaaaaaaaaaaaatcaaaaaaaaccgttcca

SEQ ID NO: 34881 - DNA, 659 bp, Artificial Sequence
  chemically treated genomic DNA (Homo sapiens) CpG-island No: 34881
agaaggcgcggagtggtagcggtaagaataacgtggaaaggacggaaaacgcgaagagtggcgttttggcggatttggggcggggtagagtggtaagggttacgttaggacgtattcggttgtgggtcgggggaggagagtacggtgggatagtaacgaatttgttgggggttttcggattcgagtttcgtcgatgaggttagcggagtttaggcgtcgggaggaggttagtagagtttttagatacgagtgtcgggaggttagcggaggggcgggacgggacgggaaatgggacgaagagtaagagttgggggaggagggaagagggggcgtcggcgttgtaagtcggaggcggttcgatagggatcgttttttttcggagaggaggtcggttttggattgaggcgcggacggggggcgtttaagggcgggtgacggggaaatatcgcggttcgcgttttttttcggttggtagcggtgtcgtttgcggtttttttttcgggttagttcggagttcggcggcggggggagcgggaggcgggagtgagggcgggggttcgggaaggagggaggagggagggtttaggcgcgttattgatagggtggtagtttaggagcggacgcgttgtcgtcgtcgttgtttttttttttttttttgt

SEQ ID NO: 34882 - DNA, 659 bp, Artificial Sequence
  chemically treated genomic DNA (Homo sapiens) CpG-island No: 34882
acaaaaaaaaaaaaaaaaacaacgacgacgacaacgcgtccgctcctaaactaccaccctatcaataacgcgcctaaaccctccctcctccctccttcccgaacccccgccctcactcccgcctcccgctccccccgccgccgaactccgaactaacccgaaaaaaaaaccgcaaacgacaccgctaccaaccgaaaaaaaacgcgaaccgcgatatttccccgtcacccgcccttaaacgccccccgtccgcgcctcaatccaaaaccgacctcctctccgaaaaaaaacgatccctatcgaaccgcctccgacttacaacgccgacgccccctcttccctcctcccccaactcttactcttcgtcccatttcccgtcccgtcccgcccctccgctaacctcccgacactcgtatctaaaaactctactaacctcctcccgacgcctaaactccgctaacctcatcgacgaaactcgaatccgaaaacccccaacaaattcgttactatcccaccgtactctcctcccccgacccacaaccgaatacgtcctaacgtaacccttaccactctaccccgccccaaatccgccaaaacgccactcttcgcgttttccgtcctttccacgttattcttaccgctaccactccgcgccttct

SEQ ID NO: 34883 - DNA, 659 bp, Artificial Sequence
  chemically treated genomic DNA (Homo sapiens) CpG-island No: 34883
gtaggaggaggaggaggagtagcggcggcggtaacgcgttcgtttttaggttgttattttgttagtggcgcgtttgggtttttttttttttttttttttcgagttttcgtttttattttcgtttttcgtttttttcgtcgtcgggtttcgagttggttcggaggaggagtcgtaggcggtatcgttgttagtcggagagaagcgcgggtcgcggtattttttcgttattcgtttttggacgtttttcgttcgcgttttagtttagagtcggtttttttttcggaaggaaacgatttttgtcgggtcgttttcggtttgtagcgtcgacgtttttttttttttttttttttagtttttgtttttcgttttatttttcgtttcgtttcgttttttcgttggtttttcgatattcgtgtttgggggttttattggttttttttcggcgtttaggtttcgttgattttatcggcggagttcgggttcgggagtttttagtaagttcgttgttgttttatcgtgtttttttttttcggtttatagtcgggtacgttttggcgtgatttttattattttgtttcgttttaggttcgttagggcgttatttttcgcgtttttcgttttttttacgttgtttttatcgttgttatttcgcgtttttt

SEQ ID NO: 34884 - DNA, 659 bp, Artificial Sequence
  chemically treated genomic DNA (Homo sapiens) CpG-island No: 34884
aaaaaacgcgaaataacaacgataaaaacaacgtaaaaaaaacgaaaaacgcgaaaaataacgccctaacgaacctaaaacgaaacaaaataataaaaatcacgccaaaacgtacccgactataaaccgaaaaaaaaaaacacgataaaacaacaacgaacttactaaaaactcccgaacccgaactccgccgataaaatcaacgaaacctaaacgccgaaaaaaaaccaataaaacccccaaacacgaatatcgaaaaaccaacgaaaaaacgaaacgaaacgaaaaataaaacgaaaaacaaaaactaaaaaaaaaaaaaaaaaaaaacgtcgacgctacaaaccgaaaacgacccgacaaaaatcgtttccttccgaaaaaaaaaccgactctaaactaaaacgcgaacgaaaaacgtccaaaaacgaataacgaaaaaataccgcgacccgcgcttctctccgactaacaacgataccgcctacgactcctcctccgaaccaactcgaaacccgacgacgaaaaaaacgaaaaacgaaaataaaaacgaaaactcgaaaaaaaaaaaaaaaaaaaaacccaaacgcgccactaacaaaataacaacctaaaaacgaacgcgttaccgccgccgctactcctcctcctcctcctac

SEQ ID NO: 34885 - DNA, 1087 bp, Artificial Sequence
  chemically treated genomic DNA (Homo sapiens) CpG-island No: 34885
tttttttagttgtcgttgttgtcgtcgttgtcgttatcgtcgtcgtcgggagaagttttattttcgatttttgttcggagtttcggtttagagttgagcgggagttcggtaggtagttgtagttcgcggtagtcgaggcgttcgcggcgtttcgatttttagtcggtgtcggcgtttaggcggtcggttgcggtcgcggttgggggcgtaaaggcggaggaggggcgggtgtgagtcggggaaatcgcgtgtcgcgtcgcgatagtttagcgagcgttcgcgttcgggatagtcgcgatggttgtgcgttttcgtcgttcgtggatgagcgtggtattagggttggtgttgggttttatcgtcgcgttttggtttatcgtttttagggtggcggagttgagcgagaggaagagacgtggttttagtttttgtttttattacggtcgttttgttgttggttttcgcgtcggcgtttagtagtcgtttttttagttttagtttcgattacggtaggagtagtcgtcgtttttcgcgcgttaggatttttaggggttatcgttgttcgaggtagtattcgggattattagttttcgaagtagtttttggtagtagttattttcgttgtagtagcggcggcgaggacgcgagtttgagggcgcgacggggtttttcggtgttttagcggtcgagggggagttcgaggaggaggacgggggcgcggttgggtagcggagagacggtcggttcgggagtagttataacggtagcggggacgggggcgttgtcgtttcgagcgttcgatttcgggattttttgtacgtgggggtgatgatcgcgtagaagtatttgggtagtcgcgcgttggtcgcgtagcggatttgggcgcgttttatttcgggtcgcgtggagtttttttttagttagtagttttttaacgtcggttagttttcgttatttttgtttgttatcgcgttatcgggtgtggacgatttttattttttttagaaaaagttttttatgatgattaagtatatgtacgattattatttggataagtatgagtggtttatgcgcgtcgacgacgatg

SEQ ID NO: 34886 - DNA, 1087 bp, Artificial Sequence
  chemically treated genomic DNA (Homo sapiens) CpG-island No: 34886
catcgtcgtcgacgcgcataaaccactcatacttatccaaataataatcgtacatatacttaatcatcataaaaaactttttctaaaaaaaataaaaatcgtccacacccgataacgcgataacaaacaaaaataacgaaaactaaccgacgttaaaaaactactaactaaaaaaaaactccacgcgacccgaaataaaacgcgcccaaatccgctacgcgaccaacgcgcgactacccaaatacttctacgcgatcatcacccccacgtacaaaaaatcccgaaatcgaacgctcgaaacgacaacgcccccgtccccgctaccgttataactactcccgaaccgaccgtctctccgctacccaaccgcgcccccgtcctcctcctcgaactccccctcgaccgctaaaacaccgaaaaaccccgtcgcgccctcaaactcgcgtcctcgccgccgctactacaacgaaaataactactaccaaaaactacttcgaaaactaataatcccgaatactacctcgaacaacgataacccctaaaaatcctaacgcgcgaaaaacgacgactactcctaccgtaatcgaaactaaaactaaaaaaacgactactaaacgccgacgcgaaaaccaacaacaaaacgaccgtaataaaaacaaaaactaaaaccacgtctcttcctctcgctcaactccgccaccctaaaaacgataaaccaaaacgcgacgataaaacccaacaccaaccctaataccacgctcatccacgaacgacgaaaacgcacaaccatcgcgactatcccgaacgcgaacgctcgctaaactatcgcgacgcgacacgcgatttccccgactcacacccgcccctcctccgcctttacgcccccaaccgcgaccgcaaccgaccgcctaaacgccgacaccgactaaaaatcgaaacgccgcgaacgcctcgactaccgcgaactacaactacctaccgaactcccgctcaactctaaaccgaaactccgaacaaaaatcgaaaataaaacttctcccgacgacgacgataacgacaacgacgacaacaacgacaactaaaaaaa

SEQ ID NO: 34887 - DNA, 1087 bp, Artificial Sequence
  chemically treated genomic DNA (Homo sapiens) CpG-island No: 34887
tatcgtcgtcggcgcgtatgaattatttatatttgtttaggtagtggtcgtgtatgtatttgattattatgaaggattttttttggggaggataggagtcgtttatattcggtagcgcgatgataggtaggggtggcgggggttggtcggcgttggggggttgttggttggaaaagaattttacgcggttcgggatgaaacgcgtttaggttcgttgcgcggttagcgcgcggttgtttaggtatttttgcgcggttattatttttacgtataggaagtttcggggtcgggcgttcggggcggtagcgttttcgttttcgttgtcgttgtggttattttcgggtcggtcgttttttcgttgtttagtcgcgttttcgttttttttttcgggttttttttcggtcgttggagtatcgggaagtttcgtcgcgtttttaggttcgcgttttcgtcgtcgttgttgtagcggaggtggttgttgttaggggttgtttcgaaaattggtgatttcgggtgttgtttcgggtagcggtggtttttggagattttggcgcgcggggggcggcgattgtttttgtcgtggtcgggattggggttgggggagcggttgttgagcgtcggcgcgggggttagtagtagagcgatcgtagtaggagtagaggttggagttacgtttttttttttcgtttagtttcgttattttgggggcgatgagttaggacgcggcggtgaagtttagtattagttttaatgttacgtttatttacgggcggcgagagcgtatagttatcgcggttgtttcgggcgcggacgttcgttgggttgtcgcggcgcggtacgcggttttttcggtttatattcgtttttttttcgtttttgcgtttttagtcgcggtcgtagtcggtcgtttaggcgtcgatatcggttggaggtcgaagcgtcgcggacgtttcgattgtcgcgggttgtagttgtttgtcgggttttcgtttagttttgggtcggggtttcgagtaagggtcgggagtgaaatttttttcggcggcggcggtggcggtagcggcggtagtagcggtagttagaggag

SEQ ID NO: 34888 - DNA, 1087 bp, Artificial Sequence
  chemically treated genomic DNA (Homo sapiens) CpG-island No: 34888
ctcctctaactaccgctactaccgccgctaccgccaccgccgccgccgaaaaaaatttcactcccgacccttactcgaaaccccgacccaaaactaaacgaaaacccgacaaacaactacaacccgcgacaatcgaaacgtccgcgacgcttcgacctccaaccgatatcgacgcctaaacgaccgactacgaccgcgactaaaaacgcaaaaacgaaaaaaaaacgaatataaaccgaaaaaaccgcgtaccgcgccgcgacaacccaacgaacgtccgcgcccgaaacaaccgcgataactatacgctctcgccgcccgtaaataaacgtaacattaaaactaatactaaacttcaccgccgcgtcctaactcatcgcccccaaaataacgaaactaaacgaaaaaaaaaaacgtaactccaacctctactcctactacgatcgctctactactaacccccgcgccgacgctcaacaaccgctcccccaaccccaatcccgaccacgacaaaaacaatcgccgccccccgcgcgccaaaatctccaaaaaccaccgctacccgaaacaacacccgaaatcaccaattttcgaaacaacccctaacaacaaccacctccgctacaacaacgacgacgaaaacgcgaacctaaaaacgcgacgaaacttcccgatactccaacgaccgaaaaaaaacccgaaaaaaaaaacgaaaacgcgactaaacaacgaaaaaacgaccgacccgaaaataaccacaacgacaacgaaaacgaaaacgctaccgccccgaacgcccgaccccgaaacttcctatacgtaaaaataataaccgcgcaaaaatacctaaacaaccgcgcgctaaccgcgcaacgaacctaaacgcgtttcatcccgaaccgcgtaaaattcttttccaaccaacaaccccccaacgccgaccaacccccgccacccctacctatcatcgcgctaccgaatataaacgactcctatcctccccaaaaaaaatccttcataataatcaaatacatacacgaccactacctaaacaaatataaataattcatacgcgccgacgacgata

SEQ ID NO: 34889 - DNA, 678 bp, Artificial Sequence
  chemically treated genomic DNA (Homo sapiens) CpG-island No: 34889
tatcgttgcggagtcgagttcgaggtttttttttgtttgcggttttttagttttcgcggggttcgacgtagtttggcgtttgcgttttggtttttatcggggttcggtattgttttcgggcgtttcgtatttaagtatatttttagtcgttttcgttacgagggttagttaggatttatttggtcgcggtcgttatcgtcgtcgtagtcgtcgttatattaagttaagttcgtttcgtggttttatcgcggttatcgtcgtcgtagtcgcgggattttcgttttcgtcgtcgttacggtttcgagcggtttggttcgttttcggcggaaatgttcgagcgtattcgagtcgggcggatgaatcgaggtcgaggcggagtttgaggtaagggggtattcgagtgttttcggaagtagtcgaacgtaatttcgcgggattggtggattagagggtgttttcgagatagtcgagcgtttttagaggtagtcgagtgtaatcgggtcggcgagggattcgagattgggttcggttgggtttagagacgttcgagcgttttcggaaatggtcgaatattttttacggtcgtattggtataattgaggttgatttttaagatcgcggagcgtttttggaaataatcgaatgtgtttagtgtttaatggaggttttgggagttta

SEQ ID NO: 34890 - DNA, 678 bp, Artificial Sequence
  chemically treated genomic DNA (Homo sapiens) CpG-island No: 34890
taaactcccaaaacctccattaaacactaaacacattcgattatttccaaaaacgctccgcgatcttaaaaatcaacctcaattataccaatacgaccgtaaaaaatattcgaccatttccgaaaacgctcgaacgtctctaaacccaaccgaacccaatctcgaatccctcgccgacccgattacactcgactacctctaaaaacgctcgactatctcgaaaacaccctctaatccaccaatcccgcgaaattacgttcgactacttccgaaaacactcgaatacccccttacctcaaactccgcctcgacctcgattcatccgcccgactcgaatacgctcgaacatttccgccgaaaacgaaccaaaccgctcgaaaccgtaacgacgacgaaaacgaaaatcccgcgactacgacgacgataaccgcgataaaaccacgaaacgaacttaacttaatataacgacgactacgacgacgataacgaccgcgaccaaataaatcctaactaaccctcgtaacgaaaacgactaaaaatatacttaaatacgaaacgcccgaaaacaataccgaaccccgataaaaaccaaaacgcaaacgccaaactacgtcgaaccccgcgaaaactaaaaaaccgcaaacaaaaaaaaacctcgaactcgactccgcaacgata

SEQ ID NO: 34891 - DNA, 678 bp, Artificial Sequence
  chemically treated genomic DNA (Homo sapiens) CpG-island No: 34891
taaatttttaaggtttttattgggtattgagtatattcggttatttttagaaacgtttcgcggttttggggattagttttagttgtgttagtgcggtcgtagagagtgttcggttattttcgaaagcgttcgggcgtttttaagtttagtcgagtttagtttcggatttttcgtcgattcgattgtattcggttatttttggaaacgttcggttgtttcgggggtattttttagtttattagtttcgcgggattacgttcggttattttcggaaatattcgggtgtttttttattttaggtttcgtttcggtttcggtttattcgttcggttcgaatgcgttcgggtattttcgtcgggggcgggttaggtcgttcggaatcgtggcggcggcggaggcggggatttcgcggttgcggcgacggtggtcgcggtggagttacggggcgggtttggtttggtgtgacggcggttgcggcggcggtggcggtcgcgattaggtgagttttgattggttttcgtggcgggggcggttgggagtgtgtttaaatgcggggcgttcgggggtagtgtcgggtttcggtggaagttagaacgtaagcgttaggttgcgtcgggtttcgcgggaattggggggtcgtaggtaagggggggtttcgggttcggtttcgtagcggtg

SEQ ID NO: 34892 - DNA, 678 bp, Artificial Sequence
  chemically treated genomic DNA (Homo sapiens) CpG-island No: 34892
caccgctacgaaaccgaacccgaaacccccccttacctacgaccccccaattcccgcgaaacccgacgcaacctaacgcttacgttctaacttccaccgaaacccgacactacccccgaacgccccgcatttaaacacactcccaaccgcccccgccacgaaaaccaatcaaaactcacctaatcgcgaccgccaccgccgccgcaaccgccgtcacaccaaaccaaacccgccccgtaactccaccgcgaccaccgtcgccgcaaccgcgaaatccccgcctccgccgccgccacgattccgaacgacctaacccgcccccgacgaaaatacccgaacgcattcgaaccgaacgaataaaccgaaaccgaaacgaaacctaaaataaaaaaacacccgaatatttccgaaaataaccgaacgtaatcccgcgaaactaataaactaaaaaatacccccgaaacaaccgaacgtttccaaaaataaccgaatacaatcgaatcgacgaaaaatccgaaactaaactcgactaaacttaaaaacgcccgaacgctttcgaaaataaccgaacactctctacgaccgcactaacacaactaaaactaatccccaaaaccgcgaaacgtttctaaaaataaccgaatatactcaatacccaataaaaaccttaaaaattta

SEQ ID NO: 34893 - DNA, 505 bp, Artificial Sequence
  chemically treated genomic DNA (Homo sapiens) CpG-island No: 34893
ttttatgtcgaggtagaggtcgtttttgtgcggcggggtatcgacgtttttttgttggttttcggaagttttgatcgtggcgcgagcggatcgacggacggatatacggacgtagggatagacgtttggttggtgcggtagattagacgcgggggttgggtcgttgggggtcgggttggtttcgtttcggggcggggatcgtagtttcgtatttgcgcgtaggttcggttcggtagcgagggtcgcgtagcgggaaaggggagtcgcgggtgtcgttttgtttgtcgtagggacgtcgaggtcgtcggtttgggagttttcgagttgcgtttcggaagggaagggcggttattggtttcgcggttcgcgcgattgttttatggtttgatttcgttttttttcgtttcggttcggtttttgttttcgtttcggttttggggttttttgggagtcgggatttgagcgtagttcgttttaattttttaatttcgtatttcggttagtt

SEQ ID NO: 34894 - DNA, 505 bp, Artificial Sequence
  chemically treated genomic DNA (Homo sapiens) CpG-island No: 34894
aactaaccgaaatacgaaattaaaaaattaaaacgaactacgctcaaatcccgactcccaaaaaaccccaaaaccgaaacgaaaacaaaaaccgaaccgaaacgaaaaaaaacgaaatcaaaccataaaacaatcgcgcgaaccgcgaaaccaataaccgcccttcccttccgaaacgcaactcgaaaactcccaaaccgacgacctcgacgtccctacgacaaacaaaacgacacccgcgactcccctttcccgctacgcgaccctcgctaccgaaccgaacctacgcgcaaatacgaaactacgatccccgccccgaaacgaaaccaacccgacccccaacgacccaacccccgcgtctaatctaccgcaccaaccaaacgtctatccctacgtccgtatatccgtccgtcgatccgctcgcgccacgatcaaaacttccgaaaaccaacaaaaaaacgtcgataccccgccgcacaaaaacgacctctacctcgacataaaa

SEQ ID NO: 34895 - DNA, 505 bp, Artificial Sequence
  chemically treated genomic DNA (Homo sapiens) CpG-island No: 34895
agttggtcgggatgcggggttggggagttggggcggattgcgtttagatttcggtttttagagagttttagggtcggggcgagggtagaggtcgggtcggggcggggagaggcggggttaggttatggagtaatcgcgcggatcgcggagttagtgatcgtttttttttttcggggcgtagttcgggggtttttaagtcggcggtttcggcgtttttgcggtagatagggcggtattcgcggtttttttttttcgttgcgcgattttcgttgtcgggtcgggtttgcgcgtaggtgcggagttgcgattttcgtttcgaggcggagttagttcggtttttagcggtttagttttcgcgtttagtttgtcgtattagttaggcgtttgtttttgcgttcgtgtgttcgttcgtcggttcgttcgcgttacgattagggttttcgggggttaataagggggcgtcggtatttcgtcgtatagaggcggtttttgtttcggtatgaag

SEQ ID NO: 34896 - DNA, 505 bp, Artificial Sequence
  chemically treated genomic DNA (Homo sapiens) CpG-island No: 34896
cttcataccgaaacaaaaaccgcctctatacgacgaaataccgacgcccccttattaacccccgaaaaccctaatcgtaacgcgaacgaaccgacgaacgaacacacgaacgcaaaaacaaacgcctaactaatacgacaaactaaacgcgaaaactaaaccgctaaaaaccgaactaactccgcctcgaaacgaaaatcgcaactccgcacctacgcgcaaacccgacccgacaacgaaaatcgcgcaacgaaaaaaaaaaaccgcgaataccgccctatctaccgcaaaaacgccgaaaccgccgacttaaaaacccccgaactacgccccgaaaaaaaaaaacgatcactaactccgcgatccgcgcgattactccataacctaaccccgcctctccccgccccgacccgacctctaccctcgccccgaccctaaaactctctaaaaaccgaaatctaaacgcaatccgccccaactccccaaccccgcatcccgaccaact

SEQ ID NO: 34897 - DNA, 632 bp, Artificial Sequence
  chemically treated genomic DNA (Homo sapiens) CpG-island No: 34897
tcgttttcgtcgttcgcgatcgtagtaacgttcggttttagtcgttcgtcgtttagtaacgtttcgttttttcgttcgcggttatggtagcgtttcgtttattcgtcggtacgcgggttcgtcggtttcgttttcgcgtcgttcgtttcgtttttcgatagtatttatttttaacgtattcgatttcgtattcgtttgggcggagttttagtcgcgttcgggggcgtcgtttttttttcgtcgtttttttattttcgtagtttcgtgcgtttttttttttgttcggtttcgcggggtttttggggtcgattttatcgtcgaggttttttttttcggtttcggcggttgcggcggtataaagggaagtagtatgttcgattttagttattggacggcggtggcggttttcggttatcggagtcgtttggtaaaaggcgcgttgttgtagcgttttaaagaggtaggggggacggcgtcggcgaaggttcgggggttagtcgagtaaataggagttgttagaagtgtgttcgtggtttggcgcggattacggcgagcgtttgtttgtggtagtagtgggaaggggggaggacgtttgtggatcgaggtgttttttggggtttttggtatttttt

SEQ ID NO: 34898 - DNA, 632 bp, Artificial Sequence
  chemically treated genomic DNA (Homo sapiens) CpG-island No: 34898
aaaaaataccaaaaaccccaaaaaacacctcgatccacaaacgtcctccccccttcccactactaccacaaacaaacgctcgccgtaatccgcgccaaaccacgaacacacttctaacaactcctatttactcgactaacccccgaaccttcgccgacgccgtcccccctacctctttaaaacgctacaacaacgcgccttttaccaaacgactccgataaccgaaaaccgccaccgccgtccaataactaaaatcgaacatactacttccctttataccgccgcaaccgccgaaaccgaaaaaaaaaacctcgacgataaaatcgaccccaaaaaccccgcgaaaccgaacaaaaaaaaaaacgcacgaaactacgaaaataaaaaaacgacgaaaaaaaaacgacgcccccgaacgcgactaaaactccgcccaaacgaatacgaaatcgaatacgttaaaaataaatactatcgaaaaacgaaacgaacgacgcgaaaacgaaaccgacgaacccgcgtaccgacgaataaacgaaacgctaccataaccgcgaacgaaaaaacgaaacgttactaaacgacgaacgactaaaaccgaacgttactacgatcgcgaacgacgaaaacga

SEQ ID NO: 34899 - DNA, 632 bp, Artificial Sequence
  chemically treated genomic DNA (Homo sapiens) CpG-island No: 34899
ggagggtgttagggattttaggggatatttcgatttataggcgtttttttttttttttattgttgttatagatagacgttcgtcgtggttcgcgttaggttacggatatatttttggtaatttttgtttgttcggttggttttcgagttttcgtcggcgtcgttttttttatttttttgggacgttgtagtagcgcgttttttgttaagcggtttcgatggtcgggagtcgttatcgtcgtttagtagttggggtcggatatgttgtttttttttgtgtcgtcgtagtcgtcgaggtcgggaagggaggtttcggcggtgggatcggttttaggagtttcgcggagtcggatagggaggggggcgtacggggttgcggggatgggggggcggcgagaaggaagcggcgttttcgagcgcgattggaatttcgtttaggcgagtgcggggtcgggtacgttgggagtaggtattgtcgggaggcggagcgagcgacgcggaagcgaggtcggcggattcgcgtgtcggcgagtgggcggggcgttgttatggtcgcgggcggagaggcggagcgttgttaggcggcgggcggttgaggtcgggcgttgttacgatcgcgggcggcgggggcgg

SEQ ID NO: 34900 - DNA, 632 bp, Artificial Sequence
  chemically treated genomic DNA (Homo sapiens) CpG-island No: 34900
ccgcccccgccgcccgcgatcgtaacaacgcccgacctcaaccgcccgccgcctaacaacgctccgcctctccgcccgcgaccataacaacgccccgcccactcgccgacacgcgaatccgccgacctcgcttccgcgtcgctcgctccgcctcccgacaatacctactcccaacgtacccgaccccgcactcgcctaaacgaaattccaatcgcgctcgaaaacgccgcttccttctcgccgcccccccatccccgcaaccccgtacgcccccctccctatccgactccgcgaaactcctaaaaccgatcccaccgccgaaacctcccttcccgacctcgacgactacgacgacacaaaaaaaaacaacatatccgaccccaactactaaacgacgataacgactcccgaccatcgaaaccgcttaacaaaaaacgcgctactacaacgtcccaaaaaaataaaaaaaacgacgccgacgaaaactcgaaaaccaaccgaacaaacaaaaattaccaaaaatatatccgtaacctaacgcgaaccacgacgaacgtctatctataacaacaataaaaaaaaaaaaaaacgcctataaatcgaaatatcccctaaaatccctaacaccctcc

SEQ ID NO: 34901 - DNA, 1039 bp, Artificial Sequence
  chemically treated genomic DNA (Homo sapiens) CpG-island No: 34901
tcgtttcgtttcgtcgataaggggaatttcggtttgggagagggcgttttcggggattcgttgtttagtttaggtattgtttagttatcgggcgtcgaggattgcgaagcgtcggggtaggttggtacggtgtttattttttttaaaacgttagttttttaagtttagaagttcgttcggtttaggtcgggagcggtttacgtcggacggtcggatcgttttgtaggatttagttcggtcgttcgttttcgtcgtcggcggtgagggaggtgagcggcgtcgatttgcgggacgagtattatttcgatttagtcgggggtgaggcgggttaggatgtttcggtcgtaggaggaaaaggaggagttggattaaaagttcgaagagaagaaaaggggaaggtcgcgtacggagcgcggtaaaggtcggcggagttagacgtttcgaggtcggagtgaagcgtcgggatcgagtttcgttttttagggagttcggggcgtacggtatcgaggagagcgcgggagttaatttgggcgtattatgcgtagggttcgggacgttgggtcggtttatatcgtcgtttgggttacgtggttcggacgggtcggcggttgtttcggtcggggggcgggggtcgcgtcggggttgcgttggacgacggagagcggcgggttcgtagcggtttggagttttttaattcgcgcgtcgcgttggttttcgagcgtaggagtcgttttttgttttttcgcgtcggtttcgcgttcggtcgttcgttttttatatagcgcgttttagtagggttcgcgttaggtcgttagtttcggagtgggcgcgggatagtgcgcggcgtttcgtagttaggttttcgttttcgtcgtatttatttttttcgtcgtttgcgatttaacgggcgtttttcgtcgcggtagttgtcgtcgggttttcgcggttattatgaagaaggaggtgtgtttcgtggttttttttaaggtcgtgttcgtagagtttttggttatttttattttcgttttttttggtttgg

SEQ ID NO: 34902 - DNA, 1039 bp, Artificial Sequence
  chemically treated genomic DNA (Homo sapiens) CpG-island No: 34902
ccaaaccaaaaaaaacgaaaataaaaataaccaaaaactctacgaacacgaccttaaaaaaaaccacgaaacacacctccttcttcataataaccgcgaaaacccgacgacaactaccgcgacgaaaaacgcccgttaaatcgcaaacgacgaaaaaaataaatacgacgaaaacgaaaacctaactacgaaacgccgcgcactatcccgcgcccactccgaaactaacgacctaacgcgaaccctactaaaacgcgctatataaaaaacgaacgaccgaacgcgaaaccgacgcgaaaaaacaaaaaacgactcctacgctcgaaaaccaacgcgacgcgcgaattaaaaaactccaaaccgctacgaacccgccgctctccgtcgtccaacgcaaccccgacgcgacccccgccccccgaccgaaacaaccgccgacccgtccgaaccacgtaacccaaacgacgatataaaccgacccaacgtcccgaaccctacgcataatacgcccaaattaactcccgcgctctcctcgataccgtacgccccgaactccctaaaaaacgaaactcgatcccgacgcttcactccgacctcgaaacgtctaactccgccgacctttaccgcgctccgtacgcgaccttccccttttcttctcttcgaacttttaatccaactcctccttttcctcctacgaccgaaacatcctaacccgcctcacccccgactaaatcgaaataatactcgtcccgcaaatcgacgccgctcacctccctcaccgccgacgacgaaaacgaacgaccgaactaaatcctacaaaacgatccgaccgtccgacgtaaaccgctcccgacctaaaccgaacgaacttctaaacttaaaaaactaacgttttaaaaaaaataaacaccgtaccaacctaccccgacgcttcgcaatcctcgacgcccgataactaaacaatacctaaactaaacaacgaatccccgaaaacgccctctcccaaaccgaaattccccttatcgacgaaacgaaacga

SEQ ID NO: 34903 - DNA, 1039 bp, Artificial Sequence
  chemically treated genomic DNA (Homo sapiens) CpG-island No: 34903
ttaggttaaagaagacgaagatgagggtggttaagaattttgcgaatacggttttgaggaaggttacggagtatatttttttttttatggtggtcgcgggggttcggcggtagttgtcgcggcggggggcgttcgttgggtcgtaggcggcggaggaggtggatgcggcgggggcgggggtttggttgcggggcgtcgcgtattgtttcgcgtttatttcgaggttggcggtttggcgcgggttttgttggggcgcgttatatagggggcgggcggtcgggcgcggggtcggcgcgggggggtagggggcggtttttacgttcgggggttagcgcggcgcgcgggttgggaggttttaggtcgttgcgggttcgtcgtttttcgtcgtttagcgtaatttcggcgcgattttcgtttttcggtcggggtagtcgtcggttcgttcgggttacgtgatttaggcggcggtgtagatcggtttagcgtttcgggttttgcgtatgatgcgtttaggttggttttcgcgtttttttcggtgtcgtgcgtttcggattttttgggagacggggttcggtttcggcgttttatttcgatttcggggcgtttagtttcgtcggtttttatcgcgtttcgtgcgcggttttttttttttttttttttcgggtttttggtttagtttttttttttttttttgcgatcggagtattttgattcgttttattttcggttgggtcggagtgatgttcgtttcgtaggtcggcgtcgtttattttttttatcgtcggcggcgggggcgggcggtcgggttgggttttgtagggcggttcggtcgttcgacgtgggtcgttttcggtttgggtcgggcgagtttttgggtttggaaggttggcgttttgggaaaagtgggtatcgtgttagtttgtttcgacgtttcgtaattttcgacgttcggtagttgggtagtatttggattaggtaacggattttcggaggcgtttttttttaggtcggggttttttttgtcgacgggacgggacgg

SEQ ID NO: 34904 - DNA, 1039 bp, Artificial Sequence
  chemically treated genomic DNA (Homo sapiens) CpG-island No: 34904
ccgtcccgtcccgtcgacaaaaaaaaccccgacctaaaaaaaaacgcctccgaaaatccgttacctaatccaaatactacccaactaccgaacgtcgaaaattacgaaacgtcgaaacaaactaacacgatacccacttttcccaaaacgccaaccttccaaacccaaaaactcgcccgacccaaaccgaaaacgacccacgtcgaacgaccgaaccgccctacaaaacccaacccgaccgcccgcccccgccgccgacgataaaaaaaataaacgacgccgacctacgaaacgaacatcactccgacccaaccgaaaataaaacgaatcaaaatactccgatcgcaaaaaaaaaaaaaaaaactaaaccaaaaacccgaaaaaaaaaaaaaaaaaaaaccgcgcacgaaacgcgataaaaaccgacgaaactaaacgccccgaaatcgaaataaaacgccgaaaccgaaccccgtctcccaaaaaatccgaaacgcacgacaccgaaaaaaacgcgaaaaccaacctaaacgcatcatacgcaaaacccgaaacgctaaaccgatctacaccgccgcctaaatcacgtaacccgaacgaaccgacgactaccccgaccgaaaaacgaaaatcgcgccgaaattacgctaaacgacgaaaaacgacgaacccgcaacgacctaaaacctcccaacccgcgcgccgcgctaacccccgaacgtaaaaaccgccccctacccccccgcgccgaccccgcgcccgaccgcccgccccctatataacgcgccccaacaaaacccgcgccaaaccgccaacctcgaaataaacgcgaaacaatacgcgacgccccgcaaccaaacccccgcccccgccgcatccacctcctccgccgcctacgacccaacgaacgccccccgccgcgacaactaccgccgaacccccgcgaccaccataaaaaaaaaaatatactccgtaaccttcctcaaaaccgtattcgcaaaattcttaaccaccctcatcttcgtcttctttaacctaa

SEQ ID NO: 34905 - DNA, 511 bp, Artificial Sequence
  chemically treated genomic DNA (Homo sapiens) CpG-island No: 34905
taaacgtcggtggtcgcggacgcgtcggcggtcgggagtattttagcgggcgggtattatagaggcgcggtttttcggcgtttagatttgttatgtggcgcgcgtcggaagcggttttgaggtcggaagtgagtttagagcgtcgcggtttcgagatgaagtcggcggtggacgagatgtttttcgagggcgtcgggttttacgtggatttggacgaggtggtacgggttcggcgggagttttcgagcgtggggagcggggaagggggagcggaagggcggcgttttggtgcgcgggtttcggggaggggaggtcgggcgggtgggcgatgggcgcggtttttaggttttttgtttcgcggagagtaaatttcggttttttcgagtatttggtgaaaggcggcgatcgatcgcggcgggaagcgtgtgttttagttcgggggattaggaggcgtagtttgagggttgagtgtttgttgggtgtttttacggttttcgggaatatattcgtg

SEQ ID NO: 34906 - DNA, 511 bp, Artificial Sequence
  chemically treated genomic DNA (Homo sapiens) CpG-island No: 34906
cacgaatatattcccgaaaaccgtaaaaacacccaacaaacactcaaccctcaaactacgcctcctaatcccccgaactaaaacacacgcttcccgccgcgatcgatcgccgcctttcaccaaatactcgaaaaaaccgaaatttactctccgcgaaacaaaaaacctaaaaaccgcgcccatcgcccacccgcccgacctcccctccccgaaacccgcgcaccaaaacgccgcccttccgctcccccttccccgctccccacgctcgaaaactcccgccgaacccgtaccacctcgtccaaatccacgtaaaacccgacgccctcgaaaaacatctcgtccaccgccgacttcatctcgaaaccgcgacgctctaaactcacttccgacctcaaaaccgcttccgacgcgcgccacataacaaatctaaacgccgaaaaaccgcgcctctataatacccgcccgctaaaatactcccgaccgccgacgcgtccgcgaccaccgacgttta

SEQ ID NO: 34907 - DNA, 511 bp, Artificial Sequence
  chemically treated genomic DNA (Homo sapiens) CpG-island No: 34907
tacgggtgtgttttcgggggtcgtgggggtatttagtaggtatttaatttttaggttgcgttttttggtttttcgggttagggtatacgtttttcgtcgcggtcggtcgtcgttttttattaggtgttcggagaaatcgggatttgtttttcgcggggtagggagtttgggagtcgcgtttatcgtttattcgttcggtttttttttttcgggattcgcgtattaggacgtcgttttttcgttttttttttttcgttttttacgttcggagattttcgtcgggttcgtgttatttcgtttaggtttacgtagggttcggcgttttcggggaatatttcgtttatcgtcggttttatttcggggtcgcggcgttttaggtttattttcggttttagagtcgttttcggcgcgcgttatatggtagatttagacgtcggaggatcgcgtttttgtggtgttcgttcgttggggtgttttcggtcgtcggcgcgttcgcggttatcggcgtttg

SEQ ID NO: 34908 - DNA, 511 bp, Artificial Sequence
  chemically treated genomic DNA (Homo sapiens) CpG-island No: 34908
caaacgccgataaccgcgaacgcgccgacgaccgaaaacaccccaacgaacgaacaccacaaaaacgcgatcctccgacgtctaaatctaccatataacgcgcgccgaaaacgactctaaaaccgaaaataaacctaaaacgccgcgaccccgaaataaaaccgacgataaacgaaatattccccgaaaacgccgaaccctacgtaaacctaaacgaaataacacgaacccgacgaaaatctccgaacgtaaaaaacgaaaaaaaaaaaacgaaaaaacgacgtcctaatacgcgaatcccgaaaaaaaaaaaccgaacgaataaacgataaacgcgactcccaaactccctaccccgcgaaaaacaaatcccgatttctccgaacacctaataaaaaacgacgaccgaccgcgacgaaaaacgtataccctaacccgaaaaaccaaaaaacgcaacctaaaaattaaatacctactaaatacccccacgacccccgaaaacacacccgta

SEQ ID NO: 34909 - DNA, 608 bp, Artificial Sequence
  chemically treated genomic DNA (Homo sapiens) CpG-island No: 34909
tgttttttttttcggtttttgcgcgttttttcggtttttttttttcgtcgcgcgcgcgtttcgtttcgggcggttttggtttcgtttttcgcgtgcgattcgtcgtttttttttgcggcgtcgcgttttcggttttttttcgtttcgcgtttttatcgtgtttttcgtcgttttttcgttttcgggcgcggtcgttgttttttttttttcgttcgtcgtcgtttgttgttttgcgttttttcgtcgtgtttttcgggttttgttttcggtttttttttgtttcgttttgcggcggtttttcgttttttttcggttttttcgtgtcgttttgcgttttcgttttgcggtttcgttttgttgtttttttgtttcgcggttgtgtttttgcgcgcgcggttatttttcgttgttgtttttcgtttgtcggtcgtcgtcgcggtttcggcgtcgcgtcgtcgtcgcgtcgtttcgttcggatcggcgcgcgtgcgcgtggtggttcgttggtcgttttggggcgttcgtgcgagtgttgtttgtcgcgttgcgcggcgtttttcgcgattgttgttttcggtgtcggtcggttatgcgtcggtttttgtgtt

SEQ ID NO: 34910 - DNA, 608 bp, Artificial Sequence
  chemically treated genomic DNA (Homo sapiens) CpG-island No: 34910
aacacaaaaaccgacgcataaccgaccgacaccgaaaacaacaatcgcgaaaaacgccgcgcaacgcgacaaacaacactcgcacgaacgccccaaaacgaccaacgaaccaccacgcgcacgcgcgccgatccgaacgaaacgacgcgacgacgacgcgacgccgaaaccgcgacgacgaccgacaaacgaaaaacaacaacgaaaaataaccgcgcgcgcaaaaacacaaccgcgaaacaaaaaaacaacaaaacgaaaccgcaaaacgaaaacgcaaaacgacacgaaaaaaccgaaaaaaaacgaaaaaccgccgcaaaacgaaacaaaaaaaaaccgaaaacaaaacccgaaaaacacgacgaaaaaacgcaaaacaacaaacgacgacgaacgaaaaaaaaaaaacaacgaccgcgcccgaaaacgaaaaaacgacgaaaaacacgataaaaacgcgaaacgaaaaaaaaccgaaaacgcgacgccgcaaaaaaaaacgacgaatcgcacgcgaaaaacgaaaccaaaaccgcccgaaacgaaacgcgcgcgcgacgaaaaaaaaaaaccgaaaaaacgcgcaaaaaccgaaaaaaaaaaca

SEQ ID NO: 34911 - DNA, 608 bp, Artificial Sequence
  chemically treated genomic DNA (Homo sapiens) CpG-island No: 34911
agtatagaggtcggcgtatggtcggtcgatatcggaggtaatagtcgcgggggacgtcgcgtagcgcggtaagtaatattcgtacgaacgttttagagcgattagcgagttattacgcgtacgcgcgtcgattcgagcggggcgacgcggcggcggcgcggcgtcggagtcgcggcgacggtcggtaggcgaaggatagtagcgaggagtggtcgcgcgcgtagagatatagtcgcggaataggagagtagtagagcgggatcgtaaggcggaagcgtagagcggtacggaagggtcgagaggaggcgaggagtcgtcgtagggcggagtagaggagagtcgaaagtagggttcgaggagtacgacgaggagacgtagggtagtagacggcggcgggcgaggaggggaaggtagcggtcgcgttcggagacgagagagcggcggggggtacggtgggggcgcggggcgaaggggggtcggaagcgcggcgtcgtaggggggagcggcgggtcgtacgcggaggacggggttagggtcgttcgaggcgaagcgcgcgcgcggcggaagaggggggtcgagggggcgcgtagggatcggagaggggggta

SEQ ID NO: 34912 - DNA, 608 bp, Artificial Sequence
  chemically treated genomic DNA (Homo sapiens) CpG-island No: 34912
tacccccctctccgatccctacgcgccccctcgacccccctcttccgccgcgcgcgcgcttcgcctcgaacgaccctaaccccgtcctccgcgtacgacccgccgctcccccctacgacgccgcgcttccgaccccccttcgccccgcgcccccaccgtaccccccgccgctctctcgtctccgaacgcgaccgctaccttcccctcctcgcccgccgccgtctactaccctacgtctcctcgtcgtactcctcgaaccctactttcgactctcctctactccgccctacgacgactcctcgcctcctctcgacccttccgtaccgctctacgcttccgccttacgatcccgctctactactctcctattccgcgactatatctctacgcgcgcgaccactcctcgctactatccttcgcctaccgaccgtcgccgcgactccgacgccgcgccgccgccgcgtcgccccgctcgaatcgacgcgcgtacgcgtaataactcgctaatcgctctaaaacgttcgtacgaatattacttaccgcgctacgcgacgtcccccgcgactattacctccgatatcgaccgaccatacgccgacctctatact

SEQ ID NO: 34913 - DNA, 651 bp, Artificial Sequence
  chemically treated genomic DNA (Homo sapiens) CpG-island No: 34913
cggggtttcgcggcggttgggatttcgcggttgttggggtttcggttcgtttatttttttttgcgcgcgggtgagttttttttgtacgttgttggcgatttttttcgtcgttatttttttattgtttatttttgttatcgcggcgtaggtttcgttcggtggtaggggtcgttttcgcgcggggagattttgcgcgtcgcgtttttagtttttagtttcggtcgcgcgtttagatcggttgtcgttttacgtcgcgtattcgatagcggagttaattgacggaggcggagcgtgcgtcggacgggcgagcgagttagcgagttagttagcgagcgacgcggggatagagggagggagaggggaggggtcgggttttaggtcgcggtcggcgtttttcgttcgtttttttcggataataagttgttttttaaagggttatttcgggcgtcggtatcgttaggttcgcgaggagggaggggcgcgcgcggcgttggggttgcggcgagcgggatttttttgacgttttagttgtatcgtttcggggcggggattaattcgtcggtttggcgttttggtttttttcgtaagtagtaattttttgtaatttaggaaaggagattaggtggaggagaggagtgttttcgaaattaa

SEQ ID NO: 34914 - DNA, 651 bp, Artificial Sequence
  chemically treated genomic DNA (Homo sapiens) CpG-island No: 34914
ttaatttcgaaaacactcctctcctccacctaatctcctttcctaaattacaaaaaattactacttacgaaaaaaaccaaaacgccaaaccgacgaattaatccccgccccgaaacgatacaactaaaacgtcaaaaaaatcccgctcgccgcaaccccaacgccgcgcgcgcccctccctcctcgcgaacctaacgataccgacgcccgaaataaccctttaaaaaacaacttattatccgaaaaaaacgaacgaaaaacgccgaccgcgacctaaaacccgacccctcccctctccctccctctatccccgcgtcgctcgctaactaactcgctaactcgctcgcccgtccgacgcacgctccgcctccgtcaattaactccgctatcgaatacgcgacgtaaaacgacaaccgatctaaacgcgcgaccgaaactaaaaactaaaaacgcgacgcgcaaaatctccccgcgcgaaaacgacccctaccaccgaacgaaacctacgccgcgataacaaaaataaacaataaaaaaataacgacgaaaaaaatcgccaacaacgtacaaaaaaaactcacccgcgcgcaaaaaaaaataaacgaaccgaaaccccaacaaccgcgaaatcccaaccgccgcgaaaccccg

SEQ ID NO: 34915 - DNA, 651 bp, Artificial Sequence
  chemically treated genomic DNA (Homo sapiens) CpG-island No: 34915
ttgatttcgaaagtattttttttttttatttagtttttttttttgggttgtaggagattattgtttgcggggaagattaagacgttaggtcggcggattagttttcgtttcggggcggtgtagttggagcgttaggggagtttcgttcgtcgtagttttagcgtcgcgcgcgttttttttttttcgcggatttggcggtgtcggcgttcggagtggttttttaaaaggtagtttattgttcggagggggcgggcggggggcgtcgatcgcggtttgaggttcggttttttttttttttttttttttgttttcgcgtcgttcgttggttagttcgttggttcgttcgttcgttcggcgtacgtttcgttttcgttagttggtttcgttgtcgggtgcgcggcgtggagcggtagtcggtttggacgcgcggtcggggttgggggttgggagcgcggcgcgtaagattttttcgcgcgagagcggtttttgttatcgggcgaggtttgcgtcgcgatggtagagatgggtagtaaaggggtgacggcgggaaagatcgttagtaacgtgtagaagaagtttattcgcgcgtaggagaaggtgagcgagtcggagttttagtagtcgcggagttttagtcgtcgcggagtttcg

SEQ ID NO: 34916 - DNA, 651 bp, Artificial Sequence
  chemically treated genomic DNA (Homo sapiens) CpG-island No: 34916
cgaaactccgcgacgactaaaactccgcgactactaaaactccgactcgctcaccttctcctacgcgcgaataaacttcttctacacgttactaacgatctttcccgccgtcacccctttactacccatctctaccatcgcgacgcaaacctcgcccgataacaaaaaccgctctcgcgcgaaaaaatcttacgcgccgcgctcccaacccccaaccccgaccgcgcgtccaaaccgactaccgctccacgccgcgcacccgacaacgaaaccaactaacgaaaacgaaacgtacgccgaacgaacgaacgaaccaacgaactaaccaacgaacgacgcgaaaacaaaaaaaaaaaaaaaaaaaaaaccgaacctcaaaccgcgatcgacgccccccgcccgccccctccgaacaataaactaccttttaaaaaaccactccgaacgccgacaccgccaaatccgcgaaaaaaaaaaaacgcgcgcgacgctaaaactacgacgaacgaaactcccctaacgctccaactacaccgccccgaaacgaaaactaatccgccgacctaacgtcttaatcttccccgcaaacaataatctcctacaacccaaaaaaaaaaactaaataaaaaaaaaaaatactttcgaaatcaa

SEQ ID NO: 34917 - DNA, 761 bp, Artificial Sequence
  chemically treated genomic DNA (Homo sapiens) CpG-island No: 34917
gtaggaaatagtaatttaaagagtagttttcgaaataaagttgtttagataaataagtcgatgtagacgagcgttatggttttgttggcgcggattttgagagtcgggttgcggtcggcgttcgagcggggtgggtttttgggcggcggggtttcgcggcggttttaattcgcgggcgtacggttttcggcgggggcgcgggtcgaggataaaggcgtcgggcggtcggggtcgtcgtcgggagggggtcgagtcgagggttttcggagtttcgtcgttatgtcggggtcgaggattttcgttaatttggcggagtttttttgtagggacggttttagtcgtatttacgagatttaggtagcgcgcgtcgtttcgggagggagttagttcgggttgttgtttagaaggttgacggcgcgggcgggagggcgttagggaggggcgcggggttggggagttttagggaggggcggcgggtagggattttcgggtattgggcgtcgcggtgggttgggggagttggattggggttgttcggttaaggttcgtaggaaggggcgttggggagaggacgtcggaaaggcgattcggggtggaggaggtaggaatcgggagcggggcgggggcgttggggaggggttttcgggaagcggatttcggagaggggtagtaggtagagggagttgaggaacggggttagaaaggaacggttgggaagaggcgggggaaatgggtgtttcgggaggtggcggtagggaggg

SEQ ID NO: 34918 - DNA, 761 bp, Artificial Sequence
  chemically treated genomic DNA (Homo sapiens) CpG-island No: 34918
ccctccctaccgccacctcccgaaacacccatttcccccgcctcttcccaaccgttcctttctaaccccgttcctcaactccctctacctactacccctctccgaaatccgcttcccgaaaacccctccccaacgcccccgccccgctcccgattcctacctcctccaccccgaatcgcctttccgacgtcctctccccaacgccccttcctacgaaccttaaccgaacaaccccaatccaactcccccaacccaccgcgacgcccaatacccgaaaatccctacccgccgcccctccctaaaactccccaaccccgcgcccctccctaacgccctcccgcccgcgccgtcaaccttctaaacaacaacccgaactaactccctcccgaaacgacgcgcgctacctaaatctcgtaaatacgactaaaaccgtccctacaaaaaaactccgccaaattaacgaaaatcctcgaccccgacataacgacgaaactccgaaaaccctcgactcgaccccctcccgacgacgaccccgaccgcccgacgcctttatcctcgacccgcgcccccgccgaaaaccgtacgcccgcgaattaaaaccgccgcgaaaccccgccgcccaaaaacccaccccgctcgaacgccgaccgcaacccgactctcaaaatccgcgccaacaaaaccataacgctcgtctacatcgacttatttatctaaacaactttatttcgaaaactactctttaaattactatttcctac

SEQ ID NO: 34919 - DNA, 761 bp, Artificial Sequence
  chemically treated genomic DNA (Homo sapiens) CpG-island No: 34919
ttttttttgtcgttatttttcgagatatttatttttttcgtttttttttagtcgtttttttttggtttcgttttttagttttttttgtttgttgttttttttcggggttcgtttttcgaagatttttttttaacgttttcgtttcgttttcggtttttgttttttttatttcggatcgttttttcggcgttttttttttagcgtttttttttgcgaattttaatcggataattttagtttagtttttttaatttatcgcggcgtttagtgttcggggatttttgttcgtcgtttttttttgggattttttaatttcgcgtttttttttggcgttttttcgttcgcgtcgttagttttttgggtagtagttcgggttggttttttttcggggcggcgcgcgttatttggatttcgtggatgcggttgaagtcgtttttgtagaagaatttcgttaggttggcgagggttttcggtttcggtatggcggcgaggtttcggggattttcggttcggttttttttcggcggcgatttcggtcgttcggcgtttttgttttcggttcgcgttttcgtcgggagtcgtgcgttcgcgggttgaggtcgtcgcggggtttcgtcgtttaggagtttatttcgttcgggcgtcggtcgtagttcggtttttaggattcgcgttagtagggttatggcgttcgtttgtatcggtttgtttgtttgagtaattttgtttcgggggttgttttttgggttgttgttttttgt

SEQ ID NO: 34920 - DNA, 761 bp, Artificial Sequence
  chemically treated genomic DNA (Homo sapiens) CpG-island No: 34920
acaaaaaacaacaacccaaaaaacaacccccgaaacaaaattactcaaacaaacaaaccgatacaaacgaacgccataaccctactaacgcgaatcctaaaaaccgaactacgaccgacgcccgaacgaaataaactcctaaacgacgaaaccccgcgacgacctcaacccgcgaacgcacgactcccgacgaaaacgcgaaccgaaaacaaaaacgccgaacgaccgaaatcgccgccgaaaaaaaaccgaaccgaaaatccccgaaacctcgccgccataccgaaaccgaaaaccctcgccaacctaacgaaattcttctacaaaaacgacttcaaccgcatccacgaaatccaaataacgcgcgccgccccgaaaaaaaaccaacccgaactactacccaaaaaactaacgacgcgaacgaaaaaacgccaaaaaaaaacgcgaaattaaaaaatcccaaaaaaaaacgacgaacaaaaatccccgaacactaaacgccgcgataaattaaaaaaactaaactaaaattatccgattaaaattcgcaaaaaaaaacgctaaaaaaaaaacgccgaaaaaacgatccgaaataaaaaaaacaaaaaccgaaaacgaaacgaaaacgttaaaaaaaaatcttcgaaaaacgaaccccgaaaaaaaacaacaaacaaaaaaaactaaaaaacgaaaccaaaaaaaaacgactaaaaaaaaacgaaaaaaataaatatctcgaaaaataacgacaaaaaaaa

SEQ ID NO: 34921 - DNA, 555 bp, Artificial Sequence
  chemically treated genomic DNA (Homo sapiens) CpG-island No: 34921
ggatttgagtaacgaggcgtgagtcggcgagggttagagggtatggcgggggggtaggtgtgtgaattgtgacgggtaataagttgagaggtgagagacgtatggggatgagtaggaattggagttggtattcggtggggaggtagcggagcgggttgaggggtgttagggggtgaaggagtgcgcgggttcgtatggcggtagggtagttgttttttcgacggcggtagtcgtgcgcgtttagtttttatcgcgtacgtagcgatggtcggttaggttgcggggattcgttggtttggttcgcgggatggtagcggttttgcgagggacgtcggtcgcggtcgaggatttagaggaggagattgatagagtagtcggtttatcggggatgagatttggaaaggcgcgggatgggggtaggaagtgggcgtggcgagggagttaggtttcgggggcgcggcgatgttcgcgttcggagtttgtttttttcggattagcgttgaggagaggagtgttttttggttttgggattttaatttgaggttattttgttat

SEQ ID NO: 34922 - DNA, 555 bp, Artificial Sequence
  chemically treated genomic DNA (Homo sapiens) CpG-island No: 34922
ataacaaaataacctcaaattaaaatcccaaaaccaaaaaacactcctctcctcaacgctaatccgaaaaaaacaaactccgaacgcgaacatcgccgcgcccccgaaacctaactccctcgccacgcccacttcctacccccatcccgcgcctttccaaatctcatccccgataaaccgactactctatcaatctcctcctctaaatcctcgaccgcgaccgacgtccctcgcaaaaccgctaccatcccgcgaaccaaaccaacgaatccccgcaacctaaccgaccatcgctacgtacgcgataaaaactaaacgcgcacgactaccgccgtcgaaaaaacaactaccctaccgccatacgaacccgcgcactccttcaccccctaacacccctcaacccgctccgctacctccccaccgaataccaactccaattcctactcatccccatacgtctctcacctctcaacttattacccgtcacaattcacacacctacccccccgccataccctctaaccctcgccgactcacgcctcgttactcaaatcc

SEQ ID NO: 34923 - DNA, 555 bp, Artificial Sequence
  chemically treated genomic DNA (Homo sapiens) CpG-island No: 34923
gtagtaggatggttttagattgaggttttagggttaaaggatatttttttttttagcgttggttcgggaaaggtaagtttcgggcgcgagtatcgtcgcgttttcgaagtttggttttttcgttacgtttattttttgtttttatttcgcgtttttttaggttttattttcggtgaatcgattgttttgttagtttttttttttgggttttcggtcgcggtcggcgtttttcgtaaagtcgttgttatttcgcgggttaagttagcgggttttcgtagtttggtcggttatcgttgcgtgcgcggtaggagttgggcgcgtacggttatcgtcgtcggaggagtaattgttttgtcgttatgcgggttcgcgtatttttttattttttaatattttttagttcgtttcgttatttttttatcggatattagttttaatttttatttatttttatacgttttttattttttaatttgttattcgttataatttatatatttattttttcgttatattttttaattttcgtcgatttacgtttcgttatttagattt

SEQ ID NO: 34924 - DNA, 555 bp, Artificial Sequence
  chemically treated genomic DNA (Homo sapiens) CpG-island No: 34924
aaatctaaataacgaaacgtaaatcgacgaaaattaaaaaatataacgaaaaaataaatatataaattataacgaataacaaattaaaaaataaaaaacgtataaaaataaataaaaattaaaactaatatccgataaaaaaataacgaaacgaactaaaaaatattaaaaaataaaaaaatacgcgaacccgcataacgacaaaacaattactcctccgacgacgataaccgtacgcgcccaactcctaccgcgcacgcaacgataaccgaccaaactacgaaaacccgctaacttaacccgcgaaataacaacgactttacgaaaaacgccgaccgcgaccgaaaacccaaaaaaaaaaactaacaaaacaatcgattcaccgaaaataaaacctaaaaaaacgcgaaataaaaacaaaaaataaacgtaacgaaaaaaccaaacttcgaaaacgcgacgatactcgcgcccgaaacttacctttcccgaaccaacgctaaaaaaaaaaatatcctttaaccctaaaacctcaatctaaaaccatcctactac

SEQ ID NO: 34925 - DNA, 620 bp, Artificial Sequence
  chemically treated genomic DNA (Homo sapiens) CpG-island No: 34925
  misc_feature (315)..(315): n is either a, c, g or t
taagttgatggatcgttattacgagtagtgttatttcggtattatcgtatggcgttcgcgacggtttattagttcgtttttcgcgttatttttgtatttttttttgtatttttttttgtatttttcgataaaattgttgcgcgtcgcgattggtaatcggcgatatttattatttggtcggtttcgtgtagagcgtagtttcgtttttcgattataacgtttttcggttcgttatagtgttgtagggagcgagtattttatagtttcgttttgaatttgtatagatgcgcgttattaggcggcggatatcggcgntcgtcgttttcggggcggttatgcgttgttgtcggcgttcggtaggaagatggttttgttttcgtcgatatttttgcgtatatatttgatgttggtcggattcgggttcgtatagaatattttgttgtttaggttggtatgtatttgcgggcgtagaatgtagttgatgaataggtgcgtattattcggatggggcgcgtcggtcgggatggttatggtgtcgaatattagggcggtcgttttcggtattagtatttggattatattgtcgtttttcgtatcgatggcgcgttggcgcgcgatat

SEQ ID NO: 34926 - DNA, 620 bp, Artificial Sequence
  chemically treated genomic DNA (Homo sapiens) CpG-island No: 34926
  misc_feature (306)..(306): n is either a, c, g or t
atatcgcgcgccaacgcgccatcgatacgaaaaacgacaatataatccaaatactaataccgaaaacgaccgccctaatattcgacaccataaccatcccgaccgacgcgccccatccgaataatacgcacctattcatcaactacattctacgcccgcaaatacataccaacctaaacaacaaaatattctatacgaacccgaatccgaccaacatcaaatatatacgcaaaaatatcgacgaaaacaaaaccatcttcctaccgaacgccgacaacaacgcataaccgccccgaaaacgacgancgccgatatccgccgcctaataacgcgcatctatacaaattcaaaacgaaactataaaatactcgctccctacaacactataacgaaccgaaaaacgttataatcgaaaaacgaaactacgctctacacgaaaccgaccaaataataaatatcgccgattaccaatcgcgacgcgcaacaattttatcgaaaaatacaaaaaaaaatacaaaaaaaaatacaaaaataacgcgaaaaacgaactaataaaccgtcgcgaacgccatacgataataccgaaataacactactcgtaataacgatccatcaactta

SEQ ID NO: 34927 - DNA, 620 bp, Artificial Sequence
  chemically treated genomic DNA (Homo sapiens) CpG-island No: 34927
  misc_feature (306)..(306): n is either a, c, g or t
atatcgcgcgttagcgcgttatcgatgcgaagaacggtaatgtgatttaggtgttggtgtcgaagacggtcgttttgatgttcgatattatggttatttcggtcgacgcgttttattcgaataatgcgtatttgtttattaattatattttgcgttcgtaagtgtatgttagtttgagtaataaggtgttttatgcgaattcgaattcggttagtattaagtatgtgcgtaaggatatcggcgagaataaggttatttttttgtcggacgtcgatagtagcgtatggtcgtttcggaagcgacgancgtcgatattcgtcgtttgatgacgcgtatttatataagtttaagacgggattgtgaggtattcgttttttgtaatattgtagcgagtcgaagggcgttgtgatcgagaagcggaattgcgttttgtacggggtcgattaggtagtgggtatcgtcgattgttaatcgcgacgcgtagtagttttgtcgggagatataagaggagatataaggggaaatataaggatggcgcgagagacggattggtaggtcgtcgcgggcgttatgcgatagtgtcgaggtaatattattcgtggtagcggtttattagtttg

SEQ ID NO: 34928 - DNA, 620 bp, Artificial Sequence
  chemically treated genomic DNA (Homo sapiens) CpG-island No: 34928
  misc_feature (315)..(315): n is either a, c, g or t
caaactaataaaccgctaccacgaataatattacctcgacactatcgcataacgcccgcgacgacctaccaatccgtctctcgcgccatccttatatttccccttatatctcctcttatatctcccgacaaaactactacgcgtcgcgattaacaatcgacgatacccactacctaatcgaccccgtacaaaacgcaattccgcttctcgatcacaacgcccttcgactcgctacaatattacaaaaaacgaatacctcacaatcccgtcttaaacttatataaatacgcgtcatcaaacgacgaatatcgacgntcgtcgcttccgaaacgaccatacgctactatcgacgtccgacaaaaaaataaccttattctcgccgatatccttacgcacatacttaatactaaccgaattcgaattcgcataaaacaccttattactcaaactaacatacacttacgaacgcaaaatataattaataaacaaatacgcattattcgaataaaacgcgtcgaccgaaataaccataatatcgaacatcaaaacgaccgtcttcgacaccaacacctaaatcacattaccgttcttcgcatcgataacgcgctaacgcgcgatat

SEQ ID NO: 34929 - DNA, 723 bp, Artificial Sequence
  chemically treated genomic DNA (Homo sapiens) CpG-island No: 34929
cgggcgcggggcggttgttatattattttggtcgggtttcgaaagggaggagtggagtttgttcgttttcgcgagttttcgcgcgtttagatttttttttatttgttcggcgtgtttagggcgtttttagcgttggaagtcgggggcgtttgttcgagtcgggagtcgttgggttatgtttttgtttattaggtttttcgaatttttggtatggtagcgtttgttcgtgttttcgatttttttcgtaggtaattcgcgcgaatttggggttcgtagagagcgagcgttcgcggatatcggttgaatagtttggaggttgcgcgagggggcgtcgcggggagggataaaagttagtaataaagagtatagatttcgtttagtagttgattgattcgttttaaaatagtcgtttttatttgttgtttttcgcgtttcgtttttaggcgtagtattcgggtttgtagttcggtcgttcgaaagtgggcgagtaggttgagtgttagcgagtagagggttagcgttagtagttcgtacgattttggattcggtagtcgtgcgtcgcgtttcgttcgcgtcgttattagagttatcgtttcgggcgcgtttaattttttagggtcgcgggtatcggtggttgtcgttttgtgggtgcgtttcgttattattttttcgcgttttgagaattaataaataaataaatagaataaataaaggcgatagtcg

SEQ ID NO: 34930 - DNA, 723 bp, Artificial Sequence
  chemically treated genomic DNA (Homo sapiens) CpG-island No: 34930
cgactatcgcctttatttattctatttatttatttattaattctcaaaacgcgaaaaaataataacgaaacgcacccacaaaacgacaaccaccgatacccgcgaccctaaaaaattaaacgcgcccgaaacgataactctaataacgacgcgaacgaaacgcgacgcacgactaccgaatccaaaatcgtacgaactactaacgctaaccctctactcgctaacactcaacctactcgcccactttcgaacgaccgaactacaaacccgaatactacgcctaaaaacgaaacgcgaaaaacaacaaataaaaacgactattttaaaacgaatcaatcaactactaaacgaaatctatactctttattactaacttttatccctccccgcgacgccccctcgcgcaacctccaaactattcaaccgatatccgcgaacgctcgctctctacgaaccccaaattcgcgcgaattacctacgaaaaaaatcgaaaacacgaacaaacgctaccataccaaaaattcgaaaaacctaataaacaaaaacataacccaacgactcccgactcgaacaaacgcccccgacttccaacgctaaaaacgccctaaacacgccgaacaaataaaaaaaaatctaaacgcgcgaaaactcgcgaaaacgaacaaactccactcctccctttcgaaacccgaccaaaataatataacaaccgccccgcgcccg

SEQ ID NO: 34931 - DNA, 723 bp, Artificial Sequence
  chemically treated genomic DNA (Homo sapiens) CpG-island No: 34931
cggttgtcgtttttatttattttatttatttatttattggtttttaagacgcgagaggatggtagcggagcgtatttataaagcggtagttatcggtgttcgcggttttggggagttgggcgcgttcgggacggtggttttggtggcggcgcgggcggagcgcggcgtacggttgtcgagtttagggtcgtgcgggttgttgacgttggttttttgttcgttggtatttagtttgttcgtttattttcggacggtcgagttgtaggttcgggtgttgcgtttggaagcggagcgcggggagtagtaaatggagacggttattttgggacgagttaattaattgttggacgaggtttgtgttttttgttgttggtttttattttttttcgcggcgttttttcgcgtagtttttagattgtttagtcggtgttcgcgggcgttcgttttttgcgagttttaggttcgcgcgagttgtttgcgggaggggtcggggatacggatagacgttgttatattagggattcggaggatttggtgggtaagagtatgatttagcgattttcggttcgggtaagcgttttcggtttttagcgttgggagcgttttgggtacgtcgggtaggtggaggaaggtttgggcgcgcggaggttcgcggaggcgggtaagttttatttttttttttcgggattcggttagggtggtgtgatagtcgtttcgcgttcg

SEQ ID NO: 34932 - DNA, 723 bp, Artificial Sequence
  chemically treated genomic DNA (Homo sapiens) CpG-island No: 34932
cgaacgcgaaacgactatcacaccaccctaaccgaatcccgaaaaaaaaaaataaaacttacccgcctccgcgaacctccgcgcgcccaaaccttcctccacctacccgacgtacccaaaacgctcccaacgctaaaaaccgaaaacgcttacccgaaccgaaaatcgctaaatcatactcttacccaccaaatcctccgaatccctaatataacaacgtctatccgtatccccgacccctcccgcaaacaactcgcgcgaacctaaaactcgcaaaaaacgaacgcccgcgaacaccgactaaacaatctaaaaactacgcgaaaaaacgccgcgaaaaaaaataaaaaccaacaacaaaaaacacaaacctcgtccaacaattaattaactcgtcccaaaataaccgtctccatttactactccccgcgctccgcttccaaacgcaacacccgaacctacaactcgaccgtccgaaaataaacgaacaaactaaataccaacgaacaaaaaaccaacgtcaacaacccgcacgaccctaaactcgacaaccgtacgccgcgctccgcccgcgccgccaccaaaaccaccgtcccgaacgcgcccaactccccaaaaccgcgaacaccgataactaccgctttataaatacgctccgctaccatcctctcgcgtcttaaaaaccaataaataaataaataaaataaataaaaacgacaaccg

SEQ ID NO: 34933 - DNA, 633 bp, Artificial Sequence
  chemically treated genomic DNA (Homo sapiens) CpG-island No: 34933
cgcgcggcgcgtgtattttagtaatagatttttaggtttttagcgcgggttaggaaggggtcggcgtttcgcgtttcgtcgggtgtgtgattttgtcgcgagggcgtagtcgagcggtcgcgtttgatgttgttgttgttatggcgattagcgtttcggcgattggttcggcgcggtcgtattacgttgttttttgggcgcggggggtgggggaggtttcggcgcgttcgtttttttttcggatgttgcgagagtaaattcggggtagttttttttcgatttttttttttttattttcgcgtttcgtatttcggatggacgggagggaaaaattttaaggtgggtttaggtagtagcgaggtggacgttttcgtttagtttggcgattacggttattcgacgttttcgttcgtttttgggtacggtgtgagcgcgcgttacgtgttagggttttttatagttcgttgttggcgtcgtttttcgttttcgttttagtttttttggaggagttcgttattttcgggaatgtgattcgtttcgcgatttaattttatttttttttattttttgtttgagtcgtttgttttttttggaaatacgttgagttttttcgttggagagggagttagaata

SEQ ID NO: 34934 - DNA, 633 bp, Artificial Sequence
  chemically treated genomic DNA (Homo sapiens) CpG-island No: 34934
tattctaactccctctccaacgaaaaaactcaacgtatttccaaaaaaaacaaacgactcaaacaaaaaataaaaaaaaataaaattaaatcgcgaaacgaatcacattcccgaaaataacgaactcctccaaaaaaactaaaacgaaaacgaaaaacgacgccaacaacgaactataaaaaaccctaacacgtaacgcgcgctcacaccgtacccaaaaacgaacgaaaacgtcgaataaccgtaatcgccaaactaaacgaaaacgtccacctcgctactacctaaacccaccttaaaatttttccctcccgtccatccgaaatacgaaacgcgaaaataaaaaaaaaaaaatcgaaaaaaaactaccccgaatttactctcgcaacatccgaaaaaaaaacgaacgcgccgaaacctcccccaccccccgcgcccaaaaaacaacgtaatacgaccgcgccgaaccaatcgccgaaacgctaatcgccataacaacaacaacatcaaacgcgaccgctcgactacgccctcgcgacaaaatcacacacccgacgaaacgcgaaacgccgaccccttcctaacccgcgctaaaaacctaaaaatctattactaaaatacacgcgccgcgcg

SEQ ID NO: 34935 - DNA, 633 bp, Artificial Sequence
  chemically treated genomic DNA (Homo sapiens) CpG-island No: 34935
tgttttggttttttttttagcggggaggtttaacgtgtttttaagaggagtaggcggtttaggtaagaagtggaggggaataaaattaaatcgcggggcgagttatattttcgggggtggcgggtttttttagggaggttggggcgggagcggggggcggcgttagtagcgggttgtggagggttttggtacgtagcgcgcgtttatatcgtgtttaggagcgagcgaggacgtcgagtaatcgtggtcgttaggttgggcgggggcgtttatttcgttgttatttgggtttattttggggtttttttttttcgtttattcggggtgcggggcgcggggatgaggaggggagggtcgagagaaggttgtttcgggtttgttttcgtagtattcggagaaggggcgggcgcgtcggagttttttttatttttcgcgtttaaggagtaacgtagtgcggtcgcgtcggattaatcgtcgaggcgttggtcgttatggtaatagtagtattaggcgcggtcgttcggttgcgttttcgcggtaaagttatatattcggcggggcgcggggcgtcggtttttttttggttcgcgttggaaatttggaagtttgttgttaaaatgtacgcgtcgcgcg

SEQ ID NO: 34936 - DNA, 633 bp, Artificial Sequence
  chemically treated genomic DNA (Homo sapiens) CpG-island No: 34936
cgcgcgacgcgtacattttaacaacaaacttccaaatttccaacgcgaaccaaaaaaaaaccgacgccccgcgccccgccgaatatataactttaccgcgaaaacgcaaccgaacgaccgcgcctaatactactattaccataacgaccaacgcctcgacgattaatccgacgcgaccgcactacgttactccttaaacgcgaaaaataaaaaaaactccgacgcgcccgccccttctccgaatactacgaaaacaaacccgaaacaaccttctctcgaccctcccctcctcatccccgcgccccgcaccccgaataaacgaaaaaaaaaaaccccaaaataaacccaaataacaacgaaataaacgcccccgcccaacctaacgaccacgattactcgacgtcctcgctcgctcctaaacacgatataaacgcgcgctacgtaccaaaaccctccacaacccgctactaacgccgccccccgctcccgccccaacctccctaaaaaaacccgccacccccgaaaatataactcgccccgcgatttaattttattcccctccacttcttacctaaaccgcctactcctcttaaaaacacgttaaacctccccgctaaaaaaaaaaccaaaaca

SEQ ID NO: 34937 - DNA, 1070 bp, Artificial Sequence
  chemically treated genomic DNA (Homo sapiens) CpG-island No: 34937
ggagacgcgtgcgatttaggtagattttgcgcggatttcgcgttaaggaggggtcgttgtttaggaatcgtttttttttttcgcgcgtgtttgttttcgtgcgcgcgttcgtttaatgttttcgattattgtttgttagtcgatttttattttaatcggtttgtttattttttcgggagcggagagatttaacgggatacgtcgttcgttttcgttttttcgggagcgcgagcgcgttttcggttgcgtttgtatagtaatgaggggcggggaggggcgacggggacgcggtggtttcgcgttcgcgcgtgtcgggacgtatcgcggggggcggcgcgattgtgaggtggcgttgacgtacgtttcggggtttttaagcggttagggcggttacggcgattgcgacggcggcggcggcggcgatcgtcgcgaggggtggtggggtcgaagtcggtgttttttggtttagttacggtgttttttttttattgattttttttttttttattacggtcgcgtaattttagcgtcggcggttttttaggtggggtaggggacgaggagcgttttttttcgttgtcggcggtttgataaatgagggatttcgggtttggggtgttgtagatcgtttcgtttcgaagtagtagttttgggtttttgttttgcggcgaggcgtatggtttttacgtcgtggggttcgttaattcgttgtttttcgttacgtttttcggtttattgtcgttattatcgttgtttgttatcggttttttagaggtcgtttttttttttttcgtttttttcggcggcggcgcgggtagttcggtcgtcgtcgtttttttttttttttcgtttttggcgtattagtagattatgtaggatgagttgtttttggggttgatatagtagtcggcgcggtcgttttcgggggcggcggttacggagaaatttttcgattattatttcggcggcggtacgatcgcgggtgtgatttattttttttttttttaggattttaaatcgagtttgtattatttttttttttttttcgtttttttttgttgttgttgtcg

SEQ ID NO: 34938 - DNA, 1070 bp, Artificial Sequence
  chemically treated genomic DNA (Homo sapiens) CpG-island No: 34938
cgacaacaacaacaaaaaaaaacgaaaaaaaaaaaaaaataatacaaactcgatttaaaatcctaaaaaaaaaaaaaataaatcacacccgcgatcgtaccgccgccgaaataataatcgaaaaatttctccgtaaccgccgcccccgaaaacgaccgcgccgactactatatcaaccccaaaaacaactcatcctacataatctactaatacgccaaaaacgaaaaaaaaaaaaaaacgacgacgaccgaactacccgcgccgccgccgaaaaaaacgaaaaaaaaaaaaacgacctctaaaaaaccgataacaaacaacgataataacgacaataaaccgaaaaacgtaacgaaaaacaacgaattaacgaaccccacgacgtaaaaaccatacgcctcgccgcaaaacaaaaacccaaaactactacttcgaaacgaaacgatctacaacaccccaaacccgaaatccctcatttatcaaaccgccgacaacgaaaaaaaacgctcctcgtcccctaccccacctaaaaaaccgccgacgctaaaattacgcgaccgtaataaaaaaaaaaaaaatcaataaaaaaaaaacaccgtaactaaaccaaaaaacaccgacttcgaccccaccacccctcgcgacgatcgccgccgccgccgccgtcgcaatcgccgtaaccgccctaaccgcttaaaaaccccgaaacgtacgtcaacgccacctcacaatcgcgccgccccccgcgatacgtcccgacacgcgcgaacgcgaaaccaccgcgtccccgtcgcccctccccgcccctcattactatacaaacgcaaccgaaaacgcgctcgcgctcccgaaaaaacgaaaacgaacgacgtatcccgttaaatctctccgctcccgaaaaaataaacaaaccgattaaaataaaaatcgactaacaaacaataatcgaaaacattaaacgaacgcgcgcacgaaaacaaacacgcgcgaaaaaaaaaaacgattcctaaacaacgacccctccttaacgcgaaatccgcgcaaaatctacctaaatcgcacgcgtctcc

SEQ ID NO: 34939 - DNA, 1070 bp, Artificial Sequence
  chemically treated genomic DNA (Homo sapiens) CpG-island No: 34939
cggtagtagtagtaggaggaggcggaggaggaggaggggtggtgtagattcggtttgaagttttgggaggggaggaggtgggttatattcgcgatcgtgtcgtcgtcggggtggtggtcggggagttttttcgtggtcgtcgttttcgaaagcggtcgcgtcggttgttgtgttagttttagaagtagtttattttgtatggtttgttgatgcgttaggaacggggaggaagaggaagcggcggcggtcgggttgttcgcgtcgtcgtcgagggggacggagaagggggaggcggtttttaagaagtcggtgataggtaacggtggtggcgatagtgggtcgaagggcgtggcggagggtagcgggttgacggattttacggcgtaaggattatacgtttcgtcgtagaataggggtttaggattgttatttcggagcggggcggtttgtagtattttaaattcgaaattttttatttattaggtcgtcggtagcgggaggagacgtttttcgttttttgttttatttaggaagtcgtcggcgttggggttgcgcggtcgtggtggaaggagggggagttagtgagagagggatatcgtgattgagttagggggtatcgatttcggttttattatttttcgcggcgatcgtcgtcgtcgtcgtcgtcgtagtcgtcgtagtcgttttggtcgtttaagaatttcggaacgtgcgttagcgttattttataatcgcgtcgtttttcgcggtgcgtttcggtacgcgcgggcgcgaggttatcgcgttttcgtcgttttttttcgttttttattattatgtagacgtagtcgagggcgcgttcgcgttttcgggagggcgggagcgagcggcgtgtttcgttgggttttttcgttttcggggaaatggataggtcggttggggtgggggtcggttggtaaatagtggtcgggagtattgggcgggcgcgcgtacgagggtaagtacgcgcgggagggagggacggtttttgggtaacggtttttttttggcgcgggattcgcgtagagtttgtttgggtcgtacgcgttttt

SEQ ID NO: 34940 - DNA, 1070 bp, Artificial Sequence
  chemically treated genomic DNA (Homo sapiens) CpG-island No: 34940
aaaaacgcgtacgacccaaacaaactctacgcgaatcccgcgccaaaaaaaaaccgttacccaaaaaccgtccctccctcccgcgcgtacttaccctcgtacgcgcgcccgcccaatactcccgaccactatttaccaaccgacccccaccccaaccgacctatccatttccccgaaaacgaaaaaacccaacgaaacacgccgctcgctcccgccctcccgaaaacgcgaacgcgccctcgactacgtctacataataataaaaaacgaaaaaaaacgacgaaaacgcgataacctcgcgcccgcgcgtaccgaaacgcaccgcgaaaaacgacgcgattataaaataacgctaacgcacgttccgaaattcttaaacgaccaaaacgactacgacgactacgacgacgacgacgacgacgatcgccgcgaaaaataataaaaccgaaatcgataccccctaactcaatcacgatatccctctctcactaactccccctccttccaccacgaccgcgcaaccccaacgccgacgacttcctaaataaaacaaaaaacgaaaaacgtctcctcccgctaccgacgacctaataaataaaaaatttcgaatttaaaatactacaaaccgccccgctccgaaataacaatcctaaacccctattctacgacgaaacgtataatccttacgccgtaaaatccgtcaacccgctaccctccgccacgcccttcgacccactatcgccaccaccgttacctatcaccgacttcttaaaaaccgcctcccccttctccgtccccctcgacgacgacgcgaacaacccgaccgccgccgcttcctcttcctccccgttcctaacgcatcaacaaaccatacaaaataaactacttctaaaactaacacaacaaccgacgcgaccgctttcgaaaacgacgaccacgaaaaaactccccgaccaccaccccgacgacgacacgatcgcgaatataacccacctcctcccctcccaaaacttcaaaccgaatctacaccacccctcctcctcctccgcctcctcctactactactaccg

SEQ ID NO: 34941 - DNA, 516 bp, Artificial Sequence
  chemically treated genomic DNA (Homo sapiens) CpG-island No: 34941
tttcgagcgttttttttcgcgagagttgcgcggtcggaattgcgtcggcgtgacgttattgatttcgtcgggtttattttcggcgttcgtatcgtttcgttttttagttaaggtttcgggttgaggtatttgtttggttgtagttttttttcgatttgttcggcgggatttaggggattaagtcgagtcgagtcgcggggttcgttttagttcggttatgagcgcggtcgtatgatgcgtttttgtttcggtcgttgtagtcgtcgtcgtcgtcgtcgtaggtcgggaggagtcgtagcgtcgggcgatttcgttcgggtttcgggtgagtgcggcgggttgggtcgggcgggttgtttattttcgggtttttcggttatttttggttttcggcgtgttttgttttttcgtcggtttcgtcgttttgtttttatttcgtcgtatatttgcgattttttggagtttttaggggtattttcgtgttcgtatttgattttttttttaggtgtttttttg

SEQ ID NO: 34942 - DNA, 516 bp, Artificial Sequence
  chemically treated genomic DNA (Homo sapiens) CpG-island No: 34942
caaaaaaacacctaaaaaaaaaatcaaatacgaacacgaaaatacccctaaaaactccaaaaaatcgcaaatatacgacgaaataaaaacaaaacgacgaaaccgacgaaaaaacaaaacacgccgaaaaccaaaaataaccgaaaaacccgaaaataaacaacccgcccgacccaacccgccgcactcacccgaaacccgaacgaaatcgcccgacgctacgactcctcccgacctacgacgacgacgacgacgactacaacgaccgaaacaaaaacgcatcatacgaccgcgctcataaccgaactaaaacgaaccccgcgactcgactcgacttaatcccctaaatcccgccgaacaaatcgaaaaaaaactacaaccaaacaaatacctcaacccgaaaccttaactaaaaaacgaaacgatacgaacgccgaaaataaacccgacgaaatcaataacgtcacgccgacgcaattccgaccgcgcaactctcgcgaaaaaaaacgctcgaaa

SEQ ID NO: 34943 - DNA, 516 bp, Artificial Sequence
  chemically treated genomic DNA (Homo sapiens) CpG-island No: 34943
taagggggtatttggaagggaagttaggtgcgggtacggaggtgtttttaggaattttagaaggtcgtaggtgtgcggcggggtggagatagagcggcggaatcgacggaaggatagggtacgtcgggggttagaagtggtcgggagattcgggagtgagtagttcgttcggtttagttcgtcgtatttattcgaggttcgggcggggtcgttcggcgttgcggtttttttcggtttgcggcggcggcggcggcgattgtagcggtcgaggtagggacgtattatgcggtcgcgtttatggtcgggttggagcgggtttcgcggttcggttcggtttggttttttgggtttcgtcgggtaggtcggaaggaggttgtagttaagtaaatgttttagttcggagttttggttggagagcggggcggtgcgagcgtcggaagtgaattcgacgaggttagtgacgttacgtcggcgtagtttcggtcgcgtagttttcgcggagaggggcgttcgagg

SEQ ID NO: 34944 - DNA, 516 bp, Artificial Sequence
  chemically treated genomic DNA (Homo sapiens) CpG-island No: 34944
cctcgaacgcccctctccgcgaaaactacgcgaccgaaactacgccgacgtaacgtcactaacctcgtcgaattcacttccgacgctcgcaccgccccgctctccaaccaaaactccgaactaaaacatttacttaactacaacctccttccgacctacccgacgaaacccaaaaaaccaaaccgaaccgaaccgcgaaacccgctccaacccgaccataaacgcgaccgcataatacgtccctacctcgaccgctacaatcgccgccgccgccgccgcaaaccgaaaaaaaccgcaacgccgaacgaccccgcccgaacctcgaataaatacgacgaactaaaccgaacgaactactcactcccgaatctcccgaccacttctaacccccgacgtaccctatccttccgtcgattccgccgctctatctccaccccgccgcacacctacgaccttctaaaattcctaaaaacacctccgtacccgcacctaacttcccttccaaataccccctta

SEQ ID NO: 34945 - DNA, 974 bp, Artificial Sequence
  chemically treated genomic DNA (Homo sapiens) CpG-island No: 34945
gtcggcggcggtaggttttatttcgcggagcgagttcgtaagttgtaggcgcgtcgttaagatgtagcggcggtttcggttgtcgtcgggcgggttaggagtagcgcgattcgagtcgggtagggggcgttcgttacggtattcgcgcgtttttagcgtttagattcgtttgcgggttcggattttttttgttattgttttattcgtcgtttttgttattttattttttgtgtcgtcgtagttcggtgttttcggttttgcgggatttcggtcgggtcggattttggtaaagcgttaggtttcgcgtgggttttcggcgagcggttgatggcgagggggcgcggcgcggttttgtagttcgagttttcgacgttggaggttcggttcgttttagtcgtattgtttcgggtcgcgcgtatcggtttttgagttgcgtcgtcgtagtattcgtcgtattcgcggggttatgcggagagtcgtcgggatggaggattttttcgcggaggaagaggagttttggtacgattagtaggatttggagtagggtgagcgcgggggcgatcgggataggaaggcggggagcgttcggtgatttttgttcgtttttttattgttgggcgttattatttcgggaggggttgggttggatcgggcgcgttcgattcggaggagggacgcgtttggagaatcgggacgtggagagagggggcgttgtcggagaagacgcggatcggacgggcggagatttgtaaaagtggggggcggggggcggtttttttatttttttagacgatcgggtattcgttatttagttcgtttatttcgttttggaggtagtaattgttcggtcgtttttggtattgttacggggtttgagcgttagttaggagttttttgaggtcgggaggcggttttttcgttatgttttgttgggagggtggtttgtgtgtagagggaagttattttacgttaaa

SEQ ID NO: 34946 - DNA, 974 bp, Artificial Sequence
  chemically treated genomic DNA (Homo sapiens) CpG-island No: 34946
tttaacgtaaaataacttccctctacacacaaaccaccctcccaacaaaacataacgaaaaaaccgcctcccgacctcaaaaaactcctaactaacgctcaaaccccgtaacaataccaaaaacgaccgaacaattactacctccaaaacgaaataaacgaactaaataacgaatacccgatcgtctaaaaaaataaaaaaaccgccccccgccccccacttttacaaatctccgcccgtccgatccgcgtcttctccgacaacgccccctctctccacgtcccgattctccaaacgcgtccctcctccgaatcgaacgcgcccgatccaacccaacccctcccgaaataataacgcccaacaataaaaaaacgaacaaaaatcaccgaacgctccccgccttcctatcccgatcgcccccgcgctcaccctactccaaatcctactaatcgtaccaaaactcctcttcctccgcgaaaaaatcctccatcccgacgactctccgcataaccccgcgaatacgacgaatactacgacgacgcaactcaaaaaccgatacgcgcgacccgaaacaatacgactaaaacgaaccgaacctccaacgtcgaaaactcgaactacaaaaccgcgccgcgccccctcgccatcaaccgctcgccgaaaacccacgcgaaacctaacgctttaccaaaatccgacccgaccgaaatcccgcaaaaccgaaaacaccgaactacgacgacacaaaaaataaaataacaaaaacgacgaataaaacaataacaaaaaaaatccgaacccgcaaacgaatctaaacgctaaaaacgcgcgaataccgtaacgaacgccccctacccgactcgaatcgcgctactcctaacccgcccgacgacaaccgaaaccgccgctacatcttaacgacgcgcctacaacttacgaactcgctccgcgaaataaaacctaccgccgccgac

SEQ ID NO: 34947 - DNA, 974 bp, Artificial Sequence
  chemically treated genomic DNA (Homo sapiens) CpG-island No: 34947
tttggcgtgagataatttttttttatatataagttatttttttagtaaaatatgacgaaggagtcgtttttcggttttagaagatttttagttagcgtttaggtttcgtaataatattaggggcggtcgagtagttgttgtttttaggacggggtgggcgagttggatgacggatgttcggtcgtttgggaaaataggaagatcgtttttcgttttttatttttgtaggttttcgttcgttcggttcgcgtttttttcggtagcgttttttttttttacgtttcggttttttagacgcgtttttttttcgagtcgggcgcgttcggtttagtttagtttttttcggggtgatagcgtttaataatggagaagcggataggggttatcgggcgtttttcgtttttttgtttcggtcgttttcgcgtttattttgttttaggttttgttggtcgtattaggattttttttttttcgcggagaagttttttatttcggcggtttttcgtatggtttcgcgggtgcggcgggtgttgcggcggcgtagtttaagggtcggtgcgcgcggttcgggataatgcggttgaggcgggtcgggtttttagcgtcgggaattcgggttatagagtcgcgtcgcgttttttcgttattaatcgttcgtcgggagtttacgcggggtttggcgttttgttagggttcggttcggtcggggtttcgtagagtcgggggtatcgggttgcggcgatataaagggtggagtggtagggacggcgggtgggatagtggtaaggaggattcgggttcgtaggcgggtttgggcgttaggagcgcgcgggtgtcgtggcgggcgttttttgttcggttcgggtcgcgttgtttttggttcgttcggcgataatcggagtcgtcgttgtattttggcggcgcgtttgtagtttgcgagttcgtttcgcggggtggggtttgtcgtcgtcgat

SEQ ID NO: 34948 - DNA, 974 bp, Artificial Sequence
  chemically treated genomic DNA (Homo sapiens) CpG-island No: 34948
atcgacgacgacaaaccccaccccgcgaaacgaactcgcaaactacaaacgcgccgccaaaatacaacgacgactccgattatcgccgaacgaaccaaaaacaacgcgacccgaaccgaacaaaaaacgcccgccacgacacccgcgcgctcctaacgcccaaacccgcctacgaacccgaatcctccttaccactatcccacccgccgtccctaccactccaccctttatatcgccgcaacccgatacccccgactctacgaaaccccgaccgaaccgaaccctaacaaaacgccaaaccccgcgtaaactcccgacgaacgattaataacgaaaaaacgcgacgcgactctataacccgaattcccgacgctaaaaacccgacccgcctcaaccgcattatcccgaaccgcgcgcaccgacccttaaactacgccgccgcaacacccgccgcacccgcgaaaccatacgaaaaaccgccgaaataaaaaacttctccgcgaaaaaaaaaaaatcctaatacgaccaacaaaacctaaaacaaaataaacgcgaaaacgaccgaaacaaaaaaacgaaaaacgcccgataacccctatccgcttctccattattaaacgctatcaccccgaaaaaaactaaactaaaccgaacgcgcccgactcgaaaaaaaaacgcgtctaaaaaaccgaaacgtaaaaaaaaaaaacgctaccgaaaaaaacgcgaaccgaacgaacgaaaacctacaaaaataaaaaacgaaaaacgatcttcctattttcccaaacgaccgaacatccgtcatccaactcgcccaccccgtcctaaaaacaacaactactcgaccgcccctaatattattacgaaacctaaacgctaactaaaaatcttctaaaaccgaaaaacgactccttcgtcatattttactaaaaaaataacttatatataaaaaaaaattatctcacgccaaa

SEQ ID NO: 34949 - DNA, 535 bp, Artificial Sequence
  chemically treated genomic DNA (Homo sapiens) CpG-island No: 34949
ttcgggggcgggtgtttttaggcggcgcgtgatttcgtttcggttcgtttcgtttcgtttgtatcgtagatatacgttttagttttttagtttttcgtgcgcgtcgggttcgagttatagagtttatggaatttacggagtcgatggaatttacggagtttatggaatttacggagtttatggaatttacggagtttatggaatttacggagtttatggaatcggcgcggacgtatttgtgggggcgaggcgttgttgcgggagttggaggtgttggtgtaggacgtggtgaggacgagtttttggtgggagcgttacggttggattgcgttattttcgcgtttagttttttcgttttgtcggtaggtgaggaacgcggggattcggcgtttcggtcggttgcgggtgggggcggggtgcggcggaggtggcggcgcggggtttgtaatagtagtcgtgggagtgtagtttgcgtagtggattggcggcggtagggaggcggaggtggtcggggtttcgtatttaaggatggagg

SEQ ID NO: 34950 - DNA, 535 bp, Artificial Sequence
  chemically treated genomic DNA (Homo sapiens) CpG-island No: 34950
cctccatccttaaatacgaaaccccgaccacctccgcctccctaccgccgccaatccactacgcaaactacactcccacgactactattacaaaccccgcgccgccacctccgccgcaccccgcccccacccgcaaccgaccgaaacgccgaatccccgcgttcctcacctaccgacaaaacgaaaaaactaaacgcgaaaataacgcaatccaaccgtaacgctcccaccaaaaactcgtcctcaccacgtcctacaccaacacctccaactcccgcaacaacgcctcgcccccacaaatacgtccgcgccgattccataaactccgtaaattccataaactccgtaaattccataaactccgtaaattccataaactccgtaaattccatcgactccgtaaattccataaactctataactcgaacccgacgcgcacgaaaaactaaaaaactaaaacgtatatctacgatacaaacgaaacgaaacgaaccgaaacgaaatcacgcgccgcctaaaaacacccgcccccgaa

SEQ ID NO: 34951 - DNA, 535 bp, Artificial Sequence
  chemically treated genomic DNA (Homo sapiens) CpG-island No: 34951
tttttatttttgggtgcggggtttcgattattttcgtttttttgtcgtcgttagtttattgcgtaggttgtatttttacggttgttgttgtagatttcgcgtcgttattttcgtcgtatttcgtttttattcgtagtcggtcgggacgtcgggttttcgcgttttttatttgtcggtaaggcgaagaggttgagcgcgaggatggcgtagtttagtcgtggcgtttttattaggagttcgtttttattacgttttgtattagtatttttagttttcgtagtagcgtttcgtttttataggtgcgttcgcgtcggttttatgggtttcgtaggttttatgggtttcgtaggttttatgggtttcgtaggttttatgggtttcgtaggttttatcggtttcgtgggttttatggattttgtggttcgggttcgacgcgtacggaggattggaggattggggcgtgtgtttgcggtgtaggcgaggcggggcgggtcggggcggagttacgcgtcgtttggggatattcgttttcggg

SEQ ID NO: 34952 - DNA, 535 bp, Artificial Sequence
  chemically treated genomic DNA (Homo sapiens) CpG-island No: 34952
cccgaaaacgaatatccccaaacgacgcgtaactccgccccgacccgccccgcctcgcctacaccgcaaacacacgccccaatcctccaatcctccgtacgcgtcgaacccgaaccacaaaatccataaaacccacgaaaccgataaaacctacgaaacccataaaacctacgaaacccataaaacctacgaaacccataaaacctacgaaacccataaaaccgacgcgaacgcacctataaaaacgaaacgctactacgaaaactaaaaatactaatacaaaacgtaataaaaacgaactcctaataaaaacgccacgactaaactacgccatcctcgcgctcaacctcttcgccttaccgacaaataaaaaacgcgaaaacccgacgtcccgaccgactacgaataaaaacgaaatacgacgaaaataacgacgcgaaatctacaacaacaaccgtaaaaatacaacctacgcaataaactaacgacgacaaaaaaacgaaaataatcgaaaccccgcacccaaaaataaaaa

SEQ ID NO: 34953 - DNA, 850 bp, Artificial Sequence
  chemically treated genomic DNA (Homo sapiens) CpG-island No: 34953
gagttcgtttgcgtaaggtaggcgcgggggattaaatggttgttggtgtagagtggggttgtttcggtattaagggttcgtttcgtggtcggaaggataaaggatatttaggggacgagggtcgtcgagttagcgcgattttcgggtcggtgggttggggcgggttgggggttggggtcgggtcgattttcgcggtggggtttatttcgtaggataaagtagcggtttcgtttttcggcgcgcgttcgaggttcgtgcgtgtgagtacgcgtcggagacggttagaaatggcggttggggcggacgagggggttggcgcgggaagcgggttgtttggttcggttacgtttttatttcgttaggaatttaggagtcggtttgtttttcgaatttattttttttcgttttttcgtttttgtaggttgtgtgtcgagtttggaagaaagtgtgattcgttcgacggaataaaggatatgatagttcggtttcgtgcggttattgcggagcgttaggaatattttttaaaatggcggtcggcgcgtcggaatagggcgggaggcggcggcgcgtgggggcgggacggggaggggcgcggttagtcgggtttttgttttcgcgatttcggcggtgtagggcgggtggagtcgcggagtagtttttatggtcgtttcgtcggagttcggtgagttcgaggagaggaaggtaatttgggggtcggcggggcgtcgtcgcgggtgggcggtgggtaaggacgtttttcgcggagtttttaggttcggagtacgtgttattggtttttttgttatttatgggtttgaaattattttaattgtttttagtttttatttta

SEQ ID NO: 34954 - DNA, 850 bp, Artificial Sequence
  chemically treated genomic DNA (Homo sapiens) CpG-island No: 34954
taaaataaaaactaaaaacaattaaaataatttcaaacccataaataacaaaaaaaccaataacacgtactccgaacctaaaaactccgcgaaaaacgtccttacccaccgcccacccgcgacgacgccccgccgacccccaaattaccttcctctcctcgaactcaccgaactccgacgaaacgaccataaaaactactccgcgactccacccgccctacaccgccgaaatcgcgaaaacaaaaacccgactaaccgcgcccctccccgtcccgcccccacgcgccgccgcctcccgccctattccgacgcgccgaccgccattttaaaaaatattcctaacgctccgcaataaccgcacgaaaccgaactatcatatcctttattccgtcgaacgaatcacactttcttccaaactcgacacacaacctacaaaaacgaaaaaacgaaaaaaaataaattcgaaaaacaaaccgactcctaaattcctaacgaaataaaaacgtaaccgaaccaaacaacccgcttcccgcgccaaccccctcgtccgccccaaccgccatttctaaccgtctccgacgcgtactcacacgcacgaacctcgaacgcgcgccgaaaaacgaaaccgctactttatcctacgaaataaaccccaccgcgaaaatcgacccgaccccaacccccaacccgccccaacccaccgacccgaaaatcgcgctaactcgacgaccctcgtcccctaaatatcctttatccttccgaccacgaaacgaacccttaataccgaaacaaccccactctacaccaacaaccatttaatcccccgcgcctaccttacgcaaacgaactc

SEQ ID NO: 34955 - DNA, 850 bp, Artificial Sequence
  chemically treated genomic DNA (Homo sapiens) CpG-island No: 34955
tgggataaggattaggaatagttaaaatagttttaagtttatgggtggtagagaagttagtgatacgtgtttcgggtttaggagtttcgcggagaacgtttttatttatcgtttattcgcggcggcgtttcgtcgatttttaggttattttttttttttcgggtttatcgggtttcggcggggcggttatgaggattatttcgcgattttattcgttttgtatcgtcggggtcgcggaagtagaagttcggttggtcgcgttttttttcgtttcgtttttacgcgtcgtcgtttttcgttttgtttcgacgcgtcggtcgttattttagggaatgtttttaacgtttcgtagtggtcgtacggggtcgggttgttatgttttttgtttcgtcgaacgggttatatttttttttaagttcggtatatagtttgtaggggcgggagagcggaaggagatgggttcggaaaataaatcgatttttagatttttggcgaggtgggggcgtaatcgagttagatagttcgtttttcgcgttagttttttcgttcgttttaatcgttatttttaatcgttttcggcgcgtgtttatacgtacgagtttcgggcgcgcgtcgaggggcggggtcgttgttttgttttgcggggtgggttttatcgcgggggtcggttcggttttagtttttagttcgttttagtttatcgattcggaagtcgcgttggttcggcggttttcgttttttaagtgttttttgttttttcggttacgggacgagtttttggtgtcggggtagttttattttgtattagtagttatttagtttttcgcgtttgttttgcgtaaacgggttt

SEQ ID NO: 34956 - DNA, 850 bp, Artificial Sequence
  chemically treated genomic DNA (Homo sapiens) CpG-island No: 34956
aaacccgtttacgcaaaacaaacgcgaaaaactaaataactactaatacaaaataaaactaccccgacaccaaaaactcgtcccgtaaccgaaaaaacaaaaaacacttaaaaaacgaaaaccgccgaaccaacgcgacttccgaatcgataaactaaaacgaactaaaaactaaaaccgaaccgacccccgcgataaaacccaccccgcaaaacaaaacaacgaccccgcccctcgacgcgcgcccgaaactcgtacgtataaacacgcgccgaaaacgattaaaaataacgattaaaacgaacgaaaaaactaacgcgaaaaacgaactatctaactcgattacgcccccacctcgccaaaaatctaaaaatcgatttattttccgaacccatctccttccgctctcccgcccctacaaactatataccgaacttaaaaaaaaatataacccgttcgacgaaacaaaaaacataacaacccgaccccgtacgaccactacgaaacgttaaaaacattccctaaaataacgaccgacgcgtcgaaacaaaacgaaaaacgacgacgcgtaaaaacgaaacgaaaaaaaacgcgaccaaccgaacttctacttccgcgaccccgacgatacaaaacgaataaaatcgcgaaataatcctcataaccgccccgccgaaacccgataaacccgaaaaaaaaaaaataacctaaaaatcgacgaaacgccgccgcgaataaacgataaataaaaacgttctccgcgaaactcctaaacccgaaacacgtatcactaacttctctaccacccataaacttaaaactattttaactattcctaatccttatccca

SEQ ID NO: 34957 - DNA, 863 bp, Artificial Sequence
  chemically treated genomic DNA (Homo sapiens) CpG-island No: 34957
gacgttcggtttgcgtagtgagatgtttgttcgtcgtcgtcgtcgtcgttatcgcggaggagcgcgataaagggagtcgagtcggacgtgagggggatttcgcggagtcgtcgcgttagcgtagttttttagtcgtatcggagtcgttagagttcgagtcgtcgtcgtcgtcgtcgtcgttttcgtcgtcgtcgcggttgtttaggggtcggttagttttttagttttgttcgggggtcgcgtcgtcgtcgtttttagcgtcgtttttagtttgtttgttcgttttaaatgtgatatcggcgtcgcggagcgcgatttgaagtcgtcgtcggggaggggacgagtattatgtcgaatttgagtaaaggtacgggtagtcggaaggatattaagatgcggattcgggttttttcggtgagttttttttcggcgttcgggatttcggggtcgggggtcgggtcgagagtcgtacgcgaggttcgggttgaagttttttaataggtcgtaggttcggtttttttttttttacgttcgtcggtcgcggggcgcgagttttttcggtaatcgggcggcgcggggtttcggcgcggtcgttttttcgggtcgtttttcgcgtcgggagttcgggtttggcgtcgcgttttcgttcgggagttgtttttttagtcgtttcgcgggcgtcggttgcggtcggggtttttcggtcgttttacgtttttttacgttgtcggggttgtaggtttagttttcggcgttgttagtagtcgcggagttttttttgtgtggggcgtgtgtggaattttttacgtggggtttcgttatattttgaaaatttatttagtttagtttttagggtgatgaag

SEQ ID NO: 34958 - DNA, 863 bp, Artificial Sequence
  chemically treated genomic DNA (Homo sapiens) CpG-island No: 34958
cttcatcaccctaaaaactaaactaaataaattttcaaaatataacgaaaccccacgtaaaaaattccacacacgccccacacaaaaaaaactccgcgactactaacaacgccgaaaactaaacctacaaccccgacaacgtaaaaaaacgtaaaacgaccgaaaaaccccgaccgcaaccgacgcccgcgaaacgactaaaaaaacaactcccgaacgaaaacgcgacgccaaacccgaactcccgacgcgaaaaacgacccgaaaaaacgaccgcgccgaaaccccgcgccgcccgattaccgaaaaaactcgcgccccgcgaccgacgaacgtaaaaaaaaaaaaaccgaacctacgacctattaaaaaacttcaacccgaacctcgcgtacgactctcgacccgacccccgaccccgaaatcccgaacgccgaaaaaaaactcaccgaaaaaacccgaatccgcatcttaatatccttccgactacccgtacctttactcaaattcgacataatactcgtcccctccccgacgacgacttcaaatcgcgctccgcgacgccgatatcacatttaaaacgaacaaacaaactaaaaacgacgctaaaaacgacgacgacgcgacccccgaacaaaactaaaaaactaaccgacccctaaacaaccgcgacgacgacgaaaacgacgacgacgacgacgacgactcgaactctaacgactccgatacgactaaaaaactacgctaacgcgacgactccgcgaaatccccctcacgtccgactcgactccctttatcgcgctcctccgcgataacgacgacgacgacgacgaacaaacatctcactacgcaaaccgaacgtc

SEQ ID NO: 34959 - DNA, 863 bp, Artificial Sequence
  chemically treated genomic DNA (Homo sapiens) CpG-island No: 34959
ttttattattttaaaagttaggttgggtaaatttttaaagtgtagcgaaattttacgtgaaaagttttatatacgttttatatagggaggatttcgcggttgttagtagcgtcggagattgggtttataatttcggtaacgtggggaggcgtggggcggtcgaggggtttcggtcgtagtcgacgttcgcggagcggttgaaggagtagttttcggacgggggcgcggcgttaggttcgggttttcggcgcggggaacggttcgggagggcggtcgcgtcggggtttcgcgtcgttcggttgtcgggaaggttcgcgtttcgcggtcggcgggcgtgggggaggggaggtcgggtttgcggtttgttgggggattttagttcgggtttcgcgtgcggttttcggttcggttttcggtttcggggtttcggacgtcgaggagagatttatcggaaaggttcggattcgtattttggtgttttttcggttgttcgtgtttttgtttagattcgatatggtgttcgtttttttttcggcggcggttttaggtcgcgtttcgcgacgtcggtgttatatttaaggcgggtaggtaggttaggggcgacgttgggggcggcggcggcgcgattttcgggtagggttggggagttggtcggtttttgggtagtcgcggcggcggcgggggcggcggcggcggcggcggcggttcggattttggcgatttcgatgcggttggggggttgcgttggcgcggcggtttcgcggggttttttttacgttcggttcggttttttttatcgcgttttttcgcgatggcggcggcggcggcgacggataaatattttattgcgtaggtcgaacgtt

SEQ ID NO: 34960 - DNA, 863 bp, Artificial Sequence
  chemically treated genomic DNA (Homo sapiens) CpG-island No: 34960
aacgttcgacctacgcaataaaatatttatccgtcgccgccgccgccgccatcgcgaaaaaacgcgataaaaaaaaccgaaccgaacgtaaaaaaaaccccgcgaaaccgccgcgccaacgcaaccccccaaccgcatcgaaatcgccaaaatccgaaccgccgccgccgccgccgccgcccccgccgccgccgcgactacccaaaaaccgaccaactccccaaccctacccgaaaatcgcgccgccgccgcccccaacgtcgcccctaacctacctacccgccttaaatataacaccgacgtcgcgaaacgcgacctaaaaccgccgccgaaaaaaaaacgaacaccatatcgaatctaaacaaaaacacgaacaaccgaaaaaacaccaaaatacgaatccgaacctttccgataaatctctcctcgacgtccgaaaccccgaaaccgaaaaccgaaccgaaaaccgcacgcgaaacccgaactaaaatcccccaacaaaccgcaaacccgacctcccctcccccacgcccgccgaccgcgaaacgcgaaccttcccgacaaccgaacgacgcgaaaccccgacgcgaccgccctcccgaaccgttccccgcgccgaaaacccgaacctaacgccgcgcccccgtccgaaaactactccttcaaccgctccgcgaacgtcgactacgaccgaaacccctcgaccgccccacgcctccccacgttaccgaaattataaacccaatctccgacgctactaacaaccgcgaaatcctccctatataaaacgtatataaaacttttcacgtaaaatttcgctacactttaaaaatttacccaacctaacttttaaaataataaaa

SEQ ID NO: 34961 - DNA, 602 bp, Artificial Sequence
  chemically treated genomic DNA (Homo sapiens) CpG-island No: 34961
tttcgcggttgttattagcgtcggagattgggtttataatttcggtaacgtggggaggcgtggggcggtcgaggggtttcggtcgtagtcgacgttcgcggagcggttgaaggagtagttttcggacgggggcgcggcgttaggttcgggttttcggcgcggggaacggttcgggaggggcggtcgcgtcggggtttcgcgtcgttcggttgtcgggaaggttttcgtttcgcggtcggcgggcgtgggggaggggaggtcgggtttgcggtttgttgggggattttagttcgggtttttcgtgcgggtttcgggtcggttttcggtttcggggtgtcggacgtcgaggagagatttatcggaaaggcgcggattcgtattttggggtgttttcggttgttcgtgtttttgtttagatatgatatggggttcgtttttttttcggcggcggttttaggtggcgtttcgcgacgtcggtgtgatatttaaagcgggtacgcgcgttatgggcgatattgggggcggcggcggcgcgattttcgggtacggttgtggagttggtcggtttttgtgtatattcggcggcggagggggcgtcgacg

SEQ ID NO: 34962 - DNA, 602 bp, Artificial Sequence
  chemically treated genomic DNA (Homo sapiens) CpG-island No: 34962
cgtcgacgccccctccgccgccgaatatacacaaaaaccgaccaactccacaaccgtacccgaaaatcgcgccgccgccgcccccaatatcgcccataacgcgcgtacccgctttaaatatcacaccgacgtcgcgaaacgccacctaaaaccgccgccgaaaaaaaaacgaaccccatatcatatctaaacaaaaacacgaacaaccgaaaacaccccaaaatacgaatccgcgcctttccgataaatctctcctcgacgtccgacaccccgaaaccgaaaaccgacccgaaacccgcacgaaaaacccgaactaaaatcccccaacaaaccgcaaacccgacctcccctcccccacgcccgccgaccgcgaaacgaaaaccttcccgacaaccgaacgacgcgaaaccccgacgcgaccgcccctcccgaaccgttccccgcgccgaaaacccgaacctaacgccgcgcccccgtccgaaaactactccttcaaccgctccgcgaacgtcgactacgaccgaaacccctcgaccgccccacgcctccccacgttaccgaaattataaacccaatctccgacgctaataacaaccgcgaaa

SEQ ID NO: 34963 - DNA, 602 bp, Artificial Sequence
  chemically treated genomic DNA (Homo sapiens) CpG-island No: 34963
cgtcggcgtttttttcgtcgtcgggtgtgtataggggtcggttagttttatagtcgtgttcgggggtcgcgtcgtcgtcgtttttagtgtcgtttatagcgcgcgtgttcgttttaaatgttatatcggcgtcgcggagcgttatttaaagtcgtcgtcggggaggggacgagttttatgttatatttgagtaaaggtacgggtagtcggaagtattttaagatgcggattcgcgttttttcggtgagttttttttcggcgttcggtatttcggggtcgggggtcggttcgagattcgtacgagaggttcgggttgaagttttttaataggtcgtaggttcggtttttttttttttacgttcgtcggtcgcggggcgagagttttttcggtaatcgggcggcgcggggtttcggcgcggtcgtttttttcgggtcgtttttcgcgtcgggagttcgggtttggcgtcgcgttttcgttcgggagttgtttttttagtcgtttcgcgggcgtcggttgcggtcggggtttttcggtcgttttacgtttttttacgttgtcggggttgtaggtttagttttcggcgttgatagtagtcgcggag

SEQ ID NO: 34964 - DNA, 602 bp, Artificial Sequence
  chemically treated genomic DNA (Homo sapiens) CpG-island No: 34964
ctccgcgactactatcaacgccgaaaactaaacctacaaccccgacaacgtaaaaaaacgtaaaacgaccgaaaaaccccgaccgcaaccgacgcccgcgaaacgactaaaaaaacaactcccgaacgaaaacgcgacgccaaacccgaactcccgacgcgaaaaacgacccgaaaaaaacgaccgcgccgaaaccccgcgccgcccgattaccgaaaaaactctcgccccgcgaccgacgaacgtaaaaaaaaaaaaaccgaacctacgacctattaaaaaacttcaacccgaacctctcgtacgaatctcgaaccgacccccgaccccgaaataccgaacgccgaaaaaaaactcaccgaaaaaacgcgaatccgcatcttaaaatacttccgactacccgtacctttactcaaatataacataaaactcgtcccctccccgacgacgactttaaataacgctccgcgacgccgatataacatttaaaacgaacacgcgcgctataaacgacactaaaaacgacgacgacgcgacccccgaacacgactataaaactaaccgacccctatacacacccgacgacgaaaaaaacgccgacg

SEQ ID NO: 34965 - DNA, 524 bp, Artificial Sequence
  chemically treated genomic DNA (Homo sapiens) CpG-island No: 34965
tttaatagttttatagtttgagcgtcggaaacgtttatcgtagttagtttgtcgaagtttaacgtttgatcgcgcgttatgaagttgtacgagagaaagtggcgtaattattgaatgtatcggatgattaaattatcgtttggacgcgcggtattattgaatttattaatatggtggtataatgttatgcgcgttcgcgtttgtaatcgggcgatgagattattgttagcgtggtagaatattacgttaatttcgttttttggttgatggtcgtttaataaattggagttaaagtggtgaaattgtcgtttaatgcgtagcgattgtcggatgtcgatttgttgttagaattgattatttttcgtagtcggattttggcgttgggttagatgtcgaacgttattggcggttgttcggatttggcgcgagcgattatttttgtttatttagtcgggatggtggtgatggttgatggtgtttagggggtagtgtattttttcgcggatgtttagtaattggatatt

SEQ ID NO: 34966 - DNA, 524 bp, Artificial Sequence
  chemically treated genomic DNA (Homo sapiens) CpG-island No: 34966
aatatccaattactaaacatccgcgaaaaaatacactaccccctaaacaccatcaaccatcaccaccatcccgactaaataaacaaaaataatcgctcgcgccaaatccgaacaaccgccaataacgttcgacatctaacccaacgccaaaatccgactacgaaaaataatcaattctaacaacaaatcgacatccgacaatcgctacgcattaaacgacaatttcaccactttaactccaatttattaaacgaccatcaaccaaaaaacgaaattaacgtaatattctaccacgctaacaataatctcatcgcccgattacaaacgcgaacgcgcataacattataccaccatattaataaattcaataataccgcgcgtccaaacgataatttaatcatccgatacattcaataattacgccactttctctcgtacaacttcataacgcgcgatcaaacgttaaacttcgacaaactaactacgataaacgtttccgacgctcaaactataaaactattaaa

SEQ ID NO: 34967 - DNA, 524 bp, Artificial Sequence
  chemically treated genomic DNA (Homo sapiens) CpG-island No: 34967
aatatttagttgttgaatattcgcggggaaatgtattgttttttgagtattattaattattattattatttcggttgaatgagtaaaggtaatcgttcgcgttagattcgggtaatcgttagtaacgttcgatatttgatttaacgttagaattcgattacggggagtaattagttttggtaataaatcgatattcggtagtcgttgcgtattaagcggtaattttattattttggttttagtttgttgggcgattattagttaggggacgaggttggcgtggtgttttgttacgttgataataattttatcgttcggttgtagacgcggacgcgtatagtattgtgttattatgttgatggatttagtggtgtcgcgcgtttagacgatagtttagttattcggtgtatttagtaattgcgttattttttttcgtgtagttttataacgcgcggttaggcgttgggtttcggtaaattggttgcgatggacgttttcggcgtttagattgtaaaattgttggg

SEQ ID NO: 34968 - DNA, 524 bp, Artificial Sequence
  chemically treated genomic DNA (Homo sapiens) CpG-island No: 34968
cccaacaattttacaatctaaacgccgaaaacgtccatcgcaaccaatttaccgaaacccaacgcctaaccgcgcgttataaaactacacgaaaaaaaataacgcaattactaaatacaccgaataactaaactatcgtctaaacgcgcgacaccactaaatccatcaacataataacacaatactatacgcgtccgcgtctacaaccgaacgataaaattattatcaacgtaacaaaacaccacgccaacctcgtcccctaactaataatcgcccaacaaactaaaaccaaaataataaaattaccgcttaatacgcaacgactaccgaatatcgatttattaccaaaactaattactccccgtaatcgaattctaacgttaaatcaaatatcgaacgttactaacgattacccgaatctaacgcgaacgattacctttactcattcaaccgaaataataataataattaataatactcaaaaaacaatacatttccccgcgaatattcaacaactaaatatt

SEQ ID NO: 34969 - DNA, 776 bp, Artificial Sequence
  chemically treated genomic DNA (Homo sapiens) CpG-island No: 34969
  misc_feature (512)..(512): n is either a, c, g or t
aatcgtgcggggaagggtcgcgaggagagtaggggcgtcgtcggtgtcgttgtatttattttgcgtagttagtggtttagggtagtcgtcgagtttttttgaggatgaggatggggcgggcgatgtggtcggcgttgtattttatttcgttttgagatagttttaggaattttggtcgttcgtaggggaaacgtaggggtaggttcgagttttcgtagttgtcgtcgtcgtgttcggagtttgagttgttagttatgatgtcgtttatgaaattggttacggtagattttattcgagtgagtatattatttcggcgttcggttgtagcggtgcgagtaggaggcggcggggtcgggtaaggcgtagcgcggggtatgtaggttgcggtgggcgtcgggcgtacggcgagtcgggttattgggacgcgtcgcgcgcggtttttagagtttagtgttgtagggggtcgagtttcggtttttcgtgtttagtgtcgcggtggtcgtcgttttttntcgttatattttcgtaacggagttgtatggagcgggtcgatcgggggagttatcgcgcgttttaggagcgtttaggcggttgtagttgtagtaggtttttttttcgttttttgcgttcggtttcggcgtgcgttgaattgagtttattcggcgagttcgcggagtcgtcgcggttgttgttacggttattgtcgtcgggttatgtgataattaggttgtaagggtttaggttgttgcggtggtcgttgtttagttttttttttg

SEQ ID NO: 34970 - DNA, 776 bp, Artificial Sequence
  chemically treated genomic DNA (Homo sapiens) CpG-island No: 34970
  misc_feature (265)..(265): n is either a, c, g or t
caaaaaaaaaactaaacaacgaccaccgcaacaacctaaacccttacaacctaattatcacataacccgacgacaataaccgtaacaacaaccgcgacgactccgcgaactcgccgaataaactcaattcaacgcacgccgaaaccgaacgcaaaaaacgaaaaaaaaacctactacaactacaaccgcctaaacgctcctaaaacgcgcgataactcccccgatcgacccgctccatacaactccgttacgaaaatataacganaaaaaacgacgaccaccgcgacactaaacacgaaaaaccgaaactcgaccccctacaacactaaactctaaaaaccgcgcgcgacgcgtcccaataacccgactcgccgtacgcccgacgcccaccgcaacctacataccccgcgctacgccttacccgaccccgccgcctcctactcgcaccgctacaaccgaacgccgaaataatatactcactcgaataaaatctaccgtaaccaatttcataaacgacatcataactaacaactcaaactccgaacacgacgacgacaactacgaaaactcgaacctacccctacgtttcccctacgaacgaccaaaattcctaaaactatctcaaaacgaaataaaatacaacgccgaccacatcgcccgccccatcctcatcctcaaaaaaactcgacgactaccctaaaccactaactacgcaaaataaatacaacgacaccgacgacgcccctactctcctcgcgacccttccccgcacgatt

SEQ ID NO: 34971 - DNA, 776 bp, Artificial Sequence
  chemically treated genomic DNA (Homo sapiens) CpG-island No: 34971
  misc_feature (265)..(265): n is either a, c, g or t
taggggaggggttgagtaacggttatcgtagtagtttgagtttttgtagtttgattattatatgattcggcggtagtagtcgtggtagtagtcgcggcggtttcgcgagttcgtcgggtgggtttagtttagcgtacgtcggagtcgagcgtagggggcggggaagggatttgttgtagttgtagtcgtttgggcgtttttggagcgcgcggtgattttttcggtcggttcgttttatgtagtttcgttgcggaagtgtagcggngggaggcggcggttatcgcggtattaagtacgagaggtcggggttcggttttttgtagtattaggttttgggagtcgcgcgcggcgcgttttagtggttcgattcgtcgtgcgttcggcgtttatcgtagtttgtatgtttcgcgttgcgttttgttcggtttcgtcgttttttgttcgtatcgttgtagtcgggcgtcggagtaatatgtttattcgagtgaaatttgtcgtggttaattttatgggcggtattatggttggtagtttaggtttcgagtacggcggcggtagttgcggaggttcggatttgtttttgcgttttttttacgggcggttagagtttttggggttgttttaggacgaggtggagtgtagcgtcgattatatcgttcgttttatttttatttttaaggagattcggcggttgttttgggttattggttacgtagagtgagtgtagcgatatcggcggcgtttttgtttttttcgcggttttttttcgtacggtt

SEQ ID NO: 34972 - DNA, 776 bp, Artificial Sequence
  chemically treated genomic DNA (Homo sapiens) CpG-island No: 34972
  misc_feature (512)..(512): n is either a, c, g or t
aaccgtacgaaaaaaaaccgcgaaaaaaacaaaaacgccgccgatatcgctacactcactctacgtaaccaataacccaaaacaaccgccgaatctccttaaaaataaaaataaaacgaacgatataatcgacgctacactccacctcgtcctaaaacaaccccaaaaactctaaccgcccgtaaaaaaaacgcaaaaacaaatccgaacctccgcaactaccgccgccgtactcgaaacctaaactaccaaccataataccgcccataaaattaaccacgacaaatttcactcgaataaacatattactccgacgcccgactacaacgatacgaacaaaaaacgacgaaaccgaacaaaacgcaacgcgaaacatacaaactacgataaacgccgaacgcacgacgaatcgaaccactaaaacgcgccgcgcgcgactcccaaaacctaatactacaaaaaaccgaaccccgacctctcgtacttaataccgcgataaccgccgcctcccnccgctacacttccgcaacgaaactacataaaacgaaccgaccgaaaaaatcaccgcgcgctccaaaaacgcccaaacgactacaactacaacaaatcccttccccgccccctacgctcgactccgacgtacgctaaactaaacccacccgacgaactcgcgaaaccgccgcgactactaccacgactactaccgccgaatcatataataatcaaactacaaaaactcaaactactacgataaccgttactcaacccctccccta

SEQ ID NO: 34973 - DNA, 849 bp, Artificial Sequence
  chemically treated genomic DNA (Homo sapiens) CpG-island No: 34973
ggcgatattagttcgcggagaagaagggttgaaggtggagtagggggatacgtcgcgttttattagacgtacgtcgcgacgtttgttggtggatattattcgggattttaaagcggtcgttcgtcgatttttagcgttaagttacggtcggatgcgtttagggcggattcgcgcggttcggttttttaaggagttcgggtgggggcggggttgggcggggcggggcgcggcgcgcgcggggcgggggcgcgcggtttgtggcgtcgttattcggtagatttcggagggtagagcgttgtgtcggtttcgttgtcgttggttaggagcgcggggatagttcggggttgcgtcggagcgtcggttcgttttttcgggggtttcgttattatgtcgttgaggtagcgtttggtttagttggttggtcgtttgtaggattcgtagaaagtggttcgtttttagcggttgtgcggggtggaagcgtcgtcgcgtcgtttagtagatcggagggaggatgagaaagcggaggcgtttttcgtcggagattttcgattgcgagggcggtagttaggggcgtttggaggtttttagtttttcgggagcgatcgtaattagtgttcggttaagtcggacggcggcggcgtttttaacggcgtgcggaacgggttggcggtcgagttgggttcggtttcgtcgcggcgcgcgggcgttttgcgtcgtaattcgttgacgggcgaggagggttagttggttcgcgtgagtaattggtcgttttattgtttgttttgtttcggtacggagttgggtaacgaatttttttatattttgtttttttttttttggatttggaat

SEQ ID NO: 34974 - DNA, 849 bp, Artificial Sequence
  chemically treated genomic DNA (Homo sapiens) CpG-island No: 34974
attccaaatccaaaaaaaaaaaaacaaaatataaaaaaattcgttacccaactccgtaccgaaacaaaacaaacaataaaacgaccaattactcacgcgaaccaactaaccctcctcgcccgtcaacgaattacgacgcaaaacgcccgcgcgccgcgacgaaaccgaacccaactcgaccgccaacccgttccgcacgccgttaaaaacgccgccgccgtccgacttaaccgaacactaattacgatcgctcccgaaaaactaaaaacctccaaacgcccctaactaccgccctcgcaatcgaaaatctccgacgaaaaacgcctccgctttctcatcctccctccgatctactaaacgacgcgacgacgcttccaccccgcacaaccgctaaaaacgaaccactttctacgaatcctacaaacgaccaaccaactaaaccaaacgctacctcaacgacataataacgaaacccccgaaaaaacgaaccgacgctccgacgcaaccccgaactatccccgcgctcctaaccaacgacaacgaaaccgacacaacgctctaccctccgaaatctaccgaataacgacgccacaaaccgcgcgcccccgccccgcgcgcgccgcgccccgccccgcccaaccccgcccccacccgaactccttaaaaaaccgaaccgcgcgaatccgccctaaacgcatccgaccgtaacttaacgctaaaaatcgacgaacgaccgctttaaaatcccgaataatatccaccaacaaacgtcgcgacgtacgtctaataaaacgcgacgtatccccctactccaccttcaacccttcttctccgcgaactaatatcgcc

SEQ ID NO: 34975 - DNA, 849 bp, Artificial Sequence
  chemically treated genomic DNA (Homo sapiens) CpG-island No: 34975
gttttagatttagaaggggaagaataggatgtagaagagttcgttgtttagtttcgtgtcgaagtagaataggtagtagagcggttagttgtttacgcgggttagttggtttttttcgttcgttagcgagttgcggcgtagagcgttcgcgcgtcgcggcgaggtcgggtttagttcggtcgttagttcgtttcgtacgtcgttgggggcgtcgtcgtcgttcggtttggtcgggtattgattgcggtcgttttcgggaggttgggggtttttaggcgtttttggttgtcgttttcgtagtcgagggttttcggcgagaggcgttttcgtttttttatttttttttcggtttgttgagcggcgcggcggcgtttttatttcgtatagtcgttggaaacgggttattttttgcgggttttgtagacggttaattagttgggttaggcgttgttttagcgatatgataacggaattttcgggaaggcgggtcggcgtttcggcgtagtttcgaattgttttcgcgtttttggttagcggtagcggaatcggtatagcgttttatttttcggagtttgtcgggtgacggcgttataggtcgcgcgttttcgtttcgcgcgcgtcgcgtttcgtttcgtttagtttcgtttttattcgggttttttgaggggtcgggtcgcgcgggttcgttttgagcgtattcggtcgtggtttggcgttgaggatcggcgggcggtcgttttgaggtttcgggtaatatttattagtaggcgtcgcggcgtacgtttggtgggacgcggcgtgtttttttgttttatttttagtttttttttttcgcgggttagtgtcgtt

SEQ ID NO: 34976 - DNA, 849 bp, Artificial Sequence
  chemically treated genomic DNA (Homo sapiens) CpG-island No: 34976
aacgacactaacccgcgaaaaaaaaaaactaaaaataaaacaaaaaaacacgccgcgtcccaccaaacgtacgccgcgacgcctactaataaatattacccgaaacctcaaaacgaccgcccgccgatcctcaacgccaaaccacgaccgaatacgctcaaaacgaacccgcgcgacccgacccctcaaaaaacccgaataaaaacgaaactaaacgaaacgaaacgcgacgcgcgcgaaacgaaaacgcgcgacctataacgccgtcacccgacaaactccgaaaaataaaacgctataccgattccgctaccgctaaccaaaaacgcgaaaacaattcgaaactacgccgaaacgccgacccgccttcccgaaaattccgttatcatatcgctaaaacaacgcctaacccaactaattaaccgtctacaaaacccgcaaaaaataacccgtttccaacgactatacgaaataaaaacgccgccgcgccgctcaacaaaccgaaaaaaaaataaaaaaacgaaaacgcctctcgccgaaaaccctcgactacgaaaacgacaaccaaaaacgcctaaaaacccccaacctcccgaaaacgaccgcaatcaatacccgaccaaaccgaacgacgacgacgcccccaacgacgtacgaaacgaactaacgaccgaactaaacccgacctcgccgcgacgcgcgaacgctctacgccgcaactcgctaacgaacgaaaaaaaccaactaacccgcgtaaacaactaaccgctctactacctattctacttcgacacgaaactaaacaacgaactcttctacatcctattcttccccttctaaatctaaaac

SEQ ID NO: 34977 - DNA, 921 bp, Artificial Sequence
  chemically treated genomic DNA (Homo sapiens) CpG-island No: 34977
ttaggcgggtttaggcgtagtcgttattttcgggttgggtttggtattgcgttattcggtgttcgcgggatttttaggaacgagaatacggttaagtaagggacgagtatagtcgttttaggtattacgatagattcgcggcggcggtttaaggattatagagggtagtacgttcgttttcgttttttttcggttcgcggtaattttttttcgcgttttcgttacgcgtaggtttagtttcgcggcggtttcggttttacgtttcgcgttcgggttcgttcggtgatttagtatttgggtatcgtatcgttgggggcgaaggtatcgatcgggcggtacgggtcgggatcgggcgttggattagggcggtttcgaggtttggcgggcgattcgtttttagtaaaggtgcgcggggggacgagcgggtgggagcggtttcgtaaataagttttcgttttagtttttgttttttgttcgaaattgatgatgttttgtattgggtcgtcgttttttagtacgtatacggttttcgtcgttataattcgttaggttacgtcgaggttttggtttcgaggattgtaacggaaattttagacgttgtaggagattacgacgtaaattagtatttcgttttcgcgattattttataggttagattttcgcgtttcgtttattttggttttaaattaatcgtttcgtacgcgtttagttcgttttttgcggtagtttcgggtcgcgagtggtcgggaatgattgggggcggggttaaggggtcgcgtgcgtcggagatttttttcgtttcgtagtcgggaaacgtttagaatttcgaaatgtggagaaaataattttttttttacgggggcgtggttcgtcggttgtagtacgcgaaattggtaaaatgatgtaaatagggtacgtttt

SEQ ID NO: 34978 - DNA, 921 bp, Artificial Sequence
  chemically treated genomic DNA (Homo sapiens) CpG-island No: 34978
aaaacgtaccctatttacatcattttaccaatttcgcgtactacaaccgacgaaccacgcccccgtaaaaaaaaaattattttctccacatttcgaaattctaaacgtttcccgactacgaaacgaaaaaaatctccgacgcacgcgaccccttaaccccgcccccaatcattcccgaccactcgcgacccgaaactaccgcaaaaaacgaactaaacgcgtacgaaacgattaatttaaaaccaaaataaacgaaacgcgaaaatctaacctataaaataatcgcgaaaacgaaatactaatttacgtcgtaatctcctacaacgtctaaaatttccgttacaatcctcgaaaccaaaacctcgacgtaacctaacgaattataacgacgaaaaccgtatacgtactaaaaaacgacgacccaatacaaaacatcatcaatttcgaacaaaaaacaaaaactaaaacgaaaacttatttacgaaaccgctcccacccgctcgtccccccgcgcacctttactaaaaacgaatcgcccgccaaacctcgaaaccgccctaatccaacgcccgatcccgacccgtaccgcccgatcgataccttcgcccccaacgatacgatacccaaatactaaatcaccgaacgaacccgaacgcgaaacgtaaaaccgaaaccgccgcgaaactaaacctacgcgtaacgaaaacgcgaaaaaaaattaccgcgaaccgaaaaaaaacgaaaacgaacgtactaccctctataatccttaaaccgccgccgcgaatctatcgtaatacctaaaacgactatactcgtcccttacttaaccgtattctcgttcctaaaaatcccgcgaacaccgaataacgcaataccaaacccaacccgaaaataacgactacgcctaaacccgcctaa

SEQ ID NO: 34979 - DNA, 921 bp, Artificial Sequence
  chemically treated genomic DNA (Homo sapiens) CpG-island No: 34979
aaagcgtattttgtttatattattttgttaatttcgcgtattgtaatcggcgggttacgttttcgtgaaaagaaggttgttttttttatatttcggggttttggacgtttttcggttgcggggcggggggagttttcggcgtacgcggttttttggtttcgtttttagttattttcggttattcgcgattcgaggttgtcgtagggggcgggttgagcgcgtgcgaggcgattggtttggggttagagtgggcgaggcgcggaggtttggtttataaagtagtcgcggagacggggtgttggtttgcgtcgtagttttttgtagcgtttggggttttcgttgtagttttcggaattaggatttcggcgtggtttagcgagttatggcgacgaaggtcgtgtgcgtgttgaagggcgacggtttagtgtagggtattattaatttcgagtagaaggtaagggttgggacggaggtttgtttgcgaggtcgtttttattcgttcgttttttcgcgtatttttgttaggagcgggtcgttcgttaggtttcggggtcgttttggtttagcgttcggtttcggttcgtgtcgttcggtcggtgttttcgtttttagcggtgcggtgtttaagtgttgagttatcgggcgggttcgggcgcggggcgtgggatcgaggtcgtcgcggggttgggtttgcgcgtggcgggagcgcggggagggattgtcgcgggtcggggaggggcgggggcgggcgtgttgttttttgtggtttttgggtcgtcgtcgcgggtttgtcgtggtgtttggagcggttgtgttcgttttttgtttggtcgtgttttcgtttttgagggtttcgcggatatcgagtggcgtagtgttaggtttagttcggggatggcgattgcgtttgggttcgtttgg

SEQ ID NO: 34980 - DNA, 921 bp, Artificial Sequence
  chemically treated genomic DNA (Homo sapiens) CpG-island No: 34980
ccaaacgaacccaaacgcaatcgccatccccgaactaaacctaacactacgccactcgatatccgcgaaaccctcaaaaacgaaaacacgaccaaacaaaaaacgaacacaaccgctccaaacaccacgacaaacccgcgacgacgacccaaaaaccacaaaaaacaacacgcccgcccccgcccctccccgacccgcgacaatccctccccgcgctcccgccacgcgcaaacccaaccccgcgacgacctcgatcccacgccccgcgcccgaacccgcccgataactcaacacttaaacaccgcaccgctaaaaacgaaaacaccgaccgaacgacacgaaccgaaaccgaacgctaaaccaaaacgaccccgaaacctaacgaacgacccgctcctaacaaaaatacgcgaaaaaacgaacgaataaaaacgacctcgcaaacaaacctccgtcccaacccttaccttctactcgaaattaataataccctacactaaaccgtcgcccttcaacacgcacacgaccttcgtcgccataactcgctaaaccacgccgaaatcctaattccgaaaactacaacgaaaaccccaaacgctacaaaaaactacgacgcaaaccaacaccccgtctccgcgactactttataaaccaaacctccgcgcctcgcccactctaaccccaaaccaatcgcctcgcacgcgctcaacccgccccctacgacaacctcgaatcgcgaataaccgaaaataactaaaaacgaaaccaaaaaaccgcgtacgccgaaaactccccccgccccgcaaccgaaaaacgtccaaaaccccgaaatataaaaaaaacaaccttcttttcacgaaaacgtaacccgccgattacaatacgcgaaattaacaaaataatataaacaaaatacgcttt

SEQ ID NO: 34981 - DNA, 1444 bp, Artificial Sequence
  chemically treated genomic DNA (Homo sapiens) CpG-island No: 34981
gttttttgttcgcggtagtcgagagttagcggtttagtgttcgtcgttttcgtcgggtgtagggtcggttagggtcgagcgtttcgtagagacgtatttcgggagtatcgcgtcgagcggagcgcgcgtgcgttagggtttgttttgggttattttcgtagttttgggatttcgcgttttgtaaggtcgttttttcggttcgcggtcgcggtcgtcgtcgtcgtcggcgggaaagcgtttagcgtttcggcgttacgcgttagtagttttgtacgcggggcggtgtagggcggcgtagggcgggacgaggcggggagggggcggggttagcgcgacggggcggggcgaacgtcgggtataggaagcgtcgggaggtttgagtcgttttagggtgtttcgcgcggcgtggattcgggtcgttgtcgttatttcgttggagagagggagagagaggttcgttcgttcgtcggtcgggttagtgtgagttagtgcgtgagggcgcggggggtcgtgttagcgagacgtagagcgtagtcgttattattaaacggatatgttgaagattagcgttgtcgtcgtttttttttttttattttgcgaacgggattgagagggggttcgttattttttcgtttttgtttcggtcgttcgtttcgtcgtttcgggcgtagtttttttttgttcgggtttcggatttcgtcgttcgtcgttttttttcggttattaggttcggttggttttttagtttcgtttcgtcgcggcgcgaggtttatgtgatcggcgggttcggagtagtcgtcgtcgtagcgcgaatatggacgtcgttaacgtttttaattaggaggtaaggggtgtttggggtaggggggtgtcgggtttgttgtgggagtcggggttcgtttttttcgtcgtcggaggtttaaagttttggttcgggtggggacgttttttgtttcggtttcggggcggcggggtttgcgcggagcggggtttgtggttcgggagaggtcgcggcgattacgggaattgatttcgtatttttttttttattgtttattttcggatcgcgatttcgggtttttttttttcgtttttttgcggtttttttatagtttaagtttgtgtcgtgtttttttaatttggttttttttcgggtttgggcgttttcgttttttgtttcgcgagtttcgttgtcgggttcgtagtgtcgggagttcgtaaagggttaagaaagaagcgcgggcgggcgtgtggggttgggggcgggggagcgggagtatttgtcggtcgtggggttggcggagaggtggttttagtttttttgttgtttaggtcgcggcgcgtcgacggttggattttgatttcgggtttgggaggagttgaagagggtgtttatttttttttttcgggatttacgtatttgggaaatagggttaataaacgg

SEQ ID NO: 34982 - DNA, 1444 bp, Artificial Sequence
  chemically treated genomic DNA (Homo sapiens) CpG-island No: 34982
ccgtttattaaccctatttcccaaatacgtaaatcccgaaaaaaaaaaataaacaccctcttcaactcctcccaaacccgaaatcaaaatccaaccgtcgacgcgccgcgacctaaacaacaaaaaaactaaaaccacctctccgccaaccccacgaccgacaaatactcccgctcccccgcccccaaccccacacgcccgcccgcgcttctttcttaaccctttacgaactcccgacactacgaacccgacaacgaaactcgcgaaacaaaaaacgaaaacgcccaaacccgaaaaaaaaccaaattaaaaaaacacgacacaaacttaaactataaaaaaaccgcaaaaaaacgaaaaaaaaaaacccgaaatcgcgatccgaaaataaacaataaaaaaaaaaatacgaaatcaattcccgtaatcgccgcgacctctcccgaaccacaaaccccgctccgcgcaaaccccgccgccccgaaaccgaaacaaaaaacgtccccacccgaaccaaaactttaaacctccgacgacgaaaaaaacgaaccccgactcccacaacaaacccgacacccccctaccccaaacaccccttacctcctaattaaaaacgttaacgacgtccatattcgcgctacgacgacgactactccgaacccgccgatcacataaacctcgcgccgcgacgaaacgaaactaaaaaaccaaccgaacctaataaccgaaaaaaaacgacgaacgacgaaatccgaaacccgaacaaaaaaaaactacgcccgaaacgacgaaacgaacgaccgaaacaaaaacgaaaaaataacgaaccccctctcaatcccgttcgcaaaataaaaaaaaaaaaacgacgacaacgctaatcttcaacatatccgtttaataataacgactacgctctacgtctcgctaacacgaccccccgcgccctcacgcactaactcacactaacccgaccgacgaacgaacgaacctctctctccctctctccaacgaaataacgacaacgacccgaatccacgccgcgcgaaacaccctaaaacgactcaaacctcccgacgcttcctatacccgacgttcgccccgccccgtcgcgctaaccccgccccctccccgcctcgtcccgccctacgccgccctacaccgccccgcgtacaaaactactaacgcgtaacgccgaaacgctaaacgctttcccgccgacgacgacgacgaccgcgaccgcgaaccgaaaaaacgaccttacaaaacgcgaaatcccaaaactacgaaaataacccaaaacaaaccctaacgcacgcgcgctccgctcgacgcgatactcccgaaatacgtctctacgaaacgctcgaccctaaccgaccctacacccgacgaaaacgacgaacactaaaccgctaactctcgactaccgcgaacaaaaaac

SEQ ID NO: 34983 - DNA, 1444 bp, Artificial Sequence
  chemically treated genomic DNA (Homo sapiens) CpG-island No: 34983
tcgtttattagttttattttttaagtgcgtgaatttcggagaagggggatgaatattttttttaattttttttagattcgggattagagtttagtcgtcgacgcgtcgcggtttgagtaataggagagttgaagttattttttcgttagttttacgatcggtagatgttttcgttttttcgtttttaattttatacgttcgttcgcgttttttttttagttttttgcgggttttcggtattgcgaattcgataacggggttcgcggagtagagagcgagggcgtttagattcgaaaaagggttaagttagaggaatacggtatagatttgggttatgggaaggtcgtaagggggcgaaggggagaagttcgaggtcgcggttcgggggtgggtagtggggggaggggtgcggggttagttttcgtggtcgtcgcgatttttttcgggttataggtttcgtttcgcgtaggtttcgtcgtttcggaatcggggtaggaagcgtttttattcggattaaagttttaaattttcggcggcgggagaaacgagtttcggtttttatagtaggttcggtatttttttgttttaaatattttttattttttggttgaaggcgttgacggcgtttatgttcgcgttgcggcggcggttgtttcgggttcgtcggttatatagatttcgcgtcgcggcggagcggggttgggaaattagtcgggtttggtggtcggggggaggcgacgagcggcggagttcgaggttcgggtaggaagaggttgcgttcgaagcggcgaggcgggcggtcgaggtagaggcggagaggtggcgggtttttttttagtttcgttcgtaggatgaggaaaaggaggcggcggtagcgttggtttttaatatgttcgtttggtggtggcggttgcgttttgcgtttcgttgatacggtttttcgcgtttttacgtattggtttatattggttcggtcggcgagcgggcgggtttttttttttttttttttagcgggatggcggtagcggttcgagtttacgtcgcgcggggtattttgggacggtttaggtttttcggcgttttttgtgttcggcgttcgtttcgtttcgtcgcgttggtttcgtttttttttcgtttcgtttcgttttgcgtcgttttgtatcgtttcgcgtgtagggttgttggcgcgtgacgtcgggacgttgggcgttttttcgtcggcggcggcggcggtcgcggtcgcgggtcggggagacggttttgtagagcgcgggattttagggttgcgagggtgatttagagtaagttttggcgtacgcgcgtttcgttcgacgcggtgttttcggggtgcgtttttgcgaaacgttcggttttaatcggttttgtattcggcgggggcggcgggtattgagtcgttggttttcggttgtcgcgaataaagggt

SEQ ID NO: 34984 - DNA, 1444 bp, Artificial Sequence
  chemically treated genomic DNA (Homo sapiens) CpG-island No: 34984
accctttattcgcgacaaccgaaaaccaacgactcaatacccgccgcccccgccgaatacaaaaccgattaaaaccgaacgtttcgcaaaaacgcaccccgaaaacaccgcgtcgaacgaaacgcgcgtacgccaaaacttactctaaatcaccctcgcaaccctaaaatcccgcgctctacaaaaccgtctccccgacccgcgaccgcgaccgccgccgccgccgacgaaaaaacgcccaacgtcccgacgtcacgcgccaacaaccctacacgcgaaacgatacaaaacgacgcaaaacgaaacgaaacgaaaaaaaaacgaaaccaacgcgacgaaacgaaacgaacgccgaacacaaaaaacgccgaaaaacctaaaccgtcccaaaataccccgcgcgacgtaaactcgaaccgctaccgccatcccgctaaaaaaaaaaaaaaaaaaacccgcccgctcgccgaccgaaccaatataaaccaatacgtaaaaacgcgaaaaaccgtatcaacgaaacgcaaaacgcaaccgccaccaccaaacgaacatattaaaaaccaacgctaccgccgcctccttttcctcatcctacgaacgaaactaaaaaaaaacccgccacctctccgcctctacctcgaccgcccgcctcgccgcttcgaacgcaacctcttcctacccgaacctcgaactccgccgctcgtcgcctccccccgaccaccaaacccgactaatttcccaaccccgctccgccgcgacgcgaaatctatataaccgacgaacccgaaacaaccgccgccgcaacgcgaacataaacgccgtcaacgccttcaaccaaaaaataaaaaatatttaaaacaaaaaaataccgaacctactataaaaaccgaaactcgtttctcccgccgccgaaaatttaaaactttaatccgaataaaaacgcttcctaccccgattccgaaacgacgaaacctacgcgaaacgaaacctataacccgaaaaaaatcgcgacgaccacgaaaactaaccccgcacccctccccccactacccacccccgaaccgcgacctcgaacttctccccttcgcccccttacgaccttcccataacccaaatctataccgtattcctctaacttaaccctttttcgaatctaaacgccctcgctctctactccgcgaaccccgttatcgaattcgcaataccgaaaacccgcaaaaaactaaaaaaaaaacgcgaacgaacgtataaaattaaaaacgaaaaaacgaaaacatctaccgatcgtaaaactaacgaaaaaataacttcaactctcctattactcaaaccgcgacgcgtcgacgactaaactctaatcccgaatctaaaaaaaattaaaaaaaatattcatcccccttctccgaaattcacgcacttaaaaaataaaactaataaacga

SEQ ID NO: 34985 - DNA, 628 bp, Artificial Sequence
  chemically treated genomic DNA (Homo sapiens) CpG-island No: 34985
cggggcgcgtttcgcgttatttttttcgtttgttgttcgttggtcgaggcggtcgcgttgcgtcgcgggtcgcgatttttttttcgcgcgtcggttcgcgcgtgtttcgcgttttcgcgtttgagcgtttcgcgtcggcggaattgtgggatcgtcgcgtataggaagtggcggcggcgcgaggcggagggcggcgatgggggtcggggcggcgggcgcgtattcgttgaggttcgacgtaggcgggcgggttagtgcgcgcgcgtacgacgcgagaatcgcgattagtaggtggagtgtaggtgagtcgcgtcgagttcggtcgagtcgtcggagggtcgtttttcgtcgcgagtcgtagggttcgtcgtagtgagcggttgcgtttcgcggggcgcgcggtttggagagcgcggcgtttggaggtttcgggtatcgttcggtttttgtgcggattgtacggttcgcggtgttgtgcggggtgtacggcgattggggatgcgggcgatcgggtagagatggggatgcggggtcgacgagagggttgggcggtttgagggtttttttcggggggaatttgttacgtttcggttttcgttttgggggagttttatggttgatttcgggg

SEQ ID NO: 34986 - DNA, 628 bp, Artificial Sequence
  chemically treated genomic DNA (Homo sapiens) CpG-island No: 34986
ccccgaaatcaaccataaaactcccccaaaacgaaaaccgaaacgtaacaaattccccccgaaaaaaaccctcaaaccgcccaaccctctcgtcgaccccgcatccccatctctacccgatcgcccgcatccccaatcgccgtacaccccgcacaacaccgcgaaccgtacaatccgcacaaaaaccgaacgatacccgaaacctccaaacgccgcgctctccaaaccgcgcgccccgcgaaacgcaaccgctcactacgacgaaccctacgactcgcgacgaaaaacgaccctccgacgactcgaccgaactcgacgcgactcacctacactccacctactaatcgcgattctcgcgtcgtacgcgcgcgcactaacccgcccgcctacgtcgaacctcaacgaatacgcgcccgccgccccgacccccatcgccgccctccgcctcgcgccgccgccacttcctatacgcgacgatcccacaattccgccgacgcgaaacgctcaaacgcgaaaacgcgaaacacgcgcgaaccgacgcgcgaaaaaaaaatcgcgacccgcgacgcaacgcgaccgcctcgaccaacgaacaacaaacgaaaaaaataacgcgaaacgcgccccg

SEQ ID NO: 34987 - DNA, 628 bp, Artificial Sequence
  chemically treated genomic DNA (Homo sapiens) CpG-island No: 34987
tttcgaaattagttatggggtttttttagagcgagagtcggagcgtagtaagtttttttcggagagggtttttaggtcgtttagttttttcgtcggtttcgtatttttatttttattcgatcgttcgtatttttagtcgtcgtgtatttcgtatagtatcgcgagtcgtgtagttcgtataggggtcgggcggtattcggagtttttaggcgtcgcgttttttaggtcgcgcgtttcgcggagcgtagtcgtttattgcggcgggttttgcgattcgcggcgggggacgatttttcggcggttcggtcgagttcggcgcggtttatttgtattttatttgttggtcgcggttttcgcgtcgtgcgcgcgcgtattggttcgttcgtttgcgtcgggttttagcgagtgcgcgttcgtcgtttcggtttttatcgtcgtttttcgtttcgcgtcgtcgttattttttgtgcgcggcgattttatagtttcgtcggcgcgggacgtttaggcgcggggacgcgggatacgcgcggatcgacgcgcgggggaggagtcgcggttcgcggcgtagcgcgatcgtttcggttaacggatagtaagcgggggaggtgacgcgaggcgcgtttcg

SEQ ID NO: 34988 - DNA, 628 bp, Artificial Sequence
  chemically treated genomic DNA (Homo sapiens) CpG-island No: 34988
cgaaacgcgcctcgcgtcacctcccccgcttactatccgttaaccgaaacgatcgcgctacgccgcgaaccgcgactcctcccccgcgcgtcgatccgcgcgtatcccgcgtccccgcgcctaaacgtcccgcgccgacgaaactataaaatcgccgcgcacaaaaaataacgacgacgcgaaacgaaaaacgacgataaaaaccgaaacgacgaacgcgcactcgctaaaacccgacgcaaacgaacgaaccaatacgcgcgcgcacgacgcgaaaaccgcgaccaacaaataaaatacaaataaaccgcgccgaactcgaccgaaccgccgaaaaatcgtcccccgccgcgaatcgcaaaacccgccgcaataaacgactacgctccgcgaaacgcgcgacctaaaaaacgcgacgcctaaaaactccgaataccgcccgacccctatacgaactacacgactcgcgatactatacgaaatacacgacgactaaaaatacgaacgatcgaataaaaataaaaatacgaaaccgacgaaaaaactaaacgacctaaaaaccctctccgaaaaaaacttactacgctccgactctcgctctaaaaaaaccccataactaatttcgaaa

SEQ ID NO: 34989 - DNA, 503 bp, Artificial Sequence
  chemically treated genomic DNA (Homo sapiens) CpG-island No: 34989
agaaatcgttttgtaaaaggatattttgggaacggggtgtcgagaatatatttttaagaatacgggatattagtaaaggtcggcggaagagtattagtaagttatagaaggaagaaaagcgggtagatcgatcgggttagtttaagttagtagaatagtagacgaaggtcggattttgcggggtttacgtagcggagttcgtttgttttttcgttcgcgtatttgtcgttcgttgcgatttggtttcgatgtattttcgtagttttcgtaacgcgcggtttcgcgttatttgtttattgttcgttaggcgttgcgttagttggattttcggcgggagcggtatttcgggaattatggtgaggagaattttgagattacgtattcgacgttttcgttggggcgttcgagtgacgatacgcgttcgttattattgaacgttatattgaggcgatataatttagttagacgttaaacgttttggacgatgttgcgtacgtatcgtt

SEQ ID NO: 34990 - DNA, 503 bp, Artificial Sequence
  chemically treated genomic DNA (Homo sapiens) CpG-island No: 34990
aacgatacgtacgcaacatcgtccaaaacgtttaacgtctaactaaattatatcgcctcaatataacgttcaataataacgaacgcgtatcgtcactcgaacgccccaacgaaaacgtcgaatacgtaatctcaaaattctcctcaccataattcccgaaataccgctcccgccgaaaatccaactaacgcaacgcctaacgaacaataaacaaataacgcgaaaccgcgcgttacgaaaactacgaaaatacatcgaaaccaaatcgcaacgaacgacaaatacgcgaacgaaaaaacaaacgaactccgctacgtaaaccccgcaaaatccgaccttcgtctactattctactaacttaaactaacccgatcgatctacccgcttttcttccttctataacttactaatactcttccgccgacctttactaatatcccgtattcttaaaaatatattctcgacaccccgttcccaaaatatccttttacaaaacgatttct

SEQ ID NO: 34991 - DNA, 503 bp, Artificial Sequence
  chemically treated genomic DNA (Homo sapiens) CpG-island No: 34991
ggcggtacgtacgtagtatcgtttaggacgtttgacgtttagttgggttgtgtcgttttagtgtgacgtttagtggtgacgagcgcgtgtcgttattcgagcgttttagcggaagcgtcgagtgcgtggttttagggttttttttattatggttttcggagtgtcgttttcgtcggagatttagttggcgtagcgtttggcgggtaatgaataggtgacgcgggatcgcgcgttgcggaagttgcggaagtatatcgaggttaggtcgtagcgggcgataggtacgcgggcgggagggtaggcgagtttcgttgcgtgggtttcgtaggattcggttttcgtttgttgttttattggtttaggttgattcgatcggtttgttcgttttttttttttttgtagtttgttggtgttttttcgtcggtttttattggtgtttcgtgtttttaaaggtgtgttttcgatatttcgtttttaggatgtttttttgtagagcggttttt

SEQ ID NO: 34992 - DNA, 503 bp, Artificial Sequence
  chemically treated genomic DNA (Homo sapiens) CpG-island No: 34992
aaaaaccgctctacaaaaaaacatcctaaaaacgaaatatcgaaaacacacctttaaaaacacgaaacaccaataaaaaccgacgaaaaaacaccaacaaactacaaaaaaaaaaaaaacgaacaaaccgatcgaatcaacctaaaccaataaaacaacaaacgaaaaccgaatcctacgaaacccacgcaacgaaactcgcctaccctcccgcccgcgtacctatcgcccgctacgacctaacctcgatatacttccgcaacttccgcaacgcgcgatcccgcgtcacctattcattacccgccaaacgctacgccaactaaatctccgacgaaaacgacactccgaaaaccataataaaaaaaaccctaaaaccacgcactcgacgcttccgctaaaacgctcgaataacgacacgcgctcgtcaccactaaacgtcacactaaaacgacacaacccaactaaacgtcaaacgtcctaaacgatactacgtacgtaccgcc

SEQ ID NO: 34993 - DNA, 698 bp, Artificial Sequence
  chemically treated genomic DNA (Homo sapiens) CpG-island No: 34993
gtttcggttcgggtttttatttgtcggtgattacgtcgtcgtaggagcgaatgatgacgattttcgagtcggtggttagtacggcgtgtatcgaggaaattagtttagcgcgggcggagagaatagcgcgtcgttagttcggttcgaggacgtagggagttcggttcggtttttcggtttgattttttttagtcgtaggtagatgtggggagcgggtttcggaggtttatcggttattttcgttcgtttcggtttcgttttcgttaggggaggacgcggaggggtttcggaaattcgggtcgtcgggacgcggagggagtagtttcggttttttgtcgtttttttttttcgttttgggtttcgcggtcgggtggggtgcggtgggtagcgtttcgggtttcggggggcgttttcggcgtcggtatttggtgttgattattacgtagtcggtgcggttttattcgggttgggagcgcgtagcgtttaggtgtagagcgcgaagagtttcgggaagaagagcgcgttttcggttagcgttagtagtatcggggttgcgggttcggcgttttcgtggcgtcgcgtggttgggttcggttcgggcgttcggttcggtcgcgcgattttaatttttcgttttcgttttcgttttttttcgttcggcgttggtttcgattcgcgggcggttttgcgcgtgatta

SEQ ID NO: 34994 - DNA, 698 bp, Artificial Sequence
  chemically treated genomic DNA (Homo sapiens) CpG-island No: 34994
taatcacgcgcaaaaccgcccgcgaatcgaaaccaacgccgaacgaaaaaaaacgaaaacgaaaacgaaaaattaaaatcgcgcgaccgaaccgaacgcccgaaccgaacccaaccacgcgacgccacgaaaacgccgaacccgcaaccccgatactactaacgctaaccgaaaacgcgctcttcttcccgaaactcttcgcgctctacacctaaacgctacgcgctcccaacccgaataaaaccgcaccgactacgtaataatcaacaccaaataccgacgccgaaaacgccccccgaaacccgaaacgctacccaccgcaccccacccgaccgcgaaacccaaaacgaaaaaaaaaaacgacaaaaaaccgaaactactccctccgcgtcccgacgacccgaatttccgaaacccctccgcgtcctcccctaacgaaaacgaaaccgaaacgaacgaaaataaccgataaacctccgaaacccgctccccacatctacctacgactaaaaaaaatcaaaccgaaaaaccgaaccgaactccctacgtcctcgaaccgaactaacgacgcgctattctctccgcccgcgctaaactaatttcctcgatacacgccgtactaaccaccgactcgaaaatcgtcatcattcgctcctacgacgacgtaatcaccgacaaataaaaacccgaaccgaaac

SEQ ID NO: 34995 - DNA, 698 bp, Artificial Sequence
  chemically treated genomic DNA (Homo sapiens) CpG-island No: 34995
tggttacgcgtagagtcgttcgcggatcggggttagcgtcgggcggagggggacggggacgggggcggagggttgaaatcgcgcggtcgggtcgggcgttcgagtcgaatttagttacgcggcgttacggaggcgtcggattcgtagtttcgatgttgttgacgttggtcgggggcgcgttttttttttcggggtttttcgcgttttgtatttgggcgttgcgcgtttttagttcggatggagtcgtatcgattgcgtgatgattagtattaggtatcggcgtcgagaacgtttttcgaggttcggggcgttgtttatcgtattttattcggtcgcggggtttagggcggaaaaggggggcggtaggaagtcggggttgtttttttcgcgtttcggcggttcgagttttcgaagttttttcgcgtttttttttggcgggagcggggtcggggcgggcgggaatggtcgatgagttttcggagttcgttttttatatttgtttgcggttggggagagttaggtcgaagggtcgggtcgggttttttgcgttttcggatcggattgacggcgcgttgtttttttcgttcgcgttaggttggttttttcggtgtacgtcgtgttggttatcggttcggggatcgttattattcgtttttgcgacgacgtgattatcggtaggtaagagttcgggtcggggt

SEQ ID NO: 34996 - DNA, 698 bp, Artificial Sequence
  chemically treated genomic DNA (Homo sapiens) CpG-island No: 34996
accccgacccgaactcttacctaccgataatcacgtcgtcgcaaaaacgaataataacgatccccgaaccgataaccaacacgacgtacaccgaaaaaaccaacctaacgcgaacgaaaaaaacaacgcgccgtcaatccgatccgaaaacgcaaaaaacccgacccgacccttcgacctaactctccccaaccgcaaacaaatataaaaaacgaactccgaaaactcatcgaccattcccgcccgccccgaccccgctcccgccaaaaaaaaacgcgaaaaaacttcgaaaactcgaaccgccgaaacgcgaaaaaaacaaccccgacttcctaccgccccccttttccgccctaaaccccgcgaccgaataaaatacgataaacaacgccccgaacctcgaaaaacgttctcgacgccgatacctaatactaatcatcacgcaatcgatacgactccatccgaactaaaaacgcgcaacgcccaaatacaaaacgcgaaaaaccccgaaaaaaaaaacgcgcccccgaccaacgtcaacaacatcgaaactacgaatccgacgcctccgtaacgccgcgtaactaaattcgactcgaacgcccgacccgaccgcgcgatttcaaccctccgcccccgtccccgtccccctccgcccgacgctaaccccgatccgcgaacgactctacgcgtaacca

SEQ ID NO: 34997 - DNA, 682 bp, Artificial Sequence
  chemically treated genomic DNA (Homo sapiens) CpG-island No: 34997
ttcggttttcgggtcgtcgtttagttttttttcgcgtttttttgcgtttgggttattttcgatttttgttgttcggtttttagtttttttttatttatttcgtttcgttatgtttcgttttagtcgttcggtttttttttttttgtacgtttcgttttcgatttttcggttttttttcggtttgttcgttatatttttggttttttttgtaagtttcgtttttggtttttgtttttttttttttcgtcggttttaattcgcgtttggttaaggttcgcgggaattcgtgagttatcgagagagtagagaattcggcgtcgttaaatagtttagttcgcgttttagcgtttcggcgtcgtcgcgttattttttcgagtaagtggtttttgggcgcgttcgtttcgcgtatattttagcgcgtttttttcgtcgttgggttgcgggttgttttcggggagcgttttcggtttagagagtttttgaagcgagtgtgagtgagtgtgagtgggtgcgtttgaataatttgtttaggtgggtgtgcgtacgagtgtgtgtaggagcgtatagtttcggaaatttcgcgaaattttattcggttttagtgtcgtattgaggatttaagattttttttaggaatttttatttatttagggcgattttttaattattttttgtcgtgagt

SEQ ID NO: 34998 - DNA, 682 bp, Artificial Sequence
  chemically treated genomic DNA (Homo sapiens) CpG-island No: 34998
actcacgacaaaaaataattaaaaaatcgccctaaataaataaaaattcctaaaaaaaatcttaaatcctcaatacgacactaaaaccgaataaaatttcgcgaaatttccgaaactatacgctcctacacacactcgtacgcacacccacctaaacaaattattcaaacgcacccactcacactcactcacactcgcttcaaaaactctctaaaccgaaaacgctccccgaaaacaacccgcaacccaacgacgaaaaaaacgcgctaaaatatacgcgaaacgaacgcgcccaaaaaccacttactcgaaaaaataacgcgacgacgccgaaacgctaaaacgcgaactaaactatttaacgacgccgaattctctactctctcgataactcacgaattcccgcgaaccttaaccaaacgcgaattaaaaccgacgaaaaaaaaaaaaacaaaaaccaaaaacgaaacttacaaaaaaaaccaaaaatataacgaacaaaccgaaaaaaaaccgaaaaatcgaaaacgaaacgtacaaaaaaaaaaaaaccgaacgactaaaacgaaacataacgaaacgaaataaataaaaaaaaactaaaaaccgaacaacaaaaatcgaaaataacccaaacgcaaaaaaacgcgaaaaaaaactaaacgacgacccgaaaaccgaa

SEQ ID NO: 34999 - DNA, 682 bp, Artificial Sequence
  chemically treated genomic DNA (Homo sapiens) CpG-island No: 34999
gtttacggtaggaggtggttaagaggtcgttttgaataggtaagggtttttaaaaggggttttggatttttagtgcggtattggaatcgagtaaaatttcgcggagttttcgaggttgtgcgtttttgtatatattcgtacgtatatttatttaaataagttgtttaaacgtatttatttatatttatttatattcgttttagaaattttttgagtcggaggcgtttttcgagagtagttcgtagtttagcggcgggagaggcgcgttggagtgtgcgcgggacgggcgcgtttaggagttatttattcggaggagtggcgcgacggcgtcgggacgttgaagcgcgagttgggttgtttggcggcgtcgagttttttgttttttcggtggtttacgggttttcgcggattttagttaagcgcgggttagagtcggcgggagaaaaggaggtagaggttaggggcggaatttgtaggagggattaagggtgtggcgggtaggtcggggaggagtcgggaggtcgggggcggagcgtgtagggaaggaggagtcgagcggttggggcggggtatggcggggcggagtgggtgaggaggagttggggatcggatagtaggagtcggaagtggtttaggcgtaggagagcgcggagaagggttgggcggcggttcgggagtcgga

SEQ ID NO: 35000 - DNA, 682 bp, Artificial Sequence
  chemically treated genomic DNA (Homo sapiens) CpG-island No: 35000
tccgactcccgaaccgccgcccaacccttctccgcgctctcctacgcctaaaccacttccgactcctactatccgatccccaactcctcctcacccactccgccccgccataccccgccccaaccgctcgactcctccttccctacacgctccgcccccgacctcccgactcctccccgacctacccgccacacccttaatccctcctacaaattccgcccctaacctctacctccttttctcccgccgactctaacccgcgcttaactaaaatccgcgaaaacccgtaaaccaccgaaaaaacaaaaaactcgacgccgccaaacaacccaactcgcgcttcaacgtcccgacgccgtcgcgccactcctccgaataaataactcctaaacgcgcccgtcccgcgcacactccaacgcgcctctcccgccgctaaactacgaactactctcgaaaaacgcctccgactcaaaaaatttctaaaacgaatataaataaatataaataaatacgtttaaacaacttatttaaataaatatacgtacgaatatatacaaaaacgcacaacctcgaaaactccgcgaaattttactcgattccaataccgcactaaaaatccaaaaccccttttaaaaacccttacctattcaaaacgacctcttaaccacctcctaccgtaaac

SEQ ID NO: 35001 - DNA, 861 bp, Artificial Sequence
  chemically treated genomic DNA (Homo sapiens) CpG-island No: 35001
cggatagcgagatggggtttagttttgcgtttcgggggtcgtaatagacggtaaggtggaggtggtttttcggtttcgtagtcggatttcggtatttcgagttcgtttatcggggtcgggttttggcgggtcgcggagtgaggtcgggcggcgtagcgtaggcggtgttcgggcgtagggttagtttcgtcgtcgtcgtcgtcgtcgtcgtcgtcgtcgtcgcgagttcggatttgttcgttcgatttggcggcgtagtttcgcgggatcgtttagttttcgtttttcgtgcggttttcgaggtagttttagtttcggacgtaatttcggagtcgttttaggtttttggggggaacggtgggttagacggggacgggaagggatagcggttttcgatcgtttttcgaggtgaggtttttacggttgggattgggtaggggtcgggcgggtgtcgggggaagcggggagggtttcgaggggcgaggggtcgcggttgggatgaggcgcgtcgggagtcgtaggtgttggggaggtaacggcgggacggttcgtatttgagttttttcggaagcgggaatcggttttgaaaggcgatgtcggggtttcgcggcgtcgcgtaggttaggaacgttgttgtttggttttaggtttggggtaggttttcgggtgtggggcgttggcggatcgggtattagtgtgtgttggggcgcgggtaattcgtaattcggggtttatagtttttttttcgtaaggggattgttttcgtttttttttcgggatagatttgcgtatttttttttcgacggtagtattatatttttttagttagtgaaaattgtaatgttgtttttttattggagg

SEQ ID NO: 35002 - DNA, 861 bp, Artificial Sequence
  chemically treated genomic DNA (Homo sapiens) CpG-island No: 35002
cctccaataaaaaaacaacattacaattttcactaactaaaaaaatataatactaccgtcgaaaaaaaaatacgcaaatctatcccgaaaaaaaaacgaaaacaatccccttacgaaaaaaaaactataaaccccgaattacgaattacccgcgccccaacacacactaatacccgatccgccaacgccccacacccgaaaacctaccccaaacctaaaaccaaacaacaacgttcctaacctacgcgacgccgcgaaaccccgacatcgcctttcaaaaccgattcccgcttccgaaaaaactcaaatacgaaccgtcccgccgttacctccccaacacctacgactcccgacgcgcctcatcccaaccgcgacccctcgcccctcgaaaccctccccgcttcccccgacacccgcccgacccctacccaatcccaaccgtaaaaacctcacctcgaaaaacgatcgaaaaccgctatcccttcccgtccccgtctaacccaccgttccccccaaaaacctaaaacgactccgaaattacgtccgaaactaaaactacctcgaaaaccgcacgaaaaacgaaaactaaacgatcccgcgaaactacgccgccaaatcgaacgaacaaatccgaactcgcgacgacgacgacgacgacgacgacgacgacgacgaaactaaccctacgcccgaacaccgcctacgctacgccgcccgacctcactccgcgacccgccaaaacccgaccccgataaacgaactcgaaataccgaaatccgactacgaaaccgaaaaaccacctccaccttaccgtctattacgacccccgaaacgcaaaactaaaccccatctcgctatccg

SEQ ID NO: 35003 - DNA, 861 bp, Artificial Sequence
  chemically treated genomic DNA (Homo sapiens) CpG-island No: 35003
tttttagtggaggagtaatattgtagtttttattggttaggagggtgtagtgttgtcgtcgaaaggaaagtgcgtaaatttgtttcgggggaagggcgaaggtagtttttttgcgggaggaaggttgtaggtttcggattacgaattattcgcgttttaatatatattgatgttcggttcgttagcgttttatattcgggaatttgttttaggtttagagttagatagtagcgtttttggtttgcgcggcgtcgcggggtttcggtatcgttttttagagtcggttttcgttttcgaggaaatttaggtgcgggtcgtttcgtcgttgtttttttagtatttgcggttttcggcgcgttttattttagtcgcggtttttcgtttttcgaggtttttttcgtttttttcggtattcgttcggtttttgtttagttttagtcgtggaagttttatttcggggggcggtcgaaggtcgttgttttttttcgttttcgtttaatttatcgttttttttagggatttgagacggtttcggggttgcgttcgggattggagttgtttcgagagtcgtacggggagcgagagttgagcgatttcgcgagattgcgtcgttaggtcgggcgggtaggttcgggttcgcggcggcggcggcggcggcggcggcggcggcggcgggattggttttgcgttcgggtatcgtttgcgttgcgtcgttcggttttatttcgcggttcgttaggattcggtttcggtgaacgggttcggggtgtcgaggttcggttgcggggtcgggaagttatttttattttgtcgtttgttacgattttcgaggcgtaaggttgagttttatttcgttattcg

SEQ ID NO: 35004 - DNA, 861 bp, Artificial Sequence
  chemically treated genomic DNA (Homo sapiens) CpG-island No: 35004
cgaataacgaaataaaactcaaccttacgcctcgaaaatcgtaacaaacgacaaaataaaaataacttcccgaccccgcaaccgaacctcgacaccccgaacccgttcaccgaaaccgaatcctaacgaaccgcgaaataaaaccgaacgacgcaacgcaaacgatacccgaacgcaaaaccaatcccgccgccgccgccgccgccgccgccgccgccgccgcgaacccgaacctacccgcccgacctaacgacgcaatctcgcgaaatcgctcaactctcgctccccgtacgactctcgaaacaactccaatcccgaacgcaaccccgaaaccgtctcaaatccctaaaaaaaacgataaattaaacgaaaacgaaaaaaaacaacgaccttcgaccgccccccgaaataaaacttccacgactaaaactaaacaaaaaccgaacgaataccgaaaaaaacgaaaaaaacctcgaaaaacgaaaaaccgcgactaaaataaaacgcgccgaaaaccgcaaatactaaaaaaacaacgacgaaacgacccgcacctaaatttcctcgaaaacgaaaaccgactctaaaaaacgataccgaaaccccgcgacgccgcgcaaaccaaaaacgctactatctaactctaaacctaaaacaaattcccgaatataaaacgctaacgaaccgaacatcaatatatattaaaacgcgaataattcgtaatccgaaacctacaaccttcctcccgcaaaaaaactaccttcgcccttcccccgaaacaaatttacgcactttcctttcgacgacaacactacaccctcctaaccaataaaaactacaatattactcctccactaaaaa

SEQ ID NO: 35005 - DNA, 551 bp, Artificial Sequence
  chemically treated genomic DNA (Homo sapiens) CpG-island No: 35005
gtgttcggcgtaagaggcgatacgtttttggagtagtcgggatttttcgttcgagttcggtacgtttcgttttacgcggagtttcggaggtcggacgggaagatttcggggtagtttttcgggtttttttttgttttttttcgttcgtttagggtataggatttttcggacggttgagcgtcgcggggttagttcgagcgatttattcgggttttacgttcggtcgcggagttgggagcgtatttaggtaggttttttacgtttggatttttggttcggtttttcgatttgataatttttcgcgttgcgttcggtttcgtttatttggttcgtatagtattgagttgatatcgcggcggttaatgtcgaaggcgcgttcgttggtttttcgcgtcgtacgggtttttttggttgtttcgcgtttcgagcgttgggtttagtcgtagtttatatttgaacgaagattagttcgcgaagcgttagcgcgagttggtaaaatattcgtagtcgttcgcgcggttcgtttttcgttttagttcgtcgtgtcgttt

SEQ ID NO: 35006 - DNA, 551 bp, Artificial Sequence
  chemically treated genomic DNA (Homo sapiens) CpG-island No: 35006
aaacgacacgacgaactaaaacgaaaaacgaaccgcgcgaacgactacgaatattttaccaactcgcgctaacgcttcgcgaactaatcttcgttcaaatataaactacgactaaacccaacgctcgaaacgcgaaacaaccaaaaaaacccgtacgacgcgaaaaaccaacgaacgcgccttcgacattaaccgccgcgatatcaactcaatactatacgaaccaaataaacgaaaccgaacgcaacgcgaaaaattatcaaatcgaaaaaccgaaccaaaaatccaaacgtaaaaaacctacctaaatacgctcccaactccgcgaccgaacgtaaaacccgaataaatcgctcgaactaaccccgcgacgctcaaccgtccgaaaaatcctataccctaaacgaacgaaaaaaaacaaaaaaaaacccgaaaaactaccccgaaatcttcccgtccgacctccgaaactccgcgtaaaacgaaacgtaccgaactcgaacgaaaaatcccgactactccaaaaacgtatcgcctcttacgccgaacac

SEQ ID NO: 35007 - DNA, 551 bp, Artificial Sequence
  chemically treated genomic DNA (Homo sapiens) CpG-island No: 35007
gggcggtacggcgggttggggcggggagcgggtcgcgcgggcggttgcgagtgttttattagttcgcgttggcgtttcgcgggttgattttcgtttaagtgtgagttgcggttgagtttagcgttcgaggcgcgaggtagttaggagggttcgtgcggcgcggggagttagcgagcgcgttttcggtattggtcgtcgcgatgttagtttagtgttgtgcgggttaggtgagcgaggtcgggcgtagcgcggggggttgttagatcggagaatcgggttaggagtttaggcgtggaggatttgtttgggtgcgtttttagtttcgcggtcgaacgtagggttcgggtgggtcgttcgggttggtttcgcggcgtttagtcgttcgggaaattttgtgttttgggcgggcgggaaggggtagggggaagttcgagaggttatttcggggttttttcgttcggttttcgggatttcgcgtggagcggggcgtgtcgggttcgggcggaggatttcgattgttttaggggcgtgtcgttttttgcgtcgagtat

SEQ ID NO: 35008 - DNA, 551 bp, Artificial Sequence
  chemically treated genomic DNA (Homo sapiens) CpG-island No: 35008
atactcgacgcaaaaaacgacacgcccctaaaacaatcgaaatcctccgcccgaacccgacacgccccgctccacgcgaaatcccgaaaaccgaacgaaaaaaccccgaaataacctctcgaacttccccctaccccttcccgcccgcccaaaacacaaaatttcccgaacgactaaacgccgcgaaaccaacccgaacgacccacccgaaccctacgttcgaccgcgaaactaaaaacgcacccaaacaaatcctccacgcctaaactcctaacccgattctccgatctaacaaccccccgcgctacgcccgacctcgctcacctaacccgcacaacactaaactaacatcgcgacgaccaataccgaaaacgcgctcgctaactccccgcgccgcacgaaccctcctaactacctcgcgcctcgaacgctaaactcaaccgcaactcacacttaaacgaaaatcaacccgcgaaacgccaacgcgaactaataaaacactcgcaaccgcccgcgcgacccgctccccgccccaacccgccgtaccgccc

SEQ ID NO: 35009 - DNA, 564 bp, Artificial Sequence
  chemically treated genomic DNA (Homo sapiens) CpG-island No: 35009
ttcgcgattattttttatttttttatcgcggtttgtttcgttgagttcggtttcgagtgttttattgttgtcgttattttttttacgacgatgtttgacgttgattttcggtcgtttttcgaattttttttatatattttttatcgtttatcgttatatattgttttgttatagtaataattttgttttttgtgtgtcggtgttttattcgtgtttcgcggttttcggtttattatattagatttttttttcgaattttttatttcgttttttttaacgttatttattcgtcgtttttttttaatacgacgatcgtcggtttttcgtttagaaggacgtgtgagacggacgcggtcggtcgtatttgtttacgcgcgtttcgtttcgttatcggacgacgggcggcgttcggtaagtcgatatgttttttaggtaggtatgcgggatgatgtcgtcgtgaagcgtagcgcgtcggggtatgtcgcgcgcgtttcgttcgtttttttttttattcggaacggagagcggtttcgaaatcgttcggaagttagattttttaaattt

SEQ ID NO: 35010 - DNA, 564 bp, Artificial Sequence
  chemically treated genomic DNA (Homo sapiens) CpG-island No: 35010
aaatttaaaaaatctaacttccgaacgatttcgaaaccgctctccgttccgaataaaaaaaaaaacgaacgaaacgcgcgcgacataccccgacgcgctacgcttcacgacgacatcatcccgcatacctacctaaaaaacatatcgacttaccgaacgccgcccgtcgtccgataacgaaacgaaacgcgcgtaaacaaatacgaccgaccgcgtccgtctcacacgtccttctaaacgaaaaaccgacgatcgtcgtattaaaaaaaaacgacgaataaataacgttaaaaaaaacgaaataaaaaattcgaaaaaaaaatctaatataataaaccgaaaaccgcgaaacacgaataaaacaccgacacacaaaaaacaaaattattactataacaaaacaatatataacgataaacgataaaaaatatataaaaaaaattcgaaaaacgaccgaaaatcaacgtcaaacatcgtcgtaaaaaaaataacgacaacaataaaacactcgaaaccgaactcaacgaaacaaaccgcgataaaaaaataaaaaataatcgcgaa

SEQ ID NO: 35011 - DNA, 564 bp, Artificial Sequence
  chemically treated genomic DNA (Homo sapiens) CpG-island No: 35011
gggtttggagggtttggttttcgggcggtttcggggtcgtttttcgtttcgggtggaaagggggacgggcggggcgcgcgcggtatatttcggcgcgttgcgttttacggcggtattatttcgtatatttgtttggggggtatgtcggtttatcgggcgtcgttcgtcgttcggtagcggggcggggcgcgcgtgagtagatgcggtcggtcgcgttcgttttatacgtttttttggacgagggatcggcggtcgtcgtgttgggggagggcggcgggtgggtaacgttggggggagcgaggtgggaagttcgggaggggagtttgatgtagtggatcgggggtcgcggggtacgagtgggatatcggtatataaaaagtaaaattattattgtggtaaaatagtgtatagcggtaaacggtaaggggtatgtgggggaggttcgggggacggtcgggggttagcgttaggtatcgtcgtgagggggatgacggtagtagtggaatattcgggatcggatttaacggggtagatcgcggtaggagagtggggggtggtcgcggg

SEQ ID NO: 35012 - DNA, 564 bp, Artificial Sequence
  chemically treated genomic DNA (Homo sapiens) CpG-island No: 35012
cccgcgaccaccccccactctcctaccgcgatctaccccgttaaatccgatcccgaatattccactactaccgtcatccccctcacgacgatacctaacgctaacccccgaccgtcccccgaacctcccccacataccccttaccgtttaccgctatacactattttaccacaataataattttactttttatataccgatatcccactcgtaccccgcgacccccgatccactacatcaaactcccctcccgaacttcccacctcgctccccccaacgttacccacccgccgccctcccccaacacgacgaccgccgatccctcgtccaaaaaaacgtataaaacgaacgcgaccgaccgcatctactcacgcgcgccccgccccgctaccgaacgacgaacgacgcccgataaaccgacataccccccaaacaaatatacgaaataataccgccgtaaaacgcaacgcgccgaaatataccgcgcgcgccccgcccgtccccctttccacccgaaacgaaaaacgaccccgaaaccgcccgaaaaccaaaccctccaaaccc

SEQ ID NO: 35013 - DNA, 623 bp, Artificial Sequence
  chemically treated genomic DNA (Homo sapiens) CpG-island No: 35013
tcgtaatcgcgttgtgattgttaggcgtgcgattggtatcgtttgtgttcgtacgttcggtaggagacgttagatagcgtgttttgtgcgggttattaggcgttttatttttatttcgtatcgtatatgcgggtgatgcgtgatttgataaagtagtatcgtttttttatggagttgatgacgatgttgcggtgacgtgcgtttaaacgggttgtttttgatgcgatattcgcgtcgttagcggtagttagtatagtacgattaataattttattaaggttattaataattttaggttgttttgatcggtttgcggtaatatcgtagagagcgacgttagtacgtcggaattaatgttttgtagatcgtcgattagcgcgttagtcgtgttcgttaggaaggggaacggttttatcgcgtcgttggtcgttagcggaaatagtatttcggtatcgaaaaagaatagcgcggcgggaacgagtagcgtttagatatttattacgttaaattagtcggggatttatatttagtaagttagttagtaggtagtagataatcgattgttatattaacgtggagaagcgtttattgggacgttcggtaaattatgcgttaaaaaacgt

SEQ ID NO: 35014 - DNA, 623 bp, Artificial Sequence
  chemically treated genomic DNA (Homo sapiens) CpG-island No: 35014
acgttttttaacgcataatttaccgaacgtcccaataaacgcttctccacgttaatataacaatcgattatctactacctactaactaacttactaaatataaatccccgactaatttaacgtaataaatatctaaacgctactcgttcccgccgcgctattctttttcgataccgaaatactatttccgctaacgaccaacgacgcgataaaaccgttccccttcctaacgaacacgactaacgcgctaatcgacgatctacaaaacattaattccgacgtactaacgtcgctctctacgatattaccgcaaaccgatcaaaacaacctaaaattattaataaccttaataaaattattaatcgtactatactaactaccgctaacgacgcgaatatcgcatcaaaaacaacccgtttaaacgcacgtcaccgcaacatcgtcatcaactccataaaaaaacgatactactttatcaaatcacgcatcacccgcatatacgatacgaaataaaaataaaacgcctaataacccgcacaaaacacgctatctaacgtctcctaccgaacgtacgaacacaaacgataccaatcgcacgcctaacaatcacaacgcgattacga

SEQ ID NO: 35015 - DNA, 623 bp, Artificial Sequence
  chemically treated genomic DNA (Homo sapiens) CpG-island No: 35015
gcgttttttggcgtatggtttgtcggacgttttaataaacgtttttttacgttaatgtggtagtcggttatttgttgtttgttggttggtttgttgaatgtggattttcgattggtttggcgtgatgaatgtttggacgttgttcgttttcgtcgcgttgttttttttcggtgtcgggatgttgttttcgttggcgattagcggcgcgatggagtcgtttttttttttggcgggtacggttggcgcgttggtcggcggtttgtaaaatattggtttcggcgtgttggcgtcgttttttgcgatgttgtcgtaaatcggttagggtagtttggggttgttgatgattttaatgggattgttgatcgtgttgtgttggttgtcgttggcgacgcggatgtcgtattaggggtagttcgtttaagcgtacgttatcgtagtatcgttattagttttatgggagaacgatgttgttttattagattacgtattattcgtatatgcggtgcggagtaagaataaaacgtttgatagttcgtataaagtacgttgtttggcgttttttgtcgagcgtgcgggtataggcgatgttagtcgtacgtttggtagttatagcgcggttgcgg

SEQ ID NO: 35016 - DNA, 623 bp, Artificial Sequence
  chemically treated genomic DNA (Homo sapiens) CpG-island No: 35016
ccgcaaccgcgctataactaccaaacgtacgactaacatcgcctatacccgcacgctcgacaaaaaacgccaaacaacgtactttatacgaactatcaaacgttttattcttactccgcaccgcatatacgaataatacgtaatctaataaaacaacatcgttctcccataaaactaataacgatactacgataacgtacgcttaaacgaactacccctaatacgacatccgcgtcgccaacgacaaccaacacaacacgatcaacaatcccattaaaatcatcaacaaccccaaactaccctaaccgatttacgacaacatcgcaaaaaacgacgccaacacgccgaaaccaatattttacaaaccgccgaccaacgcgccaaccgtacccgccaaaaaaaaaaacgactccatcgcgccgctaatcgccaacgaaaacaacatcccgacaccgaaaaaaaacaacgcgacgaaaacgaacaacgtccaaacattcatcacgccaaaccaatcgaaaatccacattcaacaaaccaaccaacaaacaacaaataaccgactaccacattaacgtaaaaaaacgtttattaaaacgtccgacaaaccatacgccaaaaaacgc

SEQ ID NO: 35017 - DNA, 511 bp, Artificial Sequence
  chemically treated genomic DNA (Homo sapiens) CpG-island No: 35017
ggttttttttcgtttaggtgagtttttttcgcgttttttattggtcgagatgttcgcggcgttgggagggcgacgtagcgcggtttagtttagggtttagggcggcgcgttattttcggtagcgcggagtttgtaaaatattttggagagaaaatggcggcggtagtagtttcggcgttttagtagttttcggatgaggagttttttttttagtttcgtcgttacggtttgtttttcggattagtgacggagagtattcgttcggtttattttaagaagttgaagaagtttcgagaggaagagtagtaatagtatcggttagggggtcgcggtaataagacgcggaatagtaataataataatacggtagtcgttacggtcgtagtcgcgggattagcggcggcggcggtcgcggggatgggggttcggtcggtttcgggcgattttttttatttacggatttttgggggtttgtgtcgaatttcggtttttggtttagagagttttttgg

SEQ ID NO: 35018 - DNA, 511 bp, Artificial Sequence
  chemically treated genomic DNA (Homo sapiens) CpG-island No: 35018
ccaaaaaactctctaaaccaaaaaccgaaattcgacacaaacccccaaaaatccgtaaataaaaaaaatcgcccgaaaccgaccgaacccccatccccgcgaccgccgccgccgctaatcccgcgactacgaccgtaacgactaccgtattattattattactattccgcgtcttattaccgcgaccccctaaccgatactattactactcttcctctcgaaacttcttcaacttcttaaaataaaccgaacgaatactctccgtcactaatccgaaaaacaaaccgtaacgacgaaactaaaaaaaaaactcctcatccgaaaactactaaaacgccgaaactactaccgccgccattttctctccaaaatattttacaaactccgcgctaccgaaaataacgcgccgccctaaaccctaaactaaaccgcgctacgtcgccctcccaacgccgcgaacatctcgaccaataaaaaacgcgaaaaaaactcacctaaacgaaaaaaaacc

SEQ ID NO: 35019 - DNA, 511 bp, Artificial Sequence
  chemically treated genomic DNA (Homo sapiens) CpG-island No: 35019
ttaggaggttttttgggttagaggtcgagattcggtataggtttttaggagttcgtaagtaggagaggtcgttcgagatcggtcggatttttattttcgcggtcgtcgtcgtcgttggtttcgcggttgcgatcgtggcggttgtcgtgttattgttattattgtttcgcgttttgttgtcgcggttttttgatcggtgttgttgttgttttttttttcgaagtttttttagttttttgaggtagatcgggcgggtgtttttcgttattggttcgggagataggtcgtaacggcggagttgagagaaaagttttttattcgagagttgttgaggcgtcgaagttgttgtcgtcgttattttttttttagggtgttttataagtttcgcgttatcggaagtgacgcgtcgttttagattttgaattagatcgcgttgcgtcgtttttttagcgtcgcgggtatttcggttaatgggaggcgcgggaggagtttatttgagcgggaaagagtt

SEQ ID NO: 35020 - DNA, 511 bp, Artificial Sequence
  chemically treated genomic DNA (Homo sapiens) CpG-island No: 35020
aactctttcccgctcaaataaactcctcccgcgcctcccattaaccgaaatacccgcgacgctaaaaaaacgacgcaacgcgatctaattcaaaatctaaaacgacgcgtcacttccgataacgcgaaacttataaaacaccctaaaaaaaaaataacgacgacaacaacttcgacgcctcaacaactctcgaataaaaaacttttctctcaactccgccgttacgacctatctcccgaaccaataacgaaaaacacccgcccgatctacctcaaaaaactaaaaaaacttcgaaaaaaaaaacaacaacaacaccgatcaaaaaaccgcgacaacaaaacgcgaaacaataataacaataacacgacaaccgccacgatcgcaaccgcgaaaccaacgacgacgacgaccgcgaaaataaaaatccgaccgatctcgaacgacctctcctacttacgaactcctaaaaacctataccgaatctcgacctctaacccaaaaaacctcctaa

SEQ ID NO: 35021 - DNA, 967 bp, Artificial Sequence
  chemically treated genomic DNA (Homo sapiens) CpG-island No: 35021
  misc_feature (731)..(732): n is either a, c, g or t
  misc_feature (759)..(759): n is either a, c, g or t
atcgtttatttttttcgaattcgttttagtcgtttagttttttcgttttatttatagtgcgggatcggagggtaaagcgggcgggacgtgatggtggtttcggtttagcgttatgtaaataagtttcgtcgaggacgcgttttatattttttttttttaggtttttagtgaaaggacgggcggaattttgcgatttaaacgtttttttgaaattttttaatgtatcgttacgggagttttattttaaattttttgttagtcgttttcggaatttcgatttttgtttggagagcgttataatggttttacgagaaaaggagaagtcggttggatcggattgagagttttgcgattcgatttttaagaggagattggggggagggagcgagtagttcgagcgagcgcgggtttttttttgggttagtcgaatagtaatagtcgagttttattaattcgcggttttttgcgtttttagtatttattttcggattggaggcgtaaagtaaataggttttcgaagttgggtatagaggtatattgttcgtttttgcggtttttattttcgtttgcgagcgcgtttcgagggagggtcgtttggcgtgggggtcgcgcggggataggcgcggagggtagcggttatttcggtcggagagcgcgaggtcggtcgcgagcgggttttcggtcgtcgagttcgcgcgggaggtagcgtcgtagtttttcggtcggatatnnggtcgtagttcggcgcgtttttttgtnttcgtcgtcgtcgtttttagtcgagtagttagcgtcgggcggtttttggggttaagttaatattttttcgtagttttttatacgtcgtttttcgagagaggttttttatatatacgtatatatttttagatcgtacgtttttttaggaaaaaaaaatcgggaattagagcgtaaggggtggtggaagtaaaagtttgatagaggtgcg

SEQ ID NO: 35022 - DNA, 967 bp, Artificial Sequence
  chemically treated genomic DNA (Homo sapiens) CpG-island No: 35022
  misc_feature (209)..(209): n is either a, c, g or t
  misc_feature (236)..(237): n is either a, c, g or t
cgcacctctatcaaacttttacttccaccaccccttacgctctaattcccgatttttttttcctaaaaaaacgtacgatctaaaaatatatacgtatatataaaaaacctctctcgaaaaacgacgtataaaaaactacgaaaaaatattaacttaaccccaaaaaccgcccgacgctaactactcgactaaaaacgacgacgacgaanacaaaaaaacgcgccgaactacgaccnnatatccgaccgaaaaactacgacgctacctcccgcgcgaactcgacgaccgaaaacccgctcgcgaccgacctcgcgctctccgaccgaaataaccgctaccctccgcgcctatccccgcgcgacccccacgccaaacgaccctccctcgaaacgcgctcgcaaacgaaaataaaaaccgcaaaaacgaacaatatacctctatacccaacttcgaaaacctatttactttacgcctccaatccgaaaataaatactaaaaacgcaaaaaaccgcgaattaataaaactcgactattactattcgactaacccaaaaaaaaacccgcgctcgctcgaactactcgctccctccccccaatctcctcttaaaaatcgaatcgcaaaactctcaatccgatccaaccgacttctccttttctcgtaaaaccattataacgctctccaaacaaaaatcgaaattccgaaaacgactaacaaaaaatttaaaataaaactcccgtaacgatacattaaaaaatttcaaaaaaacgtttaaatcgcaaaattccgcccgtcctttcactaaaaacctaaaaaaaaaaaatataaaacgcgtcctcgacgaaacttatttacataacgctaaaccgaaaccaccatcacgtcccgcccgctttaccctccgatcccgcactataaataaaacgaaaaaactaaacgactaaaacgaattcgaaaaaaataaacgat

SEQ ID NO: 35023 - DNA, 967 bp, Artificial Sequence
  chemically treated genomic DNA (Homo sapiens) CpG-island No: 35023
  misc_feature (209)..(209): n is either a, c, g or t
  misc_feature (236)..(237): n is either a, c, g or t
cgtatttttgttaggtttttgtttttattattttttacgttttgattttcgattttttttttttaagggagcgtgcggtttgggggtgtgtgcgtgtgtgtgaaagatttttttcgaagagcggcgtgtgggaaattgcgggaaaatgttgatttaattttaggagtcgttcggcgttggttgttcggttggaggcggcggcggcgaangtaggaggacgcgtcgagttgcggttnngtgttcggtcggggagttgcggcgttgtttttcgcgcggattcggcggtcgaggattcgttcgcggtcggtttcgcgtttttcggtcggggtagtcgttgtttttcgcgtttgttttcgcgcggtttttacgttagacggttttttttcggggcgcgttcgtagacggaggtaagagtcgtaggagcgaataatgtgtttttgtgtttagtttcggagatttgtttgttttgcgtttttagttcgggggtggatgttggaggcgtagggagtcgcgggttaatggggttcggttgttgttgttcggttggtttagggggagattcgcgttcgttcgggttgttcgttttttttttttaatttttttttggaaatcgagtcgtagaatttttagttcggtttagtcggtttttttttttttcgtggagttattgtaacgttttttaggtaggagtcgaggtttcgggggcggttggtaaggggtttaggatgaggttttcgtagcgatgtattggggaattttaggaaagcgtttgggtcgtaaggtttcgttcgtttttttattgggggtttggggaggaggagtgtgaagcgcgttttcggcggagtttatttgtatggcgttgggtcggggttattattacgtttcgttcgttttgtttttcggtttcgtattgtaagtggagcggggaggttgagcggttggagcgagttcgggggaagtggacggt

SEQ ID NO: 35024 - DNA, 967 bp, Artificial Sequence
  chemically treated genomic DNA (Homo sapiens) CpG-island No: 35024
  misc_feature (731)..(732): n is either a, c, g or t
  misc_feature (759)..(759): n is either a, c, g or t
accgtccacttcccccgaactcgctccaaccgctcaacctccccgctccacttacaatacgaaaccgaaaaacaaaacgaacgaaacgtaataataaccccgacccaacgccatacaaataaactccgccgaaaacgcgcttcacactcctcctccccaaacccccaataaaaaaacgaacgaaaccttacgacccaaacgctttcctaaaattccccaatacatcgctacgaaaacctcatcctaaaccccttaccaaccgcccccgaaacctcgactcctacctaaaaaacgttacaataactccacgaaaaaaaaaaaaaccgactaaaccgaactaaaaattctacgactcgatttccaaaaaaaaattaaaaaaaaaaaacgaacaacccgaacgaacgcgaatctccccctaaaccaaccgaacaacaacaaccgaaccccattaacccgcgactccctacgcctccaacatccacccccgaactaaaaacgcaaaacaaacaaatctccgaaactaaacacaaaaacacattattcgctcctacgactcttacctccgtctacgaacgcgccccgaaaaaaaaccgtctaacgtaaaaaccgcgcgaaaacaaacgcgaaaaacaacgactaccccgaccgaaaaacgcgaaaccgaccgcgaacgaatcctcgaccgccgaatccgcgcgaaaaacaacgccgcaactccccgaccgaacacnnaaccgcaactcgacgcgtcctcctacnttcgccgccgccgcctccaaccgaacaaccaacgccgaacgactcctaaaattaaatcaacattttcccgcaatttcccacacgccgctcttcgaaaaaaatctttcacacacacgcacacacccccaaaccgcacgctcccttaaaaaaaaaaaatcgaaaatcaaaacgtaaaaaataataaaaacaaaaacctaacaaaaatacg

SEQ ID NO: 35025 - DNA, 674 bp, Artificial Sequence
  chemically treated genomic DNA (Homo sapiens) CpG-island No: 35025
ggcgggggggtggtgtgcgggtgggtcggggggtgttgggggttgttggtgtgggttcggcgttgggcggcgtgcgtgtggggggggggggggcgggcggggggttcgtcgttggtcgcgggcgttgggtggggtggtgttgtttggttgttgtggtggtttttttcgttttttttttgttgggggcgtggttggtgttcggggtcggtgggtgtcggggggtgttggtggggcggggggcgcggcgttgggggggttcgcggggtggcggtggtgggggtgttcgtgcgtttgtggtcgtttgcgtgtgttttggttgtgtggttaggtggggtggtgggggtcgggtgggcgtcggggggcgtcggggtcggcgcgggtcgcggggtcggttttgtcgttgtttggttgtcggttttttcggcggtcgcgcgttcgtgtttcggtttttgttttttcgcgtgtcgtttcggtcgcgggggtgcgggttgttggtgtcgcgggttcgtgtttggggttgtcgggcggtcggtcgtggtttttgacgggttgatgttggtggtttttgcgttcgttcgcgcgtaagttcgcgcggttcggtttcggtatttttggtgtttagggtcgtcgtcgtttgcgtcgggtcgggtcggggttgcgtttgcgggcgttcg

SEQ ID NO: 35026 - DNA, 674 bp, Artificial Sequence
  chemically treated genomic DNA (Homo sapiens) CpG-island No: 35026
cgaacgcccgcaaacgcaaccccgacccgacccgacgcaaacgacgacgaccctaaacaccaaaaataccgaaaccgaaccgcgcgaacttacgcgcgaacgaacgcaaaaaccaccaacatcaacccgtcaaaaaccacgaccgaccgcccgacaaccccaaacacgaacccgcgacaccaacaacccgcacccccgcgaccgaaacgacacgcgaaaaaacaaaaaccgaaacacgaacgcgcgaccgccgaaaaaaccgacaaccaaacaacgacaaaaccgaccccgcgacccgcgccgaccccgacgccccccgacgcccacccgacccccaccaccccacctaaccacacaaccaaaacacacgcaaacgaccacaaacgcacgaacacccccaccaccgccaccccgcgaacccccccaacgccgcgccccccgccccaccaacaccccccgacacccaccgaccccgaacaccaaccacgcccccaacaaaaaaaaaacgaaaaaaaccaccacaacaaccaaacaacaccaccccacccaacgcccgcgaccaacgacgaaccccccgcccgccccccccccccccacacgcacgccgcccaacgccgaacccacaccaacaacccccaacaccccccgacccacccgcacaccacccccccgcc

SEQ ID NO: 35027 - DNA, 674 bp, Artificial Sequence
  chemically treated genomic DNA (Homo sapiens) CpG-island No: 35027
cggacgttcgtaagcgtagtttcgattcggttcggcgtaggcgacggcgattttgggtattagggatgtcggaatcggatcgcgcggatttgcgcgcgaacgagcgtaaagattattaatattagttcgttaagaattacgatcggtcgttcggtaattttagatacgagttcgcggtattaataattcgtattttcgcggtcggagcggtacgcgggggggtaagagtcggagtacgaacgcgcggtcgtcggggggatcgatagttagatagcgataaaatcggtttcgcggttcgcgtcggtttcgacgtttttcggcgtttattcgatttttattattttatttaattatataattaaaatatacgtagacggttataaacgtacgaatatttttattatcgttatttcgcggatttttttagcgtcgcgtttttcgttttattaatatttttcggtatttatcggtttcggatattaattacgtttttaataaaaaaaaaacgaggaaggttattataataattaaatagtattattttatttagcgttcgcgattaacggcgggtttttcgttcgttttttttttttttatacgtacgtcgtttagcgtcgaatttatattaataatttttaatatttttcgatttattcgtatattattttttcgtt

SEQ ID NO: 35028 - DNA, 674 bp, Artificial Sequence
  chemically treated genomic DNA (Homo sapiens) CpG-island No: 35028
aacgaaaaaataatatacgaataaatcgaaaaatattaaaaattattaatataaattcgacgctaaacgacgtacgtataaaaaaaaaaaaaacgaacgaaaaacccgccgttaatcgcgaacgctaaataaaataatactatttaattattataataaccttcctcgttttttttttattaaaaacgtaattaatatccgaaaccgataaataccgaaaaatattaataaaacgaaaaacgcgacgctaaaaaaatccgcgaaataacgataataaaaatattcgtacgtttataaccgtctacgtatattttaattatataattaaataaaataataaaaatcgaataaacgccgaaaaacgtcgaaaccgacgcgaaccgcgaaaccgattttatcgctatctaactatcgatccccccgacgaccgcgcgttcgtactccgactcttacccccccgcgtaccgctccgaccgcgaaaatacgaattattaataccgcgaactcgtatctaaaattaccgaacgaccgatcgtaattcttaacgaactaatattaataatctttacgctcgttcgcgcgcaaatccgcgcgatccgattccgacatccctaatacccaaaatcgccgtcgcctacgccgaaccgaatcgaaactacgcttacgaacgtccg

SEQ ID NO: 35029 - DNA, 576 bp, Artificial Sequence
  chemically treated genomic DNA (Homo sapiens) CpG-island No: 35029
tgttaatacgtgtatatttcgtttagattttttattttttttcgcgttttcgcgatagttgtttagtaattttagttttttagatttaattacggcgtcgtcgttcgtcgagagggttgtttatttcggggattcgtttagtttggtttagtaaaatgtattttagtagttttaatttgtatcggagaaaacgtaggttgcgcggcggtttagagcggttaagtggaatttcgtttcgatttttttgattgggtaatgcgtataagaaaattaagaggattggtcggttgtagagaggcggttcgtaacgcgacgcgaaagaagtggggtatagcggttcggggaatttttgttagttttcgattggacgaaagtagaacgtttgttttttcgtagatttagcgtacgtataacgtttatattattacgtcgtacgttgcgttagcggaagtttaatggttttattggtgggatgcgtggttaataaagggtaagaataaggcggatttcgtttttttcgtggttgattggatgtattcgttggtattgatttacgtgagttttagtatttagacg

SEQ ID NO: 35030 - DNA, 576 bp, Artificial Sequence
  chemically treated genomic DNA (Homo sapiens) CpG-island No: 35030
cgtctaaatactaaaactcacgtaaatcaataccaacgaatacatccaatcaaccacgaaaaaaacgaaatccgccttattcttaccctttattaaccacgcatcccaccaataaaaccattaaacttccgctaacgcaacgtacgacgtaataatataaacgttatacgtacgctaaatctacgaaaaaacaaacgttctactttcgtccaatcgaaaactaacaaaaattccccgaaccgctataccccacttctttcgcgtcgcgttacgaaccgcctctctacaaccgaccaatcctcttaattttcttatacgcattacccaatcaaaaaaatcgaaacgaaattccacttaaccgctctaaaccgccgcgcaacctacgttttctccgatacaaattaaaactactaaaatacattttactaaaccaaactaaacgaatccccgaaataaacaaccctctcgacgaacgacgacgccgtaattaaatctaaaaaactaaaattactaaacaactatcgcgaaaacgcgaaaaaaaataaaaaatctaaacgaaatatacacgtattaaca

SEQ ID NO: 35031 - DNA, 576 bp, Artificial Sequence
  chemically treated genomic DNA (Homo sapiens) CpG-island No: 35031
cgtttaaatgttgaaatttacgtaaattagtattagcggatgtatttagttagttacgaggaaggcggaattcgttttatttttgttttttattggttacgtattttattaatggggttattaaattttcgttaacgtagcgtacggcgtggtggtgtgagcgttgtacgtacgttgggtttacgaaggggtaggcgttttgttttcgtttaatcggaagttagtaagaatttttcgggtcgttatgttttatttttttcgcgtcgcgttacgggtcgtttttttgtagtcgattaatttttttgatttttttgtgcgtattatttaattagagaggtcgaggcggggttttatttgatcgttttaagtcgtcgcgtagtttgcgtttttttcggtataggttgaggttattaaggtatattttgttgggttaggttgggcgggttttcgggatgggtagttttttcgacgagcggcgacgtcgtggttgagtttagaaagttagagttgttggatagttatcgcgggagcgcggagggaagtgggaggtttggacggagtgtgtacgtgttggta

SEQ ID NO: 35032 - DNA, 576 bp, Artificial Sequence
  chemically treated genomic DNA (Homo sapiens) CpG-island No: 35032
taccaacacgtacacactccgtccaaacctcccacttccctccgcgctcccgcgataactatccaacaactctaactttctaaactcaaccacgacgtcgccgctcgtcgaaaaaactacccatcccgaaaacccgcccaacctaacccaacaaaatataccttaataacctcaacctataccgaaaaaaacgcaaactacgcgacgacttaaaacgatcaaataaaaccccgcctcgacctctctaattaaataatacgcacaaaaaaatcaaaaaaattaatcgactacaaaaaaacgacccgtaacgcgacgcgaaaaaaataaaacataacgacccgaaaaattcttactaacttccgattaaacgaaaacaaaacgcctaccccttcgtaaacccaacgtacgtacaacgctcacaccaccacgccgtacgctacgttaacgaaaatttaataaccccattaataaaatacgtaaccaataaaaaacaaaaataaaacgaattccgccttcctcgtaactaactaaatacatccgctaatactaatttacgtaaatttcaacatttaaacg

SEQ ID NO: 35033 - DNA, 788 bp, Artificial Sequence
  chemically treated genomic DNA (Homo sapiens) CpG-island No: 35033
agggcggtcggcggcgtacgttgtttattttgaatttcgcggaaagttggggcgtgtattcgcgagtttagagcgcgcgtattagtcgttagttgttcggtgatttcggcgcggttcggagtcgtcggtagcgttttagcgtaggaattcggttagtaggtcggtgttgttgagatattgtattatcgcgtttatgaaataggtgttgtcgtggttttttaagttttgagcgttcggcgtcgcgttttatcgtcggcggggagttggagttggggttggggttcgggcgggcgttttttttcggggttttcgggggtcgttggaattgggttcggggcgtaggcgaagttttttttatcgtcgttattatagtgtttcggttggggtcggggcggtgagttttcggggcgtgagcgttgtttagcgttagtaggaagcggttgaataggcggcgtagggagcggcggcgcggggtcggggtcgagcggttttttttttgtcgcgttttcggggtttaggtttatggttgtcggcgtagttttaggcgcggagtttcgggcgcgaggcggacgagcgtagtaggttttatagtttttttaaggtttttggtgtcggttatttgcgggttaggtgtgcggggacggggcggagcggataagggcgtgagtcgttcgcgcgggaattcggcggtacgattagttttttttaggtagcgtcgggttatttttatttttgtttggtgtcgttttcgttgcgttgattgggagttttcgtggtcggatttttta

SEQ ID NO: 35034 - DNA, 788 bp, Artificial Sequence
  chemically treated genomic DNA (Homo sapiens) CpG-island No: 35034
taaaaaatccgaccacgaaaactcccaatcaacgcaacgaaaacgacaccaaacaaaaataaaaataacccgacgctacctaaaaaaaactaatcgtaccgccgaattcccgcgcgaacgactcacgcccttatccgctccgccccgtccccgcacacctaacccgcaaataaccgacaccaaaaaccttaaaaaaactataaaacctactacgctcgtccgcctcgcgcccgaaactccgcgcctaaaactacgccgacaaccataaacctaaaccccgaaaacgcgacaaaaaaaaaaccgctcgaccccgaccccgcgccgccgctccctacgccgcctattcaaccgcttcctactaacgctaaacaacgctcacgccccgaaaactcaccgccccgaccccaaccgaaacactataataacgacgataaaaaaaacttcgcctacgccccgaacccaattccaacgacccccgaaaaccccgaaaaaaaacgcccgcccgaaccccaaccccaactccaactccccgccgacgataaaacgcgacgccgaacgctcaaaacttaaaaaaccacgacaacacctatttcataaacgcgataatacaatatctcaacaacaccgacctactaaccgaattcctacgctaaaacgctaccgacgactccgaaccgcgccgaaatcaccgaacaactaacgactaatacgcgcgctctaaactcgcgaatacacgccccaactttccgcgaaattcaaaataaacaacgtacgccgccgaccgccct

SEQ ID NO: 35035 - DNA, 788 bp, Artificial Sequence
  chemically treated genomic DNA (Homo sapiens) CpG-island No: 35035
tggggaattcgattacgaagatttttagttagcgtagcgggggcggtattaggtaggggtaggggtggttcggcgttgtttggagggggttggtcgtgtcgtcggattttcgcgcgggcggtttacgtttttgttcgtttcgtttcgttttcgtatatttggttcgtaggtagtcggtattaggagttttagagaagttgtagggtttgttgcgttcgttcgtttcgcgttcggggtttcgcgtttggagttgcgtcggtagttatggatttgggtttcggggacgcggtaggagggggatcgttcggtttcggtttcgcgtcgtcgttttttgcgtcgtttgtttagtcgttttttgttggcgttgggtagcgtttacgtttcggggatttatcgtttcggttttagtcgggatattgtgatggcgacggtgaggggggtttcgtttgcgtttcgggtttagttttagcggttttcgggagtttcggggaggaacgttcgttcggattttagttttagttttagtttttcgtcggcgatggggcgcggcgtcgggcgtttagggtttgaagaattacggtaatatttgttttatgaacgcggtggtgtagtgttttagtaatatcgatttgttggtcgagtttttgcgttggggcgttatcggcggtttcgggtcgcgtcgaggttatcgagtagttggcggttggtgcgcgcgttttggattcgcgaatatacgttttaatttttcgcggagtttaaggtaggtagcgtgcgtcgtcgatcgtttt

SEQ ID NO: 35036 - DNA, 788 bp, Artificial Sequence
  chemically treated genomic DNA (Homo sapiens) CpG-island No: 35036
aaaacgatcgacgacgcacgctacctaccttaaactccgcgaaaaattaaaacgtatattcgcgaatccaaaacgcgcgcaccaaccgccaactactcgataacctcgacgcgacccgaaaccgccgataacgccccaacgcaaaaactcgaccaacaaatcgatattactaaaacactacaccaccgcgttcataaaacaaatattaccgtaattcttcaaaccctaaacgcccgacgccgcgccccatcgccgacgaaaaactaaaactaaaactaaaatccgaacgaacgttcctccccgaaactcccgaaaaccgctaaaactaaacccgaaacgcaaacgaaacccccctcaccgtcgccatcacaatatcccgactaaaaccgaaacgataaatccccgaaacgtaaacgctacccaacgccaacaaaaaacgactaaacaaacgacgcaaaaaacgacgacgcgaaaccgaaaccgaacgatccccctcctaccgcgtccccgaaacccaaatccataactaccgacgcaactccaaacgcgaaaccccgaacgcgaaacgaacgaacgcaacaaaccctacaacttctctaaaactcctaataccgactacctacgaaccaaatatacgaaaacgaaacgaaacgaacaaaaacgtaaaccgcccgcgcgaaaatccgacgacacgaccaaccccctccaaacaacgccgaaccacccctacccctacctaataccgcccccgctacgctaactaaaaatcttcgtaatcgaattcccca

SEQ ID NO: 35037 - DNA, 657 bp, Artificial Sequence
  chemically treated genomic DNA (Homo sapiens) CpG-island No: 35037
gttgttcgcgtttttttcgcgcggttgttcgtattttaattttttgaggttacgggtcgtcgtcgttttttcggattcgttcgttcggtttagggggagggacgtttgggttcggtcgtttcgttgtttcggtcgcgcgtttcgcgtcggttcgacggtttgttcgtttttttgttatttttcgtttttacggggtttttttgtgcggcgtttttcgtcggtcggttttatttttaggtttcgtttttcgtcgtcgttatcgtcggattttgtttaggggaatggtttgcgagtcgggtttttggagataggaagtgaggcgtgcgagttttatgagcgcgtcgcggttcgggttggcgtgcgggtgcggttgcggcggtcgcgcggcggggtttcgggaggcgggtcgttgagcggggcgcgcggtttcgaggatgcgggagcgggagcgggagtaggtgagggcgcggttttcggtcggcgggaggggcgggcggttggttcgagcggtggggtgtgtttattcgttcggatttcggagcgcgttcgcggtttcggaatttcggagaatggggcgcggcggttagattcgtagcgggagcgtaataaagagaaaagttttgttttttaggttcgtttttatatatttgagtaatt

SEQ ID NO: 35038 - DNA, 657 bp, Artificial Sequence
  chemically treated genomic DNA (Homo sapiens) CpG-island No: 35038
aattactcaaatatataaaaacgaacctaaaaaacaaaacttttctctttattacgctcccgctacgaatctaaccgccgcgccccattctccgaaattccgaaaccgcgaacgcgctccgaaatccgaacgaataaacacaccccaccgctcgaaccaaccgcccgcccctcccgccgaccgaaaaccgcgccctcacctactcccgctcccgctcccgcatcctcgaaaccgcgcgccccgctcaacgacccgcctcccgaaaccccgccgcgcgaccgccgcaaccgcacccgcacgccaacccgaaccgcgacgcgctcataaaactcgcacgcctcacttcctatctccaaaaacccgactcgcaaaccattcccctaaacaaaatccgacgataacgacgacgaaaaacgaaacctaaaaataaaaccgaccgacgaaaaacgccgcacaaaaaaaccccgtaaaaacgaaaaataacaaaaaaacgaacaaaccgtcgaaccgacgcgaaacgcgcgaccgaaacaacgaaacgaccgaacccaaacgtccctccccctaaaccgaacgaacgaatccgaaaaaacgacgacgacccgtaacctcaaaaaattaaaatacgaacaaccgcgcgaaaaaaacgcgaacaac

SEQ ID NO: 35039 - DNA, 657 bp, Artificial Sequence
  chemically treated genomic DNA (Homo sapiens) CpG-island No: 35039
aattatttaagtatatgagagcgaatttgaaaaataagatttttttttttgttacgttttcgttacgggtttggtcgtcgcgttttatttttcgggatttcggggtcgcgggcgcgtttcggggttcgggcgagtggatatattttatcgttcgggttagtcgttcgtttttttcgtcggtcggggatcgcgtttttatttgttttcgttttcgttttcgtattttcggggtcgcgcgtttcgtttagcgattcgtttttcggggtttcgtcgcgcggtcgtcgtagtcgtattcgtacgttagttcgggtcgcggcgcgtttatggggttcgtacgttttattttttgtttttaaaaattcggttcgtagattatttttttgggtagagttcggcggtggcgacggcgaggggcgaggtttggaggtgggatcggtcggcgaggagcgtcgtataaagaagtttcgtgggggcggggggtggtaggaggacggatagatcgtcggatcgacgcgggacgcgcggtcggagtagcggggcggtcgggtttaggcgtttttttttttgagtcgggcgggcggattcggggaggcggcggcggttcgtgattttagagagttggaatgcgggtagtcgcgcgggggaggcgcggatagt

SEQ ID NO: 35040 - DNA, 657 bp, Artificial Sequence
  chemically treated genomic DNA (Homo sapiens) CpG-island No: 35040
actatccgcgcctcccccgcgcgactacccgcattccaactctctaaaatcacgaaccgccgccgcctccccgaatccgcccgcccgactcaaaaaaaaaaacgcctaaacccgaccgccccgctactccgaccgcgcgtcccgcgtcgatccgacgatctatccgtcctcctaccaccccccgcccccacgaaacttctttatacgacgctcctcgccgaccgatcccacctccaaacctcgcccctcgccgtcgccaccgccgaactctacccaaaaaaataatctacgaaccgaatttttaaaaacaaaaaataaaacgtacgaaccccataaacgcgccgcgacccgaactaacgtacgaatacgactacgacgaccgcgcgacgaaaccccgaaaaacgaatcgctaaacgaaacgcgcgaccccgaaaatacgaaaacgaaaacgaaaacaaataaaaacgcgatccccgaccgacgaaaaaaacgaacgactaacccgaacgataaaatatatccactcgcccgaaccccgaaacgcgcccgcgaccccgaaatcccgaaaaataaaacgcgacgaccaaacccgtaacgaaaacgtaacaaaaaaaaaaatcttatttttcaaattcgctctcatatacttaaataatt

SEQ ID NO: 35041 - DNA, 1072 bp, Artificial Sequence
  chemically treated genomic DNA (Homo sapiens) CpG-island No: 35041
tttcgtcgatgtcgtttaattttagtattatcgggagtgacgttatgaggtttgattatttttcgttttatcggtatagcgtcgtgatattttcgttttatcgttttattttagattatgagattgtgatgaagtagtttaataggggtttggtgtatgcggaacggtagagttattcgttgcgaaattttaatatcggtagttcgtacgtttatagtaggttcgcggcgttggtttatagttagttcgagattcgcgagtacgtatagtttttttcgttagcggtcgtatattgttcgtttagtttgagttatagtttttatagttcgtttttttatttttattttgtcgagcggcggttcgtggtgggcgcggttagcgtgtcggagttgattaatgcgtagttgtaggcgtaggattattcgttttttaatattatgcggacgtaggtgtatcggttatttttattttattcgttttttaggttcgttaatagtacgttagatttgtttcgttatttttatattagtagtagtaatttcgattttattacgcggcgcgtgtattattcggtgtaaacgttttaggaggatagtttgttcgtggcgtattcgttgtaggaggttagcgagttttttatcgcgcgcgcgtaacgcgtagttgtataaacggaatagtatcgaggtggtcgggtttagttacggtttggagggtttgtcggtttaaggagcgtattttattcgcgtcggcggtagaggtggcgtcgcgagtcgtttcggtgggtttttagtttagcgtttttatcgagaggatatagcgagaagggtcggaggaggcggagggtttgaggtacggttataagaagtttttgtcggacgttattatgttaatttatagtagcgaggaggaggaggacgaggatttcgaggaggagagcggggttcgggcgttttttgtacgtgcgcgcgagtttcggttcggtttggtttaggatttatttggttgttttcgcgttttgttcgtcgggtttttgtatattttggagtttaaggtttacgttttagacgcggag

SEQ ID NO: 35042 - DNA, 1072 bp, Artificial Sequence
  chemically treated genomic DNA (Homo sapiens) CpG-island No: 35042
ctccgcgtctaaaacgtaaaccttaaactccaaaatatacaaaaacccgacgaacaaaacgcgaaaacaaccaaataaatcctaaaccaaaccgaaccgaaactcgcgcgcacgtacaaaaaacgcccgaaccccgctctcctcctcgaaatcctcgtcctcctcctcctcgctactataaattaacataataacgtccgacaaaaacttcttataaccgtacctcaaaccctccgcctcctccgacccttctcgctatatcctctcgataaaaacgctaaactaaaaacccaccgaaacgactcgcgacgccacctctaccgccgacgcgaataaaatacgctccttaaaccgacaaaccctccaaaccgtaactaaacccgaccacctcgatactattccgtttatacaactacgcgttacgcgcgcgcgataaaaaactcgctaacctcctacaacgaatacgccacgaacaaactatcctcctaaaacgtttacaccgaataatacacgcgccgcgtaataaaatcgaaattactactactaatataaaaataacgaaacaaatctaacgtactattaacgaacctaaaaaacgaataaaataaaaataaccgatacacctacgtccgcataatattaaaaaacgaataatcctacgcctacaactacgcattaatcaactccgacacgctaaccgcgcccaccacgaaccgccgctcgacaaaataaaaataaaaaaacgaactataaaaactataactcaaactaaacgaacaatatacgaccgctaacgaaaaaaactatacgtactcgcgaatctcgaactaactataaaccaacgccgcgaacctactataaacgtacgaactaccgatattaaaatttcgcaacgaataactctaccgttccgcatacaccaaacccctattaaactacttcatcacaatctcataatctaaaataaaacgataaaacgaaaatatcacgacgctataccgataaaacgaaaaataatcaaacctcataacgtcactcccgataatactaaaattaaacgacatcgacgaaa

SEQ ID NO: 35043 - DNA, 1072 bp, Artificial Sequence
  chemically treated genomic DNA (Homo sapiens) CpG-island No: 35043
tttcgcgtttgggacgtgggttttgggttttaggatgtgtaggggttcggcgagtaggacgcgagggtagttaggtgggttttgggttaggtcgggtcgaggttcgcgcgtacgtgtaggaggcgttcgggtttcgttttttttttcgaagttttcgtttttttttttttcgttgttgtggattagtatggtggcgttcgatagggattttttatggtcgtattttaagtttttcgtttttttcggtttttttcgttgtgttttttcggtgaaaacgttgggttgggagtttatcgagacggttcgcggcgttatttttgtcgtcgacgcggatagggtgcgttttttgagtcggtaggttttttaggtcgtggttgagttcggttatttcgatgttgtttcgtttgtgtagttgcgcgttgcgcgcgcgcggtgaggggttcgttgattttttgtagcgagtgcgttacgggtaggttgtttttttggaacgtttgtatcgagtggtgtacgcgtcgcgtgatgaggtcggggttgttgttgttgatgtaaaggtggcgggataggtttggcgtgttgttggcgggtttggggggcgggtagggtgggggtggtcggtatatttgcgttcgtatgatgttgggagacgggtagttttgcgtttgtagttgcgtattggttagtttcggtacgttgatcgcgtttattacgggtcgtcgttcggtagggtaggggtagggagacgggttgtggaagttgtagtttaggttgaacgggtagtgtgcggtcgttggcgaggggagttgtgcgtgttcgcggatttcgggttggttgtagattagcgtcgcgggtttgttgtaggcgtacgagttgtcgatgttgaggtttcgtagcgagtggttttgtcgtttcgtatgtattaggtttttgttgagttgttttattatagttttatagtttggggtggggcggtaggacgggggtattacggcgttgtgtcgatgggacgggaggtagttaggttttatgacgttattttcggtgatgttagggttggacgatatcggcgagg

SEQ ID NO: 35044 - DNA, 1072 bp, Artificial Sequence
  chemically treated genomic DNA (Homo sapiens) CpG-island No: 35044
cctcgccgatatcgtccaaccctaacatcaccgaaaataacgtcataaaacctaactacctcccgtcccatcgacacaacgccgtaatacccccgtcctaccgccccaccccaaactataaaactataataaaacaactcaacaaaaacctaatacatacgaaacgacaaaaccactcgctacgaaacctcaacatcgacaactcgtacgcctacaacaaacccgcgacgctaatctacaaccaacccgaaatccgcgaacacgcacaactcccctcgccaacgaccgcacactacccgttcaacctaaactacaacttccacaacccgtctccctacccctaccctaccgaacgacgacccgtaataaacgcgatcaacgtaccgaaactaaccaatacgcaactacaaacgcaaaactacccgtctcccaacatcatacgaacgcaaatataccgaccacccccaccctacccgccccccaaacccgccaacaacacgccaaacctatcccgccacctttacatcaacaacaacaaccccgacctcatcacgcgacgcgtacaccactcgatacaaacgttccaaaaaaacaacctacccgtaacgcactcgctacaaaaaatcaacgaacccctcaccgcgcgcgcgcaacgcgcaactacacaaacgaaacaacatcgaaataaccgaactcaaccacgacctaaaaaacctaccgactcaaaaaacgcaccctatccgcgtcgacgacaaaaataacgccgcgaaccgtctcgataaactcccaacccaacgttttcaccgaaaaaacacaacgaaaaaaaccgaaaaaaacgaaaaacttaaaatacgaccataaaaaatccctatcgaacgccaccatactaatccacaacaacgaaaaaaaaaaaaacgaaaacttcgaaaaaaaaaacgaaacccgaacgcctcctacacgtacgcgcgaacctcgacccgacctaacccaaaacccacctaactaccctcgcgtcctactcgccgaacccctacacatcctaaaacccaaaacccacgtcccaaacgcgaaa

SEQ ID NO: 35045 - DNA, 714 bp, Artificial Sequence
  chemically treated genomic DNA (Homo sapiens) CpG-island No: 35045
ggtgtcgatttcgagggtattttcgcgttggatgcggttttagggcgtttgtatttggcgcggtttttggatttcgaagttggttcgtcgtggcgcgcgtttacggtacgcgttgaggggtcgggagcgcgggcgcgcggttgttgcgagtgtaggtgtaagtgtaggacgagaatgagtatgcgttcgtttttgcgcgcgattcgttgggcgcgttgttagagaattcggagttcggcgtagcgttgtatatttttcgcgcgtcggacgtcgacggtttcggttttaatagcgacgtgcgttatcgtttgttgcgttaggagtcgttcgtgtcgggtttcgtttggacgcgcgtatcggggcgttagtttcgcgcggtttggatcgagagattattttcgcgttgttgttgttggtggaagttatcgatcggttcgttaacgttagtcgtcgtcgtgtagcgcgcgttttagcgtatatacgttacggatgcgaatgagaacgcgtttgttttcgtttcgtcgtgtacgcgtgcgttttttagaggattagtcgtttgggttcgcggttggtacgtttttagttcgcgattcgtatttgggcgaggttgtacgcgtgttttatcggttggtatttggcggggacggttattttcggttgtatttaagtattggtgagagttagttttgggagtgagggcgaggaaggtgttga

SEQ ID NO: 35046 - DNA, 714 bp, Artificial Sequence
  chemically treated genomic DNA (Homo sapiens) CpG-island No: 35046
tcaacaccttcctcgccctcactcccaaaactaactctcaccaatacttaaatacaaccgaaaataaccgtccccgccaaataccaaccgataaaacacgcgtacaacctcgcccaaatacgaatcgcgaactaaaaacgtaccaaccgcgaacccaaacgactaatcctctaaaaaacgcacgcgtacacgacgaaacgaaaacaaacgcgttctcattcgcatccgtaacgtatatacgctaaaacgcgcgctacacgacgacgactaacgttaacgaaccgatcgataacttccaccaacaacaacaacgcgaaaataatctctcgatccaaaccgcgcgaaactaacgccccgatacgcgcgtccaaacgaaacccgacacgaacgactcctaacgcaacaaacgataacgcacgtcgctattaaaaccgaaaccgtcgacgtccgacgcgcgaaaaatatacaacgctacgccgaactccgaattctctaacaacgcgcccaacgaatcgcgcgcaaaaacgaacgcatactcattctcgtcctacacttacacctacactcgcaacaaccgcgcgcccgcgctcccgacccctcaacgcgtaccgtaaacgcgcgccacgacgaaccaacttcgaaatccaaaaaccgcgccaaatacaaacgccctaaaaccgcatccaacgcgaaaataccctcgaaatcgacacc

SEQ ID NO: 35047 - DNA, 714 bp, Artificial Sequence
  chemically treated genomic DNA (Homo sapiens) CpG-island No: 35047
ttagtatttttttcgtttttatttttagaattaatttttattagtgtttgagtgtagtcggaagtggtcgttttcgttagatgttagtcgataggatacgcgtgtagtttcgtttagatgcgggtcgcgggttaggagcgtgttagtcgcgggtttaggcggttggttttttgggaggcgtacgcgtgtacggcgaggcgaagataggcgcgtttttattcgtattcgtgacgtatatgcgttgaaacgcgcgttgtacgacggcggttggcgttggcgggtcggtcggtggtttttattagtagtagtagcgcgggagtggtttttcggtttaggtcgcgcggagttgacgtttcggtgcgcgcgtttaggcgaagttcggtacgggcggtttttggcgtagtaggcggtagcgtacgtcgttattggggtcggggtcgtcggcgttcgacgcgcggaaagtgtatagcgttgcgtcgggtttcgggttttttggtagcgcgtttagcgggtcgcgcgtaaaggcgggcgtatgtttattttcgttttgtatttgtatttgtattcgtagtagtcgcgcgttcgcgttttcggttttttagcgcgtatcgtaagcgcgcgttacggcgggttagtttcgaagtttaggggtcgcgttaggtataagcgttttgaggtcgtatttagcgcgaaggtgttttcgggatcggtatt

SEQ ID NO: 35048 - DNA, 714 bp, Artificial Sequence
  chemically treated genomic DNA (Homo sapiens) CpG-island No: 35048
aataccgatcccgaaaacaccttcgcgctaaatacgacctcaaaacgcttatacctaacgcgacccctaaacttcgaaactaacccgccgtaacgcgcgcttacgatacgcgctaaaaaaccgaaaacgcgaacgcgcgactactacgaatacaaatacaaatacaaaacgaaaataaacatacgcccgcctttacgcgcgacccgctaaacgcgctaccaaaaaacccgaaacccgacgcaacgctatacactttccgcgcgtcgaacgccgacgaccccgaccccaataacgacgtacgctaccgcctactacgccaaaaaccgcccgtaccgaacttcgcctaaacgcgcgcaccgaaacgtcaactccgcgcgacctaaaccgaaaaaccactcccgcgctactactactaataaaaaccaccgaccgacccgccaacgccaaccgccgtcgtacaacgcgcgtttcaacgcatatacgtcacgaatacgaataaaaacgcgcctatcttcgcctcgccgtacacgcgtacgcctcccaaaaaaccaaccgcctaaacccgcgactaacacgctcctaacccgcgacccgcatctaaacgaaactacacgcgtatcctatcgactaacatctaacgaaaacgaccacttccgactacactcaaacactaataaaaattaattctaaaaataaaaacgaaaaaaatactaa

SEQ ID NO: 35049 - DNA, 609 bp, Artificial Sequence
  chemically treated genomic DNA (Homo sapiens) CpG-island No: 35049
gttttcgcggcggagcgttttatcgttttaaatgttattggttgacgtagttttaaaaaaaattcgatggttcgtttattttatattagggggcgtttggtttttcggtcgttatagagcgttttggatgtttgaagttcgtttagttcgtcgtttttggaaaagtttaatatcgttttttcgtttttttcgagattgttaacgaggtaggttttgatgcgtatgcgtaaatacgtttattacgtttcgagttaaggcgtatgcgttttttgaaattgtcgttatcggttttattttttagtttttagtttcggtttttaaggggcgggtagaagttggaaatatgcggttgtcggtcgttgtagcgattttttatggtcgcgtatttcgtcgtatgggtttcggtttcgagtttcgtatttatttgttgcggaatttgtttatagggttggtgcggtacgaacgtatcgaggtattatgggcgcgtgtggacgaaatgaggggttacgcggagaaggtgaggagcgcggtttttttgtttattttgcgggtttggtttgagggggcggagtcggttgtaagtggaaagggatcgggattaatttggta

SEQ ID NO: 35050 - DNA, 609 bp, Artificial Sequence
  chemically treated genomic DNA (Homo sapiens) CpG-island No: 35050
taccaaattaatcccgatccctttccacttacaaccgactccgccccctcaaaccaaacccgcaaaataaacaaaaaaaccgcgctcctcaccttctccgcgtaacccctcatttcgtccacacgcgcccataatacctcgatacgttcgtaccgcaccaaccctataaacaaattccgcaacaaataaatacgaaactcgaaaccgaaacccatacgacgaaatacgcgaccataaaaaatcgctacaacgaccgacaaccgcatatttccaacttctacccgccccttaaaaaccgaaactaaaaactaaaaaataaaaccgataacgacaatttcaaaaaacgcatacgccttaactcgaaacgtaataaacgtatttacgcatacgcatcaaaacctacctcgttaacaatctcgaaaaaaacgaaaaaacgatattaaacttttccaaaaacgacgaactaaacgaacttcaaacatccaaaacgctctataacgaccgaaaaaccaaacgccccctaatataaaataaacgaaccatcgaattttttttaaaactacgtcaaccaataacatttaaaacgataaaacgctccgccgcgaaaac

SEQ ID NO: 35051 - DNA, 609 bp, Artificial Sequence
  chemically treated genomic DNA (Homo sapiens) CpG-island No: 35051
tattaggttggtttcggtttttttttatttgtagtcggtttcgtttttttagattagattcgtagagtggataagagggtcgcgttttttatttttttcgcgtagttttttatttcgtttatacgcgtttatggtgtttcgatgcgttcgtgtcgtattagttttgtgagtaagtttcgtaatagatggatgcgggattcgggatcgaggtttatacggcgaaatacgcggttatgggagatcgttgtagcgatcgatagtcgtatgtttttaatttttgttcgttttttggaggtcggaattggaaattggaaggtagagtcggtggcggtaattttagggaacgtatgcgttttagttcggagcgtggtgaacgtgtttgcgtatgcgtattagagtttgtttcgttggtaatttcgggaagggcggagaaacggtgttgagtttttttagaggcggcgagttgggcgggttttaggtatttagagcgttttgtggcggtcgaagaattaggcgttttttagtgtgggataagcgggttatcgggttttttttggggttgcgttagttagtggtatttagggcgatggggcgtttcgtcgcggagat

SEQ ID NO: 35052 - DNA, 609 bp, Artificial Sequence
  chemically treated genomic DNA (Homo sapiens) CpG-island No: 35052
atctccgcgacgaaacgccccatcgccctaaataccactaactaacgcaaccccaaaaaaaacccgataacccgcttatcccacactaaaaaacgcctaattcttcgaccgccacaaaacgctctaaatacctaaaacccgcccaactcgccgcctctaaaaaaactcaacaccgtttctccgcccttcccgaaattaccaacgaaacaaactctaatacgcatacgcaaacacgttcaccacgctccgaactaaaacgcatacgttccctaaaattaccgccaccgactctaccttccaatttccaattccgacctccaaaaaacgaacaaaaattaaaaacatacgactatcgatcgctacaacgatctcccataaccgcgtatttcgccgtataaacctcgatcccgaatcccgcatccatctattacgaaacttactcacaaaactaatacgacacgaacgcatcgaaacaccataaacgcgtataaacgaaataaaaaactacgcgaaaaaaataaaaaacgcgaccctcttatccactctacgaatctaatctaaaaaaacgaaaccgactacaaataaaaaaaaaccgaaaccaacctaata

SEQ ID NO: 35053 - DNA, 797 bp, Artificial Sequence
  chemically treated genomic DNA (Homo sapiens) CpG-island No: 35053
gacgagttcgggagtcgttggtcgttaattatcgcgcggtggagaggcgggcgttcggtttcggcgcgttgggggagttagttggcgttgttttttttatcgttttagacgtttatatcgatatagatagacgtatagacgggcgggtagatatcgatagttttttaatcgtttgcgttttagtttcggtttagggagtttttcgtattttttggggtgtcgtaaattgtagttcggtaggttcgcgtcgggagaagggagggcgcgtaggcggtcggaggaggggaggttttagcgcgttttcgttgcgatgtgaacggcggcggtttttatttggagtcgtatttggggcgtcgagtttcggggtcgcggaaagaatgcgcgtcgttcgtgcgtttcgtttgtcgcgtttggttattcgtagtcgtcgcgttcgtatttgattatggagtgcgtttttttgttcgcgtgtgttttttcggttgcgggttcgggttcgtcgaggggtttggcgggattggggcgcgtggttaaggtaggtgtcgtcgagcggagtttcgagagcgggtggtagggggcgttcgacgttagtttcgtcgcgttttttacgcgcgatgttatttttttttttgtaggcgttttagttgtgttgtttttgttgtgcgtcggtcgtcgcggttttagttagtgatagtagtagcggcgttagcggattaaatgatggttcgtatttgttttttatttttaagaagggtttttcgtagtattttgattttttttttttttaaagagagaaa

SEQ ID NO: 35054 - DNA, 797 bp, Artificial Sequence
  chemically treated genomic DNA (Homo sapiens) CpG-island No: 35054
tttctctctttaaaaaaaaaaaaaatcaaaatactacgaaaaacccttcttaaaaataaaaaacaaatacgaaccatcatttaatccgctaacgccgctactactatcactaactaaaaccgcgacgaccgacgcacaacaaaaacaacacaactaaaacgcctacaaaaaaaaaaataacatcgcgcgtaaaaaacgcgacgaaactaacgtcgaacgccccctaccacccgctctcgaaactccgctcgacgacacctaccttaaccacgcgccccaatcccgccaaacccctcgacgaacccgaacccgcaaccgaaaaaacacacgcgaacaaaaaaacgcactccataatcaaatacgaacgcgacgactacgaataaccaaacgcgacaaacgaaacgcacgaacgacgcgcattctttccgcgaccccgaaactcgacgccccaaatacgactccaaataaaaaccgccgccgttcacatcgcaacgaaaacgcgctaaaacctcccctcctccgaccgcctacgcgccctcccttctcccgacgcgaacctaccgaactacaatttacgacaccccaaaaaatacgaaaaactccctaaaccgaaactaaaacgcaaacgattaaaaaactatcgatatctacccgcccgtctatacgtctatctatatcgatataaacgtctaaaacgataaaaaaaacaacgccaactaactcccccaacgcgccgaaaccgaacgcccgcctctccaccgcgcgataattaacgaccaacgactcccgaactcgtc

SEQ ID NO: 35055 - DNA, 797 bp, Artificial Sequence
  chemically treated genomic DNA (Homo sapiens) CpG-island No: 35055
tttttttttttgggggaaggaagggttaaagtgttgcgaaaggttttttttggggatggggggtaaatacgaattattatttaattcgttggcgtcgttgttgttgttattggttaaggtcgcggcgatcgacgtatagtagaggtagtatagttggagcgtttgtaagagaaaaggtgatatcgcgcgtgaggggcgcggcggggttggcgtcgggcgttttttgttattcgttttcggagtttcgttcggcggtatttgttttggttacgcgttttagtttcgttaggtttttcggcgggttcgaattcgtagtcgggaaggtatacgcgagtaggagggcgtattttatggttaggtgcggacgcggcggttgcgggtggttagacgcggtaggcggagcgtacgggcggcgcgtatttttttcgcggtttcggagttcggcgttttaggtgcggttttaggtgagagtcgtcgtcgtttatatcgtagcgggggcgcgttgggattttttttttttcggtcgtttgcgcgtttttttttttttcggcgcgggtttgtcgagttgtagtttgcggtattttagagggtacggggggttttttgggtcgggattggagcgtaaacggttgggagattgtcggtgtttgttcgttcgtttgtgcgtttgtttgtgtcggtgtgagcgtttgaggcgatggggaagatagcgttagttggtttttttagcgcgtcggagtcgagcgttcgtttttttatcgcgcggtgattggcgattagcggttttcgggttcgtt

SEQ ID NO: 35056 - DNA, 797 bp, Artificial Sequence
  chemically treated genomic DNA (Homo sapiens) CpG-island No: 35056
aacgaacccgaaaaccgctaatcgccaatcaccgcgcgataaaaaaacgaacgctcgactccgacgcgctaaaaaaaccaactaacgctatcttccccatcgcctcaaacgctcacaccgacacaaacaaacgcacaaacgaacgaacaaacaccgacaatctcccaaccgtttacgctccaatcccgacccaaaaaaccccccgtaccctctaaaataccgcaaactacaactcgacaaacccgcgccgaaaaaaaaaaaaacgcgcaaacgaccgaaaaaaaaaaaatcccaacgcgcccccgctacgatataaacgacgacgactctcacctaaaaccgcacctaaaacgccgaactccgaaaccgcgaaaaaaatacgcgccgcccgtacgctccgcctaccgcgtctaaccacccgcaaccgccgcgtccgcacctaaccataaaatacgccctcctactcgcgtataccttcccgactacgaattcgaacccgccgaaaaacctaacgaaactaaaacgcgtaaccaaaacaaataccgccgaacgaaactccgaaaacgaataacaaaaaacgcccgacgccaaccccgccgcgcccctcacgcgcgatatcaccttttctcttacaaacgctccaactatactacctctactatacgtcgatcgccgcgaccttaaccaataacaacaacaacgacgccaacgaattaaataataattcgtatttaccccccatccccaaaaaaaacctttcgcaacactttaacccttccttcccccaaaaaaaaaaa

SEQ ID NO: 35057 - DNA, 523 bp, Artificial Sequence
  chemically treated genomic DNA (Homo sapiens) CpG-island No: 35057
cgtcgggttaggcgtagaggcgaacgggaggcggcgttgtatcgtgttcgttttttttcggttcggtttcggttttagttttagttttagttttagtttcggtttcggtttcggttcgcgggcgttgcgttttcgcgtataggaggcggcggcggtttttagttatcggttttcgtcggcgagcgtacgatgtattgtttgggcgtcgagtatttggtaagcgttcgtagtttcggttttcgggggaggagtttcggggaagggtcgagtttttcgtttttacgtattttttttgtcggacgttttcgtttttttcgcgtttcggggatttcgttttcgtttagtattttggggttatttggcggggaggaatttggattttgttttagtgttggggcggaggcgggggagacgcgggtcgcggggcgtaaatttggggtcgtttttaggtgtatttttaggtaagtatttggcggtagggggtttaatattcgtttcgcgtagagtaggtgttttaaaggtt

SEQ ID NO: 35058 - DNA, 523 bp, Artificial Sequence
  chemically treated genomic DNA (Homo sapiens) CpG-island No: 35058
aacctttaaaacacctactctacgcgaaacgaatattaaaccccctaccgccaaatacttacctaaaaatacacctaaaaacgaccccaaatttacgccccgcgacccgcgtctcccccgcctccgccccaacactaaaacaaaatccaaattcctccccgccaaataaccccaaaatactaaacgaaaacgaaatccccgaaacgcgaaaaaaacgaaaacgtccgacaaaaaaaatacgtaaaaacgaaaaactcgacccttccccgaaactcctcccccgaaaaccgaaactacgaacgcttaccaaatactcgacgcccaaacaatacatcgtacgctcgccgacgaaaaccgataactaaaaaccgccgccgcctcctatacgcgaaaacgcaacgcccgcgaaccgaaaccgaaaccgaaactaaaactaaaactaaaactaaaaccgaaaccgaaccgaaaaaaaacgaacacgatacaacgccgcctcccgttcgcctctacgcctaacccgacg

SEQ ID NO: 35059 - DNA, 523 bp, Artificial Sequence
  chemically treated genomic DNA (Homo sapiens) CpG-island No: 35059
agtttttgaaatatttgttttgcgcggagcggatgttaagttttttgtcgttaagtgtttatttggaggtgtatttgaggacgattttaagtttgcgtttcgcggttcgcgtttttttcgttttcgttttagtattggagtagggtttaggttttttttcgttaggtggttttaaggtattaagcgggggcgggattttcgaggcgcgggaaaggcggaagcgttcggtagggaaggtgcgtgaaggcgggggattcgattttttttcggggtttttttttcgagggtcgaggttgcgagcgtttattaggtattcggcgtttaggtagtgtatcgtgcgttcgtcggcgggggtcggtgattgggagtcgtcgtcgttttttgtacgcggagacgtagcgttcgcgagtcggggtcggggtcggggttggggttggggttggggttggagtcggggtcgggtcggggaggggcgggtacggtgtagcgtcgtttttcgttcgtttttgcgtttggttcggcg

SEQ ID NO: 35060 - DNA, 523 bp, Artificial Sequence
  chemically treated genomic DNA (Homo sapiens) CpG-island No: 35060
cgccgaaccaaacgcaaaaacgaacgaaaaacgacgctacaccgtacccgcccctccccgacccgaccccgactccaaccccaaccccaaccccaaccccgaccccgaccccgactcgcgaacgctacgtctccgcgtacaaaaaacgacgacgactcccaatcaccgacccccgccgacgaacgcacgatacactacctaaacgccgaatacctaataaacgctcgcaacctcgaccctcgaaaaaaaaaccccgaaaaaaaatcgaatcccccgccttcacgcaccttccctaccgaacgcttccgcctttcccgcgcctcgaaaatcccgcccccgcttaataccttaaaaccacctaacgaaaaaaaacctaaaccctactccaatactaaaacgaaaacgaaaaaaacgcgaaccgcgaaacgcaaacttaaaatcgtcctcaaatacacctccaaataaacacttaacgacaaaaaacttaacatccgctccgcgcaaaacaaatatttcaaaaact

SEQ ID NO: 35061 - DNA, 983 bp, Artificial Sequence
  chemically treated genomic DNA (Homo sapiens) CpG-island No: 35061
tcgggagggattgttttcgggtttcgcggttagggttgcgttttttttttttcgggttttacgcgttttcggcggacgcggggatttttttatagtggtttcgtagttggggtaagggggatattttcggcgtcgcggagtcgcgagcggagcgagcgttcggggcgtatttgagtttttagtatttttcgcggtcgcggtaaatagtatgtgcgggcgttgcgggtttcgggtcggtattcgggttcggggatcggggatcggggatcggggatcggggcgttttcgcgttggtcgtcgtcggtatttatcgttgtgtttgtcgtatttttagtgatgggatatggtcgcgttggcggtcggggtagggtaggaatcggtatcgatttggcggcggcggtttgggcgtttgtattgtgtgttcgcgggtcgcgtcggtattagtttttataggttttcgttaatttcgtgttcgggggcggttcgggggagggggttcgggtggatttaggcgataaggggaggtggtgacgggcggaggtgaatttttcgcgttcggggcggggcgggtcgggcgggcgagttttcgggggcggggaaaacgttttttcggttggcgttcggcggggtttcggggtttcggggtttcggggtttttttttcgtcgttcggtttttttcggtttacggtagggtttcggtgttttgggttggtagcgaagttcggagttttgggcgtgcggcggttgcggtggtttttgggttttttcgtttaattcgggtcgcggagtttttacgcgtattttatttttttttcggttgcggagtttggcggcggcggggattgttcgggattcggattttcggcgtttttcgttttttgtttttattgtgatttgttttttggtttcggagttttttcgttttattcgcgtcggggtttttagcgcgaagggtttagtttttggtgttttcggtttgggg

SEQ ID NO: 35062 - DNA, 983 bp, Artificial Sequence
  chemically treated genomic DNA (Homo sapiens) CpG-island No: 35062
ccccaaaccgaaaacaccaaaaactaaacccttcgcgctaaaaaccccgacgcgaataaaacgaaaaaactccgaaaccaaaaaacaaatcacaataaaaacaaaaaacgaaaaacgccgaaaatccgaatcccgaacaatccccgccgccgccaaactccgcaaccgaaaaaaaaataaaatacgcgtaaaaactccgcgacccgaattaaacgaaaaaacccaaaaaccaccgcaaccgccgcacgcccaaaactccgaacttcgctaccaacccaaaacaccgaaaccctaccgtaaaccgaaaaaaaccgaacgacgaaaaaaaaaccccgaaaccccgaaaccccgaaaccccgccgaacgccaaccgaaaaaacgttttccccgcccccgaaaactcgcccgcccgacccgccccgccccgaacgcgaaaaattcacctccgcccgtcaccacctccccttatcgcctaaatccacccgaaccccctcccccgaaccgcccccgaacacgaaattaacgaaaacctataaaaactaataccgacgcgacccgcgaacacacaatacaaacgcccaaaccgccgccgccaaatcgataccgattcctaccctaccccgaccgccaacgcgaccatatcccatcactaaaaatacgacaaacacaacgataaataccgacgacgaccaacgcgaaaacgccccgatccccgatccccgatccccgatccccgaacccgaataccgacccgaaacccgcaacgcccgcacatactatttaccgcgaccgcgaaaaatactaaaaactcaaatacgccccgaacgctcgctccgctcgcgactccgcgacgccgaaaatatcccccttaccccaactacgaaaccactataaaaaaatccccgcgtccgccgaaaacgcgtaaaacccgaaaaaaaaaaaacgcaaccctaaccgcgaaacccgaaaacaatccctcccga

SEQ ID NO: 35063 - DNA, 983 bp, Artificial Sequence
  chemically treated genomic DNA (Homo sapiens) CpG-island No: 35063
ttttaggtcggggatattagagattgagtttttcgcgttggagatttcggcgcgggtggggcgggagggtttcggggttaagagataggttataatggggataggggacgaaaggcgtcgggggttcgggtttcgagtagttttcgtcgtcgttagatttcgtagtcgggagggggatggggtgcgcgtagaggtttcgcggttcgggttggacggaggagtttaggagttatcgtagtcgtcgtacgtttagagtttcgagtttcgttgttagtttaggatatcggggttttgtcgtgggtcgaggggagtcgggcggcgggagaggagtttcggagtttcggagtttcggagtttcgtcgggcgttagtcgagagggcgtttttttcgttttcggagattcgttcgttcggttcgtttcgtttcgagcgcggggagtttattttcgttcgttattatttttttttgtcgtttaggtttattcgagttttttttttcgggtcgttttcgagtacgaagttggcgggagtttataaaagttggtgtcggcgcgattcgcggatatatagtgtaggcgtttaagtcgtcgtcgttagatcggtgtcgatttttgttttgtttcgatcgttagcgcgattatgttttattattgggggtacggtaaatataacggtgagtgtcggcgacggttagcgcgggggcgtttcgattttcgattttcgattttcgattttcgagttcggatgtcggttcggggttcgtagcgttcgtatatgttgtttatcgcggtcgcggggagtgttggaggtttaggtgcgtttcgggcgttcgtttcgttcgcggtttcgcggcgtcggggatgttttttttgttttagttgcgaggttattgtggaggaattttcgcgttcgtcggaggcgcgtagggttcgagggaggggaggcgtagttttggtcgcgggattcgaggatagtttttttcgg

SEQ ID NO: 35064 - DNA, 983 bp, Artificial Sequence
  chemically treated genomic DNA (Homo sapiens) CpG-island No: 35064
ccgaaaaaaactatcctcgaatcccgcgaccaaaactacgcctcccctccctcgaaccctacgcgcctccgacgaacgcgaaaattcctccacaataacctcgcaactaaaacaaaaaaaacatccccgacgccgcgaaaccgcgaacgaaacgaacgcccgaaacgcacctaaacctccaacactccccgcgaccgcgataaacaacatatacgaacgctacgaaccccgaaccgacatccgaactcgaaaatcgaaaatcgaaaatcgaaaatcgaaacgcccccgcgctaaccgtcgccgacactcaccgttatatttaccgtacccccaataataaaacataatcgcgctaacgatcgaaacaaaacaaaaatcgacaccgatctaacgacgacgacttaaacgcctacactatatatccgcgaatcgcgccgacaccaacttttataaactcccgccaacttcgtactcgaaaacgacccgaaaaaaaaaactcgaataaacctaaacgacaaaaaaaaataataacgaacgaaaataaactccccgcgctcgaaacgaaacgaaccgaacgaacgaatctccgaaaacgaaaaaaacgccctctcgactaacgcccgacgaaactccgaaactccgaaactccgaaactcctctcccgccgcccgactcccctcgacccacgacaaaaccccgatatcctaaactaacaacgaaactcgaaactctaaacgtacgacgactacgataactcctaaactcctccgtccaacccgaaccgcgaaacctctacgcgcaccccatccccctcccgactacgaaatctaacgacgacgaaaactactcgaaacccgaacccccgacgcctttcgtcccctatccccattataacctatctcttaaccccgaaaccctcccgccccacccgcgccgaaatctccaacgcgaaaaactcaatctctaatatccccgacctaaaa

SEQ ID NO: 35065 - DNA, 1204 bp, Artificial Sequence
  chemically treated genomic DNA (Homo sapiens) CpG-island No: 35065
ttgcgtcgtgtttgttggaagttttcggtagttgttgaaattttcgtttcggaggtcgtttcggtaaattttgcggatgattttattacggcggaaagacgaaaaggaggtttttaggtattcgggatcgttcgtgtttcgttttttttttcgatgaagtttgacgcggtaggtttttcggtagggttaatgggacggtttggtggggtattgtcggttttttttagttatagataagtttcgcgtttcgattttttagcgtttttagacgttggatgtcgaggtttggttttttatagtcgtcgacgttttatgagcgaagttagttagatgttagtatcgttttcggtttcgtttcgagttagttttttttatattttcgttcggggtacgttttcggttcgtttttattttcgtttcgaatacgtttttagattggtttcgtttcgttttcgttcgtaatttcgtttcgatcggaagaagtcgcggtatttagcgtttatagggtcgggaatgggggtgtcgtcgttgtttagttagttttgcgttcgttgaggttcggttatcgtttcgttgtcgtcgcggcgttttcgtttcgttttttgttcgtatcgttttcggagttagggtcgagttttcgttatgtcggttcggcggttgttgttgttgttgacgttgttgttgttcggtttcggggtgagtgatcggggagcgtggggtggaggatagttcgcgacggtcgggtcggggtcggggtagcgtcgcggcgtcggggttggagttcgagttgggagcgcgacggcggcggttagatgtttcgtgagtttagtcgtgggaggttcgggtcgggcgtaggaggcggtatcgggtcgggagagtttttttgacgggagtcgcggttttatcgaggcgtcggtcgttcgaagagttttttaagttagcgcggttgttacgggtagcggtttttcggatttcgcgggttcgggcgtaatttcgtggcgttttgtacggtatttgggggttttagaaggtttcggtttgaggaggtcgtttatttgcgggattttttttttcgcgggcgggcgtcggcgttgtttggcgggggtcgcggaggagtcgaaagggcgttgggatttaggggaagggtttgttttgcgtttcgaatttttgtttgaattttttaaaaattcgaaaattttgggga

SEQ ID NO: 35066 - DNA, 1204 bp, Artificial Sequence
  chemically treated genomic DNA (Homo sapiens) CpG-island No: 35066
tccccaaaattttcgaatttttaaaaaattcaaacaaaaattcgaaacgcaaaacaaacccttcccctaaatcccaacgccctttcgactcctccgcgacccccgccaaacaacgccgacgcccgcccgcgaaaaaaaaaatcccgcaaataaacgacctcctcaaaccgaaaccttctaaaacccccaaataccgtacaaaacgccacgaaattacgcccgaacccgcgaaatccgaaaaaccgctacccgtaacaaccgcgctaacttaaaaaactcttcgaacgaccgacgcctcgataaaaccgcgactcccgtcaaaaaaactctcccgacccgataccgcctcctacgcccgacccgaacctcccacgactaaactcacgaaacatctaaccgccgccgtcgcgctcccaactcgaactccaaccccgacgccgcgacgctaccccgaccccgacccgaccgtcgcgaactatcctccaccccacgctccccgatcactcaccccgaaaccgaacaacaacaacgtcaacaacaacaacaaccgccgaaccgacataacgaaaactcgaccctaactccgaaaacgatacgaacaaaaaacgaaacgaaaacgccgcgacgacaacgaaacgataaccgaacctcaacgaacgcaaaactaactaaacaacgacgacacccccattcccgaccctataaacgctaaataccgcgacttcttccgatcgaaacgaaattacgaacgaaaacgaaacgaaaccaatctaaaaacgtattcgaaacgaaaataaaaacgaaccgaaaacgtaccccgaacgaaaatataaaaaaaactaactcgaaacgaaaccgaaaacgatactaacatctaactaacttcgctcataaaacgtcgacgactataaaaaaccaaacctcgacatccaacgtctaaaaacgctaaaaaatcgaaacgcgaaacttatctataactaaaaaaaaccgacaataccccaccaaaccgtcccattaaccctaccgaaaaacctaccgcgtcaaacttcatcgaaaaaaaaaacgaaacacgaacgatcccgaatacctaaaaacctccttttcgtctttccgccgtaataaaatcatccgcaaaatttaccgaaacgacctccgaaacgaaaatttcaacaactaccgaaaacttccaacaaacacgacgcaa

SEQ ID NO: 35067 - DNA, 1204 bp, Artificial Sequence
  chemically treated genomic DNA (Homo sapiens) CpG-island No: 35067
tttttaaagttttcgaatttttaaaaagtttaaataaggattcgaagcgtaggatagattttttttttggattttaacgttttttcggttttttcgcggttttcgttaggtagcgtcggcgttcgttcgcgaggaggagggtttcgtaggtgggcggtttttttaggtcggggttttttgggatttttaagtgtcgtgtaggacgttacgaagttgcgttcgagttcgcggggttcggggagtcgttgttcgtgatagtcgcgttggtttgggaggtttttcgggcggtcgacgtttcggtggggtcgcgattttcgttagggaagttttttcggttcggtgtcgttttttacgttcggttcgagttttttacggttgggtttacggggtatttggtcgtcgtcgtcgcgtttttagttcggattttagtttcggcgtcgcgacgttgtttcggtttcgattcggtcgtcgcgagttgttttttattttacgtttttcggttatttatttcgaggtcgggtagtagtagcgttagtagtagtagtagtcgtcgggtcggtatggcgaggattcggttttggtttcgggggcggtacggatagaggacggggcgggggcgtcgcgacgatagcgaggcggtgatcgagttttagcggacgtagaattgattaggtagcggcggtatttttattttcggttttataagcgttgggtgtcgcggtttttttcggtcggggcggagttgcgggcggggacggggcggggttaatttaggggcgtgttcggggcggagatgggggcgggtcgagggcgtgtttcgggcggggatgtgggaggggttggttcggggcggggtcgaaggcggtgttggtatttggttggtttcgtttatgaggcgtcggcggttgtaaaggattaggtttcggtatttagcgtttgggggcgttgggggatcgaggcgcgaagtttgtttgtggttgggaaagatcggtaatgttttattaggtcgttttattaattttgtcgagggatttgtcgcgttagattttatcggggaaaagggcgggatacgggcggtttcgggtgtttagaagtttttttttcgttttttcgtcgtggtggaattattcgtaaggtttatcgaggcgattttcggagcgaaggttttagtagttatcggaggtttttagtaaatacggcgtag

SEQ ID NO: 35068 - DNA, 1204 bp, Artificial Sequence
  chemically treated genomic DNA (Homo sapiens) CpG-island No: 35068
ctacgccgtatttactaaaaacctccgataactactaaaaccttcgctccgaaaatcgcctcgataaaccttacgaataattccaccacgacgaaaaaacgaaaaaaaaacttctaaacacccgaaaccgcccgtatcccgcccttttccccgataaaatctaacgcgacaaatccctcgacaaaattaataaaacgacctaataaaacattaccgatctttcccaaccacaaacaaacttcgcgcctcgatcccccaacgcccccaaacgctaaataccgaaacctaatcctttacaaccgccgacgcctcataaacgaaaccaaccaaataccaacaccgccttcgaccccgccccgaaccaacccctcccacatccccgcccgaaacacgccctcgacccgcccccatctccgccccgaacacgcccctaaattaaccccgccccgtccccgcccgcaactccgccccgaccgaaaaaaaccgcgacacccaacgcttataaaaccgaaaataaaaataccgccgctacctaatcaattctacgtccgctaaaactcgatcaccgcctcgctatcgtcgcgacgcccccgccccgtcctctatccgtaccgcccccgaaaccaaaaccgaatcctcgccataccgacccgacgactactactactactaacgctactactacccgacctcgaaataaataaccgaaaaacgtaaaataaaaaacaactcgcgacgaccgaatcgaaaccgaaacaacgtcgcgacgccgaaactaaaatccgaactaaaaacgcgacgacgacgaccaaataccccgtaaacccaaccgtaaaaaactcgaaccgaacgtaaaaaacgacaccgaaccgaaaaaacttccctaacgaaaatcgcgaccccaccgaaacgtcgaccgcccgaaaaacctcccaaaccaacgcgactatcacgaacaacgactccccgaaccccgcgaactcgaacgcaacttcgtaacgtcctacacgacacttaaaaatcccaaaaaaccccgacctaaaaaaaccgcccacctacgaaaccctcctcctcgcgaacgaacgccgacgctacctaacgaaaaccgcgaaaaaaccgaaaaaacgttaaaatccaaaaaaaaaatctatcctacgcttcgaatccttatttaaactttttaaaaattcgaaaactttaaaaa

SEQ ID NO: 35069 - DNA, 674 bp, Artificial Sequence
  chemically treated genomic DNA (Homo sapiens) CpG-island No: 35069
atttgttattggttaatggtagtaaagttcgtttattagcgttggtttgtttttttaaaagaacgttatcgacgtttttttgttttttagcgtttgtaggtttcgggaggttaggttgtatttttggcgggtcgtttggttgggtgggtttcggaggtcgtggttcgggagtagggaggcgtaggggggtcggtttgttgtgatgatattttaattaaagtacgtgttagattgttgacgcgggtgatgcgaattggagtttgagtttgttcgagcggagttgggagggggttggcgggcgggcgcgcgtatattcgttgatttattattttcgtttttgtagtttttagtcgaggacgtcggatgttatcgtttttgttgttttgttattttattttcgttaataaagtggtttgaatttaattttggtgtcggtgtgtgtcgttggcgacgcgttgtttttgagttttcgtcgagttttttcgtggcgtcgggggttaatttgtagcgttagagtatgtgtttgcgtataattggggtcgtttggtttttcgcgggcggtttttttaatcgcgagcgataagaagtaatttgattgttcggttgttaggttgggtaattttttagttgttttgttacgataggttttaattcgtaatattaaggttggaatg

SEQ ID NO: 35070 - DNA, 674 bp, Artificial Sequence
  chemically treated genomic DNA (Homo sapiens) CpG-island No: 35070
cattccaaccttaatattacgaattaaaacctatcgtaacaaaacaactaaaaaattacccaacctaacaaccgaacaatcaaattacttcttatcgctcgcgattaaaaaaaccgcccgcgaaaaaccaaacgaccccaattatacgcaaacacatactctaacgctacaaattaacccccgacgccacgaaaaaactcgacgaaaactcaaaaacaacgcgtcgccaacgacacacaccgacaccaaaattaaattcaaaccactttattaacgaaaataaaataacaaaacaacaaaaacgataacatccgacgtcctcgactaaaaactacaaaaacgaaaataataaatcaacgaatatacgcgcgcccgcccgccaaccccctcccaactccgctcgaacaaactcaaactccaattcgcatcacccgcgtcaacaatctaacacgtactttaattaaaatatcatcacaacaaaccgacccccctacgcctccctactcccgaaccacgacctccgaaacccacccaaccaaacgacccgccaaaaatacaacctaacctcccgaaacctacaaacgctaaaaaacaaaaaaacgtcgataacgttcttttaaaaaaacaaaccaacgctaataaacgaactttactaccattaaccaataacaaat

SEQ ID NO: 35071 - DNA, 674 bp, Artificial Sequence
  chemically treated genomic DNA (Homo sapiens) CpG-island No: 35071
tattttagttttggtattacggattgaggtttgtcgtggtaaaatagttggaaaattgtttagtttagtagtcggatagttaggttattttttgtcgttcgcggttaaaaaggtcgttcgcgggaggttaggcggttttagttatgcgtaagtatatgttttagcgttgtagattgattttcggcgttacgaggaagttcggcgggggtttaaagatagcgcgtcgttaacgatatatatcgatattagggttgggtttaaattattttattgacgggaatggggtggtaaagtagtaaggacgatgatattcgacgttttcggttgggagttataagaacgagagtgatagattagcgggtgtgcgcgcgttcgttcgttagtttttttttagtttcgttcgggtaggtttagattttagttcgtattattcgcgttagtagtttaatacgtgttttaattggaatgttattatagtaggtcggtttttttacgtttttttgttttcgagttacgattttcggggtttatttagttagacgattcgttaggaatataatttgatttttcggaatttgtaggcgttgaaagataggggagcgtcgatggcgtttttttaaaggagtagattagcgttgatgggcgggttttattgttattaattaatagtaagt

SEQ ID NO: 35072 - DNA, 674 bp, Artificial Sequence
  chemically treated genomic DNA (Homo sapiens) CpG-island No: 35072
acttactattaattaataacaataaaacccgcccatcaacgctaatctactcctttaaaaaaacgccatcgacgctcccctatctttcaacgcctacaaattccgaaaaatcaaattatattcctaacgaatcgtctaactaaataaaccccgaaaatcgtaactcgaaaacaaaaaaacgtaaaaaaaccgacctactataataacattccaattaaaacacgtattaaactactaacgcgaataatacgaactaaaatctaaacctacccgaacgaaactaaaaaaaaactaacgaacgaacgcgcgcacacccgctaatctatcactctcgttcttataactcccaaccgaaaacgtcgaatatcatcgtccttactactttaccaccccattcccgtcaataaaataatttaaacccaaccctaatatcgatatatatcgttaacgacgcgctatctttaaacccccgccgaacttcctcgtaacgccgaaaatcaatctacaacgctaaaacatatacttacgcataactaaaaccgcctaacctcccgcgaacgacctttttaaccgcgaacgacaaaaaataacctaactatccgactactaaactaaacaattttccaactattttaccacgacaaacctcaatccgtaataccaaaactaaaata

SEQ ID NO: 35073 - DNA, 606 bp, Artificial Sequence
  chemically treated genomic DNA (Homo sapiens) CpG-island No: 35073
tttcgcgttagggaggggtcggagtcgtcgtcgaggtcgtcgagcgtagaaagtgcgcgaaagggacgcgttgcgagttttatacgtgacggcgtcgcgtcgaatcgagcgggatttggcggtagcggcggcgggcgtagcggggcggttcggagcggcgcgggcggtttggagtttcgggagcggcgcgcgcggtttcggtttagcggtttttttggtttcgcgttgtatatttttttttggcggcggcgttatttgtagtagcgttcgttcgaatatggcgatacggagtagtaggagggagtcgcgattttcgtttttatttattttggtcgtattgttgtcgttcggagttttttgcgaagtttggacgtagaggttgtacggcggtagcgcgtttttgttttaggatcggggttttttcgtggtgtagggcgattcgcgcgagttgcggttgtgggcgcgcggggatgttaggggggcgagtcgcgcggacgagaagtcgtttcggaggaaacggagcgttgttttgtagttcgagtttattaaggtgtacggataggtgagtagttttgtaattcgtttttttttagttttttttttttt

SEQ ID NO: 35074 - DNA, 606 bp, Artificial Sequence
  chemically treated genomic DNA (Homo sapiens) CpG-island No: 35074
aaaaaaaaaaaaactaaaaaaaaacgaattacaaaactactcacctatccgtacaccttaataaactcgaactacaaaacaacgctccgtttcctccgaaacgacttctcgtccgcgcgactcgcccccctaacatccccgcgcgcccacaaccgcaactcgcgcgaatcgccctacaccacgaaaaaaccccgatcctaaaacaaaaacgcgctaccgccgtacaacctctacgtccaaacttcgcaaaaaactccgaacgacaacaatacgaccaaaataaataaaaacgaaaatcgcgactccctcctactactccgtatcgccatattcgaacgaacgctactacaaataacgccgccgccaaaaaaaaatatacaacgcgaaaccaaaaaaaccgctaaaccgaaaccgcgcgcgccgctcccgaaactccaaaccgcccgcgccgctccgaaccgccccgctacgcccgccgccgctaccgccaaatcccgctcgattcgacgcgacgccgtcacgtataaaactcgcaacgcgtccctttcgcgcactttctacgctcgacgacctcgacgacgactccgacccctccctaacgcgaaa

SEQ ID NO: 35075 - DNA, 606 bp, Artificial Sequence
  chemically treated genomic DNA (Homo sapiens) CpG-island No: 35075
ggagaggaaaaaattggagggaggcgggttgtaaaattgtttatttgttcgtatattttgatgggttcgggttgtagggtagcgtttcgtttttttcggagcggtttttcgttcgcgcggttcgtttttttggtattttcgcgcgtttatagtcgtagttcgcgcgggtcgttttgtattacgaggaagtttcggttttggggtaagggcgcgttgtcgtcgtgtagtttttgcgtttagatttcgtagagagtttcgggcggtagtagtgcgattagggtgaataggaacgggagtcgcgatttttttttgttgtttcgtgtcgttatgttcgggcgaacgttattgtaggtggcgtcgtcgttaggagagaatgtgtagcgcgaggttaggagagtcgttgggtcgggatcgcgcgcgtcgttttcggggttttaggtcgttcgcgtcgtttcgggtcgtttcgttgcgttcgtcgtcgttgtcgttaggtttcgttcggttcggcgcggcgtcgttacgtgtgaggttcgtagcgcgtttttttcgcgtattttttgcgttcggcggtttcggcggcgatttcggtttttttttggcgcgggg

SEQ ID NO: 35076 - DNA, 606 bp, Artificial Sequence
  chemically treated genomic DNA (Homo sapiens) CpG-island No: 35076
ccccgcgccaaaaaaaaaccgaaatcgccgccgaaaccgccgaacgcaaaaaatacgcgaaaaaaacgcgctacgaacctcacacgtaacgacgccgcgccgaaccgaacgaaacctaacgacaacgacgacgaacgcaacgaaacgacccgaaacgacgcgaacgacctaaaaccccgaaaacgacgcgcgcgatcccgacccaacgactctcctaacctcgcgctacacattctctcctaacgacgacgccacctacaataacgttcgcccgaacataacgacacgaaacaacaaaaaaaaatcgcgactcccgttcctattcaccctaatcgcactactaccgcccgaaactctctacgaaatctaaacgcaaaaactacacgacgacaacgcgcccttaccccaaaaccgaaacttcctcgtaatacaaaacgacccgcgcgaactacgactataaacgcgcgaaaataccaaaaaaacgaaccgcgcgaacgaaaaaccgctccgaaaaaaacgaaacgctaccctacaacccgaacccatcaaaatatacgaacaaataaacaattttacaacccgcctccctccaattttttcctctcc

SEQ ID NO: 35077 - DNA, 542 bp, Artificial Sequence
  chemically treated genomic DNA (Homo sapiens) CpG-island No: 35077
gggcgggcgaggggagttcgattcgaattggttgtttttttttgattacgattaattcggagcgcgcgcgtttttttgtttgggaggatttttgatagttacgggcggtcgggcggagtcgcgcggatagaacgaggagttcgacgagaggatagtttcgtttttcgtagtttagtgttttttttcggggattgttttgttaggttatgttttcgtgggcggtcgttttagcgttgttattggcggcgttcgttttgttttttttgcgattttggaagcgcgttgtcggagcgcgaattttagttcgggattacgaggagtaggaggtggcgagcggaggtttcgcggattagtttagcgatcggcgcgaagcgtttttcggaggttgtagttttatttgtaagtcgtcggcgttggtttagtgtttgttgcgcgttttgcgacgttcggcggcgttggaatttagttttcgtttttggttgtcgggattttatttgtaaattttttgttattttattttgttagtcgggttcgggtttgag

SEQ ID NO: 35078 - DNA, 542 bp, Artificial Sequence
  chemically treated genomic DNA (Homo sapiens) CpG-island No: 35078
ctcaaacccgaacccgactaacaaaataaaataacaaaaaatttacaaataaaatcccgacaaccaaaaacgaaaactaaattccaacgccgccgaacgtcgcaaaacgcgcaacaaacactaaaccaacgccgacgacttacaaataaaactacaacctccgaaaaacgcttcgcgccgatcgctaaactaatccgcgaaacctccgctcgccacctcctactcctcgtaatcccgaactaaaattcgcgctccgacaacgcgcttccaaaatcgcaaaaaaaacaaaacgaacgccgccaataacaacgctaaaacgaccgcccacgaaaacataacctaacaaaacaatccccgaaaaaaaacactaaactacgaaaaacgaaactatcctctcgtcgaactcctcgttctatccgcgcgactccgcccgaccgcccgtaactatcaaaaatcctcccaaacaaaaaaacgcgcgcgctccgaattaatcgtaatcaaaaaaaaacaaccaattcgaatcgaactcccctcgcccgccc

SEQ ID NO: 35079 - DNA, 542 bp, Artificial Sequence
  chemically treated genomic DNA (Homo sapiens) CpG-island No: 35079
tttaggttcgggttcgattggtaggatgaagtggtagaaggtttgtaggtggggtttcgatagttaggagcgggggttgggttttagcgtcgtcgagcgtcgtagagcgcgtagtaggtattgggttagcgtcgacggtttgtaaatgaggttgtagttttcggggagcgtttcgcgtcggtcgttgaattgattcgcggggttttcgttcgttattttttgtttttcgtggtttcggattgaggttcgcgtttcgatagcgcgtttttagggtcgtaggaggagtaaggcgagcgtcgttagtagtagcgttagagcggtcgtttacggaggtatggtttggtaggatagttttcggagggaggtattgggttgcggggagcggagttgttttttcgtcgggtttttcgttttgttcgcgcggtttcgttcggtcgttcgtggttgttaagagtttttttaagtaggagggcgcgcgcgtttcggattggtcgtggttaggaggagatagttagttcgggtcgagtttttttcgttcgttt

SEQ ID NO: 35080 - DNA, 542 bp, Artificial Sequence
  chemically treated genomic DNA (Homo sapiens) CpG-island No: 35080
aaacgaacgaaaaaaactcgacccgaactaactatctcctcctaaccacgaccaatccgaaacgcgcgcgccctcctacttaaaaaaactcttaacaaccacgaacgaccgaacgaaaccgcgcgaacaaaacgaaaaacccgacgaaaaaacaactccgctccccgcaacccaatacctccctccgaaaactatcctaccaaaccatacctccgtaaacgaccgctctaacgctactactaacgacgctcgccttactcctcctacgaccctaaaaacgcgctatcgaaacgcgaacctcaatccgaaaccacgaaaaacaaaaaataacgaacgaaaaccccgcgaatcaattcaacgaccgacgcgaaacgctccccgaaaactacaacctcatttacaaaccgtcgacgctaacccaatacctactacgcgctctacgacgctcgacgacgctaaaacccaacccccgctcctaactatcgaaaccccacctacaaaccttctaccacttcatcctaccaatcgaacccgaacctaaa

SEQ ID NO: 35081 - DNA, 714 bp, Artificial Sequence
  chemically treated genomic DNA (Homo sapiens) CpG-island No: 35081
cgaatttttttcgtttttcgtaggttagcggaacgttacggttacggtcgtcgttcgggtttttttttttttttaagtttttttttaaggttcgtttttcgttcgcgtttttcgtcgtattcgggagcgggaaacgcggtcgtcgggcgcgcggggttacggtgtaggtcgtttttttcgtggtcgttttttttttttattttaatcgttttcgttttttattttagggattcgttcggggtcgcgcggtcgttatcgggttatataatttcggcgcggcgcggcgcggagggggaggggcggcgggcggcggtcgttcgtagtgcgggggggattcggaaaagggtcgtagagggtttcggggtagtcgggtcggcgtgtcgtgtggttttcggtattttttttttttcgttttttcgtcggtcggagtcggtgataggaattagtttttaatatggcggataggaagcggtttcgcgaggaggagagaatattttagtttcgtcggtttcgaggcgagcgggttaggggcgtcggtttgcggagaagttttcgcggatagataacggggttcggacgcgtaagacgggcgtttaggggtggaaatgattcgagggacgatagggttttttatatatttagacggtaaattttaaggttataggtgggttcggggcggcgggtgagcgaggacgtttttttaatttagttttt

SEQ ID NO: 35082 - DNA, 714 bp, Artificial Sequence
  chemically treated genomic DNA (Homo sapiens) CpG-island No: 35082
aaaaactaaattaaaaaaacgtcctcgctcacccgccgccccgaacccacctataaccttaaaatttaccgtctaaatatataaaaaaccctatcgtccctcgaatcatttccacccctaaacgcccgtcttacgcgtccgaaccccgttatctatccgcgaaaacttctccgcaaaccgacgcccctaacccgctcgcctcgaaaccgacgaaactaaaatattctctcctcctcgcgaaaccgcttcctatccgccatattaaaaactaattcctatcaccgactccgaccgacgaaaaaacgaaaaaaaaaaaataccgaaaaccacacgacacgccgacccgactaccccgaaaccctctacgacccttttccgaatcccccccgcactacgaacgaccgccgcccgccgcccctccccctccgcgccgcgccgcgccgaaattatataacccgataacgaccgcgcgaccccgaacgaatccctaaaataaaaaacgaaaacgattaaaataaaaaaaaaaaacgaccacgaaaaaaacgacctacaccgtaaccccgcgcgcccgacgaccgcgtttcccgctcccgaatacgacgaaaaacgcgaacgaaaaacgaaccttaaaaaaaaacttaaaaaaaaaaaaaaacccgaacgacgaccgtaaccgtaacgttccgctaacctacgaaaaacgaaaaaaattcg

SEQ ID NO: 35083 - DNA, 714 bp, Artificial Sequence
  chemically treated genomic DNA (Homo sapiens) CpG-island No: 35083
gagggttaagttgaggaagcgttttcgtttattcgtcgtttcgagtttatttgtggttttggggtttgtcgtttgggtgtgtgggggattttatcgtttttcgggttatttttatttttaaacgttcgttttgcgcgttcggatttcgttgtttgttcgcgagggttttttcgtaggtcggcgtttttggttcgttcgtttcggagtcggcgaggttggaatgttttttttttttcgcggggtcgttttttgttcgttatgttggaagttgatttttgttatcgatttcggtcggcggaggagcggagggggaagggtgtcgaaggttatacggtacgtcggttcggttgtttcgggattttttgcggttttttttcgggtttttttcgtattgcgggcggtcgtcgttcgtcgttttttttttttcgcgtcgcgtcgcgtcggggttgtgtaattcggtggcggtcgcgcggtttcgggcgggtttttggggtgaggggcgggggcggttggggtgggggagggaagcggttacgaggggagcggtttgtatcgtggtttcgcgcgttcgacggtcgcgtttttcgttttcgggtgcggcgggaggcgcgggcggggagcgggttttgaagaggagtttgaagggggaaggaggttcgggcggcggtcgtggtcgtagcgtttcgttggtttgcgaggggcgagggggattcg

SEQ ID NO: 35084 - DNA, 714 bp, Artificial Sequence
  chemically treated genomic DNA (Homo sapiens) CpG-island No: 35084
cgaatccccctcgcccctcgcaaaccaacgaaacgctacgaccacgaccgccgcccgaacctccttcccccttcaaactcctcttcaaaacccgctccccgcccgcgcctcccgccgcacccgaaaacgaaaaacgcgaccgtcgaacgcgcgaaaccacgatacaaaccgctcccctcgtaaccgcttccctcccccaccccaaccgcccccgcccctcaccccaaaaacccgcccgaaaccgcgcgaccgccaccgaattacacaaccccgacgcgacgcgacgcgaaaaaaaaaaaacgacgaacgacgaccgcccgcaatacgaaaaaaacccgaaaaaaaaccgcaaaaaatcccgaaacaaccgaaccgacgtaccgtataaccttcgacacccttccccctccgctcctccgccgaccgaaatcgataacaaaaatcaacttccaacataacgaacaaaaaacgaccccgcgaaaaaaaaaaaacattccaacctcgccgactccgaaacgaacgaaccaaaaacgccgacctacgaaaaaaccctcgcgaacaaacaacgaaatccgaacgcgcaaaacgaacgtttaaaaataaaaataacccgaaaaacgataaaatcccccacacacccaaacgacaaaccccaaaaccacaaataaactcgaaacgacgaataaacgaaaacgcttcctcaacttaaccctc

SEQ ID NO: 35085 - DNA, 597 bp, Artificial Sequence
  chemically treated genomic DNA (Homo sapiens) CpG-island No: 35085
ggggggcgcgagcgggggttcggggtcgcgagttggggttcggggagcgcgagcgggggttcggggggcgggggtcgcgggtcgcgaggggggcgggggtcgcgagggggcggggcgtgcgagggggcgggggcgtgcgagggggcgggggcgcgcgagggggcggggcgcgcgagggggcggggcgcgcgagggggcggggcgcgcgagggggcggggcgcgcgagggggcggggcgcgcgagggggcggggcgcgcgagggggcggggcgcgcgagggggcggggcgcgcgagggggcggggcgcgtcgggttcgtttttttcgcggcgtttagtggtagtagggagggtcggtgagatgttagagtaaggtagggttttgtatttggggatcgttgacgtttgggtttttttttcgcggttgttagcgttgcgtggttcgagatttgcggtcgggcggggattaaggttgtttttcggagggtttcggtcgcgtggtcgttttgttagagcggttgatgttaggtagtgttgggaggcgttgtttttcgggttcgttttttttttgttgttttaattttgtatttttttcgggt

SEQ ID NO: 35086 - DNA, 597 bp, Artificial Sequence
  chemically treated genomic DNA (Homo sapiens) CpG-island No: 35086
acccgaaaaaaatacaaaattaaaacaacaaaaaaaaaacgaacccgaaaaacaacgcctcccaacactacctaacatcaaccgctctaacaaaacgaccacgcgaccgaaaccctccgaaaaacaaccttaatccccgcccgaccgcaaatctcgaaccacgcaacgctaacaaccgcgaaaaaaaaacccaaacgtcaacgatccccaaatacaaaaccctaccttactctaacatctcaccgaccctccctactaccactaaacgccgcgaaaaaaacgaacccgacgcgccccgccccctcgcgcgccccgccccctcgcgcgccccgccccctcgcgcgccccgccccctcgcgcgccccgccccctcgcgcgccccgccccctcgcgcgccccgccccctcgcgcgccccgccccctcgcgcgccccgccccctcgcgcgcccccgccccctcgcacgcccccgccccctcgcacgccccgccccctcgcgacccccgcccccctcgcgacccgcgacccccgccccccgaacccccgctcgcgctccccgaaccccaactcgcgaccccgaacccccgctcgcgcccccc

SEQ ID NO: 35087 - DNA, 597 bp, Artificial Sequence
  chemically treated genomic DNA (Homo sapiens) CpG-island No: 35087
attcgggagagatgtagagttaggataataggagagaagcgaattcggagagtaacgttttttagtattgtttgatattaatcgttttggtagggcgattacgcggtcggggtttttcggaaagtagttttaattttcgttcgatcgtaggtttcgggttacgtagcgttaatagtcgcgggagggggatttaaacgttagcggtttttaaatataggattttattttgttttggtattttatcggttttttttgttgttattgagcgtcgcggagaggacgagttcggcgcgtttcgttttttcgcgcgtttcgttttttcgcgcgtttcgttttttcgcgcgtttcgttttttcgcgcgtttcgttttttcgcgcgtttcgttttttcgcgcgtttcgttttttcgcgcgtttcgttttttcgcgcgtttcgttttttcgcgcgttttcgttttttcgtacgttttcgttttttcgtacgtttcgttttttcgcggttttcgtttttttcgcggttcgcggttttcgtttttcggattttcgttcgcgtttttcggattttagttcgcggtttcggattttcgttcgcgtttttt

SEQ ID NO: 35088 - DNA, 597 bp, Artificial Sequence
  chemically treated genomic DNA (Homo sapiens) CpG-island No: 35088
aaaaaacgcgaacgaaaatccgaaaccgcgaactaaaatccgaaaaacgcgaacgaaaatccgaaaaacgaaaaccgcgaaccgcgaaaaaaacgaaaaccgcgaaaaaacgaaacgtacgaaaaaacgaaaacgtacgaaaaaacgaaaacgcgcgaaaaaacgaaacgcgcgaaaaaacgaaacgcgcgaaaaaacgaaacgcgcgaaaaaacgaaacgcgcgaaaaaacgaaacgcgcgaaaaaacgaaacgcgcgaaaaaacgaaacgcgcgaaaaaacgaaacgcgcgaaaaaacgaaacgcgccgaactcgtcctctccgcgacgctcaataacaacaaaaaaaaccgataaaataccaaaacaaaataaaatcctatatttaaaaaccgctaacgtttaaatccccctcccgcgactattaacgctacgtaacccgaaacctacgatcgaacgaaaattaaaactactttccgaaaaaccccgaccgcgtaatcgccctaccaaaacgattaatatcaaacaatactaaaaaacgttactctccgaattcgcttctctcctattatcctaactctacatctctcccgaat

SEQ ID NO: 35089 - DNA, 1063 bp, Artificial Sequence
  chemically treated genomic DNA (Homo sapiens) CpG-island No: 35089
tatgttttcgaatagtttttgtttatcgatcgtacgttttttgggtatgttcgggtagcggtgatttttagttatattttttattagttcggtttcgggtaggcgagcgcgttgtttatcggttattttcgttacgttttttttattttttttattttagttataataatataataatcgtagttatcgcgcggtacgtggaaaggttattttttagtgggttttgtagaaagtaattagatagcggaaggttacgagaaacgttggtgaagttaaatcgatttcgggagcgtagcggtttcggattttttttggaagtttttttcgcgttttcgcgcgtttatttggaggcgtcgcgtttttcgtttgttaagtcggttttcggtttttgttcgtgttttgggttttcggcgggtagcggcggagggaggttaggcgcggtatcgtttttcgtagttgtacgagttatttcgaggtcgcggggtgggcgggcgcgagttaggcgcgcggggttgtggggatttgtcggcgttattgacgttttcgcgcggtatatcgcgttcggttggttcgggaggggattcgatttattcgaagcgttttgttagttgttcggttcggtttcggtcgttgtcgtcgtcgttgaatttttttttttgcgcggtcgtcgcggattcggttttatttttcgtttcggtagtcgcggagtttttagggatttcgggggcggggagtagcggcggcggcggcggttcgggcgggcgggcgtaatagcggttaagtttggcgtttcgtcgtagggtaggttcggcgggggcggttaaggtcgggttggggtcgcggttggtcgcgtattttcgcgttatttacggtttttttgtagtgcgtttttgcgttcgtcggagcggcgttttggtcgaagtttgttattttcggaaggggtcgcgttcggatattaggggcggtttacgcgtgattggatattaagagtcggagaagtttagagattaggatattgtggcgtggttcgagttgtaggagagaggtgtttaatttttatggg

SEQ ID NO: 35090 - DNA, 1063 bp, Artificial Sequence
  chemically treated genomic DNA (Homo sapiens) CpG-island No: 35090
cccataaaaattaaacacctctctcctacaactcgaaccacgccacaatatcctaatctctaaacttctccgactcttaatatccaatcacgcgtaaaccgcccctaatatccgaacgcgaccccttccgaaaataacaaacttcgaccaaaacgccgctccgacgaacgcaaaaacgcactacaaaaaaaccgtaaataacgcgaaaatacgcgaccaaccgcgaccccaacccgaccttaaccgcccccgccgaacctaccctacgacgaaacgccaaacttaaccgctattacgcccgcccgcccgaaccgccgccgccgccgctactccccgcccccgaaatccctaaaaactccgcgactaccgaaacgaaaaataaaaccgaatccgcgacgaccgcgcaaaaaaaaaaattcaacgacgacgacaacgaccgaaaccgaaccgaacaactaacaaaacgcttcgaataaatcgaatcccctcccgaaccaaccgaacgcgatataccgcgcgaaaacgtcaataacgccgacaaatccccacaaccccgcgcgcctaactcgcgcccgcccaccccgcgacctcgaaataactcgtacaactacgaaaaacgataccgcgcctaacctccctccgccgctacccgccgaaaacccaaaacacgaacaaaaaccgaaaaccgacttaacaaacgaaaaacgcgacgcctccaaataaacgcgcgaaaacgcgaaaaaaacttccaaaaaaaatccgaaaccgctacgctcccgaaatcgatttaacttcaccaacgtttctcgtaaccttccgctatctaattactttctacaaaacccactaaaaaataacctttccacgtaccgcgcgataactacgattattatattattataactaaaataaaaaaaataaaaaaaacgtaacgaaaataaccgataaacaacgcgctcgcctacccgaaaccgaactaataaaaaatataactaaaaatcaccgctacccgaacatacccaaaaaacgtacgatcgataaacaaaaactattcgaaaacata

SEQ ID NO: 35091 - DNA, 1063 bp, Artificial Sequence
  chemically treated genomic DNA (Homo sapiens) CpG-island No: 35091
tttatggagattggatattttttttttgtaattcgggttacgttatagtgttttagtttttaaattttttcggtttttggtgtttagttacgcgtaaatcgtttttggtgttcgagcgcggtttttttcgagagtgataggtttcggttagggcgtcgtttcgacgggcgtagggacgtattgtagagaggtcgtgggtgacgcggaggtacgcggttaatcgcgattttagttcggttttggtcgttttcgtcggatttattttgcggcggggcgttaggtttggtcgttgttgcgttcgttcgttcgagtcgtcgtcgtcgtcgttgtttttcgttttcggggtttttggaggtttcgcggttgtcggagcgggaggtggagtcgagttcgcggcggtcgcgtaggagggaaagtttagcgacggcggtagcggtcggagtcgggtcgggtagttagtagggcgtttcgggtgagtcgggttttttttcgggttagtcgggcgcggtgtgtcgcgcgggggcgttagtggcgtcggtagatttttatagtttcgcgcgtttagttcgcgttcgtttatttcgcgatttcggggtggttcgtgtagttgcggaggacggtgtcgcgtttggttttttttcgtcgttgttcgtcgggggtttagggtacgggtaggggtcggggatcggtttggtaggcggagggcgcggcgtttttaggtgggcgcgcggggacgcggagggagtttttagggagggttcggggtcgttgcgttttcggggtcggtttggttttattagcgtttttcgtggtttttcgttgtttgattgttttttgtaaaatttattgaaaagtagtttttttacgtgtcgcgcgatgattgcggttattgtattattgtggttgggatggagagggtggagggggcgtgacgagggtggtcggtgggtagcgcgttcgtttgttcgggatcgggttagtgggggatgtggttgagggttatcgttgttcgaatatgtttaggggacgtgcgatcggtgggtagaagttgttcgagggtatg

SEQ ID NO: 35092 - DNA, 1063 bp, Artificial Sequence
  chemically treated genomic DNA (Homo sapiens) CpG-island No: 35092
cataccctcgaacaacttctacccaccgatcgcacgtcccctaaacatattcgaacaacgataaccctcaaccacatcccccactaacccgatcccgaacaaacgaacgcgctacccaccgaccaccctcgtcacgccccctccaccctctccatcccaaccacaataatacaataaccgcaatcatcgcgcgacacgtaaaaaaactacttttcaataaattttacaaaaaacaatcaaacaacgaaaaaccacgaaaaacgctaataaaaccaaaccgaccccgaaaacgcaacgaccccgaaccctccctaaaaactccctccgcgtccccgcgcgcccacctaaaaacgccgcgccctccgcctaccaaaccgatccccgacccctacccgtaccctaaacccccgacgaacaacgacgaaaaaaaaccaaacgcgacaccgtcctccgcaactacacgaaccaccccgaaatcgcgaaataaacgaacgcgaactaaacgcgcgaaactataaaaatctaccgacgccactaacgcccccgcgcgacacaccgcgcccgactaacccgaaaaaaaacccgactcacccgaaacgccctactaactacccgacccgactccgaccgctaccgccgtcgctaaactttccctcctacgcgaccgccgcgaactcgactccacctcccgctccgacaaccgcgaaacctccaaaaaccccgaaaacgaaaaacaacgacgacgacgacgactcgaacgaacgaacgcaacaacgaccaaacctaacgccccgccgcaaaataaatccgacgaaaacgaccaaaaccgaactaaaatcgcgattaaccgcgtacctccgcgtcacccacgacctctctacaatacgtccctacgcccgtcgaaacgacgccctaaccgaaacctatcactctcgaaaaaaaccgcgctcgaacaccaaaaacgatttacgcgtaactaaacaccaaaaaccgaaaaaatttaaaaactaaaacactataacgtaacccgaattacaaaaaaaaaatatccaatctccataaa

SEQ ID NO: 35093 - DNA, 1077 bp, Artificial Sequence
  chemically treated genomic DNA (Homo sapiens) CpG-island No: 35093
ggggaaagtcggggttttgaaaatagtagcgataaaggtaggcggggtcgcggtcgcgtttcgagggtttcggcggagtttatttggggcgtacgaggtcggtcgggttagtagtagtagttagaggttaggaagtagtagtttcgggcggcggcggcgggcgtagcgggcggaaggtcgtcggtcgttcggtttcggggttagcgcgatttcggcgcggggttttttttttatggtcgcgtttcggcgtcggcgtcgcgttttcggtattttcggtcggcgtttcggttcggtttcgcggtttagcggttttcgggttcgggaggggcggtcgttgcggttgcggttgggacggggcgtcgcgtatcggcgcggagggaggtcggagaggcgggggcgggtcgggtcggaatcgaggataggggcgttagtcgtacgttcgttttgtcgtttcgtttttttcggagtttcggagtcgttgttcggtaacgcgcgggttcgggcgcgggacggcgagtattttttttcggtcggtcggacgtttgtttgtttgtttgtttgtttgtttgcggggcggtcggggtagcgtgcgcggggttcggcgcggtagaggcggtaagggcggcgaggcggcgcggtttagtttttttttaggattcgtttttcggagggagcgcgaggggttcggggggtttgggtcgggcggtgtcgtttcgattcgtatttaatttcgggtttcgtcgcgcgtttttcggggcgttcggattagggtaggtcggtaagtcgggggaggggttttttcgtttttttcgttttttttttttcgtcgattttttgcgggtagtaggtgtgtggggcgtcgcgtttttaggatagtttcggggtcgcggaggggataaagttagataaagtcgggtttttgcgttagagtttagcgtgtaaggtaggggcgagtagagcgtacgtagttttttttcgtttttttgttttaagaaggtgcggttatttttgcgggttttcgggaagcgattttgcgtttagggtttgggaggttcgcgggattttgtatttagtagg

SEQ ID NO: 35094 - DNA, 1077 bp, Artificial Sequence
  chemically treated genomic DNA (Homo sapiens) CpG-island No: 35094
cctactaaatacaaaatcccgcgaacctcccaaaccctaaacgcaaaatcgcttcccgaaaacccgcaaaaataaccgcaccttcttaaaacaaaaaaacgaaaaaaaactacgtacgctctactcgcccctaccttacacgctaaactctaacgcaaaaacccgactttatctaactttatcccctccgcgaccccgaaactatcctaaaaacgcgacgccccacacacctactacccgcaaaaaatcgacgaaaaaaaaaaaacgaaaaaaacgaaaaaacccctcccccgacttaccgacctaccctaatccgaacgccccgaaaaacgcgcgacgaaacccgaaattaaatacgaatcgaaacgacaccgcccgacccaaaccccccgaacccctcgcgctccctccgaaaaacgaatcctaaaaaaaaactaaaccgcgccgcctcgccgcccttaccgcctctaccgcgccgaaccccgcgcacgctaccccgaccgccccgcaaacaaacaaacaaacaaacaaacaaacgtccgaccgaccgaaaaaaaatactcgccgtcccgcgcccgaacccgcgcgttaccgaacaacgactccgaaactccgaaaaaaacgaaacgacaaaacgaacgtacgactaacgcccctatcctcgattccgacccgacccgcccccgcctctccgacctccctccgcgccgatacgcgacgccccgtcccaaccgcaaccgcaacgaccgcccctcccgaacccgaaaaccgctaaaccgcgaaaccgaaccgaaacgccgaccgaaaataccgaaaacgcgacgccgacgccgaaacgcgaccataaaaaaaaaaccccgcgccgaaatcgcgctaaccccgaaaccgaacgaccgacgaccttccgcccgctacgcccgccgccgccgcccgaaactactacttcctaacctctaactactactactaacccgaccgacctcgtacgccccaaataaactccgccgaaaccctcgaaacgcgaccgcgaccccgcctacctttatcgctactattttcaaaaccccgactttcccc

SEQ ID NO: 35095 - DNA, 1077 bp, Artificial Sequence
  chemically treated genomic DNA (Homo sapiens) CpG-island No: 35095
tttgttaagtgtagggtttcgcgggttttttaggttttgagcgtagggtcgtttttcgaagattcgtagaggtggtcgtatttttttaaggtaggaaggcgggggagagttgcgtgcgttttgttcgtttttgttttgtacgttgagttttagcgtaggagttcgattttgtttggttttgtttttttcgcggtttcgaggttgttttgagagcgcggcgttttatatatttgttgttcgtaaggagtcggcgggagaggaggagcgagggaggcgagaggatttttttttcggtttgtcggtttattttgattcgggcgtttcggggaacgcgcggcgggattcggggttgggtgcgggtcggggcggtatcgttcggtttaggtttttcgagtttttcgcgtttttttcggaaggcgggttttgggggagggttgggtcgcgtcgtttcgtcgtttttgtcgtttttgtcgcgtcgagtttcgcgtacgttgtttcggtcgtttcgtaggtaggtaggtaggtaggtaggtaggcgttcggtcggtcgggagggggtgttcgtcgtttcgcgttcgggttcgcgcgttgtcgggtagcggtttcgaggtttcgaagggggcggagcggtaaggcgggcgtgcggttggcgtttttgttttcggtttcggttcggttcgttttcgttttttcggttttttttcgcgtcggtgcgcggcgtttcgttttagtcgtagtcgtagcggtcgtttttttcggattcgagagtcgttgagtcgcgaggtcgggtcggggcgtcggtcgggaatgtcgggggcgcggcgtcgacgtcgaggcgcggttatggaggggaagtttcgcgtcggggtcgcgttggtttcggggtcgagcggtcgacggtttttcgttcgttgcgttcgtcgtcgtcgttcggggttgttgttttttggtttttggttgttgttgttggttcggtcggtttcgtgcgttttaggtaagtttcgtcgagattttcggaacgcggtcgcgatttcgtttgtttttatcgttgttgtttttaaaatttcggtttttttt

SEQ ID NO: 35096 - DNA, 1077 bp, Artificial Sequence
  chemically treated genomic DNA (Homo sapiens) CpG-island No: 35096
aaaaaaaaccgaaattttaaaaacaacaacgataaaaacaaacgaaatcgcgaccgcgttccgaaaatctcgacgaaacttacctaaaacgcacgaaaccgaccgaaccaacaacaacaaccaaaaaccaaaaaacaacaaccccgaacgacgacgacgaacgcaacgaacgaaaaaccgtcgaccgctcgaccccgaaaccaacgcgaccccgacgcgaaacttcccctccataaccgcgcctcgacgtcgacgccgcgcccccgacattcccgaccgacgccccgacccgacctcgcgactcaacgactctcgaatccgaaaaaaacgaccgctacgactacgactaaaacgaaacgccgcgcaccgacgcgaaaaaaaaccgaaaaaacgaaaacgaaccgaaccgaaaccgaaaacaaaaacgccaaccgcacgcccgccttaccgctccgcccccttcgaaacctcgaaaccgctacccgacaacgcgcgaacccgaacgcgaaacgacgaacaccccctcccgaccgaccgaacgcctacctacctacctacctacctacctacgaaacgaccgaaacaacgtacgcgaaactcgacgcgacaaaaacgacaaaaacgacgaaacgacgcgacccaaccctcccccaaaacccgccttccgaaaaaaacgcgaaaaactcgaaaaacctaaaccgaacgataccgccccgacccgcacccaaccccgaatcccgccgcgcgttccccgaaacgcccgaatcaaaataaaccgacaaaccgaaaaaaaaatcctctcgcctccctcgctcctcctctcccgccgactccttacgaacaacaaatatataaaacgccgcgctctcaaaacaacctcgaaaccgcgaaaaaaacaaaaccaaacaaaatcgaactcctacgctaaaactcaacgtacaaaacaaaaacgaacaaaacgcacgcaactctcccccgccttcctaccttaaaaaaatacgaccacctctacgaatcttcgaaaaacgaccctacgctcaaaacctaaaaaacccgcgaaaccctacacttaacaaa

SEQ ID NO: 35097 - DNA, 520 bp, Artificial Sequence
  chemically treated genomic DNA (Homo sapiens) CpG-island No: 35097
tgagtttcgaagttttagttcggatttaattcggtcgcgtcgcgtaggattcgggggggcgggcgggggtagtaatttttttggcgtgggcggttgagacgtttttatggagaggattttcgcgttttttcgtttagttgttggaagcgcgggggaggacgtttaggaaaggtttgcgggagggggtcgtttagtttcgcgttttcggttcggggtaggacgaagttttttttttcgtcgttttcgtttttagtaggacggttaggcgcgcggtagcgtttatagtttcgttcgtcgcgttttttattatagtttcgttggggtattgttagtatgtgcggcgtagagtgtagtgtcgtagttggtttcgcggttggtacggcgtaagcgtaagagaacggtatatttttagcgagtgcgtacggtatacgcggcgcgttggttcggttcgagttttcgtttatttgaagaacgcgtcgggcgagagtcgagcgttcgagtagtgggagtttagattcgt

SEQ ID NO: 35098 - DNA, 520 bp, Artificial Sequence
  chemically treated genomic DNA (Homo sapiens) CpG-island No: 35098
acgaatctaaactcccactactcgaacgctcgactctcgcccgacgcgttcttcaaataaacgaaaactcgaaccgaaccaacgcgccgcgtataccgtacgcactcgctaaaaatataccgttctcttacgcttacgccgtaccaaccgcgaaaccaactacgacactacactctacgccgcacatactaacaataccccaacgaaactataataaaaaacgcgacgaacgaaactataaacgctaccgcgcgcctaaccgtcctactaaaaacgaaaacgacgaaaaaaaaaacttcgtcctaccccgaaccgaaaacgcgaaactaaacgaccccctcccgcaaacctttcctaaacgtcctcccccgcgcttccaacaactaaacgaaaaaacgcgaaaatcctctccataaaaacgtctcaaccgcccacgccaaaaaaattactacccccgcccgcccccccgaatcctacgcgacgcgaccgaattaaatccgaactaaaacttcgaaactca

SEQ ID NO: 35099 - DNA, 520 bp, Artificial Sequence
  chemically treated genomic DNA (Homo sapiens) CpG-island No: 35099
gcgaatttagatttttattattcgagcgttcggttttcgttcggcgcgttttttagatgaacgagagttcggatcgagttagcgcgtcgcgtgtgtcgtgcgtattcgttggaggtgtgtcgtttttttgcgtttgcgtcgtattagtcgcgaggttagttgcgatattgtattttgcgtcgtatatgttggtagtgttttaacgggattgtggtgagaggcgcggcgggcgggattgtgggcgttgtcgcgcgtttggtcgttttgttggaagcgggagcgacgggaaggggggtttcgttttgtttcgggtcggggacgcggggttggacgattttttttcgtaggttttttttgggcgttttttttcgcgtttttagtagttgggcggaaaggcgcgaaggttttttttatggagacgttttaatcgtttacgttagaaaagttgttgttttcgttcgttttttcggattttgcgcgacgcggtcgggttaaattcggattgggatttcggagttta

SEQ ID NO: 35100 - DNA, 520 bp, Artificial Sequence
  chemically treated genomic DNA (Homo sapiens) CpG-island No: 35100
taaactccgaaatcccaatccgaatttaacccgaccgcgtcgcgcaaaatccgaaaaaacgaacgaaaacaacaacttttctaacgtaaacgattaaaacgtctccataaaaaaaaccttcgcgcctttccgcccaactactaaaaacgcgaaaaaaaacgcccaaaaaaaacctacgaaaaaaaatcgtccaaccccgcgtccccgacccgaaacaaaacgaaaccccccttcccgtcgctcccgcttccaacaaaacgaccaaacgcgcgacaacgcccacaatcccgcccgccgcgcctctcaccacaatcccgttaaaacactaccaacatatacgacgcaaaatacaatatcgcaactaacctcgcgactaatacgacgcaaacgcaaaaaaacgacacacctccaacgaatacgcacgacacacgcgacgcgctaactcgatccgaactctcgttcatctaaaaaacgcgccgaacgaaaaccgaacgctcgaataataaaaatctaaattcgc

SEQ ID NO: 35101 - DNA, 656 bp, Artificial Sequence
  chemically treated genomic DNA (Homo sapiens) CpG-island No: 35101
  misc_feature (213)..(213): n is either a, c, g or t
acgatttgcgtaggcgtggtttgaggaaacgttcgttgtggcgagttattcgaaaggtttcggtcgggggcgggaataggatcggttcgcgggttggcgtcgataggttgtcgtagagatagggcgggttttgttaagcgacgcgtttcgtcgtggggcggtgtttgcgtttgagtttttacgagagggaaggaacgttgtttcgagtttcgncgtcgcgtcgcgtagattcgcgtcgtcgtcgattttagaggcggggtcggaagcgttacggtttgattttcgagtttttttgttttcgaaggggcggtcgtttttttttcgattcgtttcgtttttttttttttttttttattattcggaggtcgaagtttttagttagggcggggcggcgtagttcgagttttcggattcggaagaagcgttatttttcgtttttattatggagtttatcgtatcgttttttatcgaggaggattttattgaagtgaagaaggacgtgagtaacgtagttgtgtttagggcgggcgggggcggttgtagtttagcgggagacgaaagcggaagtttggagttcgaggataaggaggattttttaggtcggaggagcggaaagttttagtataggaggattgtggcgagttttgtattcgagg

SEQ ID NO: 35102 - DNA, 656 bp, Artificial Sequence
  chemically treated genomic DNA (Homo sapiens) CpG-island No: 35102
  misc_feature (444)..(444): n is either a, c, g or t
cctcgaatacaaaactcgccacaatcctcctatactaaaactttccgctcctccgacctaaaaaatcctccttatcctcgaactccaaacttccgctttcgtctcccgctaaactacaaccgcccccgcccgccctaaacacaactacgttactcacgtccttcttcacttcaataaaatcctcctcgataaaaaacgatacgataaactccataataaaaacgaaaaataacgcttcttccgaatccgaaaactcgaactacgccgccccgccctaactaaaaacttcgacctccgaataataaaaaaaaaaaaaaaaaaacgaaacgaatcgaaaaaaaaacgaccgccccttcgaaaacaaaaaaactcgaaaatcaaaccgtaacgcttccgaccccgcctctaaaatcgacgacgacgcgaatctacgcgacgcgacgncgaaactcgaaacaacgttccttccctctcgtaaaaactcaaacgcaaacaccgccccacgacgaaacgcgtcgcttaacaaaacccgccctatctctacgacaacctatcgacgccaacccgcgaaccgatcctattcccgcccccgaccgaaacctttcgaataactcgccacaacgaacgtttcctcaaaccacgcctacgcaaatcgt

SEQ ID NO: 35103 - DNA, 656 bp, Artificial Sequence
  chemically treated genomic DNA (Homo sapiens) CpG-island No: 35103
  misc_feature (444)..(444): n is either a, c, g or t
tttcggatgtagggttcgttatagtttttttgtgttaggatttttcgttttttcgatttggaggattttttttgttttcggattttaggttttcgttttcgtttttcgttgggttgtagtcgttttcgttcgttttgggtatagttgcgttatttacgtttttttttattttagtgaggtttttttcggtgagggacggtgcggtgggttttatggtggaggcgggagatggcgtttttttcgggttcgggagttcgggttgcgtcgtttcgttttggttgggggtttcggttttcgggtaatggggaagaaggagaggaggcggagcgggtcgggagaaagacggtcgttttttcgggaatagagggattcgggggttaaatcgtagcgttttcggtttcgtttttgaggtcgacggcgacgcgaatttacgcgacgcgacgncggagttcggagtagcgttttttttttttcgtagaggtttaggcgtaggtatcgttttacggcgaggcgcgtcgtttagtagagttcgttttgtttttgcggtagtttatcgacgttagttcgcgggtcgattttgttttcgttttcgatcggagtttttcgggtggttcgttatagcgggcgtttttttaagttacgtttgcgtaggtcgt

SEQ ID NO: 35104 - DNA, 656 bp, Artificial Sequence
  chemically treated genomic DNA (Homo sapiens) CpG-island No: 35104
  misc_feature (213)..(213): n is either a, c, g or t
acgacctacgcaaacgtaacttaaaaaaacgcccgctataacgaaccacccgaaaaactccgatcgaaaacgaaaacaaaatcgacccgcgaactaacgtcgataaactaccgcaaaaacaaaacgaactctactaaacgacgcgcctcgccgtaaaacgatacctacgcctaaacctctacgaaaaaaaaaaaacgctactccgaactccgncgtcgcgtcgcgtaaattcgcgtcgccgtcgacctcaaaaacgaaaccgaaaacgctacgatttaacccccgaatccctctattcccgaaaaaacgaccgtctttctcccgacccgctccgcctcctctccttcttccccattacccgaaaaccgaaacccccaaccaaaacgaaacgacgcaacccgaactcccgaacccgaaaaaaacgccatctcccgcctccaccataaaacccaccgcaccgtccctcaccgaaaaaaacctcactaaaataaaaaaaaacgtaaataacgcaactatacccaaaacgaacgaaaacgactacaacccaacgaaaaacgaaaacgaaaacctaaaatccgaaaacaaaaaaaatcctccaaatcgaaaaaacgaaaaatcctaacacaaaaaaactataacgaaccctacatccgaaa

SEQ ID NO: 35105 - DNA, 861 bp, Artificial Sequence
  chemically treated genomic DNA (Homo sapiens) CpG-island No: 35105
  misc_feature (519)..(519): n is either a, c, g or t
ttacgacgtatttgttgtgttagttggcgggtttggattatgtcgttttttagtagatcgcgacgaatttcgtcgattaagtttaggtcgtaggttttacgcgtatcggtaaggatttttgttatttttatggaggttttacgtacgcggaagaattgtataaagtcggagtcgaagtcggtaaagtgataggttaggttaaggttgagtagatgcgagtgtaagcgttttatttttagtagaatggcgcggattatttgcgtacgttttggtatttgaatatttatcgcgttttttatcgacgtggtgtaggcggtgttgtgggtaaagtcgtagatttcgtatatacggttagagaggaaggttatttcgttataattttatacggggttttcgttagtttttttatgtcgcgatggacgtagaatagatcggtagtcggcgtcgataatgttttcgtatcgacgaatacgacggaagtggttcggtttattagaagtgacgtgtagcggattaatncggtacgacgttgttttttttgtcgtttagtatcgttgatgaattcgtaggttttagtatcggtggtcggtgtcggacgttgacgataatttatgttgtttttacgtagcggataaagtttattcggttagttattcggtagtattagacgacgtttattcggtagattaatcggaattaaatcgtatatatcgcgtattttacgttcgttttatatcgtcgtcggaacgcgcggcgttacggacggatatttcggtttgttggcgttaatttcgacgcgaatcgtaatttaatatttagtgtttttttttatcgatagtacgtagtaaacggcgtaatgat

SEQ ID NO: 35106 - DNA, 861 bp, Artificial Sequence
  chemically treated genomic DNA (Homo sapiens) CpG-island No: 35106
  misc_feature (343)..(343): n is either a, c, g or t
atcattacgccgtttactacgtactatcgataaaaaaaaacactaaatattaaattacgattcgcgtcgaaattaacgccaacaaaccgaaatatccgtccgtaacgccgcgcgttccgacgacgatataaaacgaacgtaaaatacgcgatatatacgatttaattccgattaatctaccgaataaacgtcgtctaatactaccgaataactaaccgaataaactttatccgctacgtaaaaacaacataaattatcgtcaacgtccgacaccgaccaccgatactaaaacctacgaattcatcaacgatactaaacgacaaaaaaaacaacgtcgtaccgnattaatccgctacacgtcacttctaataaaccgaaccacttccgtcgtattcgtcgatacgaaaacattatcgacgccgactaccgatctattctacgtccatcgcgacataaaaaaactaacgaaaaccccgtataaaattataacgaaataaccttcctctctaaccgtatatacgaaatctacgactttacccacaacaccgcctacaccacgtcgataaaaaacgcgataaatattcaaataccaaaacgtacgcaaataatccgcgccattctactaaaaataaaacgcttacactcgcatctactcaaccttaacctaacctatcactttaccgacttcgactccgactttatacaattcttccgcgtacgtaaaacctccataaaaataacaaaaatccttaccgatacgcgtaaaacctacgacctaaacttaatcgacgaaattcgtcgcgatctactaaaaaacgacataatccaaacccgccaactaacacaacaaatacgtcgtaa

SEQ ID NO: 35107 - DNA, 861 bp, Artificial Sequence
  chemically treated genomic DNA (Homo sapiens) CpG-island No: 35107
  misc_feature (343)..(343): n is either a, c, g or t
gttattacgtcgtttattacgtgttgtcgatggagaagggtattaagtgttggattacggttcgcgtcgaagttgacgttaataaatcggaatattcgttcgtgacgtcgcgcgtttcggcggcggtgtggggcgagcgtgaagtgcgcgatatgtacggtttgatttcggttggtttgtcggatgaacgtcgtttggtgttgtcggatgattggtcggatgaattttattcgttgcgtaaagatagtatggattatcgttagcgttcggtatcgattatcgatgttgaaatttacgagtttattaacgatattgggcgataagaaaaataacgtcgtgtcgnattggttcgttgtacgttatttttgatgaatcgggttattttcgtcgtgttcgtcgatgcgaaaatattatcgacgtcgattatcggtttgttttacgtttatcgcggtatggaaaaattggcggaaatttcgtatggggttataacgaagtgatttttttttttgatcgtgtgtgcgggatttgcggttttgtttatagtatcgtttatattacgtcggtggaaaacgcgatgggtatttaggtgttagaacgtgcgtagatgattcgcgttattttgttggaggtagaacgtttgtattcgtatttgtttaattttggtttggtttgttattttatcggtttcgatttcggttttatgtagttttttcgcgtgcgtgaaatttttatgaaaatggtagagatttttatcggtgcgcgtaaaatttacggtttgaatttgatcggcgggattcgtcgcgatttgttgaaagacgatatgatttagattcgttagttggtataatagatgcgtcgtga

SEQ ID NO: 35108 - DNA, 861 bp, Artificial Sequence
  chemically treated genomic DNA (Homo sapiens) CpG-island No: 35108
  misc_feature (519)..(519): n is either a, c, g or t
tcacgacgcatctattataccaactaacgaatctaaatcatatcgtctttcaacaaatcgcgacgaatcccgccgatcaaattcaaaccgtaaattttacgcgcaccgataaaaatctctaccattttcataaaaatttcacgcacgcgaaaaaactacataaaaccgaaatcgaaaccgataaaataacaaaccaaaccaaaattaaacaaatacgaatacaaacgttctacctccaacaaaataacgcgaatcatctacgcacgttctaacacctaaatacccatcgcgttttccaccgacgtaatataaacgatactataaacaaaaccgcaaatcccgcacacacgatcaaaaaaaaaaatcacttcgttataaccccatacgaaatttccgccaatttttccataccgcgataaacgtaaaacaaaccgataatcgacgtcgataatattttcgcatcgacgaacacgacgaaaataacccgattcatcaaaaataacgtacaacgaaccaatncgacacgacgttatttttcttatcgcccaatatcgttaataaactcgtaaatttcaacatcgataatcgataccgaacgctaacgataatccatactatctttacgcaacgaataaaattcatccgaccaatcatccgacaacaccaaacgacgttcatccgacaaaccaaccgaaatcaaaccgtacatatcgcgcacttcacgctcgccccacaccgccgccgaaacgcgcgacgtcacgaacgaatattccgatttattaacgtcaacttcgacgcgaaccgtaatccaacacttaatacccttctccatcgacaacacgtaataaacgacgtaataac

SEQ ID NO: 35109 - DNA, 572 bp, Artificial Sequence
  chemically treated genomic DNA (Homo sapiens) CpG-island No: 35109
gtttttttattagttacggttttattttcgggcgaggtttgttatcgattagtagtcgtttcgtttagttcggagtttttttaattttcgagtttaagtagatttcgttggttcgcggtttgtatttttcgtcgggtttacgttttttcggtcgtttagtaggagtttagttttcgttatcggagtcggtcgggagagggtataaaattatcgttatttaagggcggttgttattagagaggagcgaattttagattcgtttgtggaagagatttggggtcgttaaggaaacggcggggaggggagcgaggaggagagacgttgaggatttggcgtcggcgtcgtcgtcgtcgtcgtcgaaataaagagtaggaatttatttgggcgaatcggcgtttgaatttaaggggaggtcgaggtcgttgtggcgagagattataattcgggtcgggagggggggtggttacggtttttttttcgtttttttagtgcggggaatatgtagagtcggggggagattagtcgagaagataaatcgttgtttttttttttttttttttttttttttttta

SEQ ID NO: 35110 - DNA, 572 bp, Artificial Sequence
  chemically treated genomic DNA (Homo sapiens) CpG-island No: 35110
taaaaaaaaaaaaaaaaaaaaaaaaaaaaaacaacgatttatcttctcgactaatctccccccgactctacatattccccgcactaaaaaaacgaaaaaaaaaccgtaaccaccccccctcccgacccgaattataatctctcgccacaacgacctcgacctccccttaaattcaaacgccgattcgcccaaataaattcctactctttatttcgacgacgacgacgacgacgccgacgccaaatcctcaacgtctctcctcctcgctcccctccccgccgtttccttaacgaccccaaatctcttccacaaacgaatctaaaattcgctcctctctaataacaaccgcccttaaataacgataattttataccctctcccgaccgactccgataacgaaaactaaactcctactaaacgaccgaaaaaacgtaaacccgacgaaaaatacaaaccgcgaaccaacgaaatctacttaaactcgaaaattaaaaaaactccgaactaaacgaaacgactactaatcgataacaaacctcgcccgaaaataaaaccgtaactaataaaaaaac

SEQ ID NO: 35111 - DNA, 572 bp, Artificial Sequence
  chemically treated genomic DNA (Homo sapiens) CpG-island No: 35111
tgggagaaggaggaggaggaggaagaagaagtaacgatttgttttttcggttggttttttttcggttttatatgtttttcgtattgaggagacggaagaggagtcgtagttattttttttttcggttcggattatagtttttcgttatagcggtttcggtttttttttggatttagacgtcgattcgtttaggtaaatttttgttttttatttcggcggcggcggcggcggcgtcggcgttaggtttttagcgtttttttttttcgttttttttttcgtcgtttttttagcggttttaggttttttttataggcgagtttagagttcgtttttttttggtggtagtcgtttttgggtagcggtggttttgtattttttttcggtcggtttcggtggcggggattgggtttttgttgggcggtcggggaggcgtaggttcggcggagagtgtaggtcgcgggttagcggaatttatttgagttcggggattaggagagtttcgggttgagcggagcgattgttggtcggtgataggtttcgttcgggagtggagtcgtagttagtggggaggt

SEQ ID NO: 35112 - DNA, 572 bp, Artificial Sequence
  chemically treated genomic DNA (Homo sapiens) CpG-island No: 35112
acctccccactaactacgactccactcccgaacgaaacctatcaccgaccaacaatcgctccgctcaacccgaaactctcctaatccccgaactcaaataaattccgctaacccgcgacctacactctccgccgaacctacgcctccccgaccgcccaacaaaaacccaatccccgccaccgaaaccgaccgaaaaaaaatacaaaaccaccgctacccaaaaacgactaccaccaaaaaaaaacgaactctaaactcgcctataaaaaaaacctaaaaccgctaaaaaaacgacgaaaaaaaaaacgaaaaaaaaaaacgctaaaaacctaacgccgacgccgccgccgccgccgccgaaataaaaaacaaaaatttacctaaacgaatcgacgtctaaatccaaaaaaaaaccgaaaccgctataacgaaaaactataatccgaaccgaaaaaaaaaataactacgactcctcttccgtctcctcaatacgaaaaacatataaaaccgaaaaaaaaccaaccgaaaaaacaaatcgttacttcttcttcctcctcctcctccttctccca

SEQ ID NO: 35113 - DNA, 620 bp, Artificial Sequence
  chemically treated genomic DNA (Homo sapiens) CpG-island No: 35113
ttttcgtcggcgttaaatattaataattatttttttttttttattttattttcgttatcgtcgtagtcgtcgttgtcgttatttgggttcgcgttttcggtcgcgtcgcgcggtattcgggtttagttagtcgggaggcggttagtttttttttacgttcgtttttttagggcggttgtggatgttgttagtattgtcgatgttttagagcgacgtttgttttgcgatataggcgggtcggtttttttttgtttttatttttttggaggtcgataggagcggggttcgagttcggtggtggtcgtgagcgtggggggtatttaggttcggacgggtttttaggtcgtcgacggcggcggttggaggtcgcgttggttgttttaggtcgtcgttagttttagggagtcgattttcgggcggttttatagaggacgttcgcgattcgatggcgatgatgttcgttttaaatggtgtttttgtagtcgggtggatggatggatcgtatattttgttttttgagagtcgggattttacgttcgattgcgtgttatttttgcggaataagaacgtaatttttggaggtgaagacgattgtcggttggattgaattggaatcgtgt

SEQ ID NO: 35114 - DNA, 620 bp, Artificial Sequence
  chemically treated genomic DNA (Homo sapiens) CpG-island No: 35114
acacgattccaattcaatccaaccgacaatcgtcttcacctccaaaaattacgttcttattccgcaaaaataacacgcaatcgaacgtaaaatcccgactctcaaaaaacaaaatatacgatccatccatccacccgactacaaaaacaccatttaaaacgaacatcatcgccatcgaatcgcgaacgtcctctataaaaccgcccgaaaatcgactccctaaaactaacgacgacctaaaacaaccaacgcgacctccaaccgccgccgtcgacgacctaaaaacccgtccgaacctaaataccccccacgctcacgaccaccaccgaactcgaaccccgctcctatcgacctccaaaaaaataaaaacaaaaaaaaaccgacccgcctatatcgcaaaacaaacgtcgctctaaaacatcgacaatactaacaacatccacaaccgccctaaaaaaacgaacgtaaaaaaaaactaaccgcctcccgactaactaaacccgaataccgcgcgacgcgaccgaaaacgcgaacccaaataacgacaacgacgactacgacgataacgaaaataaaataaaaaaaaaaaaataattattaatatttaacgccgacgaaaa

SEQ ID NO: 35115 - DNA, 620 bp, Artificial Sequence
  chemically treated genomic DNA (Homo sapiens) CpG-island No: 35115
atacgattttaatttaatttagtcgatagtcgtttttatttttaaaggttgcgtttttatttcgtagaaataatacgtagtcgggcgtaaggtttcggtttttaaaaggtaaggtgtacgatttatttatttattcggttgtagggatattatttaaaacgggtattatcgttatcgaatcgcgggcgttttttgtggggtcgttcggagatcggttttttaaagttaacgacgatttgggatagttagcgcggtttttagtcgtcgtcgtcggcgatttgagagttcgttcgggtttgagtgttttttacgtttacgattattatcgaattcgggtttcgtttttgtcggtttttaggaaaataaagatagaggagagtcggttcgtttgtgtcgtagggtaaacgtcgttttgaagtatcgataatattggtaatatttatagtcgttttgaggggacgggcgtagaggagagttggtcgtttttcggttggttgggttcgggtgtcgcgcggcgcggtcgaggacgcgagtttaagtggcggtagcggcggttgcggcggtggcggaagtggagtggggaagagggggtggttgttagtgtttggcgtcggcggagg

SEQ ID NO: 35116 - DNA, 620 bp, Artificial Sequence
  chemically treated genomic DNA (Homo sapiens) CpG-island No: 35116
cctccgccgacgccaaacactaacaaccaccccctcttccccactccacttccgccaccgccgcaaccgccgctaccgccacttaaactcgcgtcctcgaccgcgccgcgcgacacccgaacccaaccaaccgaaaaacgaccaactctcctctacgcccgtcccctcaaaacgactataaatattaccaatattatcgatacttcaaaacgacgtttaccctacgacacaaacgaaccgactctcctctatctttattttcctaaaaaccgacaaaaacgaaacccgaattcgataataatcgtaaacgtaaaaaacactcaaacccgaacgaactctcaaatcgccgacgacgacgactaaaaaccgcgctaactatcccaaatcgtcgttaactttaaaaaaccgatctccgaacgaccccacaaaaaacgcccgcgattcgataacgataatacccgttttaaataatatccctacaaccgaataaataaataaatcgtacaccttaccttttaaaaaccgaaaccttacgcccgactacgtattatttctacgaaataaaaacgcaacctttaaaaataaaaacgactatcgactaaattaaattaaaatcgtat

SEQ ID NO: 35117 - DNA, 569 bp, Artificial Sequence
  chemically treated genomic DNA (Homo sapiens) CpG-island No: 35117
ttttcgtaaatggatttattttggggagttgttcggttcgtttggattgtttacgggcgtattgacgttgtggggggaatgttttcgaattgggggtacgaggtcgggggaatcgtttttgagattcgggttagaagttacgagtttgggtttcgggggtgtatgtagacggcgtttagtttcgcgcggaatcgtcggcgggatcgggggtggggttcggaggttcgggggcggggtcggtcgggggcgggggcgggggcggggtcgcggtcgttgtagtagcgcgggtcgggttagggggcgtttcgcgcggtagcgattttggtaggcgttgtagtgaagttggattcgtaggcgggcgtgcgtggagcgggggtcgcggtcgcgtcgtagagatgtgattcgggtcgaaggttagttggagcgtcggcgttgcggggtcgcgggggtcggtaagtgcgagttgcgtcgatgtagtggaggacgttgtggggattttagaaatttttttcgtcgtggatttgggagaattggggggttcgttttttgtgtttttttaagcgtttttt

SEQ ID NO: 35118 - DNA, 569 bp, Artificial Sequence
  chemically treated genomic DNA (Homo sapiens) CpG-island No: 35118
aaaaaacgcttaaaaaaacacaaaaaacgaaccccccaattctcccaaatccacgacgaaaaaaatttctaaaatccccacaacgtcctccactacatcgacgcaactcgcacttaccgacccccgcgaccccgcaacgccgacgctccaactaaccttcgacccgaatcacatctctacgacgcgaccgcgacccccgctccacgcacgcccgcctacgaatccaacttcactacaacgcctaccaaaatcgctaccgcgcgaaacgccccctaacccgacccgcgctactacaacgaccgcgaccccgcccccgcccccgcccccgaccgaccccgcccccgaacctccgaaccccacccccgatcccgccgacgattccgcgcgaaactaaacgccgtctacatacacccccgaaacccaaactcgtaacttctaacccgaatctcaaaaacgattcccccgacctcgtacccccaattcgaaaacattccccccacaacgtcaatacgcccgtaaacaatccaaacgaaccgaacaactccccaaaataaatccatttacgaaaa

SEQ ID NO: 35119 - DNA, 569 bp, Artificial Sequence
  chemically treated genomic DNA (Homo sapiens) CpG-island No: 35119
ggggggcgtttagaaaaatataagaagcggattttttaatttttttaaatttacggcgggaaaagtttttggggtttttatagcgttttttattgtatcggcgtagttcgtatttatcgattttcgcggtttcgtagcgtcgacgttttagttggttttcggttcgagttatatttttgcggcgcggtcgcggttttcgttttacgtacgttcgtttgcgggtttagttttattgtagcgtttgttagagtcgttgtcgcgcgaggcgttttttggttcggttcgcgttgttgtagcggtcgcggtttcgttttcgttttcgttttcggtcggtttcgttttcgggttttcgagttttattttcggtttcgtcggcggtttcgcgcggggttaggcgtcgtttgtatgtattttcggagtttaagttcgtagtttttagttcggattttagagacgattttttcgatttcgtgtttttaattcggggatattttttttataacgttagtgcgttcgtaagtagtttagacgagtcgggtaattttttagggtagatttatttgcgggaa

SEQ ID NO: 35120 - DNA, 569 bp, Artificial Sequence
  chemically treated genomic DNA (Homo sapiens) CpG-island No: 35120
ttcccgcaaataaatctaccctaaaaaattacccgactcgtctaaactacttacgaacgcactaacgttataaaaaaaatatccccgaattaaaaacacgaaatcgaaaaaatcgtctctaaaatccgaactaaaaactacgaacttaaactccgaaaatacatacaaacgacgcctaaccccgcgcgaaaccgccgacgaaaccgaaaataaaactcgaaaacccgaaaacgaaaccgaccgaaaacgaaaacgaaaacgaaaccgcgaccgctacaacaacgcgaaccgaaccaaaaaacgcctcgcgcgacaacgactctaacaaacgctacaataaaactaaacccgcaaacgaacgtacgtaaaacgaaaaccgcgaccgcgccgcaaaaatataactcgaaccgaaaaccaactaaaacgtcgacgctacgaaaccgcgaaaatcgataaatacgaactacgccgatacaataaaaaacgctataaaaaccccaaaaacttttcccgccgtaaatttaaaaaaattaaaaaatccgcttcttatatttttctaaacgcccccc

SEQ ID NO: 35121 - DNA, 1126 bp, Artificial Sequence
  chemically treated genomic DNA (Homo sapiens) CpG-island No: 35121
gtgtcgttgcgttttttttttttttgcggttgtttttgcgttcgttttttttttcggttttttttcgggttttggtgtttgttcgtagttatcggtttttttttttttttcggttttttcgtttttttttttcgttatttttgttcgttttttttttttttcgtgtttcgttttgtttgttttcgttttttattttcgttttttttttttatttattttttcgtgtttttgcgtttgttgtgttcgttttttcgtttgagcgtttcgtcgtcggtgcgggttttttcgtgcgttttattcgcgttcgtcggtcggttcgcgcgtgtcgtgcgtcgttcgcgttttgcgtttttttcgttttgtttttcgtttttttgtgcgtttcggttttcgagcgtcgcgcgttttgcgttttggcgtcggtttgtttttcgtcgtgtttggttatttcgcgtgatttcgtcgtttcggcgtgcgtttttgcgtcgcgtcgtggtgcgttcggcgcgtcgtttttggcgtcgtttttattacgtttgtcgtttttgtgttcgtagttcgcgcggttgagtttgtttgtttcgtgttgtttttttgtttttttttttcgttcgttttgttcgtgttgtttttgtgtttttttcgcggtttcggtttgcgtggtcgtttttcgttttttcgcgtgtcggggttggtcgttttgttcgtttgttgtttttagttcgcgtttttcgtttttcgcgttttcgcgttcgcgtattttcgcggtcgtcgagttcgtgtcgtttcgacggcgcgcgttttttcgttcgtttcgtcgttcgtcgttttgttcgttttttttcgttgtttgcggttgtttgtcgtttcgttggttttttttttttttttttttttttttttcgcgcgtgttcgtttgtttcgtttttgttttttttttcgttgcgtttgtcgtcgtcggtgcgtgtgtttcgtgtttttgttgtcgcgtttttcgtgtttttcgtttggcggtcgtcgttcgttttttgtttcgcgtcgtttttgtgtgttttgttcggcgtttcgtttcgtttttttttcgtttttgttttttttttgttgtttcgtttcgcgtgttatttgt

SEQ ID NO: 35122 - DNA, 1126 bp, Artificial Sequence
  chemically treated genomic DNA (Homo sapiens) CpG-island No: 35122
acaaataacacgcgaaacgaaacaacaaaaaaaaaacaaaaacgaaaaaaaaacgaaacgaaacgccgaacaaaacacacaaaaacgacgcgaaacaaaaaacgaacgacgaccgccaaacgaaaaacacgaaaaacgcgacaacaaaaacacgaaacacacgcaccgacgacgacaaacgcaacgaaaaaaaaaacaaaaacgaaacaaacgaacacgcgcgaaaaaaaaaaaaaaaaaaaaaaaaaaaaccaacgaaacgacaaacaaccgcaaacaacgaaaaaaaacgaacaaaacgacgaacgacgaaacgaacgaaaaaacgcgcgccgtcgaaacgacacgaactcgacgaccgcgaaaatacgcgaacgcgaaaacgcgaaaaacgaaaaacgcgaactaaaaacaacaaacgaacaaaacgaccaaccccgacacgcgaaaaaacgaaaaacgaccacgcaaaccgaaaccgcgaaaaaaacacaaaaacaacacgaacaaaacgaacgaaaaaaaaaaacaaaaaaacaacacgaaacaaacaaactcaaccgcgcgaactacgaacacaaaaacgacaaacgtaataaaaacgacgccaaaaacgacgcgccgaacgcaccacgacgcgacgcaaaaacgcacgccgaaacgacgaaatcacgcgaaataaccaaacacgacgaaaaacaaaccgacgccaaaacgcaaaacgcgcgacgctcgaaaaccgaaacgcacaaaaaaacgaaaaacaaaacgaaaaaaacgcaaaacgcgaacgacgcacgacacgcgcgaaccgaccgacgaacgcgaataaaacgcacgaaaaaacccgcaccgacgacgaaacgctcaaacgaaaaaacgaacacaacaaacgcaaaaacacgaaaaaataaataaaaaaaaaaaacgaaaataaaaaacgaaaacaaacaaaacgaaacacgaaaaaaaaaaaaaacgaacaaaaataacgaaaaaaaaaaacgaaaaaaccgaaaaaaaaaaaaaaaccgataactacgaacaaacaccaaaacccgaaaaaaaaccgaaaaaaaaaacgaacgcaaaaacaaccgcaaaaaaaaaaaaaacgcaacgacac

SEQ ID NO: 35123 - DNA, 1126 bp, Artificial Sequence
  chemically treated genomic DNA (Homo sapiens) CpG-island No: 35123
gtaggtgatacgcgggacgaagtagtaagagaagaatagagacggaggggaggcggaacgaggcgtcggatagagtatatagaaacgacgcgagatagaagacgaacgacggtcgttaggcggagggtacgaaggacgcgataataggagtacgaggtatacgtatcgacgacggtagacgtaacgggagagagaatagaagcgaaatagacggatacgcgcggggagaaagagagaggaggagagggaagttaacgagacggtaggtaatcgtaaatagcggaaagaagcgagtagagcggcgagcggcgagacggacgaaaggacgcgcgtcgtcggagcggtacggattcgacggtcgcgaggatgcgcgagcgcggaggcgcgagagacgagaggcgcgaattgaaagtaataaacgagtagaacgattagtttcgatacgcgaaggagcgggaggcggttacgtaagtcgaggtcgcgagagagatatagggatagtacggataaggcggacggaaggaagagataggagagtagtacgagataggtaggtttagtcgcgcgggttacggatataggagcgataggcgtagtggagacgacgttaggggcgacgcgtcgagcgtattacgacgcggcgtaggagcgtacgtcggggcggcggggttacgcgaggtggttaagtacgacgggaggtagatcgacgttagggcgtaaggcgcgcgacgttcgggagtcgggacgtatagaaggacggagggtaggacgaaggagacgtaggacgcggacggcgtacgatacgcgcggatcggtcggcgggcgcgagtaggacgtacgagagagttcgtatcgacgacgaaacgtttaggcgagggagcgagtataataagcgtagaagtacgagaagatgagtggaggaagaaggcggagatgaaaggcgaagataggtagaacgagatacgaagaagggagggagcgaatagagatgacgggaggagagaacgaggagatcgagagagagagagaggtcggtagttgcggataggtattaaggttcgagagggagtcgggggaggaggcgagcgtaggggtagtcgtagggaggagaagggcgtagcgatat

SEQ ID NO: 35124 - DNA, 1126 bp, Artificial Sequence
  chemically treated genomic DNA (Homo sapiens) CpG-island No: 35124
atatcgctacgcccttctcctccctacgactacccctacgctcgcctcctcccccgactccctctcgaaccttaatacctatccgcaactaccgacctctctctctctctcgatctcctcgttctctcctcccgtcatctctattcgctccctcccttcttcgtatctcgttctacctatcttcgcctttcatctccgccttcttcctccactcatcttctcgtacttctacgcttattatactcgctccctcgcctaaacgtttcgtcgtcgatacgaactctctcgtacgtcctactcgcgcccgccgaccgatccgcgcgtatcgtacgccgtccgcgtcctacgtctccttcgtcctaccctccgtccttctatacgtcccgactcccgaacgtcgcgcgccttacgccctaacgtcgatctacctcccgtcgtacttaaccacctcgcgtaaccccgccgccccgacgtacgctcctacgccgcgtcgtaatacgctcgacgcgtcgcccctaacgtcgtctccactacgcctatcgctcctatatccgtaacccgcgcgactaaacctacctatctcgtactactctcctatctcttccttccgtccgccttatccgtactatccctatatctctctcgcgacctcgacttacgtaaccgcctcccgctccttcgcgtatcgaaactaatcgttctactcgtttattactttcaattcgcgcctctcgtctctcgcgcctccgcgctcgcgcatcctcgcgaccgtcgaatccgtaccgctccgacgacgcgcgtcctttcgtccgtctcgccgctcgccgctctactcgcttctttccgctatttacgattacctaccgtctcgttaacttccctctcctcctctctctttctccccgcgcgtatccgtctatttcgcttctattctctctcccgttacgtctaccgtcgtcgatacgtatacctcgtactcctattatcgcgtccttcgtaccctccgcctaacgaccgtcgttcgtcttctatctcgcgtcgtttctatatactctatccgacgcctcgttccgcctcccctccgtctctattcttctcttactacttcgtcccgcgtatcacctac

SEQ ID NO: 35125 - DNA, 870 bp, Artificial Sequence
  chemically treated genomic DNA (Homo sapiens) CpG-island No: 35125
gggcggttcggcgaggcggatcgcgtggcggcggcgtacgggtattttaatttgggttaggtgagtgcggtcggtttcgcgcgtttaaaattttttcggcggttttcgggcgcgcgaggggggcgttttcgtagttttgttcgttcggtttcggtttcgcgcgcgcgtgggaaggtttcgggatcgtttggggacggcgggcggtcggggcgtttgcggggggggggtgtcgttcgggggggcgtcgcgcgggatattcggcggggtgggggggattggggtttcgcgtggggcgtttacgtaggttcggcgcgtcgatcgtaagtttttcggtagtgtcgtttaatttcgcgttcggaagtgtggttttagaagtcggggcggcgcggatatttgtcgggtttcgggggagtttgggttgttttagcgtcgcgcgtcgttcgtcgttgggttttgggcgtttattcggttttttttcgcggagcggtttttttgttttcgacgggcggcgcgagtttcggattcggtgcgcgcgtaaggggtcggtcgttgtttgggtgatatgagcgtggttcggcgtttcggggattcgcgttttttcggtgttcgcggttttcgggggtagatggtcgggagtttgtattttggagttcggtcgtcgtcggagaggttttgggatagcgtagggtcgggggttttgggtttaaaatttttttaggagcggagggagggcgttttgtgtgggggtttttgtcgcggttttgatggtcgagcggtgtgatttttggtaagtcgtttttttgataagtttttttgtagttagtggtaatgtttatatcgttgggttgtcggaaagatttaatgttgcgt

SEQ ID NO: 35126 - DNA, 870 bp, Artificial Sequence
  chemically treated genomic DNA (Homo sapiens) CpG-island No: 35126
acgcaacattaaatctttccgacaacccaacgatataaacattaccactaactacaaaaaaacttatcaaaaaaacgacttaccaaaaatcacaccgctcgaccatcaaaaccgcgacaaaaacccccacacaaaacgccctccctccgctcctaaaaaaattttaaacccaaaacccccgaccctacgctatcccaaaacctctccgacgacgaccgaactccaaaatacaaactcccgaccatctacccccgaaaaccgcgaacaccgaaaaaacgcgaatccccgaaacgccgaaccacgctcatatcacccaaacaacgaccgaccccttacgcgcgcaccgaatccgaaactcgcgccgcccgtcgaaaacaaaaaaaccgctccgcgaaaaaaaaccgaataaacgcccaaaacccaacgacgaacgacgcgcgacgctaaaacaacccaaactcccccgaaacccgacaaatatccgcgccgccccgacttctaaaaccacacttccgaacgcgaaattaaacgacactaccgaaaaacttacgatcgacgcgccgaacctacgtaaacgccccacgcgaaaccccaatcccccccaccccgccgaatatcccgcgcgacgcccccccgaacgacaccccccccccgcaaacgccccgaccgcccgccgtccccaaacgatcccgaaaccttcccacgcgcgcgcgaaaccgaaaccgaacgaacaaaactacgaaaacgcccccctcgcgcgcccgaaaaccgccgaaaaaattttaaacgcgcgaaaccgaccgcactcacctaacccaaattaaaatacccgtacgccgccgccacgcgatccgcctcgccgaaccgccc

SEQ ID NO: 35127 - DNA, 870 bp, Artificial Sequence
  chemically treated genomic DNA (Homo sapiens) CpG-island No: 35127
acgtagtattagattttttcgataatttagcggtgtagatattgttattgattgtaaaggagtttgttaggggagcgatttgttaaaggttatatcgttcggttattagaatcgcggtagaagtttttatataaagcgtttttttttcgtttttggagaggttttaaatttaggattttcggttttgcgttgttttaaggttttttcgacggcggtcgggttttagggtgtaggttttcggttatttattttcgggagtcgcggatatcgagggagcgcgagttttcgagacgtcgggttacgtttatgttatttaagtagcggtcggttttttgcgcgcgtatcgggttcggagttcgcgtcgttcgtcgagggtagaggggtcgtttcgcgggggagagtcgggtgggcgtttaggatttagcggcggacggcgcgcgacgttgaggtagtttagattttttcggagttcggtaggtgttcgcgtcgtttcggtttttgaggttatattttcgagcgcggggttgggcggtattgtcgggggatttgcggtcggcgcgtcggatttgcgtgggcgttttacgcgggattttagttttttttatttcgtcgagtgtttcgcgcggcgttttttcgggcgatatttttttttcgtaggcgtttcggtcgttcgtcgtttttaagcggtttcggagtttttttacgcgcgcgcggggtcggggtcgggcggataggattgcggaggcgtttttttcgcgcgttcggaggtcgtcgggaaagttttgggcgcgcggggtcggtcgtatttatttggtttaagttgaggtattcgtgcgtcgtcgttacgcggttcgtttcgtcgggtcgttt

SEQ ID NO: 35128 - DNA, 870 bp, Artificial Sequence
  chemically treated genomic DNA (Homo sapiens) CpG-island No: 35128
aaacgacccgacgaaacgaaccgcgtaacgacgacgcacgaatacctcaacttaaaccaaataaatacgaccgaccccgcgcgcccaaaactttcccgacgacctccgaacgcgcgaaaaaaacgcctccgcaatcctatccgcccgaccccgaccccgcgcgcgcgtaaaaaaactccgaaaccgcttaaaaacgacgaacgaccgaaacgcctacgaaaaaaaaatatcgcccgaaaaaacgccgcgcgaaacactcgacgaaataaaaaaaactaaaatcccgcgtaaaacgcccacgcaaatccgacgcgccgaccgcaaatcccccgacaataccgcccaaccccgcgctcgaaaatataacctcaaaaaccgaaacgacgcgaacacctaccgaactccgaaaaaatctaaactacctcaacgtcgcgcgccgtccgccgctaaatcctaaacgcccacccgactctcccccgcgaaacgacccctctaccctcgacgaacgacgcgaactccgaacccgatacgcgcgcaaaaaaccgaccgctacttaaataacataaacgtaacccgacgtctcgaaaactcgcgctccctcgatatccgcgactcccgaaaataaataaccgaaaacctacaccctaaaacccgaccgccgtcgaaaaaaccttaaaacaacgcaaaaccgaaaatcctaaatttaaaacctctccaaaaacgaaaaaaaaacgctttatataaaaacttctaccgcgattctaataaccgaacgatataacctttaacaaatcgctcccctaacaaactcctttacaatcaataacaatatctacaccgctaaattatcgaaaaaatctaatactacgt

SEQ ID NO: 35129 - DNA, 961 bp, Artificial Sequence
  chemically treated genomic DNA (Homo sapiens) CpG-island No: 35129
gcgtagttttttttcgcgggtagcgtattatgttgttcgggtgggcgtttttgttgttgtgcgcgtttcgtttgtttttggtcgcggtcggtttcgtcgcgatatttgtttaggataaagtcgggtagttttcgattgttgtagtagtcgtttagtttcgtcggcggtagggggaggaggtgtaggagcgagtcgagtttttcggttattcgtattttttggcgtagcggcgtaggagtaaggggttggtgtagaatatcgattaattttatttcggcggcggtaaggtgggttatttcgtttacgcgggcggtcggaggttttttttggatttggagcgagatggttcggtgggtattgttggtttcgtgttcgtaggaggcgggacgagtgcgttttggcgttatcggagttattgtttttatcggggtatagtggacgttagttttcgttttttggttgtttttgatttttgtgggggtttcgacggttttttcgcggttaagtacgcgcgttatattttaaagttattgttgcgcggattttgggcggaggaagaaaaggggcgcgtgtacggggatgggttcgtacggattttgtacgtttatattcgcgagggttttagttttgaggttttgtcgtcgcgcgttagttgcgaaattttcgcgtttatatcggaggtttacgagtatgtttcggcgtatagtaattcgagcggacgcgtagtattggtttcgtagtttttggattagttcgttttttcgttcgttgggggtttaggatcgtagacgtggtggcggcggcggcgtcgttttatttttcgggttcgttaggtggagttgtttttggtggttgacgcgtttatggcgcggttgtatggtcggggtttgtagtattatttgttgattttggtttttatcgttaataggttgtatagttatgttagtatcgagaattatat

SEQ ID NO: 35130 - DNA, 961 bp, Artificial Sequence
  chemically treated genomic DNA (Homo sapiens) CpG-island No: 35130
atataattctcgatactaacataactatacaacctattaacgataaaaaccaaaatcaacaaataatactacaaaccccgaccatacaaccgcgccataaacgcgtcaaccaccaaaaacaactccacctaacgaacccgaaaaataaaacgacgccgccgccgccaccacgtctacgatcctaaacccccaacgaacgaaaaaacgaactaatccaaaaactacgaaaccaatactacgcgtccgctcgaattactatacgccgaaacatactcgtaaacctccgatataaacgcgaaaatttcgcaactaacgcgcgacgacaaaacctcaaaactaaaaccctcgcgaatataaacgtacaaaatccgtacgaacccatccccgtacacgcgccccttttcttcctccgcccaaaatccgcgcaacaataactttaaaatataacgcgcgtacttaaccgcgaaaaaaccgtcgaaacccccacaaaaatcaaaaacaaccaaaaaacgaaaactaacgtccactataccccgataaaaacaataactccgataacgccaaaacgcactcgtcccgcctcctacgaacacgaaaccaacaatacccaccgaaccatctcgctccaaatccaaaaaaaacctccgaccgcccgcgtaaacgaaataacccaccttaccgccgccgaaataaaattaatcgatattctacaccaaccccttactcctacgccgctacgccaaaaaatacgaataaccgaaaaactcgactcgctcctacacctcctccccctaccgccgacgaaactaaacgactactacaacaatcgaaaactacccgactttatcctaaacaaatatcgcgacgaaaccgaccgcgaccaaaaacaaacgaaacgcgcacaacaacaaaaacgcccacccgaacaacataatacgctacccgcgaaaaaaaactacgc

SEQ ID NO: 35131 - DNA, 961 bp, Artificial Sequence
  chemically treated genomic DNA (Homo sapiens) CpG-island No: 35131
atgtggttttcgatgttagtatggttgtatagtttattggcgatggaggttagggttagtaggtaatgttgtaggtttcggttatataatcgcgttatggacgcgttagttattaaaagtagttttatttggcgggttcgggagatggagcggcgtcgtcgtcgttattacgtttgcggttttgagtttttagcgggcgaaagagcggattggtttaaaagttgcgaggttaatgttgcgcgttcgttcgggttgttgtgcgtcggaatatgttcgtgggttttcggtgtggacgcgggggtttcgtagttggcgcgcggcggtagggttttaaagttgaagttttcgcgggtgtagacgtgtaggattcgtgcggatttattttcgtatacgcgtttttttttttttttcgtttagggttcgcgtagtagtggttttagggtgtagcgcgcgtgtttgatcgcgaagaagtcgtcgagatttttatagaggttaaagatagttagagagcggggattagcgtttattgtgtttcgatagaagtagtggtttcggtggcgttagggcgtattcgtttcgttttttgcgggtacgaagttagtaatgtttatcgaattatttcgttttaggtttaagaggaattttcggtcgttcgcgtagacgaggtagtttattttgtcgtcgtcggagtagagttggtcgatgttttgtattagttttttgtttttgcgtcgttgcgttagggggtgcgggtggtcgggaggttcggttcgtttttgtattttttttttttgtcgtcggcggggttgggcggttgttgtagtagtcggaggttgttcggttttattttgggtaggtgtcgcggcggggtcgatcgcggttaggggtaggcggaacgcgtatagtagtagggacgtttattcgagtagtatagtgcgttgttcgcggggaggggttgcgt

SEQ ID NO: 35132 - DNA, 961 bp, Artificial Sequence
  chemically treated genomic DNA (Homo sapiens) CpG-island No: 35132
acgcaacccctccccgcgaacaacgcactatactactcgaataaacgtccctactactatacgcgttccgcctacccctaaccgcgatcgaccccgccgcgacacctacccaaaataaaaccgaacaacctccgactactacaacaaccgcccaaccccgccgacgacaaaaaaaaaaaatacaaaaacgaaccgaacctcccgaccacccgcaccccctaacgcaacgacgcaaaaacaaaaaactaatacaaaacatcgaccaactctactccgacgacgacaaaataaactacctcgtctacgcgaacgaccgaaaattcctcttaaacctaaaacgaaataattcgataaacattactaacttcgtacccgcaaaaaacgaaacgaatacgccctaacgccaccgaaaccactacttctatcgaaacacaataaacgctaatccccgctctctaactatctttaacctctataaaaatctcgacgacttcttcgcgatcaaacacgcgcgctacaccctaaaaccactactacgcgaaccctaaacgaaaaaaaaaaaaaaacgcgtatacgaaaataaatccgcacgaatcctacacgtctacacccgcgaaaacttcaactttaaaaccctaccgccgcgcgccaactacgaaacccccgcgtccacaccgaaaacccacgaacatattccgacgcacaacaacccgaacgaacgcgcaacattaacctcgcaacttttaaaccaatccgctctttcgcccgctaaaaactcaaaaccgcaaacgtaataacgacgacgacgccgctccatctcccgaacccgccaaataaaactacttttaataactaacgcgtccataacgcgattatataaccgaaacctacaacattacctactaaccctaacctccatcgccaataaactatacaaccatactaacatcgaaaaccacat

SEQ ID NO: 35133 - DNA, 957 bp, Artificial Sequence
  chemically treated genomic DNA (Homo sapiens) CpG-island No: 35133
gcgttatggacgcgttagttattaaaagtagttttatttggcgggttcgggagatggagcggcgtcgtcgtcgttattacgtttgcggttttgagtttttagcgggcgaaagagcggattggtttaagagttgcgaggttagtgttgcgcgttcgttcgggttgttgtgcgtcggagtatgttcgtgggttttcggtgtggacgcgggggtttcgtagttggcgcgcggcggtagggtttcgaagttgaagttttcgcgggtgtagacgtgtaggattcgtgcggatttattttcgtatacgcgtttttttttttttttcgtttagggttcgcgtagtagtggttttagggtgtagcgcgcgtgtttgatcgcgaagaagtcgtcgagatttttatagaggttaaagatagttagagagcggggattagcgtttattgtgtttcgatagaagtagtggtttcggtggcgttagggcgtattcgtttcgttttttgcgggtacgaagttagtaatgtttatcgaattatttcgttttaggtttaagaggaattttcggtcgttcgcgtagacgaggtagttttttttgtcgtcgtcggagtagagttggtcgatgttttgtattagttttttgtttttgcgtcgttgcgttagggggtgcgggtggtcgggaggttcggttcgtttttgtattttttttttttgtcgtcggcggggttgggcggttgttgtagtagtcggaggttgttcggttttattttgggtaggtgtcgcggcggggtcgatcgcggttaggggtaggcggaacgcgtatagtagtagggacgtttattcgagtagtatagtgcgttgttcgcggggaggggttgcgcgattgggattttatgggtatttgttatttgttatgaagttaacggggcgggggatggggatatatatatatttgtttgtaggattga

SEQ ID NO: 35134 - DNA, 957 bp, Artificial Sequence
  chemically treated genomic DNA (Homo sapiens) CpG-island No: 35134
tcaatcctacaaacaaatatatatatatccccatcccccgccccgttaacttcataacaaataacaaatacccataaaatcccaatcgcgcaacccctccccgcgaacaacgcactatactactcgaataaacgtccctactactatacgcgttccgcctacccctaaccgcgatcgaccccgccgcgacacctacccaaaataaaaccgaacaacctccgactactacaacaaccgcccaaccccgccgacgacaaaaaaaaaaaatacaaaaacgaaccgaacctcccgaccacccgcaccccctaacgcaacgacgcaaaaacaaaaaactaatacaaaacatcgaccaactctactccgacgacgacaaaaaaaactacctcgtctacgcgaacgaccgaaaattcctcttaaacctaaaacgaaataattcgataaacattactaacttcgtacccgcaaaaaacgaaacgaatacgccctaacgccaccgaaaccactacttctatcgaaacacaataaacgctaatccccgctctctaactatctttaacctctataaaaatctcgacgacttcttcgcgatcaaacacgcgcgctacaccctaaaaccactactacgcgaaccctaaacgaaaaaaaaaaaaaaacgcgtatacgaaaataaatccgcacgaatcctacacgtctacacccgcgaaaacttcaacttcgaaaccctaccgccgcgcgccaactacgaaacccccgcgtccacaccgaaaacccacgaacatactccgacgcacaacaacccgaacgaacgcgcaacactaacctcgcaactcttaaaccaatccgctctttcgcccgctaaaaactcaaaaccgcaaacgtaataacgacgacgacgccgctccatctcccgaacccgccaaataaaactacttttaataactaacgcgtccataacgc

SEQ ID NO: 35135 - DNA, 957 bp, Artificial Sequence
  chemically treated genomic DNA (Homo sapiens) CpG-island No: 35135
ttaattttgtaagtaagtgtgtgtgtgtttttatttttcgtttcgttaattttatagtaaataataaatatttataaagttttagtcgcgtagttttttttcgcgggtagcgtattatgttgttcgggtgggcgtttttgttgttgtgcgcgtttcgtttgtttttggtcgcggtcggtttcgtcgcgatatttgtttaggataaagtcgggtagttttcgattgttgtagtagtcgtttagtttcgtcggcggtagggggaggaggtgtaggagcgagtcgagtttttcggttattcgtattttttggcgtagcggcgtaggagtaaggggttggtgtaaaatatcgattaattttatttcggcggcggtaaggggggttatttcgtttacgcgggcggtcggaggttttttttggatttggagcgagatggttcggtgggtattgttggtttcgtgttcgtaggaggcgggacgagtgcgttttggcgttatcggagttattgtttttatcggggtatagtggacgttagttttcgttttttggttgtttttgatttttgtgggggtttcgacggttttttcgcggttaagtacgcgcgttatattttaaagttattgttgcgcggattttgggcggaggaagaaaaggggcgcgtgtacggggatgggttcgtacggattttgtacgtttatattcgcgagggttttagtttcgaggttttgtcgtcgcgcgttagttgcgaaattttcgcgtttatatcggaggtttacgagtatgtttcggcgtatagtaattcgagcggacgcgtagtattggtttcgtagtttttggattagttcgttttttcgttcgttgggggtttaggatcgtaaacgtggtggcggcggcggcgtcgttttatttttcgggttcgttaggtggagttgtttttggtggttgacgcgtttatggcgt

SEQ ID NO: 35136 - DNA, 957 bp, Artificial Sequence
  chemically treated genomic DNA (Homo sapiens) CpG-island No: 35136
acgccataaacgcgtcaaccaccaaaaacaactccacctaacgaacccgaaaaataaaacgacgccgccgccgccaccacgtttacgatcctaaacccccaacgaacgaaaaaacgaactaatccaaaaactacgaaaccaatactacgcgtccgctcgaattactatacgccgaaacatactcgtaaacctccgatataaacgcgaaaatttcgcaactaacgcgcgacgacaaaacctcgaaactaaaaccctcgcgaatataaacgtacaaaatccgtacgaacccatccccgtacacgcgccccttttcttcctccgcccaaaatccgcgcaacaataactttaaaatataacgcgcgtacttaaccgcgaaaaaaccgtcgaaacccccacaaaaatcaaaaacaaccaaaaaacgaaaactaacgtccactataccccgataaaaacaataactccgataacgccaaaacgcactcgtcccgcctcctacgaacacgaaaccaacaatacccaccgaaccatctcgctccaaatccaaaaaaaacctccgaccgcccgcgtaaacgaaataaccccccttaccgccgccgaaataaaattaatcgatattttacaccaaccccttactcctacgccgctacgccaaaaaatacgaataaccgaaaaactcgactcgctcctacacctcctccccctaccgccgacgaaactaaacgactactacaacaatcgaaaactacccgactttatcctaaacaaatatcgcgacgaaaccgaccgcgaccaaaaacaaacgaaacgcgcacaacaacaaaaacgcccacccgaacaacataatacgctacccgcgaaaaaaaactacgcgactaaaactttataaatatttattatttactataaaattaacgaaacgaaaaataaaaacacacacacacttacttacaaaattaa

SEQ ID NO: 35137 - DNA, 739 bp, Artificial Sequence
  chemically treated genomic DNA (Homo sapiens) CpG-island No: 35137
gtcgagttcgttttcgtaattttttttattttgtttggggtttcgtcgtttcggtttttattgttatgtttcgcgtttcggtgtttttattttagatttgttgttattattttcgggttcggcgtcgtcgtcgtcgtttttttttttatatttgtttttgagtcgtttttttgtggtttgtttttcggcggatttttgggttcggtcgttgagtgtcggattcggttgtgcgtagtttttgttcgcggtttcggcgttgcgttttattttttacgtaggatttcgtcgttcggcgttataaggattttttcgcggtcgtcgtcgttgttgttgttcgaggtgcggtttttgttaggggtggttaatcgtatcggattgcgtcgagtacgtttcgttttatcgttttagttcgttcgttttttgtttcggattacgttttaagttcggttttaataggttttttattgattttttttgatcgcggggtatagggtcggggtcgtatataggtatttgattgatggagtttgggaagtcgagcggtcgatggaattcgaggattggcggagttgtcgatgggcgggatagggtagggcggggtttttttagacgcggaagattttgtaattttagtaatttacgggttcgtttggggtgcggttagttttgtttgtgttgtttttcggttaaagtttatggcgtttttttttacgtttttattttttttgggagattttta

SEQ ID NO: 35138 - DNA, 739 bp, Artificial Sequence
  chemically treated genomic DNA (Homo sapiens) CpG-island No: 35138
taaaaatctcccaaaaaaaataaaaacgtaaaaaaaaacgccataaactttaaccgaaaaacaacacaaacaaaactaaccgcaccccaaacgaacccgtaaattactaaaattacaaaatcttccgcgtctaaaaaaaccccgccctaccctatcccgcccatcgacaactccgccaatcctcgaattccatcgaccgctcgacttcccaaactccatcaatcaaatacctatatacgaccccgaccctataccccgcgatcaaaaaaaatcaataaaaaacctattaaaaccgaacttaaaacgtaatccgaaacaaaaaacgaacgaactaaaacgataaaacgaaacgtactcgacgcaatccgatacgattaaccacccctaacaaaaaccgcacctcgaacaacaacaacgacgacgaccgcgaaaaaatccttataacgccgaacgacgaaatcctacgtaaaaaataaaacgcaacgccgaaaccgcgaacaaaaactacgcacaaccgaatccgacactcaacgaccgaacccaaaaatccgccgaaaaacaaaccacaaaaaaacgactcaaaaacaaatataaaaaaaaaaacgacgacgacgacgccgaacccgaaaataataacaacaaatctaaaataaaaacaccgaaacgcgaaacataacaataaaaaccgaaacgacgaaaccccaaacaaaataaaaaaaattacgaaaacgaactcgac

SEQ ID NO: 35139 - DNA, 739 bp, Artificial Sequence
  chemically treated genomic DNA (Homo sapiens) CpG-island No: 35139
tgggaattttttaagaaaagtaaaggcgtggggagaagcgttatgaattttgatcggagagtagtataaataagattgatcgtattttaggcgggttcgtaggttattaaagttgtaaggtttttcgcgtttgaggagatttcgttttgttttgtttcgtttatcgataatttcgttaattttcgggttttatcgatcgttcggttttttaggttttattaattaaatatttatatacggtttcggttttgtgtttcgcgattagggaaggttagtagagagtttattggagtcgagtttggggcgtggttcggggtagggggcgggcggattgagacggtggggcggggcgtgttcggcgtagttcggtgcgattggttatttttggtaggagtcgtatttcggatagtagtagcggcggcggtcgcgggagggtttttgtggcgtcgggcggcggggttttgcgtggagagtgggacgtaacgtcgagatcgcgagtagaggttgcgtatagtcggattcggtatttagcgatcggatttaaggattcgtcggggaataagttataggagagcgatttaggaataagtgtgggagaggaagcggcggcggcggcgtcgggttcgggggtggtgatagtaggtttgaggtgagagtatcggggcgcggggtatgatagtgggagtcgaggcggcgggattttaggtagagtgaggggagttgcgggagcgggttcgat

SEQ ID NO: 35140 - DNA, 739 bp, Artificial Sequence
  chemically treated genomic DNA (Homo sapiens) CpG-island No: 35140
atcgaacccgctcccgcaactcccctcactctacctaaaatcccgccgcctcgactcccactatcataccccgcgccccgatactctcacctcaaacctactatcaccacccccgaacccgacgccgccgccgccgcttcctctcccacacttattcctaaatcgctctcctataacttattccccgacgaatccttaaatccgatcgctaaataccgaatccgactatacgcaacctctactcgcgatctcgacgttacgtcccactctccacgcaaaaccccgccgcccgacgccacaaaaaccctcccgcgaccgccgccgctactactatccgaaatacgactcctaccaaaaataaccaatcgcaccgaactacgccgaacacgccccgccccaccgtctcaatccgcccgccccctaccccgaaccacgccccaaactcgactccaataaactctctactaaccttccctaatcgcgaaacacaaaaccgaaaccgtatataaatatttaattaataaaacctaaaaaaccgaacgatcgataaaacccgaaaattaacgaaattatcgataaacgaaacaaaacaaaacgaaatctcctcaaacgcgaaaaaccttacaactttaataacctacgaacccgcctaaaatacgatcaatcttatttatactactctccgatcaaaattcataacgcttctccccacgcctttacttttcttaaaaaattccca

SEQ ID NO: 35141 - DNA, 974 bp, Artificial Sequence
  chemically treated genomic DNA (Homo sapiens) CpG-island No: 35141
gagtgtaacgtatttagggttttttcgttattttagtacggatgggggtaattttttcgagtttcgtaattttcggcggtttttttacgtagttttaggtttcggaggtcgtttcgtttttttttcgaatagttttattttttttcgtagcggttttattttcgtttcgggcggtcggtcgagcggtaggatttattttcgttcgattcgcggtttcgatagttgcgttcgtcgttttcggcgttttttagttttttatttttttcggggtagtattcgggggtcggcggcgttttagtttgggtcggggtcggggttagtagttcgcggtatttatgtcgtttttgatcgtagttgagcgtggtttacggatatcgcggttattcgcgttcggtattcgtcgtttgtttagtagtgttcgcggtagtttttaattcgaggatcggtagttacggcgatttttttttcgttttcgtcgagtttcgtttttcgcgttcgcgttcggtaacgggggtttcgcgtcgcgagcgattttcgggtcgagagttgttcgataacggtttgatttcgttatttttgggggagtggagatgtcgttggacgttttcgtcgttataattttagtttttttatcgtcgttttaaaatttttaacgtatagtgggggaggggcggagttaggttcgttagagttaggtaaatttacgggtaggtttagtagcggttaggatttcgaggttcgtaggcgattttcggagatagtcgttaggcggcgtttggagttagaattaaagcggtgatcgttagcgatttaggggcggagggtttgaagggtttttggtaggtggaggtggtttttaatttaagtagggaacgacgcgatttgtttttttattaggtcggaaaatttagacgtttagagtgtgcgtgattatgtagtttggttttttttgtgattagttagagttttattaa

SEQ ID NO: 35142 - DNA, 974 bp, Artificial Sequence
  chemically treated genomic DNA (Homo sapiens) CpG-island No: 35142
ttaataaaactctaactaatcacaaaaaaaaccaaactacataatcacgcacactctaaacgtctaaattttccgacctaataaaaaaacaaatcgcgtcgttccctacttaaattaaaaaccacctccacctaccaaaaacccttcaaaccctccgcccctaaatcgctaacgatcaccgctttaattctaactccaaacgccgcctaacgactatctccgaaaatcgcctacgaacctcgaaatcctaaccgctactaaacctacccgtaaatttacctaactctaacgaacctaactccgcccctcccccactatacgttaaaaattttaaaacgacgataaaaaaactaaaattataacgacgaaaacgtccaacgacatctccactcccccaaaaataacgaaatcaaaccgttatcgaacaactctcgacccgaaaatcgctcgcgacgcgaaacccccgttaccgaacgcgaacgcgaaaaacgaaactcgacgaaaacgaaaaaaaaatcgccgtaactaccgatcctcgaattaaaaactaccgcgaacactactaaacaaacgacgaataccgaacgcgaataaccgcgatatccgtaaaccacgctcaactacgatcaaaaacgacataaataccgcgaactactaaccccgaccccgacccaaactaaaacgccgccgacccccgaatactaccccgaaaaaaataaaaaactaaaaaacgccgaaaacgacgaacgcaactatcgaaaccgcgaatcgaacgaaaataaatcctaccgctcgaccgaccgcccgaaacgaaaataaaaccgctacgaaaaaaaataaaactattcgaaaaaaaaacgaaacgacctccgaaacctaaaactacgtaaaaaaaccgccgaaaattacgaaactcgaaaaaattacccccatccgtactaaaataacgaaaaaaccctaaatacgttacactc

SEQ ID NO: 35143 - DNA, 974 bp, Artificial Sequence
  chemically treated genomic DNA (Homo sapiens) CpG-island No: 35143
ttaataaagttttaattagttataggaggagttaggttgtatgattacgtatattttggacgtttaggtttttcgatttaataagggggtaggtcgcgtcgttttttgtttaaattagagattatttttatttgttaagggttttttaaatttttcgtttttaggtcgttaacgattatcgttttagttttagttttaggcgtcgtttggcggttgttttcggaagtcgtttgcgagtttcggggttttgatcgttgttgggtttgttcgtagatttgtttgattttagcgaatttggtttcgttttttttttattatacgttgaggattttaagacggcgatgaaagggttgaggttgtggcgacgggggcgtttagcggtatttttatttttttaaggatggcggaattaggtcgttgtcgggtagttttcgattcggaagtcgttcgcggcgcgaggttttcgttgtcgagcgcgggcgcggggggcggagttcggcggagacggggaaggggtcgtcgtggttgtcggttttcgagttgggggttgtcgcggatattgttaggtagacggcgagtatcgagcgcgggtggtcgcggtgttcgtgggttacgtttagttgcggttagaggcgatatgagtgtcgcgggttgttggtttcggtttcggtttaggttggagcgtcgtcggttttcgagtattatttcgaggaggatgaagagttggagagcgtcgaggacgacgagcgtagttgtcggggtcgcgagtcggacgaaggtgagttttgtcgttcggtcggtcgttcggagcggaggtgggatcgttgcgggagggggtggggttgttcgggagaggggcgggacggttttcggggtttggggttgcgtggaggggtcgtcgggagttgcggggttcggggaagttatttttattcgtgttggagtagcggggaagttttgggtgcgttatattt

SEQ ID NO: 35144 - DNA, 974 bp, Artificial Sequence
  chemically treated genomic DNA (Homo sapiens) CpG-island No: 35144
aaatataacgcacccaaaacttccccgctactccaacacgaataaaaataacttccccgaaccccgcaactcccgacgacccctccacgcaaccccaaaccccgaaaaccgtcccgcccctctcccgaacaaccccaccccctcccgcaacgatcccacctccgctccgaacgaccgaccgaacgacaaaactcaccttcgtccgactcgcgaccccgacaactacgctcgtcgtcctcgacgctctccaactcttcatcctcctcgaaataatactcgaaaaccgacgacgctccaacctaaaccgaaaccgaaaccaacaacccgcgacactcatatcgcctctaaccgcaactaaacgtaacccacgaacaccgcgaccacccgcgctcgatactcgccgtctacctaacaatatccgcgacaacccccaactcgaaaaccgacaaccacgacgaccccttccccgtctccgccgaactccgccccccgcgcccgcgctcgacaacgaaaacctcgcgccgcgaacgacttccgaatcgaaaactacccgacaacgacctaattccgccatccttaaaaaaataaaaataccgctaaacgcccccgtcgccacaacctcaaccctttcatcgccgtcttaaaatcctcaacgtataataaaaaaaaaacgaaaccaaattcgctaaaatcaaacaaatctacgaacaaacccaacaacgatcaaaaccccgaaactcgcaaacgacttccgaaaacaaccgccaaacgacgcctaaaactaaaactaaaacgataatcgttaacgacctaaaaacgaaaaatttaaaaaacccttaacaaataaaaataatctctaatttaaacaaaaaacgacgcgacctacccccttattaaatcgaaaaacctaaacgtccaaaatatacgtaatcatacaacctaactcctcctataactaattaaaactttattaa

SEQ ID NO: 35145 - DNA, 712 bp, Artificial Sequence
  chemically treated genomic DNA (Homo sapiens) CpG-island No: 35145
atcggcgcggtacgttcgggcgcgttttaggagaggtcggcgcgtagtagtcgcgcgtgtacgtattttcggtttagcgttttggtttgggttattagttttttgtttgtgggcgagcggttaaaggcgtttatgatttcggcggcgaagatcgaggagcgtcgtagtatttttatggcggcgacgcgggtggggggcgtcgtatttgcgggtataagcgtttagtcgggtggagggaggcggcgcggggaacggggcgcgcggggcgtcgggttgggcgtggttttcgggaagggtcgtagtcggcgtcgggttcgttttcgttttttgtgttttaaatttttaaaaatttagcgttatttttttttagagttcgaatttagttatagatatttttcgaggttgttagggatcggtggggtcgcggggagacggcggtttgtttcggggtcgtcgggttcgttttcgaagacgagtgcgtgggcggcgggggcggagggtatagtttagcgcgttttttacggcgattgttaggattcggtttttttcgtttcggttcggggtcgtttattttcgtcgttggcgttttgcgcgcgtgttttcggtttcgtcgttttcgtggtatttcgggtatttcggtacggacgttacgttcgtcgcgtttatttttttcgtcgtatggcgcgggcgtcggggtggagttttggtttta

SEQ ID NO: 35146 - DNA, 712 bp, Artificial Sequence
  chemically treated genomic DNA (Homo sapiens) CpG-island No: 35146
taaaaccaaaactccaccccgacgcccgcgccatacgacgaaaaaaataaacgcgacgaacgtaacgtccgtaccgaaatacccgaaataccacgaaaacgacgaaaccgaaaacacgcgcgcaaaacgccaacgacgaaaataaacgaccccgaaccgaaacgaaaaaaaccgaatcctaacaatcgccgtaaaaaacgcgctaaactataccctccgcccccgccgcccacgcactcgtcttcgaaaacgaacccgacgaccccgaaacaaaccgccgtctccccgcgaccccaccgatccctaacaacctcgaaaaatatctataactaaattcgaactctaaaaaaaaataacgctaaatttttaaaaatttaaaacacaaaaaacgaaaacgaacccgacgccgactacgacccttcccgaaaaccacgcccaacccgacgccccgcgcgccccgttccccgcgccgcctccctccacccgactaaacgcttatacccgcaaatacgacgccccccacccgcgtcgccgccataaaaatactacgacgctcctcgatcttcgccgccgaaatcataaacgcctttaaccgctcgcccacaaacaaaaaactaataacccaaaccaaaacgctaaaccgaaaatacgtacacgcgcgactactacgcgccgacctctcctaaaacgcgcccgaacgtaccgcgccgat

SEQ ID NO: 35147 - DNA, 712 bp, Artificial Sequence
  chemically treated genomic DNA (Homo sapiens) CpG-island No: 35147
tgaagttagaattttatttcggcgttcgcgttatgcggcgggagaggtgagcgcggcgggcgtggcgttcgtgtcggggtgttcggggtgttacgggaacggcgaggtcggggatacgcgcgtaggacgttagcggcggaggtgggcggtttcgggtcggggcggggagggtcgggttttggtagtcgtcgtgggggacgcgttgggttgtgtttttcgttttcgtcgtttacgtattcgttttcgagggcgggttcggcggtttcggagtaaatcgtcgttttttcgcggttttatcggtttttggtagtttcggggaatgtttgtagttgaattcgggttttgaaagaaggtggcgttgggtttttaaagatttggggtataaaaaacgagagcggattcggcgtcggttacggtttttttcgagggttacgtttagttcggcgtttcgcgcgtttcgtttttcgcgtcgtttttttttattcggttgagcgtttgtgttcgtaggtgcggcgttttttattcgcgtcgtcgttatggaggtgttgcggcgtttttcggttttcgtcgtcgagattatggacgtttttgatcgttcgtttatagataaggagttggtggtttaggttaaggcgttgggtcgggagtacgtgtacgcgcggttgttgcgcgtcggttttttttggagcgcgttcgagcgtgtcgcgtcggt

SEQ ID NO: 35148 - DNA, 712 bp, Artificial Sequence
  chemically treated genomic DNA (Homo sapiens) CpG-island No: 35148
accgacgcgacacgctcgaacgcgctccaaaaaaaaccgacgcgcaacaaccgcgcgtacacgtactcccgacccaacgccttaacctaaaccaccaactccttatctataaacgaacgatcaaaaacgtccataatctcgacgacgaaaaccgaaaaacgccgcaacacctccataacgacgacgcgaataaaaaacgccgcacctacgaacacaaacgctcaaccgaataaaaaaaaacgacgcgaaaaacgaaacgcgcgaaacgccgaactaaacgtaaccctcgaaaaaaaccgtaaccgacgccgaatccgctctcgttttttataccccaaatctttaaaaacccaacgccaccttctttcaaaacccgaattcaactacaaacattccccgaaactaccaaaaaccgataaaaccgcgaaaaaacgacgatttactccgaaaccgccgaacccgccctcgaaaacgaatacgtaaacgacgaaaacgaaaaacacaacccaacgcgtcccccacgacgactaccaaaacccgaccctccccgccccgacccgaaaccgcccacctccgccgctaacgtcctacgcgcgtatccccgacctcgccgttcccgtaacaccccgaacaccccgacacgaacgccacgcccgccgcgctcacctctcccgccgcataacgcgaacgccgaaataaaattctaacttca

SEQ ID NO: 35149 - DNA, 757 bp, Artificial Sequence
  chemically treated genomic DNA (Homo sapiens) CpG-island No: 35149
ggcgttttaaggttagtgttcgaggtcggttcgtagtcgttgtcgagatcgggtaagatggatcgggtatttcggggcggtttttcgagtttgggagttatcgagttcggagtttttttacgggtcggttttaatgttatttggtttcgaggtttattcggtgttttttgttgaagtcgagcggttaggttgcggacgtgtagatttgatggttttcggtttttcgattcggttcggtttggcggcgtcgtatcggttattttttgttttatttgtcgttattgttcgtcgcgatcgttttttatattcggtgtttcgcgatcggaagagagtaaggtcgcgtcgcggagtattacgggatcgaggaagatttcgttcgtattcggtcgtacggaggttatcgtggagcggaaaagggtagcgttgcgaacgtcgtaaaatgtcgggtcgggttgtttttcggtaggcgttggagaggttgtttttcggcggcgtcgggcgagaagcgcgattggagtttggggttgcggttttttagaggcgcgagtcgtttttttaggagtcgaggtttaaacggggtcgggtttgaagggtttttcggttagttcgcggtcgcgttattaatcgtcgtcgtttcgtttcgtttttcggttgaggcgtcgcgcggttaggtagcgggtttaggttttagtcgcgcgtttaggggttttcggggttttttcgggttagtatgttcggggtgaaattgattatttag

SEQ ID NO: 35150 - DNA, 757 bp, Artificial Sequence
  chemically treated genomic DNA (Homo sapiens) CpG-island No: 35150
ctaaataatcaatttcaccccgaacatactaacccgaaaaaaccccgaaaacccctaaacgcgcgactaaaacctaaacccgctacctaaccgcgcgacgcctcaaccgaaaaacgaaacgaaacgacgacgattaataacgcgaccgcgaactaaccgaaaaacccttcaaacccgaccccgtttaaacctcgactcctaaaaaaacgactcgcgcctctaaaaaaccgcaaccccaaactccaatcgcgcttctcgcccgacgccgccgaaaaacaacctctccaacgcctaccgaaaaacaacccgacccgacattttacgacgttcgcaacgctacccttttccgctccacgataacctccgtacgaccgaatacgaacgaaatcttcctcgatcccgtaatactccgcgacgcgaccttactctcttccgatcgcgaaacaccgaatataaaaaacgatcgcgacgaacaataacgacaaataaaacaaaaaataaccgatacgacgccgccaaaccgaaccgaatcgaaaaaccgaaaaccatcaaatctacacgtccgcaacctaaccgctcgacttcaacaaaaaacaccgaataaacctcgaaaccaaataacattaaaaccgacccgtaaaaaaactccgaactcgataactcccaaactcgaaaaaccgccccgaaatacccgatccatcttacccgatctcgacaacgactacgaaccgacctcgaacactaaccttaaaacgcc

SEQ ID NO: 35151 - DNA, 757 bp, Artificial Sequence
  chemically treated genomic DNA (Homo sapiens) CpG-island No: 35151
ttgggtggttagttttatttcgggtatgttgattcgggagggtttcggaggtttttgggcgcgcggttgaggtttggattcgttgtttggtcgcgcggcgttttagtcgagaagcgggacgaggcggcggcgattgatggcgcggtcgcgggttggtcgggggattttttaggttcggtttcgtttgggtttcggtttttggaaaagcgattcgcgtttttgggaagtcgtagttttagattttagtcgcgtttttcgttcggcgtcgtcggaaagtagtttttttaacgtttgtcggaaagtagttcggttcggtattttacgacgttcgtagcgttattttttttcgttttacggtgattttcgtgcggtcgggtgcgggcggagtttttttcgatttcgtggtgtttcgcggcgcggttttgttttttttcggtcgcgggatatcgggtgtagagggcggtcgcggcgggtagtggcggtaggtgagataggaggtggtcggtgcggcgtcgttaggtcgggtcgggtcggggggtcgggagttattaagtttgtacgttcgtagtttggtcgttcggttttagtaggaagtatcgaatgggtttcggagttaggtgatattgaggtcggttcgtgggggaatttcgggttcggtggtttttaggttcggggggtcgtttcgaagtgttcggtttattttattcggtttcgatagcggttgcggatcggtttcgggtattgattttggagcgtt

SEQ ID NO: 35152 - DNA, 757 bp, Artificial Sequence
  chemically treated genomic DNA (Homo sapiens) CpG-island No: 35152
aacgctccaaaatcaatacccgaaaccgatccgcaaccgctatcgaaaccgaataaaataaaccgaacacttcgaaacgaccccccgaacctaaaaaccaccgaacccgaaattcccccacgaaccgacctcaatatcacctaactccgaaacccattcgatacttcctactaaaaccgaacgaccaaactacgaacgtacaaacttaataactcccgaccccccgacccgacccgacctaacgacgccgcaccgaccacctcctatctcacctaccgccactacccgccgcgaccgccctctacacccgatatcccgcgaccgaaaaaaaacaaaaccgcgccgcgaaacaccacgaaatcgaaaaaaactccgcccgcacccgaccgcacgaaaatcaccgtaaaacgaaaaaaaataacgctacgaacgtcgtaaaataccgaaccgaactactttccgacaaacgttaaaaaaactactttccgacgacgccgaacgaaaaacgcgactaaaatctaaaactacgacttcccaaaaacgcgaatcgcttttccaaaaaccgaaacccaaacgaaaccgaacctaaaaaatcccccgaccaacccgcgaccgcgccatcaatcgccgccgcctcgtcccgcttctcgactaaaacgccgcgcgaccaaacaacgaatccaaacctcaaccgcgcgcccaaaaacctccgaaaccctcccgaatcaacatacccgaaataaaactaaccacccaa

SEQ ID NO: 35153 - DNA, 1468 bp, Artificial Sequence
  chemically treated genomic DNA (Homo sapiens) CpG-island No: 35153
ttcgcgttgggatcggattttcgaaaaattcggaagcggcgggcgagggatttcgcgggtttgttcggtttggggtcgttcggatagatttttcgttcgttcggtagttcggcgtttttcgtttgttattttttttagtattttgtttcggtagtagcgttttttagtcgtggggtcgacgataattcgcgagattttcggtttcgagtgcgaatggtggtgatggtggtgaggggtcgtcgggggtatttgcgtttgggattgaggtggttgcgatttttcggggggttgcggcggtcgtttttttttcgagttcgtttcgtaatttttgtttagcgtttgttcgtatattttggtgttggcggttggttggtaggtgatagttcgtaaaagttttatggtcgttttgtcgtttcgtattgttcgttgttattttttaggcgcggttatacgttcgagtcggtcgtggttttcgtatttttgtttttggtgtcgattagtatttaatatttcggtttatttgtgcgagtgagagcgttcggcgaagttttatatacggggaggcgggaagggggcggagattcgatacgcgatattacgttacggtttatgtttcgttttacggtcggtcgagcgcgcgtggtcgggaagtaagttttgtttcgttattcgggtttcgttttttagcggagtcgcgcgttttaaacgtcggtcgtcgagattttttgcggtcgcgggaaggtttttagagtcgttcgtgggtttcgttgtttcgtttttcgaaggtttcgagttttagcgtataaaatagaatcgcgagggtcgacgtttggttttattttcgttttagtcgtttggtggtagggtagtgtcgtgattcgagcgagtcgggcgcgggtgtagacgtagtttttttttcgtatagtttttttcggtcgttcggggttttttgtgttaaggtattagggtgttcggagttcgtcgtacgggtaggcgaggtttttttcggtcgtatgatagggttcgtttgtagttgtttcgtagtgtttgttcgcgttgtgacgagttcgttggtgtttagttggggtagtgtcgagaggtcgtgggggtgaaaggtcgggattcgtggagtcgggtattcgagtttatcgcgttagggtagatacgggttcgtagtcgggatttcgggtcgatcggttaatcgtgttaggattttattcgaggttcgtttggttttcgtttatgtttttagagcgagtttttgtttgaggtcggtttttgaattttgtagagcgaggtcggcgttttggtaaggcgtttttcgttcgtagttcgaagattggaaagtaagggcgttattttgtggaatgtttcggaatgtcgttaggtgtcgaagtgggtagcggttgataatcgtgggtttttgatagttattagtattaaatatcgatgtcgattgtgagttttt

SEQ ID NO: 35154 - DNA, 1468 bp, Artificial Sequence
  chemically treated genomic DNA (Homo sapiens) CpG-island No: 35154
aaaaactcacaatcgacatcgatatttaatactaataactatcaaaaacccacgattatcaaccgctacccacttcgacacctaacgacattccgaaacattccacaaaataacgcccttactttccaatcttcgaactacgaacgaaaaacgccttaccaaaacgccgacctcgctctacaaaattcaaaaaccgacctcaaacaaaaactcgctctaaaaacataaacgaaaaccaaacgaacctcgaataaaatcctaacacgattaaccgatcgacccgaaatcccgactacgaacccgtatctaccctaacgcgataaactcgaatacccgactccacgaatcccgacctttcacccccacgacctctcgacactaccccaactaaacaccaacgaactcgtcacaacgcgaacaaacactacgaaacaactacaaacgaaccctatcatacgaccgaaaaaaacctcgcctacccgtacgacgaactccgaacaccctaataccttaacacaaaaaaccccgaacgaccgaaaaaaactatacgaaaaaaaaactacgtctacacccgcgcccgactcgctcgaatcacgacactaccctaccaccaaacgactaaaacgaaaataaaaccaaacgtcgaccctcgcgattctattttatacgctaaaactcgaaaccttcgaaaaacgaaacaacgaaacccacgaacgactctaaaaaccttcccgcgaccgcaaaaaatctcgacgaccgacgtttaaaacgcgcgactccgctaaaaaacgaaacccgaataacgaaacaaaacttacttcccgaccacgcgcgctcgaccgaccgtaaaacgaaacataaaccgtaacgtaatatcgcgtatcgaatctccgcccccttcccgcctccccgtatataaaacttcgccgaacgctctcactcgcacaaataaaccgaaatattaaatactaatcgacaccaaaaacaaaaatacgaaaaccacgaccgactcgaacgtataaccgcgcctaaaaaataacaacgaacaatacgaaacgacaaaacgaccataaaacttttacgaactatcacctaccaaccaaccgccaacaccaaaatatacgaacaaacgctaaacaaaaattacgaaacgaactcgaaaaaaaaacgaccgccgcaaccccccgaaaaatcgcaaccacctcaatcccaaacgcaaatacccccgacgacccctcaccaccatcaccaccattcgcactcgaaaccgaaaatctcgcgaattatcgtcgaccccacgactaaaaaacgctactaccgaaacaaaatactaaaaaaaataacaaacgaaaaacgccgaactaccgaacgaacgaaaaatctatccgaacgaccccaaaccgaacaaacccgcgaaatccctcgcccgccgcttccgaatttttcgaaaatccgatcccaacgcgaa

SEQ ID NO: 35155 - DNA, 1468 bp, Artificial Sequence
  chemically treated genomic DNA (Homo sapiens) CpG-island No: 35155
ggaaatttataatcggtatcgatgtttagtattagtaattgttaaaggtttacggttgttaatcgttgtttatttcgatatttaacggtatttcggaatattttataagatggcgtttttgttttttaattttcgggttacgggcggaggacgttttgttaggacgtcgatttcgttttgtaaggtttaggggtcgattttagatagaggttcgttttaggggtatgggcgggggttagacgggtttcgagtgggattttggtacggttggtcgatcggttcgggatttcggttgcgggttcgtgtttgttttagcgcgatgggttcgaatgttcggttttacgaatttcggttttttatttttacggtttttcggtattgttttagttagatattagcgagttcgttatagcgcgggtaggtattgcggggtagttgtagacgagttttgttatacggtcggaggaggtttcgtttgttcgtgcggcgggtttcgggtattttgatattttgatataggaggtttcgggcggtcgggaagggttgtgcgggggagggattgcgtttatattcgcgttcgattcgttcgggttacggtattgttttgttattaggcggttggggcgggggtgaggttaggcgtcggttttcgcgattttgttttgtacgttgaggttcggagttttcgaagaacgggatagcggggtttacggacggttttgaaggttttttcgcggtcgtaagagatttcggcggtcggcgtttgaggcgcgcggtttcgttgggaagcgagattcgggtggcgggataagatttgtttttcggttacgcgcgttcggtcggtcgtggggcggggtataggtcgtgacgtgatgtcgcgtatcgagttttcgtttttttttcgttttttcgtatataagatttcgtcgagcgtttttattcgtataagtggatcggggtgttgggtgttagtcggtattagaggtaagggtgcgaggattacggtcggttcggacgtgtgatcgcgtttagggggtggtagcgggtagtgcggggcggtaaggcgattatggagtttttgcggattattatttattagttagtcgttagtattaaaatgtgcgagtaggcgttgggtaagggttgcggagcggattcgaagaagaagcggtcgtcgtagtttttcgaggaatcgtagttattttagttttaggcgtaagtgttttcggcggttttttattattattattattattcgtattcggggtcggagatttcgcggattatcgtcgattttacgattgggaagcgttattgtcggggtaaagtgttgggaaaggtgataagcggagggcgtcgggttgtcgggcgggcgggaggtttgttcgggcgattttaagtcgggtaagttcgcggggtttttcgttcgtcgttttcgggtttttcgggggttcgattttagcgcgag

SEQ ID NO: 35156 - DNA, 1468 bp, Artificial Sequence
  chemically treated genomic DNA (Homo sapiens) CpG-island No: 35156
ctcgcgctaaaatcgaacccccgaaaaacccgaaaacgacgaacgaaaaaccccgcgaacttacccgacttaaaatcgcccgaacaaacctcccgcccgcccgacaacccgacgccctccgcttatcacctttcccaacactttaccccgacaataacgcttcccaatcgtaaaatcgacgataatccgcgaaatctccgaccccgaatacgaataataataataataataaaaaaccgccgaaaacacttacgcctaaaactaaaataactacgattcctcgaaaaactacgacgaccgcttcttcttcgaatccgctccgcaacccttacccaacgcctactcgcacattttaatactaacgactaactaataaataataatccgcaaaaactccataatcgccttaccgccccgcactacccgctaccaccccctaaacgcgatcacacgtccgaaccgaccgtaatcctcgcacccttacctctaataccgactaacacccaacaccccgatccacttatacgaataaaaacgctcgacgaaatcttatatacgaaaaaacgaaaaaaaaacgaaaactcgatacgcgacatcacgtcacgacctataccccgccccacgaccgaccgaacgcgcgtaaccgaaaaacaaatcttatcccgccacccgaatctcgcttcccaacgaaaccgcgcgcctcaaacgccgaccgccgaaatctcttacgaccgcgaaaaaaccttcaaaaccgtccgtaaaccccgctatcccgttcttcgaaaactccgaacctcaacgtacaaaacaaaatcgcgaaaaccgacgcctaacctcacccccgccccaaccgcctaataacaaaacaataccgtaacccgaacgaatcgaacgcgaatataaacgcaatccctcccccgcacaacccttcccgaccgcccgaaacctcctatatcaaaatatcaaaatacccgaaacccgccgcacgaacaaacgaaacctcctccgaccgtataacaaaactcgtctacaactaccccgcaatacctacccgcgctataacgaactcgctaatatctaactaaaacaataccgaaaaaccgtaaaaataaaaaaccgaaattcgtaaaaccgaacattcgaacccatcgcgctaaaacaaacacgaacccgcaaccgaaatcccgaaccgatcgaccaaccgtaccaaaatcccactcgaaacccgtctaacccccgcccatacccctaaaacgaacctctatctaaaatcgacccctaaaccttacaaaacgaaatcgacgtcctaacaaaacgtcctccgcccgtaacccgaaaattaaaaaacaaaaacgccatcttataaaatattccgaaataccgttaaatatcgaaataaacaacgattaacaaccgtaaacctttaacaattactaatactaaacatcgataccgattataaatttcc

SEQ ID NO: 35157 - DNA, 852 bp, Artificial Sequence
  chemically treated genomic DNA (Homo sapiens) CpG-island No: 35157
ttgagtgtattggcgagcgtttggtttttcggtggagtgggattgcgtgtattggtgagcgtttggtttttttgtggagtgggattgcgtgtattggcgagtgttcggtttttcggtggagtgggattgcgtgtattgattagcgtttggtttttcggtggagtgggattgcgtgtattggcgagtgtttggtttttcggtggagtgggattgagtgtattgacgagcgtttggtttttcggtggagtgggattggtgtgtgttggcgagtgttcggttttttggtgggagtgggtttgcgtgtattgattagcgtttggtttttcggtggagtgggattgagtgtattgattagcgtttggtttttcggtggagtgggattgagtgtattggcgagcgtttggtttttcggtggagtgggattgagtgtattggcgagcgtttggtttttcggtggagtgggattgcgtgtattggcgagcgtttggtttttcggtggagtgggattgcgtgtattggtgagcgtttggtttttcggtggagtgggattgcgtgtattggcgagtgttcggtttttcggtggagtgggattgagtgtattggcgagcgtttggtttttcggtggagtgggattgcgtgtattggcgagcgtttggtttttcggtggagtgggattgcgtgtattggtgagtatttggtttttcggtggagtgggattgcgtgtattggcgagtgttcggtttttcggtggagtgggattgagtgtattggcgagcgtttggttttttggtagagtgggattgcgtgtattggtgagcgtttggtttttaggtggagtgggattgtagtatg

SEQ ID NO: 35158 - DNA, 852 bp, Artificial Sequence
  chemically treated genomic DNA (Homo sapiens) CpG-island No: 35158
catactacaatcccactccacctaaaaaccaaacgctcaccaatacacgcaatcccactctaccaaaaaaccaaacgctcgccaatacactcaatcccactccaccgaaaaaccgaacactcgccaatacacgcaatcccactccaccgaaaaaccaaatactcaccaatacacgcaatcccactccaccgaaaaaccaaacgctcgccaatacacgcaatcccactccaccgaaaaaccaaacgctcgccaatacactcaatcccactccaccgaaaaaccgaacactcgccaatacacgcaatcccactccaccgaaaaaccaaacgctcaccaatacacgcaatcccactccaccgaaaaaccaaacgctcgccaatacacgcaatcccactccaccgaaaaaccaaacgctcgccaatacactcaatcccactccaccgaaaaaccaaacgctcgccaatacactcaatcccactccaccgaaaaaccaaacgctaatcaatacactcaatcccactccaccgaaaaaccaaacgctaatcaatacacgcaaacccactcccaccaaaaaaccgaacactcgccaacacacaccaatcccactccaccgaaaaaccaaacgctcgtcaatacactcaatcccactccaccgaaaaaccaaacactcgccaatacacgcaatcccactccaccgaaaaaccaaacgctaatcaatacacgcaatcccactccaccgaaaaaccgaacactcgccaatacacgcaatcccactccacaaaaaaaccaaacgctcaccaatacacgcaatcccactccaccgaaaaaccaaacgctcgccaatacactcaa

SEQ ID NO: 35159 - DNA, 852 bp, Artificial Sequence
  chemically treated genomic DNA (Homo sapiens) CpG-island No: 35159
tatattgtaattttattttatttggagattaggcgtttattaatatacgtaattttattttattaggagattaggcgttcgttaatatatttaattttattttatcgggagatcgggtattcgttaatatacgtaattttattttatcgggagattaggtgtttattagtatacgtaattttattttatcgggagattaggcgttcgttaatatacgtaattttattttatcgggagattaggcgttcgttaatatatttaattttattttatcgggagatcgggtattcgttaatatacgtaattttattttatcgggagattaggcgtttattagtatacgtaattttattttatcgggagattaggcgttcgttaatatacgtaattttattttatcgggagattaggcgttcgttaatatatttaattttattttatcgggagattaggcgttcgttaatatatttaattttattttatcgggagattaggcgttagttaatatatttaattttattttatcgggagattaggcgttagttaatatacgtaaatttatttttattaggagatcgggtattcgttaatatatattaattttattttatcgggagattaggcgttcgttaatatatttaattttattttatcgggagattaggtattcgttaatatacgtaattttattttatcgggagattaggcgttagttaatatacgtaattttattttatcgggagatcgggtattcgttaatatacgtaattttattttatagggagattaggcgtttattagtatacgtaattttattttatcgggagattaggcgttcgttaatatatttaa

SEQ ID NO: 35160 - DNA, 852 bp, Artificial Sequence
  chemically treated genomic DNA (Homo sapiens) CpG-island No: 35160
ttaaatatattaacgaacgcctaatctcccgataaaataaaattacgtatactaataaacgcctaatctccctataaaataaaattacgtatattaacgaatacccgatctcccgataaaataaaattacgtatattaactaacgcctaatctcccgataaaataaaattacgtatattaacgaatacctaatctcccgataaaataaaattaaatatattaacgaacgcctaatctcccgataaaataaaattaatatatattaacgaatacccgatctcctaataaaaataaatttacgtatattaactaacgcctaatctcccgataaaataaaattaaatatattaactaacgcctaatctcccgataaaataaaattaaatatattaacgaacgcctaatctcccgataaaataaaattaaatatattaacgaacgcctaatctcccgataaaataaaattacgtatattaacgaacgcctaatctcccgataaaataaaattacgtatactaataaacgcctaatctcccgataaaataaaattacgtatattaacgaatacccgatctcccgataaaataaaattaaatatattaacgaacgcctaatctcccgataaaataaaattacgtatattaacgaacgcctaatctcccgataaaataaaattacgtatactaataaacacctaatctcccgataaaataaaattacgtatattaacgaatacccgatctcccgataaaataaaattaaatatattaacgaacgcctaatctcctaataaaataaaattacgtatattaataaacgcctaatctccaaataaaataaaattacaatata

SEQ ID NO: 35161 - DNA, 595 bp, Artificial Sequence
  chemically treated genomic DNA (Homo sapiens) CpG-island No: 35161
  misc_feature (253)..(253): n is either a, c, g or t
tattagtatacgtaattttattttatcgggaggattaggcgtatcgttaatatacgtaattttattttatcggggagattacggtcgtttagttttaatatacgttaatttcgtacgttcgatcgggggaagtattaggtcggttacgattaatatagcgttaatatttattttacgcgggagattaggtcggttagtgtaatatatttaattttattttatcgggagattaggcgttagattaattatacgntaatattcgattattattaggagatcgggtattcgttaatatatataattttattttatcgggagattaggcgttcgttaatatatttaattttattttatcgggagattaggcgttcgttaatatatttaattttattttatcgggagattaggtattcgttaatatatataattttattttatcgggagattagacgttagttaatatacgtaattttattttatcgggagatcgggcgttcgttaatatatgtaattttattttatcgggagattaggcgttagttaatatacgtaattttattttattaggagattagggtattcgtttaatatatat

SEQ ID NO: 35162 - DNA, 595 bp, Artificial Sequence
  chemically treated genomic DNA (Homo sapiens) CpG-island No: 35162
  misc_feature (343)..(343): n is either a, c, g or t
atatatattaaacgaataccctaatctcctaataaaataaaattacgtatattaactaacgcctaatctcccgataaaataaaattacatatattaacgaacgcccgatctcccgataaaataaaattacgtatattaactaacgtctaatctcccgataaaataaaattatatatattaacgaatacctaatctcccgataaaataaaattaaatatattaacgaacgcctaatctcccgataaaataaaattaaatatattaacgaacgcctaatctcccgataaaataaaattatatatattaacgaatacccgatctcctaataataatcgaatattancgtataattaatctaacgcctaatctcccgataaaataaaattaaatatattacactaaccgacctaatctcccgcgtaaaataaatattaacgctatattaatcgtaaccgacctaatacttcccccgatcgaacgtacgaaattaacgtatattaaaactaaacgaccgtaatctccccgataaaataaaattacgtatattaacgatacgcctaatcctcccgataaaataaaattacgtatactaata

SEQ ID NO: 35163 - DNA, 595 bp, Artificial Sequence
  chemically treated genomic DNA (Homo sapiens) CpG-island No: 35163
  misc_feature (343)..(343): n is either a, c, g or t
gtgtgtgttgggcgagtgttttggttttttggtggagtgggattgcgtgtattgattagcgtttggtttttcggtggagtgggattgtatgtattggcgagcgttcggtttttcggtggagtgggattgcgtgtattgattagcgtttggtttttcggtggagtgggattgtgtgtgttggcgagtgtttggtttttcggtggagtgggattgagtgtattggcgagcgtttggtttttcggtggagtgggattgagtgtattggcgagcgtttggtttttcggtggagtgggattgtgtgtgttggcgagtgttcggttttttggtggtagtcgggtattgncgtgtagttgatttagcgtttggtttttcggtggagtgggattgagtgtattgtattagtcggtttggtttttcgcgtggagtgggtattgacgttgtattggtcgtagtcgatttggtgtttttttcggtcggacgtgcggaattgacgtgtattagggttgagcggtcgtggttttttcggtggagtgggattgcgtgtattggcgatgcgtttggttttttcggtggagtgggattgcgtgtattggtg

SEQ ID NO: 35164 - DNA, 595 bp, Artificial Sequence
  chemically treated genomic DNA (Homo sapiens) CpG-island No: 35164
  misc_feature (253)..(253): n is either a, c, g or t
caccaatacacgcaatcccactccaccgaaaaaaccaaacgcatcgccaatacacgcaatcccactccaccgaaaaaaccacgaccgctcaaccctaatacacgtcaattccgcacgtccgaccgaaaaaaacaccaaatcgactacgaccaatacaacgtcaatacccactccacgcgaaaaaccaaaccgactaatacaatacactcaatcccactccaccgaaaaaccaaacgctaaatcaactacacgncaatacccgactaccaccaaaaaaccgaacactcgccaacacacacaatcccactccaccgaaaaaccaaacgctcgccaatacactcaatcccactccaccgaaaaaccaaacgctcgccaatacactcaatcccactccaccgaaaaaccaaacactcgccaacacacacaatcccactccaccgaaaaaccaaacgctaatcaatacacgcaatcccactccaccgaaaaaccgaacgctcgccaatacatacaatcccactccaccgaaaaaccaaacgctaatcaatacacgcaatcccactccaccaaaaaaccaaaacactcgcccaacacacac

SEQ ID NO: 35165 - DNA, 1502 bp, Artificial Sequence
  chemically treated genomic DNA (Homo sapiens) CpG-island No: 35165
taggcgttcgttaatatatttaattttattttatcgggagattaggcgttcgttaatatatttaattttattttatcgggagattaggtattcgttaatatatataattttattttattaggagattaggcgttcgttaatatacgtaattttattttatcgggagattaggcgttcgttaatatatttaattttattttatcgggagattaggtattcgttaatatatataattttattttattaggagattaggcgttcgttaatatatttaattttattttatcgggagattaggcgttagttaatatacgtaattttattttattaggagatcgggtattcgttaatatatataattttattttatcgggagattaggcgttcgttaatatatttaattttattttatcgggagattaggtatttattaatatacgtaattttattttatcgggagattaggcgttagttaatatacgtaattttattttatcgggagattagacgttagttaatatacgtaattttattttattaggagatcgggtattcgttaatatacgtaattttattttatcgggagattaggcgttagttaatatacgtaattttattttattaggagatcgggtattcgttaatatatataattttattttatcgggagattaggcgttcgttaatatatttaattttattttatcgggagattaggcgttcgttaatatatttaattttattttatcgggagattaggtattcgttaatatatataattttattttattaggagattaggcgttcgttaatatacgtaattttattttattaggagattaggcgttcgttaatatatttaattttattttatcgggagattaggcgttagttaatatacgtaattttattttattaggagatcgggtattcgttaatatatataattttattttatcgggagattaggcgttcgttaatatatttaattttattttatcgggagattaggcgttagttaatatacgtaattttattttattaggagatcgggtattcgttaatatatataattttattttatcgggagattaggcgttcgttaatatatttaattttattttatcgggagattaggcgttcgttaatatatttaattttattttatcgggagattaggtattcgttaatatatataattttattttatcgggagattagacgttagttaatatacgtaattttattttatcgggagatcgggcgttcgttaatatacgtaattttattttatcgggagattaggcgttagttaatatacgtaattttattttattaggagatcgggtattcgttaatatatataattttattttatcgggagattaggcgttcgttaatatatttaattttattttatcgggagattaggtattcgttaatatatttaatttttatttatcgggagattaggtattcgttaatatatataattttatttt

SEQ ID NO: 35166 - DNA, 1502 bp, Artificial Sequence
  chemically treated genomic DNA (Homo sapiens) CpG-island No: 35166
aaaataaaattatatatattaacgaatacctaatctcccgataaataaaaattaaatatattaacgaatacctaatctcccgataaaataaaattaaatatattaacgaacgcctaatctcccgataaaataaaattatatatattaacgaatacccgatctcctaataaaataaaattacgtatattaactaacgcctaatctcccgataaaataaaattacgtatattaacgaacgcccgatctcccgataaaataaaattacgtatattaactaacgtctaatctcccgataaaataaaattatatatattaacgaatacctaatctcccgataaaataaaattaaatatattaacgaacgcctaatctcccgataaaataaaattaaatatattaacgaacgcctaatctcccgataaaataaaattatatatattaacgaatacccgatctcctaataaaataaaattacgtatattaactaacgcctaatctcccgataaaataaaattaaatatattaacgaacgcctaatctcccgataaaataaaattatatatattaacgaatacccgatctcctaataaaataaaattacgtatattaactaacgcctaatctcccgataaaataaaattaaatatattaacgaacgcctaatctcctaataaaataaaattacgtatattaacgaacgcctaatctcctaataaaataaaattatatatattaacgaatacctaatctcccgataaaataaaattaaatatattaacgaacgcctaatctcccgataaaataaaattaaatatattaacgaacgcctaatctcccgataaaataaaattatatatattaacgaatacccgatctcctaataaaataaaattacgtatattaactaacgcctaatctcccgataaaataaaattacgtatattaacgaatacccgatctcctaataaaataaaattacgtatattaactaacgtctaatctcccgataaaataaaattacgtatattaactaacgcctaatctcccgataaaataaaattacgtatattaataaatacctaatctcccgataaaataaaattaaatatattaacgaacgcctaatctcccgataaaataaaattatatatattaacgaatacccgatctcctaataaaataaaattacgtatattaactaacgcctaatctcccgataaaataaaattaaatatattaacgaacgcctaatctcctaataaaataaaattatatatattaacgaatacctaatctcccgataaaataaaattaaatatattaacgaacgcctaatctcccgataaaataaaattacgtatattaacgaacgcctaatctcctaataaaataaaattatatatattaacgaatacctaatctcccgataaaataaaattaaatatattaacgaacgcctaatctcccgataaaataaaattaaatatattaacgaacgccta

SEQ ID NO: 35167 - DNA, 1502 bp, Artificial Sequence
  chemically treated genomic DNA (Homo sapiens) CpG-island No: 35167
gaagtgggattgtgtgtgttggcgagtgtttggtttttcggtgagtggggattgagtgtattggcgagtgtttggtttttcggtggagtgggattgagtgtattgacgagcgtttggtttttcggtggagtgggattgtgtgtgttggcgagtgttcggttttttggtggagtgggattgcgtgtattgattagcgtttggtttttcggtggagtgggattgcgtgtattggcgagcgttcggtttttcggtggagtgggattgcgtgtattgattagcgtttggtttttcggtggagtgggattgtgtgtgttggcgagtgtttggtttttcggtggagtgggattgagtgtattggcgagcgtttggtttttcggtggagtgggattgagtgtattgacgagcgtttggtttttcggtggagtgggattgtgtgtgttggcgagtgttcggttttttggtggagtgggattgcgtgtattgattagcgtttggtttttcggtggagtgggattgagtgtattggcgagcgtttggtttttcggtggagtgggattgtgtgtgttggcgagtgttcggttttttggtagagtgggattgcgtgtattgattagcgtttggtttttcggtggagtgggattgagtgtattggcgagcgtttggttttttggtggagtgggattgcgtgtattggcgagcgtttggttttttggtggagtgggattgtgtgtgttggcgagtgtttggtttttcggtggagtgggattgagtgtattggcgagcgtttggtttttcggtggagtgggattgagtgtattgacgagcgtttggtttttcggtggagtgggattgtgtgtgttggcgagtgttcggttttttggtggagtgggattgcgtgtattgattagcgtttggtttttcggtggagtgggattgcgtgtattggcgagtgttcggttttttggtggagtgggattgcgtgtattgattagcgtttggtttttcggtggagtgggattgcgtgtattgattagcgtttggtttttcggtggagtgggattgcgtgtattggtgagtgtttggtttttcggtggagtgggattgagtgtattgacgagcgtttggtttttcggtggagtgggattgtgtgtattggcgagtgttcggttttttggtagagtgggattgcgtgtattgattagcgtttggtttttcggtggagtgggattgagtgtattggcgagcgtttggttttttggtggagtgggattgtgtgtgttggcgagtgtttggtttttcggtggagtgggattgagtgtattggcgagcgtttggtttttcggtggagtgggattgcgtgtattggcgagcgtttggttttttggtggagtgggattgtgtgtgttggcgagtgtttggtttttcggtggagtgggattgagtgtattggcgagcgtttggtttttcggtggagtgggattgagtgtattgacgagcgtttg

SEQ ID NO: 35168 - DNA, 1502 bp, Artificial Sequence
  chemically treated genomic DNA (Homo sapiens) CpG-island No: 35168
caaacgctcgtcaatacactcaatcccactccaccgaaaaaccaaacgctcgccaatacactcaatcccactccaccgaaaaaccaaacactcgccaacacacacaatcccactccaccaaaaaaccaaacgctcgccaatacacgcaatcccactccaccgaaaaaccaaacgctcgccaatacactcaatcccactccaccgaaaaaccaaacactcgccaacacacacaatcccactccaccaaaaaaccaaacgctcgccaatacactcaatcccactccaccgaaaaaccaaacgctaatcaatacacgcaatcccactctaccaaaaaaccgaacactcgccaatacacacaatcccactccaccgaaaaaccaaacgctcgtcaatacactcaatcccactccaccgaaaaaccaaacactcaccaatacacgcaatcccactccaccgaaaaaccaaacgctaatcaatacacgcaatcccactccaccgaaaaaccaaacgctaatcaatacacgcaatcccactccaccaaaaaaccgaacactcgccaatacacgcaatcccactccaccgaaaaaccaaacgctaatcaatacacgcaatcccactccaccaaaaaaccgaacactcgccaacacacacaatcccactccaccgaaaaaccaaacgctcgtcaatacactcaatcccactccaccgaaaaaccaaacgctcgccaatacactcaatcccactccaccgaaaaaccaaacactcgccaacacacacaatcccactccaccaaaaaaccaaacgctcgccaatacacgcaatcccactccaccaaaaaaccaaacgctcgccaatacactcaatcccactccaccgaaaaaccaaacgctaatcaatacacgcaatcccactctaccaaaaaaccgaacactcgccaacacacacaatcccactccaccgaaaaaccaaacgctcgccaatacactcaatcccactccaccgaaaaaccaaacgctaatcaatacacgcaatcccactccaccaaaaaaccgaacactcgccaacacacacaatcccactccaccgaaaaaccaaacgctcgtcaatacactcaatcccactccaccgaaaaaccaaacgctcgccaatacactcaatcccactccaccgaaaaaccaaacactcgccaacacacacaatcccactccaccgaaaaaccaaacgctaatcaatacacgcaatcccactccaccgaaaaaccgaacgctcgccaatacacgcaatcccactccaccgaaaaaccaaacgctaatcaatacacgcaatcccactccaccaaaaaaccgaacactcgccaacacacacaatcccactccaccgaaaaaccaaacgctcgtcaatacactcaatcccactccaccgaaaaaccaaacactcgccaatacactcaatccccactcaccgaaaaaccaaacactcgccaacacacacaatcccacttc

SEQ ID NO: 35169 - DNA, 732 bp, Artificial Sequence
  chemically treated genomic DNA (Homo sapiens) CpG-island No: 35169
cgcgcgttcgtttgttgtttggagtttttaattcggcggaatttaggttaggacgcgtcgtcgttttgacgtgttgtcggtcgggaggcgcgggcgttaggttttaacgattagggtgggtggtcgcggggtaggggttggatttgaattcgtttttcgggggttttggatgcgggatgcgggatgcgggatgcgggttcgattttttcgttgttggtcgaggagcgttttgagagtttttttttcgcgcgcgaggataaatatgcgcggtttgttagttagtgcggcgttgttttttagttgatagggtgacgtttcgtttggaggtttggagattggttttttgatttggtttttttcggtagtttaatgggtaaagtttttcgttcgtttagaaattagttttttcgcgcgttttttttgcgcgcggcgaggtcgagacgtttttcgcggtgatagcgtgtaaggcggagattcggcgcgtttttagtttagggaaagtttaggcgacgcgatcgtaagttcgagtttaggtttttcggagtcgttagggcgcgtcgggttgtttgtttttttgtttttttttgtaggaatttttcgtcgttcgcggtcgggatttcgggtttttttcgggcgtagattttagttatcgttttgggtcggggtttttttttttttgaaattcgtgcggaaggatttttttcggggtttttcgttttggttttagatatt

SEQ ID NO: 35170 - DNA, 732 bp, Artificial Sequence
  chemically treated genomic DNA (Homo sapiens) CpG-island No: 35170
aatatctaaaaccaaaacgaaaaaccccgaaaaaaatccttccgcacgaatttcaaaaaaaaaaaaaccccgacccaaaacgataactaaaatctacgcccgaaaaaaacccgaaatcccgaccgcgaacgacgaaaaattcctacaaaaaaaaacaaaaaaacaaacaacccgacgcgccctaacgactccgaaaaacctaaactcgaacttacgatcgcgtcgcctaaactttccctaaactaaaaacgcgccgaatctccgccttacacgctatcaccgcgaaaaacgtctcgacctcgccgcgcgcaaaaaaaacgcgcgaaaaaactaatttctaaacgaacgaaaaactttacccattaaactaccgaaaaaaaccaaatcaaaaaaccaatctccaaacctccaaacgaaacgtcaccctatcaactaaaaaacaacgccgcactaactaacaaaccgcgcatatttatcctcgcgcgcgaaaaaaaaactctcaaaacgctcctcgaccaacaacgaaaaaatcgaacccgcatcccgcatcccgcatcccgcatccaaaacccccgaaaaacgaattcaaatccaacccctaccccgcgaccacccaccctaatcgttaaaacctaacgcccgcgcctcccgaccgacaacacgtcaaaacgacgacgcgtcctaacctaaattccgccgaattaaaaactccaaacaacaaacgaacgcgcg

SEQ ID NO: 35171 - DNA, 732 bp, Artificial Sequence
  chemically treated genomic DNA (Homo sapiens) CpG-island No: 35171
ggtgtttggggttagggcgaggggtttcgggaggggttttttcgtacggattttagaaagagggaaatttcgatttagagcggtgattggaatttacgttcgggagaggttcggagtttcggtcgcgggcggcgggggatttttgtaggaaggggtaggaaggtaagtagttcggcgcgttttggcggtttcgagggatttgggttcgggtttgcggtcgcgtcgtttgggttttttttgggttgggagcgcgtcgggttttcgttttgtacgttgttatcgcgggagacgtttcggtttcgtcgcgcgtagaggggacgcgcggagaggttggtttttgggcgagcggagagttttgtttattaagttgtcggaagaagttaaattaaaaagttaatttttaagtttttaaacggaacgttattttattagttgggagatagcgtcgtattgattgataagtcgcgtatatttattttcgcgcgcggaggggagatttttagaacgtttttcgattagtagcgaggaagtcgagttcgtatttcgtatttcgtatttcgtatttagagttttcgagggacgaatttagatttaatttttgtttcgcggttatttattttagtcgttggagtttggcgttcgcgtttttcggtcggtagtacgttaaaacggcggcgcgttttgatttggatttcgtcgagttgggagttttaggtagtaggcgggcgcgcg

SEQ ID NO: 35172 - DNA, 732 bp, Artificial Sequence
  chemically treated genomic DNA (Homo sapiens) CpG-island No: 35172
cgcgcgcccgcctactacctaaaactcccaactcgacgaaatccaaatcaaaacgcgccgccgttttaacgtactaccgaccgaaaaacgcgaacgccaaactccaacgactaaaataaataaccgcgaaacaaaaattaaatctaaattcgtccctcgaaaactctaaatacgaaatacgaaatacgaaatacgaactcgacttcctcgctactaatcgaaaaacgttctaaaaatctcccctccgcgcgcgaaaataaatatacgcgacttatcaatcaatacgacgctatctcccaactaataaaataacgttccgtttaaaaacttaaaaattaactttttaatttaacttcttccgacaacttaataaacaaaactctccgctcgcccaaaaaccaacctctccgcgcgtcccctctacgcgcgacgaaaccgaaacgtctcccgcgataacaacgtacaaaacgaaaacccgacgcgctcccaacccaaaaaaaacccaaacgacgcgaccgcaaacccgaacccaaatccctcgaaaccgccaaaacgcgccgaactacttaccttcctaccccttcctacaaaaatcccccgccgcccgcgaccgaaactccgaacctctcccgaacgtaaattccaatcaccgctctaaatcgaaatttccctctttctaaaatccgtacgaaaaaacccctcccgaaacccctcgccctaaccccaaacacc

SEQ ID NO: 35173 - DNA, 649 bp, Artificial Sequence
  chemically treated genomic DNA (Homo sapiens) CpG-island No: 35173
  misc_feature (356)..(356): n is either a, c, g or t
  misc_feature (515)..(515): n is either a, c, g or t
  misc_feature (587)..(587): n is either a, c, g or t
cgtagtcgtcgtcgtttcgggtagagtttgcgtttttgttttgcgtttcgggcgttgaagtcgggcgggcgatgttcgcggcgtgaaagcgttcgcggcgggcgtcgatttttgttttagttttttgtttttttcgtttcgtttgtttcgtgtttttgtgattttggttttggcgtcgtcgtttaggcgtttcgtaatgtagttgtttttgcgtttcggcgggaggcgttttgtttcgcgagcgttcggggttcgtagttcggtttgggggtttagtcgagttcgggcggggtcggggtcgcggtggcgatgtatcgggttcgttagcgttaggagcgttaggtagttgaggcggngggtaagttttttttcggaggagtcgcgttttcggtttcgtcggtttcgtcgcgatgttgttttatagtttgtcgggtttcgaggtgtacggggttatcgacgagatggatcgtagggttaagagcgaggttttcgttattaggttcggtatcgatcgnggaatttcggagacgtaggcgcgcgggtgtggggtcggggttgaaagtttggaatgggttcgggtaggacgngttttttgttttttaaatttggggaggcgtttttcgggtcgttatgggattgggggcgtggg

SEQ ID NO: 35174 - DNA, 649 bp, Artificial Sequence
  chemically treated genomic DNA (Homo sapiens) CpG-island No: 35174
  misc_feature (63)..(63): n is either a, c, g or t
  misc_feature (135)..(135): n is either a, c, g or t
  misc_feature (294)..(294): n is either a, c, g or t
cccacgcccccaatcccataacgacccgaaaaacgcctccccaaatttaaaaaacaaaaaacncgtcctacccgaacccattccaaactttcaaccccgaccccacacccgcgcgcctacgtctccgaaattccncgatcgataccgaacctaataacgaaaacctcgctcttaaccctacgatccatctcgtcgataaccccgtacacctcgaaacccgacaaactataaaacaacatcgcgacgaaaccgacgaaaccgaaaacgcgactcctccgaaaaaaaacttacccnccgcctcaactacctaacgctcctaacgctaacgaacccgatacatcgccaccgcgaccccgaccccgcccgaactcgactaaacccccaaaccgaactacgaaccccgaacgctcgcgaaacaaaacgcctcccgccgaaacgcaaaaacaactacattacgaaacgcctaaacgacgacgccaaaaccaaaatcacaaaaacacgaaacaaacgaaacgaaaaaaacaaaaaactaaaacaaaaatcgacgcccgccgcgaacgctttcacgccgcgaacatcgcccgcccgacttcaacgcccgaaacgcaaaacaaaaacgcaaactctacccgaaacgacgacgactacg

SEQ ID NO: 35175 - DNA, 649 bp, Artificial Sequence
  chemically treated genomic DNA (Homo sapiens) CpG-island No: 35175
  misc_feature (63)..(63): n is either a, c, g or t
  misc_feature (135)..(135): n is either a, c, g or t
  misc_feature (294)..(294): n is either a, c, g or t
tttacgtttttagttttatggcggttcgaaggacgtttttttaaatttgggggataaaaggtncgttttgttcgggtttattttaagtttttagtttcgattttatattcgcgcgtttacgttttcggggttttncggtcgatgtcgaatttgatggcgggagtttcgtttttggttttgcggtttatttcgtcgatgatttcgtgtatttcggggttcgatagattgtggaatagtatcgcggcgggatcggcggggtcgggggcgcggttttttcgagggagggtttgtttntcgttttagttgtttggcgtttttggcgttaacgggttcggtgtatcgttatcgcggtttcggtttcgttcgagttcggttgagtttttaggtcgagttacgggtttcgggcgttcgcggggtaggacgtttttcgtcgaggcgtaggggtagttatattgcggggcgtttgggcgacggcgttaaagttagggttataagggtacgggataagcggggcggggggagtaggagattaggatagaggtcggcgttcgtcgcgggcgtttttacgtcgcgggtatcgttcgttcggttttagcgttcggggcgtaaagtaagggcgtaaattttgttcgaggcggcgacggttgcg

SEQ ID NO: 35176 - DNA, 649 bp, Artificial Sequence
  chemically treated genomic DNA (Homo sapiens) CpG-island No: 35176
  misc_feature (356)..(356): n is either a, c, g or t
  misc_feature (515)..(515): n is either a, c, g or t
  misc_feature (587)..(587): n is either a, c, g or t
cgcaaccgtcgccgcctcgaacaaaatttacgcccttactttacgccccgaacgctaaaaccgaacgaacgatacccgcgacgtaaaaacgcccgcgacgaacgccgacctctatcctaatctcctactccccccgccccgcttatcccgtacccttataaccctaactttaacgccgtcgcccaaacgccccgcaatataactacccctacgcctcgacgaaaaacgtcctaccccgcgaacgcccgaaacccgtaactcgacctaaaaactcaaccgaactcgaacgaaaccgaaaccgcgataacgatacaccgaacccgttaacgccaaaaacgccaaacaactaaaacganaaacaaaccctccctcgaaaaaaccgcgcccccgaccccgccgatcccgccgcgatactattccacaatctatcgaaccccgaaatacacgaaatcatcgacgaaataaaccgcaaaaccaaaaacgaaactcccgccatcaaattcgacatcgaccgnaaaaccccgaaaacgtaaacgcgcgaatataaaatcgaaactaaaaacttaaaataaacccgaacaaaacgnaccttttatcccccaaatttaaaaaaacgtccttcgaaccgccataaaactaaaaacgtaaa

SEQ ID NO: 35177 - DNA, 898 bp, Artificial Sequence
  chemically treated genomic DNA (Homo sapiens) CpG-island No: 35177
tagtttcgttttgtatcgttatcgttacgtataaggcggtgtgtgggtagttcggacgtggtatttgtttttagttgtttaatttcgggcgtcgcgacggttacgtgtatagcggtaggtttttttgtttcgttttcgcggttcggtttttgcgtgggttcggtttcgtttatagttcgcgtagtttcgcgagtttggtttcggcggttttagtttttaaggagttcgtgagggttaggttgcgtttgcgtcgggcggttggtgggcggggcgagggtcgttggggtcgcgaagtggggcggtcgggtgggttacgagtcgggtttgggttgaggggcgcggtttcgcggtggattttagttcggtaacgggaaggcgagtttttttttatcgtttaaagtaaattttgtcgtttttttcgcggcgttttcgagttttcgtcgtcgtcgggtcgtcgtagttcgcgaagagtcgttttgcgttagggtttttttttttgtttcggcgcggggttattgcgttatggacgttatagtattggagcgggacgttgtgtagttcgttcgtttggcggtttagcgcgattacgaaggtcgttatttcgaggcggtgttttattataaggtagggtcgggttcggcgtttcggtcggagttgtttagtcggagtgcggttcgggtttgcggtcgaggggcgggattcgggtgcggaggttagcggtttcggttttgtttttttttcgttcgtttttcggttttttttttgttgggagcggtaagttcgagtgtagaggtcgacgttgaggttgcggggaggttgggtcgcggttgtagtcgtcgtttttttatttgtagttttgattggtaaatgtttatcgttgagtcgttttggggggtag

SEQ ID NO: 35178 - DNA, 898 bp, Artificial Sequence
  chemically treated genomic DNA (Homo sapiens) CpG-island No: 35178
ctaccccccaaaacgactcaacgataaacatttaccaatcaaaactacaaataaaaaaacgacgactacaaccgcgacccaacctccccgcaacctcaacgtcgacctctacactcgaacttaccgctcccaacaaaaaaaaaaccgaaaaacgaacgaaaaaaaaacaaaaccgaaaccgctaacctccgcacccgaatcccgcccctcgaccgcaaacccgaaccgcactccgactaaacaactccgaccgaaacgccgaacccgaccctaccttataataaaacaccgcctcgaaataacgaccttcgtaatcgcgctaaaccgccaaacgaacgaactacacaacgtcccgctccaatactataacgtccataacgcaataaccccgcgccgaaacaaaaaaaaaaaccctaacgcaaaacgactcttcgcgaactacgacgacccgacgacgacgaaaactcgaaaacgccgcgaaaaaaacgacaaaatttactttaaacgataaaaaaaaactcgccttcccgttaccgaactaaaatccaccgcgaaaccgcgcccctcaacccaaacccgactcgtaacccacccgaccgccccacttcgcgaccccaacgaccctcgccccgcccaccaaccgcccgacgcaaacgcaacctaaccctcacgaactccttaaaaactaaaaccgccgaaaccaaactcgcgaaactacgcgaactataaacgaaaccgaacccacgcaaaaaccgaaccgcgaaaacgaaacaaaaaaacctaccgctatacacgtaaccgtcgcgacgcccgaaattaaacaactaaaaacaaataccacgtccgaactacccacacaccgccttatacgtaacgataacgatacaaaacgaaacta

SEQ ID NO: 35179 - DNA, 898 bp, Artificial Sequence
  chemically treated genomic DNA (Homo sapiens) CpG-island No: 35179
ttgttttttaaagcggtttaacggtgggtatttgttagttaggattataggtggaggagcggcggttgtagtcgcgatttagttttttcgtagttttagcgtcggtttttgtattcgggtttgtcgtttttaataagaggagggtcgggaggcggacgagggaaaagtaaagtcggggtcgttagttttcgtattcggatttcgtttttcggtcgtaggttcgggtcgtatttcgattgagtaatttcgatcgaagcgtcgggttcggttttattttgtaataaaatatcgtttcggagtagcggttttcgtggtcgcgttgaatcgttagacgggcgaattgtatagcgtttcgttttagtgttgtggcgtttatggcgtagtggtttcgcgtcggggtagggaaggaggttttgacgtaggacggtttttcgcggattgcggcggttcggcggcggcgaggattcgggagcgtcgcggaaggagcggtaaagtttattttggacggtggaggagagttcgttttttcgttgtcgggttggggtttatcgcgaagtcgcgttttttagtttagattcggttcgtagtttattcggtcgttttatttcgcggttttagcggttttcgtttcgtttattagtcgttcgacgtaggcgtagtttggtttttacgagttttttagaagttggggtcgtcgaggttaggttcgcgggattgcgcgggttgtgggcggggtcgggtttacgtaggagtcgggtcgcgggggcggggtaaaaaggtttgtcgttgtgtacgtgatcgtcgcggcgttcgggattgagtagttgagggtaggtgttacgttcgagttgtttatatatcgttttatgcgtggcggtggcggtgtagggcgaggttg

SEQ ID NO: 35180 - DNA, 898 bp, Artificial Sequence
  chemically treated genomic DNA (Homo sapiens) CpG-island No: 35180
caacctcgccctacaccgccaccgccacgcataaaacgatatataaacaactcgaacgtaacacctaccctcaactactcaatcccgaacgccgcgacgatcacgtacacaacgacaaacctttttaccccgcccccgcgacccgactcctacgtaaacccgaccccgcccacaacccgcgcaatcccgcgaacctaacctcgacgaccccaacttctaaaaaactcgtaaaaaccaaactacgcctacgtcgaacgactaataaacgaaacgaaaaccgctaaaaccgcgaaataaaacgaccgaataaactacgaaccgaatctaaactaaaaaacgcgacttcgcgataaaccccaacccgacaacgaaaaaacgaactctcctccaccgtccaaaataaactttaccgctccttccgcgacgctcccgaatcctcgccgccgccgaaccgccgcaatccgcgaaaaaccgtcctacgtcaaaacctccttccctaccccgacgcgaaaccactacgccataaacgccacaacactaaaacgaaacgctatacaattcgcccgtctaacgattcaacgcgaccacgaaaaccgctactccgaaacgatattttattacaaaataaaaccgaacccgacgcttcgatcgaaattactcaatcgaaatacgacccgaacctacgaccgaaaaacgaaatccgaatacgaaaactaacgaccccgactttacttttccctcgtccgcctcccgaccctcctcttattaaaaacgacaaacccgaatacaaaaaccgacgctaaaactacgaaaaaactaaatcgcgactacaaccgccgctcctccacctataatcctaactaacaaatacccaccgttaaaccgctttaaaaaacaa

SEQ ID NO: 35181 - DNA, 598 bp, Artificial Sequence
  chemically treated genomic DNA (Homo sapiens) CpG-island No: 35181
agtagcgtagcgtagcgagtttcgtggtcgcgttttaatagcgttcgatagttttcgatagtttaaatcgcggttttagtttcggtcgtatttttagttcgcgttagtatgatgaataatagcggttatttagacgtcggtttcggtttgggcgatgagatagacgagatgtcgtttacggagaaggatttggcggaggacgcgtcgtggaagaagatttagtagaatatatttacgcgttggtgtaatgagtattttaagtgcgtgggtaagcgtttgatcgatttgtagcgcgattttagcgacgggtttcggtttatcgcgttgttcgaggtgtttagttagaagcgtatgtatcgtaagttttattcgcgttttaattttcgttaaatgaagttggagaacgtgttcgtggttttcgagtttttcgagcgcgagtatattaagttcgtgtttataggttagtgtcgggggcgagggtacgggcgttgcggggatagggtcgttttatggggtaggggtataggtgcggggtgggcgcgcggggagttgaggagatagggacggagaggtatttttcggatatagagagaagatt

SEQ ID NO: 35182 - DNA, 598 bp, Artificial Sequence
  chemically treated genomic DNA (Homo sapiens) CpG-island No: 35182
aatcttctctctatatccgaaaaatacctctccgtccctatctcctcaactccccgcgcgcccaccccgcacctatacccctaccccataaaacgaccctatccccgcaacgcccgtaccctcgcccccgacactaacctataaacacgaacttaatatactcgcgctcgaaaaactcgaaaaccacgaacacgttctccaacttcatttaacgaaaattaaaacgcgaataaaacttacgatacatacgcttctaactaaacacctcgaacaacgcgataaaccgaaacccgtcgctaaaatcgcgctacaaatcgatcaaacgcttacccacgcacttaaaatactcattacaccaacgcgtaaatatattctactaaatcttcttccacgacgcgtcctccgccaaatccttctccgtaaacgacatctcgtctatctcatcgcccaaaccgaaaccgacgtctaaataaccgctattattcatcatactaacgcgaactaaaaatacgaccgaaactaaaaccgcgatttaaactatcgaaaactatcgaacgctattaaaacgcgaccacgaaactcgctacgctacgctact

SEQ ID NO: 35183 - DNA, 598 bp, Artificial Sequence
  chemically treated genomic DNA (Homo sapiens) CpG-island No: 35183
ggttttttttttatattcggggggtgttttttcgtttttgtttttttagtttttcgcgcgtttatttcgtatttgtgtttttgttttatgggacgattttattttcgtagcgttcgtgttttcgttttcggtattgatttatggatacgagtttgatgtgttcgcgttcgaggaattcgagggttacggatacgttttttagttttatttggcggaagttggggcgcggatggaatttgcggtatatgcgtttttggttgagtatttcgagtagcgcgatgagtcggagttcgtcgttgaggtcgcgttgtaggtcggttaggcgtttgtttacgtatttgaggtgtttattgtattagcgcgtgaatgtgttttgttggatttttttttacggcgcgtttttcgttaggttttttttcgtggacggtatttcgtttgttttatcgtttaggtcgaggtcggcgtttgagtagtcgttgttgtttattatgttggcgcgggttgggggtgcggtcggggttagggtcgcggtttgggttatcgggggttgtcgggcgttgttggggcgcgattacgggattcgttgcgttgcgttgtt

SEQ ID NO: 35184 - DNA, 598 bp, Artificial Sequence
  chemically treated genomic DNA (Homo sapiens) CpG-island No: 35184
aacaacgcaacgcaacgaatcccgtaatcgcgccccaacaacgcccgacaacccccgataacccaaaccgcgaccctaaccccgaccgcacccccaacccgcgccaacataataaacaacaacgactactcaaacgccgacctcgacctaaacgataaaacaaacgaaataccgtccacgaaaaaaaacctaacgaaaaacgcgccgtaaaaaaaaatccaacaaaacacattcacgcgctaatacaataaacacctcaaatacgtaaacaaacgcctaaccgacctacaacgcgacctcaacgacgaactccgactcatcgcgctactcgaaatactcaaccaaaaacgcatataccgcaaattccatccgcgccccaacttccgccaaataaaactaaaaaacgtatccgtaaccctcgaattcctcgaacgcgaacacatcaaactcgtatccataaatcaataccgaaaacgaaaacacgaacgctacgaaaataaaatcgtcccataaaacaaaaacacaaatacgaaataaacgcgcgaaaaactaaaaaaacaaaaacgaaaaaacaccccccgaatataaaaaaaaaacc

SEQ ID NO: 35185 - DNA, 793 bp, Artificial Sequence
  chemically treated genomic DNA (Homo sapiens) CpG-island No: 35185
cgttaatacgtatataagaatatcgaggatatataattttttatattagacgagattaataacgtattaagaagagagcggagtaataaaagtatacgttacgagaagtagttcgagtattaagagatagatgggtagaatagtatgagagcgagatagagagaggcggagaattataggggaggtaagcgacgcggaggaaggtagtattgagtagcgttttgggtagatacggagaagatagagtcgaacgaattagaggagatatagtcgataaaagaggagcggagaagaaagtatggaggtttgagtagaatacggagcgggcgtcgagggggagtaatagaatgatgttggagacgcgtagagacgtacggattcgagcggaacggagtaggagaggagggtagtagaaatcggaggaaggacgcgcgcgtaggcgagtaggggcgagagataggagcgaaggaagggcgagaacggatagaagagagaacgagtagggcgcgcgagcgaggaggaaacgttaagggtagatgcgcgttcgagcgaagcgacgacgtgtattagaggcggatcgttatagttcggtaggcgcgttacgacgtacgagtacggagaggatatagagaagaggtaagacgaggtagaaagcgagagagtacgggagagaagggaggcgaaggaggagggacggcgagagcgggcgcgggcggaacgtaagaacggcgagatcggagtatatcgatagagggaggacgaacgagaggatgacgagcgcgtaggggaggga

SEQ ID NO: 35186 - DNA, 793 bp, Artificial Sequence
  chemically treated genomic DNA (Homo sapiens) CpG-island No: 35186
tccctcccctacgcgctcgtcatcctctcgttcgtcctccctctatcgatatactccgatctcgccgttcttacgttccgcccgcgcccgctctcgccgtccctcctccttcgcctcccttctctcccgtactctctcgctttctacctcgtcttacctcttctctatatcctctccgtactcgtacgtcgtaacgcgcctaccgaactataacgatccgcctctaatacacgtcgtcgcttcgctcgaacgcgcatctacccttaacgtttcctcctcgctcgcgcgccctactcgttctctcttctatccgttctcgcccttccttcgctcctatctctcgcccctactcgcctacgcgcgcgtccttcctccgatttctactaccctcctctcctactccgttccgctcgaatccgtacgtctctacgcgtctccaacatcattctattactccccctcgacgcccgctccgtattctactcaaacctccatactttcttctccgctcctcttttatcgactatatctcctctaattcgttcgactctatcttctccgtatctacccaaaacgctactcaatactaccttcctccgcgtcgcttacctcccctataattctccgcctctctctatctcgctctcatactattctacccatctatctcttaatactcgaactacttctcgtaacgtatacttttattactccgctctcttcttaatacgttattaatctcgtctaatataaaaaattatatatcctcgatattcttatatacgtattaacg

SEQ ID NO: 35187 - DNA, 793 bp, Artificial Sequence
  chemically treated genomic DNA (Homo sapiens) CpG-island No: 35187
ttttttttttacgcgttcgttattttttcgttcgttttttttttgtcggtgtgtttcggtttcgtcgtttttacgtttcgttcgcgttcgttttcgtcgttttttttttttcgttttttttttttttcgtattttttcgttttttgtttcgttttgttttttttttgtgtttttttcgtattcgtgcgtcgtggcgcgtttgtcgagttgtggcggttcgtttttggtgtacgtcgtcgtttcgttcgagcgcgtatttgtttttgacgtttttttttcgttcgcgcgttttgttcgtttttttttttgttcgttttcgtttttttttcgtttttgtttttcgtttttgttcgtttgcgcgcgcgtttttttttcggtttttgttattttttttttttgtttcgtttcgttcgagttcgtgcgtttttgcgcgtttttagtattattttgttgttttttttcggcgttcgtttcgtgttttatttaagtttttatgttttttttttcgttttttttttgtcggttgtgttttttttggttcgttcggttttgtttttttcgtgtttgtttagggcgttgtttagtgttgttttttttcgcgtcgtttattttttttgtggtttttcgtttttttttgtttcgtttttatattattttatttatttgttttttggtgttcgggttgtttttcgtggcgtgtgtttttattgtttcgttttttttttggtgcgttattggtttcgtttgatgtagggggttgtgtgttttcgatgtttttgtgtgcgtgttggcg

SEQ ID NO: 35188 - DNA, 793 bp, Artificial Sequence
  chemically treated genomic DNA (Homo sapiens) CpG-island No: 35188
cgccaacacgcacacaaaaacatcgaaaacacacaaccccctacatcaaacgaaaccaataacgcaccaaaaaaaaaacgaaacaataaaaacacacgccacgaaaaacaacccgaacaccaaaaaacaaataaataaaataatataaaaacgaaacaaaaaaaaacgaaaaaccacaaaaaaaataaacgacgcgaaaaaaaacaacactaaacaacgccctaaacaaacacgaaaaaaacaaaaccgaacgaaccaaaaaaaacacaaccgacaaaaaaaaaacgaaaaaaaaaacataaaaacttaaataaaacacgaaacgaacgccgaaaaaaaacaacaaaataatactaaaaacgcgcaaaaacgcacgaactcgaacgaaacgaaacaaaaaaaaaaaataacaaaaaccgaaaaaaaaacgcgcgcgcaaacgaacaaaaacgaaaaacaaaaacgaaaaaaaaacgaaaacgaacaaaaaaaaaaacgaacaaaacgcgcgaacgaaaaaaaaacgtcaaaaacaaatacgcgctcgaacgaaacgacgacgtacaccaaaaacgaaccgccacaactcgacaaacgcgccacgacgcacgaatacgaaaaaaacacaaaaaaaaaacaaaacgaaacaaaaaacgaaaaaatacgaaaaaaaaaaaaaacgaaaaaaaaaaaacgacgaaaacgaacgcgaacgaaacgtaaaaacgacgaaaccgaaacacaccgacaaaaaaaaaacgaacgaaaaaataacgaacgcgtaaaaaaaaaa

SEQ ID NO: 35189 - DNA, 583 bp, Artificial Sequence
  chemically treated genomic DNA (Homo sapiens) CpG-island No: 35189
ggaaaacgcggtagtagtttgaggtcgtttttcggcggggacgagtgaattacgaataaagatcgggtttcgagaagatcgggaaaaagaaaaatttttaaacgattaaggacgagagtttaaaaaatatcggagcgagatataattaggagaggggtaaatttttaaggacggtcgacgaggaattacgatggaatataaataattaaatacgataataggggatataagtttattatattagaacggaatatattgcgtttttgggagaaggcgacgaaattacgcgtaagtaaagagagatatagtagaaaaggatcgagcgatcgtaagggtatttttcgtattagtagaggagagagatataacgcgggagatacgacgataacgtataataaattataatagtgtaagatagatttaatataggatagcgagtaacgaagcgcgtagaagataattataaggaataaagcgtcgagaagaattcgttattataagaaaaaggtagagacgacgtattaataagaaagagggacgaggattcgaagacgcgggagggaagacgataataaataagagt

SEQ ID NO: 35190 - DNA, 583 bp, Artificial Sequence
  chemically treated genomic DNA (Homo sapiens) CpG-island No: 35190
actcttatttattatcgtcttccctcccgcgtcttcgaatcctcgtccctctttcttattaatacgtcgtctctacctttttcttataataacgaattcttctcgacgctttattccttataattatcttctacgcgcttcgttactcgctatcctatattaaatctatcttacactattataatttattatacgttatcgtcgtatctcccgcgttatatctctctcctctactaatacgaaaaatacccttacgatcgctcgatccttttctactatatctctctttacttacgcgtaatttcgtcgccttctcccaaaaacgcaatatattccgttctaatataataaacttatatcccctattatcgtatttaattatttatattccatcgtaattcctcgtcgaccgtccttaaaaatttacccctctcctaattatatctcgctccgatattttttaaactctcgtccttaatcgtttaaaaatttttctttttcccgatcttctcgaaacccgatctttattcgtaattcactcgtccccgccgaaaaacgacctcaaactactaccgcgttttcc

SEQ ID NO: 35191 - DNA, 583 bp, Artificial Sequence
  chemically treated genomic DNA (Homo sapiens) CpG-island No: 35191
gtttttgtttgttgtcgttttttttttcgcgttttcggattttcgttttttttttttgttggtgcgtcgtttttgttttttttttgtggtgacgggtttttttcggcgttttgttttttgtggttgttttttgcgcgtttcgttgttcgttgttttgtgttggatttgttttgtattgttgtggtttgttgtgcgttgtcgtcgtatttttcgcgttgtgttttttttttttgttggtgcggggggtgtttttgcggtcgttcggtttttttttgttgtatttttttttgtttgcgcgtggtttcgtcgtttttttttagggacgtagtgtgtttcgttttggtgtggtgagtttgtgttttttgttgtcgtgtttgattgtttgtattttatcgtggtttttcgtcggtcgtttttgggggtttgttttttttttggttgtgtttcgtttcggtgttttttgggttttcgtttttggtcgtttgggggtttttttttttttcgattttttcggggttcggtttttgttcgtggtttattcgttttcgtcggggggcggttttaggttgttgtcgcgtttttt

SEQ ID NO: 35192 - DNA, 583 bp, Artificial Sequence
  chemically treated genomic DNA (Homo sapiens) CpG-island No: 35192
aaaaaacgcgacaacaacctaaaaccgccccccgacgaaaacgaataaaccacgaacaaaaaccgaaccccgaaaaaatcgaaaaaaaaaaaaacccccaaacgaccaaaaacgaaaacccaaaaaacaccgaaacgaaacacaaccaaaaaaaaaacaaacccccaaaaacgaccgacgaaaaaccacgataaaatacaaacaatcaaacacgacaacaaaaaacacaaactcaccacaccaaaacgaaacacactacgtccctaaaaaaaaacgacgaaaccacgcgcaaacaaaaaaaaatacaacaaaaaaaaaccgaacgaccgcaaaaacaccccccgcaccaacaaaaaaaaaaaacacaacgcgaaaaatacgacgacaacgcacaacaaaccacaacaatacaaaacaaatccaacacaaaacaacgaacaacgaaacgcgcaaaaaacaaccacaaaaaacaaaacgccgaaaaaaacccgtcaccacaaaaaaaaaacaaaaacgacgcaccaacaaaaaaaaaaaacgaaaatccgaaaacgcgaaaaaaaaaacgacaacaaacaaaaac

SEQ ID NO: 35193 - DNA, 1752 bp, Artificial Sequence
  chemically treated genomic DNA (Homo sapiens) CpG-island No: 35193
gcgtggcggggtttttaggagcggtagttcgtgcggtttgggggcggtttttttttcgtatcgtagcggggcgtgtaaagcgtttgcggttgtagtgtgggcgtttattttacgtgttcggcggcgtgcgaggagtagtaatattttttgtgggcgatgaaggtggataggttgttgaatttgatgttgtaaagacggtagtatcggtggttgtcgttgggtagcggcgtcggcgtgtttttgttgggagtttggacgtttttgttcgagtaggaggggggcgtcggcgggggcggtacggtttcgggcgcggcggtcggggacgggggcgggtcgggcggcggtttttggggtttcgggtcgaggtcgtttcgggggttacgggattcgggttgcggggaggcggcgggggcgggagcgggcgaggggtcgcggtcggtcggcgttcgggtttcgattttcgggtcggttaggggcgcgtcgagtagtaggtcgtgcgttaggcggaaatgttttagtaggttttcgcgtatcgggtcgttcggggggtagtaggggtaggcggcggcgggtaggtcgagcgcgtcgggcggtggcgtagcggggtacgagtattttttgtgcgttaggtaggtttcgaggttgtggaagtttacgcggtaggtcgtgtattcgtggtagtcggttagcgtcggtgtcggggtttcggggagcgggcgtcgcggttttttgtttaggtcgatggggtcgtcggtcgcggggtcgggcgagcgcgtaggggcgaggtcggggtcgttttcgttttcgttttcgggtcgcggcgattcgggcgcgggggcgtggtcgggcggcggggggggcggggcgtcggtcgcgtgtagttcgtagagtttgcggcgtttgcgcgtgcgtataggcgcggcgggagagggggtcgggggcgcggtcggtttagggggtttcgggggcgcggtcggtcggcgcggcggcgggtcgtggcgcgaggcgtagtagtatcgtttgtgtacggtgtaggtttcgtggcggttgaagcggatgttgtaggtttcgtatagcgtgcggttggggtcgtttttcgcgtcgtttacggagttattcgggttttggttgttttcgttgtttcggtcgttcgcgtcgttttcgggcgtggtcgcgtttttagtttttttttcgcgcgtttcggggttcggggacgagcgcggcgcgtcgggttcggcgggttggtcggggggcgcgcgggtcgggtcggggggcgttttgggtttgcgcgcggtaggcgcgttttcgggcgtacggcggtttgaatagtagaggcgtttgtgtacgtagtagttgttgacgttgttgaaggtgatttcgtattcgaagtacgtagcgtttttgggggtttcggggaagagttcggtttgcgcgtcgtcggcgttcgcgttcgcgttttgttgtagtcggttgtgtattagttcggatattttggttaggattttcgaggcggggggcgtcgcgtcgggttcgaatacgtattgcggaaggaatagggtttcggttaggtttagttcgtcgggtatcgggttggagttcggcgtggggttggatagttcggttttgatttggtcggggcggggttgcgcggcgacggcgttcgcgacggggtttggggtttaggtttttcggggtttaggatgggggtcgttttcggtttttttatcgtttttattttgatgtttttggggg

SEQ ID NO: 35194 - DNA, 1752 bp, Artificial Sequence
  chemically treated genomic DNA (Homo sapiens) CpG-island No: 35194
cccccaaaaacatcaaaataaaaacgataaaaaaaccgaaaacgacccccatcctaaaccccgaaaaacctaaaccccaaaccccgtcgcgaacgccgtcgccgcgcaaccccgccccgaccaaatcaaaaccgaactatccaaccccacgccgaactccaacccgatacccgacgaactaaacctaaccgaaaccctattccttccgcaatacgtattcgaacccgacgcgacgccccccgcctcgaaaatcctaaccaaaatatccgaactaatacacaaccgactacaacaaaacgcgaacgcgaacgccgacgacgcgcaaaccgaactcttccccgaaacccccaaaaacgctacgtacttcgaatacgaaatcaccttcaacaacgtcaacaactactacgtacacaaacgcctctactattcaaaccgccgtacgcccgaaaacgcgcctaccgcgcgcaaacccaaaacgccccccgacccgacccgcgcgccccccgaccaacccgccgaacccgacgcgccgcgctcgtccccgaaccccgaaacgcgcgaaaaaaaaactaaaaacgcgaccacgcccgaaaacgacgcgaacgaccgaaacaacgaaaacaaccaaaacccgaataactccgtaaacgacgcgaaaaacgaccccaaccgcacgctatacgaaacctacaacatccgcttcaaccgccacgaaacctacaccgtacacaaacgatactactacgcctcgcgccacgacccgccgccgcgccgaccgaccgcgcccccgaaaccccctaaaccgaccgcgcccccgaccccctctcccgccgcgcctatacgcacgcgcaaacgccgcaaactctacgaactacacgcgaccgacgccccgccccccccgccgcccgaccacgcccccgcgcccgaatcgccgcgacccgaaaacgaaaacgaaaacgaccccgacctcgcccctacgcgctcgcccgaccccgcgaccgacgaccccatcgacctaaacaaaaaaccgcgacgcccgctccccgaaaccccgacaccgacgctaaccgactaccacgaatacacgacctaccgcgtaaacttccacaacctcgaaacctacctaacgcacaaaaaatactcgtaccccgctacgccaccgcccgacgcgctcgacctacccgccgccgcctacccctactaccccccgaacgacccgatacgcgaaaacctactaaaacatttccgcctaacgcacgacctactactcgacgcgcccctaaccgacccgaaaatcgaaacccgaacgccgaccgaccgcgacccctcgcccgctcccgcccccgccgcctccccgcaacccgaatcccgtaacccccgaaacgacctcgacccgaaaccccaaaaaccgccgcccgacccgcccccgtccccgaccgccgcgcccgaaaccgtaccgcccccgccgacgcccccctcctactcgaacaaaaacgtccaaactcccaacaaaaacacgccgacgccgctacccaacgacaaccaccgatactaccgtctttacaacatcaaattcaacaacctatccaccttcatcgcccacaaaaaatattactactcctcgcacgccgccgaacacgtaaaataaacgcccacactacaaccgcaaacgctttacacgccccgctacgatacgaaaaaaaaaccgcccccaaaccgcacgaactaccgctcctaaaaaccccgccacgc

SEQ ID NO: 35195 - DNA, 1752 bp, Artificial Sequence
  chemically treated genomic DNA (Homo sapiens) CpG-island No: 35195
tttttaggagtattaaggtggaggcggtggaggagtcggaggcggtttttattttgggtttcggagagtttgggttttaggtttcgtcgcggacgtcgtcgtcgcgtagtttcgtttcggttaggttaaggtcgagttgtttagttttacgtcgggttttagttcggtgttcggcgagttgggtttggtcggggttttgtttttttcgtagtacgtgttcgggttcgacgcggcgtttttcgtttcggagattttggttaagatgttcgagttggtgtatagtcggttgtagtagggcgcgggcgcgggcgtcggcggcgcgtagatcgggttttttttcggggtttttaagggcgttacgtgtttcgagtgcgagattatttttagtaacgttaataattattacgtgtataagcgtttttattgtttaggtcgtcgtgcgttcgaggacgcgtttgtcgcgcgtaggtttaaggcgtttttcggttcggttcgcgcgtttttcggttagttcgtcgaattcgacgcgtcgcgttcgttttcgggtttcggagcgcgcgaggagggggttgggggcgcggttacgttcgaggacggcgcgggcggtcggggtagcgagggtagttagagttcgggtagtttcgtggacgacgcggaggacgattttagtcgtacgttgtgcgaggtttgtaatattcgttttagtcgttacgagatttatatcgtgtataagcggtattattgcgtttcgcgttacgattcgtcgtcgcgtcgatcggtcgcgttttcgggattttttgggtcggtcgcgttttcggttttttttttcgtcgcgtttgtgcgtacgcgtagacgtcgtaagttttacgagttgtacgcggtcggcgtttcgtttttttcgtcgttcggttacgttttcgcgttcgagtcgtcgcggttcggaagcggaagcggaagcggtttcggtttcgtttttgcgcgttcgttcggtttcgcggtcgacggttttatcgatttgagtaagaagtcgcggcgttcgtttttcggagtttcggtatcggcgttggtcgattattacgagtgtacggtttgtcgcgtgagtttttatagtttcgaggtttatttggcgtataagaagtattcgtgtttcgttgcgttatcgttcggcgcgttcggtttgttcgtcgtcgtttgtttttattgtttttcgaacggttcggtgcgcggggatttgttggagtattttcgtttggcgtacggtttgttgttcggcgcgtttttggtcggttcgggggtcgaggttcggacgtcggtcgatcgcggtttttcgttcgttttcgttttcgtcgttttttcgtagttcgggtttcgtggttttcgggacggtttcggttcggagttttaggagtcgtcgttcggttcgttttcgttttcggtcgtcgcgttcgaggtcgtgtcgttttcgtcggcgttttttttttattcggataagggcgtttagatttttagtaagggtacgtcggcgtcgttgtttaacggtaattatcggtattgtcgtttttgtaatattaagtttagtagtttgtttatttttatcgtttataagaagtattattgtttttcgtacgtcgtcgagtacgtgaagtgagcgtttatattatagtcgtagacgttttgtacgtttcgttgcgatgcggggagggggtcgtttttaggtcgtacggattgtcgtttttgggaatttcgttacgt

SEQ ID NO: 35196 - DNA, 1752 bp, Artificial Sequence
  chemically treated genomic DNA (Homo sapiens) CpG-island No: 35196
acgtaacgaaattcccaaaaacgacaatccgtacgacctaaaaacgaccccctccccgcatcgcaacgaaacgtacaaaacgtctacgactataatataaacgctcacttcacgtactcgacgacgtacgaaaaacaataatacttcttataaacgataaaaataaacaaactactaaacttaatattacaaaaacgacaataccgataattaccgttaaacaacgacgccgacgtacccttactaaaaatctaaacgcccttatccgaataaaaaaaaaacgccgacgaaaacgacacgacctcgaacgcgacgaccgaaaacgaaaacgaaccgaacgacgactcctaaaactccgaaccgaaaccgtcccgaaaaccacgaaacccgaactacgaaaaaacgacgaaaacgaaaacgaacgaaaaaccgcgatcgaccgacgtccgaacctcgacccccgaaccgaccaaaaacgcgccgaacaacaaaccgtacgccaaacgaaaatactccaacaaatccccgcgcaccgaaccgttcgaaaaacaataaaaacaaacgacgacgaacaaaccgaacgcgccgaacgataacgcaacgaaacacgaatacttcttatacgccaaataaacctcgaaactataaaaactcacgcgacaaaccgtacactcgtaataatcgaccaacgccgataccgaaactccgaaaaacgaacgccgcgacttcttactcaaatcgataaaaccgtcgaccgcgaaaccgaacgaacgcgcaaaaacgaaaccgaaaccgcttccgcttccgcttccgaaccgcgacgactcgaacgcgaaaacgtaaccgaacgacgaaaaaaacgaaacgccgaccgcgtacaactcgtaaaacttacgacgtctacgcgtacgcacaaacgcgacgaaaaaaaaaaccgaaaacgcgaccgacccaaaaaatcccgaaaacgcgaccgatcgacgcgacgacgaatcgtaacgcgaaacgcaataataccgcttatacacgatataaatctcgtaacgactaaaacgaatattacaaacctcgcacaacgtacgactaaaatcgtcctccgcgtcgtccacgaaactacccgaactctaactaccctcgctaccccgaccgcccgcgccgtcctcgaacgtaaccgcgcccccaaccccctcctcgcgcgctccgaaacccgaaaacgaacgcgacgcgtcgaattcgacgaactaaccgaaaaacgcgcgaaccgaaccgaaaaacgccttaaacctacgcgcgacaaacgcgtcctcgaacgcacgacgacctaaacaataaaaacgcttatacacgtaataattattaacgttactaaaaataatctcgcactcgaaacacgtaacgcccttaaaaaccccgaaaaaaaacccgatctacgcgccgccgacgcccgcgcccgcgccctactacaaccgactatacaccaactcgaacatcttaaccaaaatctccgaaacgaaaaacgccgcgtcgaacccgaacacgtactacgaaaaaaacaaaaccccgaccaaacccaactcgccgaacaccgaactaaaacccgacgtaaaactaaacaactcgaccttaacctaaccgaaacgaaactacgcgacgacgacgtccgcgacgaaacctaaaacccaaactctccgaaacccaaaataaaaaccgcctccgactcctccaccgcctccaccttaatactcctaaaaa

SEQ ID NO: 35197 - DNA, 936 bp, Artificial Sequence
  chemically treated genomic DNA (Homo sapiens) CpG-island No: 35197
cgttttaagtttttattcgttttagtcgcggcgttttcgcgttgttttttaattcggtcgggtttggtggttaaagataaggttttttatcgtttttggcgatcgttatcgggtcgatcggttaggtttttatcggagtttatatcgattcgggcgggaggaaaatttagcgggttgggggcgtcgggggtttcgagttgtttcggtttcgcgtttttcgtcggtagttcggtttatcgttttcgttatttggtcggttaaggtcgcgttttcgtttcgttttgttttcgtttttacgtttgaagttaataaatggaagcgtttattttagttattatcggttgcgcgttttattagcgcggtatatttattttcgtacggaataaaaggcgtatagaggcgcgggtagttgcgttagggttttgatgggggcgcgggtggggggtgggcggttcgaagcgttcggtttttttcgttttgtattcgcggttcggtcgtaggtgaggttagggtagcgggtaggtataggcgttggtaagagggcgggcgggcgggcgtcgtcgtttggtgataattagttttcgtattttaacgtgttgagatttgttatggggaggaggcgtttcgggtcgcgagcgatagggagggttcgcggttttgtttttttcgttcgggttttttttttgtttcggtttcgggtcgtaacgaggatgggtcgcggtggtttatcgtgtattcgtcgcggttttagtttttaaagtgcgcgcgttttgttcgtttcgttgggttgggttacgggttttcgttggcgttggcggttttattagcgttggagatcggtttttaatttgcgatttttttgttcgagttatttgtattttttattatagtgaaatattatatatatatatatatatatatatatatatatatata

SEQ ID NO: 35198 - DNA, 936 bp, Artificial Sequence
  chemically treated genomic DNA (Homo sapiens) CpG-island No: 35198
tatatatatatatatatatatatatatatatatatataatatttcactataataaaaaatacaaataactcgaacaaaaaaatcgcaaattaaaaaccgatctccaacgctaataaaaccgccaacgccaacgaaaacccgtaacccaacccaacgaaacgaacaaaacgcgcgcactttaaaaactaaaaccgcgacgaatacacgataaaccaccgcgacccatcctcgttacgacccgaaaccgaaacaaaaaaaaaacccgaacgaaaaaaacaaaaccgcgaaccctccctatcgctcgcgacccgaaacgcctcctccccataacaaatctcaacacgttaaaatacgaaaactaattatcaccaaacgacgacgcccgcccgcccgccctcttaccaacgcctatacctacccgctaccctaacctcacctacgaccgaaccgcgaatacaaaacgaaaaaaaccgaacgcttcgaaccgcccaccccccacccgcgcccccatcaaaaccctaacgcaactacccgcgcctctatacgccttttattccgtacgaaaataaatataccgcgctaataaaacgcgcaaccgataataactaaaataaacgcttccatttattaacttcaaacgtaaaaacgaaaacaaaacgaaacgaaaacgcgaccttaaccgaccaaataacgaaaacgataaaccgaactaccgacgaaaaacgcgaaaccgaaacaactcgaaacccccgacgcccccaacccgctaaattttcctcccgcccgaatcgatataaactccgataaaaacctaaccgatcgacccgataacgatcgccaaaaacgataaaaaaccttatctttaaccaccaaacccgaccgaattaaaaaacaacgcgaaaacgccgcgactaaaacgaataaaaacttaaaacg

SEQ ID NO: 35199 - DNA, 936 bp, Artificial Sequence
  chemically treated genomic DNA (Homo sapiens) CpG-island No: 35199
tgtgtgtgtgtgtgtgtgtgtgtgtgtgtgtgtgtgtggtgttttattgtgatgagaaatgtagatagttcggatagggagatcgtaggttggaaatcgatttttagcgttgataaggtcgttagcgttagcgagagttcgtagtttagtttagcggggcgggtagagcgcgcgtattttgggaattgggatcgcggcgggtgtacggtgagttatcgcggtttattttcgttgcggttcgggatcggggtagagaaagggttcggacgaggaaggtagggtcgcggattttttttgtcgttcgcggttcggggcgttttttttttatggtagattttagtacgttaagatgcgaaggttgattgttattaagcggcggcgttcgttcgttcgtttttttgttagcgtttgtgtttgttcgttgttttggttttatttgcggtcgggtcgcgagtgtagagcggagggggtcgagcgtttcgggtcgtttattttttattcgcgtttttattaaagttttggcgtagttgttcgcgtttttgtgcgttttttgtttcgtgcggagatagatgtgtcgcgttgataaggcgcgtaatcgatggtggttgagataggcgtttttatttattaattttaaacgtgggagcgggggtagggcgaggcgggagcgcggttttggtcggttagatggcggaggcgataggtcgggttgtcgacggggagcgcggggtcggggtagttcgggattttcggcgtttttagttcgttgggtttttttttcgttcgagtcgatgtgagtttcgataagagtttggtcggtcggttcgatggcgatcgttaagagcgataagaggttttatttttggttattaggttcggtcgggttggagaatagcgcgggggcgtcgcgattggggcgagtgggggtttggaacg

SEQ ID NO: 35200 - DNA, 936 bp, Artificial Sequence
  chemically treated genomic DNA (Homo sapiens) CpG-island No: 35200
cgttccaaacccccactcgccccaatcgcgacgcccccgcgctattctccaacccgaccgaacctaataaccaaaaataaaacctcttatcgctcttaacgatcgccatcgaaccgaccgaccaaactcttatcgaaactcacatcgactcgaacgaaaaaaaaacccaacgaactaaaaacgccgaaaatcccgaactaccccgaccccgcgctccccgtcgacaacccgacctatcgcctccgccatctaaccgaccaaaaccgcgctcccgcctcgccctacccccgctcccacgtttaaaattaataaataaaaacgcctatctcaaccaccatcgattacgcgccttatcaacgcgacacatctatctccgcacgaaacaaaaaacgcacaaaaacgcgaacaactacgccaaaactttaataaaaacgcgaataaaaaataaacgacccgaaacgctcgaccccctccgctctacactcgcgacccgaccgcaaataaaaccaaaacaacgaacaaacacaaacgctaacaaaaaaacgaacgaacgaacgccgccgcttaataacaatcaaccttcgcatcttaacgtactaaaatctaccataaaaaaaaaacgccccgaaccgcgaacgacaaaaaaaatccgcgaccctaccttcctcgtccgaaccctttctctaccccgatcccgaaccgcaacgaaaataaaccgcgataactcaccgtacacccgccgcgatcccaattcccaaaatacgcgcgctctacccgccccgctaaactaaactacgaactctcgctaacgctaacgaccttatcaacgctaaaaatcgatttccaacctacgatctccctatccgaactatctacatttctcatcacaataaaacaccacacacacacacacacacacacacacacacacacaca

SEQ ID NO: 35201 - DNA, 823 bp, Artificial Sequence
  chemically treated genomic DNA (Homo sapiens) CpG-island No: 35201
cgtcgtattatttcgtagatgcgggggaggggtaggtcgcgaggggtcgagttgttcgggtcgcgtttttaaatatttttttttcggttttcgggcggtttttttttgggttgaatttttcggtgtttaagtcgagacgcgggggtttaggtcgtcggcggagattagattacggcgcgtttggtatagcgcggggggcgcggcgcggggtgaaggtcgtcggcgtttagggtagagcggggacgggcgggggcggcgttggcggttgggtttcggcgggggtcgggcgcgcggaggggatcgcgggtaaagtttgatttacgtttgatttgtcgggggttgttttgttttcgtttggatatgttttcggcgtcgcgcgttttttcggcggtcgtttttagtttcgggcgggcggcggcgggcggcgggggcgcggcggggtcgcggggtcgtttatgttttcggttttcggttttcgcggtcgtttcggttcgcgtttttagttcgcgcgtttagtttcggagtcgttggagttgtcgcggaggttcgagaggttacggttttgcgttgcgggcgcgcggattgttcgacgggcgggtgtcggttttttcgttttcgcgtattcgtcgtcgtcgtcgcggtcgttcggttttttttaatggaattcgcgggcggcgagcggcggagtaggcggttattgcgagggcgtttttggcgggttggaggtacggggcggggtcgggtttgagcgtcgtcggtcgtcgtatttttcgtttcgtttcgggataggatataacgtttataacggagataatggatataa

SEQ ID NO: 35202 - DNA, 823 bp, Artificial Sequence
  chemically treated genomic DNA (Homo sapiens) CpG-island No: 35202
ttatatccattatctccgttataaacgttatatcctatcccgaaacgaaacgaaaaatacgacgaccgacgacgctcaaacccgaccccgccccgtacctccaacccgccaaaaacgccctcgcaataaccgcctactccgccgctcgccgcccgcgaattccattaaaaaaaaccgaacgaccgcgacgacgacgacgaatacgcgaaaacgaaaaaaccgacacccgcccgtcgaacaatccgcgcgcccgcaacgcaaaaccgtaacctctcgaacctccgcgacaactccaacgactccgaaactaaacgcgcgaactaaaaacgcgaaccgaaacgaccgcgaaaaccgaaaaccgaaaacataaacgaccccgcgaccccgccgcgcccccgccgcccgccgccgcccgcccgaaactaaaaacgaccgccgaaaaaacgcgcgacgccgaaaacatatccaaacgaaaacaaaacaacccccgacaaatcaaacgtaaatcaaactttacccgcgatcccctccgcgcgcccgacccccgccgaaacccaaccgccaacgccgcccccgcccgtccccgctctaccctaaacgccgacgaccttcaccccgcgccgcgccccccgcgctataccaaacgcgccgtaatctaatctccgccgacgacctaaacccccgcgtctcgacttaaacaccgaaaaattcaacccaaaaaaaaaccgcccgaaaaccgaaaaaaaaatatttaaaaacgcgacccgaacaactcgacccctcgcgacctacccctcccccgcatctacgaaataatacgacg

SEQ ID NO: 35203 - DNA, 823 bp, Artificial Sequence
  chemically treated genomic DNA (Homo sapiens) CpG-island No: 35203
ttgtgtttattgttttcgttatagacgttgtgttttatttcggggcggggcgggaggtgcggcggtcgacgacgtttaggttcggtttcgtttcgtgtttttagttcgttaggagcgttttcgtagtggtcgtttgtttcgtcgttcgtcgttcgcgggttttattgagaaaagtcgagcggtcgcggcggcggcggcgagtgcgcgggagcggaggagtcggtattcgttcgtcgggtagttcgcgcgttcgtaacgtaggatcgtggtttttcgggttttcgcggtagttttagcggtttcggggttgggcgcgcgggttgggggcgcgggtcggggcggtcgcggagatcgggggtcgggggtatgagcggtttcgcggtttcgtcgcgttttcgtcgttcgtcgtcgttcgttcggggttagaggcggtcgtcgggagggcgcgcggcgtcggagatatgtttaggcggaaatagagtaattttcggtagattaagcgtgagttaaattttgttcgcggtttttttcgcgcgttcgattttcgtcggagtttagtcgttagcgtcgttttcgttcgttttcgttttgttttgggcgtcggcgatttttatttcgcgtcgcgtttttcgcgttgtgttaagcgcgtcgtaatttaattttcgtcggcggtttgggttttcgcgtttcggtttgggtatcggggggtttagtttaggagggggtcgttcggaggtcgggaggagggtgtttgggggcgcggttcgggtagttcggtttttcgcggtttgtttttttttcgtatttgcgagatggtgcggcg

SEQ ID NO: 35204 - DNA, 823 bp, Artificial Sequence
  chemically treated genomic DNA (Homo sapiens) CpG-island No: 35204
cgccgcaccatctcgcaaatacgaaaaaaaaacaaaccgcgaaaaaccgaactacccgaaccgcgcccccaaacaccctcctcccgacctccgaacgaccccctcctaaactaaaccccccgatacccaaaccgaaacgcgaaaacccaaaccgccgacgaaaattaaattacgacgcgcttaacacaacgcgaaaaacgcgacgcgaaataaaaatcgccgacgcccaaaacaaaacgaaaacgaacgaaaacgacgctaacgactaaactccgacgaaaatcgaacgcgcgaaaaaaaccgcgaacaaaatttaactcacgcttaatctaccgaaaattactctatttccgcctaaacatatctccgacgccgcgcgccctcccgacgaccgcctctaaccccgaacgaacgacgacgaacgacgaaaacgcgacgaaaccgcgaaaccgctcatacccccgacccccgatctccgcgaccgccccgacccgcgcccccaacccgcgcgcccaaccccgaaaccgctaaaactaccgcgaaaacccgaaaaaccacgatcctacgttacgaacgcgcgaactacccgacgaacgaataccgactcctccgctcccgcgcactcgccgccgccgccgcgaccgctcgacttttctcaataaaacccgcgaacgacgaacgacgaaacaaacgaccactacgaaaacgctcctaacgaactaaaaacacgaaacgaaaccgaacctaaacgtcgtcgaccgccgcacctcccgccccgccccgaaataaaacacaacgtctataacgaaaacaataaacacaa

SEQ ID NO: 35205 - DNA, 959 bp, Artificial Sequence
  chemically treated genomic DNA (Homo sapiens) CpG-island No: 35205
tagtcgcgttagggggttaattaatttcgatatcgttcggcgttagttgggcgttattaggcgcggatttcggagcgagggtaggtgcgcgggtcggaagtttcgggcgtttatttggtatttatttggagtttatttggcgttcgggtttcgcgtcgtcgtttttcgtttagttcgtcgcgttcgtatttcgcggtttttgaggtttagtaggagtattttttttattagggttagtcgcgtttttttggagtcgtttttgtcgtcgtcgttttgttcgtcgcggcggttttgcgcgtcgttttcgttgttgtcggcgtcgtcgttcgtcgttcgttttttgtcggcggcgttgcgggaggtttcggtgcgtcgttgtattaggtcggagttgcgttgggttagcgaggttatggttttcgtcgaggcgtcgagtcgggtcgagagggtcgtaggatcgatcgggtcgtttttttttttttcgcgcggttttcgattcgggttttcgtgttaaattcggacgtcggggcgacgttcgtcggtagtagggtcgggggtagttatgaggaaataggttaggtcgaagcgggttggtcgggcgtcggcggggtaggagaggagcgtttttttgtttgtggtcgtagttttcgaaatatttcgagttttaaggcggaggcggcggcggcgtttttttaatatggcggtttcggttgacgttatcggaggatgtggtagagtcggcgcgggagagttgggtcgggaggcgtcggaagcggcggtcggggattcgttgttattgtagtttatatttttttcggttttcggtgtttgttttttttttggcgtttttgcgttttttgattcgcggttttgtagttttgttttcgtgacgtgtttttttttttttcgtttttcgttttttttttattatttagggttggagtttgaatttggcgggg

SEQ ID NO: 35206 - DNA, 959 bp, Artificial Sequence
  chemically treated genomic DNA (Homo sapiens) CpG-island No: 35206
ccccgccaaattcaaactccaaccctaaataataaaaaaaaaacgaaaaacgaaaaaaaaaaaaacacgtcacgaaaacaaaactacaaaaccgcgaatcaaaaaacgcaaaaacgccaaaaaaaaaacaaacaccgaaaaccgaaaaaaatataaactacaataacaacgaatccccgaccgccgcttccgacgcctcccgacccaactctcccgcgccgactctaccacatcctccgataacgtcaaccgaaaccgccatattaaaaaaacgccgccgccgcctccgccttaaaactcgaaatatttcgaaaactacgaccacaaacaaaaaaacgctcctctcctaccccgccgacgcccgaccaacccgcttcgacctaacctatttcctcataactacccccgaccctactaccgacgaacgtcgccccgacgtccgaatttaacacgaaaacccgaatcgaaaaccgcgcgaaaaaaaaaaaaacgacccgatcgatcctacgaccctctcgacccgactcgacgcctcgacgaaaaccataacctcgctaacccaacgcaactccgacctaatacaacgacgcaccgaaacctcccgcaacgccgccgacaaaaaacgaacgacgaacgacgacgccgacaacaacgaaaacgacgcgcaaaaccgccgcgacgaacaaaacgacgacgacaaaaacgactccaaaaaaacgcgactaaccctaataaaaaaaatactcctactaaacctcaaaaaccgcgaaatacgaacgcgacgaactaaacgaaaaacgacgacgcgaaacccgaacgccaaataaactccaaataaataccaaataaacgcccgaaacttccgacccgcgcacctaccctcgctccgaaatccgcgcctaataacgcccaactaacgccgaacgatatcgaaattaattaaccccctaacgcgacta

SEQ ID NO: 35207 - DNA, 959 bp, Artificial Sequence
  chemically treated genomic DNA (Homo sapiens) CpG-island No: 35207
tttcgttaggtttaggttttagttttgggtagtgaaggggaaacggggaacggaaggagggagggtacgttacgggagtaggattgtaggatcgcgggttagggggcgtaggaacgttaaagaaaagataagtatcgagggtcgggaagggtgtaggttgtagtggtagcggattttcggtcgtcgttttcggcgtttttcggtttagttttttcgcgtcgattttgttatatttttcggtgacgttagtcggggtcgttatattggaaaggcgtcgtcgtcgttttcgttttggagttcggggtgtttcggggattgcggttataggtaggaaggcgttttttttttgtttcgtcgacgttcggttagttcgtttcggtttgatttgtttttttatgattgttttcggttttgttgtcgacggacgtcgtttcggcgttcggatttaatacggaaattcggatcggaggtcgcgcggggaggaggagggcgattcggtcggttttgcgattttttcggttcggttcggcgtttcggcgggagttatgatttcgttgatttagcgtagtttcggtttggtgtagcggcgtatcgaggtttttcgtaacgtcgtcgataaggagcgggcggcgggcggcggcgtcggtagtagcgaggacgacgcgtagagtcgtcgcgacgagtaggacgacgacgataagggcgattttaaggaaacgcggttgattttgatggaggaagtgtttttgttgggttttaaggatcgcgaggtgcgggcgcggcgggttgggcggggggcggcggcgcggggttcgggcgttaggtgagttttaggtaggtgttaggtgagcgttcgaggttttcggttcgcgtatttgttttcgtttcgaagttcgcgtttggtggcgtttagttgacgtcgagcggtgtcggagttggttgattttttggcgcggttg

SEQ ID NO: 35208 - DNA, 959 bp, Artificial Sequence
  chemically treated genomic DNA (Homo sapiens) CpG-island No: 35208
caaccgcgccaaaaaatcaaccaactccgacaccgctcgacgtcaactaaacgccaccaaacgcgaacttcgaaacgaaaacaaatacgcgaaccgaaaacctcgaacgctcacctaacacctacctaaaactcacctaacgcccgaaccccgcgccgccgccccccgcccaacccgccgcgcccgcacctcgcgatccttaaaacccaacaaaaacacttcctccatcaaaatcaaccgcgtttccttaaaatcgcccttatcgtcgtcgtcctactcgtcgcgacgactctacgcgtcgtcctcgctactaccgacgccgccgcccgccgcccgctccttatcgacgacgttacgaaaaacctcgatacgccgctacaccaaaccgaaactacgctaaatcaacgaaatcataactcccgccgaaacgccgaaccgaaccgaaaaaatcgcaaaaccgaccgaatcgccctcctcctccccgcgcgacctccgatccgaatttccgtattaaatccgaacgccgaaacgacgtccgtcgacaacaaaaccgaaaacaatcataaaaaaacaaatcaaaccgaaacgaactaaccgaacgtcgacgaaacaaaaaaaaaacgccttcctacctataaccgcaatccccgaaacaccccgaactccaaaacgaaaacgacgacgacgcctttccaatataacgaccccgactaacgtcaccgaaaaatataacaaaatcgacgcgaaaaaactaaaccgaaaaacgccgaaaacgacgaccgaaaatccgctaccactacaacctacacccttcccgaccctcgatacttatcttttctttaacgttcctacgccccctaacccgcgatcctacaatcctactcccgtaacgtaccctccctccttccgttccccgtttccccttcactacccaaaactaaaacctaaacctaacgaaa

SEQ ID NO: 35209 - DNA, 781 bp, Artificial Sequence
  chemically treated genomic DNA (Homo sapiens) CpG-island No: 35209
ggttgttggtggatggcgtgaataagtcgaaattgtggttttatttgtcggttgattattgggtataacggtcgaatcgcgtgtcgattttttttttggattgtaagatgtggaatgtgatcgcgttgttacgaaagtcgatggtattggtagtttgttgtttgttgttgacgcggtatatcggttatatcggttcggtgtcggaacgtgcgttgtagaagattttttcgtttatttaatgcgtagtttgttggcgcgtaattcggcgttggaagcggcggttttcgacgatatttattggggttgtgtgtagtagacgttggagtagggttttaatatcgttcgtaacgcggcgttgttggtagaagtattatattttgtttcggcggttatcgttaatcgtttgtgtggtttatttatgtaggtattgtatgacgtagtacgaatgattatgattggcgatgcgtaggtatgtttggttggcggcgtggagtatatgggttatgtgtcgatgagttacggcgtcgatttttatttcggtttgagtcgtaatgtcgttaaagcggcgggtatgatgggtttaacggtagaaatgttggcgcgtatgtacggtattagtcgtgaaatgtaggatgtttttgtcgcgcggttatacgttcgcgtttgggtcgttacgtagtcggtcgtatttaaataatgaaattatttcgatcggtggttacgatgtcgacggcgttttgaagtagtttaatttacgacgaagtgattcgtttaggaaatt

SEQ ID NO: 35210 - DNA, 781 bp, Artificial Sequence
  chemically treated genomic DNA (Homo sapiens) CpG-island No: 35210
aatttcctaaacgaatcacttcgtcgtaaattaaactacttcaaaacgccgtcgacatcgtaaccaccgatcgaaataatttcattatttaaatacgaccgactacgtaacgacccaaacgcgaacgtataaccgcgcgacaaaaacatcctacatttcacgactaataccgtacatacgcgccaacatttctaccgttaaacccatcatacccgccgctttaacgacattacgactcaaaccgaaataaaaatcgacgccgtaactcatcgacacataacccatatactccacgccgccaaccaaacatacctacgcatcgccaatcataatcattcgtactacgtcatacaatacctacataaataaaccacacaaacgattaacgataaccgccgaaacaaaatataatacttctaccaacaacgccgcgttacgaacgatattaaaaccctactccaacgtctactacacacaaccccaataaatatcgtcgaaaaccgccgcttccaacgccgaattacgcgccaacaaactacgcattaaataaacgaaaaaatcttctacaacgcacgttccgacaccgaaccgatataaccgatataccgcgtcaacaacaaacaacaaactaccaataccatcgactttcgtaacaacgcgatcacattccacatcttacaatccaaaaaaaaaatcgacacgcgattcgaccgttatacccaataatcaaccgacaaataaaaccacaatttcgacttattcacgccatccaccaacaacc

SEQ ID NO: 35211 - DNA, 781 bp, Artificial Sequence
  chemically treated genomic DNA (Homo sapiens) CpG-island No: 35211
ggttttttgggcgaattatttcgtcgtaagttaaattgttttaggacgtcgtcggtatcgtgattatcggtcgggatgattttattatttaaatgcggtcgattgcgtggcggtttaggcgcgggcgtgtgatcgcgcggtaaaggtattttgtattttacggttgatatcgtgtatacgcgttagtatttttgtcgttaagtttattatgttcgtcgttttggcgatattgcggtttaggtcggggtgaaaatcgacgtcgtgatttatcggtatatggtttatatgttttacgtcgttaattagatatgtttgcgtatcgttagttatgattattcgtgttgcgttatgtagtgtttgtatggatgaattatataagcgattaacggtaatcgtcgggatagagtgtggtatttttgttagtagcgtcgcgttacgggcgatattaaaattttgttttagcgtttgttgtatataattttagtaaatatcgtcgagggtcgtcgtttttagcgtcgggttacgcgttagtaggttacgtattaaatgagcggagagattttttgtagcgtacgtttcggtatcggatcgatataatcgatatgtcgcgttagtagtagatagtaggttattaatgttatcggttttcgtgatagcgcgattatattttatattttatagtttagaaagaggatcggtacgcggttcgatcgttgtgtttagtaattaatcggtagatagaattatagtttcggtttgtttacgttatttattagtaatt

SEQ ID NO: 35212 - DNA, 781 bp, Artificial Sequence
  chemically treated genomic DNA (Homo sapiens) CpG-island No: 35212
aattactaataaataacgtaaacaaaccgaaactataattctatctaccgattaattactaaacacaacgatcgaaccgcgtaccgatcctctttctaaactataaaatataaaatataatcgcgctatcacgaaaaccgataacattaataacctactatctactactaacgcgacatatcgattatatcgatccgataccgaaacgtacgctacaaaaaatctctccgctcatttaatacgtaacctactaacgcgtaacccgacgctaaaaacgacgaccctcgacgatatttactaaaattatatacaacaaacgctaaaacaaaattttaatatcgcccgtaacgcgacgctactaacaaaaataccacactctatcccgacgattaccgttaatcgcttatataattcatccatacaaacactacataacgcaacacgaataatcataactaacgatacgcaaacatatctaattaacgacgtaaaacatataaaccatataccgataaatcacgacgtcgattttcaccccgacctaaaccgcaatatcgccaaaacgacgaacataataaacttaacgacaaaaatactaacgcgtatacacgatatcaaccgtaaaatacaaaatacctttaccgcgcgatcacacgcccgcgcctaaaccgccacgcaatcgaccgcatttaaataataaaatcatcccgaccgataatcacgataccgacgacgtcctaaaacaatttaacttacgacgaaataattcgcccaaaaaacc

SEQ ID NO: 35213 - DNA, 916 bp, Artificial Sequence
  chemically treated genomic DNA (Homo sapiens) CpG-island No: 35213
tgtggcgagggatcgtcgtagattgattgaggttaaagcgtttgcgtaattagttcgttaagatcggataatcgggtttagcgggtagatttagttgtaaaataatcgttttttcgttagggacgtagagtacggtgataattatcgtatcggttaacgttatcgtggtaggtagatgattattggtaagattttgtagcgttattagcggatcggttagcggaacggtgtcgaataataggttattgttgtagttgtcgtgtaacgatttagtatattagaatcgatggaatacgattttaaagaatagtttttagatacgagagatattgataataggcgacgataatattagttaacggtgattgcgttattagtttttttttttttagcgtttcgcgttcggcgttacgtttacgatttgttattgtttttttttagttagtcgaagcggtaatggtgatttaatttttttttcgttagtgatagcggtaatattttgattgtcggttgttttagtacgtatattttttcgtatttatcgtaatcggtataggcgtcgttgtgaatcgtcggtagaaagcgggcgtgtttatcggtacgcgtgttgcgttttagttttagggtgatggttttattaattttcgggtattcgcgataataaatatcgtagcgtagtttttgaaagttgagatagtttttttggtttattagtatcgttagttttattcgcgcgtcgtcgatcgatttaattttacgatttagcgtatcgtttgggtatattttggcgtacggaatgtttttatatatttcgtaaggaatatttcgtgcgataaaatatggcgtgttcgtcgatagattagaggttagcgtcgttagttttaaggtgtcgtaagggtaagtttgaatatattga

SEQ ID NO: 35214 - DNA, 916 bp, Artificial Sequence
  chemically treated genomic DNA (Homo sapiens) CpG-island No: 35214
tcaatatattcaaacttacccttacgacaccttaaaactaacgacgctaacctctaatctatcgacgaacacgccatattttatcgcacgaaatattccttacgaaatatataaaaacattccgtacgccaaaatatacccaaacgatacgctaaatcgtaaaattaaatcgatcgacgacgcgcgaataaaactaacgatactaataaaccaaaaaaactatctcaactttcaaaaactacgctacgatatttattatcgcgaatacccgaaaattaataaaaccatcaccctaaaactaaaacgcaacacgcgtaccgataaacacgcccgctttctaccgacgattcacaacgacgcctataccgattacgataaatacgaaaaaatatacgtactaaaacaaccgacaatcaaaatattaccgctatcactaacgaaaaaaaaattaaatcaccattaccgcttcgactaactaaaaaaaaacaataacaaatcgtaaacgtaacgccgaacgcgaaacgctaaaaaaaaaaaaactaataacgcaatcaccgttaactaatattatcgtcgcctattatcaatatctctcgtatctaaaaactattctttaaaatcgtattccatcgattctaatatactaaatcgttacacgacaactacaacaataacctattattcgacaccgttccgctaaccgatccgctaataacgctacaaaatcttaccaataatcatctacctaccacgataacgttaaccgatacgataattatcaccgtactctacgtccctaacgaaaaaacgattattttacaactaaatctacccgctaaacccgattatccgatcttaacgaactaattacgcaaacgctttaacctcaatcaatctacgacgatccctcgccaca

SEQ ID NO: 35215 - DNA, 916 bp, Artificial Sequence
  chemically treated genomic DNA (Homo sapiens) CpG-island No: 35215
ttagtgtgtttaggtttgtttttacgatattttaaaattggcgacgttggtttttggtttgtcggcgggtacgttatattttgtcgtacgggatattttttgcgaaatgtgtgaggatatttcgtgcgttaaagtgtgtttaagcggtgcgttggatcgtgagattgaatcgatcgacgacgcgcggatggggttggcggtattggtggattaggaaaattgttttaatttttaggggttgcgttgcgatgtttgttatcgcgaatgttcgaaaattgatgaggttattattttggagttggagcgtaatacgcgtatcggtaagtacgttcgttttttgtcgacggtttatagcgacgtttgtatcggttgcggtaagtgcgaaaaagtatgcgtgttggaataatcggtaattaaggtgttatcgttgttattggcgaaaggggagttaggttattattatcgtttcggttggttggaggggaataatggtaaatcgtaaacgtgacgtcgggcgcgaggcgttggagaaaaaaaggttggtggcgtagttatcgttggttggtgttatcgtcgtttgttgttagtgtttttcgtgtttggggattgttttttggagtcgtgttttatcggttttggtgtgttggatcgttgtacggtaattatagtagtagtttgttattcgatatcgtttcgttgatcgattcgttgatgacgttgtaaagttttgttagtggttatttgtttgttacggtggcgttgatcggtgcggtgattattatcgtgttttacgtttttggcgggaaagcgattattttgtagttgggtttgttcgttgaattcgattattcgattttagcgaattggttacgtaggcgttttgattttaattagtttgcgacgatttttcgttata

SEQ ID NO: 35216 - DNA, 916 bp, Artificial Sequence
  chemically treated genomic DNA (Homo sapiens) CpG-island No: 35216
tataacgaaaaatcgtcgcaaactaattaaaatcaaaacgcctacgtaaccaattcgctaaaatcgaataatcgaattcaacgaacaaacccaactacaaaataatcgctttcccgccaaaaacgtaaaacacgataataatcaccgcaccgatcaacgccaccgtaacaaacaaataaccactaacaaaactttacaacgtcatcaacgaatcgatcaacgaaacgatatcgaataacaaactactactataattaccgtacaacgatccaacacaccaaaaccgataaaacacgactccaaaaaacaatccccaaacacgaaaaacactaacaacaaacgacgataacaccaaccaacgataactacgccaccaacctttttttctccaacgcctcgcgcccgacgtcacgtttacgatttaccattattcccctccaaccaaccgaaacgataataataacctaactcccctttcgccaataacaacgataacaccttaattaccgattattccaacacgcatactttttcgcacttaccgcaaccgatacaaacgtcgctataaaccgtcgacaaaaaacgaacgtacttaccgatacgcgtattacgctccaactccaaaataataacctcatcaattttcgaacattcgcgataacaaacatcgcaacgcaacccctaaaaattaaaacaattttcctaatccaccaataccgccaaccccatccgcgcgtcgtcgatcgattcaatctcacgatccaacgcaccgcttaaacacactttaacgcacgaaatatcctcacacatttcgcaaaaaatatcccgtacgacaaaatataacgtacccgccgacaaaccaaaaaccaacgtcgccaattttaaaatatcgtaaaaacaaacctaaacacactaa

SEQ ID NO: 35217 - DNA, 1195 bp, Artificial Sequence
  chemically treated genomic DNA (Homo sapiens) CpG-island No: 35217
attcgtcgaaagcgtttttaggttggcggttttttttttttagttcgatacgggttttcgattcgaatttagttttttagtcggaggcgggtggtcgtaagtttggggttttcggtcggtaatcgaattggtgggcgcggcgttcgtttcgcggttttcgcgtacgggtttgtttcgttatcgaggagtcggagttttttagggacggggattcgtaggtttcgggaagtcgttttaatcggagttgttcggttttcgagtttatttgtcgtatttgggcggcggttcggtttgggttttagtcgttggttattcgcgcgggtaggtcggagggaataaaggcgtttcggggaggggacgagttttttttttcgtcgcgtttttagagggcgggttgtcggggttcgcggtgggagaggttttttcggtttttcgatttttcggcgttgggtcgtgcgcggttcgggttagggcggcgggtttcgattcggtgtttacgttagttacgcgttttcggtttaagcgcgcgtttttatttgaagttttggcgttattcgtcgggcgagggtcggcgtgtttttattttttcgttattttttttttttagagatttcgttcggttcggagtgggtagattcggagtttttcgcgtcggagatcgcgagtcgttcggtcgaggaggcgcggcggggcgggggcggggcggaggggtcggttcgtagtttttaatgtcgggagttcgcgttggagatttagggagtttagttcggggtcgcggtacggagaacgaattattcgtggtttggagacgtatttcgtcgagcggttagaattttttttatttagcgattcggaaaggaagttaatatttttatttagagaggtttcggtcgcggaaagatgcggtcgcggtatagtcgtgtttttattacgtaattgattatagattaatttcgcgcggaattatcggtttagggcgtttcgttaagaggcggattgtgttggtttcgcgggttttacgtttagggaacgtcgcggttttttttatacgggatatcggtttcgtagcgtcgcggattaggatggttttttatttttcgagcgggagttttaacgtaggtttaggcgggttttgttaaaaggtttttggttatattatttatgcgtggagttttgggggttttagtaataaagt

SEQ ID NO: 35218 - DNA, 1195 bp, Artificial Sequence
  chemically treated genomic DNA (Homo sapiens) CpG-island No: 35218
actttattactaaaacccccaaaactccacgcataaataatataaccaaaaaccttttaacaaaacccgcctaaacctacgttaaaactcccgctcgaaaaataaaaaaccatcctaatccgcgacgctacgaaaccgatatcccgtataaaaaaaaccgcgacgttccctaaacgtaaaacccgcgaaaccaacacaatccgcctcttaacgaaacgccctaaaccgataattccgcgcgaaattaatctataatcaattacgtaataaaaacacgactataccgcgaccgcatctttccgcgaccgaaacctctctaaataaaaatattaacttcctttccgaatcgctaaataaaaaaaattctaaccgctcgacgaaatacgtctccaaaccacgaataattcgttctccgtaccgcgaccccgaactaaactccctaaatctccaacgcgaactcccgacattaaaaactacgaaccgacccctccgccccgcccccgccccgccgcgcctcctcgaccgaacgactcgcgatctccgacgcgaaaaactccgaatctacccactccgaaccgaacgaaatctctaaaaaaaaaaaataacgaaaaaataaaaacacgccgaccctcgcccgacgaataacgccaaaacttcaaataaaaacgcgcgcttaaaccgaaaacgcgtaactaacgtaaacaccgaatcgaaacccgccgccctaacccgaaccgcgcacgacccaacgccgaaaaatcgaaaaaccgaaaaaacctctcccaccgcgaaccccgacaacccgccctctaaaaacgcgacgaaaaaaaaaactcgtcccctccccgaaacgcctttattccctccgacctacccgcgcgaataaccaacgactaaaacccaaaccgaaccgccgcccaaatacgacaaataaactcgaaaaccgaacaactccgattaaaacgacttcccgaaacctacgaatccccgtccctaaaaaactccgactcctcgataacgaaacaaacccgtacgcgaaaaccgcgaaacgaacgccgcgcccaccaattcgattaccgaccgaaaaccccaaacttacgaccacccgcctccgactaaaaaactaaattcgaatcgaaaacccgtatcgaactaaaaaaaaaaaaccgccaacctaaaaacgctttcgacgaat

SEQ ID NO: 35219 - DNA, 1195 bp, Artificial Sequence
  chemically treated genomic DNA (Homo sapiens) CpG-island No: 35219
attttgttattgaggtttttagagttttacgtataagtggtgtgattagaaattttttaataagattcgtttgagtttgcgttagagttttcgttcggaaagtaaaagattattttaattcgcggcgttgcggaatcggtgtttcgtgtgggaggaatcgcggcgttttttgggcgtagggttcgcgaggttagtatagttcgttttttggcggagcgttttgggtcggtggtttcgcgcggagttagtttgtggttagttacgtggtgaaaatacggttgtgtcgcggtcgtattttttcgcggtcgaggtttttttgggtgggagtgttggtttttttttcggatcgttaaatggggaaagttttggtcgttcggcgggatacgtttttaggttacggatggttcgtttttcgtgtcgcggtttcgagttgggttttttgggtttttagcgcgggttttcggtattgggggttgcgggtcggttttttcgtttcgttttcgtttcgtcgcgttttttcggtcgagcggttcgcggttttcggcgcgggaggtttcgagtttgtttatttcgggtcgagcgaggtttttggaggagaagagtggcgaggaggtgagggtacgtcggttttcgttcggcgggtggcgttaggattttaggtgggaacgcgcgtttgggtcgggggcgcgtggttggcgtggatatcggatcggggttcgtcgttttggttcggatcgcgtacggtttagcgtcgggaagtcgggaagtcggggaggttttttttatcgcgggtttcggtagttcgttttttgaaagcgcggcggagaaggaggttcgtttttttttcggaacgtttttgtttttttcggtttgttcgcgcgggtggttagcggttgggatttaggtcgggtcgtcgtttaggtgcggtaggtaggttcgggggtcgggtagtttcggttggggcggtttttcggggtttgcgggttttcgtttttgaggagtttcggtttttcggtggcgggataggttcgtgcgcgggagtcgcgaggcgaacgtcgcgtttattaattcggttgtcggtcgggggttttaggtttgcggttattcgttttcggttggagggttgaattcgagtcgaaagttcgtgtcgggttggaaagaagaaatcgttaatttgagaacgttttcggcgagt

SEQ ID NO: 35220 - DNA, 1195 bp, Artificial Sequence
  chemically treated genomic DNA (Homo sapiens) CpG-island No: 35220
actcgccgaaaacgttctcaaattaacgatttcttctttccaacccgacacgaactttcgactcgaattcaaccctccaaccgaaaacgaataaccgcaaacctaaaacccccgaccgacaaccgaattaataaacgcgacgttcgcctcgcgactcccgcgcacgaacctatcccgccaccgaaaaaccgaaactcctcaaaaacgaaaacccgcaaaccccgaaaaaccgccccaaccgaaactacccgacccccgaacctacctaccgcacctaaacgacgacccgacctaaatcccaaccgctaaccacccgcgcgaacaaaccgaaaaaaacaaaaacgttccgaaaaaaaaacgaacctccttctccgccgcgctttcaaaaaacgaactaccgaaacccgcgataaaaaaaacctccccgacttcccgacttcccgacgctaaaccgtacgcgatccgaaccaaaacgacgaaccccgatccgatatccacgccaaccacgcgcccccgacccaaacgcgcgttcccacctaaaatcctaacgccacccgccgaacgaaaaccgacgtaccctcacctcctcgccactcttctcctccaaaaacctcgctcgacccgaaataaacaaactcgaaacctcccgcgccgaaaaccgcgaaccgctcgaccgaaaaaacgcgacgaaacgaaaacgaaacgaaaaaaccgacccgcaacccccaataccgaaaacccgcgctaaaaacccaaaaaacccaactcgaaaccgcgacacgaaaaacgaaccatccgtaacctaaaaacgtatcccgccgaacgaccaaaactttccccatttaacgatccgaaaaaaaaaccaacactcccacccaaaaaaacctcgaccgcgaaaaaatacgaccgcgacacaaccgtattttcaccacgtaactaaccacaaactaactccgcgcgaaaccaccgacccaaaacgctccgccaaaaaacgaactatactaacctcgcgaaccctacgcccaaaaaacgccgcgattcctcccacacgaaacaccgattccgcaacgccgcgaattaaaataatcttttactttccgaacgaaaactctaacgcaaactcaaacgaatcttattaaaaaatttctaatcacaccacttatacgtaaaactctaaaaacctcaataacaaaat

SEQ ID NO: 35221 - DNA, 628 bp, Artificial Sequence
  chemically treated genomic DNA (Homo sapiens) CpG-island No: 35221
agtcgagcgaagtcggtggggcgatcgtataagtttatggtttttattcgtttttatatacgatatttatttcgttagtgtttcggaggggaatttcgatggagtttcgcgatatgatggggttaaaaggcgagtaagtgtttcgtttcgtcgtttcgtagtcggtagttttcgttttaggttaatttagaggtgagtgacggtttcggttttggttttgattgtcgtttcgcggcgtcgttggagttttggtttttttttttcgttagtcgtttaaataacgagtagcggacggcggacggttattttcggcgatttcgttttttgtttcggaagtattttcgggggagcgtgttttacgcgagtttagtttgtggtttcggtgttttcgttttggggttggcggtttcgaagtttttgttggcgtgtcggttgtagggtgtttcgagagtttgtaggattttcggaattatttggcgtttgattttttttagcgttggcgcggtttcgaatgaaaatttggaaggcgtagtcgtttggtttcgcggtgggcggggtttttgtttgacgtggatttttcgggatgggtttggttaattttgttttttttttaagattgttagggata

SEQ ID NO: 35222 - DNA, 628 bp, Artificial Sequence
  chemically treated genomic DNA (Homo sapiens) CpG-island No: 35222
tatccctaacaatcttaaaaaaaaaacaaaattaaccaaacccatcccgaaaaatccacgtcaaacaaaaaccccgcccaccgcgaaaccaaacgactacgccttccaaattttcattcgaaaccgcgccaacgctaaaaaaaatcaaacgccaaataattccgaaaatcctacaaactctcgaaacaccctacaaccgacacgccaacaaaaacttcgaaaccgccaaccccaaaacgaaaacaccgaaaccacaaactaaactcgcgtaaaacacgctcccccgaaaatacttccgaaacaaaaaacgaaatcgccgaaaataaccgtccgccgtccgctactcgttatttaaacgactaacgaaaaaaaaaaaccaaaactccaacgacgccgcgaaacgacaatcaaaaccaaaaccgaaaccgtcactcacctctaaattaacctaaaacgaaaactaccgactacgaaacgacgaaacgaaacacttactcgccttttaaccccatcatatcgcgaaactccatcgaaattcccctccgaaacactaacgaaataaatatcgtatataaaaacgaataaaaaccataaacttatacgatcgccccaccgacttcgctcgact

SEQ ID NO: 35223 - DNA, 628 bp, Artificial Sequence
  chemically treated genomic DNA (Homo sapiens) CpG-island No: 35223
tatttttaataattttgggaagaaaataggattggttaggtttatttcgagaggtttacgttaggtaggggtttcgtttatcgcgggattaagcggttacgttttttaagtttttattcggggtcgcgttagcgttgaggagagttagacgttagatggtttcgaaggttttgtaggttttcggggtattttatagtcgatacgttaataaaagtttcggagtcgttaattttaaaacggaaatatcggagttataagttgagttcgcgtagggtacgttttttcgggagtgttttcgggatagggggcggggtcgtcggaagtggtcgttcgtcgttcgttgttcgttgtttaagcggttgacgggaaggagaagttagagttttagcggcgtcgcggggcggtagttaagattagagtcggagtcgttatttatttttggattagtttgaagcggagattatcggttgcggagcggcggggcgagatatttgttcgttttttgattttattatgtcgcggggttttatcgagattttttttcgggatattgacgaggtaagtgtcgtgtatggaggcgggtgggggttatgaatttgtacgatcgttttatcgatttcgttcgatt

SEQ ID NO: 35224 - DNA, 628 bp, Artificial Sequence
  chemically treated genomic DNA (Homo sapiens) CpG-island No: 35224
aatcgaacgaaatcgataaaacgatcgtacaaattcataacccccacccgcctccatacacgacacttacctcgtcaatatcccgaaaaaaaatctcgataaaaccccgcgacataataaaatcaaaaaacgaacaaatatctcgccccgccgctccgcaaccgataatctccgcttcaaactaatccaaaaataaataacgactccgactctaatcttaactaccgccccgcgacgccgctaaaactctaacttctccttcccgtcaaccgcttaaacaacgaacaacgaacgacgaacgaccacttccgacgaccccgccccctatcccgaaaacactcccgaaaaaacgtaccctacgcgaactcaacttataactccgatatttccgttttaaaattaacgactccgaaacttttattaacgtatcgactataaaataccccgaaaacctacaaaaccttcgaaaccatctaacgtctaactctcctcaacgctaacgcgaccccgaataaaaacttaaaaaacgtaaccgcttaatcccgcgataaacgaaacccctacctaacgtaaacctctcgaaataaacctaaccaatcctattttcttcccaaaattattaaaaata

SEQ ID NO: 35225 - DNA, 640 bp, Artificial Sequence
  chemically treated genomic DNA (Homo sapiens) CpG-island No: 35225
aaggagtgttatagcgttaaattttgttggtttcgcgttaggtcgagttttatttttttagttcgcggttaatatttttatttcgttttatagttcgtcgcgttcgcggggcgatattttttattttattatttcggaggtggtgcggtcgagtttcggatttaattggcggaagcggggtcggttgtgtgcgcgcgtataaatgttcggatgcgtcgcgacgattcgcgcgtttttttcgggcggtagggggcgcgtatcgaggtatcgcggcgagtttggttgtttttggggtttgtgtggttttgtgtgtcggaaagatggagtaagaagtcgagttcgaggggcggtcgcgatttttttgatcgagattttgttgttttcgtagttaggagtatcgttttttttcggattagtgcgtacgagcgtttagtgttttggttcggagagtggaatgattttcgaggtttagggcgtcgtgttttcgcgcgtttcgtgaaggaaattggggagttttgagggattttcgattttaagcgcgaaaatttcggatggtgaggagtaggtattggttcggtagcgagcggttatttttgggtttgggttttgacggtgttttttttatcgttggtttttagtt

SEQ ID NO: 35226 - DNA, 640 bp, Artificial Sequence
  chemically treated genomic DNA (Homo sapiens) CpG-island No: 35226
aactaaaaaccaacgataaaaaaaacaccgtcaaaacccaaacccaaaaataaccgctcgctaccgaaccaatacctactcctcaccatccgaaattttcgcgcttaaaatcgaaaatccctcaaaactccccaatttccttcacgaaacgcgcgaaaacacgacgccctaaacctcgaaaatcattccactctccgaaccaaaacactaaacgctcgtacgcactaatccgaaaaaaaacgatactcctaactacgaaaacaacaaaatctcgatcaaaaaaatcgcgaccgcccctcgaactcgacttcttactccatctttccgacacacaaaaccacacaaaccccaaaaacaaccaaactcgccgcgatacctcgatacgcgccccctaccgcccgaaaaaaacgcgcgaatcgtcgcgacgcatccgaacatttatacgcgcgcacacaaccgaccccgcttccgccaattaaatccgaaactcgaccgcaccacctccgaaataataaaataaaaaatatcgccccgcgaacgcgacgaactataaaacgaaataaaaatattaaccgcgaactaaaaaaataaaactcgacctaacgcgaaaccaacaaaatttaacgctataacactcctt

SEQ ID NO: 35227 - DNA, 640 bp, Artificial Sequence
  chemically treated genomic DNA (Homo sapiens) CpG-island No: 35227
ggttgggaattagcgatagaggggatatcgttagagtttagatttaaaagtgatcgttcgttgtcgggttagtatttgttttttattattcggggttttcgcgtttggagtcgggggttttttaagattttttagttttttttacggggcgcgcggaagtacgacgttttgggtttcggggattattttatttttcgggttagggtattgggcgttcgtacgtattaattcggggagggacggtgtttttggttgcgaaagtagtaggatttcggttagaggggtcgcggtcgtttttcgggttcggttttttgttttattttttcgatatatagggttatataggttttagaagtagttaagttcgtcgcggtgtttcggtgcgcgttttttatcgttcgaggggagcgcgcgggtcgtcgcggcgtattcgggtatttgtgcgcgcgtatataatcggtttcgttttcgttaattgggttcggggttcggtcgtattattttcgggatgatggagtggggggtgtcgtttcgcgggcgcggcgggttgtgaggcggggtgggggtgttggtcgcgagttgagagggtggggttcggtttggcgcggagttagtaaggtttggcgttgtgatatttttt

SEQ ID NO: 35228 - DNA, 640 bp, Artificial Sequence
  chemically treated genomic DNA (Homo sapiens) CpG-island No: 35228
aaaaaatatcacaacgccaaaccttactaactccgcgccaaaccgaaccccaccctctcaactcgcgaccaacacccccaccccgcctcacaacccgccgcgcccgcgaaacgacaccccccactccatcatcccgaaaataatacgaccgaaccccgaacccaattaacgaaaacgaaaccgattatatacgcgcgcacaaatacccgaatacgccgcgacgacccgcgcgctcccctcgaacgataaaaaacgcgcaccgaaacaccgcgacgaacttaactacttctaaaacctatataaccctatatatcgaaaaaataaaacaaaaaaccgaacccgaaaaacgaccgcgacccctctaaccgaaatcctactactttcgcaaccaaaaacaccgtccctccccgaattaatacgtacgaacgcccaataccctaacccgaaaaataaaataatccccgaaacccaaaacgtcgtacttccgcgcgccccgtaaaaaaaactaaaaaatcttaaaaaacccccgactccaaacgcgaaaaccccgaataataaaaaacaaatactaacccgacaacgaacgatcacttttaaatctaaactctaacgatatcccctctatcgctaattcccaacc

SEQ ID NO: 35229 - DNA, 516 bp, Artificial Sequence
  chemically treated genomic DNA (Homo sapiens) CpG-island No: 35229
tttcgtgtcgggggtatttcggggttcgtagagggggtgttttgtttttgagtttcgatagttcgcgttgggcgcgttttttcgtagtttttagaaaggagttattaggtagcgtttcgcgggttttttttttcgggattttttttgggaattcggaggttttcggcgcggtaggcgtaaggggagcggggtcggcgaggaggggtgaattggcgaaataaagtcgtgatttagggggttttttttcggggatcgcggcgggtacgtttcgggtattttatttttcggtttcgatttttggatcggtttttaagaaagcggttttcgcgggtttcgagttgtgcggaaaggttaggtttttttcgattcgaaggtatttataggttgttttttaattttatttagatcgcgttaacggggttaagtggggtttgaggttcgggttgggggtcgcggcgatttgagattagggtaggagggtttcgtgtttgagattttcggcgagagcgttaggtt

SEQ ID NO: 35230 - DNA, 516 bp, Artificial Sequence
  chemically treated genomic DNA (Homo sapiens) CpG-island No: 35230
aacctaacgctctcgccgaaaatctcaaacacgaaaccctcctaccctaatctcaaatcgccgcgacccccaacccgaacctcaaaccccacttaaccccgttaacgcgatctaaataaaattaaaaaacaacctataaataccttcgaatcgaaaaaaacctaacctttccgcacaactcgaaacccgcgaaaaccgctttcttaaaaaccgatccaaaaatcgaaaccgaaaaataaaatacccgaaacgtacccgccgcgatccccgaaaaaaaaccccctaaatcacgactttatttcgccaattcacccctcctcgccgaccccgctccccttacgcctaccgcgccgaaaacctccgaattcccaaaaaaaatcccgaaaaaaaaaacccgcgaaacgctacctaataactcctttctaaaaactacgaaaaaacgcgcccaacgcgaactatcgaaactcaaaaacaaaacaccccctctacgaaccccgaaatacccccgacacgaaa

SEQ ID NO: 35231 - DNA, 516 bp, Artificial Sequence
  chemically treated genomic DNA (Homo sapiens) CpG-island No: 35231
agtttggcgttttcgtcgggggttttaggtacggggtttttttgttttgattttaggtcgtcgcggtttttagttcgagttttagattttatttaatttcgttagcgcgatttgggtaaggttgggaggtagtttatagatgttttcgggtcggaaggagtttggttttttcgtatagttcggggttcgcgggggtcgtttttttgaggatcgatttaagaatcggggtcggggagtgggatgttcggagcgtgttcgtcgcgattttcgaagagaagttttttgagttacgattttgtttcgttagtttattttttttcgtcgatttcgttttttttgcgtttgtcgcgtcgagggttttcgggtttttaagaggggtttcgggaggaggggttcgcggagcgttgtttggtgatttttttttgaaggttgcggaaaagcgcgtttagcgcgggttgtcggggtttagggatagggtattttttttgcggatttcggagtgttttcggtacggga

SEQ ID NO: 35232 - DNA, 516 bp, Artificial Sequence
  chemically treated genomic DNA (Homo sapiens) CpG-island No: 35232
tcccgtaccgaaaacactccgaaatccgcaaaaaaaataccctatccctaaaccccgacaacccgcgctaaacgcgcttttccgcaaccttcaaaaaaaaatcaccaaacaacgctccgcgaacccctcctcccgaaacccctcttaaaaacccgaaaaccctcgacgcgacaaacgcaaaaaaaacgaaatcgacgaaaaaaaataaactaacgaaacaaaatcgtaactcaaaaaacttctcttcgaaaatcgcgacgaacacgctccgaacatcccactccccgaccccgattcttaaatcgatcctcaaaaaaacgacccccgcgaaccccgaactatacgaaaaaaccaaactccttccgacccgaaaacatctataaactacctcccaaccttacccaaatcgcgctaacgaaattaaataaaatctaaaactcgaactaaaaaccgcgacgacctaaaatcaaaacaaaaaaaccccgtacctaaaacccccgacgaaaacgccaaact

SEQ ID NO: 35233 - DNA, 554 bp, Artificial Sequence
  chemically treated genomic DNA (Homo sapiens) CpG-island No: 35233
tatcgttgggtcgtatcgttggatcgtatcgttggatcgtatcgttggattttatcgttggattttattataggatcgtatcgttggattttatcgttggattttattataggatcgtatcgttggattttatcgttggatcgtatcgttggattttattataggatcgtatcgttggattttatcgttggattttattataggatcgtatcgttggattttatcgttggattttattataggatcgtatcgttggatcgtatcgttggatcgtatcgttggatcgtacggtaggatcgtatcgttggattttattataggattttattataggattttatcgttgggtcgtatcgtaggatcgtatcgttggatcgtattatcgttttggtaggtgagcgtggagtttggcgttttttggcgacgattttggttagatttttaggagcgtttttgcgggtaaagttatatgtacgttttgttttgggtttagtaatcgagtcgtaggagagacggagtggtttggggttaggttttgagttcgaggagtagtt

SEQ ID NO: 35234 - DNA, 554 bp, Artificial Sequence
  chemically treated genomic DNA (Homo sapiens) CpG-island No: 35234
aactactcctcgaactcaaaacctaaccccaaaccactccgtctctcctacgactcgattactaaacccaaaacaaaacgtacatataactttacccgcaaaaacgctcctaaaaatctaaccaaaatcgtcgccaaaaaacgccaaactccacgctcacctaccaaaacgataatacgatccaacgatacgatcctacgatacgacccaacgataaaatcctataataaaatcctataataaaatccaacgatacgatcctaccgtacgatccaacgatacgatccaacgatacgatccaacgatacgatcctataataaaatccaacgataaaatccaacgatacgatcctataataaaatccaacgataaaatccaacgatacgatcctataataaaatccaacgatacgatccaacgataaaatccaacgatacgatcctataataaaatccaacgataaaatccaacgatacgatcctataataaaatccaacgataaaatccaacgatacgatccaacgatacgatccaacgatacgacccaacgata

SEQ ID NO: 35235 - DNA, 554 bp, Artificial Sequence
  chemically treated genomic DNA (Homo sapiens) CpG-island No: 35235
agttgtttttcggatttaggatttggttttaggttatttcgttttttttacgattcggttgttgagtttagaatagagcgtatatgtgattttattcgtaggggcgtttttggaagtttgattagggtcgtcgttagggagcgttaggttttacgtttatttgttaggacggtggtgcggtttagcggtgcggttttgcggtgcggtttagcggtgaggttttgtggtgaggttttgtggtgaggtttagcggtacggttttgtcgtgcggtttagcggtgcggtttagcggtgcggtttagcggtgcggttttgtggtgaggtttagcggtgaggtttagcggtgcggttttgtggtgaggtttagcggtgaggtttagcggtgcggttttgtggtgaggtttagcggtgcggtttagcggtgaggtttagcggtgcggttttgtggtgaggtttagcggtgaggtttagcggtgcggttttgtggtgaggtttagcggtgaggtttagcggtgcggtttagcggtgcggtttagcggtgcggtttagcggtg

SEQ ID NO: 35236 - DNA, 554 bp, Artificial Sequence
  chemically treated genomic DNA (Homo sapiens) CpG-island No: 35236
caccgctaaaccgcaccgctaaaccgcaccgctaaaccgcaccgctaaacctcaccgctaaacctcaccacaaaaccgcaccgctaaacctcaccgctaaacctcaccacaaaaccgcaccgctaaacctcaccgctaaaccgcaccgctaaacctcaccacaaaaccgcaccgctaaacctcaccgctaaacctcaccacaaaaccgcaccgctaaacctcaccgctaaacctcaccacaaaaccgcaccgctaaaccgcaccgctaaaccgcaccgctaaaccgcacgacaaaaccgtaccgctaaacctcaccacaaaacctcaccacaaaacctcaccgctaaaccgcaccgcaaaaccgcaccgctaaaccgcaccaccgtcctaacaaataaacgtaaaacctaacgctccctaacgacgaccctaatcaaacttccaaaaacgcccctacgaataaaatcacatatacgctctattctaaactcaacaaccgaatcgtaaaaaaaacgaaataacctaaaaccaaatcctaaatccgaaaaacaact

SEQ ID NO: 35237 - DNA, 529 bp, Artificial Sequence
  chemically treated genomic DNA (Homo sapiens) CpG-island No: 35237
ttcggcgtattttttgtttcgattcgcgtttttcgtttttagggtcgaaataaatatcgggtgtttggcgtcgttagaagtcgtgcgtatgcgttagcgttaagcgggacgttgcgtcgggttaaaggttagcggcgtaaaatggcggcggcgatgattttttgtcggttgttgaatcggtgtggcgaggcggcgcggagtttgtttttgggcgttaggtgtttcggggtgcgggtttcgtcgatcggggagaaggttacgtatattggttaggtaacggtcgttgggtataggatgtatttttttttagtcgtatttcgggcgattggtggtagtgggttcgtcgggtattcgcggttttggttttgcgtcggtagcgtaggtcgtggtaaggttgtgttgtcgtttacgcgtcggggaggacgttcgcgagtcgggacggtggtggtagtttgtagcggtgggtttcgtttttttagggtttgcgggttttggaacgggaagtttttttagcgggtagtatttgttg

SEQ ID NO: 35238 - DNA, 529 bp, Artificial Sequence
  chemically treated genomic DNA (Homo sapiens) CpG-island No: 35238
caacaaatactacccgctaaaaaaacttcccgttccaaaacccgcaaaccctaaaaaaacgaaacccaccgctacaaactaccaccaccgtcccgactcgcgaacgtcctccccgacgcgtaaacgacaacacaaccttaccacgacctacgctaccgacgcaaaaccaaaaccgcgaatacccgacgaacccactaccaccaatcgcccgaaatacgactaaaaaaaaatacatcctatacccaacgaccgttacctaaccaatatacgtaaccttctccccgatcgacgaaacccgcaccccgaaacacctaacgcccaaaaacaaactccgcgccgcctcgccacaccgattcaacaaccgacaaaaaatcatcgccgccgccattttacgccgctaacctttaacccgacgcaacgtcccgcttaacgctaacgcatacgcacgacttctaacgacgccaaacacccgatatttatttcgaccctaaaaacgaaaaacgcgaatcgaaacaaaaaatacgccgaa

SEQ ID NO: 35239 - DNA, 529 bp, Artificial Sequence
  chemically treated genomic DNA (Homo sapiens) CpG-island No: 35239
tagtaagtgttgttcgttggggagatttttcgttttagagttcgtaggttttggaaggacgagatttatcgttataggttgttattatcgtttcgattcgcgggcgtttttttcggcgcgtgagcgatagtataattttattacgatttgcgttgtcggcgtagaattagggtcgcggatgttcggcgagtttattgttattagtcgttcgaggtgcggttggaggaaggtgtattttgtatttagcggtcgttatttggttagtgtgcgtgatttttttttcggtcggcgagattcgtatttcgaaatatttggcgtttaggggtaggtttcgcgtcgtttcgttatatcggtttagtagtcggtagaaggttatcgtcgtcgttattttgcgtcgttggtttttgattcggcgtaacgtttcgtttagcgttaacgtatgcgtacggtttttggcggcgttaaatattcggtatttatttcggttttgggggcggggagcgcgggtcggggtagagggtgcgtcgga

SEQ ID NO: 35240 - DNA, 529 bp, Artificial Sequence
  chemically treated genomic DNA (Homo sapiens) CpG-island No: 35240
tccgacgcaccctctaccccgacccgcgctccccgcccccaaaaccgaaataaataccgaatatttaacgccgccaaaaaccgtacgcatacgttaacgctaaacgaaacgttacgccgaatcaaaaaccaacgacgcaaaataacgacgacgataaccttctaccgactactaaaccgatataacgaaacgacgcgaaacctacccctaaacgccaaatatttcgaaatacgaatctcgccgaccgaaaaaaaaatcacgcacactaaccaaataacgaccgctaaatacaaaatacaccttcctccaaccgcacctcgaacgactaataacaataaactcgccgaacatccgcgaccctaattctacgccgacaacgcaaatcgtaataaaattatactatcgctcacgcgccgaaaaaaacgcccgcgaatcgaaacgataataacaacctataacgataaatctcgtccttccaaaacctacgaactctaaaacgaaaaatctccccaacgaacaacacttacta

SEQ ID NO: 35241 - DNA, 565 bp, Artificial Sequence
  chemically treated genomic DNA (Homo sapiens) CpG-island No: 35241
gcgcggttatttttggggcgggtatttaatttttcgttttgtaaattgcggggtgacgggacgttgttattaggatttaagatggttatcgcgttcgttagttatttcgttagttcgcgcgttagtgagttggtacgagatacgcggtggtttacggcgtttggggacgatttttagtttttcgtacggggcggagcgttcgttttttttttaattagtacgtcgggtcggttagttaggggtcgttcgcgcgcggggtgtgtgaggacgcgtttttagtcgttgagtgtttgagtcgggaagtagttgttgtggtatttgttgttgttcgagcggacgtagagtatcggacgcgggcgtcgtggcgttgggtaggagggcgaagttatgacgttagttaggtaacgagcgggcggttgttttgattgtttcgagttgggcgttagtttttcgagcgcgtgagtattgtcgttttttttcgcgggtggtttggagtttgttttcgtttttggtttttttcgtgttgggggtttttttcgtattttttatttgggtatttttgttt

SEQ ID NO: 35242 - DNA, 565 bp, Artificial Sequence
  chemically treated genomic DNA (Homo sapiens) CpG-island No: 35242
aaacaaaaatacccaaataaaaaatacgaaaaaaacccccaacacgaaaaaaaccaaaaacgaaaacaaactccaaaccacccgcgaaaaaaaacgacaatactcacgcgctcgaaaaactaacgcccaactcgaaacaatcaaaacaaccgcccgctcgttacctaactaacgtcataacttcgccctcctacccaacgccacgacgcccgcgtccgatactctacgtccgctcgaacaacaacaaataccacaacaactacttcccgactcaaacactcaacgactaaaaacgcgtcctcacacaccccgcgcgcgaacgacccctaactaaccgacccgacgtactaattaaaaaaaaaacgaacgctccgccccgtacgaaaaactaaaaatcgtccccaaacgccgtaaaccaccgcgtatctcgtaccaactcactaacgcgcgaactaacgaaataactaacgaacgcgataaccatcttaaatcctaataacaacgtcccgtcaccccgcaatttacaaaacgaaaaattaaatacccgccccaaaaataaccgcgc

SEQ ID NO: 35243 - DNA, 565 bp, Artificial Sequence
  chemically treated genomic DNA (Homo sapiens) CpG-island No: 35243
aagtagaaatgtttaaatgaaaagtgcggagggaatttttaatacgagggggattagaggcggaggtaggttttagattattcgcgagaaggagcgatagtgtttacgcgttcgggaggttaacgtttagttcggagtagttaaggtagtcgttcgttcgttatttgattgacgttatggtttcgtttttttgtttagcgttacggcgttcgcgttcgatgttttacgttcgttcgggtagtagtaggtattatagtaattgtttttcggtttaggtatttagcgattgggagcgcgtttttatatatttcgcgcgcgggcggtttttggttagtcggttcggcgtgttgattggagggaaggcgggcgtttcgtttcgtgcgaagggttggagatcgtttttagacgtcgtgggttatcgcgtgtttcgtgttagtttattggcgcgcgggttagcgagatgattagcgggcgcggtggttattttgagttttagtaatagcgtttcgttatttcgtagtttatagggcgagagattgggtgttcgttttaaaaatggtcgcgt

SEQ ID NO: 35244 - DNA, 565 bp, Artificial Sequence
  chemically treated genomic DNA (Homo sapiens) CpG-island No: 35244
acgcgaccatttttaaaacgaacacccaatctctcgccctataaactacgaaataacgaaacgctattactaaaactcaaaataaccaccgcgcccgctaatcatctcgctaacccgcgcgccaataaactaacacgaaacacgcgataacccacgacgtctaaaaacgatctccaacccttcgcacgaaacgaaacgcccgccttccctccaatcaacacgccgaaccgactaaccaaaaaccgcccgcgcgcgaaatatataaaaacgcgctcccaatcgctaaatacctaaaccgaaaaacaattactataatacctactactacccgaacgaacgtaaaacatcgaacgcgaacgccgtaacgctaaacaaaaaaacgaaaccataacgtcaatcaaataacgaacgaacgactaccttaactactccgaactaaacgttaacctcccgaacgcgtaaacactatcgctccttctcgcgaataatctaaaacctacctccgcctctaatccccctcgtattaaaaattccctccgcacttttcatttaaacatttctactt

SEQ ID NO: 35245 - DNA, 850 bp, Artificial Sequence
  chemically treated genomic DNA (Homo sapiens) CpG-island No: 35245
atttcgttttttgcgtttcgtttttcgcgttttttgcgtcgttttatttttttttttgttttatttttttattttgttttttttttttgtcgtttgttgatatttacgtgtttttgtttgtttttcgttttcgttattttttcgttttgtttttcgttcgttttatgtcgttttttttatttttttttttgtttgcgtttttttttttttttttcgttcgtttgtcgtgtttttttggtttgtttttttatggcgttatttttttttgtcgttgttggcgtgttgttttttttcgcggagttggcgttttcgttgcgttttcgttgttttttttgtggttgttttttttttttcgcgcgtgtttcgttttcgcgttcggtttcggttttagttttgttttgttggcgtgttttcgtttttttcgttttttgttgtattcgtgttttttttttcggatgttcgtcgttttgtattttcgttttgttcgtttttttttcgcgtcgtttttcgtcgttcgtttcgttgttgcgttcgcgttttttgttgtgttttgtgtcgtttgtcgtcgttttttttcgttttttttcgtgtttttcgttttttttttcgttggttttttcggttttttgtagttttttacggtttttcgttttttttttttttttggtgtgttttcgttttttgtttgtttttgtcgcgttttatttttgttttcgtttttttgttttcgttcgcggtttcgttttttttttttcggtcgtattttttttttcgttgttttgttttttttttttgtttattttttttttttgttcgttgttttcgttgtggtgttttttttgtttttgtt

SEQ ID NO: 35246 - DNA, 850 bp, Artificial Sequence
  chemically treated genomic DNA (Homo sapiens) CpG-island No: 35246
aacaaaaacaaaaaaaacaccacaacgaaaacaacgaacaaaaaaaaaaaataaacaaaaaaaaaaaacaaaacaacgaaaaaaaaaatacgaccgaaaaaaaaaaaacgaaaccgcgaacgaaaacaaaaaaacgaaaacaaaaataaaacgcgacaaaaacaaacaaaaaacgaaaacacaccaaaaaaaaaaaaaaaacgaaaaaccgtaaaaaactacaaaaaaccgaaaaaaccaacgaaaaaaaaaacgaaaaacacgaaaaaaaacgaaaaaaaacgacgacaaacgacacaaaacacaacaaaaaacgcgaacgcaacaacgaaacgaacgacgaaaaacgacgcgaaaaaaaaacgaacaaaacgaaaatacaaaacgacgaacatccgaaaaaaaaaacacgaatacaacaaaaaacgaaaaaaacgaaaacacgccaacaaaacaaaactaaaaccgaaaccgaacgcgaaaacgaaacacgcgcgaaaaaaaaaaaacaaccacaaaaaaaacaacgaaaacgcaacgaaaacgccaactccgcgaaaaaaaacaacacgccaacaacgacaaaaaaaaataacgccataaaaaaacaaaccaaaaaaacacgacaaacgaacgaaaaaaaaaaaaaaaaacgcaaacaaaaaaaaaaataaaaaaaacgacataaaacgaacgaaaaacaaaacgaaaaaataacgaaaacgaaaaacaaacaaaaacacgtaaatatcaacaaacgacaaaaaaaaaaaacaaaataaaaaaataaaacaaaaaaaaaaataaaacgacgcaaaaaacgcgaaaaacgaaacgcaaaaaacgaaat

SEQ ID NO: 35247 - DNA, 850 bp, Artificial Sequence
  chemically treated genomic DNA (Homo sapiens) CpG-island No: 35247
aatagaagtagagagggtattatagcgaggatagcgagtagggggagagaatagatagggagagagggtaggatagcggaggaggaagtacgatcgagaaggaaagagcgagatcgcgggcggaagtaggaagacgagagtagaggtggggcgcgataagaataagtagagagcgaagatatattaagaaagagagggaagcgagggatcgtaggaggttgtagggagtcggagaagttaacggaaaaagaggcgaagggtacggaaggagacgaggaaagacgacgataagcgatataagatatagtagaggacgcggacgtagtagcgaggcgagcgacgaggagcgacgcggaagagaggcgagtagagcgagagtatagaacgacgaatattcgaggaggaggatacggatgtaataagaagcgaggaagacggaggtacgttagtagagtaggattggggtcgggatcgaacgcggagacggaatacgcgcgagagagaagaaatagttataagaaaggtagcgagagcgtagcggggacgttagtttcgcgagggaggatagtacgttagtagcgataggggagaatgacgttatggaaggataagttaagaggatacgataggcggacggaggagggaggagggagcgtaggtagagagagaggtgagagagacgatatggggcgggcgggaggtaggacggaggggtagcgagggcgaagagtaagtagagatacgtggatgttagtagacggtagagaggagagataagatggaggagtggggtagagagggaggtaggacggcgtagagaacgcgagggacggagcgtaagaggcgagat

SEQ ID NO: 35248 - DNA, 850 bp, Artificial Sequence
  chemically treated genomic DNA (Homo sapiens) CpG-island No: 35248
atctcgcctcttacgctccgtccctcgcgttctctacgccgtcctacctccctctctaccccactcctccatcttatctctcctctctaccgtctactaacatccacgtatctctacttactcttcgccctcgctacccctccgtcctacctcccgcccgccccatatcgtctctctcacctctctctctacctacgctccctcctccctcctccgtccgcctatcgtatcctcttaacttatccttccataacgtcattctcccctatcgctactaacgtactatcctccctcgcgaaactaacgtccccgctacgctctcgctacctttcttataactatttcttctctctcgcgcgtattccgtctccgcgttcgatcccgaccccaatcctactctactaacgtacctccgtcttcctcgcttcttattacatccgtatcctcctcctcgaatattcgtcgttctatactctcgctctactcgcctctcttccgcgtcgctcctcgtcgctcgcctcgctactacgtccgcgtcctctactatatcttatatcgcttatcgtcgtctttcctcgtctccttccgtacccttcgcctctttttccgttaacttctccgactccctacaacctcctacgatccctcgcttccctctctttcttaatatatcttcgctctctacttattcttatcgcgccccacctctactctcgtcttcctacttccgcccgcgatctcgctctttccttctcgatcgtacttcctcctccgctatcctaccctctctccctatctattctctccccctactcgctatcctcgctataataccctctctacttctatt

SEQ ID NO: 35249 - DNA, 724 bp, Artificial Sequence
  chemically treated genomic DNA (Homo sapiens) CpG-island No: 35249
gtttcgtaagttggagcgtcggttcggtgtaagtttacggtttattcgtgaattttttcggttttagcggggatttaggatttcgttttttgttcgttcgatttttcgtggttcgcggggacgtttagcgttcgggtcgtgcgcgcggaaagagtcgtatcggaggaggcgtaggcggtcgggtttttatttcggattagcgggcggcgttttcgtttttatttttattcgtttcgcgtttcgggagcgtaggtaggcggcggtagggggcggggagcggttacggtggtcgtcgtcggattttagtcgcgcggttttcgcgttacgttttatttcggttcggatttatttgcgtttttgtttcggtcgcggtttggttcggggttgtattagttcgacgtagtggtggcggtagtagcggtggcgggaggtttggtttattttttatcgttgagtcggatcgagtatttagcgcggcgcggcggcgtttaacgttcgtttcgaaatttatttgtttggttaaaacggagtgacgttacgcgtcggtttaatcgacggttggtcgggggaggggttacggatttagagttttacggcgttttttgtcggatattgggggcgggaagggggaagtgaaaagggagatttggatgacgcgtttgcggtttttaagtggtagagaatgaaagtttgagtacgattgtagggaaaggaattaaatttt

SEQ ID NO: 35250 - DNA, 724 bp, Artificial Sequence
  chemically treated genomic DNA (Homo sapiens) CpG-island No: 35250
aaaatttaattcctttccctacaatcgtactcaaactttcattctctaccacttaaaaaccgcaaacgcgtcatccaaatctcccttttcacttcccccttcccgcccccaatatccgacaaaaaacgccgtaaaactctaaatccgtaacccctcccccgaccaaccgtcgattaaaccgacgcgtaacgtcactccgttttaaccaaacaaataaatttcgaaacgaacgttaaacgccgccgcgccgcgctaaatactcgatccgactcaacgataaaaaataaaccaaacctcccgccaccgctactaccgccaccactacgtcgaactaatacaaccccgaaccaaaccgcgaccgaaacaaaaacgcaaataaatccgaaccgaaataaaacgtaacgcgaaaaccgcgcgactaaaatccgacgacgaccaccgtaaccgctccccgccccctaccgccgcctacctacgctcccgaaacgcgaaacgaataaaaataaaaacgaaaacgccgcccgctaatccgaaataaaaacccgaccgcctacgcctcctccgatacgactctttccgcgcgcacgacccgaacgctaaacgtccccgcgaaccacgaaaaatcgaacgaacaaaaaacgaaatcctaaatccccgctaaaaccgaaaaaattcacgaataaaccgtaaacttacaccgaaccgacgctccaacttacgaaac

SEQ ID NO: 35251 - DNA, 724 bp, Artificial Sequence
  chemically treated genomic DNA (Homo sapiens) CpG-island No: 35251
gaggtttgatttttttttttatagtcgtgtttaaatttttattttttattatttgggggtcgtagacgcgttatttaggtttttttttttattttttttttttcgtttttagtgttcggtagggggcgtcgtgaaattttggattcgtggtttttttttcggttaatcgtcgattgggtcggcgcgtgacgttatttcgttttagttaaataaatgggtttcggggcgagcgttgggcgtcgtcgcgtcgcgttgggtgttcggttcgatttagcggtggggagtgagttaggtttttcgttatcgttgttgtcgttattattgcgtcgggttggtgtagtttcgggttaggtcgcggtcggggtaggagcgtaggtgggttcgggtcgaggtggggcgtggcgcgagggtcgcgcgattggggttcggcggcggttatcgtggtcgtttttcgttttttatcgtcgtttgtttgcgttttcggggcgcggggcgggtgggggtgggggcgggggcgtcgttcgttggttcggggtagggattcggtcgtttgcgtttttttcggtgcggtttttttcgcgcgtacggttcgggcgttgagcgttttcgcgggttacggagggtcgggcgggtagggagcggggttttgggttttcgttgaagtcgaggagatttacggataggtcgtgagtttgtatcggatcggcgttttaatttacgggat

SEQ ID NO: 35252 - DNA, 724 bp, Artificial Sequence
  chemically treated genomic DNA (Homo sapiens) CpG-island No: 35252
atcccgtaaattaaaacgccgatccgatacaaactcacgacctatccgtaaatctcctcgacttcaacgaaaacccaaaaccccgctccctacccgcccgaccctccgtaacccgcgaaaacgctcaacgcccgaaccgtacgcgcgaaaaaaaccgcaccgaaaaaaacgcaaacgaccgaatccctaccccgaaccaacgaacgacgcccccgcccccacccccacccgccccgcgccccgaaaacgcaaacaaacgacgataaaaaacgaaaaacgaccacgataaccgccgccgaaccccaatcgcgcgaccctcgcgccacgccccacctcgacccgaacccacctacgctcctaccccgaccgcgacctaacccgaaactacaccaacccgacgcaataataacgacaacaacgataacgaaaaacctaactcactccccaccgctaaatcgaaccgaacacccaacgcgacgcgacgacgcccaacgctcgccccgaaacccatttatttaactaaaacgaaataacgtcacgcgccgacccaatcgacgattaaccgaaaaaaaaaccacgaatccaaaatttcacgacgccccctaccgaacactaaaaacgaaaaaaaaaaaataaaaaaaaaaacctaaataacgcgtctacgacccccaaataataaaaaataaaaatttaaacacgactataaaaaaaaaaatcaaacctc

SEQ ID NO: 35253 - DNA, 624 bp, Artificial Sequence
  chemically treated genomic DNA (Homo sapiens) CpG-island No: 35253
  misc_feature (305)..(305): n is either a, c, g or t
  misc_feature (362)..(362): n is either a, c, g or t
cggtcgttgtggttggggtcggttaagtcgaatatcggttatacgtaagcggcggcgggtgtggttggtgtgattaagatggtgatggcgatgcggtacgggtagttgttacgtacgttgtacgtggaatttttttcgtcggaggtggattggtcggcggggacggtttaattttttacggagaatacgttttggtttaggagtggtcgtgttcgtcgggtgggggtgtcgtcgttcgggattagtggtattaacgcgtacgttattttcgaatagttttcgggagtgtcgagttagtttgcggngtcgggttcgggttttgtcgtggatgtttcggtggtgtcgtggatggtgtcgggtanaatattcgaagcgttattcgcgtaggtaacggcgttgatgatttatttggacgagcgatttgatgttttttcgttggatgttgggtattcgttggcggtgatacggtcggcgttggatgttcgtgttcgattattcggcgtcgttatcggatttacgttttcggggggtggacgaataagcgatgttcgggaagagaattgggtttgttttcgatttggtataagggttgtttttttattagggatttaacgaattcgatta

SEQ ID NO: 35254 - DNA, 624 bp, Artificial Sequence
  chemically treated genomic DNA (Homo sapiens) CpG-island No: 35254
  misc_feature (263)..(263): n is either a, c, g or t
  misc_feature (320)..(320): n is either a, c, g or t
taatcgaattcgttaaatccctaataaaaaaacaacccttataccaaatcgaaaacaaacccaattctcttcccgaacatcgcttattcgtccaccccccgaaaacgtaaatccgataacgacgccgaataatcgaacacgaacatccaacgccgaccgtatcaccgccaacgaatacccaacatccaacgaaaaaacatcaaatcgctcgtccaaataaatcatcaacgccgttacctacgcgaataacgcttcgaatattntacccgacaccatccacgacaccaccgaaacatccacgacaaaacccgaacccgacnccgcaaactaactcgacactcccgaaaactattcgaaaataacgtacgcgttaataccactaatcccgaacgacgacacccccacccgacgaacacgaccactcctaaaccaaaacgtattctccgtaaaaaattaaaccgtccccgccgaccaatccacctccgacgaaaaaaattccacgtacaacgtacgtaacaactacccgtaccgcatcgccatcaccatcttaatcacaccaaccacacccgccgccgcttacgtataaccgatattcgacttaaccgaccccaaccacaacgaccg

SEQ ID NO: 35255 - DNA, 624 bp, Artificial Sequence
  chemically treated genomic DNA (Homo sapiens) CpG-island No: 35255
  misc_feature (263)..(263): n is either a, c, g or t
  misc_feature (320)..(320): n is either a, c, g or t
taatcggattcgttaagtttttaatggaaaagtaatttttgtattaagtcgaaggtaagtttagtttttttttcggatatcgtttgttcgtttatttttcgggggcgtgggttcgatgacgacgtcgggtggtcgggtacgggtatttagcgtcgatcgtgttatcgttagcgagtatttaatatttagcgaggagatattaggtcgttcgtttagataggttattaacgtcgttgtttgcgcggatagcgtttcgggtgttntgttcgatattatttacggtattatcggaatatttacgatagaattcgaattcggtntcgtagattgattcggtattttcgggggttgttcgaggatgacgtgcgcgttagtattattgatttcgaacgacgatatttttattcgacgaatacgattatttttgggttagggcgtgtttttcgtaaggagttgaatcgttttcgtcgattaatttattttcggcgaaaaagattttacgtgtaacgtgcgtggtagttgttcgtgtcgtatcgttattattattttgattatattagttatattcgtcgtcgtttgcgtatgatcgatgttcgatttgatcgattttaattataacggtcg

SEQ ID NO: 35256 - DNA, 624 bp, Artificial Sequence
  chemically treated genomic DNA (Homo sapiens) CpG-island No: 35256
  misc_feature (305)..(305): n is either a, c, g or t
  misc_feature (362)..(362): n is either a, c, g or t
cgaccgttataattaaaatcgatcaaatcgaacatcgatcatacgcaaacgacgacgaatataactaatataatcaaaataataataacgatacgacacgaacaactaccacgcacgttacacgtaaaatctttttcgccgaaaataaattaatcgacgaaaacgattcaactccttacgaaaaacacgccctaacccaaaaataatcgtattcgtcgaataaaaatatcgtcgttcgaaatcaataatactaacgcgcacgtcatcctcgaacaacccccgaaaataccgaatcaatctacganaccgaattcgaattctatcgtaaatattccgataataccgtaaataatatcgaacanaacacccgaaacgctatccgcgcaaacaacgacgttaataacctatctaaacgaacgacctaatatctcctcgctaaatattaaatactcgctaacgataacacgatcgacgctaaatacccgtacccgaccacccgacgtcgtcatcgaacccacgcccccgaaaaataaacgaacaaacgatatccgaaaaaaaaactaaacttaccttcgacttaatacaaaaattacttttccattaaaaacttaacgaatccgatta

SEQ ID NO: 35257 - DNA, 1190 bp, Artificial Sequence
  chemically treated genomic DNA (Homo sapiens) CpG-island No: 35257
tatttcgcgcgttcggttttggaggttgcggggagcgacgtagcgcgatatttatttttaggaaagcgttgtttttcgtagaggagagaggttgattgtatttttagttcggtttttcgtttttttagcggttcgttttagatattgtatcgcggaggggaggtcggtcgattttttcggcgatgttcggtttttgtttgttgtgggagggtagcggcgggtatcgtgattttcgtatcgagaagagttttttttgttttttagtcgaagttttcgagtgttcggagtacgtttatttttcgcgaatatatttttgtagtcgaagtagtttttgaagttcgtagcgtttgtaataggttcggggtagtgggggaaatttatagtagtggcgattggtcgtaacgtataattgagttttagcgacggttacgggtaaggaggcgacgaatcggtcgttttagtttagggaagcggtggcgaatgtttcggagaaaggagggttagtcggggagaggattgcgtttcgaacgatggttcgcggatcggttatcgatggcgttcgttttcgtttgtcgtttttacgtcgcggattcggtgtttaggattcgtagagcgttttcggagcgcgttacggtagggtagagtaagtttgttattgtaggcgtcgcggaaggaggcgggttgtgcgttcgggggagggagttagaaagcgttttgtgtgtcggcggtcgttaggcgtttggatcgggttttcgtagcgttatcgtcgtatcgtttttttttcggttgttagagtagtttgcgtttcgtcgtcgtgcgtttcgttataagtggcgcggcggggaggggagggggcgcgtatgtaaagagatcgatatcgggggagggaggaagcgtattagcgcggtttgtggtgtaggaggaggaagaggaggagaaggagtgggaggaggagaggagttagagaagagcgtgtcgggggagttaatcgggagaggaagcgggagaggggggttgcggggagtgtagagagataaagcggacgtattgttttagtcgttggtagttgtaatttcgggaatcgagaataaaataagttttttcgggttcgagtgtttgcgtttttttgggttagtttggttaatggatagtttcggatttgagggatttattttaggggagcgtagttt

SEQ ID NO: 35258 - DNA, 1190 bp, Artificial Sequence
  chemically treated genomic DNA (Homo sapiens) CpG-island No: 35258
aaactacgctcccctaaaataaatccctcaaatccgaaactatccattaaccaaactaacccaaaaaaacgcaaacactcgaacccgaaaaaacttattttattctcgattcccgaaattacaactaccaacgactaaaacaatacgtccgctttatctctctacactccccgcaacccccctctcccgcttcctctcccgattaactcccccgacacgctcttctctaactcctctcctcctcccactccttctcctcctcttcctcctcctacaccacaaaccgcgctaatacgcttcctccctcccccgatatcgatctctttacatacgcgccccctcccctccccgccgcgccacttataacgaaacgcacgacgacgaaacgcaaactactctaacaaccgaaaaaaaaacgatacgacgataacgctacgaaaacccgatccaaacgcctaacgaccgccgacacacaaaacgctttctaactccctcccccgaacgcacaacccgcctccttccgcgacgcctacaataacaaacttactctaccctaccgtaacgcgctccgaaaacgctctacgaatcctaaacaccgaatccgcgacgtaaaaacgacaaacgaaaacgaacgccatcgataaccgatccgcgaaccatcgttcgaaacgcaatcctctccccgactaaccctcctttctccgaaacattcgccaccgcttccctaaactaaaacgaccgattcgtcgcctccttacccgtaaccgtcgctaaaactcaattatacgttacgaccaatcgccactactataaatttcccccactaccccgaacctattacaaacgctacgaacttcaaaaactacttcgactacaaaaatatattcgcgaaaaataaacgtactccgaacactcgaaaacttcgactaaaaaacaaaaaaaactcttctcgatacgaaaatcacgatacccgccgctaccctcccacaacaaacaaaaaccgaacatcgccgaaaaaatcgaccgacctcccctccgcgatacaatatctaaaacgaaccgctaaaaaaacgaaaaaccgaactaaaaatacaatcaacctctctcctctacgaaaaacaacgctttcctaaaaataaatatcgcgctacgtcgctccccgcaacctccaaaaccgaacgcgcgaaata

SEQ ID NO: 35259 - DNA, 1190 bp, Artificial Sequence
  chemically treated genomic DNA (Homo sapiens) CpG-island No: 35259
gggttgcgtttttttaaggtgggttttttagattcggggttgtttattaattaggttggtttaaagaggcgtagatattcgaattcgggaaaatttattttattttcggttttcggggttgtagttgttagcggttgagatagtgcgttcgttttgtttttttgtatttttcgtagtttttttttttcgttttttttttcgattaattttttcgatacgtttttttttagttttttttttttttttattttttttttttttttttttttttttatattataggtcgcgttaatgcgttttttttttttttcggtgtcggtttttttgtatacgcgttttttttttttttcgtcgcgttatttatagcggggcgtacggcggcggggcgtagattgttttggtagtcggagaggaggcggtgcggcggtggcgttgcggagattcggtttagacgtttggcggtcgtcggtatataaggcgttttttagttttttttttcgagcgtatagttcgttttttttcgcggcgtttgtagtggtaggtttgttttgttttatcgtgacgcgtttcggagacgttttgcgggttttggatatcgggttcgcggcgtggggacgatagacggaggcgaacgttatcggtagtcggttcgcgagttatcgttcggggcgtagtttttttttcggttggttttttttttttcggggtattcgttatcgtttttttgggttgagacgatcggttcgtcgtttttttgttcgtgatcgtcgttagaatttagttgtgcgttgcggttagtcgttattgttgtaagttttttttattgtttcggatttgttgtaggcgttgcgggttttaggggttgtttcggttgtaggggtgtgttcgcgaggggtgagcgtgtttcgagtattcgggagtttcgattagagggtaaggggagtttttttcggtgcggagattacggtgttcgtcgttgtttttttatagtaggtagaagtcgggtatcgtcggagaggtcgatcggtttttttttcgcggtgtaatgtttggggcgagtcgttggggaagcgaggagtcgagttaaggatatagttagttttttttttttgcggaaagtagcgtttttttgggggtgaatgtcgcgttgcgtcgtttttcgtagtttttagggtcgagcgcgcgggatg

SEQ ID NO: 35260 - DNA, 1190 bp, Artificial Sequence
  chemically treated genomic DNA (Homo sapiens) CpG-island No: 35260
catcccgcgcgctcgaccctaaaaactacgaaaaacgacgcaacgcgacattcacccccaaaaaaacgctactttccgcaaaaaaaaaaaactaactatatccttaactcgactcctcgcttccccaacgactcgccccaaacattacaccgcgaaaaaaaaaccgatcgacctctccgacgatacccgacttctacctactataaaaaaacaacgacgaacaccgtaatctccgcaccgaaaaaaactccccttaccctctaatcgaaactcccgaatactcgaaacacgctcacccctcgcgaacacacccctacaaccgaaacaacccctaaaacccgcaacgcctacaacaaatccgaaacaataaaaaaaacttacaacaataacgactaaccgcaacgcacaactaaattctaacgacgatcacgaacaaaaaaacgacgaaccgatcgtctcaacccaaaaaaacgataacgaataccccgaaaaaaaaaaaaccaaccgaaaaaaaaactacgccccgaacgataactcgcgaaccgactaccgataacgttcgcctccgtctatcgtccccacgccgcgaacccgatatccaaaacccgcaaaacgtctccgaaacgcgtcacgataaaacaaaacaaacctaccactacaaacgccgcgaaaaaaaacgaactatacgctcgaaaaaaaaaactaaaaaacgccttatataccgacgaccgccaaacgtctaaaccgaatctccgcaacgccaccgccgcaccgcctcctctccgactaccaaaacaatctacgccccgccgccgtacgccccgctataaataacgcgacgaaaaaaaaaaaaaacgcgtatacaaaaaaaccgacaccgaaaaaaaaaaaaaacgcattaacgcgacctataatataaaaaaaaaaaaaaaaaaaaaaaaaataaaaaaaaaaaaaaaactaaaaaaaaacgtatcgaaaaaattaatcgaaaaaaaaaacgaaaaaaaaaaactacgaaaaatacaaaaaaacaaaacgaacgcactatctcaaccgctaacaactacaaccccgaaaaccgaaaataaaataaattttcccgaattcgaatatctacgcctctttaaaccaacctaattaataaacaaccccgaatctaaaaaacccaccttaaaaaaacgcaaccc

SEQ ID NO: 35261 - DNA, 594 bp, Artificial Sequence
  chemically treated genomic DNA (Homo sapiens) CpG-island No: 35261
gcgggatcgaggaatttaggtgtggatagggataggtaaggcgggggacgaagagaaatgaaagttatatcggtggcggatgttttgaatataattcgttcgttatcgtacgtttttcgtttcgtatttagcggatttcgggacggtagtaggtgggttgtatacggattttgggataagtcgagttgaaaatcgcggagttaggggtggggtggagacgttcgcgacgttaaggttggggtttcggaatacgttgggaggagggtggaaggtaatttcggggaaattgggaaaggcggtttggatttcgggaatatcgcgtatttgcgggggtatagttttattcgagcgaacgggttttaaaggggaggtttcgcggtgtttatcgcgtagagtttagggggtggtgcgttcggtttttttgcggcgtatagtttagtttaggaacgcgggcggtgcggatttagcgggtcgggtgtaggcgcggagttgggtttttgcgttcggttcgattttcgtttataaatagagtagttagttgtagggttttattttgttttttaattgtttgattgtttgttcgttttattggtg

SEQ ID NO: 35262 - DNA, 594 bp, Artificial Sequence
  chemically treated genomic DNA (Homo sapiens) CpG-island No: 35262
caccaataaaacgaacaaacaatcaaacaattaaaaaacaaaataaaaccctacaactaactactctatttataaacgaaaatcgaaccgaacgcaaaaacccaactccgcgcctacacccgacccgctaaatccgcaccgcccgcgttcctaaactaaactatacgccgcaaaaaaaccgaacgcaccaccccctaaactctacgcgataaacaccgcgaaacctcccctttaaaacccgttcgctcgaataaaactatacccccgcaaatacgcgatattcccgaaatccaaaccgcctttcccaatttccccgaaattaccttccaccctcctcccaacgtattccgaaaccccaaccttaacgtcgcgaacgtctccaccccacccctaactccgcgattttcaactcgacttatcccaaaatccgtatacaacccacctactaccgtcccgaaatccgctaaatacgaaacgaaaaacgtacgataacgaacgaattatattcaaaacatccgccaccgatataactttcatttctcttcgtcccccgccttacctatccctatccacacctaaattcctcgatcccgc

SEQ ID NO: 35263 - DNA, 594 bp, Artificial Sequence
  chemically treated genomic DNA (Homo sapiens) CpG-island No: 35263
tattagtgagacgaataagtagttaggtagttggaaagtagaatggagttttgtaattggttgttttatttatagacggaggtcgggtcgggcgtagaggtttagtttcgcgtttgtattcggttcgttgagttcgtatcgttcgcgtttttgggttgggttgtgcgtcgtagaagggtcgggcgtattattttttgagttttgcgcggtgggtatcgcgggattttttttttggagttcgttcgttcgggtggggttgtgttttcgtaggtacgcggtgttttcgaagtttaggtcgttttttttagttttttcgaggttgttttttattttttttttagcgtgtttcgggattttagttttggcgtcgcgggcgtttttattttatttttagtttcgcggtttttagttcgatttgttttagagttcgtgtgtagtttatttgttgtcgtttcgggattcgttgagtgcggagcggggaacgtgcggtagcgagcgagttgtgtttagaatattcgttatcgatgtggtttttattttttttcgtttttcgttttgtttgtttttgtttatatttaggtttttcggtttcgt

SEQ ID NO: 35264 - DNA, 594 bp, Artificial Sequence
  chemically treated genomic DNA (Homo sapiens) CpG-island No: 35264
acgaaaccgaaaaacctaaatataaacaaaaacaaacaaaacgaaaaacgaaaaaaaataaaaaccacatcgataacgaatattctaaacacaactcgctcgctaccgcacgttccccgctccgcactcaacgaatcccgaaacgacaacaaataaactacacacgaactctaaaacaaatcgaactaaaaaccgcgaaactaaaaataaaataaaaacgcccgcgacgccaaaactaaaatcccgaaacacgctaaaaaaaaaataaaaaacaacctcgaaaaaactaaaaaaaacgacctaaacttcgaaaacaccgcgtacctacgaaaacacaaccccacccgaacgaacgaactccaaaaaaaaaatcccgcgatacccaccgcgcaaaactcaaaaaataatacgcccgacccttctacgacgcacaacccaacccaaaaacgcgaacgatacgaactcaacgaaccgaatacaaacgcgaaactaaacctctacgcccgacccgacctccgtctataaataaaacaaccaattacaaaactccattctactttccaactacctaactacttattcgtctcactaata

SEQ ID NO: 35265 - DNA, 521 bp, Artificial Sequence
  chemically treated genomic DNA (Homo sapiens) CpG-island No: 35265
gttagttcgagggatcgcggtgtggatagggataggtaaggcggggaaggaggagaaacgaaagttatattggtggcgggtgttttgtatacgattcgttttttattatacgtttttcgtttcgtatacgatcgattcggggattggagtaggagggttgtatcgggatttcgggataggtttagttgaaaacggcggggcgagggggtggggtggagacgttcgcgacgttaaggttggggtttcggaaagcgcggggaggagggtggaaggtaaaggtaatttcggggaaattgggaaaggcggtcgggatttcggggatattgcgtattattcggcgtatagtttttttcgcgtaaattcgagttaaaggggcggtcgagcggcgtattcggagcggagtttaggggatggtgcgttcggtatttatgttgggtttagtttagtttagtttaggatcgttggcggtgcgaatttagtcgggcgggtgtaagcgcggggtagggtttttgcgttcggtt

SEQ ID NO: 35266 - DNA, 521 bp, Artificial Sequence
  chemically treated genomic DNA (Homo sapiens) CpG-island No: 35266
aaccgaacgcaaaaaccctaccccgcgcttacacccgcccgactaaattcgcaccgccaacgatcctaaactaaactaaactaaacccaacataaataccgaacgcaccatcccctaaactccgctccgaatacgccgctcgaccgcccctttaactcgaatttacgcgaaaaaaactatacgccgaataatacgcaatatccccgaaatcccgaccgcctttcccaatttccccgaaattacctttaccttccaccctcctccccgcgctttccgaaaccccaaccttaacgtcgcgaacgtctccaccccaccccctcgccccgccgttttcaactaaacctatcccgaaatcccgatacaaccctcctactccaatccccgaatcgatcgtatacgaaacgaaaaacgtataataaaaaacgaatcgtatacaaaacacccgccaccaatataactttcgtttctcctccttccccgccttacctatccctatccacaccgcgatccctcgaactaac

SEQ ID NO: 35267 - DNA, 521 bp, Artificial Sequence
  chemically treated genomic DNA (Homo sapiens) CpG-island No: 35267
ggtcgggcgtagaggttttgtttcgcgtttgtattcgttcggttgggttcgtatcgttagcggttttgggttgggttgggttgagtttagtataagtgtcgggcgtattattttttgagtttcgtttcgagtgcgtcgttcgatcgtttttttggttcgggtttgcgcgggaggggttgtgcgtcgggtggtacgtagtgttttcgaggtttcggtcgttttttttagttttttcgaagttgtttttgttttttattttttttttcgcgtttttcgggattttagttttggcgtcgcgggcgtttttattttattttttcgtttcgtcgtttttaattgggtttgtttcggagtttcggtgtagtttttttgttttagttttcggatcggtcgtgtgcggagcggggggcgtgtggtagggagcgagtcgtgtgtagagtattcgttattaatgtggttttcgtttttttttttttttcgttttgtttgtttttgtttatatcgcggtttttcggattggt

SEQ ID NO: 35268 - DNA, 521 bp, Artificial Sequence
  chemically treated genomic DNA (Homo sapiens) CpG-island No: 35268
accaatccgaaaaaccgcgatataaacaaaaacaaacaaaacgaaaaaaaaaaaaaaacgaaaaccacattaataacgaatactctacacacgactcgctccctaccacacgccccccgctccgcacacgaccgatccgaaaactaaaacaaaaaaactacaccgaaactccgaaacaaacccaattaaaaacgacgaaacgaaaaaataaaataaaaacgcccgcgacgccaaaactaaaatcccgaaaaacgcgaaaaaaaaaataaaaaacaaaaacaacttcgaaaaaactaaaaaaaacgaccgaaacctcgaaaacactacgtaccacccgacgcacaacccctcccgcgcaaacccgaaccaaaaaaacgatcgaacgacgcactcgaaacgaaactcaaaaaataatacgcccgacacttatactaaactcaacccaacccaacccaaaaccgctaacgatacgaacccaaccgaacgaatacaaacgcgaaacaaaacctctacgcccgacc

SEQ ID NO: 35269 - DNA, 531 bp, Artificial Sequence
  chemically treated genomic DNA (Homo sapiens) CpG-island No: 35269
acgggagagagaggtcgattcgtgtttttcgtgttgttgtgtacggaggagcgggttcgagggatcgcggtgtggatagggataggtaaggcgggagatgaggagaaacgaaagttatatcggtggcgggtgttttgtatataattcgttggttatcgtacgtttttcgttttttatttagtcgattcggggataggagtaggagggttgtatcgggatttcgggataggtttagttgaaaacggcgaagcgagggatggggtggagacgttcgcgacgttaaggttggggtttcggaaagcgcggggaggagggtggaaggtaaaggtaattttagggaaattgggaaaggcggttaggatttcggggatatcgtatatcgtcgggcgtatagttttttacgcgcgaaggggcgttagaagggcggtttcgcggcgcgtcgggagtggagtttaggggttggtgttttcggtttttttgttgcgtataggttagtttaggatcgttgggggttcgaatttagcggggcgg

SEQ ID NO: 35270 - DNA, 531 bp, Artificial Sequence
  chemically treated genomic DNA (Homo sapiens) CpG-island No: 35270
ccgccccgctaaattcgaacccccaacgatcctaaactaacctatacgcaacaaaaaaaccgaaaacaccaacccctaaactccactcccgacgcgccgcgaaaccgcccttctaacgccccttcgcgcgtaaaaaactatacgcccgacgatatacgatatccccgaaatcctaaccgcctttcccaatttccctaaaattacctttaccttccaccctcctccccgcgctttccgaaaccccaaccttaacgtcgcgaacgtctccaccccatccctcgcttcgccgttttcaactaaacctatcccgaaatcccgatacaaccctcctactcctatccccgaatcgactaaataaaaaacgaaaaacgtacgataaccaacgaattatatacaaaacacccgccaccgatataactttcgtttctcctcatctcccgccttacctatccctatccacaccgcgatccctcgaacccgctcctccgtacacaacaacacgaaaaacacgaatcgacctctctctcccgt

SEQ ID NO: 35271 - DNA, 531 bp, Artificial Sequence
  chemically treated genomic DNA (Homo sapiens) CpG-island No: 35271
tcgtttcgttgggttcgagtttttagcggttttgggttggtttgtgcgtagtagaagggtcgggggtattaatttttgagttttattttcggcgcgtcgcgggatcgtttttttggcgttttttcgcgcgtgaggggttgtgcgttcggcggtatgcggtgttttcgaggttttggtcgttttttttagtttttttgaagttgtttttgttttttattttttttttcgcgtttttcgggattttagttttggcgtcgcgggcgtttttattttatttttcgtttcgtcgtttttagttgggtttgtttcggagtttcggtgtagtttttttgtttttgttttcggatcggttgagtgggaagcggggagcgtgcggtagttagcgagttgtgtgtagagtattcgttatcgatgtggttttcgtttttttttatttttcgttttgtttgtttttgtttatatcgcggtttttcggattcgttttttcgtatatagtaatacggggaatacgggtcggtttttttttttcgt

SEQ ID NO: 35272 - DNA, 531 bp, Artificial Sequence
  chemically treated genomic DNA (Homo sapiens) CpG-island No: 35272
acgaaaaaaaaaaaccgacccgtattccccgtattactatatacgaaaaaacgaatccgaaaaaccgcgatataaacaaaaacaaacaaaacgaaaaataaaaaaaaacgaaaaccacatcgataacgaatactctacacacaactcgctaactaccgcacgctccccgcttcccactcaaccgatccgaaaacaaaaacaaaaaaactacaccgaaactccgaaacaaacccaactaaaaacgacgaaacgaaaaataaaataaaaacgcccgcgacgccaaaactaaaatcccgaaaaacgcgaaaaaaaaaataaaaaacaaaaacaacttcaaaaaaactaaaaaaaacgaccaaaacctcgaaaacaccgcataccgccgaacgcacaacccctcacgcgcgaaaaaacgccaaaaaaacgatcccgcgacgcgccgaaaataaaactcaaaaattaatacccccgacccttctactacgcacaaaccaacccaaaaccgctaaaaactcgaacccaacgaaacga

SEQ ID NO: 35273 - DNA, 511 bp, Artificial Sequence
  chemically treated genomic DNA (Homo sapiens) CpG-island No: 35273
tttttttttttattttcggagatggtacgtgcgcgtttttacgtagtggcggttgttgcggcgagtacgttttttgcgggatttacgcggggagtgggttggtagtgcgcgtatagcggcggcgagtgggtcgtgtacgcggatgcggggtgggagtgggggcgtacgcgcgggcgtggggcgagcgggtttcggtagtgtatatatacggtaggggcgggcgatagatgtagtgcgtgcgtcggagtttaagcgtataaacggaaagagcgggcgcggtgcgtaggggcgggcgtttagcgggtttggtatgcgcgttttcgttcgaggttataaagtatcgtattgttgatattaattaagtcgcgcgttaagttgaagttggagaagtacgtttaaacgagttataggtggtggtttaattacgagatgggaatttgaggattgatacgtagttttatggtgagatacgcgggatcgcgagacggatatatggatattgaggggtaga

SEQ ID NO: 35274 - DNA, 511 bp, Artificial Sequence
  chemically treated genomic DNA (Homo sapiens) CpG-island No: 35274
tctacccctcaatatccatatatccgtctcgcgatcccgcgtatctcaccataaaactacgtatcaatcctcaaattcccatctcgtaattaaaccaccacctataactcgtttaaacgtacttctccaacttcaacttaacgcgcgacttaattaatatcaacaatacgatactttataacctcgaacgaaaacgcgcataccaaacccgctaaacgcccgcccctacgcaccgcgcccgctctttccgtttatacgcttaaactccgacgcacgcactacatctatcgcccgcccctaccgtatatatacactaccgaaacccgctcgccccacgcccgcgcgtacgcccccactcccaccccgcatccgcgtacacgacccactcgccgccgctatacgcgcactaccaacccactccccgcgtaaatcccgcaaaaaacgtactcgccgcaacaaccgccactacgtaaaaacgcgcacgtaccatctccgaaaataaaaaaaaaaa

SEQ ID NO: 35275 - DNA, 511 bp, Artificial Sequence
  chemically treated genomic DNA (Homo sapiens) CpG-island No: 35275
tttgttttttagtgtttatgtattcgtttcgcggtttcgcgtgttttattataaggttacgtgttagtttttaggtttttatttcgtagttagattattatttgtagttcgtttgaacgtgtttttttaattttaatttgacgcgcggtttggttagtgttagtagtgcgatgttttatagtttcgggcgggggcgcgtatgttaagttcgttgggcgttcgtttttgcgtatcgcgttcgtttttttcgtttgtgcgtttgggtttcggcgtacgtattgtatttgtcgttcgtttttgtcgtgtgtgtgtattgtcggggttcgttcgttttacgttcgcgcgtgcgtttttatttttatttcgtattcgcgtgtacgatttattcgtcgtcgttgtgcgcgtattgttagtttatttttcgcgtgggtttcgtaggggacgtgttcgtcgtagtagtcgttattgcgtggaagcgcgtacgtattattttcgaaagtggagaaaaagg

SEQ ID NO: 35276 - DNA, 511 bp, Artificial Sequence
  chemically treated genomic DNA (Homo sapiens) CpG-island No: 35276
cctttttctccactttcgaaaataatacgtacgcgcttccacgcaataacgactactacgacgaacacgtcccctacgaaacccacgcgaaaaataaactaacaatacgcgcacaacgacgacgaataaatcgtacacgcgaatacgaaataaaaataaaaacgcacgcgcgaacgtaaaacgaacgaaccccgacaatacacacacacgacaaaaacgaacgacaaatacaatacgtacgccgaaacccaaacgcacaaacgaaaaaaacgaacgcgatacgcaaaaacgaacgcccaacgaacttaacatacgcgcccccgcccgaaactataaaacatcgcactactaacactaaccaaaccgcgcgtcaaattaaaattaaaaaaacacgttcaaacgaactacaaataataatctaactacgaaataaaaacctaaaaactaacacgtaaccttataataaaacacgcgaaaccgcgaaacgaatacataaacactaaaaaacaaa

SEQ ID NO: 35277 - DNA, 709 bp, Artificial Sequence
  chemically treated genomic DNA (Homo sapiens) CpG-island No: 35277
atcggcggttttacgtcggtacgttagcgttcgttcgaagcggttcgttatttcggtaagtattcggtacggcggtagcggcgttggtagtacgtttttagtattcggtattcgtttagattattttagtatttattacggtttttgtgcgttgttggtcgttaggtaaagatgcgggtttaatcggatattcggcggtagcgttttttatagtcgcgttagcgtatggtcgttcggttgtgttgttttattatcgcgtattagttatattgatttattgcggttgtatatcgtttttttcggtagtagcggtttaaagtgaatgtttcgttcgtcgttgtcgttgagtattagttcgttattacgtagttgtaagcggatattagaaggcgttttttagtcggggtcgaaaacgtttatcggtgtaggcgttttcgttcggtagttgttgtaggtgcgggagagaatgaacggtagcgggtcgggtagcgtaaggttcgtttcgtcgggtagtattttcgtttttagtagcggatttatcgggttgttcgaagttatttcgttcggatatatcgagtacgttacgtcggtgggcgcgttaatttttatatttgtcgaattttggataatgggatcgttatattgagttatatttttttgacgcgtcgttggtttttcgtttatataaagtgtttttttagttattgtt

SEQ ID NO: 35278 - DNA, 709 bp, Artificial Sequence
  chemically treated genomic DNA (Homo sapiens) CpG-island No: 35278
aacaataactaaaaaaacactttatataaacgaaaaaccaacgacgcgtcaaaaaaatataactcaatataacgatcccattatccaaaattcgacaaatataaaaattaacgcgcccaccgacgtaacgtactcgatatatccgaacgaaataacttcgaacaacccgataaatccgctactaaaaacgaaaatactacccgacgaaacgaaccttacgctacccgacccgctaccgttcattctctcccgcacctacaacaactaccgaacgaaaacgcctacaccgataaacgttttcgaccccgactaaaaaacgccttctaatatccgcttacaactacgtaataacgaactaatactcaacgacaacgacgaacgaaacattcactttaaaccgctactaccgaaaaaaacgatatacaaccgcaataaatcaatataactaatacgcgataataaaacaacacaaccgaacgaccatacgctaacgcgactataaaaaacgctaccgccgaatatccgattaaacccgcatctttacctaacgaccaacaacgcacaaaaaccgtaataaatactaaaataatctaaacgaataccgaatactaaaaacgtactaccaacgccgctaccgccgtaccgaatacttaccgaaataacgaaccgcttcgaacgaacgctaacgtaccgacgtaaaaccgccgat

SEQ ID NO: 35279 - DNA, 709 bp, Artificial Sequence
  chemically treated genomic DNA (Homo sapiens) CpG-island No: 35279
aataataattaaaagggtattttatatgagcggaaaattagcggcgcgttagggagatatgatttagtatggcggttttattgtttagggttcggtaggtgtaagaattggcgcgtttatcggcgtggcgtgttcggtgtgttcgggcgggatgatttcgggtaattcggtaaattcgttgttgggggcgaaggtgttgttcggcgagacggattttgcgttgttcggttcgttgtcgtttattttttttcgtatttatagtagttatcggacgaagacgtttgtatcggtgggcgttttcggtttcggttggaaagcgttttttgatattcgtttatagttacgtgatgacggattgatatttaacgataacggcgggcggagtatttattttgagtcgttgttgtcgggggaggcggtgtatagtcgtagtgagttaatgtggttggtgcgcggtggtaaggtagtatagtcggacggttatacgttggcgcggttgtggggggcgttgtcgtcggatattcggttaagttcgtatttttatttggcgattaatagcgtataggggtcgtggtggatattggggtggtttgagcgggtgtcgggtgttgaggacgtattgttagcgtcgttgtcgtcgtatcgggtgtttatcgggatggcggatcgtttcgggcggacgttgacgtatcggcgtgaggtcgtcggt

SEQ ID NO: 35280 - DNA, 709 bp, Artificial Sequence
  chemically treated genomic DNA (Homo sapiens) CpG-island No: 35280
accgacgacctcacgccgatacgtcaacgtccgcccgaaacgatccgccatcccgataaacacccgatacgacgacaacgacgctaacaatacgtcctcaacacccgacacccgctcaaaccaccccaatatccaccacgacccctatacgctattaatcgccaaataaaaatacgaacttaaccgaatatccgacgacaacgccccccacaaccgcgccaacgtataaccgtccgactatactaccttaccaccgcgcaccaaccacattaactcactacgactatacaccgcctcccccgacaacaacgactcaaaataaatactccgcccgccgttatcgttaaatatcaatccgtcatcacgtaactataaacgaatatcaaaaaacgctttccaaccgaaaccgaaaacgcccaccgatacaaacgtcttcgtccgataactactataaatacgaaaaaaaataaacgacaacgaaccgaacaacgcaaaatccgtctcgccgaacaacaccttcgcccccaacaacgaatttaccgaattacccgaaatcatcccgcccgaacacaccgaacacgccacgccgataaacgcgccaattcttacacctaccgaaccctaaacaataaaaccgccatactaaatcatatctccctaacgcgccgctaattttccgctcatataaaatacccttttaattattatt

SEQ ID NO: 35281 - DNA, 522 bp, Artificial Sequence
  chemically treated genomic DNA (Homo sapiens) CpG-island No: 35281
ttgttgttatcgggattttcgtttcgttttattttgttagtaaaggatgggcgatggcgggttttatttttatcgcgtttggcggcgtatttgtcgtgatgcgcgttatgtttggttggatgtcggatcgttttggcggcgtgaaagtggcgattgtttttttgtttgtagaaacggtgggtttgttgttgttttggtaagttttaggtgtatgggtcgtattagcgggcgcggcgttatcggagtcggatgttcgtttattttttttgcgttgggcgtggaggtggttaaacgcgtttttttataagttcgcggtatcgtattgggcggttacgtcgcgttttaggatatcgttttcggcgttttcgggtcgttgcgggaatgttggcgattacgtttggttatttttcggtattttttgtcggggcgatttttgcggtgttggtattattgttacgatattgttatttcgtcggggtttacgaattagttagattagtattaggataatcgcgattaata

SEQ ID NO: 35282 - DNA, 522 bp, Artificial Sequence
  chemically treated genomic DNA (Homo sapiens) CpG-island No: 35282
tattaatcgcgattatcctaatactaatctaactaattcgtaaaccccgacgaaataacaatatcgtaacaataataccaacaccgcaaaaatcgccccgacaaaaaataccgaaaaataaccaaacgtaatcgccaacattcccgcaacgacccgaaaacgccgaaaacgatatcctaaaacgcgacgtaaccgcccaatacgataccgcgaacttataaaaaaacgcgtttaaccacctccacgcccaacgcaaaaaaaataaacgaacatccgactccgataacgccgcgcccgctaatacgacccatacacctaaaacttaccaaaacaacaacaaacccaccgtttctacaaacaaaaaaacaatcgccactttcacgccgccaaaacgatccgacatccaaccaaacataacgcgcatcacgacaaatacgccgccaaacgcgataaaaataaaacccgccatcgcccatcctttactaacaaaataaaacgaaacgaaaatcccgataacaacaa

SEQ ID NO: 35283 - DNA, 522 bp, Artificial Sequence
  chemically treated genomic DNA (Homo sapiens) CpG-island No: 35283
tgttagtcgcgattattttgatgttggtttggttggttcgtaaatttcgacgaaatgatagtatcgtgataataatattagtatcgtagagatcgtttcggtaagaaatatcgaagagtaattaaacgtggtcgttagtattttcgtagcggttcggagacgtcgagggcgatattttgaaacgcggcgtaatcgtttagtgcggtgtcgcgaatttgtgaggggacgcgtttaattatttttacgtttagcgtaggaaagataagcgaatattcggtttcggtaacgtcgcgttcgttaatgcgatttatgtatttggggtttgttagagtagtaataagtttatcgtttttataagtagagagataatcgttatttttacgtcgttaaaacggttcggtatttagttaaatatgacgcgtattacgataaatgcgtcgttaaacgcggtaagagtaaagttcgttatcgtttattttttgttggtaaagtagagcgaaacgaaagtttcgataatagtaa

SEQ ID NO: 35284 - DNA, 522 bp, Artificial Sequence
  chemically treated genomic DNA (Homo sapiens) CpG-island No: 35284
ttactattatcgaaactttcgtttcgctctactttaccaacaaaaaataaacgataacgaactttactcttaccgcgtttaacgacgcatttatcgtaatacgcgtcatatttaactaaataccgaaccgttttaacgacgtaaaaataacgattatctctctacttataaaaacgataaacttattactactctaacaaaccccaaatacataaatcgcattaacgaacgcgacgttaccgaaaccgaatattcgcttatctttcctacgctaaacgtaaaaataattaaacgcgtcccctcacaaattcgcgacaccgcactaaacgattacgccgcgtttcaaaatatcgccctcgacgtctccgaaccgctacgaaaatactaacgaccacgtttaattactcttcgatatttcttaccgaaacgatctctacgatactaatattattatcacgatactatcatttcgtcgaaatttacgaaccaaccaaaccaacatcaaaataatcgcgactaaca

SEQ ID NO: 35285 - DNA, 750 bp, Artificial Sequence
  chemically treated genomic DNA (Homo sapiens) CpG-island No: 35285
ttacggatgtcgaacgtcgttattagtagtattaaagcggtaaaggggcgaaagtattgcgcgggaaaggagaattaacgttggtgtttttcgcgttagtgggcgatcgttcgttggcgttacgggcggaatatcgcgttaagtaattgattaaacggtaaaaagagcgtttggtagcggaaggcgtagggtttgtagagttgttaagtagtttgtaaatttcggagattaaaagcgattgaaatgttcgtgatatttaattaggtcggtaacgttatttagcgcgttattcgttaaacgatgtatttggaaggcgtttttagtgttcggttagcggtaacgtagatcgtgatgcgtcgttagtttaaagtcgaaacgattgtatagcgtcggatcgtttagcgttattattgcggtatagtcgaatttattaagcgaatcgagttttttatagattagttggcgtgttagtttttgtttacggtattttttattaatcgttaacggtgttatgtcgatttattgtaggttttcgttttgtatattaatcggattaaatgttatatagttaatgatttgattttcgttatttgtcgttattagttttagcgttagaaagttatttttacgtagatcgtgaattagtttcgttttcgtattattttcgaatgagcgacgtagtagggtattaatattcggcgtattaatgggaatttttattcgaattagtatggtttatttatcgatgtt

SEQ ID NO: 35286 - DNA, 750 bp, Artificial Sequence
  chemically treated genomic DNA (Homo sapiens) CpG-island No: 35286
aacatcgataaataaaccatactaattcgaataaaaattcccattaatacgccgaatattaataccctactacgtcgctcattcgaaaataatacgaaaacgaaactaattcacgatctacgtaaaaataactttctaacgctaaaactaataacgacaaataacgaaaatcaaatcattaactatataacatttaatccgattaatatacaaaacgaaaacctacaataaatcgacataacaccgttaacgattaataaaaaataccgtaaacaaaaactaacacgccaactaatctataaaaaactcgattcgcttaataaattcgactataccgcaataataacgctaaacgatccgacgctatacaatcgtttcgactttaaactaacgacgcatcacgatctacgttaccgctaaccgaacactaaaaacgccttccaaatacatcgtttaacgaataacgcgctaaataacgttaccgacctaattaaatatcacgaacatttcaatcgcttttaatctccgaaatttacaaactacttaacaactctacaaaccctacgccttccgctaccaaacgctctttttaccgtttaatcaattacttaacgcgatattccgcccgtaacgccaacgaacgatcgcccactaacgcgaaaaacaccaacgttaattctcctttcccgcgcaatactttcgcccctttaccgctttaatactactaataacgacgttcgacatccgtaa

SEQ ID NO: 35287 - DNA, 750 bp, Artificial Sequence
  chemically treated genomic DNA (Homo sapiens) CpG-island No: 35287
gatatcggtaggtgaattatgttaattcgagtagaaatttttattgatgcgtcgggtattgatgttttgttgcgtcgtttattcgaaagtgatgcggaagcgaagttggtttacgatttgcgtgaagatggttttttgacgttggggttggtggcgatagatgacgaaggttaggttattggttatgtggtatttagttcggttgatgtgtagggcgaagatttgtaatgggtcggtatggtatcgttggcggttgatgaaaaatatcgtggataggggttggtacgttaattggtttatgaaggattcgattcgtttaatgagttcggttatgtcgtagtggtgacgttgggcgattcggcgttgtatagtcgtttcggttttgaattggcggcgtattacgatttgcgttgtcgttggtcgggtattgaaagcgttttttaggtatatcgtttagcggatgacgcgttgaatggcgttatcggtttggttgagtattacgagtattttaatcgtttttaattttcggggtttgtagattgtttaatagttttgtaaattttgcgtttttcgttattagacgttttttttgtcgtttggttagttgtttaacgcgatatttcgttcgtaacgttagcgaacgatcgtttattggcgcggaaaatattagcgttagtttttttttttcgcgtagtgttttcgtttttttgtcgttttggtgttgttgatagcggcgttcgatattcgtgg

SEQ ID NO: 35288 - DNA, 750 bp, Artificial Sequence
  chemically treated genomic DNA (Homo sapiens) CpG-island No: 35288
ccacgaatatcgaacgccgctatcaacaacaccaaaacgacaaaaaaacgaaaacactacgcgaaaaaaaaaaactaacgctaatattttccgcgccaataaacgatcgttcgctaacgttacgaacgaaatatcgcgttaaacaactaaccaaacgacaaaaaaaacgtctaataacgaaaaacgcaaaatttacaaaactattaaacaatctacaaaccccgaaaattaaaaacgattaaaatactcgtaatactcaaccaaaccgataacgccattcaacgcgtcatccgctaaacgatatacctaaaaaacgctttcaatacccgaccaacgacaacgcaaatcgtaatacgccgccaattcaaaaccgaaacgactatacaacgccgaatcgcccaacgtcaccactacgacataaccgaactcattaaacgaatcgaatccttcataaaccaattaacgtaccaacccctatccacgatatttttcatcaaccgccaacgataccataccgacccattacaaatcttcgccctacacatcaaccgaactaaataccacataaccaataacctaaccttcgtcatctatcgccaccaaccccaacgtcaaaaaaccatcttcacgcaaatcgtaaaccaacttcgcttccgcatcactttcgaataaacgacgcaacaaaacatcaatacccgacgcatcaataaaaatttctactcgaattaacataattcacctaccgatatc

SEQ ID NO: 35289 - DNA, 577 bp, Artificial Sequence
  chemically treated genomic DNA (Homo sapiens) CpG-island No: 35289
gtaaattgaataggagcgggggaaatttcgtggtaattacggtaacggtggcggggcgagaattttgcgtaggcgcgttatattttattttcgtttatttatattacggcggtcggttttagttatttttttcggttttagattttacgggtcggttacgggtgggggtagtagggaggtacgggtttggcgtttgcgtagtcgtcggggcgttggtgtgatcgagtttacgtagcgagggttgtagtcgttttttttttggcgttgttatcgcggtttagaggttataaaagggttaacgggttttttttgttgtttagtcgcgtcgttagcgggttgagggtaggaagtagtcgtttcgagtggaggcgattgggggttgaagagcgcgtcgttttttcgttttattttttaggtgagacgttttttcgatttcggagattgaggttattgggtagtcgtggattttttcggacggttgcggcgatttattttttttcgttgtggtggtatttttggggcgggggttttttaggttattatagtagtttcggtttttttttttcgggagattcgg

SEQ ID NO: 35290 - DNA, 577 bp, Artificial Sequence
  chemically treated genomic DNA (Homo sapiens) CpG-island No: 35290
ccgaatctcccgaaaaaaaaaaaccgaaactactataataacctaaaaaacccccgccccaaaaataccaccacaacgaaaaaaaataaatcgccgcaaccgtccgaaaaaatccacgactacccaataacctcaatctccgaaatcgaaaaaacgtctcacctaaaaaataaaacgaaaaaacgacgcgctcttcaacccccaatcgcctccactcgaaacgactacttcctaccctcaacccgctaacgacgcgactaaacaacaaaaaaaacccgttaacccttttataacctctaaaccgcgataacaacgccaaaaaaaaaacgactacaaccctcgctacgtaaactcgatcacaccaacgccccgacgactacgcaaacgccaaacccgtacctccctactacccccacccgtaaccgacccgtaaaatctaaaaccgaaaaaaataactaaaaccgaccgccgtaatataaataaacgaaaataaaatataacgcgcctacgcaaaattctcgccccgccaccgttaccgtaattaccacgaaatttcccccgctcctattcaatttac

SEQ ID NO: 35291 - DNA, 577 bp, Artificial Sequence
  chemically treated genomic DNA (Homo sapiens) CpG-island No: 35291
tcgagtttttcgaggggaaggaatcgaggttgttgtggtaatttggggaattttcgttttagaagtattattatagcgggaaggaatggatcgtcgtagtcgttcgagaaggtttacggttgtttagtggttttagttttcgggatcgagggagcgttttatttggaaagtgggacgagagggcggcgcgttttttagtttttagtcgtttttattcggagcggttattttttatttttagttcgttggcggcgcgattgggtagtagagggagttcgttagtttttttataatttttaggtcgcgatggtagcgttagggaggaggcgattgtagttttcgttacgtgagttcgattatattagcgtttcggcgattgcgtaggcgttaagttcgtgtttttttgttgtttttattcgtggtcggttcgtggagtttgaggtcgagaggagtggttgggatcggtcgtcgtggtgtgggtaagcgggagtgggatgtaacgcgtttgcgtagggttttcgtttcgttatcgttatcgtggttattacggggtttttttcgtttttgtttagtttgt

SEQ ID NO: 35292 - DNA, 577 bp, Artificial Sequence
  chemically treated genomic DNA (Homo sapiens) CpG-island No: 35292
acaaactaaacaaaaacgaaaaaaaccccgtaataaccacgataacgataacgaaacgaaaaccctacgcaaacgcgttacatcccactcccgcttacccacaccacgacgaccgatcccaaccactcctctcgacctcaaactccacgaaccgaccacgaataaaaacaacaaaaaaacacgaacttaacgcctacgcaatcgccgaaacgctaatataatcgaactcacgtaacgaaaactacaatcgcctcctccctaacgctaccatcgcgacctaaaaattataaaaaaactaacgaactccctctactacccaatcgcgccgccaacgaactaaaaataaaaaataaccgctccgaataaaaacgactaaaaactaaaaaacgcgccgccctctcgtcccactttccaaataaaacgctccctcgatcccgaaaactaaaaccactaaacaaccgtaaaccttctcgaacgactacgacgatccattccttcccgctataataatacttctaaaacgaaaattccccaaattaccacaacaacctcgattccttcccctcgaaaaactcga

SEQ ID NO: 35293 - DNA, 551 bp, Artificial Sequence
  chemically treated genomic DNA (Homo sapiens) CpG-island No: 35293
ttttacgttttaggtcgggcgtttatattttgttttttttgacgtcgtatagttacgtatttaggtatttttttcgttatttttttttttcgtttgtaggcggtgtttatatcgtttttttcgtttttgtagatcgggttttggagggcggtcgggcggtttacgggtcggtgtcgcgtcgttagagagaacgcggtaattcgttttagtcgattttggatttttgatttggcgcgatttcggaagtgggcgggcgcgcgatttcgaagttagtatcgacgcggcgtatcgtagttaatcgtacgttttaggtcgtagcgttttggcgaggttggttaatgggtacggggtttgatgtcgttttcggtttatttttttgttcggttttcgggagggtcggttcgtttttttcggacgtcgaggatttattatcgcgatttcgtttcgttcggcgcgggtttaggtgagtgtagagtggcgttttagttgtagcggcggttagggtcgtgggaaagaatggggcgatgaagggttgggtacgtcgttttttt

SEQ ID NO: 35294 - DNA, 551 bp, Artificial Sequence
  chemically treated genomic DNA (Homo sapiens) CpG-island No: 35294
aaaaaaacgacgtacccaacccttcatcgccccattctttcccacgaccctaaccgccgctacaactaaaacgccactctacactcacctaaacccgcgccgaacgaaacgaaatcgcgataataaatcctcgacgtccgaaaaaaacgaaccgaccctcccgaaaaccgaacaaaaaaataaaccgaaaacgacatcaaaccccgtacccattaaccaacctcgccaaaacgctacgacctaaaacgtacgattaactacgatacgccgcgtcgatactaacttcgaaatcgcgcgcccgcccacttccgaaatcgcgccaaatcaaaaatccaaaatcgactaaaacgaattaccgcgttctctctaacgacgcgacaccgacccgtaaaccgcccgaccgccctccaaaacccgatctacaaaaacgaaaaaaacgatataaacaccgcctacaaacgaaaaaaaaaaataacgaaaaaaatacctaaatacgtaactatacgacgtcaaaaaaaacaaaatataaacgcccgacctaaaacgtaaaa

SEQ ID NO: 35295 - DNA, 551 bp, Artificial Sequence
  chemically treated genomic DNA (Homo sapiens) CpG-island No: 35295
gggaaggcggcgtgtttagttttttatcgttttatttttttttacggttttggtcgtcgttgtagttggggcgttattttgtatttatttgggttcgcgtcgggcggggcgaagtcgcggtggtaggttttcggcgttcgggaggagcggatcggttttttcggggatcgggtaagagggtgggtcggaagcggtattaggtttcgtgtttattggttagtttcgttaggacgttgcgatttgggacgtgcgattggttgcggtgcgtcgcgtcggtgttggtttcgaggtcgcgcgttcgtttattttcggggtcgcgttaggttaggagtttagagtcggttgaagcgagttgtcgcgttttttttggcggcgcgatatcggttcgtggatcgttcggtcgttttttaggattcggtttgtaggagcggagagggcggtgtggatatcgtttgtaggcgaggagaaggggtggcggagagggtatttgggtgcgtggttgtgcggcgttaggaggagtagggtgtgggcgttcggtttggggcgtggag

SEQ ID NO: 35296 - DNA, 551 bp, Artificial Sequence
  chemically treated genomic DNA (Homo sapiens) CpG-island No: 35296
ctccacgccccaaaccgaacgcccacaccctactcctcctaacgccgcacaaccacgcacccaaataccctctccgccaccccttctcctcgcctacaaacgatatccacaccgccctctccgctcctacaaaccgaatcctaaaaaacgaccgaacgatccacgaaccgatatcgcgccgccaaaaaaaacgcgacaactcgcttcaaccgactctaaactcctaacctaacgcgaccccgaaaataaacgaacgcgcgacctcgaaaccaacaccgacgcgacgcaccgcaaccaatcgcacgtcccaaatcgcaacgtcctaacgaaactaaccaataaacacgaaacctaataccgcttccgacccaccctcttacccgatccccgaaaaaaccgatccgctcctcccgaacgccgaaaacctaccaccgcgacttcgccccgcccgacgcgaacccaaataaatacaaaataacgccccaactacaacgacgaccaaaaccgtaaaaaaaaataaaacgataaaaaactaaacacgccgccttccc

SEQ ID NO: 35297 - DNA, 799 bp, Artificial Sequence
  chemically treated genomic DNA (Homo sapiens) CpG-island No: 35297
ggagaggtcgggtaaggaggatcgcgggaggtatggatgcgggggtgttgtgttagggggagggtcggggaaagcgggcggggggaggttgtttcgggtacggatatggggtaggcgggtgggaaaggcgcgagtggaaattgagggggaggatggggaaaagtaggttgtggggaggttgtcgggggacgggagtaggggaggtggggacgtaggttgttttgggggggttgtagcgggagaatggggagagacgaatggggggaagttatttcggggcggttggggggttgtcgggggaggatggggagaagcgtgtgggggaggttgtttgggggaacgagggtcgggggttgtcgggggatggtggggagaggcgggcgggggtggttgttttgggggacgagggtggggggtagtagggggaggatggggagaggcgggcgggggaggttttttattttgggggcggggcggaagttgggggcggggttgcgcggttatttggttcgggagttttaggcgtcggtttttcgttcgttcgttcgtaggtgtcgttattgttgtttagcgttcgtcgggatattcggatttcggtttcgtttcggtttcgtttcgagggtttatttgtatgcgttcgcggtttttttcggggcggttaaagcgacgtgtttttgtttttcgtgggtagtttcggcgcgtgtggtcgcggatttttaggtaattcgggagttgggaattcgggtggggtcgcggggaggggatttaggggtaggatttggcggtggggttgtggggg

SEQ ID NO: 35298 - DNA, 799 bp, Artificial Sequence
  chemically treated genomic DNA (Homo sapiens) CpG-island No: 35298
cccccacaaccccaccgccaaatcctacccctaaatcccctccccgcgaccccacccgaattcccaactcccgaattacctaaaaatccgcgaccacacgcgccgaaactacccacgaaaaacaaaaacacgtcgctttaaccgccccgaaaaaaaccgcgaacgcatacaaataaaccctcgaaacgaaaccgaaacgaaaccgaaatccgaatatcccgacgaacgctaaacaacaataacgacacctacgaacgaacgaacgaaaaaccgacgcctaaaactcccgaaccaaataaccgcgcaaccccgcccccaacttccgccccgcccccaaaataaaaaacctcccccgcccgcctctccccatcctccccctactaccccccaccctcgtcccccaaaacaaccacccccgcccgcctctccccaccatcccccgacaacccccgaccctcgttcccccaaacaacctcccccacacgcttctccccatcctcccccgacaaccccccaaccgccccgaaataacttccccccattcgtctctccccattctcccgctacaacccccccaaaacaacctacgtccccacctcccctactcccgtcccccgacaacctccccacaacctacttttccccatcctccccctcaatttccactcgcgcctttcccacccgcctaccccatatccgtacccgaaacaacctccccccgcccgctttccccgaccctccccctaacacaacacccccgcatccatacctcccgcgatcctccttacccgacctctcc

SEQ ID NO: 35299 - DNA, 799 bp, Artificial Sequence
  chemically treated genomic DNA (Homo sapiens) CpG-island No: 35299
tttttataattttatcgttaggttttgtttttgggtttttttttcgcggttttattcgagtttttagttttcgggttatttggggattcgcggttatacgcgtcgaggttgtttacgggggataaggatacgtcgttttagtcgtttcgggaggggtcgcggacgtatgtaaatgagttttcggggcggggtcggggcggggtcggggttcgggtgtttcggcgggcgttgggtagtagtggcggtatttgcgggcgggcgggcgggaggtcggcgtttggggttttcggattaggtggtcgcgtagtttcgtttttagttttcgtttcgtttttaagatagaaaatttttttcgttcgtttttttttattttttttttattgttttttattttcgttttttaagatagttattttcgttcgtttttttttattatttttcgatagttttcgattttcgtttttttagatagttttttttatacgtttttttttattttttttcgatagttttttaatcgtttcgagatagtttttttttattcgtttttttttattttttcgttatagtttttttaagatagtttgcgtttttattttttttattttcgtttttcgatagtttttttataatttgtttttttttatttttttttttaatttttattcgcgttttttttattcgtttattttatattcgtgttcgagatagttttttttcgttcgtttttttcgattttttttttgatatagtattttcgtatttatgtttttcgcgattttttttgttcggttttttt

SEQ ID NO: 35300 - DNA, 799 bp, Artificial Sequence
  chemically treated genomic DNA (Homo sapiens) CpG-island No: 35300
aaaaaaaccgaacaaaaaaaatcgcgaaaaacataaatacgaaaatactatatcaaaaaaaaaatcgaaaaaaacgaacgaaaaaaaactatctcgaacacgaatataaaataaacgaataaaaaaaacgcgaataaaaattaaaaaaaaaaataaaaaaaaacaaattataaaaaaactatcgaaaaacgaaaataaaaaaaataaaaacgcaaactatcttaaaaaaactataacgaaaaaataaaaaaaaacgaataaaaaaaaactatctcgaaacgattaaaaaactatcgaaaaaaaataaaaaaaaacgtataaaaaaaactatctaaaaaaacgaaaatcgaaaactatcgaaaaataataaaaaaaaacgaacgaaaataactatcttaaaaaacgaaaataaaaaacaataaaaaaaaaataaaaaaaaacgaacgaaaaaaattttctatcttaaaaacgaaacgaaaactaaaaacgaaactacgcgaccacctaatccgaaaaccccaaacgccgacctcccgcccgcccgcccgcaaataccgccactactacccaacgcccgccgaaacacccgaaccccgaccccgccccgaccccgccccgaaaactcatttacatacgtccgcgacccctcccgaaacgactaaaacgacgtatccttatcccccgtaaacaacctcgacgcgtataaccgcgaatccccaaataacccgaaaactaaaaactcgaataaaaccgcgaaaaaaaaacccaaaaacaaaacctaacgataaaattataaaaa

SEQ ID NO: 35301 - DNA, 834 bp, Artificial Sequence
  chemically treated genomic DNA (Homo sapiens) CpG-island No: 35301
tatcgtttatttttttaggatgatgggcggggttttttgggtcggtgtggattgacgagtggttggtcgttttgtttattacgatatttcgttttcgcgttacgttatatgacgtagtttattatggcggcgggagcgcggttttttaggttcgtcgtttcgtagggttgttggcgttgttgttgttgagaggcggcggcggcggcgtaggcgggcgggaaggatggtgtttttgcgattggagcggtaggtgcggatcgggagtcggatcgaggtttggtagaagtaacgtgtgttcgggagtaatcggcgcgggtgttattgaggtagcggagggaggtaggatcgattgacgggcgaacggacggacggacggaaggcgattcgagggtcggtttcggagtcgcgtcgtgggcgagatgtcggggtcgtcggcgttgcggcggaggttgttgttgttgttgttggtttttttgatcgtcggtagtgttggggtcgcgttattttcgtaaataggtgtaggtgagcgggttcgcggcggggacggggttgcggggttttcggcgtggaggggagggggcggtagggtcgggtcggtttcggcgtcgaggaatcggagggtttgtcgggggcgggaagtttagggaggcgagtgattagggagatttttgtcgtaggggcgtgggatttgggggggcgggagcgaggcgacgtcgttggggttggggagggcggcgggcgaggtagtagttatcgatttttttcgggataggttgcggtgtcggttttggatttgttgttttaagatttttagtttatatcgttttttggtag

SEQ ID NO: 35302 - DNA, 834 bp, Artificial Sequence
  chemically treated genomic DNA (Homo sapiens) CpG-island No: 35302
ctaccaaaaaacgatataaactaaaaatcttaaaacaacaaatccaaaaccgacaccgcaacctatcccgaaaaaaatcgataactactacctcgcccgccgccctccccaaccccaacgacgtcgcctcgctcccgcccccccaaatcccacgcccctacgacaaaaatctccctaatcactcgcctccctaaacttcccgcccccgacaaaccctccgattcctcgacgccgaaaccgacccgaccctaccgccccctcccctccacgccgaaaaccccgcaaccccgtccccgccgcgaacccgctcacctacacctatttacgaaaataacgcgaccccaacactaccgacgatcaaaaaaaccaacaacaacaacaacaacctccgccgcaacgccgacgaccccgacatctcgcccacgacgcgactccgaaaccgaccctcgaatcgccttccgtccgtccgtccgttcgcccgtcaatcgatcctacctccctccgctacctcaataacacccgcgccgattactcccgaacacacgttacttctaccaaacctcgatccgactcccgatccgcacctaccgctccaatcgcaaaaacaccatccttcccgcccgcctacgccgccgccgccgcctctcaacaacaacaacgccaacaaccctacgaaacgacgaacctaaaaaaccgcgctcccgccgccataataaactacgtcatataacgtaacgcgaaaacgaaatatcgtaataaacaaaacgaccaaccactcgtcaatccacaccgacccaaaaaaccccgcccatcatcctaaaaaaataaacgata

SEQ ID NO: 35303 - DNA, 834 bp, Artificial Sequence
  chemically treated genomic DNA (Homo sapiens) CpG-island No: 35303
ttgttaggaagcgatataagttgaggattttaaggtaataggtttagggtcggtatcgtagtttatttcgggaggggtcggtggttgttatttcgttcgtcgttttttttagttttaacgacgtcgtttcgttttcgtttttttaaattttacgtttttgcggtagaaatttttttaattattcgtttttttgggtttttcgttttcggtaggtttttcgatttttcggcgtcgaggtcggttcggttttgtcgtttttttttttttacgtcgaagatttcgtagtttcgttttcgtcgcgggttcgtttatttgtatttgtttgcggaagtggcgcggttttagtattgtcggcgattaggaggattagtagtagtagtagtagttttcgtcgtaacgtcggcggtttcggtatttcgtttacggcgcggtttcggggtcggttttcgagtcgtttttcgttcgttcgttcgttcgttcgttagtcgattttgttttttttcgttgttttagtggtattcgcgtcggttgttttcgagtatacgttgtttttgttaaatttcggttcggttttcggttcgtatttgtcgttttagtcgtagaaatattatttttttcgttcgtttgcgtcgtcgtcgtcgttttttaatagtagtaacgttagtagttttgcggagcggcgggtttgggaagtcgcgttttcgtcgttatgatgggttgcgttatgtgacgtagcgcgggggcgggatgtcgtgatggatagggcggttagttattcgttagtttatatcggtttaggaggtttcgtttattattttgaaggagtgagcggtg

SEQ ID NO: 35304 - DNA, 834 bp, Artificial Sequence
  chemically treated genomic DNA (Homo sapiens) CpG-island No: 35304
caccgctcactccttcaaaataataaacgaaacctcctaaaccgatataaactaacgaataactaaccgccctatccatcacgacatcccgcccccgcgctacgtcacataacgcaacccatcataacgacgaaaacgcgacttcccaaacccgccgctccgcaaaactactaacgttactactattaaaaaacgacgacgacgacgcaaacgaacgaaaaaaataatatttctacgactaaaacgacaaatacgaaccgaaaaccgaaccgaaatttaacaaaaacaacgtatactcgaaaacaaccgacgcgaataccactaaaacaacgaaaaaaaacaaaatcgactaacgaacgaacgaacgaacgaacgaaaaacgactcgaaaaccgaccccgaaaccgcgccgtaaacgaaataccgaaaccgccgacgttacgacgaaaactactactactactactaatcctcctaatcgccgacaatactaaaaccgcgccacttccgcaaacaaatacaaataaacgaacccgcgacgaaaacgaaactacgaaatcttcgacgtaaaaaaaaaaaaacgacaaaaccgaaccgacctcgacgccgaaaaatcgaaaaacctaccgaaaacgaaaaacccaaaaaaacgaataattaaaaaaatttctaccgcaaaaacgtaaaatttaaaaaaacgaaaacgaaacgacgtcgttaaaactaaaaaaaacgacgaacgaaataacaaccaccgacccctcccgaaataaactacgataccgaccctaaacctattaccttaaaatcctcaacttatatcgcttcctaacaa

SEQ ID NO: 35305 - DNA, 572 bp, Artificial Sequence
  chemically treated genomic DNA (Homo sapiens) CpG-island No: 35305
ttattgatttttttattttatttttttatttattttgtttttttttcgtttttttttttcgcgggtaagtgaggtttttttcgtatttttatttcgcggttttgttagttatttacggtaggagacgcgcggagggtcggtttttttttttttttttttttttttcgaattttttttttcgtcgggaataaatttaaacgcgttcgagcgtcgcgttttattatttattcgtttatggttacggatttttcgtttttcgcgcgtttttcgcgtttttattttcgtcgttttttttttatacgttatcgggcgcgtttacgcgcgaattcggttttttcgtttattttggtaacgggttacgttttcgttcggtttgttcgcgaataattttttcgatttttttgttttatattttgtttttttatacgcgtaatttcgttttttttttttttttttttttttttttttttttttttcgttcgttcgtcgggttttttttttttattttttttttttttggtttatttcgtttttttgtggtgaaattttttttatatatttaggtttttttt

SEQ ID NO: 35306 - DNA, 572 bp, Artificial Sequence
  chemically treated genomic DNA (Homo sapiens) CpG-island No: 35306
aaaaaaaacctaaatatataaaaaaaatttcaccacaaaaaaacgaaataaaccaaaaaaaaaaaaaataaaaaaaaaaaacccgacgaacgaacgaaaaaaaaaaaaaaaaaaaaaaaaaaaaaaaaaaaaaacgaaattacgcgtataaaaaaacaaaatataaaacaaaaaaatcgaaaaaattattcgcgaacaaaccgaacgaaaacgtaacccgttaccaaaataaacgaaaaaaccgaattcgcgcgtaaacgcgcccgataacgtataaaaaaaaaacgacgaaaataaaaacgcgaaaaacgcgcgaaaaacgaaaaatccgtaaccataaacgaataaataataaaacgcgacgctcgaacgcgtttaaatttattcccgacgaaaaaaaaaattcgaaaaaaaaaaaaaaaaaaaaaaaaaccgaccctccgcgcgtctcctaccgtaaataactaacaaaaccgcgaaataaaaatacgaaaaaaacctcacttacccgcgaaaaaaaaaaacgaaaaaaaaacaaaataaataaaaaaataaaataaaaaaatcaataa

SEQ ID NO: 35307 - DNA, 572 bp, Artificial Sequence
  chemically treated genomic DNA (Homo sapiens) CpG-island No: 35307
gagggaaatttaagtatgtggggggggttttattataagaaggcggggtagattaggaagggggggggtgggggggggagattcgacgaacgaacggggggggggggagggggggagggggggggggaggggggcgggattgcgcgtatggagaggtagggtatgagataagggggtcggggggattattcgcggatagatcgggcgggaacgtgattcgttattagggtggacggggaggtcgggttcgcgcgtgggcgcgttcggtggcgtgtggggggggggcggcgggggtgggggcgcggggggcgcgcggggggcgggggattcgtggttatgggcgaatgagtggtggggcgcggcgttcgggcgcgtttgggtttgttttcggcgggggggggggttcggggggggggggggggggggagggggtcggtttttcgcgcgttttttgtcgtgggtggttggtagagtcgcggggtggaaatgcggggaaggttttatttgttcgcgaggggggggagcgagaggggagtaaggtggatagaaagatggggtgggggggttaatgg

SEQ ID NO: 35308 - DNA, 572 bp, Artificial Sequence
  chemically treated genomic DNA (Homo sapiens) CpG-island No: 35308
ccattaacccccccaccccatctttctatccaccttactcccctctcgctcccccccctcgcgaacaaataaaaccttccccgcatttccaccccgcgactctaccaaccacccacgacaaaaaacgcgcgaaaaaccgaccccctccccccccccccccccccccgaacccccccccccgccgaaaacaaacccaaacgcgcccgaacgccgcgccccaccactcattcgcccataaccacgaatcccccgccccccgcgcgccccccgcgcccccacccccgccgccccccccccacacgccaccgaacgcgcccacgcgcgaacccgacctccccgtccaccctaataacgaatcacgttcccgcccgatctatccgcgaataatccccccgacccccttatctcataccctacctctccatacgcgcaatcccgcccccctccccccccccctccccccctccccccccccccgttcgttcgtcgaatctcccccccccacccccccccttcctaatctaccccgccttcttataataaaaccccccccacatacttaaatttccctc

SEQ ID NO: 35309 - DNA, 576 bp, Artificial Sequence
  chemically treated genomic DNA (Homo sapiens) CpG-island No: 35309
ggtcgcgcgcggttgttaagagacgtcggcgttgttttagaaatagacggcgtagcgcgtaggatacgttttttggtagcgatattttcgcgaaggttacgcgagtgcgcgtgtggtatgcgtaggcgtagtgaacgggcgtcgttataagggggcggggtataaggggcggggatttacgtcgaggttttatttttttttagggtaggtatgatcgagagttggggcgggagcgttgatttgtcgggtaaagttagttttatcgttcgatttagttgtacgcgtagggagtgtgtgtttattttgattcggttcggtttttcgttttcgtcgaagcgtagaggcgaatgagagttgagttttggggagtagcgtttcgatttacgtttttagtaagtcgagtgtttaaaatatatttagttattagttgtcgttgtggttttatcgcgaggacgcggagggaggcgttgtagagtacgggcgacgtgattatagttgtcggggttaattttggaatgtcgggtgttcggaggagtttttttagttggggttaagtagcgtttaagtaggtgaaaa

SEQ ID NO: 35310 - DNA, 576 bp, Artificial Sequence
  chemically treated genomic DNA (Homo sapiens) CpG-island No: 35310
ttttcacctacttaaacgctacttaaccccaactaaaaaaactcctccgaacacccgacattccaaaattaaccccgacaactataatcacgtcgcccgtactctacaacgcctccctccgcgtcctcgcgataaaaccacaacgacaactaataactaaatatattttaaacactcgacttactaaaaacgtaaatcgaaacgctactccccaaaactcaactctcattcgcctctacgcttcgacgaaaacgaaaaaccgaaccgaatcaaaataaacacacactccctacgcgtacaactaaatcgaacgataaaactaactttacccgacaaatcaacgctcccgccccaactctcgatcatacctaccctaaaaaaaaataaaacctcgacgtaaatccccgccccttataccccgcccccttataacgacgcccgttcactacgcctacgcataccacacgcgcactcgcgtaaccttcgcgaaaatatcgctaccaaaaaacgtatcctacgcgctacgccgtctatttctaaaacaacgccgacgtctcttaacaaccgcgcgcgacc

SEQ ID NO: 35311 - DNA, 576 bp, Artificial Sequence
  chemically treated genomic DNA (Homo sapiens) CpG-island No: 35311
tttttatttgtttggacgttgtttggttttagttggggaggttttttcgagtattcggtattttagagttagtttcgatagttgtggttacgtcgttcgtgttttgtagcgttttttttcgcgttttcgcggtggggttatagcgatagttagtggttgaatgtattttaaatattcggtttgttgagggcgtgagtcggagcgttgttttttaggatttagtttttattcgtttttgcgtttcggcggggacggggagtcgggtcgagttagagtgaatatatattttttgcgcgtgtaattgagtcgagcggtagggttggttttattcgataggttaacgttttcgttttagttttcggttatatttgttttaaggaggggtggagtttcggcgtggattttcgttttttgtgtttcgtttttttataacggcgttcgtttattgcgtttgcgtatgttatacgcgtattcgcgtggttttcgcgaaggtgtcgttgttaagaaacgtgttttgcgcgttacgtcgtttgtttttagggtaacgtcggcgttttttagtaatcgcgcgcggtt

SEQ ID NO: 35312 - DNA, 576 bp, Artificial Sequence
  chemically treated genomic DNA (Homo sapiens) CpG-island No: 35312
aaccgcgcgcgattactaaaaaacgccgacgttaccctaaaaacaaacgacgtaacgcgcaaaacacgtttcttaacaacgacaccttcgcgaaaaccacgcgaatacgcgtataacatacgcaaacgcaataaacgaacgccgttataaaaaaacgaaacacaaaaaacgaaaatccacgccgaaactccacccctccttaaaacaaatataaccgaaaactaaaacgaaaacgttaacctatcgaataaaaccaaccctaccgctcgactcaattacacgcgcaaaaaatatatattcactctaactcgacccgactccccgtccccgccgaaacgcaaaaacgaataaaaactaaatcctaaaaaacaacgctccgactcacgccctcaacaaaccgaatatttaaaatacattcaaccactaactatcgctataaccccaccgcgaaaacgcgaaaaaaaacgctacaaaacacgaacgacgtaaccacaactatcgaaactaactctaaaataccgaatactcgaaaaaacctccccaactaaaaccaaacaacgtccaaacaaataaaaa

SEQ ID NO: 35313 - DNA, 1392 bp, Artificial Sequence
  chemically treated genomic DNA (Homo sapiens) CpG-island No: 35313
  misc_feature (956)..(956): n is either a, c, g or t
tcgggtagcgcgagttgcgttggggggaggggagaagagggtaaggggaggggataagagagttagcgttttcgttcggtgatgtaggtagttcggggaggtggagtcgcgacgtttgaaggagtttttatcgtagtcgcgttttcggtttgttttattaagtagtcgttagttatacggtgtatcgtaagattgcggcggtagggagtcgcggaaatgttcgatcgttttgggtttcggtggagcgttcgagttcgaggtttagcgtttcgagtcgtcggtttcgttttgcgtttgtttagacggtatggagatagttcgtcgggaaaagcggtttttagttattcggtcgtcgttcgtatttcggttgttggttcggttgcgatcgggaatttgcgattagtttttgttcggtattgggtatttttaggtatcgattgttttcggttttgttagtttttcgcgattttagggcggtggatttttgcgcgttttttttttttcggtttttcgatagatcgtcggttgagttttttgcgtttttagtttttttcgtcgtcgtcgcgatgttgttttggagacgtaataaattcgtgttggtggaggacgaggttaagtgtaaggcgaagagtttgacgttcggggttcgttatacgtcgttgttttttagttttttgcgtttttgttcggatttgttgttcgattggtcgttggaggttttgggtcgatgtgtttcgtagtcggcgttagaaagtggagtttaataaggaggattcgatttatatcgtgtggtatttgggtaacgcgttattttgtacgttaaggaatcggttcgtatcgacgacgtcgtgggtaagatttgggttcgttgcgggtttggcgggggtattaagatgaagttgaagttggggtcgtacgcgattttcgtattgtacgtcgttgtacgcgatagtttngtacgcggagcgttttcgcgggcggtcgcgagcgttatcgtttattttcgttgtcgcgtattatttattgtacggcggacgggcgttattcgcgcgtttttcgtttgcggtttatcgttattaggcgtttataaggtcgtggtgttgcgttgttatttgtgttgttgcgcgtataaggtttttcggtttcgtttgtttcgttagatcgcgttggttttttagcgattttaagcgttttacgtagattacgtcgttacgttttagagtattttcggtttggggcggtttttcgttgtcgtttttattgttcgttttttaatgttatttcgtttattttttcgtatttatttattttttttttttttttttttcgttttttttatttattaattttttttatttttattataatattattatattatttttttatttt

SEQ ID NO: 35314 - DNA, 1392 bp, Artificial Sequence
  chemically treated genomic DNA (Homo sapiens) CpG-island No: 35314
  misc_feature (437)..(437): n is either a, c, g or t
aaaataaaaaaataatataataatattataataaaaataaaaaaaattaataaataaaaaaaacgaaaaaaaaaaaaaaaaaaaataaataaatacgaaaaaataaacgaaataacattaaaaaacgaacaataaaaacgacaacgaaaaaccgccccaaaccgaaaatactctaaaacgtaacgacgtaatctacgtaaaacgcttaaaatcgctaaaaaaccaacgcgatctaacgaaacaaacgaaaccgaaaaaccttatacgcgcaacaacacaaataacaacgcaacaccacgaccttataaacgcctaataacgataaaccgcaaacgaaaaacgcgcgaataacgcccgtccgccgtacaataaataatacgcgacaacgaaaataaacgataacgctcgcgaccgcccgcgaaaacgctccgcgtacnaaactatcgcgtacaacgacgtacaatacgaaaatcgcgtacgaccccaacttcaacttcatcttaatacccccgccaaacccgcaacgaacccaaatcttacccacgacgtcgtcgatacgaaccgattccttaacgtacaaaataacgcgttacccaaataccacacgatataaatcgaatcctccttattaaactccactttctaacgccgactacgaaacacatcgacccaaaacctccaacgaccaatcgaacaacaaatccgaacaaaaacgcaaaaaactaaaaaacaacgacgtataacgaaccccgaacgtcaaactcttcgccttacacttaacctcgtcctccaccaacacgaatttattacgtctccaaaacaacatcgcgacgacgacgaaaaaaactaaaaacgcaaaaaactcaaccgacgatctatcgaaaaaccgaaaaaaaaaaaacgcgcaaaaatccaccgccctaaaatcgcgaaaaactaacaaaaccgaaaacaatcgatacctaaaaatacccaataccgaacaaaaactaatcgcaaattcccgatcgcaaccgaaccaacaaccgaaatacgaacgacgaccgaataactaaaaaccgcttttcccgacgaactatctccataccgtctaaacaaacgcaaaacgaaaccgacgactcgaaacgctaaacctcgaactcgaacgctccaccgaaacccaaaacgatcgaacatttccgcgactccctaccgccgcaatcttacgatacaccgtataactaacgactacttaataaaacaaaccgaaaacgcgactacgataaaaactccttcaaacgtcgcgactccacctccccgaactacctacatcaccgaacgaaaacgctaactctcttatcccctccccttaccctcttctcccctccccccaacgcaactcgcgctacccga

SEQ ID NO: 35315 - DNA, 1392 bp, Artificial Sequence
  chemically treated genomic DNA (Homo sapiens) CpG-island No: 35315
  misc_feature (437)..(437): n is either a, c, g or t
ggggtgggggagtgatgtggtggtgttgtggtgggggtggagggggttggtgagtggggggagcggggggaggggggggggggggtggatgggtgcgggggggtaggcggagtggtattaggaggcgggtagtgggggcggtaacgaggggtcgttttagatcgaagatgttttgagacgtggcggcgtgatttgcgtgaggcgtttgaagtcgttgaagagttagcgcggtttggcggagtaggcggggtcgaggggttttgtgcgcgtagtagtataggtggtagcgtagtattacggttttgtgggcgtttggtggcggtagatcgtaggcgaaagacgcgcgggtggcgttcgttcgtcgtgtagtaggtgatgcgcggtagcgagggtaggcggtgacgttcgcggtcgttcgcgagagcgtttcgcgtgtngaattgtcgcgtgtagcggcgtgtagtgcgggaatcgcgtgcggttttagttttagttttattttagtgttttcgttaggttcgtagcgagtttagattttgtttacggcgtcgtcggtgcgagtcgattttttggcgtgtagggtgacgcgttgtttaggtattatacggtgtaggtcgggttttttttgttgagttttattttttggcgtcggttgcggaatatatcggtttagagtttttagcggttagtcgggtagtaggttcgggtaggagcgtaggaagttggagagtagcgacgtgtagcgagtttcggacgttaggtttttcgttttgtatttggtttcgttttttattagtacgaatttgttacgtttttagggtagtatcgcggcggcggcgaaaggggttgggggcgtagggagtttagtcggcggtttgtcgggagatcgggggagggaaggcgcgtagaagtttatcgttttggagtcgcgagaagttggtagggtcggggatagtcggtgtttggagatgtttagtgtcgggtaggggttagtcgtagattttcggtcgtagtcgggttagtagtcgaggtgcggacggcggtcgagtggttgaggatcgtttttttcggcgagttgtttttatgtcgtttgggtaagcgtaggacggggtcggcggttcggggcgttgagtttcgggttcggacgttttatcgaagtttaagacggtcgggtattttcgcggttttttgtcgtcgtaattttgcggtatatcgtgtagttggcggttgtttagtggggtagatcgagagcgcggttgcggtggggatttttttaggcgtcgcggttttattttttcgggttgtttatattatcgggcgggagcgttagtttttttgttttttttttttgttttttttttttttttttttagcgtagttcgcgttgttcgg

SEQ ID NO: 35316 - DNA, 1392 bp, Artificial Sequence
  chemically treated genomic DNA (Homo sapiens) CpG-island No: 35316
  misc_feature (956)..(956): n is either a, c, g or t
ccgaacaacgcgaactacgctaaaaaaaaaaaaaaaaaaaacaaaaaaaaaaaacaaaaaaactaacgctcccgcccgataatataaacaacccgaaaaaataaaaccgcgacgcctaaaaaaatccccaccgcaaccgcgctctcgatctaccccactaaacaaccgccaactacacgatataccgcaaaattacgacgacaaaaaaccgcgaaaatacccgaccgtcttaaacttcgataaaacgtccgaacccgaaactcaacgccccgaaccgccgaccccgtcctacgcttacccaaacgacataaaaacaactcgccgaaaaaaacgatcctcaaccactcgaccgccgtccgcacctcgactactaacccgactacgaccgaaaatctacgactaacccctacccgacactaaacatctccaaacaccgactatccccgaccctaccaacttctcgcgactccaaaacgataaacttctacgcgccttccctcccccgatctcccgacaaaccgccgactaaactccctacgcccccaacccctttcgccgccgccgcgatactaccctaaaaacgtaacaaattcgtactaataaaaaacgaaaccaaatacaaaacgaaaaacctaacgtccgaaactcgctacacgtcgctactctccaacttcctacgctcctacccgaacctactacccgactaaccgctaaaaactctaaaccgatatattccgcaaccgacgccaaaaaataaaactcaacaaaaaaaacccgacctacaccgtataatacctaaacaacgcgtcaccctacacgccaaaaaatcgactcgcaccgacgacgccgtaaacaaaatctaaactcgctacgaacctaacgaaaacactaaaataaaactaaaactaaaaccgcacgcgattcccgcactacacgccgctacacgcgacaattcnacacgcgaaacgctctcgcgaacgaccgcgaacgtcaccgcctaccctcgctaccgcgcatcacctactacacgacgaacgaacgccacccgcgcgtctttcgcctacgatctaccgccaccaaacgcccacaaaaccgtaatactacgctaccacctatactactacgcgcacaaaacccctcgaccccgcctactccgccaaaccgcgctaactcttcaacgacttcaaacgcctcacgcaaatcacgccgccacgtctcaaaacatcttcgatctaaaacgacccctcgttaccgcccccactacccgcctcctaataccactccgcctacccccccgcacccatccacccccccccccccctccccccgctccccccactcaccaaccccctccacccccaccacaacaccaccacatcactcccccacccc

SEQ ID NO: 35317 - DNA, 870 bp, Artificial Sequence
  chemically treated genomic DNA (Homo sapiens) CpG-island No: 35317
gagcgtcggatagcggtcgtggtttttagaggtcggacgttcggttttttcgtagttagagtattttttagttttttagcgagttagagagggagttcgagtggcgggataggttcggttcgttcgaatcgtttttgttggatgttttttttagtcgcgtttatcggaatagtattaaggacgtatagtttcgtgttttgggggttattttttttcgacgtcgagatttggagttgggggcgttcgtggcgtcgaggttttggcggttacggtttttttcggtttacgtggggttgcggagtttcgaggcgtcggttttcgttttttcgtatacgtttcgggagcggtatagcgtgatttttgttgagggcgatttggttaggttcgtgttttttgtcgttcggagaggtgttcgtcggcgtttgattttcgagtagaagaagcgtttttattcggagttcgagaagatgaacgaggtggggatcgtggaggaggtcgaatcggtatttttgggttcgtagagaaatgggatgcgtttttcggagagtagcgtggtcgatcggcgtcgttttttcgagcgcgatggtaaggtttgttttacgtttagtttgtcggggttcgagttgaagtagttttagtagagcgttttggcggattatatttagcgtaagatcggtaagcggtttattttcgtcgtcggttgtagtttttaggagttcgggttattgcgtgagcgcgtttagagtgtttatttttagttcggtttcgcggcgttcgaaggtttcggtttcgtttcggtttttagtttgagtttattgcgggagtttagtttgtagtttcgtagggaggttacgtttttgtcggttatag

SEQ ID NO: 35318 - DNA, 870 bp, Artificial Sequence
  chemically treated genomic DNA (Homo sapiens) CpG-island No: 35318
ctataaccgacaaaaacgtaacctccctacgaaactacaaactaaactcccgcaataaactcaaactaaaaaccgaaacgaaaccgaaaccttcgaacgccgcgaaaccgaactaaaaataaacactctaaacgcgctcacgcaataacccgaactcctaaaaactacaaccgacgacgaaaataaaccgcttaccgatcttacgctaaatataatccgccaaaacgctctactaaaactacttcaactcgaaccccgacaaactaaacgtaaaacaaaccttaccatcgcgctcgaaaaaacgacgccgatcgaccacgctactctccgaaaaacgcatcccatttctctacgaacccaaaaataccgattcgacctcctccacgatccccacctcgttcatcttctcgaactccgaataaaaacgcttcttctactcgaaaatcaaacgccgacgaacacctctccgaacgacaaaaaacacgaacctaaccaaatcgccctcaacaaaaatcacgctataccgctcccgaaacgtatacgaaaaaacgaaaaccgacgcctcgaaactccgcaaccccacgtaaaccgaaaaaaaccgtaaccgccaaaacctcgacgccacgaacgcccccaactccaaatctcgacgtcgaaaaaaaataacccccaaaacacgaaactatacgtccttaatactattccgataaacgcgactaaaaaaaacatccaacaaaaacgattcgaacgaaccgaacctatcccgccactcgaactccctctctaactcgctaaaaaactaaaaaatactctaactacgaaaaaaccgaacgtccgacctctaaaaaccacgaccgctatccgacgctc

SEQ ID NO: 35319 - DNA, 870 bp, Artificial Sequence
  chemically treated genomic DNA (Homo sapiens) CpG-island No: 35319
ttgtggtcggtaggagcgtggtttttttgcggggttgtaggttgggttttcgtagtgagtttaagttggaggtcgaggcgaggtcggagttttcgagcgtcgcggggtcgggttggaggtaggtattttgggcgcgtttacgtagtggttcgggtttttggaggttgtagtcggcggcggaggtaggtcgtttgtcggttttgcgttggatgtagttcgttagggcgttttgttggaattgttttagttcgggtttcgataggttgagcgtggagtaggttttgttatcgcgttcgaagagacggcgtcggtcggttacgttgtttttcgggaaacgtattttatttttttgcgggtttaggggtgtcggttcggttttttttacgatttttatttcgtttattttttcgggtttcgagtaggagcgttttttttgttcgggagttaggcgtcggcgagtattttttcgggcggtagggggtacgggtttggttaggtcgtttttagtaggggttacgttgtgtcgttttcggggcgtgtgcggggaggcggaggtcgacgtttcggggtttcgtagttttacgtgggtcgaggaaggtcgtggtcgttaggatttcgacgttacgggcgtttttagttttaggtttcgacgtcgaaaggaggtggtttttaagatacgggattgtgcgtttttgatgttgtttcggtaggcgcggttgaagggggtatttagtaggggcgattcgggcgagtcgggtttgtttcgttattcgggttttttttttggttcgttggagagttggaaggtgttttggttacggaggagtcgagcgttcggtttttgggggttacggtcgttgttcgacgttt

SEQ ID NO: 35320 - DNA, 870 bp, Artificial Sequence
  chemically treated genomic DNA (Homo sapiens) CpG-island No: 35320
aaacgtcgaacaacgaccgtaacccccaaaaaccgaacgctcgactcctccgtaaccaaaacaccttccaactctccaacgaaccaaaaaaaaaacccgaataacgaaacaaacccgactcgcccgaatcgcccctactaaatacccccttcaaccgcgcctaccgaaacaacatcaaaaacgcacaatcccgtatcttaaaaaccacctcctttcgacgtcgaaacctaaaactaaaaacgcccgtaacgtcgaaatcctaacgaccacgaccttcctcgacccacgtaaaactacgaaaccccgaaacgtcgacctccgcctccccgcacacgccccgaaaacgacacaacgtaacccctactaaaaacgacctaaccaaacccgtaccccctaccgcccgaaaaaatactcgccgacgcctaactcccgaacaaaaaaaacgctcctactcgaaacccgaaaaaataaacgaaataaaaatcgtaaaaaaaaccgaaccgacacccctaaacccgcaaaaaaataaaatacgtttcccgaaaaacaacgtaaccgaccgacgccgtctcttcgaacgcgataacaaaacctactccacgctcaacctatcgaaacccgaactaaaacaattccaacaaaacgccctaacgaactacatccaacgcaaaaccgacaaacgacctacctccgccgccgactacaacctccaaaaacccgaaccactacgtaaacgcgcccaaaatacctacctccaacccgaccccgcgacgctcgaaaactccgacctcgcctcgacctccaacttaaactcactacgaaaacccaacctacaaccccgcaaaaaaaccacgctcctaccgaccacaa

SEQ ID NO: 35321 - DNA, 741 bp, Artificial Sequence
  chemically treated genomic DNA (Homo sapiens) CpG-island No: 35321
ttgcgtttttttggttttgtatcgttacgtattgggttttgtatcgttacgtatcgggttcggtattataacgtattcggttttgtatcgttacgtatcgggttttgtatcgtaacgtattcggttttgtatcgtaacgtatcgggttttgtatcgttacgtattcggttttgtatcgttacgtatcgggttttgtatcgttacgtatcgggttcggtattataacgtattcggttttgtatcgttacgtatcgggttttgtatcgtaacgtattcggttttgtatcgtaacgtatcgggttttgtatcgttacgtattcggttttgtatcgttacgtattaggttttgtatcgttacgcgttcggttttgtattataacgtattcggttttgtatcgttacgcgttcggttttgtattataacgtattcggttttgtatcgtaaagtattcggcgcggtatcgttacgcgttcggttttgtattataacgtattcggttttgtatcgttacgcgttcggttttgtattataacgtattcggttttgtatcgttacgcgttcggttttgtatcgtaacgcggtttttcgtttatttcgttgttttcggtgcggggagggggcggtcggcgttttttaatttattttcgtcgtttttatggttaggttgaaatgttatagtttggttatttagtaggatacggattgcgtcgtgaggtttaaggagttattggatttggaag

SEQ ID NO: 35322 - DNA, 741 bp, Artificial Sequence
  chemically treated genomic DNA (Homo sapiens) CpG-island No: 35322
cttccaaatccaataactccttaaacctcacgacgcaatccgtatcctactaaataaccaaactataacatttcaacctaaccataaaaacgacgaaaataaattaaaaaacgccgaccgccccctccccgcaccgaaaacaacgaaataaacgaaaaaccgcgttacgatacaaaaccgaacgcgtaacgatacaaaaccgaatacgttataatacaaaaccgaacgcgtaacgatacaaaaccgaatacgttataatacaaaaccgaacgcgtaacgataccgcgccgaatactttacgatacaaaaccgaatacgttataatacaaaaccgaacgcgtaacgatacaaaaccgaatacgttataatacaaaaccgaacgcgtaacgatacaaaacctaatacgtaacgatacaaaaccgaatacgtaacgatacaaaacccgatacgttacgatacaaaaccgaatacgttacgatacaaaacccgatacgtaacgatacaaaaccgaatacgttataataccgaacccgatacgtaacgatacaaaacccgatacgtaacgatacaaaaccgaatacgtaacgatacaaaacccgatacgttacgatacaaaaccgaatacgttacgatacaaaacccgatacgtaacgatacaaaaccgaatacgttataataccgaacccgatacgtaacgatacaaaacccaatacgtaacgatacaaaaccaaaaaaacgcaa

SEQ ID NO: 35323 - DNA, 741 bp, Artificial Sequence
  chemically treated genomic DNA (Homo sapiens) CpG-island No: 35323
tttttaggtttaatggttttttgagttttacgacgtaattcgtgttttgttggataattagattgtgatattttagtttgattatgaagacggcggaggtaggttggggagcgtcggtcgtttttttttcgtatcgggagtagcgaggtgggcgagaagtcgcgttgcggtgtagggtcgggcgcgtggcggtgtagggtcgggtgcgttgtggtgtagggtcgggcgcgtggcggtgtagggtcgggtgcgttgtggtgtagggtcgggcgcgtggcggtgtcgcgtcgagtgttttgcggtgtagggtcgggtgcgttgtggtgtagggtcgggcgcgtggcggtgtagggtcgggtgcgttgtggtgtagggtcgggcgcgtggcggtgtagggtttggtgcgtggcggtgtagggtcgggtgcgtggcggtgtagggttcggtgcgttgcggtgtagggtcgggtgcgttgcggtgtagggttcggtgcgtggcggtgtagggtcgagtgcgttgtggtgtcgggttcggtgcgtggcggtgtagggttcggtgcgtggcggtgtagggtcgggtgcgtggcggtgtagggttcggtgcgttgcggtgtagggtcgggtgcgttgcggtgtagggttcggtgcgtggcggtgtagggtcgagtgcgttgtggtgtcgggttcggtgcgtggcggtgtagggtttagtgcgtggcggtgtagggttaagagagcgtag

SEQ ID NO: 35324 - DNA, 741 bp, Artificial Sequence
  chemically treated genomic DNA (Homo sapiens) CpG-island No: 35324
ctacgctctcttaaccctacaccgccacgcactaaaccctacaccgccacgcaccgaacccgacaccacaacgcactcgaccctacaccgccacgcaccgaaccctacaccgcaacgcacccgaccctacaccgcaacgcaccgaaccctacaccgccacgcacccgaccctacaccgccacgcaccgaaccctacaccgccacgcaccgaacccgacaccacaacgcactcgaccctacaccgccacgcaccgaaccctacaccgcaacgcacccgaccctacaccgcaacgcaccgaaccctacaccgccacgcacccgaccctacaccgccacgcaccaaaccctacaccgccacgcgcccgaccctacaccacaacgcacccgaccctacaccgccacgcgcccgaccctacaccacaacgcacccgaccctacaccgcaaaacactcgacgcgacaccgccacgcgcccgaccctacaccacaacgcacccgaccctacaccgccacgcgcccgaccctacaccacaacgcacccgaccctacaccgccacgcgcccgaccctacaccgcaacgcgacttctcgcccacctcgctactcccgatacgaaaaaaaaacgaccgacgctccccaacctacctccgccgtcttcataatcaaactaaaatatcacaatctaattatccaacaaaacacgaattacgtcgtaaaactcaaaaaaccattaaacctaaaaa

SEQ ID NO: 35325 - DNA, 869 bp, Artificial Sequence
  chemically treated genomic DNA (Homo sapiens) CpG-island No: 35325
  misc_feature (775)..(775): n is either a, c, g or t
  misc_feature (796)..(796): n is either a, c, g or t
cgcgttttttttattgagattttagtttttggacgattgttttttttcgggttcggtttatttcgtaataagtggaggggtttcgtttgattttaggggtcggcgtttttttttttttttttttgcgtttgcgaattttttcgggcgttttcggagtcgcgatttttgttggggatttcgggggcgggaggtcgaggggcgcggcgagggtcgtgacgcgaggcggggtcggttaatgggagcgtttcgcggcgtaggttgagtcgtcgggttataaaaaggaggcgcggtcgggttttttagtttgtggtcgttttcggttcggagtgtgatttaagtaggttgcgtattttttttaggtgatttcggttatagtttattgttcgcggttatcggcggagtttagtcgtagatttcgaagcgtttcggggtttttttcgaacggtagcggttgcggcgggtttatggagaagggttttgtgcgggtattcgcggagaagcgcggggcgttaggtgtagtaatgggttttcgagcgggattcgtcgcggttcggtttagtagtcggcggagaagtttcgcggtcgaggtaagagcgcgtatcgcggacggttggaaggcgatcgttcgtacgaggagatacgagtgaatttttaattggtagcgttattcgttatttgagtcgtgggtagaattttacgtaaggttgttagcgtttgaggggttcgtatgtattttataaggtatagatattttagtcgtagcgggttgtaagtnggcgcgggcgtgtgcgtaagngagttagtattcgtttgtttttgggagtacgggtttatcgacgtttcgcgttgcggttgtggtttcggtttgg

SEQ ID NO: 35326 - DNA, 869 bp, Artificial Sequence
  chemically treated genomic DNA (Homo sapiens) CpG-island No: 35326
  misc_feature (74)..(74): n is either a, c, g or t
  misc_feature (95)..(95): n is either a, c, g or t
ccaaaccgaaaccacaaccgcaacgcgaaacgtcgataaacccgtactcccaaaaacaaacgaatactaactcncttacgcacacgcccgcgccnacttacaacccgctacgactaaaatatctataccttataaaatacatacgaacccctcaaacgctaacaaccttacgtaaaattctacccacgactcaaataacgaataacgctaccaattaaaaattcactcgtatctcctcgtacgaacgatcgccttccaaccgtccgcgatacgcgctcttacctcgaccgcgaaacttctccgccgactactaaaccgaaccgcgacgaatcccgctcgaaaacccattactacacctaacgccccgcgcttctccgcgaatacccgcacaaaacccttctccataaacccgccgcaaccgctaccgttcgaaaaaaaccccgaaacgcttcgaaatctacgactaaactccgccgataaccgcgaacaataaactataaccgaaatcacctaaaaaaaatacgcaacctacttaaatcacactccgaaccgaaaacgaccacaaactaaaaaacccgaccgcgcctcctttttataacccgacgactcaacctacgccgcgaaacgctcccattaaccgaccccgcctcgcgtcacgaccctcgccgcgcccctcgacctcccgcccccgaaatccccaacaaaaatcgcgactccgaaaacgcccgaaaaaattcgcaaacgcaaaaaaaaaaaaaaaaaaacgccgacccctaaaatcaaacgaaacccctccacttattacgaaataaaccgaacccgaaaaaaaacaatcgtccaaaaactaaaatctcaataaaaaaaacgcg

SEQ ID NO: 35327 - DNA, 869 bp, Artificial Sequence
  chemically treated genomic DNA (Homo sapiens) CpG-island No: 35327
  misc_feature (74)..(74): n is either a, c, g or t
  misc_feature (95)..(95): n is either a, c, g or t
ttaaatcgaggttatagtcgtagcgcggagcgtcgatgaattcgtgtttttaaagataagcgaatgttgatttntttgcgtatacgttcgcgttnatttataattcgttacgattgaagtgtttgtattttgtgaaatgtatgcgagttttttaggcgttgatagttttgcgtggggttttgtttacgatttagatgacgagtagcgttgttagttaggagtttattcgtattttttcgtgcgggcggtcgttttttagtcgttcgcggtgcgcgtttttgtttcggtcgcggggttttttcgtcggttgttgggtcgggtcgcggcggatttcgttcgggaatttattgttgtatttggcgtttcgcgttttttcgcgggtgttcgtatagggtttttttttatggattcgtcgtagtcgttgtcgttcgggaaggatttcggggcgtttcgaggtttgcggttaaatttcgtcggtggtcgcggataatgggttgtggtcggagttatttgaggaaggtacgtaatttgtttagattatatttcgagtcgggagcggttataggttggaaagttcggtcgcgttttttttttatggttcggcggtttagtttgcgtcgcggagcgtttttattggtcggtttcgtttcgcgttacggttttcgtcgcgtttttcggtttttcgttttcggggtttttagtaggggtcgcggtttcggagacgttcggaggggttcgtaagcgtagggagggaaggaaaagggcgtcggtttttaggattaggcgggatttttttatttattgcggaatgagtcgaattcgaaaagaggtagtcgtttaggagttgggattttagtgagaaagacgcg

SEQ ID NO: 35328 - DNA, 869 bp, Artificial Sequence
  chemically treated genomic DNA (Homo sapiens) CpG-island No: 35328
  misc_feature (775)..(775): n is either a, c, g or t
  misc_feature (796)..(796): n is either a, c, g or t
cgcgtctttctcactaaaatcccaactcctaaacgactacctcttttcgaattcgactcattccgcaataaataaaaaaatcccgcctaatcctaaaaaccgacgcccttttccttccctccctacgcttacgaacccctccgaacgtctccgaaaccgcgacccctactaaaaaccccgaaaacgaaaaaccgaaaaacgcgacgaaaaccgtaacgcgaaacgaaaccgaccaataaaaacgctccgcgacgcaaactaaaccgccgaaccataaaaaaaaaacgcgaccgaactttccaacctataaccgctcccgactcgaaatataatctaaacaaattacgtaccttcctcaaataactccgaccacaacccattatccgcgaccaccgacgaaatttaaccgcaaacctcgaaacgccccgaaatccttcccgaacgacaacgactacgacgaatccataaaaaaaaaccctatacgaacacccgcgaaaaaacgcgaaacgccaaatacaacaataaattcccgaacgaaatccgccgcgacccgacccaacaaccgacgaaaaaaccccgcgaccgaaacaaaaacgcgcaccgcgaacgactaaaaaacgaccgcccgcacgaaaaaatacgaataaactcctaactaacaacgctactcgtcatctaaatcgtaaacaaaaccccacgcaaaactatcaacgcctaaaaaactcgcatacatttcacaaaatacaaacacttcaatcgtaacgaattataaatnaacgcgaacgtatacgcaaanaaatcaacattcgcttatctttaaaaacacgaattcatcgacgctccgcgctacgactataacctcgatttaa

SEQ ID NO: 35329 - DNA, 542 bp, Artificial Sequence
  chemically treated genomic DNA (Homo sapiens) CpG-island No: 35329
  misc_feature (477)..(477): n is either a, c, g or t
gttgattcggttttatgtacgacgtagtgttgcgttggtgttttttttgttttttaggggcgaggggatcggcggggtagttatattacgttatttcggttgttcgagcgagtgtcgtttgtcgttacgttcgtacgcgtacggtgttagattattcgttttttttttttttttttttttttcggttcgtggcgtttcgtttttcgcgcgatttatgttcgtttttattttttttcgtttcgtttttcggtgtttttattatcgtttcgttcgttgcgcgttgttttatgtgttaatttcgttttatttttttcgtttttcgcgtacgtagttatattagttcgcgttagtttagtattatcgttcgttttcggatttcgtttagtcgttttttttatatttattacgttcgttttttttttcgtaatgtttatttttattcgtttttttttttatatttttatgtcgttttttatnagaattattcgtcgcgtaatcgtttttattatagtatttcgtttttttttgtacgttagtttatt

SEQ ID NO: 35330 - DNA, 542 bp, Artificial Sequence
  chemically treated genomic DNA (Homo sapiens) CpG-island No: 35330
  misc_feature (66)..(66): n is either a, c, g or t
aataaactaacgtacaaaaaaaaacgaaatactataataaaaacgattacgcgacgaataattctnataaaaaacgacataaaaatataaaaaaaaaaacgaataaaaataaacattacgaaaaaaaaaacgaacgtaataaatataaaaaaaacgactaaacgaaatccgaaaacgaacgataatactaaactaacgcgaactaatataactacgtacgcgaaaaacgaaaaaaataaaacgaaattaacacataaaacaacgcgcaacgaacgaaacgataataaaaacaccgaaaaacgaaacgaaaaaaaataaaaacgaacataaatcgcgcgaaaaacgaaacgccacgaaccgaaaaaaaaaaaaaaaaaaaaaaaacgaataatctaacaccgtacgcgtacgaacgtaacgacaaacgacactcgctcgaacaaccgaaataacgtaatataactaccccgccgatcccctcgcccctaaaaaacaaaaaaaacaccaacgcaacactacgtcgtacataaaaccgaatcaac

SEQ ID NO: 35331 - DNA, 542 bp, Artificial Sequence
  chemically treated genomic DNA (Homo sapiens) CpG-island No: 35331
  misc_feature (66)..(66): n is either a, c, g or t
aataaattgacgtgtaagaagaggcggggtattgtagtagaggcggttacgcggcgggtaattttngtggggggcgatatggggatatggaggggggggcgagtaaaagtgaatattgcgggggggggggcgggcgtggtaaatgtaaggggggcgattgggcggaattcgagagcgggcgatgatgttagattaacgcggattggtgtggttacgtgcgcgggaaacggggggggtaaagcggaattaatatatggggtagcgcgtagcgggcggaacggtggtgggggtatcgggagacgaggcgaaagagggtaggggcgggtataaatcgcgcgggggacggaacgttacgggtcgggaggaaggaaggaaggggggggacgggtgatttaatatcgtgcgcgtgcgaacgtgacggtagacggtattcgttcgggtaatcggagtggcgtggtatgattatttcgtcgattttttcgtttttagaagatagggagggtattagcgtaatattgcgtcgtgtatagggtcgggttagt

SEQ ID NO: 35332 - DNA, 542 bp, Artificial Sequence
  chemically treated genomic DNA (Homo sapiens) CpG-island No: 35332
  misc_feature (477)..(477): n is either a, c, g or t
actaacccgaccctatacacgacgcaatattacgctaataccctccctatcttctaaaaacgaaaaaatcgacgaaataatcataccacgccactccgattacccgaacgaataccgtctaccgtcacgttcgcacgcgcacgatattaaatcacccgtccccccccttccttccttcctcccgacccgtaacgttccgtcccccgcgcgatttatacccgcccctaccctctttcgcctcgtctcccgatacccccaccaccgttccgcccgctacgcgctaccccatatattaattccgctttaccccccccgtttcccgcgcacgtaaccacaccaatccgcgttaatctaacatcatcgcccgctctcgaattccgcccaatcgccccccttacatttaccacgcccgcccccccccccgcaatattcacttttactcgcccccccctccatatccccatatcgccccccacnaaaattacccgccgcgtaaccgcctctactacaataccccgcctcttcttacacgtcaatttatt

SEQ ID NO: 35333 - DNA, 526 bp, Artificial Sequence
  chemically treated genomic DNA (Homo sapiens) CpG-island No: 35333
ttatgttagtattagcgttcgatgtaataacggtatgttatttgtttgtttcgcgtagttgtcgagtatatgttgttagtatttcggttgttgcgttacgtcgatcgtttggttggtttgttagtcggcgtattatgtttatgtcgtaaggaaggcgttattattgttatttttattttattaggtaaagcgcgtttcgggtttcgttagttgtattagtcgtagacggttattttgaattatttgacgaatgtcgttagcggcggtattttgatgatcggtaagcgaacgttaggcgagattgagcgggattagacggttatcggtgttgattacgttattttacggtttatcgattaacgtattaagattgttgcggaaaattttttgcggcgttttattattttgtagtcggatattgttcgtttgttcgggtaatattagcgcgttatcgttattatcgagtatgatatttttttgttgtttaacgggttagttgttatttataaaagatagttttgtgtta

SEQ ID NO: 35334 - DNA, 526 bp, Artificial Sequence
  chemically treated genomic DNA (Homo sapiens) CpG-island No: 35334
taacacaaaactatcttttataaataacaactaacccgttaaacaacaaaaaaatatcatactcgataataacgataacgcgctaatattacccgaacaaacgaacaatatccgactacaaaataataaaacgccgcaaaaaattttccgcaacaatcttaatacgttaatcgataaaccgtaaaataacgtaatcaacaccgataaccgtctaatcccgctcaatctcgcctaacgttcgcttaccgatcatcaaaataccgccgctaacgacattcgtcaaataattcaaaataaccgtctacgactaatacaactaacgaaacccgaaacgcgctttacctaataaaataaaaataacaataataacgccttccttacgacataaacataatacgccgactaacaaaccaaccaaacgatcgacgtaacgcaacaaccgaaatactaacaacatatactcgacaactacgcgaaacaaacaaataacataccgttattacatcgaacgctaatactaacataa

SEQ ID NO: 35335 - DNA, 526 bp, Artificial Sequence
  chemically treated genomic DNA (Homo sapiens) CpG-island No: 35335
tagtataaaattgttttttgtggataatagttggttcgttgaatagtagaaaaatgttatgttcggtggtggcgataacgcgttgatgttgttcgagtaggcgagtaatattcggttataaagtagtgaaacgtcgtaggagatttttcgtaataattttgatgcgttagtcgatgaatcgtggggtggcgtaattaatatcggtagtcgtttgatttcgtttagtttcgtttggcgttcgtttgtcgattattaaagtgtcgtcgttaacgatattcgttagatgatttaggataatcgtttgcggttgatgtaattggcggggttcggagcgcgttttatttggtggggtgaagatggtaatggtgacgttttttttacggtatgggtatggtacgtcgattggtaggttagttaggcgatcggcgtaacgtaataatcggaatattggtagtatatgttcgatagttacgcggagtaggtagataatatgtcgttattgtatcgggcgttggtgttggtatgg

SEQ ID NO: 35336 - DNA, 526 bp, Artificial Sequence
  chemically treated genomic DNA (Homo sapiens) CpG-island No: 35336
ccataccaacaccaacgcccgatacaataacgacatattatctacctactccgcgtaactatcgaacatatactaccaatattccgattattacgttacgccgatcgcctaactaacctaccaatcgacgtaccatacccataccgtaaaaaaaacgtcaccattaccatcttcaccccaccaaataaaacgcgctccgaaccccgccaattacatcaaccgcaaacgattatcctaaatcatctaacgaatatcgttaacgacgacactttaataatcgacaaacgaacgccaaacgaaactaaacgaaatcaaacgactaccgatattaattacgccaccccacgattcatcgactaacgcatcaaaattattacgaaaaatctcctacgacgtttcactactttataaccgaatattactcgcctactcgaacaacatcaacgcgttatcgccaccaccgaacataacatttttctactattcaacgaaccaactattatccacaaaaaacaattttatacta

SEQ ID NO: 35337 - DNA, 1015 bp, Artificial Sequence
  chemically treated genomic DNA (Homo sapiens) CpG-island No: 35337
gggcgtagtcgttattagagtttcggtcgagttcgggagcgaagcggggtcgagttaggatttattagttgttttaggttttttttcgagagtttcgcgtaacggtatcgttgttgttcgaattcgtatcgggtggttttggttattattattattcgggaggggcggaagtcgtcgttcgcgcggttgttatagttcgttagttcgcgcggttgtttttgttttaggtgtcgtcggtcgttatcgttatcgtttagtcggggtcgcgcggcggggtttttcgtattcggttttcgtagcgtcgtcgttcggtcgttcgttacgcgataatagttgtttagtaagaagtttcggtagtaagttatcgtgggtcgggtcgcggtcgcgggtttgggttcgggtttttgttttagttttttatcgtcgggagtgcgcgtcgttcgcgtcgttcgggtttttaatttcgcgtcggacgggtagaggttaagtgttaggacgtgcgtggtttacgcggttagggggacgtatttaggcgttgacgaaggcggggaaagcgtggcgattgggaaacgggagattttacgcgggagaaaggtgggcggggaagaaatggaggttttagttagtgggttttgtttgtttgtttattcgttttatttacgtttgtataatggttgtttcgtcgttcgggggcgattttttcgtattatacgttttttcgaggtcgtttttttttcgtttttaggttaattttatcggttaattagagttcgcggcggtttcggattcgaggggtcgcgttattggttgcggtttgagaaagaggtagaattttgttaggcgattgcgtcgttttgaggaatttagttggattcggtttgaggcggcgcggggttagcgggtggggttttgagcggttggcgggaaggtaggtttttggtatatgttcgtttgggttttgttttgtaggtcgattacgtgtttattggtttatttgattagggtcggtgtgata

SEQ ID NO: 35338 - DNA, 1015 bp, Artificial Sequence
  chemically treated genomic DNA (Homo sapiens) CpG-island No: 35338
tatcacaccgaccctaatcaaataaaccaataaacacgtaatcgacctacaaaacaaaacccaaacgaacatataccaaaaacctaccttcccgccaaccgctcaaaaccccacccgctaaccccgcgccgcctcaaaccgaatccaactaaattcctcaaaacgacgcaatcgcctaacaaaattctacctctttctcaaaccgcaaccaataacgcgacccctcgaatccgaaaccgccgcgaactctaattaaccgataaaattaacctaaaaacgaaaaaaaaacgacctcgaaaaaacgtataatacgaaaaaatcgcccccgaacgacgaaacaaccattatacaaacgtaaataaaacgaataaacaaacaaacaaaacccactaactaaaacctccatttcttccccgcccacctttctcccgcgtaaaatctcccgtttcccaatcgccacgctttccccgccttcgtcaacgcctaaatacgtccccctaaccgcgtaaaccacgcacgtcctaacacttaacctctacccgtccgacgcgaaattaaaaacccgaacgacgcgaacgacgcgcactcccgacgataaaaaactaaaacaaaaacccgaacccaaacccgcgaccgcgacccgacccacgataacttactaccgaaacttcttactaaacaactattatcgcgtaacgaacgaccgaacgacgacgctacgaaaaccgaatacgaaaaaccccgccgcgcgaccccgactaaacgataacgataacgaccgacgacacctaaaacaaaaacaaccgcgcgaactaacgaactataacaaccgcgcgaacgacgacttccgcccctcccgaataataataataaccaaaaccacccgatacgaattcgaacaacaacgataccgttacgcgaaactctcgaaaaaaaacctaaaacaactaataaatcctaactcgaccccgcttcgctcccgaactcgaccgaaactctaataacgactacgccc

SEQ ID NO: 35339 - DNA, 1015 bp, Artificial Sequence
  chemically treated genomic DNA (Homo sapiens) CpG-island No: 35339
tattatatcgattttggttaaataaattaatgggtacgtggtcggtttgtagaatagaatttaagcgagtatatgttaggaatttgttttttcgttagtcgtttaaaattttattcgttggtttcgcgtcgttttagatcggatttagttggattttttagggcgacgtaatcgtttaatagaattttattttttttttaggtcgtagttaatggcgcggtttttcggattcggagtcgtcgcgggttttgattggtcgatagagttagtttgggggcgggagaagagcgatttcggggaagcgtgtggtgcggggaggtcgttttcgggcggcgaagtagttattatgtaggcgtgagtgaaacgaataaataaataaataaaatttattagttggggtttttatttttttttcgtttatttttttttcgcgtggggtttttcgttttttaatcgttacgtttttttcgttttcgttaacgtttgggtacgtttttttagtcgcgtgggttacgtacgttttggtatttaatttttgttcgttcggcgcgaagttagaggttcgggcggcgcggacggcgcgtattttcggcggtagggagttgaggtaagggttcgagtttaagttcgcggtcgcggttcggtttacgatgatttgttatcgaggttttttgttgggtagttgttgtcgcgtggcgggcggtcgggcggcggcgttgcggggatcgggtgcgggaggtttcgtcgcgcggtttcggttgggcggtgacggtggcggtcggcggtatttggggtaggggtagtcgcgcgagttggcgggttgtggtagtcgcgcggacggcggttttcgtttttttcgggtggtggtggtggttaaaattattcggtacgagttcgagtagtagcggtatcgttacgcggagttttcggaggaggatttgaagtagttggtgggttttggttcggtttcgtttcgttttcgggttcggtcggggttttggtggcggttgcgttt

SEQ ID NO: 35340 - DNA, 1015 bp, Artificial Sequence
  chemically treated genomic DNA (Homo sapiens) CpG-island No: 35340
aaacgcaaccgccaccaaaaccccgaccgaacccgaaaacgaaacgaaaccgaaccaaaacccaccaactacttcaaatcctcctccgaaaactccgcgtaacgataccgctactactcgaactcgtaccgaataattttaaccaccaccaccacccgaaaaaaacgaaaaccgccgtccgcgcgactaccacaacccgccaactcgcgcgactacccctaccccaaataccgccgaccgccaccgtcaccgcccaaccgaaaccgcgcgacgaaacctcccgcacccgatccccgcaacgccgccgcccgaccgcccgccacgcgacaacaactacccaacaaaaaacctcgataacaaatcatcgtaaaccgaaccgcgaccgcgaacttaaactcgaacccttacctcaactccctaccgccgaaaatacgcgccgtccgcgccgcccgaacctctaacttcgcgccgaacgaacaaaaattaaataccaaaacgtacgtaacccacgcgactaaaaaaacgtacccaaacgttaacgaaaacgaaaaaaacgtaacgattaaaaaacgaaaaaccccacgcgaaaaaaaaataaacgaaaaaaaaataaaaaccccaactaataaattttatttatttatttattcgtttcactcacgcctacataataactacttcgccgcccgaaaacgacctccccgcaccacacgcttccccgaaatcgctcttctcccgcccccaaactaactctatcgaccaatcaaaacccgcgacgactccgaatccgaaaaaccgcgccattaactacgacctaaaaaaaaaataaaattctattaaacgattacgtcgccctaaaaaatccaactaaatccgatctaaaacgacgcgaaaccaacgaataaaattttaaacgactaacgaaaaaacaaattcctaacatatactcgcttaaattctattctacaaaccgaccacgtacccattaatttatttaaccaaaatcgatataata

SEQ ID NO: 35341 - DNA, 1013 bp, Artificial Sequence
  chemically treated genomic DNA (Homo sapiens) CpG-island No: 35341
atttgtagcgaggttcggaaatcggtttcgttagagtcgattttattcgttaggaatgcgtttcgttttcgtcgttttttcgcggtaatcgtttttgggtttttttcgttttaggggtaggagatagttcgaggggagcgtcgtttcggttcgttataatatcgtcgggtcggtcgtcggtcgtataggtattaggaggatagggtttggggcggattttacgttttatttcggttttcgcggttcgggagacgttcgcgtttgggtcgggtaggggattcggagttgatcgaggtttgattttttaagtcggttacggtttcgagtttacgttggatattggaggagacgttttttttatcggattttcgaatttatttttgtttcgggtaggggcgttagggttgcggttcggttagagttttttgggtcgtaagcgagagtcgttttttttttttcgtttcggggcgtaagttttttcgggtgttcgttcgtatttttaattttttagagcggcggtagcgtagggtggcgggcgagtaggtttattttttagtagcggcgatagtagtttgaggaagcgcgggggagggttttttcgatgcgtcgaggcgttttttaatcggggcggagacgacggaggggaggagtttcgacggtcgttttttcgaatttttttttcgtagttgtggttcgacggttgttttcgggaattagcgtcgtaattattattttttttttttttagttttcgtttttttttttttttttttttatttttttttttcgttttcggtcgtttcgttttaacgcgtcgttcgcgtgttgtgcgttatggcgttatttttattaggttcgttgcgggcggttttggatacggttgtttttttgcgtattttcgtttcgcgttcgcgtaggattcgttacgttgtattcgggtggtttttattgtcggtttttacgtttgaattatattagaaataatttaagaattggttaattattttttgtttg

SEQ ID NO: 35342 - DNA, 1013 bp, Artificial Sequence
  chemically treated genomic DNA (Homo sapiens) CpG-island No: 35342
caaacaaaaaataattaaccaattcttaaattatttctaatataattcaaacgtaaaaaccgacaataaaaaccacccgaatacaacgtaacgaatcctacgcgaacgcgaaacgaaaatacgcaaaaaaacaaccgtatccaaaaccgcccgcaacgaacctaataaaaataacgccataacgcacaacacgcgaacgacgcgttaaaacgaaacgaccgaaaacgaaaaaaaaaaataaaaaaaaaaaaaaaaaaaaacgaaaactaaaaaaaaaaaaaataataattacgacgctaattcccgaaaacaaccgtcgaaccacaactacgaaaaaaaaattcgaaaaaacgaccgtcgaaactcctcccctccgtcgtctccgccccgattaaaaaacgcctcgacgcatcgaaaaaaccctcccccgcgcttcctcaaactactatcgccgctactaaaaaataaacctactcgcccgccaccctacgctaccgccgctctaaaaaattaaaaatacgaacgaacacccgaaaaaacttacgccccgaaacgaaaaaaaaaaaacgactctcgcttacgacccaaaaaactctaaccgaaccgcaaccctaacgcccctacccgaaacaaaaataaattcgaaaatccgataaaaaaaacgtctcctccaatatccaacgtaaactcgaaaccgtaaccgacttaaaaaatcaaacctcgatcaactccgaatcccctacccgacccaaacgcgaacgtctcccgaaccgcgaaaaccgaaataaaacgtaaaatccgccccaaaccctatcctcctaatacctatacgaccgacgaccgacccgacgatattataacgaaccgaaacgacgctcccctcgaactatctcctacccctaaaacgaaaaaaacccaaaaacgattaccgcgaaaaaacgacgaaaacgaaacgcattcctaacgaataaaatcgactctaacgaaaccgatttccgaacctcgctacaaat

SEQ ID NO: 35343 - DNA, 1013 bp, Artificial Sequence
  chemically treated genomic DNA (Homo sapiens) CpG-island No: 35343
taggtaaagaataattagttagtttttgaattatttttggtgtagtttaggcgtgggggtcggtagtgggggttattcgggtgtagcgtggcgggttttgcgcgggcgcggaacgagggtgcgtaagggaatagtcgtgtttagagtcgttcgtagcgggtttggtgggggtgacgttatgacgtatagtacgcgggcggcgcgttggggcggggcggtcgggggcgggaggaagaagtgggaggaggaggaggggaaagcgggggttgggggagggggaggtggtagttgcggcgttggttttcgggagtagtcgtcgagttataattgcggaggaggagttcgggaaagcggtcgtcgggatttttttttttcgtcgttttcgtttcggttgagaggcgtttcggcgtatcggagggattttttttcgcgtttttttaggttgttgtcgtcgttgttgggagatgggtttattcgttcgttattttgcgttgtcgtcgttttgaggagttaaaggtacgggcgggtattcggaggagtttgcgtttcggagcgggagagaaggggcggttttcgtttacgatttagggagttttggtcgggtcgtagttttagcgtttttgttcgggatagaaatggattcggaagttcggtgggaaaggcgttttttttagtgtttagcgtgggttcggggtcgtggtcggtttagggggttaggtttcggttagtttcgggttttttattcggtttaggcgcgggcgtttttcgggtcgcgggggtcgaggtggagcgtgggattcgttttaagttttgtttttttggtgtttgtgcggtcggcggtcggttcggcgatattatgacgggtcgaggcggcgtttttttcgagttgttttttgtttttaaagcgggggagatttaagggcggttgtcgcggggaggcggcgggggcggaacgtatttttgacgggtgaaatcggttttaacgggatcgattttcgggtttcgttgtaaat

SEQ ID NO: 35344 - DNA, 1013 bp, Artificial Sequence
  chemically treated genomic DNA (Homo sapiens) CpG-island No: 35344
atttacaacgaaacccgaaaatcgatcccgttaaaaccgatttcacccgtcaaaaatacgttccgcccccgccgcctccccgcgacaaccgcccttaaatctcccccgctttaaaaacaaaaaacaactcgaaaaaaacgccgcctcgacccgtcataatatcgccgaaccgaccgccgaccgcacaaacaccaaaaaaacaaaacttaaaacgaatcccacgctccacctcgacccccgcgacccgaaaaacgcccgcgcctaaaccgaataaaaaacccgaaactaaccgaaacctaaccccctaaaccgaccacgaccccgaacccacgctaaacactaaaaaaaacgcctttcccaccgaacttccgaatccatttctatcccgaacaaaaacgctaaaactacgacccgaccaaaactccctaaatcgtaaacgaaaaccgccccttctctcccgctccgaaacgcaaactcctccgaatacccgcccgtacctttaactcctcaaaacgacgacaacgcaaaataacgaacgaataaacccatctcccaacaacgacgacaacaacctaaaaaaacgcgaaaaaaaatccctccgatacgccgaaacgcctctcaaccgaaacgaaaacgacgaaaaaaaaaaatcccgacgaccgctttcccgaactcctcctccgcaattataactcgacgactactcccgaaaaccaacgccgcaactaccacctccccctcccccaacccccgctttcccctcctcctcctcccacttcttcctcccgcccccgaccgccccgccccaacgcgccgcccgcgtactatacgtcataacgtcacccccaccaaacccgctacgaacgactctaaacacgactattcccttacgcaccctcgttccgcgcccgcgcaaaacccgccacgctacacccgaataacccccactaccgacccccacgcctaaactacaccaaaaataattcaaaaactaactaattattctttaccta

SEQ ID NO: 35345 - DNA, 665 bp, Artificial Sequence
  chemically treated genomic DNA (Homo sapiens) CpG-island No: 35345
tttttacgattcgtcgtcggagcggtcggttttcggagatcgtagtagagaggtttatacgttttttggttgtttcggttttagtggtcgttttttcgattttagttacgtagcgttaatcgtcgtagttatcgttattttaggattttattgtggtgggagaagaggggcgggggtattgtagagggggtaacgcgcggcgggatatgcgtcgttttttcggtaacggcgcgcgggggcgagaattcgtcggtgcggagagcgtaatgcgagttagattggagttatgtgattcgtcggagtttgtggtgtcgtttttggttttttaagtcgaaaagagattatattaacgaattcgtttttattcgtttaggaattatgtattttagaatgttaattagatttcgcgttttaaacgtttgtcggttataggtggaggattataaattttagtatgtcgtgcgttttcggcgttgatcgcggagttggaggttttaggcgtatgcggaagtgtattgattttttagttcgttgagatcgatcggaggagatgtgggtgtttcgagtgggcgtgttagttacggtcgtttcgtattaagtagttaagagtggaattagtgtgtcgatttggttattgatattgtgggtgatataaggtgtaataa

SEQ ID NO: 35346 - DNA, 665 bp, Artificial Sequence
  chemically treated genomic DNA (Homo sapiens) CpG-island No: 35346
ttattacaccttatatcacccacaatatcaataaccaaatcgacacactaattccactcttaactacttaatacgaaacgaccgtaactaacacgcccactcgaaacacccacatctcctccgatcgatctcaacgaactaaaaaatcaatacacttccgcatacgcctaaaacctccaactccgcgatcaacgccgaaaacgcacgacatactaaaatttataatcctccacctataaccgacaaacgtttaaaacgcgaaatctaattaacattctaaaatacataattcctaaacgaataaaaacgaattcgttaatataatctcttttcgacttaaaaaaccaaaaacgacaccacaaactccgacgaatcacataactccaatctaactcgcattacgctctccgcaccgacgaattctcgcccccgcgcgccgttaccgaaaaaacgacgcatatcccgccgcgcgttaccccctctacaatacccccgcccctcttctcccaccacaataaaatcctaaaataacgataactacgacgattaacgctacgtaactaaaatcgaaaaaacgaccactaaaaccgaaacaaccaaaaaacgtataaacctctctactacgatctccgaaaaccgaccgctccgacgacgaatcgtaaaaa

SEQ ID NO: 35347 - DNA, 665 bp, Artificial Sequence
  chemically treated genomic DNA (Homo sapiens) CpG-island No: 35347
ttgttgtattttatgttatttatagtgttagtagttaaatcgatatattagttttatttttggttatttaatacggagcggtcgtagttgatacgtttattcgaaatatttatatttttttcggtcgattttaacgggttgagggattaatgtattttcgtatacgtttagggtttttagtttcgcgattaacgtcggaagcgtacggtatgttgggatttgtagttttttatttgtggtcggtaggcgtttagaacgcgaggtttagttggtattttgggatatatagtttttgggcgggtgggggcggattcgttggtgtaattttttttcggtttaaagagttagaagcgatattatagatttcggcgggttatatgattttagtttagttcgtattgcgtttttcgtatcggcgagttttcgttttcgcgcgtcgttgtcgaggagacggcgtatgtttcgtcgcgcgttgttttttttgtagtattttcgtttttttttttttattataatgagattttaagatggcggtggttgcggcggttggcgttgcgtagttgaggtcgaaaaggcggttattggggtcgaggtagttaggaaacgtgtgggtttttttgttgcggttttcgagggtcgatcgtttcggcggcgggtcgtggggg

SEQ ID NO: 35348 - DNA, 665 bp, Artificial Sequence
  chemically treated genomic DNA (Homo sapiens) CpG-island No: 35348
cccccacgacccgccgccgaaacgatcgaccctcgaaaaccgcaacaaaaaaacccacacgtttcctaactacctcgaccccaataaccgccttttcgacctcaactacgcaacgccaaccgccgcaaccaccgccatcttaaaatctcattataataaaaaaaaaaaaacgaaaatactacaaaaaaaacaacgcgcgacgaaacatacgccgtctcctcgacaacgacgcgcgaaaacgaaaactcgccgatacgaaaaacgcaatacgaactaaactaaaatcatataacccgccgaaatctataatatcgcttctaactctttaaaccgaaaaaaaattacaccaacgaatccgcccccacccgcccaaaaactatatatcccaaaataccaactaaacctcgcgttctaaacgcctaccgaccacaaataaaaaactacaaatcccaacataccgtacgcttccgacgttaatcgcgaaactaaaaaccctaaacgtatacgaaaatacattaatccctcaacccgttaaaatcgaccgaaaaaaatataaatatttcgaataaacgtatcaactacgaccgctccgtattaaataaccaaaaataaaactaatatatcgatttaactactaacactataaataacataaaatacaacaa

SEQ ID NO: 35349 - DNA, 526 bp, Artificial Sequence
  chemically treated genomic DNA (Homo sapiens) CpG-island No: 35349
ggcgattggtaatatgtcgatggcggcggtatttattttggtgtcgattatttttatcgtattgtatttggcgttcgtgaaacgtttgggagcgttcgatgtattttgaacgcgtatcgtttttttttaaattggcggtttggggcggcgttgtttttttatatttttttattttgataatcgtcgtttatgcgtttaatattgaagatgcggcgtttagttttttatcgtagggtttgacgttgcgttggtttagcgtggtagtatagcgtagtgatatttttgatgtcgtgatattgttatttaaagtggcggcgttggcgatattaattgcgttggtgttagggacgttggtagttgtcgcgttgtggcgacgagattttttcggtaaaaacgttatttcgttgttattgttgttgtttattgcgttgtcgggtattgttattggtttggcgttattaatcgtttttaaaattattaatttggagtcgggattttttattatcgtggtcggttatgcgatttt

SEQ ID NO: 35350 - DNA, 526 bp, Artificial Sequence
  chemically treated genomic DNA (Homo sapiens) CpG-island No: 35350
aaaatcgcataaccgaccacgataataaaaaatcccgactccaaattaataattttaaaaacgattaataacgccaaaccaataacaatacccgacaacgcaataaacaacaacaataacaacgaaataacgtttttaccgaaaaaatctcgtcgccacaacgcgacaactaccaacgtccctaacaccaacgcaattaatatcgccaacgccgccactttaaataacaatatcacgacatcaaaaatatcactacgctatactaccacgctaaaccaacgcaacgtcaaaccctacgataaaaaactaaacgccgcatcttcaatattaaacgcataaacgacgattatcaaaataaaaaaatataaaaaaacaacgccgccccaaaccgccaatttaaaaaaaaacgatacgcgttcaaaatacatcgaacgctcccaaacgtttcacgaacgccaaatacaatacgataaaaataatcgacaccaaaataaataccgccgccatcgacatattaccaatcgcc

SEQ ID NO: 35351 - DNA, 526 bp, Artificial Sequence
  chemically treated genomic DNA (Homo sapiens) CpG-island No: 35351
aaagtcgtatgatcgattacgatggtgaaaaatttcggttttagattgatggttttaaaggcggttaataacgttagattagtgataatgttcggtagcgtaatgggtagtagtagtaatagcgaaatggcgtttttgtcgaaaaagtttcgtcgttatagcgcggtagttgttagcgtttttaatattagcgtaattaatgtcgttagcgtcgttattttaagtgatagtgttacggtattaagaatattattacgttgtgttgttacgttaaattagcgtagcgttaggttttgcggtggaaaattaaacgtcgtatttttagtgttaaacgtataggcggcgattattaggatgggaaaatgtaggaaaataacgtcgttttaggtcgttagtttgaggaaaaacggtgcgcgtttagagtgtatcgaacgtttttagacgttttacgaacgttaggtatagtgcgatgagaataatcggtattagggtgaatgtcgtcgttatcggtatattgttaatcgtt

SEQ ID NO: 35352 - DNA, 526 bp, Artificial Sequence
  chemically treated genomic DNA (Homo sapiens) CpG-island No: 35352
aacgattaacaatataccgataacgacgacattcaccctaataccgattattctcatcgcactatacctaacgttcgtaaaacgtctaaaaacgttcgatacactctaaacgcgcaccgtttttcctcaaactaacgacctaaaacgacgttattttcctacattttcccatcctaataatcgccgcctatacgtttaacactaaaaatacgacgtttaattttccaccgcaaaacctaacgctacgctaatttaacgtaacaacacaacgtaataatattcttaataccgtaacactatcacttaaaataacgacgctaacgacattaattacgctaatattaaaaacgctaacaactaccgcgctataacgacgaaactttttcgacaaaaacgccatttcgctattactactactacccattacgctaccgaacattatcactaatctaacgttattaaccgcctttaaaaccatcaatctaaaaccgaaatttttcaccatcgtaatcgatcatacgacttt

SEQ ID NO: 35353 - DNA, 501 bp, Artificial Sequence
  chemically treated genomic DNA (Homo sapiens) CpG-island No: 35353
tgcgtatcgtgttgatgaatttttattatttggttgtaattttagtattaagtttgggcgggtttatagacgatatgtaaatcgtatttttgcgttatcgtttcgtggtagataattttaaaattaaaataggacggcgttttttttaacgtaggagagcgcgttaatttttagttatacggcggtgacgcgtttaatatcgatgttgtttcgtttgtcgttggataattttaacggcgttttggtaaagagataatttatgtattttcgttatttttgcgattaaatagtagggcgcgacgttttgcgtgtggtatattcggattcgtgattgtagcgaaaggattattcgtgcgtagttattcgttaggcgttggttttttttaatcgatatgttgtgcgaaagcggcgatattagcgaataggagagatattgcgaaatatcgtttagttcgttaacggtaaaggttatagtgttatacggtagttgtagattaattt

SEQ ID NO: 35354 - DNA, 501 bp, Artificial Sequence
  chemically treated genomic DNA (Homo sapiens) CpG-island No: 35354
aaattaatctacaactaccgtataacactataacctttaccgttaacgaactaaacgatatttcgcaatatctctcctattcgctaatatcgccgctttcgcacaacatatcgattaaaaaaaaccaacgcctaacgaataactacgcacgaataatcctttcgctacaatcacgaatccgaatataccacacgcaaaacgtcgcgccctactatttaatcgcaaaaataacgaaaatacataaattatctctttaccaaaacgccgttaaaattatccaacgacaaacgaaacaacatcgatattaaacgcgtcaccgccgtataactaaaaattaacgcgctctcctacgttaaaaaaaacgccgtcctattttaattttaaaattatctaccacgaaacgataacgcaaaaatacgatttacatatcgtctataaacccgcccaaacttaatactaaaattacaaccaaataataaaaattcatcaacacgatacgca

SEQ ID NO: 35355 - DNA, 501 bp, Artificial Sequence
  chemically treated genomic DNA (Homo sapiens) CpG-island No: 35355
aaattggtttgtaattgtcgtatggtattatgatttttatcgttggcgaattggacggtgtttcgtaatattttttttgttcgttgatgtcgtcgttttcgtatagtatgtcgattgaagagggttaacgtttgacggatgattgcgtacgaatgattttttcgttgtagttacgaattcggatgtattatacgtagggcgtcgcgttttgttgtttggtcgtaggagtggcgaaaatgtatgagttgtttttttgttagagcgtcgttgaaattatttaacggtaggcggagtagtatcgatgttaagcgcgttatcgtcgtgtggttggaaattggcgcgtttttttgcgttgaggagagcgtcgttttgttttagttttgaaattgtttgttacggaacggtggcgtaagggtgcgatttatatatcgtttataaattcgtttaggtttggtgttgggattgtagttaggtggtggagatttattagtacgatgcgta

SEQ ID NO: 35356 - DNA, 501 bp, Artificial Sequence
  chemically treated genomic DNA (Homo sapiens) CpG-island No: 35356
tacgcatcgtactaataaatctccaccacctaactacaatcccaacaccaaacctaaacgaatttataaacgatatataaatcgcacccttacgccaccgttccgtaacaaacaatttcaaaactaaaacaaaacgacgctctcctcaacgcaaaaaaacgcgccaatttccaaccacacgacgataacgcgcttaacatcgatactactccgcctaccgttaaataatttcaacgacgctctaacaaaaaaacaactcatacattttcgccactcctacgaccaaacaacaaaacgcgacgccctacgtataatacatccgaattcgtaactacaacgaaaaaatcattcgtacgcaatcatccgtcaaacgttaaccctcttcaatcgacatactatacgaaaacgacgacatcaacgaacaaaaaaaatattacgaaacaccgtccaattcgccaacgataaaaatcataataccatacgacaattacaaaccaattt

SEQ ID NO: 35357 - DNA, 812 bp, Artificial Sequence
  chemically treated genomic DNA (Homo sapiens) CpG-island No: 35357
agtcggatgaagtgtataatttgggcgtaatgagttacgttgcggttttttttgagttattagaatatatcgttgacgtcgacgcgatgggtacgttgcgtttgttggaggcgattcgttttttcggtttggaaaagaaaattcgtttttattaggtttttatttttgaattgtatggtttggtgtaggaaatttcgtagaaagagattacgtcgttttattcgcgattttcgtatgcggtcgttaaattgtacgtttattggattatcgttaattatcgtgaattttacggtatgtacgtttgtaacggaattttttttaattatgaattttcgcgtcgcggcgaaattttcgttattcgtaaaattattcgcgtaatcgttaatatcgtttaggggttggagtcgtgtttgtatttcggtaatatggattttttgcgtgattggggttacgttaaagattacgtaaaaatgtagtggatgatgttgtagtaggaatagtcggaagatttcgttatcgcgatcggcgtttagtatttcgtgcgttagttcgtggaaatggcggtagtatagttgggtattaaattgcgttttgaaggtacgggcgttgaagagaagggtattgtggttttcgttatcgggtatgacgcgtcgggcgttaaatcgggtgatgtgattatcgttgttgattcgcgttattttcgttcggttgaagttgaaacgttgttcggcgattcgattaaagcgtacgaaaaattgggttggaaatcggaaattatttttagagagatggtgtttgaaatggtggttaat

SEQ ID NO: 35358 - DNA, 812 bp, Artificial Sequence
  chemically treated genomic DNA (Homo sapiens) CpG-island No: 35358
attaaccaccatttcaaacaccatctctctaaaaataatttccgatttccaacccaatttttcgtacgctttaatcgaatcgccgaacaacgtttcaacttcaaccgaacgaaaataacgcgaatcaacaacgataatcacatcacccgatttaacgcccgacgcgtcatacccgataacgaaaaccacaatacccttctcttcaacgcccgtaccttcaaaacgcaatttaatacccaactatactaccgccatttccacgaactaacgcacgaaatactaaacgccgatcgcgataacgaaatcttccgactattcctactacaacatcatccactacatttttacgtaatctttaacgtaaccccaatcacgcaaaaaatccatattaccgaaatacaaacacgactccaacccctaaacgatattaacgattacgcgaataattttacgaataacgaaaatttcgccgcgacgcgaaaattcataattaaaaaaaattccgttacaaacgtacataccgtaaaattcacgataattaacgataatccaataaacgtacaatttaacgaccgcatacgaaaatcgcgaataaaacgacgtaatctctttctacgaaatttcctacaccaaaccatacaattcaaaaataaaaacctaataaaaacgaattttcttttccaaaccgaaaaaacgaatcgcctccaacaaacgcaacgtacccatcgcgtcgacgtcaacgatatattctaataactcaaaaaaaaccgcaacgtaactcattacgcccaaattatacacttcatccgact

SEQ ID NO: 35359 - DNA, 812 bp, Artificial Sequence
  chemically treated genomic DNA (Homo sapiens) CpG-island No: 35359
attagttattattttagatattatttttttgagggtgattttcggtttttagtttagtttttcgtgcgttttggtcgggtcgtcgagtagcgttttaattttagtcggacggaagtaacgcgggttaatagcgataattatattattcggtttaacgttcggcgcgttatgttcggtgacggaaattataatgtttttttttttaacgttcgtgtttttaaagcgtagtttgatgtttagttgtgttgtcgttatttttacgaattgacgtacggagtattgaacgtcggtcgcgataacgaaatttttcggttgtttttgttgtagtattatttattgtatttttacgtagtttttggcgtggttttagttacgtagggaatttatattgtcgaggtataggtacgattttagtttttgggcgatgttggcgattgcgcgggtgattttgcgggtaacgaaggtttcgtcgcggcgcggggatttatggttgaagagaatttcgttataggcgtatatgtcgtaggatttacggtagttaacggtgatttagtaggcgtatagtttggcgatcgtatacggagatcgcgggtagaacggcgtggtttttttttgcggaattttttgtattagattatatagtttagaggtggaagtttgatagaaacgagtttttttttttagatcgaggaagcggatcgtttttagtaggcgtagcgtatttatcgcgtcgacgttagcggtatattttggtgatttaaaagagatcgtaacgtggtttattgcgtttaggttgtatattttattcggtt

SEQ ID NO: 35360 - DNA, 812 bp, Artificial Sequence
  chemically treated genomic DNA (Homo sapiens) CpG-island No: 35360
aaccgaataaaatatacaacctaaacgcaataaaccacgttacgatctcttttaaatcaccaaaatataccgctaacgtcgacgcgataaatacgctacgcctactaaaaacgatccgcttcctcgatctaaaaaaaaaaactcgtttctatcaaacttccacctctaaactatataatctaatacaaaaaattccgcaaaaaaaaaccacgccgttctacccgcgatctccgtatacgatcgccaaactatacgcctactaaatcaccgttaactaccgtaaatcctacgacatatacgcctataacgaaattctcttcaaccataaatccccgcgccgcgacgaaaccttcgttacccgcaaaatcacccgcgcaatcgccaacatcgcccaaaaactaaaatcgtacctatacctcgacaatataaattccctacgtaactaaaaccacgccaaaaactacgtaaaaatacaataaataatactacaacaaaaacaaccgaaaaatttcgttatcgcgaccgacgttcaatactccgtacgtcaattcgtaaaaataacgacaacacaactaaacatcaaactacgctttaaaaacacgaacgttaaaaaaaaaaacattataatttccgtcaccgaacataacgcgccgaacgttaaaccgaataatataattatcgctattaacccgcgttacttccgtccgactaaaattaaaacgctactcgacgacccgaccaaaacgcacgaaaaactaaactaaaaaccgaaaatcaccctcaaaaaaataatatctaaaataataactaat

SEQ ID NO: 35361 - DNA, 639 bp, Artificial Sequence
  chemically treated genomic DNA (Homo sapiens) CpG-island No: 35361
ggcggcggtgttgagtcgggaatcgcgcgtttattcgtttagtcggacggtttcggcgcgggtgggtgagatattgggaatagcggttagttgtagagggttcgaggtcgggcgcgcgggagcggggcgcgtcgaacgcgcgcgtgcgcggttcgtgtgtgggtttgcgggggcgtgcgcggttggggggtagtgagggtcgtcgcggcggcgcgtagtacggcgggaatatggcgcgcggaatcggcgtacgcgtttagttggtgggatcgttagttcgaggcggacgcggttcggatttcgtggatatggagtagtggtcgtcgtcggcgttcgagtcggtttaagggtcgattttcgtaaggagttgaaggcggcgggagatcgagtcggcgtcggtgagtgcgtgagggattcgggtcgggagattttttttgttaaatttcggcggtgggagtcgggtcgggttttagcgattgaggagcgtttgcgaggcggagggtgtttcgtagttcgggttcgattttagtcgcgagtcgttaggcgataggatatggtcggtcgtttgtttgttttagttttcgcgagagtgtgtgtgggtgtgtgtgggtgtgtatgggtgttggtttgtatatatcg

SEQ ID NO: 35362 - DNA, 639 bp, Artificial Sequence
  chemically treated genomic DNA (Homo sapiens) CpG-island No: 35362
cgatatatacaaaccaacacccatacacacccacacacacccacacacactctcgcgaaaactaaaacaaacaaacgaccgaccatatcctatcgcctaacgactcgcgactaaaatcgaacccgaactacgaaacaccctccgcctcgcaaacgctcctcaatcgctaaaacccgacccgactcccaccgccgaaatttaacaaaaaaaatctcccgacccgaatccctcacgcactcaccgacgccgactcgatctcccgccgccttcaactccttacgaaaatcgacccttaaaccgactcgaacgccgacgacgaccactactccatatccacgaaatccgaaccgcgtccgcctcgaactaacgatcccaccaactaaacgcgtacgccgattccgcgcgccatattcccgccgtactacgcgccgccgcgacgaccctcactaccccccaaccgcgcacgcccccgcaaacccacacacgaaccgcgcacgcgcgcgttcgacgcgccccgctcccgcgcgcccgacctcgaaccctctacaactaaccgctattcccaatatctcacccacccgcgccgaaaccgtccgactaaacgaataaacgcgcgattcccgactcaacaccgccgcc

SEQ ID NO: 35363 - DNA, 639 bp, Artificial Sequence
  chemically treated genomic DNA (Homo sapiens) CpG-island No: 35363
cggtgtgtgtaggttaatatttatatatatttatatatatttatatatattttcgcggaaattgaggtaggtaggcggtcgattatgttttgtcgtttgacggttcgcggttgggatcgaattcggattgcgagatatttttcgtttcgtaggcgttttttagtcgttgaggttcggttcggtttttatcgtcggagtttgataaagaaagtttttcggttcgagttttttacgtatttatcggcgtcgattcggtttttcgtcgtttttagttttttgcgggggtcggtttttgggtcggttcgggcgtcggcggcggttattgttttatatttacggggttcgggtcgcgttcgtttcgagttaacggttttattagttaggcgcgtgcgtcggtttcgcgcgttatgttttcgtcgtgttgcgcgtcgtcgcggcgatttttattgttttttaatcgcgtacgttttcgtaggtttatatacgaatcgcgtacgcgcgcgttcgacgcgtttcgttttcgcgcgttcggtttcgggttttttgtagttggtcgttgtttttagtgttttatttattcgcgtcggaatcgttcgattgggcgggtgagcgcgcggttttcgatttagtatcgtcgtt

SEQ ID NO: 35364 - DNA, 639 bp, Artificial Sequence
  chemically treated genomic DNA (Homo sapiens) CpG-island No: 35364
aacgacgatactaaatcgaaaaccgcgcgctcacccgcccaatcgaacgattccgacgcgaataaataaaacactaaaaacaacgaccaactacaaaaaacccgaaaccgaacgcgcgaaaacgaaacgcgtcgaacgcgcgcgtacgcgattcgtatataaacctacgaaaacgtacgcgattaaaaaacaataaaaatcgccgcgacgacgcgcaacacgacgaaaacataacgcgcgaaaccgacgcacgcgcctaactaataaaaccgttaactcgaaacgaacgcgacccgaaccccgtaaatataaaacaataaccgccgccgacgcccgaaccgacccaaaaaccgacccccgcaaaaaactaaaaacgacgaaaaaccgaatcgacgccgataaatacgtaaaaaactcgaaccgaaaaactttctttatcaaactccgacgataaaaaccgaaccgaacctcaacgactaaaaaacgcctacgaaacgaaaaatatctcgcaatccgaattcgatcccaaccgcgaaccgtcaaacgacaaaacataatcgaccgcctacctacctcaatttccgcgaaaatatatataaatatatataaatatatataaatattaacctacacacaccg

SEQ ID NO: 35365 - DNA, 757 bp, Artificial Sequence
  chemically treated genomic DNA (Homo sapiens) CpG-island No: 35365
  misc_feature (754)..(754): n is either a, c, g or t
cgtaagagttttcgttcgacgagtaggatgagatcggcgagtcggttatggagtttaagtcgttggagtagttgggggagatggtgggcgataggacgtttgtttggaaggcggcgtttatcgcgttatgttcgtttagtagttgttgtagcgcgcggatgtattcgatcgtcgagcgtagtgtttttattttatttatttttttgttggtcgcgtcgttggggacgtgttttcgaagggtggtaaagtttaggttgattaatttgacgcggttgcgttcgcgttcgttgcggcgcgttacggcggtcggttgttgttgcggtaggttgtagttaaagtcgttgaagttgagtcggcgtttgtagcgtattagttcgggcgaagacgagcgttgtcgtttgatttgtttgggcgttgatttgtgatcgttttttgagggttggtcgtcggtcgtcggttttagttgcggcgtttgttgttgttgttgttgttgttgttgttgttgttgcgcgttttgcgttgtcgttgcggcggttgcggtcgtcgcggttgcggtcgtggtaaagaaataggttgcgggcggtaggaagggttgttggggttgcggttggggttgttggtcggcgtcgtcgttttttattttggtagagttttttatgcgtagcggcggttaaggagtcgcggaattagagcgattcgggacgcgaggtgcggggttcgcgagggggatatagagagaatttgggtgcggtanata

SEQ ID NO: 35366 - DNA, 757 bp, Artificial Sequence
  chemically treated genomic DNA (Homo sapiens) CpG-island No: 35366
  misc_feature (4)..(4): n is either a, c, g or t
tatntaccgcacccaaattctctctatatccccctcgcgaaccccgcacctcgcgtcccgaatcgctctaattccgcgactccttaaccgccgctacgcataaaaaactctaccaaaataaaaaacgacgacgccgaccaacaaccccaaccgcaaccccaacaacccttcctaccgcccgcaacctatttctttaccacgaccgcaaccgcgacgaccgcaaccgccgcaacgacaacgcaaaacgcgcaacaacaacaacaacaacaacaacaacaacaacaaacgccgcaactaaaaccgacgaccgacgaccaaccctcaaaaaacgatcacaaatcaacgcccaaacaaatcaaacgacaacgctcgtcttcgcccgaactaatacgctacaaacgccgactcaacttcaacgactttaactacaacctaccgcaacaacaaccgaccgccgtaacgcgccgcaacgaacgcgaacgcaaccgcgtcaaattaatcaacctaaactttaccacccttcgaaaacacgtccccaacgacgcgaccaacaaaaaaataaataaaataaaaacactacgctcgacgatcgaatacatccgcgcgctacaacaactactaaacgaacataacgcgataaacgccgccttccaaacaaacgtcctatcgcccaccatctcccccaactactccaacgacttaaactccataaccgactcgccgatctcatcctactcgtcgaacgaaaactcttacg

SEQ ID NO: 35367 - DNA, 757 bp, Artificial Sequence
  chemically treated genomic DNA (Homo sapiens) CpG-island No: 35367
  misc_feature (4)..(4): n is either a, c, g or t
tgtntatcgtatttaagttttttttgtgtttttttcgcgggtttcgtatttcgcgtttcggatcgttttgatttcgcgattttttggtcgtcgttgcgtatggaaagttttgttaagatggagagcggcggcgtcggttagtagttttagtcgtagttttagtagttttttttgtcgttcgtagtttgtttttttgttacggtcgtagtcgcggcggtcgtagtcgtcgtagcggtagcgtagagcgcgtagtagtagtagtagtagtagtagtagtagtagtaggcgtcgtagttgagatcggcggtcgacggttagtttttagggggcggttataagttagcgtttaagtaagttaagcgatagcgttcgttttcgttcgaattgatgcgttgtaaacgtcggtttaattttagcggttttggttatagtttgtcgtagtagtagtcggtcgtcgtggcgcgtcgtaacgagcgcgagcgtaatcgcgttaagttggttaatttgggttttgttatttttcgggagtacgtttttaacggcgcggttaataagaagatgagtaaggtggagatattgcgttcggcggtcgagtatattcgcgcgttgtagtagttgttggacgagtatgacgcggtgagcgtcgttttttaggtaggcgttttgtcgtttattattttttttaattattttaacgatttgaattttatggtcggttcgtcggttttattttattcgtcggacgagggtttttacg

SEQ ID NO: 35368 - DNA, 757 bp, Artificial Sequence
  chemically treated genomic DNA (Homo sapiens) CpG-island No: 35368
  misc_feature (754)..(754): n is either a, c, g or t
cgtaaaaaccctcgtccgacgaataaaataaaaccgacgaaccgaccataaaattcaaatcgttaaaataattaaaaaaaataataaacgacaaaacgcctacctaaaaaacgacgctcaccgcgtcatactcgtccaacaactactacaacgcgcgaatatactcgaccgccgaacgcaatatctccaccttactcatcttcttattaaccgcgccgttaaaaacgtactcccgaaaaataacaaaacccaaattaaccaacttaacgcgattacgctcgcgctcgttacgacgcgccacgacgaccgactactactacgacaaactataaccaaaaccgctaaaattaaaccgacgtttacaacgcatcaattcgaacgaaaacgaacgctatcgcttaacttacttaaacgctaacttataaccgccccctaaaaactaaccgtcgaccgccgatctcaactacgacgcctactactactactactactactactactactactacgcgctctacgctaccgctacgacgactacgaccgccgcgactacgaccgtaacaaaaaaacaaactacgaacgacaaaaaaaactactaaaactacgactaaaactactaaccgacgccgccgctctccatcttaacaaaactttccatacgcaacgacgaccaaaaaatcgcgaaatcaaaacgatccgaaacgcgaaatacgaaacccgcgaaaaaaacacaaaaaaaacttaaatacgatanaca

SEQ ID NO: 35369 - DNA, 514 bp, Artificial Sequence
  chemically treated genomic DNA (Homo sapiens) CpG-island No: 35369
ttttttttttttttttttattttttttttttttttgtttttttatttttttttttttttttcgttttttttttttacgttttttttcgttttcggtaatttttttattttgtttattttcgtttatttttttgtttttgttttttttttttttgcgttttgtcggtgtttttttttttttagtttttatcgcgtatttttgtttcgtttattacgaatttcgtagcgtattcgtttttttattttagagtatttattttcgttatttttttttagttttttattttttagtttttcgagtttcgtttttgttcgtttttttttcgttttttttttttcgatttttttttttttcgttttttttttttttttttttcgttttttcgtattttcgttttatatatttcgatttttattcgttttcgtttttttatttttttcgttttttcgtttcgcgttatttcgtttattttttcgcgatatgcgttgtcgttgtttttttttatttaatcgtt

SEQ ID NO: 35370 - DNA, 514 bp, Artificial Sequence
  chemically treated genomic DNA (Homo sapiens) CpG-island No: 35370
aacgattaaataaaaaaaaacaacgacaacgcatatcgcgaaaaaataaacgaaataacgcgaaacgaaaaaacgaaaaaaataaaaaaacgaaaacgaataaaaatcgaaatatataaaacgaaaatacgaaaaaacgaaaaaaaaaaaaaaaaaaaacgaaaaaaaaaaaaatcgaaaaaaaaaaaacgaaaaaaaaacgaacaaaaacgaaactcgaaaaactaaaaaataaaaaactaaaaaaaaataacgaaaataaatactctaaaataaaaaaacgaatacgctacgaaattcgtaataaacgaaacaaaaatacgcgataaaaactaaaaaaaaaaaaacaccgacaaaacgcaaaaaaaaaaaaaacaaaaacaaaaaaataaacgaaaataaacaaaataaaaaaattaccgaaaacgaaaaaaaacgtaaaaaaaaaaaacgaaaaaaaaaaaaaaaaataaaaaaacaaaaaaaaaaaaaaaataaaaaaaaaaaaaaaaaa

SEQ ID NO: 35371 - DNA, 514 bp, Artificial Sequence
  chemically treated genomic DNA (Homo sapiens) CpG-island No: 35371
ggcgattaaataaaaaagggtaacggtagcgtatatcgcggaaaagtgggcgaaatggcgcgaggcgggggggcgggggaaatgagaaagcgggggcgggtgggaatcggggtatatgaaacggagatgcgggggggcgggaaaaaaaggggaagagagcgggggaaaaaagaatcggggggagaaagacggggggaaaacgggtaagggcgaagttcggaggattggaggatggggaattaagaaaagatggcgggaatggatgttttagaatgggggaacggatgcgttacggaattcgtgatgaacggggtaggggtacgcgatggggattgagagaaaagaagtatcggtaggacgtagagggagaagaggtaagagtagggggataggcgggggtggataggatggggagattatcgggggcgggggggagcgtgggggaagggggcgaaggggaaagggggggataaggaagtaggaagggagagaaggtagggggaagggagggggg

SEQ ID NO: 35372 - DNA, 514 bp, Artificial Sequence
  chemically treated genomic DNA (Homo sapiens) CpG-island No: 35372
cccccctcccttccccctaccttctctcccttcctacttccttatccccccctttccccttcgcccccttcccccacgctcccccccgcccccgataatctccccatcctatccacccccgcctatccccctactcttacctcttctccctctacgtcctaccgatacttcttttctctcaatccccatcgcgtacccctaccccgttcatcacgaattccgtaacgcatccgttcccccattctaaaacatccattcccgccatcttttcttaattccccatcctccaatcctccgaacttcgcccttacccgttttccccccgtctttctccccccgattcttttttcccccgctctcttcccctttttttcccgcccccccgcatctccgtttcatataccccgattcccacccgcccccgctttctcatttcccccgcccccccgcctcgcgccatttcgcccacttttccgcgatatacgctaccgttacccttttttatttaatcgcc

SEQ ID NO: 35373 - DNA, 686 bp, Artificial Sequence
  chemically treated genomic DNA (Homo sapiens) CpG-island No: 35373
tatcgaaacgagcgggacgcgtaggcgatttttttgtagtcggttgaaggcggggaacgtgttttaggcgaggaattcgtcgttttcgggttcgagtagggttacgagtagtatttggtgttggaagcgtacggtcggttgtttttcgtagttgtttcgttttagttaaaattttgagttaaagagggcggtagggaggcggttagggaggtcggttttggtcgagcgcgttcggggagtttcgtggtatagcggtcggggtaggtttatcgtggtttcggaaggttattagtagcggcgggatgtacgtgagcgtagcggttagtagtaggaatagcgcggttttggagtagagtttcgcgcggtaattgcgttcgatcgggtgagagaagagtttatagagcgttatgagtatcgttcgtaggtatttcgcgagtcgggggattaagtttggttttttttggttgttatcgtttcggtttttacggtaatcgacggtttatagaaaggagttaatagtaaggtcgtatcgaaaggagttagtggcgggggcggggttagcgggcgtggcgttgtcggggacggtcggtttagtttttcgagttgtgtacgtttgcgtaaaggttgggcggcgatagaacgttttcgtggattagagtcgtggttgttgtttgtgttaatatttg

SEQ ID NO: 35374 - DNA, 686 bp, Artificial Sequence
  chemically treated genomic DNA (Homo sapiens) CpG-island No: 35374
caaatattaacacaaacaacaaccacgactctaatccacgaaaacgttctatcgccgcccaacctttacgcaaacgtacacaactcgaaaaactaaaccgaccgtccccgacaacgccacgcccgctaaccccgcccccgccactaactcctttcgatacgaccttactattaactcctttctataaaccgtcgattaccgtaaaaaccgaaacgataacaaccaaaaaaaaccaaacttaatcccccgactcgcgaaatacctacgaacgatactcataacgctctataaactcttctctcacccgatcgaacgcaattaccgcgcgaaactctactccaaaaccgcgctattcctactactaaccgctacgctcacgtacatcccgccgctactaataaccttccgaaaccacgataaacctaccccgaccgctataccacgaaactccccgaacgcgctcgaccaaaaccgacctccctaaccgcctccctaccgccctctttaactcaaaattttaactaaaacgaaacaactacgaaaaacaaccgaccgtacgcttccaacaccaaatactactcgtaaccctactcgaacccgaaaacgacgaattcctcgcctaaaacacgttccccgccttcaaccgactacaaaaaaatcgcctacgcgtcccgctcgtttcgata

SEQ ID NO: 35375 - DNA, 686 bp, Artificial Sequence
  chemically treated genomic DNA (Homo sapiens) CpG-island No: 35375
taaatgttaatatagataatagttacgattttggtttacggaaacgttttatcgtcgtttagtttttacgtaaacgtatatagttcgaaaagttaggtcgatcgttttcggtagcgttacgttcgttaatttcgttttcgttattggtttttttcggtgcggttttgttattggtttttttttgtgagtcgtcggttgtcgtggagatcgaggcgatggtaattaggagaagttaaatttggtttttcggttcgcggagtgtttgcgagcggtgtttatggcgttttatgagttttttttttattcggtcgagcgtagttatcgcgcggggttttgttttaaagtcgcgttgtttttgttgttggtcgttgcgtttacgtatatttcgtcgttgttggtggtttttcggagttacggtgagtttgtttcggtcgttgtgttacgaggtttttcgggcgcgttcggttagggtcggtttttttaatcgtttttttatcgttttttttaatttagggttttggttgaagcggagtagttacgaggagtagtcgatcgtgcgtttttaatattaggtgttgttcgtggttttgttcggattcgaaagcgacgggtttttcgtttggagtacgtttttcgtttttaatcggttgtaaggggatcgtttgcgcgtttcgttcgtttcggtg

SEQ ID NO: 35376 - DNA, 686 bp, Artificial Sequence
  chemically treated genomic DNA (Homo sapiens) CpG-island No: 35376
caccgaaacgaacgaaacgcgcaaacgatccccttacaaccgattaaaaacgaaaaacgtactccaaacgaaaaacccgtcgctttcgaatccgaacaaaaccacgaacaacacctaatattaaaaacgcacgatcgactactcctcgtaactactccgcttcaaccaaaaccctaaattaaaaaaaacgataaaaaaacgattaaaaaaaccgaccctaaccgaacgcgcccgaaaaacctcgtaacacaacgaccgaaacaaactcaccgtaactccgaaaaaccaccaacaacgacgaaatatacgtaaacgcaacgaccaacaacaaaaacaacgcgactttaaaacaaaaccccgcgcgataactacgctcgaccgaataaaaaaaaaactcataaaacgccataaacaccgctcgcaaacactccgcgaaccgaaaaaccaaatttaacttctcctaattaccatcgcctcgatctccacgacaaccgacgactcacaaaaaaaaaccaataacaaaaccgcaccgaaaaaaaccaataacgaaaacgaaattaacgaacgtaacgctaccgaaaacgatcgacctaacttttcgaactatatacgtttacgtaaaaactaaacgacgataaaacgtttccgtaaaccaaaatcgtaactattatctatattaacattta

SEQ ID NO: 35377 - DNA, 1104 bp, Artificial Sequence
  chemically treated genomic DNA (Homo sapiens) CpG-island No: 35377
gcgtgagcgagtttttttttatcgttttttataaggcgttatcggtgacggagttgggcgagcgggtatttttttttacgtaggtaaggatggttacgtcgttcgtattcgtgaaggcgattcgttcggcgtgtcgttgcggtttcggtttcgcggcgttttcggttagggtttcgggttttgttttcgagtcggtgttcgtcgtcgaggcggggtttagtcgataggtttttagttttagtttttcgttgcgttttacgtagtttaggatgtattgcgtggagatgaaattattcgaggtttcggttagcgttttttcgggttgggttagtagtacggtttcgggtttttgtattcggtatacggtgtcgtcgtcgtgtaggatgagcgtcgatagtcgacgtttggtcgggttgggtcgtacgtagaaggatatggagttgtcgtcgttttttacgaatagagtcgaggaatgggtgggttcgttggggtttttgtttaaatttatcgttttcgttatgtttgacgtcgagtattattagaagagttattttttcgcgagcgtttggtatatagagtttaattgattgagttgttatcgtagacgtttttgtcgcgaagcgtagtattgggtttgcgtagtagtagtcgcggcgtatcgagagtgttcgttttttttttttcggaagaggtggggtttcgtattttgatttggaaattaacgtattattttttttatttttgggtcgggtttttcgggaagatggcggtcgtgtaggcggtcgaggtgaaagtggatggtagcgagtcgaaattgagtaagaagtgagtgtcgttgcgagtttttaaagtttttgcggtaggagagtttgggttgggaagcgtcgcgaggtttttattaaggttgttgtgtcggggtttttttgtcggttttcgtgggtacgtatatgttgagacgtggtggttgcgttttgtagattacgtatttcgggatatttcgggtacgttcggtttttcgtttttagttggtatcggcgggatgttttttattatatttttagagttaagagattgtggaggaggaattaggacgagaattaagag

SEQ ID NO: 35378 - DNA, 1104 bp, Artificial Sequence
  chemically treated genomic DNA (Homo sapiens) CpG-island No: 35378
ctcttaattctcgtcctaattcctcctccacaatctcttaactctaaaaatataataaaaaacatcccgccgataccaactaaaaacgaaaaaccgaacgtacccgaaatatcccgaaatacgtaatctacaaaacgcaaccaccacgtctcaacatatacgtacccacgaaaaccgacaaaaaaaccccgacacaacaaccttaataaaaacctcgcgacgcttcccaacccaaactctcctaccgcaaaaactttaaaaactcgcaacgacactcacttcttactcaatttcgactcgctaccatccactttcacctcgaccgcctacacgaccgccatcttcccgaaaaacccgacccaaaaataaaaaaaataatacgttaatttccaaatcaaaatacgaaaccccacctcttccgaaaaaaaaaaaacgaacactctcgatacgccgcgactactactacgcaaacccaatactacgcttcgcgacaaaaacgtctacgataacaactcaatcaattaaactctatataccaaacgctcgcgaaaaaataactcttctaataatactcgacgtcaaacataacgaaaacgataaatttaaacaaaaaccccaacgaacccacccattcctcgactctattcgtaaaaaacgacgacaactccatatccttctacgtacgacccaacccgaccaaacgtcgactatcgacgctcatcctacacgacgacgacaccgtataccgaatacaaaaacccgaaaccgtactactaacccaacccgaaaaaacgctaaccgaaacctcgaataatttcatctccacgcaatacatcctaaactacgtaaaacgcaacgaaaaactaaaactaaaaacctatcgactaaaccccgcctcgacgacgaacaccgactcgaaaacaaaacccgaaaccctaaccgaaaacgccgcgaaaccgaaaccgcaacgacacgccgaacgaatcgccttcacgaatacgaacgacgtaaccatccttacctacgtaaaaaaaaatacccgctcgcccaactccgtcaccgataacgccttataaaaaacgataaaaaaaaactcgctcacgc

SEQ ID NO: 35379 - DNA, 1104 bp, Artificial Sequence
  chemically treated genomic DNA (Homo sapiens) CpG-island No: 35379
tttttagttttcgttttagttttttttttatagttttttaattttaggagtatgatagggagtatttcgtcggtgttagttgggaacggggagtcgggcgtgttcggggtatttcggggtacgtggtttgtagggcgtagttattacgttttagtatgtgcgtatttacgagagtcggtaagaaggtttcggtatagtagttttggtgggaatttcgcggcgttttttagtttagatttttttatcgtaaaggttttaaagattcgtagcgatatttattttttgtttagtttcggttcgttgttatttatttttatttcggtcgtttgtacggtcgttattttttcggagggttcgatttaaaagtaaggaggatagtacgttaatttttaggttaaggtgcgaagttttatttttttcgggggagagggggcgggtattttcgatgcgtcgcggttgttgttgcgtaggtttagtgttgcgtttcgcggtagaggcgtttgcggtgatagtttagttagttgagttttgtgtgttaggcgttcgcgagggggtagtttttttagtagtgttcggcgttagatatggcggaggcgatggatttgggtaaagattttaacgggtttatttatttttcgattttgttcgtgagggacgacggtagttttatgtttttttacgtgcggtttagttcggttaagcgtcggttgtcgacgtttattttgtacggcggcggtatcgtgtgtcgagtgtaggagttcggggtcgtgttgttggtttagttcggggaggcgttggtcgaggtttcgggtgattttatttttacgtagtatattttggattgcgtggagcgtaacgagaggttggagttggaggtttatcggttgggtttcgtttcggcggcggatatcggttcggaagtaaagttcggggttttggtcgagggcgtcgcggagtcggagtcgtagcggtacgtcgggcggatcgtttttacggatgcggacgacgtagttatttttatttacgtgaaggaaaatgttcgttcgtttagtttcgttatcggtaacgttttgtggaaagcgatggagaagagttcgtttacgt

SEQ ID NO: 35380 - DNA, 1104 bp, Artificial Sequence
  chemically treated genomic DNA (Homo sapiens) CpG-island No: 35380
acgtaaacgaactcttctccatcgctttccacaaaacgttaccgataacgaaactaaacgaacgaacattttccttcacgtaaataaaaataactacgtcgtccgcatccgtaaaaacgatccgcccgacgtaccgctacgactccgactccgcgacgccctcgaccaaaaccccgaactttacttccgaaccgatatccgccgccgaaacgaaacccaaccgataaacctccaactccaacctctcgttacgctccacgcaatccaaaatatactacgtaaaaataaaatcacccgaaacctcgaccaacgcctccccgaactaaaccaacaacacgaccccgaactcctacactcgacacacgataccgccgccgtacaaaataaacgtcgacaaccgacgcttaaccgaactaaaccgcacgtaaaaaaacataaaactaccgtcgtccctcacgaacaaaatcgaaaaataaataaacccgttaaaatctttacccaaatccatcgcctccgccatatctaacgccgaacactactaaaaaaactaccccctcgcgaacgcctaacacacaaaactcaactaactaaactatcaccgcaaacgcctctaccgcgaaacgcaacactaaacctacgcaacaacaaccgcgacgcatcgaaaatacccgccccctctcccccgaaaaaaataaaacttcgcaccttaacctaaaaattaacgtactatcctccttacttttaaatcgaaccctccgaaaaaataacgaccgtacaaacgaccgaaataaaaataaataacaacgaaccgaaactaaacaaaaaataaatatcgctacgaatctttaaaacctttacgataaaaaaatctaaactaaaaaacgccgcgaaattcccaccaaaactactataccgaaaccttcttaccgactctcgtaaatacgcacatactaaaacgtaataactacgccctacaaaccacgtaccccgaaataccccgaacacgcccgactccccgttcccaactaacaccgacgaaatactccctatcatactcctaaaattaaaaaactataaaaaaaaaactaaaacgaaaactaaaaa

SEQ ID NO: 35381 - DNA, 627 bp, Artificial Sequence
  chemically treated genomic DNA (Homo sapiens) CpG-island No: 35381
  misc_feature (121)..(121): n is either a, c, g or t
  misc_feature (545)..(546): n is either a, c, g or t
tacgatggttgcgttacggggttttggtttcgcgaattagttttatttatcgcggcgttgtttttggcgtttaagcgaggcggtaggttcgttaaagtagtagaatggggtagtcgacgantaagtcgcgggcgatgttgacgcgttgttgttcgttatcggaaaatgtcgatggtgttaggtgttataggcgtttcggtacgtttaggcgggtgagaagacgcgcggttttagcggcgtaggttttacgcggaacgtcggtatcgagtagcggttgtattattatttttagtgttgagatacgcgggatgacgcgtagaaattggtttatttagtcgacggtggttttgcggatttttattattttgcgcgttggcgcggtgattaggtttatttattcgttatcgtgtttgatttggatttgattttcgtcgggtagatagttggcgtatagcgagcgtagtagagttgatttgtcgttgtcggaatggtcgtggagtattacgtattcgttcgcgttgacggtgagcgaggcgcgattgagnngacgggtaaggtagtaacgtcgttttgttggtgtaggatgaaggttttattgacgttttgtacgttaattatttttcgttt

SEQ ID NO: 35382 - DNA, 627 bp, Artificial Sequence
  chemically treated genomic DNA (Homo sapiens) CpG-island No: 35382
  misc_feature (82)..(83): n is either a, c, g or t
  misc_feature (507)..(507): n is either a, c, g or t
aaacgaaaaataattaacgtacaaaacgtcaataaaaccttcatcctacaccaacaaaacgacgttactaccttacccgtcnnctcaatcgcgcctcgctcaccgtcaacgcgaacgaatacgtaatactccacgaccattccgacaacgacaaatcaactctactacgctcgctatacgccaactatctacccgacgaaaatcaaatccaaatcaaacacgataacgaataaataaacctaatcaccgcgccaacgcgcaaaataataaaaatccgcaaaaccaccgtcgactaaataaaccaatttctacgcgtcatcccgcgtatctcaacactaaaaataataatacaaccgctactcgataccgacgttccgcgtaaaacctacgccgctaaaaccgcgcgtcttctcacccgcctaaacgtaccgaaacgcctataacacctaacaccatcgacattttccgataacgaacaacaacgcgtcaacatcgcccgcgacttantcgtcgactaccccattctactactttaacgaacctaccgcctcgcttaaacgccaaaaacaacgccgcgataaataaaactaattcgcgaaaccaaaaccccgtaacgcaaccatcgta

SEQ ID NO: 35383 - DNA, 627 bp, Artificial Sequence
  chemically treated genomic DNA (Homo sapiens) CpG-island No: 35383
  misc_feature (82)..(83): n is either a, c, g or t
  misc_feature (507)..(507): n is either a, c, g or t
aggcgaaaaatgattaacgtataaaacgttagtaaaatttttattttgtattagtaaaacggcgttgttgttttgttcgttnntttaatcgcgtttcgtttatcgttaacgcgggcgaatgcgtggtgttttacggttatttcggtagcggtaaattaattttgttacgttcgttgtacgttaattatttgttcgacgaaggttaaatttagattaaatacggtgacgagtgggtagatttggttatcgcgttagcgcgtaaagtggtggaaattcgtaaaattatcgtcggttgggtgagttagtttttgcgcgttatttcgcgtattttagtattggaagtggtgatgtagtcgttgttcgatatcggcgtttcgcgtgaagtttgcgtcgttaaagtcgcgcgtttttttattcgtttgaacgtgtcggaacgtttgtggtatttggtattatcgatatttttcggtggcgaatagtagcgcgttaatatcgttcgcggtttantcgtcgattattttattttgttgttttgacgaatttatcgtttcgtttggacgttaaaaatagcgtcgcggtgggtggaattgattcgcgaagttaaaatttcgtggcgtagttatcgta

SEQ ID NO: 35384 - DNA, 627 bp, Artificial Sequence
  chemically treated genomic DNA (Homo sapiens) CpG-island No: 35384
  misc_feature (121)..(121): n is either a, c, g or t
  misc_feature (545)..(546): n is either a, c, g or t
tacgataactacgccacgaaattttaacttcgcgaatcaattccacccaccgcgacgctatttttaacgtccaaacgaaacgataaattcgtcaaaacaacaaaataaaataatcgacgantaaaccgcgaacgatattaacgcgctactattcgccaccgaaaaatatcgataataccaaataccacaaacgttccgacacgttcaaacgaataaaaaaacgcgcgactttaacgacgcaaacttcacgcgaaacgccgatatcgaacaacgactacatcaccacttccaatactaaaatacgcgaaataacgcgcaaaaactaactcacccaaccgacgataattttacgaatttccaccactttacgcgctaacgcgataaccaaatctacccactcgtcaccgtatttaatctaaatttaaccttcgtcgaacaaataattaacgtacaacgaacgtaacaaaattaatttaccgctaccgaaataaccgtaaaacaccacgcattcgcccgcgttaacgataaacgaaacgcgattaaannaacgaacaaaacaacaacgccgttttactaatacaaaataaaaattttactaacgttttatacgttaatcatttttcgcct

SEQ ID NO: 35385 - DNA, 578 bp, Artificial Sequence
  chemically treated genomic DNA (Homo sapiens) CpG-island No: 35385
tgtcggttgcgtggcgtggggtttcgtgggtgtggttttgttgttgtgtgttgtgtcgttttgcgagtcgtttttttttttcgtttggtttacgtcgtcgggtgattttttttgaacggtcgttggatggtcggttttgcggtttcgttgtttggcggcgtgtcgttttgttattcgcgggttttcggtggcgtcgcgatgcgcgtttcgttcggttgggttttttttttttcgtttttgttgtgttggagatttttgttcgcgggggcggggggtttcgtgtaggcgcgcgcggttcgcgtttgtcggtgtggcgggcgttatgttcgggtagtgtttttgggatttgtttatacgcgattcgtttgtatcgatttcggagaagttattcgttacgtcgcgattggagtagcgtcgcggtagtgcgattttggtgttttttttttcgcgtttagcgggcgtaggttataagttacgtcgggttgtgcgatgataatttttatgtttttcgggtttttgtttgggttttatcgtggtatttttagtttttttatttggcgtcgtgttgttttcggagt

SEQ ID NO: 35386 - DNA, 578 bp, Artificial Sequence
  chemically treated genomic DNA (Homo sapiens) CpG-island No: 35386
actccgaaaacaacacgacgccaaataaaaaaactaaaaataccacgataaaacccaaacaaaaacccgaaaaacataaaaattatcatcgcacaacccgacgtaacttataacctacgcccgctaaacgcgaaaaaaaaaacaccaaaatcgcactaccgcgacgctactccaatcgcgacgtaacgaataacttctccgaaatcgatacaaacgaatcgcgtataaacaaatcccaaaaacactacccgaacataacgcccgccacaccgacaaacgcgaaccgcgcgcgcctacacgaaaccccccgcccccgcgaacaaaaatctccaacacaacaaaaacgaaaaaaaaaaaacccaaccgaacgaaacgcgcatcgcgacgccaccgaaaacccgcgaataacaaaacgacacgccgccaaacaacgaaaccgcaaaaccgaccatccaacgaccgttcaaaaaaaatcacccgacgacgtaaaccaaacgaaaaaaaaaaacgactcgcaaaacgacacaacacacaacaacaaaaccacacccacgaaaccccacgccacgcaaccgaca

SEQ ID NO: 35387 - DNA, 578 bp, Artificial Sequence
  chemically treated genomic DNA (Homo sapiens) CpG-island No: 35387
gtttcgagggtaatacgacgttagatgaggagattaggggtattacggtggggtttagataaaggttcggaggatatgagaattattatcgtatagttcggcgtgatttataatttgcgttcgttagacgcggggaaaaggatattaaggtcgtattatcgcgacgttgttttagtcgcggcgtagcgggtgattttttcgaaatcgatataagcgggtcgcgtgtgggtaagttttagagatattgttcggatatgacgttcgttatatcggtagacgcgggtcgcgcgcgtttgtacggggtttttcgttttcgcgaatagagatttttaatatagtaggagcgaggagaagaaaatttaatcgagcgaggcgcgtatcgcgacgttatcgggggttcgcgagtagtaaagcgatacgtcgttaaataacgaagtcgtagagtcggttatttaacgatcgtttaagaagagttattcggcggcgtgaattagacgagagagaaagacgattcgtaaggcgatataatatatagtaataaaattatatttacgagattttacgttacgtagtcggta

SEQ ID NO: 35388 - DNA, 578 bp, Artificial Sequence
  chemically treated genomic DNA (Homo sapiens) CpG-island No: 35388
taccgactacgtaacgtaaaatctcgtaaatataattttattactatatattatatcgccttacgaatcgtctttctctctcgtctaattcacgccgccgaataactcttcttaaacgatcgttaaataaccgactctacgacttcgttatttaacgacgtatcgctttactactcgcgaacccccgataacgtcgcgatacgcgcctcgctcgattaaattttcttctcctcgctcctactatattaaaaatctctattcgcgaaaacgaaaaaccccgtacaaacgcgcgcgacccgcgtctaccgatataacgaacgtcatatccgaacaatatctctaaaacttacccacacgcgacccgcttatatcgatttcgaaaaaatcacccgctacgccgcgactaaaacaacgtcgcgataatacgaccttaatatccttttccccgcgtctaacgaacgcaaattataaatcacgccgaactatacgataataattctcatatcctccgaacctttatctaaaccccaccgtaatacccctaatctcctcatctaacgtcgtattaccctcgaaac

SEQ ID NO: 35389 - DNA, 569 bp, Artificial Sequence
  chemically treated genomic DNA (Homo sapiens) CpG-island No: 35389
gcggtttcggagcgttgagatcggagtcgcggtcgcgggatttcgagtttgatttaattggagtcgggagacgcgagttagagcggggtgggtatagcgtcggaggtttcgagcgttagggcgcgtaagtttaataagggaggggattcgatagtcgtggcggttttttaacggttcgttaagtttttttgttcggtcggggtttttatcgtttcgggattcggttcggttcgcgatttataacgattttcgggtcgtttttttttttttcgtttttttttttttttttcgtttcgatcgggtcggtatttattgagggaaggaggagcggtttaggtttgcgcgtatttacgtcgacgtatatcgttatcgcgtcgagtttcggttgacgcggacgtttttcgggcgtcgattagtaagggaacgggttacgtttttatttatattttttagtggatgggcggggtcgagcgcggggatttggcgtttacgaagggcgagggtttgttttttgagaagaaatcgggtagcggtgggtttgggttattgtagagtttggtagggttaga

SEQ ID NO: 35390 - DNA, 569 bp, Artificial Sequence
  chemically treated genomic DNA (Homo sapiens) CpG-island No: 35390
tctaaccctaccaaactctacaataacccaaacccaccgctacccgatttcttctcaaaaaacaaaccctcgcccttcgtaaacgccaaatccccgcgctcgaccccgcccatccactaaaaaatataaataaaaacgtaacccgttcccttactaatcgacgcccgaaaaacgtccgcgtcaaccgaaactcgacgcgataacgatatacgtcgacgtaaatacgcgcaaacctaaaccgctcctccttccctcaataaataccgacccgatcgaaacgaaaaaaaaaaaaaaaaacgaaaaaaaaaaaaacgacccgaaaatcgttataaatcgcgaaccgaaccgaatcccgaaacgataaaaaccccgaccgaacaaaaaaacttaacgaaccgttaaaaaaccgccacgactatcgaatcccctcccttattaaacttacgcgccctaacgctcgaaacctccgacgctatacccaccccgctctaactcgcgtctcccgactccaattaaatcaaactcgaaatcccgcgaccgcgactccgatctcaacgctccgaaaccgc

SEQ ID NO: 35391 - DNA, 569 bp, Artificial Sequence
  chemically treated genomic DNA (Homo sapiens) CpG-island No: 35391
tttggttttgttaggttttgtagtagtttaagtttatcgttgttcggtttttttttagagagtaagttttcgtttttcgtgagcgttaaattttcgcgttcggtttcgtttatttattgaggggtgtgggtaggggcgtggttcgtttttttgttggtcggcgttcggaaggcgttcgcgttagtcggagttcgacgcggtgacggtgtgcgtcgacgtaagtacgcgtaagtttgggtcgttttttttttttttagtgagtgtcggttcggtcggggcgggggagaagagggagggcgggggagggagaggcgattcgagagtcgttgtgggtcgcgggtcggatcgggtttcggggcggtgggagtttcggtcgggtagaagggtttggcgggtcgttagaggatcgttacggttgtcgagtttttttttttgttggatttgcgcgttttggcgttcggaattttcggcgttgtgtttatttcgttttagttcgcgtttttcgattttaattaggttaggttcggagtttcgcggtcgcggtttcggttttaacgtttcggggtcgt

SEQ ID NO: 35392 - DNA, 569 bp, Artificial Sequence
  chemically treated genomic DNA (Homo sapiens) CpG-island No: 35392
acgaccccgaaacgttaaaaccgaaaccgcgaccgcgaaactccgaacctaacctaattaaaatcgaaaaacgcgaactaaaacgaaataaacacaacgccgaaaattccgaacgccaaaacgcgcaaatccaacaaaaaaaaaaactcgacaaccgtaacgatcctctaacgacccgccaaacccttctacccgaccgaaactcccaccgccccgaaacccgatccgacccgcgacccacaacgactctcgaatcgcctctccctcccccgccctccctcttctcccccgccccgaccgaaccgacactcactaaaaaaaaaaaaaacgacccaaacttacgcgtacttacgtcgacgcacaccgtcaccgcgtcgaactccgactaacgcgaacgccttccgaacgccgaccaacaaaaaaacgaaccacgcccctacccacacccctcaataaataaacgaaaccgaacgcgaaaatttaacgctcacgaaaaacgaaaacttactctctaaaaaaaaaccgaacaacgataaacttaaactactacaaaacctaacaaaaccaaa

SEQ ID NO: 35393 - DNA, 674 bp, Artificial Sequence
  chemically treated genomic DNA (Homo sapiens) CpG-island No: 35393
ggtttcgtatttttttttttttattcgaggtcggggttttaaagtcggtgttacggtggtagtatttagcgttttgttggttttttcgttagtagcgtcgagcggggggttttttgttatagtatttgttgtatcgaatttttcggtcgtagaatttttttttttcgagggtcgatattttttgcgtgataatatcgttggtttcgttaaaatggatgttgtttttgggaattttttcggttggcgttatttttagggttttagtatcgttatttcgttaagtcgagtttttttggtcgcggtatattttgtttttcggtgtttttattttttcggtggcggtagcgttttggtagtcgatttgagggatttggaatcgtagttagttgcgtagagtttggggttttcgggcgacgtcggcgttgggcgggggagttcgtcgttttttcgagttagaggtagaggagttgcgcggacgtcgtttttttatagcgtcgcgagcgtcgacgtacgggtttttgttcggttttttgaatttagtttttcggcggcgtcgttggcgtttttatcgtaggtttttgcggtttcgttcgtcgttggttttttggttttagtaagtttcgatttcgcggtgttcgttatttttattttttgtttaaataattagttaaaat

SEQ ID NO: 35394 - DNA, 674 bp, Artificial Sequence
  chemically treated genomic DNA (Homo sapiens) CpG-island No: 35394
attttaactaattatttaaacaaaaaataaaaataacgaacaccgcgaaatcgaaacttactaaaaccaaaaaaccaacgacgaacgaaaccgcaaaaacctacgataaaaacgccaacgacgccgccgaaaaactaaattcaaaaaaccgaacaaaaacccgtacgtcgacgctcgcgacgctataaaaaaacgacgtccgcgcaactcctctacctctaactcgaaaaaacgacgaactcccccgcccaacgccgacgtcgcccgaaaaccccaaactctacgcaactaactacgattccaaatccctcaaatcgactaccaaaacgctaccgccaccgaaaaaataaaaacaccgaaaaacaaaatataccgcgaccaaaaaaactcgacttaacgaaataacgatactaaaaccctaaaaataacgccaaccgaaaaaattcccaaaaacaacatccattttaacgaaaccaacgatattatcacgcaaaaaatatcgaccctcgaaaaaaaaaaattctacgaccgaaaaattcgatacaacaaatactataacaaaaaaccccccgctcgacgctactaacgaaaaaaccaacaaaacgctaaatactaccaccgtaacaccgactttaaaaccccgacctcgaataaaaaaaaaaaaatacgaaacc

SEQ ID NO: 35395 - DNA, 674 bp, Artificial Sequence
  chemically treated genomic DNA (Homo sapiens) CpG-island No: 35395
attttggttagttatttggataagaggtagaaatagcgggtatcgcgaaatcgaaatttgttaggattaagaagttaacgacgggcgaaatcgtaggggtttgcgatagagacgttagcggcgtcgtcgggggattgggtttaggaggtcgagtaggaattcgtgcgtcggcgttcgcggcgttgtgaagagacggcgttcgcgtagtttttttgtttttggttcggaggagcggcgggttttttcgtttagcgtcggcgtcgttcgggaattttagattttgcgtaattggttgcgattttaaattttttagatcggttattagagcgttgtcgttatcgagaaaatggaggtatcgaggaataagatgtgtcgcgattaagagaattcggtttggcgaaatggcggtgttgggattttaagagtgacgttagtcggaggagtttttaaggataatatttattttggcggaattaacggtgttgttacgtagaaaatgtcgattttcggaaaagagaggttttgcgatcgagaaattcggtgtaataagtgttgtgatagaaaatttttcgttcggcgttgttggcgaaagagttaataaaacgttgggtgttgttatcgtgatatcgattttaggatttcggtttcggatggagaaaggagggtacggagtt

SEQ ID NO: 35396 - DNA, 674 bp, Artificial Sequence
  chemically treated genomic DNA (Homo sapiens) CpG-island No: 35396
aactccgtaccctcctttctccatccgaaaccgaaatcctaaaatcgatatcacgataacaacacccaacgttttattaactctttcgccaacaacgccgaacgaaaaattttctatcacaacacttattacaccgaatttctcgatcgcaaaacctctcttttccgaaaatcgacattttctacgtaacaacaccgttaattccgccaaaataaatattatccttaaaaactcctccgactaacgtcactcttaaaatcccaacaccgccatttcgccaaaccgaattctcttaatcgcgacacatcttattcctcgatacctccattttctcgataacgacaacgctctaataaccgatctaaaaaatttaaaatcgcaaccaattacgcaaaatctaaaattcccgaacgacgccgacgctaaacgaaaaaacccgccgctcctccgaaccaaaaacaaaaaaactacgcgaacgccgtctcttcacaacgccgcgaacgccgacgcacgaattcctactcgacctcctaaacccaatcccccgacgacgccgctaacgtctctatcgcaaacccctacgatttcgcccgtcgttaacttcttaatcctaacaaatttcgatttcgcgatacccgctatttctacctcttatccaaataactaaccaaaat

SEQ ID NO: 35397 - DNA, 558 bp, Artificial Sequence
  chemically treated genomic DNA (Homo sapiens) CpG-island No: 35397
gtcgtcgtcgttgtttcgggtaagtttatggtcgagtttttgttttgggttgatttcgttcgttttcgtttttgtcgttaacgttttcgtttttcgggtcgtacgtcgtcgttacgttcgtaaatttgagatgcgttatcgcgttaagtgggcggaggtgggaaggggcgggggaggacgcggagggtagtttaaaacgggggagtttaattataggtttacgttcggtacgtaggcgtagggattttttcggggttcgggggcgggtttaattttcgggttcgggggcgggtttaatttttagtttcgtttttgatttcgtttttttcgtgtcgttttatttttcgaggaaaagatttggtggttaagttagcggatttaattcgcgattattagcgatttattggttgcgtttttgtttagcgtttatattgcgttggtagagattgtcgggtgtattttgaggacgaggcgtggtttaggatgtgtcggggagttgttttgtattttttttttgttgtgtatttcgaattttttttagggtgggaaaggatattt

SEQ ID NO: 35398 - DNA, 558 bp, Artificial Sequence
  chemically treated genomic DNA (Homo sapiens) CpG-island No: 35398
aaatatcctttcccaccctaaaaaaaattcgaaatacacaacaaaaaaaaaatacaaaacaactccccgacacatcctaaaccacgcctcgtcctcaaaatacacccgacaatctctaccaacgcaatataaacgctaaacaaaaacgcaaccaataaatcgctaataatcgcgaattaaatccgctaacttaaccaccaaatcttttcctcgaaaaataaaacgacacgaaaaaaacgaaatcaaaaacgaaactaaaaattaaacccgcccccgaacccgaaaattaaacccgcccccgaaccccgaaaaaatccctacgcctacgtaccgaacgtaaacctataattaaactcccccgttttaaactaccctccgcgtcctcccccgccccttcccacctccgcccacttaacgcgataacgcatctcaaatttacgaacgtaacgacgacgtacgacccgaaaaacgaaaacgttaacgacaaaaacgaaaacgaacgaaatcaacccaaaacaaaaactcgaccataaacttacccgaaacaacgacgacgac

SEQ ID NO: 35399 - DNA, 558 bp, Artificial Sequence
  chemically treated genomic DNA (Homo sapiens) CpG-island No: 35399
aggtgtttttttttattttaaagaaaattcgagatgtatagtaagaaaaaaatgtaagatagtttttcgatatattttgagttacgtttcgtttttagggtgtattcgatagtttttgttagcgtagtgtggacgttggataaagacgtagttagtaggtcgttggtggtcgcgggttggattcgttgatttggttattaaatttttttttcggggagtgaagcggtacggaaggagcggagttaagggcggggttggggattggattcgttttcgggttcggggattggattcgttttcgggtttcggaggagtttttgcgtttgcgtgtcgggcgtggatttgtggttggattttttcgttttgggttgtttttcgcgttttttttcgtttttttttattttcgtttatttgacgcgatgacgtattttaggtttgcggacgtggcggcggcgtacggttcggaaggcggagacgttggcggtagaggcggaggcggacggggttagtttaaagtagaggttcggttatgaatttattcgggatagcggcggcggt

SEQ ID NO: 35400 - DNA, 558 bp, Artificial Sequence
  chemically treated genomic DNA (Homo sapiens) CpG-island No: 35400
accgccgccgctatcccgaataaattcataaccgaacctctactttaaactaaccccgtccgcctccgcctctaccgccaacgtctccgccttccgaaccgtacgccgccgccacgtccgcaaacctaaaatacgtcatcgcgtcaaataaacgaaaataaaaaaaaacgaaaaaaaacgcgaaaaacaacccaaaacgaaaaaatccaaccacaaatccacgcccgacacgcaaacgcaaaaactcctccgaaacccgaaaacgaatccaatccccgaacccgaaaacgaatccaatccccaaccccgcccttaactccgctccttccgtaccgcttcactccccgaaaaaaaaatttaataaccaaatcaacgaatccaacccgcgaccaccaacgacctactaactacgtctttatccaacgtccacactacgctaacaaaaactatcgaatacaccctaaaaacgaaacgtaactcaaaatatatcgaaaaactatcttacatttttttcttactatacatctcgaattttctttaaaataaaaaaaaacacct

SEQ ID NO: 35401 - DNA, 722 bp, Artificial Sequence
  chemically treated genomic DNA (Homo sapiens) CpG-island No: 35401
  misc_feature (360)..(360): n is either a, c, g or t
  misc_feature (670)..(670): n is either a, c, g or t
  misc_feature (699)..(699): n is either a, c, g or t
  misc_feature (705)..(705): n is either a, c, g or t
  misc_feature (710)..(710): n is either a, c, g or t
cgaaatagggttcgttttatttcggtcggggagcgcgggattttcgtggttatttagcgttatcgttcgcgggttcgttttgcgtaggcgcggcgttttcgtttattagatttcgggtcgggcgtcgcgtggtgcgtaggcgtaatgttttttattagtttttcgttttgatttcgtcggggggcgtaggcgtagtttgcgtaaggattggcgggattgttcggcggcgattttagacgtgtcgggggttcggagtttgtcgcggttgttaagcgtttagcgttttggggttggtcgttggtttaaggcggtgaggtttttgttcgggaatcgggcgaaggaagcgggggggcgagtcgncggagagatcggagacggttattagcgggtttaagtcggacgggacggtcgggtttttcgcgtttttttgttcgaggatatcggagagaggtggttgggaagagatttttggtcgggtgtaaagggggaagtcgtcgagaatggtattttggggtcgttggaggagtttcggatttttatgcgggttaggtcgcggttttcgggtagaaatagcgcgaattttcgtcggtttttgttttgggcggtttttttttcgtttcgttattagattcgggattttttgagtgttttcgagagattttcggtaggntttgaaggtacgtcgtttttcgttttttncgtcgngcggnggcgcgatttcg

SEQ ID NO: 35402 - DNA, 722 bp, Artificial Sequence
  chemically treated genomic DNA (Homo sapiens) CpG-island No: 35402
  misc_feature (13)..(13): n is either a, c, g or t
  misc_feature (18)..(18): n is either a, c, g or t
  misc_feature (24)..(24): n is either a, c, g or t
  misc_feature (53)..(53): n is either a, c, g or t
  misc_feature (363)..(363): n is either a, c, g or t
cgaaatcgcgccnccgcncgacgnaaaaaacgaaaaacgacgtaccttcaaancctaccgaaaatctctcgaaaacactcaaaaaatcccgaatctaataacgaaacgaaaaaaaaaccgcccaaaacaaaaaccgacgaaaattcgcgctatttctacccgaaaaccgcgacctaacccgcataaaaatccgaaactcctccaacgaccccaaaataccattctcgacgacttccccctttacacccgaccaaaaatctcttcccaaccacctctctccgatatcctcgaacaaaaaaacgcgaaaaacccgaccgtcccgtccgacttaaacccgctaataaccgtctccgatctctccgncgactcgcccccccgcttccttcgcccgattcccgaacaaaaacctcaccgccttaaaccaacgaccaaccccaaaacgctaaacgcttaacaaccgcgacaaactccgaacccccgacacgtctaaaatcgccgccgaacaatcccgccaatccttacgcaaactacgcctacgccccccgacgaaatcaaaacgaaaaactaataaaaaacattacgcctacgcaccacgcgacgcccgacccgaaatctaataaacgaaaacgccgcgcctacgcaaaacgaacccgcgaacgataacgctaaataaccacgaaaatcccgcgctccccgaccgaaataaaacgaaccctatttcg

SEQ ID NO: 35403 - DNA, 722 bp, Artificial Sequence
  chemically treated genomic DNA (Homo sapiens) CpG-island No: 35403
  misc_feature (13)..(13): n is either a, c, g or t
  misc_feature (18)..(18): n is either a, c, g or t
  misc_feature (24)..(24): n is either a, c, g or t
  misc_feature (53)..(53): n is either a, c, g or t
  misc_feature (363)..(363): n is either a, c, g or t
cgaggtcgcgttntcgtncggcgnaaaaggcgggaggcggcgtatttttagantttgtcgaaggtttttcggagatatttaagaggtttcggatttaatagcggggcgaaggggagatcgtttaaagtaagagtcggcgggggttcgcgttatttttattcgggaatcgcggtttaattcgtataagggttcgaagtttttttagcggttttagagtattattttcggcggtttttttttttgtattcggttaagagtttttttttagttattttttttcgatattttcgggtaagagagcgcgggagattcggtcgtttcgttcggtttggattcgttggtggtcgttttcggttttttcgncggttcgttttttcgtttttttcgttcggttttcgggtagagattttatcgttttgggttagcggttagttttagggcgttgagcgtttggtaatcgcgataggtttcggattttcgatacgtttgaggtcgtcgtcgggtagtttcgttagtttttgcgtagattgcgtttgcgtttttcggcgaggttaagacgaggagttagtgggggatattgcgtttgcgtattacgcgacgttcggttcggggtttaatgggcggggacgtcgcgtttgcgtaaagcggattcgcggacggtggcgttgggtggttacggaggtttcgcgtttttcgatcgagatagggcgggttttatttcg

SEQ ID NO: 35404 - DNA, 722 bp, Artificial Sequence
  chemically treated genomic DNA (Homo sapiens) CpG-island No: 35404
  misc_feature (360)..(360): n is either a, c, g or t
  misc_feature (670)..(670): n is either a, c, g or t
  misc_feature (699)..(699): n is either a, c, g or t
  misc_feature (705)..(705): n is either a, c, g or t
  misc_feature (710)..(710): n is either a, c, g or t
cgaaataaaacccgccctatctcgatcgaaaaacgcgaaacctccgtaaccacccaacgccaccgtccgcgaatccgctttacgcaaacgcgacgtccccgcccattaaaccccgaaccgaacgtcgcgtaatacgcaaacgcaatatcccccactaactcctcgtcttaacctcgccgaaaaacgcaaacgcaatctacgcaaaaactaacgaaactacccgacgacgacctcaaacgtatcgaaaatccgaaacctatcgcgattaccaaacgctcaacgccctaaaactaaccgctaacccaaaacgataaaatctctacccgaaaaccgaacgaaaaaaacgaaaaaacgaaccgncgaaaaaaccgaaaacgaccaccaacgaatccaaaccgaacgaaacgaccgaatctcccgcgctctcttacccgaaaatatcgaaaaaaaataactaaaaaaaaactcttaaccgaatacaaaaaaaaaaaccgccgaaaataatactctaaaaccgctaaaaaaacttcgaacccttatacgaattaaaccgcgattcccgaataaaaataacgcgaacccccgccgactcttactttaaacgatctccccttcgccccgctattaaatccgaaacctcttaaatatctccgaaaaaccttcgacaaantctaaaaatacgccgcctcccgccttttncgccgnacganaacgcgacctcg

SEQ ID NO: 35405 - DNA, 544 bp, Artificial Sequence
  chemically treated genomic DNA (Homo sapiens) CpG-island No: 35405
atagcgcgtagttcggcgttcgtacgtacggtgttgagcgttttatttcgtaggatgtaggttttttcggtcgtttgtcgttttatggtagcgtggtgtaggttgtagtaggttttcgaggtcgagtagttagtacggtcggtagtggggtgttcgtcgtcgttcggttcgggttagagcgtttgttagaggaggtatagggcgaacgtcggttttattttttgaggtttcgtacgtagagttgtttttaatttggatttgtttcgttcgaggacgtagagttgtgtttggagcgcggttatcgttttttatagttggtttttttaattcggtttttttttttttttttttcgttttcgttttcgacggattttttaattgttaagaattttttcgcgggtttagcggttaatagttttttttaggtcgcgataggaaatgtgtgcggagcgttgttaggttcggtgtagttttgagttattttggggttaggaatatagttggcgtcgggtataggggacgtagtcgattagaaggttaaata

SEQ ID NO: 35406 - DNA, 544 bp, Artificial Sequence
  chemically treated genomic DNA (Homo sapiens) CpG-island No: 35406
tatttaaccttctaatcgactacgtcccctatacccgacgccaactatattcctaaccccaaaataactcaaaactacaccgaacctaacaacgctccgcacacatttcctatcgcgacctaaaaaaaactattaaccgctaaacccgcgaaaaaattcttaacaattaaaaaatccgtcgaaaacgaaaacgaaaaaaaaaaaaaaaaaaaccgaattaaaaaaaccaactataaaaaacgataaccgcgctccaaacacaactctacgtcctcgaacgaaacaaatccaaattaaaaacaactctacgtacgaaacctcaaaaaataaaaccgacgttcgccctatacctcctctaacaaacgctctaacccgaaccgaacgacgacgaacaccccactaccgaccgtactaactactcgacctcgaaaacctactacaacctacaccacgctaccataaaacgacaaacgaccgaaaaaacctacatcctacgaaataaaacgctcaacaccgtacgtacgaacgccgaactacgcgctat

SEQ ID NO: 35407 - DNA, 544 bp, Artificial Sequence
  chemically treated genomic DNA (Homo sapiens) CpG-island No: 35407
tgtttgattttttagtcgattgcgttttttgtattcggcgttagttgtgtttttgattttagaataatttagggttgtatcgggtttggtagcgtttcgtatatattttttgtcgcggtttaagggaaattgttggtcgttgggttcgcggggggatttttggtagttggggggttcgtcgggagcgagggcggaggggaagggagggggaatcgggttggggaagttagttgtagagggcggtgatcgcgttttagatatagttttgcgttttcgagcgggatagatttaagttgggagtagttttgcgtgcggggttttagagaatgaggtcggcgttcgttttgtgttttttttggtaggcgttttggttcgggtcgggcggcggcgaatattttattgtcgatcgtgttggttgttcggtttcgggggtttgttatagtttgtattacgttattatgaagcggtaggcggtcgaggaggtttgtattttgcgaggtggggcgtttagtatcgtgcgtgcgggcgtcgagttgcgcgttgt

SEQ ID NO: 35408 - DNA, 544 bp, Artificial Sequence
  chemically treated genomic DNA (Homo sapiens) CpG-island No: 35408
acaacgcgcaactcgacgcccgcacgcacgatactaaacgccccacctcgcaaaatacaaacctcctcgaccgcctaccgcttcataataacgtaatacaaactataacaaacccccgaaaccgaacaaccaacacgatcgacaataaaatattcgccgccgcccgacccgaaccaaaacgcctaccaaaaaaaacacaaaacgaacgccgacctcattctctaaaaccccgcacgcaaaactactcccaacttaaatctatcccgctcgaaaacgcaaaactatatctaaaacgcgatcaccgccctctacaactaacttccccaacccgattccccctcccttcccctccgccctcgctcccgacgaaccccccaactaccaaaaatccccccgcgaacccaacgaccaacaatttcccttaaaccgcgacaaaaaatatatacgaaacgctaccaaacccgatacaaccctaaattattctaaaatcaaaaacacaactaacgccgaatacaaaaaacgcaatcgactaaaaaatcaaaca

SEQ ID NO: 35409 - DNA, 562 bp, Artificial Sequence
  chemically treated genomic DNA (Homo sapiens) CpG-island No: 35409
  misc_feature (11)..(11): n is either a, c, g or t
  misc_feature (94)..(94): n is either a, c, g or t
  misc_feature (98)..(98): n is either a, c, g or t
  misc_feature (130)..(130): n is either a, c, g or t
  misc_feature (132)..(132): n is either a, c, g or t
aagtaaagcgnttaaaatagcgtttttttgtcggtcgcgaaggcgtggcggtcgcggatcggcggatttcgggttatattagttgttcgggtgncgantagtagggattttacgatcgcgggtgtcgggnancgttttattgaggagttttatcgagattttcggtttggttaggcggggggttttttttttagttcgcggaacgtaggttcgggagacggcggggtttattgtgttttcggatttatattttgttcgggggtcggatttttgtaaagcgtttatttggaaagaagttttatttgtagggaaggcgggtgtacgtaatgatggttcgtgtgttcgggatgtgaatgttaattaagattgcgttcgttggtggagtgtgcgcgggtttttcgtgaggtgtttttggtagttatagtttacgagttagcgagaagatggttgggaggcggcgagtttcgttattcgggcgacgtatttcgaattttataggtatgggtgagttggttagtattggattcgagtgtttgtttttatttgagtatagatatttggt

SEQ ID NO: 35410 - DNA, 562 bp, Artificial Sequence
  chemically treated genomic DNA (Homo sapiens) CpG-island No: 35410
  misc_feature (431)..(431): n is either a, c, g or t
  misc_feature (433)..(433): n is either a, c, g or t
  misc_feature (465)..(465): n is either a, c, g or t
  misc_feature (469)..(469): n is either a, c, g or t
  misc_feature (552)..(552): n is either a, c, g or t
accaaatatctatactcaaataaaaacaaacactcgaatccaatactaaccaactcacccatacctataaaattcgaaatacgtcgcccgaataacgaaactcgccgcctcccaaccatcttctcgctaactcgtaaactataactaccaaaaacacctcacgaaaaacccgcgcacactccaccaacgaacgcaatcttaattaacattcacatcccgaacacacgaaccatcattacgtacacccgccttccctacaaataaaacttctttccaaataaacgctttacaaaaatccgacccccgaacaaaatataaatccgaaaacacaataaaccccgccgtctcccgaacctacgttccgcgaactaaaaaaaaaaccccccgcctaaccaaaccgaaaatctcgataaaactcctcaataaaacgntncccgacacccgcgatcgtaaaatccctactantcgncacccgaacaactaatataacccgaaatccgccgatccgcgaccgccacgccttcgcgaccgacaaaaaaacgctattttaancgctttactt

SEQ ID NO: 35411 - DNA, 562 bp, Artificial Sequence
  chemically treated genomic DNA (Homo sapiens) CpG-island No: 35411
  misc_feature (431)..(431): n is either a, c, g or t
  misc_feature (433)..(433): n is either a, c, g or t
  misc_feature (465)..(465): n is either a, c, g or t
  misc_feature (469)..(469): n is either a, c, g or t
  misc_feature (552)..(552): n is either a, c, g or t
attaggtgtttgtatttagataagaataagtattcgaatttaatgttaattaatttatttatatttatggagttcgaaatgcgtcgttcgggtagcggggttcgtcgttttttagttattttttcgttaattcgtgaattgtgattgttagaagtattttacggaggattcgcgtatattttattaacggacgtagttttggttggtatttatatttcggatatacggattattattgcgtatattcgttttttttgtaagtgaaatttttttttaagtggacgttttgtagaaattcggttttcgagtagagtgtaggttcgaaggtatagtgagtttcgtcgtttttcggatttgcgtttcgcggattgggaagaagatttttcgtttggttaggtcgaagatttcggtgaggttttttagtggagcgntnttcgatattcgcggtcgtggggtttttgttgntcgntattcggatagttggtatgattcggggttcgtcggttcgcggtcgttacgttttcgcggtcgataggggggcgttgttttgancgttttgttt

SEQ ID NO: 35412 - DNA, 562 bp, Artificial Sequence
  chemically treated genomic DNA (Homo sapiens) CpG-island No: 35412
  misc_feature (11)..(11): n is either a, c, g or t
  misc_feature (94)..(94): n is either a, c, g or t
  misc_feature (98)..(98): n is either a, c, g or t
  misc_feature (130)..(130): n is either a, c, g or t
  misc_feature (132)..(132): n is either a, c, g or t
aaacaaaacgntcaaaacaacgcccccctatcgaccgcgaaaacgtaacgaccgcgaaccgacgaaccccgaatcataccaactatccgaatancgancaacaaaaaccccacgaccgcgaatatcgaanancgctccactaaaaaacctcaccgaaatcttcgacctaaccaaacgaaaaatcttcttcccaatccgcgaaacgcaaatccgaaaaacgacgaaactcactataccttcgaacctacactctactcgaaaaccgaatttctacaaaacgtccacttaaaaaaaaatttcacttacaaaaaaaacgaatatacgcaataataatccgtatatccgaaatataaataccaaccaaaactacgtccgttaataaaatatacgcgaatcctccgtaaaatacttctaacaatcacaattcacgaattaacgaaaaaataactaaaaaacgacgaaccccgctacccgaacgacgcatttcgaactccataaatataaataaattaattaacattaaattcgaatacttattcttatctaaatacaaacacctaat

SEQ ID NO: 35413 - DNA, 613 bp, Artificial Sequence
  chemically treated genomic DNA (Homo sapiens) CpG-island No: 35413
ggttggggtcggttaagtcgaatatcggttatacgtaagcggcggcgggtgtggttggtgtgattaagatggtgatggcgatgcggtacgggtagttgttacgtacgttgtacgtggaatcgtcgtttttttggaggtggattggtcggcggggacggtttaattttttacggagaatacgttttggtttaggagtggtcgtgttcgtcgggtgggggtgtcgtcgttcgggattagtggtattaacgcgtacgttattttcgaatagttttcgggagtgtcgagttagtttgcggggtcgggttcgggttttgtcgtggatgtttcggtggtgtcgtggatggtgtcgggtaaaatattcgaagcgttattcgcgtaggtaacggcgttgatgatttatttggacgagcgatttgatgttttttcgttggatgttgggtattcgttggcgttgaatcggtcggcgttggatgagcgagcgggggtgttgggggtcgatcgtgagacgttgttgtgcggtgtgaaagcgttgtttgtcggttatgaggtttttgggttgtgatcgatttggggggttgggggtcgattgggtttgtgttttcggttagggtgg

SEQ ID NO: 35414 - DNA, 613 bp, Artificial Sequence
  chemically treated genomic DNA (Homo sapiens) CpG-island No: 35414
ccaccctaaccgaaaacacaaacccaatcgacccccaaccccccaaatcgatcacaacccaaaaacctcataaccgacaaacaacgctttcacaccgcacaacaacgtctcacgatcgacccccaacacccccgctcgctcatccaacgccgaccgattcaacgccaacgaatacccaacatccaacgaaaaaacatcaaatcgctcgtccaaataaatcatcaacgccgttacctacgcgaataacgcttcgaatattttacccgacaccatccacgacaccaccgaaacatccacgacaaaacccgaacccgaccccgcaaactaactcgacactcccgaaaactattcgaaaataacgtacgcgttaataccactaatcccgaacgacgacacccccacccgacgaacacgaccactcctaaaccaaaacgtattctccgtaaaaaattaaaccgtccccgccgaccaatccacctccaaaaaaacgacgattccacgtacaacgtacgtaacaactacccgtaccgcatcgccatcaccatcttaatcacaccaaccacacccgccgccgcttacgtataaccgatattcgacttaaccgaccccaacc

SEQ ID NO: 35415 - DNA, 613 bp, Artificial Sequence
  chemically treated genomic DNA (Homo sapiens) CpG-island No: 35415
ttattttggtcggaaatataaatttaatcggtttttagttttttagatcggttataatttaggagttttatgatcggtagatagcgtttttatatcgtataataacgttttacggtcgatttttagtattttcgttcgtttatttagcgtcgatcggtttaacgttagcgagtatttaatatttagcgaggagatattaggtcgttcgtttagataggttattaacgtcgttgtttgcgcggatagcgtttcgggtgttttgttcgatattatttacggtattatcggaatatttacgatagaattcgaattcggtttcgtagattgattcggtattttcgggggttgttcgaggatgacgtgcgcgttagtattattgatttcgaacgacgatatttttattcgacgaatacgattatttttgggttagggcgtgtttttcgtaaggagttgaatcgttttcgtcgattaatttatttttagaaagacggcgattttacgtgtaacgtgcgtggtagttgttcgtgtcgtatcgttattattattttgattatattagttatattcgtcgtcgtttgcgtatgatcgatgttcgatttgatcgattttaatt

SEQ ID NO: 35416 - DNA, 613 bp, Artificial Sequence
  chemically treated genomic DNA (Homo sapiens) CpG-island No: 35416
aattaaaatcgatcaaatcgaacatcgatcatacgcaaacgacgacgaatataactaatataatcaaaataataataacgatacgacacgaacaactaccacgcacgttacacgtaaaatcgccgtctttctaaaaataaattaatcgacgaaaacgattcaactccttacgaaaaacacgccctaacccaaaaataatcgtattcgtcgaataaaaatatcgtcgttcgaaatcaataatactaacgcgcacgtcatcctcgaacaacccccgaaaataccgaatcaatctacgaaaccgaattcgaattctatcgtaaatattccgataataccgtaaataatatcgaacaaaacacccgaaacgctatccgcgcaaacaacgacgttaataacctatctaaacgaacgacctaatatctcctcgctaaatattaaatactcgctaacgttaaaccgatcgacgctaaataaacgaacgaaaatactaaaaatcgaccgtaaaacgttattatacgatataaaaacgctatctaccgatcataaaactcctaaattataaccgatctaaaaaactaaaaaccgattaaatttatatttccgaccaaaataa

SEQ ID NO: 35417 - DNA, 740 bp, Artificial Sequence
  chemically treated genomic DNA (Homo sapiens) CpG-island No: 35417
tagtacgagtcgcggagcggtttaatttagagcgggtagttgcggacgagttggagaggaaggtgattataattagtgaattagtaatttttgtcgagttttaagtttcgatttagcggtataatgcgttgtgtcggcgtttcggggaaaggaaagaattttaaaggtattgagagcgtagggttaaaagaacgtttttaggttatttggagtttacggcggtgtatttaagcgtcgtagttgcggttgttttggtgtgggttgtttatcgtgcgtacgtttcgggcggcgcggtttttttaggcgcggtgttttatttcgggttcgggaagcgagtcgtttggttagtacgtgggttggggaaaagtttgtcgagatcggttgggagcgtttggtagttttggaattttagcggtcgtcgcggggttggcgacgttaggtaggagcgcggagcggcgggtgtagttattgggatgtttcgttttcgttcgcgagcgcggtttttaggtaaggggtgcgttcgtttatattttttgtttttttaattaattgtgtcgttttttgcgttttttttacggttattttatagttaagattttttttttttcgagttgtagaaggtagaacgttttcgggaggacgaagtgattcgaagggatgtggtaagcgtatttttcgatggagatgtagatcggttgaggtttgggatgtttttataagtaggtggtgttgtggtttaa

SEQ ID NO: 35418 - DNA, 740 bp, Artificial Sequence
  chemically treated genomic DNA (Homo sapiens) CpG-island No: 35418
ttaaaccacaacaccacctacttataaaaacatcccaaacctcaaccgatctacatctccatcgaaaaatacgcttaccacatcccttcgaatcacttcgtcctcccgaaaacgttctaccttctacaactcgaaaaaaaaaaaatcttaactataaaataaccgtaaaaaaaacgcaaaaaacgacacaattaattaaaaaaacaaaaaatataaacgaacgcaccccttacctaaaaaccgcgctcgcgaacgaaaacgaaacatcccaataactacacccgccgctccgcgctcctacctaacgtcgccaaccccgcgacgaccgctaaaattccaaaactaccaaacgctcccaaccgatctcgacaaacttttccccaacccacgtactaaccaaacgactcgcttcccgaacccgaaataaaacaccgcgcctaaaaaaaccgcgccgcccgaaacgtacgcacgataaacaacccacaccaaaacaaccgcaactacgacgcttaaatacaccgccgtaaactccaaataacctaaaaacgttcttttaaccctacgctctcaatacctttaaaattctttcctttccccgaaacgccgacacaacgcattataccgctaaatcgaaacttaaaactcgacaaaaattactaattcactaattataatcaccttcctctccaactcgtccgcaactacccgctctaaattaaaccgctccgcgactcgtacta

SEQ ID NO: 35419 - DNA, 740 bp, Artificial Sequence
  chemically treated genomic DNA (Homo sapiens) CpG-island No: 35419
ttggattatagtattatttatttatagaagtattttaagttttagtcggtttgtatttttatcggaaagtgcgtttgttatattttttcggattatttcgttttttcgagagcgttttgttttttatagttcggaaagaaagaaattttagttgtgaagtgatcgtggagaaagcgtaggaagcgatataattggttagggaggtagagagtgtgagcgggcgtattttttgtttggggatcgcgttcgcgggcggggacggagtattttagtggttgtattcgtcgtttcgcgtttttgtttggcgtcgttaatttcgcggcggtcgttggaattttagagttgttaggcgtttttagtcggtttcggtaaatttttttttagtttacgtgttaattaagcggttcgtttttcgagttcgggatggagtatcgcgtttagggaggtcgcgtcgttcgagacgtgcgtacggtaggtaatttatattaaggtagtcgtagttgcggcgtttgggtatatcgtcgtggattttaaatggtttaagagcgtttttttagttttgcgtttttagtgtttttagagttttttttttttttcggagcgtcggtataacgtattatgtcgttgggtcggagtttagggttcggtagaggttgttaatttattgattataattatttttttttttaattcgttcgtagttgttcgttttggattaagtcgtttcgcggttcgtgtta

SEQ ID NO: 35420 - DNA, 740 bp, Artificial Sequence
  chemically treated genomic DNA (Homo sapiens) CpG-island No: 35420
taacacgaaccgcgaaacgacttaatccaaaacgaacaactacgaacgaattaaaaaaaaaaataattataatcaataaattaacaacctctaccgaaccctaaactccgacccaacgacataatacgttataccgacgctccgaaaaaaaaaaaaaactctaaaaacactaaaaacgcaaaactaaaaaaacgctcttaaaccatttaaaatccacgacgatatacccaaacgccgcaactacgactaccttaatataaattacctaccgtacgcacgtctcgaacgacgcgacctccctaaacgcgatactccatcccgaactcgaaaaacgaaccgcttaattaacacgtaaactaaaaaaaaatttaccgaaaccgactaaaaacgcctaacaactctaaaattccaacgaccgccgcgaaattaacgacgccaaacaaaaacgcgaaacgacgaatacaaccactaaaatactccgtccccgcccgcgaacgcgatccccaaacaaaaaatacgcccgctcacactctctacctccctaaccaattatatcgcttcctacgctttctccacgatcacttcacaactaaaatttctttctttccgaactataaaaaacaaaacgctctcgaaaaaacgaaataatccgaaaaaatataacaaacgcactttccgataaaaatacaaaccgactaaaacttaaaatacttctataaataaataatactataatccaa

SEQ ID NO: 35421 - DNA, 872 bp, Artificial Sequence
  chemically treated genomic DNA (Homo sapiens) CpG-island No: 35421
aggacgtcgtcgagcgtttggagttgtgcgcgtgtgcgtgtgcgcgtgtgcgagtgtgaagtgtagcgttggagtgtaatatgttgtaatgggaggaaatttagcggcgtcggagcgttcgggatcgtcgcggtcgttttgagcgtagtggcgtcgagtagtttttttcgtagtcggtgtgatttgtttttttaggtgcgtggtcgtcggtcgtcggggagcgcggttcgggtatgcgggtgtcgagagggggcgacggggttcgggaggcgggggacggaaggtgcgtcgcgtttcgggggtgagcgggtgtggacggcgaatcggcgcgggcgggtggtgcgttttttttcggttgttcggcgagtcgggggaagcggagggcggcgtgggtgtcgtaggttcggttgaatttcgggcgtttggcggggtgtgtgtggcgggaagggtagtaggttcgcgggacgggtttggttggattgtgaacgtcggcgtttcgtgcgttgtttttcgggagtagggatttattgtgcgcgcgtggggagcgcggcgggtatttgggcgcgtacgaaatgtgcgtttgtgtttgtatatttgtacggcgttgtgttttttggcggggtttcgggggcgggggcgtgcgagatgtcgtgtttatagtagtgtgcgttatgtttattcgttttgttcgttggcgtttttcgggagcgttcgtttcgataaattttattgttttagcgcgtcggtatcggttcgggaggtgcgagttggtatcgggcgcgtagttggcgggggagggaaagcggtttttttttgtcgcgggaggtttcgtttttatttttttttcggtttatttgggtttagttttattt

SEQ ID NO: 35422 - DNA, 872 bp, Artificial Sequence
  chemically treated genomic DNA (Homo sapiens) CpG-island No: 35422
aaataaaactaaacccaaataaaccgaaaaaaaaataaaaacgaaacctcccgcgacaaaaaaaaaccgctttccctcccccgccaactacgcgcccgataccaactcgcacctcccgaaccgataccgacgcgctaaaacaataaaatttatcgaaacgaacgctcccgaaaaacgccaacgaacaaaacgaataaacataacgcacactactataaacacgacatctcgcacgcccccgcccccgaaaccccgccaaaaaacacaacgccgtacaaatatacaaacacaaacgcacatttcgtacgcgcccaaatacccgccgcgctccccacgcgcgcacaataaatccctactcccgaaaaacaacgcacgaaacgccgacgttcacaatccaaccaaacccgtcccgcgaacctactacccttcccgccacacacaccccgccaaacgcccgaaattcaaccgaacctacgacacccacgccgccctccgcttcccccgactcgccgaacaaccgaaaaaaaacgcaccacccgcccgcgccgattcgccgtccacacccgctcacccccgaaacgcgacgcaccttccgtcccccgcctcccgaaccccgtcgccccctctcgacacccgcatacccgaaccgcgctccccgacgaccgacgaccacgcacctaaaaaaacaaatcacaccgactacgaaaaaaactactcgacgccactacgctcaaaacgaccgcgacgatcccgaacgctccgacgccgctaaatttcctcccattacaacatattacactccaacgctacacttcacactcgcacacgcgcacacgcacacgcgcacaactccaaacgctcgacgacgtcct

SEQ ID NO: 35423 - DNA, 872 bp, Artificial Sequence
  chemically treated genomic DNA (Homo sapiens) CpG-island No: 35423
aggtggggttgagtttaggtgagtcgggagggagataggggcgaggtttttcgcggtagggagaggtcgttttttttttttcgttagttgcgcgttcggtgttagttcgtatttttcgggtcgatgtcggcgcgttggggtagtgaggtttgtcggggcgggcgttttcgagaggcgttagcgggtagggcgagtggatatggcgtatattgttgtggatacggtatttcgtacgttttcgttttcgaggtttcgttaggggatatagcgtcgtgtaaatgtataaatataaacgtatatttcgtgcgcgtttaggtgttcgtcgcgttttttacgcgcgtatagtaggtttttgttttcgggggatagcgtacgggacgtcgacgtttatagtttaattagattcgtttcgcggatttgttgtttttttcgttatatatatttcgttaagcgttcggagtttagtcgaatttgcggtatttacgtcgtttttcgtttttttcggttcgtcgagtagtcggggaagggcgtattattcgttcgcgtcggttcgtcgtttatattcgtttattttcggaacgcggcgtatttttcgtttttcgtttttcgggtttcgtcgttttttttcggtattcgtatgttcgagtcgcgtttttcgacggtcgacggttacgtatttgaagggataggttatatcggttgcgggaggggttgttcggcgttattgcgtttagaacggtcgcggcggtttcgggcgtttcgacgtcgttgggtttttttttattatagtatgttgtattttagcgttgtattttatattcgtatacgcgtatacgtatacgcgtataattttaggcgttcggcggcgtttt

SEQ ID NO: 35424 - DNA, 872 bp, Artificial Sequence
  chemically treated genomic DNA (Homo sapiens) CpG-island No: 35424
aaaacgccgccgaacgcctaaaattatacgcgtatacgtatacgcgtatacgaatataaaatacaacgctaaaatacaacatactataataaaaaaaaacccaacgacgtcgaaacgcccgaaaccgccgcgaccgttctaaacgcaataacgccgaacaacccctcccgcaaccgatataacctatcccttcaaatacgtaaccgtcgaccgtcgaaaaacgcgactcgaacatacgaataccgaaaaaaaacgacgaaacccgaaaaacgaaaaacgaaaaatacgccgcgttccgaaaataaacgaatataaacgacgaaccgacgcgaacgaataatacgcccttccccgactactcgacgaaccgaaaaaaacgaaaaacgacgtaaataccgcaaattcgactaaactccgaacgcttaacgaaatatatataacgaaaaaaacaacaaatccgcgaaacgaatctaattaaactataaacgtcgacgtcccgtacgctatcccccgaaaacaaaaacctactatacgcgcgtaaaaaacgcgacgaacacctaaacgcgcacgaaatatacgtttatatttatacatttacacgacgctatatcccctaacgaaacctcgaaaacgaaaacgtacgaaataccgtatccacaacaatatacgccatatccactcgccctacccgctaacgcctctcgaaaacgcccgccccgacaaacctcactaccccaacgcgccgacatcgacccgaaaaatacgaactaacaccgaacgcgcaactaacgaaaaaaaaaaaacgacctctccctaccgcgaaaaacctcgcccctatctccctcccgactcacctaaactcaaccccacct

SEQ ID NO: 35425 - DNA, 885 bp, Artificial Sequence
  chemically treated genomic DNA (Homo sapiens) CpG-island No: 35425
agacgcggtatatttagattttcgttaggttcgtatatatatttaggggtaatatagcgtcgtatttcgaggtcgagtcgtacgtttatatttcggatacgtaatttacggatacgacgtatagcgcgtttaatacggttttcgttatgcgaaatttcgtacgggaggtttcgcggtttcggacgcgcgttcgttttagatttcgcgttcgtagggacgcgtcgcgtagatcgcgtaggatcgttcgcgcgtttcgggattttagtttagttcggttcggtttcgtcgcggattcggggcgcgggttttttattttgtcgattagtttttcgcgtttgtatacgcggttcgagttcgggtttcgtaggaaggcggcgattagggggcgatttttgcgtcgtcgtcgcggtcggggttttatcgcgcggattttggcgtagtcgggtcgagattatcgcgttgcggtcgtttcggggtcgttttgagggcgtaggagtcgtcggggagcgttttattggtcgcgggggcggggagggggcggagttcgggcgtaggtttagttcggggaggggcgggaggtgttcggtcgtggagtggggggcgcgtgagcggcggggacgtcgcggttggggaagttttacggattagagcgcgttcgagtttcgtacgttaatcgggcgttaggggtcgcgtttagttcgcgagttttttcgattttgtatattcgggttggttgggaatcgttgatacgttcgttttatcgagcgggaaattgaggttttttcgcgcgtggggggttgggggttttcgggggttttttttttatagtgcgtttgaggtatgagtttcgacgttttgaatgtgtgttatttcgggttttttttg

SEQ ID NO: 35426 - DNA, 885 bp, Artificial Sequence
  chemically treated genomic DNA (Homo sapiens) CpG-island No: 35426
caaaaaaaacccgaaataacacacattcaaaacgtcgaaactcatacctcaaacgcactataaaaaaaaaacccccgaaaacccccaaccccccacgcgcgaaaaaacctcaatttcccgctcgataaaacgaacgtatcaacgattcccaaccaacccgaatatacaaaatcgaaaaaactcgcgaactaaacgcgacccctaacgcccgattaacgtacgaaactcgaacgcgctctaatccgtaaaacttccccaaccgcgacgtccccgccgctcacgcgccccccactccacgaccgaacacctcccgcccctccccgaactaaacctacgcccgaactccgccccctccccgcccccgcgaccaataaaacgctccccgacgactcctacgccctcaaaacgaccccgaaacgaccgcaacgcgataatctcgacccgactacgccaaaatccgcgcgataaaaccccgaccgcgacgacgacgcaaaaatcgccccctaatcgccgccttcctacgaaacccgaactcgaaccgcgtatacaaacgcgaaaaactaatcgacaaaataaaaaacccgcgccccgaatccgcgacgaaaccgaaccgaactaaactaaaatcccgaaacgcgcgaacgatcctacgcgatctacgcgacgcgtccctacgaacgcgaaatctaaaacgaacgcgcgtccgaaaccgcgaaacctcccgtacgaaatttcgcataacgaaaaccgtattaaacgcgctatacgtcgtatccgtaaattacgtatccgaaatataaacgtacgactcgacctcgaaatacgacgctatattacccctaaatatatatacgaacctaacgaaaatctaaatataccgcgtct

SEQ ID NO: 35427 - DNA, 885 bp, Artificial Sequence
  chemically treated genomic DNA (Homo sapiens) CpG-island No: 35427
tagggaggattcgaaatggtatatatttagaacgtcgaggtttatattttaagcgtattgtgggggagaagttttcggaagtttttaattttttacgcgcgagagagttttagtttttcgttcggtaaagcgggcgtattagcggtttttagttagttcgggtgtgtagggtcggaggagttcgcgggttgagcgcggtttttggcgttcggttggcgtgcgggattcgggcgcgttttggttcgtggaatttttttagtcgcggcgttttcgtcgtttacgcgttttttattttacggtcgggtatttttcgttttttttcgggttggatttgcgttcgggtttcgtttttttttcgttttcgcggttaataaaacgtttttcggcggtttttgcgtttttagagcggtttcggagcggtcgtagcgcggtggtttcggttcggttgcgttagagttcgcgcgatggagtttcggtcgcggcggcggcgtaggagtcgttttttggtcgtcgtttttttgcgagattcgggttcgggtcgcgtgtataggcgcgggaagttgatcggtaaggtgggaggttcgcgtttcgagttcgcgacggggtcggatcgggttgggttggggtttcggggcgcgcgggcgattttgcgcggtttacgcggcgcgtttttgcgagcgcggggtttggagcgggcgcgcgttcggagtcgcggggtttttcgtgcggggtttcgtatggcgggaatcgtgttgagcgcgttgtgcgtcgtgttcgtgggttgcgtgttcggggtgtgggcgtgcggttcggtttcgggatgcgacgttgtgttgtttttgggtgtgtgtgcgagtttggcgagggtttgagtgtgtcgcgttt

SEQ ID NO: 35428 - DNA, 885 bp, Artificial Sequence
  chemically treated genomic DNA (Homo sapiens) CpG-island No: 35428
aaacgcgacacactcaaaccctcgccaaactcgcacacacacccaaaaacaacacaacgtcgcatcccgaaaccgaaccgcacgcccacaccccgaacacgcaacccacgaacacgacgcacaacgcgctcaacacgattcccgccatacgaaaccccgcacgaaaaaccccgcgactccgaacgcgcgcccgctccaaaccccgcgctcgcaaaaacgcgccgcgtaaaccgcgcaaaatcgcccgcgcgccccgaaaccccaacccaacccgatccgaccccgtcgcgaactcgaaacgcgaacctcccaccttaccgatcaacttcccgcgcctatacacgcgacccgaacccgaatctcgcaaaaaaacgacgaccaaaaaacgactcctacgccgccgccgcgaccgaaactccatcgcgcgaactctaacgcaaccgaaccgaaaccaccgcgctacgaccgctccgaaaccgctctaaaaacgcaaaaaccgccgaaaaacgttttattaaccgcgaaaacgaaaaaaaaacgaaacccgaacgcaaatccaacccgaaaaaaaacgaaaaatacccgaccgtaaaataaaaaacgcgtaaacgacgaaaacgccgcgactaaaaaaattccacgaaccaaaacgcgcccgaatcccgcacgccaaccgaacgccaaaaaccgcgctcaacccgcgaactcctccgaccctacacacccgaactaactaaaaaccgctaatacgcccgctttaccgaacgaaaaactaaaactctctcgcgcgtaaaaaattaaaaacttccgaaaacttctcccccacaatacgcttaaaatataaacctcgacgttctaaatatataccatttcgaatcctcccta

SEQ ID NO: 35429 - DNA, 533 bp, Artificial Sequence
  chemically treated genomic DNA (Homo sapiens) CpG-island No: 35429
acgtcggtgggacgtaattcgggcgtcggcggggtaggggtagcgttcgggatttttagatttagggcggggtgatttcggttcgcgtatattttcgggttttgagcgcggcgttcggaatagtagtttcggggtagaggagggcggttagttttcgcgtcgcgttttcgttcgagtttgttaaggttattcggattcgggcgttcgatattagtttgcggtttcgggatttttgcgttcgcgttcgtcgggtagttttttgtcgtagattcgcgttcgtcgcgcgagggcgttcggggtcgtcgttttttttgattcgggtttgggcgcgtttgcggaggtcgcggtgggagggatcgttttaggttttttatttcgtttagtattttgggtttcgtcgttttcgttcgttttggggtcgtttagggagtcgggacgcgttgtttgggtttcgcgtagtcggtaagtttatttgtttatttttttatttttttcgggggaaattgaggtttagaggtgcggtttgttttgag

SEQ ID NO: 35430 - DNA, 533 bp, Artificial Sequence
  chemically treated genomic DNA (Homo sapiens) CpG-island No: 35430
ctcaaaacaaaccgcacctctaaacctcaatttcccccgaaaaaaataaaaaaataaacaaataaacttaccgactacgcgaaacccaaacaacgcgtcccgactccctaaacgaccccaaaacgaacgaaaacgacgaaacccaaaatactaaacgaaataaaaaacctaaaacgatccctcccaccgcgacctccgcaaacgcgcccaaacccgaatcaaaaaaaacgacgaccccgaacgccctcgcgcgacgaacgcgaatctacgacaaaaaactacccgacgaacgcgaacgcaaaaatcccgaaaccgcaaactaatatcgaacgcccgaatccgaataaccttaacaaactcgaacgaaaacgcgacgcgaaaactaaccgccctcctctaccccgaaactactattccgaacgccgcgctcaaaacccgaaaatatacgcgaaccgaaatcaccccgccctaaatctaaaaatcccgaacgctacccctaccccgccgacgcccgaattacgtcccaccgacgt

SEQ ID NO: 35431 - DNA, 533 bp, Artificial Sequence
  chemically treated genomic DNA (Homo sapiens) CpG-island No: 35431
tttaaggtaagtcgtatttttgggttttagtttttttcggagaaagtgggaggataggtagatggatttatcggttgcgcggagtttaggtagcgcgtttcggttttttgagcggttttagggcgagcggaagcggcggggtttaaggtgttgggcggggtggggagtttgggacggttttttttatcgcggttttcgtaggcgcgtttaggttcgggttaggaggggcggcggtttcgggcgttttcgcgcggcgggcgcggatttgcggtaggggattgttcggcggacgcgagcgtaggggtttcggagtcgtaggttggtgtcgggcgttcgggttcgggtgattttggtaggttcgggcgggggcgcggcgcggggattgatcgtttttttttgtttcggggttgttatttcgggcgtcgcgtttagggttcgggaatgtgcgcgaatcgaggttatttcgttttgggtttgggagtttcgggcgttgtttttatttcgtcgacgttcggattgcgttttatcggcgt

SEQ ID NO: 35432 - DNA, 533 bp, Artificial Sequence
  chemically treated genomic DNA (Homo sapiens) CpG-island No: 35432
acgccgataaaacgcaatccgaacgtcgacgaaataaaaacaacgcccgaaactcccaaacccaaaacgaaataacctcgattcgcgcacattcccgaaccctaaacgcgacgcccgaaataacaaccccgaaacaaaaaaaaacgatcaatccccgcgccgcgcccccgcccgaacctaccaaaatcacccgaacccgaacgcccgacaccaacctacgactccgaaacccctacgctcgcgtccgccgaacaatcccctaccgcaaatccgcgcccgccgcgcgaaaacgcccgaaaccgccgcccctcctaacccgaacctaaacgcgcctacgaaaaccgcgataaaaaaaaccgtcccaaactccccaccccgcccaacaccttaaaccccgccgcttccgctcgccctaaaaccgctcaaaaaaccgaaacgcgctacctaaactccgcgcaaccgataaatccatctacctatcctcccactttctccgaaaaaaactaaaacccaaaaatacgacttaccttaaa

SEQ ID NO: 35433 - DNA, 709 bp, Artificial Sequence
  chemically treated genomic DNA (Homo sapiens) CpG-island No: 35433
gcgttgttttaggtcgtttatggtttcgacgcgttcggggttggttgttcgagttcgttcgcggattagggtatttatttcgttgtacgcgtatcgttttttcgtagtttgagtcgcgatgtttcggtttcgcgtcggtgttcgttttcggtttttcgttaggattaatgggagggtagggcggataaaggaggaggggtttgtttcgtttttttcgtcgtatagtttttcgttacggtcgtcgttgtttagatttcgtcgggagagggcggggcgcggcggtttagggtatcgattggtcgggtcggagcgagacgtagttgattggaagggcggtgttagaggatgggattattggttgaagggtggagttagggcgaggagaggcgtgggggggcggaatcggggggaggggttaaagaaatattcgagtcgattggagaaacgggacgcgatttattggcgagattagtggagggcggggttgattataaaggaggtagggcggaatggtaggggcgggaacggggcgaggtttatcggaggaggcgggattacgtaaaagaatgattttgattaggtcggataggaggtcgggttgattttcgaaggaggggtgtgttggaaagtgggagaggttaaataaagggtaggacgcgttatcgtaatagtgaattcgtttttttgggttagttttgtcgttgtataa

SEQ ID NO: 35434 - DNA, 709 bp, Artificial Sequence
  chemically treated genomic DNA (Homo sapiens) CpG-island No: 35434
ttatacaacgacaaaactaacccaaaaaaacgaattcactattacgataacgcgtcctaccctttatttaacctctcccactttccaacacacccctccttcgaaaatcaacccgacctcctatccgacctaatcaaaatcattcttttacgtaatcccgcctcctccgataaacctcgccccgttcccgcccctaccattccgccctacctcctttataatcaaccccgccctccactaatctcgccaataaatcgcgtcccgtttctccaatcgactcgaatatttctttaacccctccccccgattccgcccccccacgcctctcctcgccctaactccacccttcaaccaataatcccatcctctaacaccgcccttccaatcaactacgtctcgctccgacccgaccaatcgataccctaaaccgccgcgccccgccctctcccgacgaaatctaaacaacgacgaccgtaacgaaaaactatacgacgaaaaaaacgaaacaaacccctcctcctttatccgccctaccctcccattaatcctaacgaaaaaccgaaaacgaacaccgacgcgaaaccgaaacatcgcgactcaaactacgaaaaaacgatacgcgtacaacgaaataaataccctaatccgcgaacgaactcgaacaaccaaccccgaacgcgtcgaaaccataaacgacctaaaacaacgc

SEQ ID NO: 35435 - DNA, 709 bp, Artificial Sequence
  chemically treated genomic DNA (Homo sapiens) CpG-island No: 35435
ttgtataacgataagattaatttagagaagcgggtttattgttgcgataacgcgttttattttttgtttgattttttttattttttaatatatttttttttcgagaattagttcggttttttgttcggtttaattagaattatttttttgcgtaatttcgtttttttcgataagtttcgtttcgttttcgtttttattatttcgttttgttttttttgtgattagtttcgttttttattggtttcgttaatgaatcgcgtttcgtttttttaatcggttcggatgtttttttagttttttttttcggtttcgtttttttacgttttttttcgttttggttttattttttagttaataattttattttttgatatcgtttttttaattagttacgtttcgtttcggttcggttaatcggtgttttgggtcgtcgcgtttcgttttttttcggcggggtttgggtagcggcggtcgtggcggagggttatgcggcgggggagacggggtaggtttttttttttttgttcgttttgtttttttattggttttagcggggggtcgggggcggatatcggcgcggggtcggagtatcgcggtttaggttgcgggaaagcggtgcgcgtgtagcggggtgggtgttttggttcgcgggcgagttcgagtagttaatttcgggcgcgtcggggttatggacggtttgaggtagcgt

SEQ ID NO: 35436 - DNA, 709 bp, Artificial Sequence
  chemically treated genomic DNA (Homo sapiens) CpG-island No: 35436
acgctacctcaaaccgtccataaccccgacgcgcccgaaattaactactcgaactcgcccgcgaaccaaaacacccaccccgctacacgcgcaccgctttcccgcaacctaaaccgcgatactccgaccccgcgccgatatccgcccccgaccccccgctaaaaccaataaaaaaacaaaacgaacaaaaaaaaaaaaacctaccccgtctcccccgccgcataaccctccgccacgaccgccgctacccaaaccccgccgaaaaaaaacgaaacgcgacgacccaaaacaccgattaaccgaaccgaaacgaaacgtaactaattaaaaaaacgatatcaaaaaataaaattattaactaaaaaataaaaccaaaacgaaaaaaaacgtaaaaaaacgaaaccgaaaaaaaaaactaaaaaaacatccgaaccgattaaaaaaacgaaacgcgattcattaacgaaaccaataaaaaacgaaactaatcacaaaaaaaacaaaacgaaataataaaaacgaaaacgaaacgaaacttatcgaaaaaaacgaaattacgcaaaaaaataattctaattaaaccgaacaaaaaaccgaactaattctcgaaaaaaaaatatattaaaaaataaaaaaaatcaaacaaaaaataaaacgcgttatcgcaacaataaacccgcttctctaaattaatcttatcgttatacaa

SEQ ID NO: 35437 - DNA, 522 bp, Artificial Sequence
  chemically treated genomic DNA (Homo sapiens) CpG-island No: 35437
cgttttagcgttggaggttaagtaggtgattgcggggttcggtttatcgttttcgtttttaggcgcggttcggcggtttattcgttttcgttttcgtttttcgtagttcgtttttgacgtggagagatatgtagtatttggtggttcgcgcgtttaagtcggcgtatttgtaggtcgaggattggaggattaacggcgtggggcgttaaggtgcggcggggtcgggcgggggcggggattcggggtttacggggcgagtgattgttgttttttcgcgtagtgagttattattacggatacgggttgttggacgtcgggttgttggtggatatcgttcgtatttggttgtttatttagtcgtagaggaagtgcgtcgttcgggtttagagtcgttttacgtgagatttttgcgcgttttttcgttattttcgttgggggtgtgggggataggtttgaggttttagtttatttatttgtaaaacgagggttggatttcgtgatttttgagtttcgatttcgttt

SEQ ID NO: 35438 - DNA, 522 bp, Artificial Sequence
  chemically treated genomic DNA (Homo sapiens) CpG-island No: 35438
aaacgaaatcgaaactcaaaaatcacgaaatccaaccctcgttttacaaataaataaactaaaacctcaaacctatcccccacacccccaacgaaaataacgaaaaaacgcgcaaaaatctcacgtaaaacgactctaaacccgaacgacgcacttcctctacgactaaataaacaaccaaatacgaacgatatccaccaacaacccgacgtccaacaacccgtatccgtaataataactcactacgcgaaaaaacaacaatcactcgccccgtaaaccccgaatccccgcccccgcccgaccccgccgcaccttaacgccccacgccgttaatcctccaatcctcgacctacaaatacgccgacttaaacgcgcgaaccaccaaatactacatatctctccacgtcaaaaacgaactacgaaaaacgaaaacgaaaacgaataaaccgccgaaccgcgcctaaaaacgaaaacgataaaccgaaccccgcaatcacctacttaacctccaacgctaaaacg

SEQ ID NO: 35439 - DNA, 522 bp, Artificial Sequence
  chemically treated genomic DNA (Homo sapiens) CpG-island No: 35439
aggcgaggtcggggtttagaggttacggggtttagttttcgttttatagatgggtaaattgaggttttaggtttgttttttatatttttagcggggatagcggaggggcgcgtaggggttttacgtggggcggttttggattcggacggcgtattttttttgcggttgggtgggtagttaggtgcgggcggtgtttattagtagttcggcgtttagtagttcgtattcgtagtgatggtttattgcgcggaagggtagtagttattcgtttcgtgggtttcgggttttcgttttcgttcggtttcgtcgtattttggcgttttacgtcgttggttttttagttttcggtttgtaggtgcgtcggtttggacgcgcggattattaggtgttgtatgtttttttacgttaggaacgggttgcggggggcgggggcgggggcgggtgagtcgtcgggtcgcgtttgggggcgagggcggtggatcgggtttcgtagttatttatttggtttttagcgttagggcg

SEQ ID NO: 35440 - DNA, 522 bp, Artificial Sequence
  chemically treated genomic DNA (Homo sapiens) CpG-island No: 35440
cgccctaacgctaaaaaccaaataaataactacgaaacccgatccaccgccctcgcccccaaacgcgacccgacgactcacccgcccccgcccccgccccccgcaacccgttcctaacgtaaaaaaacatacaacacctaataatccgcgcgtccaaaccgacgcacctacaaaccgaaaactaaaaaaccaacgacgtaaaacgccaaaatacgacgaaaccgaacgaaaacgaaaacccgaaacccacgaaacgaataactactacccttccgcgcaataaaccatcactacgaatacgaactactaaacgccgaactactaataaacaccgcccgcacctaactacccacccaaccgcaaaaaaaatacgccgtccgaatccaaaaccgccccacgtaaaacccctacgcgcccctccgctatccccgctaaaaatataaaaaacaaacctaaaacctcaatttacccatctataaaacgaaaactaaaccccgtaacctctaaaccccgacctcgcct

SEQ ID NO: 35441 - DNA, 1104 bp, Artificial Sequence
  chemically treated genomic DNA (Homo sapiens) CpG-island No: 35441
gttttcgtgtacgaagggtgcggagatgggagttttggcgaggttgggatcgtttacgtcgttgtcgaggagggagagttggtcgtcggcgggggtttcggggggttttttggtttttaggttcggggacgtgttggagttggttttgggggcggcgattttttcggtttggattacggcgtcgttggttttgcgcggcgggggttcggtcggggcgttttcgggcgtggagtttcgtagtggtagggtcgtggcgggaagcgtgttgcgtaggatgtggggtacgtttttatttcggatgcgtcgttaggtcgtgttcggcgcggttattttggggagcggtcggggtttttcgtcgttgttgcggcgcgcggcgtcggttgaggtaggggtcgcggggacggcgtcgtcgggtttgcgggttacgttgatgtgcggtagcgacgcgtagcgtttgatagttttcggtcgggcggcgggcgcgcgtataggtaggcgggacgggttttcggaggtggtgcgtcgggtagggcgttcgttagggttgggtcgggtcgcggggggtcgttgtcgggtcggggtcgggttttgtcggggtgtcgttcggagtttttcgtagcgcgaggagtagaggaagacggcgggtagcgcgggtcggtcgcggcggggcgaggcgttttggggggtagaggtcgcggattcggtcgaggatagttcggagcggcggcgtcgtaagttcggcgattttttgatgaaggttagttgtcgtcggaagttcgagcggtcggaggattcgttgtcgttggagagggttgaggttatacgtattaggtttaggcggttttcgcgcgttttcgggttcgtttcggttttcgttcggtttttggggttcggtttcgggattgttcgagttagcggtggcggtttacgtcgggtcggtttttgtatgaacgggattcgtacgggcgatttttgcgttttgtgttgtttcgttagaagggtgcgcgtcggcgttttgggtatcggggaggtttcggggtcgggtagggttttagtagtttgggtgatcggggggcgttttttgggtaggggttgggaggcggg

SEQ ID NO: 35442 - DNA, 1104 bp, Artificial Sequence
  chemically treated genomic DNA (Homo sapiens) CpG-island No: 35442
cccgcctcccaacccctacccaaaaaacgccccccgatcacccaaactactaaaaccctacccgaccccgaaacctccccgatacccaaaacgccgacgcgcacccttctaacgaaacaacacaaaacgcaaaaatcgcccgtacgaatcccgttcatacaaaaaccgacccgacgtaaaccgccaccgctaactcgaacaatcccgaaaccgaaccccaaaaaccgaacgaaaaccgaaacgaacccgaaaacgcgcgaaaaccgcctaaacctaatacgtataacctcaaccctctccaacgacaacgaatcctccgaccgctcgaacttccgacgacaactaaccttcatcaaaaaatcgccgaacttacgacgccgccgctccgaactatcctcgaccgaatccgcgacctctaccccccaaaacgcctcgccccgccgcgaccgacccgcgctacccgccgtcttcctctactcctcgcgctacgaaaaactccgaacgacaccccgacaaaacccgaccccgacccgacaacgaccccccgcgacccgacccaaccctaacgaacgccctacccgacgcaccacctccgaaaacccgtcccgcctacctatacgcgcgcccgccgcccgaccgaaaactatcaaacgctacgcgtcgctaccgcacatcaacgtaacccgcaaacccgacgacgccgtccccgcgacccctacctcaaccgacgccgcgcgccgcaacaacgacgaaaaaccccgaccgctccccaaaataaccgcgccgaacacgacctaacgacgcatccgaaataaaaacgtaccccacatcctacgcaacacgcttcccgccacgaccctaccactacgaaactccacgcccgaaaacgccccgaccgaacccccgccgcgcaaaaccaacgacgccgtaatccaaaccgaaaaaatcgccgcccccaaaaccaactccaacacgtccccgaacctaaaaaccaaaaaaccccccgaaacccccgccgacgaccaactctccctcctcgacaacgacgtaaacgatcccaacctcgccaaaactcccatctccgcacccttcgtacacgaaaac

SEQ ID NO: 35443 - DNA, 1104 bp, Artificial Sequence
  chemically treated genomic DNA (Homo sapiens) CpG-island No: 35443
ttcgttttttagtttttgtttagaaagcgtttttcggttatttaggttgttggggttttgttcggtttcggagttttttcggtgtttaaaacgtcggcgcgtatttttttggcgaagtagtataagacgtagagatcgttcgtgcggatttcgtttatgtagaggtcggttcggcgtgggtcgttatcgttggttcgggtagtttcggagtcgggttttaggggtcgggcggggatcgaggcgggttcgggggcgcgcgggggtcgtttgggtttggtgcgtgtggttttagttttttttagcggtagcgagtttttcgatcgttcgggttttcggcgatagttaatttttattaaggagtcgtcgggtttgcggcgtcgtcgtttcgagttgttttcggtcgagttcgcggtttttgttttttagggcgtttcgtttcgtcgcggtcggttcgcgttgttcgtcgtttttttttgtttttcgcgttgcgaagagtttcgagcggtatttcggtagggttcggtttcggttcggtagcggtttttcgcggttcgatttagttttggcgagcgttttgttcggcgtattattttcgagagttcgtttcgtttgtttgtgcgcgcgttcgtcgttcggtcggagattgttaagcgttacgcgtcgttgtcgtatattagcgtggttcgtaggttcgacggcgtcgttttcgcggtttttgttttagtcgacgtcgcgcgtcgtagtagcgacggggagtttcggtcgttttttagggtggtcgcgtcgggtacgatttggcggcgtattcgagatgaggacgtgttttatattttgcgtagtacgtttttcgttacggttttgttattgcggggttttacgttcgaggacgtttcggtcgggttttcgtcgcgtaagattagcgacgtcgtggtttagatcgaggaggtcgtcgtttttaagattaattttagtacgttttcgagtttggagattagggagtttttcggggttttcgtcggcggttagtttttttttttcggtagcgacgtggacggttttagtttcgttaaggtttttattttcgtatttttcgtgtacgagggt

SEQ ID NO: 35444 - DNA, 1104 bp, Artificial Sequence
  chemically treated genomic DNA (Homo sapiens) CpG-island No: 35444
accctcgtacacgaaaaatacgaaaataaaaaccttaacgaaactaaaaccgtccacgtcgctaccgaaaaaaaaaaactaaccgccgacgaaaaccccgaaaaactccctaatctccaaactcgaaaacgtactaaaattaatcttaaaaacgacgacctcctcgatctaaaccacgacgtcgctaatcttacgcgacgaaaacccgaccgaaacgtcctcgaacgtaaaaccccgcaataacaaaaccgtaacgaaaaacgtactacgcaaaatataaaacacgtcctcatctcgaatacgccgccaaatcgtacccgacgcgaccaccctaaaaaacgaccgaaactccccgtcgctactacgacgcgcgacgtcgactaaaacaaaaaccgcgaaaacgacgccgtcgaacctacgaaccacgctaatatacgacaacgacgcgtaacgcttaacaatctccgaccgaacgacgaacgcgcgcacaaacaaacgaaacgaactctcgaaaataatacgccgaacaaaacgctcgccaaaactaaatcgaaccgcgaaaaaccgctaccgaaccgaaaccgaaccctaccgaaataccgctcgaaactcttcgcaacgcgaaaaacaaaaaaaaacgacgaacaacgcgaaccgaccgcgacgaaacgaaacgccctaaaaaacaaaaaccgcgaactcgaccgaaaacaactcgaaacgacgacgccgcaaacccgacgactccttaataaaaattaactatcgccgaaaacccgaacgatcgaaaaactcgctaccgctaaaaaaaactaaaaccacacgcaccaaacccaaacgacccccgcgcgcccccgaacccgcctcgatccccgcccgacccctaaaacccgactccgaaactacccgaaccaacgataacgacccacgccgaaccgacctctacataaacgaaatccgcacgaacgatctctacgtcttatactacttcgccaaaaaaatacgcgccgacgttttaaacaccgaaaaaactccgaaaccgaacaaaaccccaacaacctaaataaccgaaaaacgctttctaaacaaaaactaaaaaacgaa

SEQ ID NO: 35445 - DNA, 669 bp, Artificial Sequence
  chemically treated genomic DNA (Homo sapiens) CpG-island No: 35445
cgaggcggcgttagagaagttgatcggcgtgtttttcgcggagttagtgtaggagtcgtttttttgggtcggggtcggggcgggtattaatatgtagacgggtacggggagtgcgcggcgatttggtattagcgcggaggttattttgcgtagtcgggtaggtacggcggtttttaggtattttcgtagtagttttagtttttggttcgcggcgtcgcgagggcgagaattcgtgggcgtcggttttttttttcgtcgtcggtgttttgtaaagtggaggtcggcgttttcggcgttttcgtcgcgttcggggtaggtcgagggtagtagtcgtagttttacgttttgttgtacgtagtgttcgtgtaaggttagcgcgttgaggttggaggcgtacgagaagttttcgtttggtttttttacggtaaagcgtacgttgtttgcgtttagtttagatggtagtcggtagcgttttcggtagtcggcgatgtttaggaagcgttttacgtagtttttttattgtaggttgaattgggtggtttcggggggattttgtggcgcgggcgttagcggtggcgttttgtttcggttgggaggtatggtttgttcggggttgtcgggtagttcgttagggttgatggtgtcgttgttttgttcgttgtaaggttt

SEQ ID NO: 35446 - DNA, 669 bp, Artificial Sequence
  chemically treated genomic DNA (Homo sapiens) CpG-island No: 35446
aaaccttacaacgaacaaaacaacgacaccatcaaccctaacgaactacccgacaaccccgaacaaaccatacctcccaaccgaaacaaaacgccaccgctaacgcccgcgccacaaaatccccccgaaaccacccaattcaacctacaataaaaaaactacgtaaaacgcttcctaaacatcgccgactaccgaaaacgctaccgactaccatctaaactaaacgcaaacaacgtacgctttaccgtaaaaaaaccaaacgaaaacttctcgtacgcctccaacctcaacgcgctaaccttacacgaacactacgtacaacaaaacgtaaaactacgactactaccctcgacctaccccgaacgcgacgaaaacgccgaaaacgccgacctccactttacaaaacaccgacgacgaaaaaaaaaaccgacgcccacgaattctcgccctcgcgacgccgcgaaccaaaaactaaaactactacgaaaatacctaaaaaccgccgtacctacccgactacgcaaaataacctccgcgctaataccaaatcgccgcgcactccccgtacccgtctacatattaatacccgccccgaccccgacccaaaaaaacgactcctacactaactccgcgaaaaacacgccgatcaacttctctaacgccgcctcg

SEQ ID NO: 35447 - DNA, 669 bp, Artificial Sequence
  chemically treated genomic DNA (Homo sapiens) CpG-island No: 35447
gaattttgtagcgggtagggtagcggtattattagttttagcgagttgttcgatagtttcggatagattatgttttttagtcggagtaagacgttatcgttggcgttcgcgttatagggttttttcgaggttatttagtttagtttgtagtgggagagttacgtgaagcgttttttggatatcgtcgattgtcgggagcgttgtcggttgttatttgagttggacgtaggtagcgtgcgttttatcgtggagaagttagacgagaatttttcgtgcgtttttagttttagcgcgttggttttgtacgagtattacgtgtagtaggacgtggagttgcggttgttgttttcggtttgtttcgagcgcggcgggggcgtcgggggcgtcggtttttattttgtagggtatcggcggcgggaggaggggtcggcgtttacgggttttcgttttcgcggcgtcgcggattaggagttggaattgttgcgggagtgtttgggagtcgtcgtgtttgttcggttgcgtaaggtggttttcgcgttggtgttaggtcgtcgcgtatttttcgtgttcgtttatatgttggtgttcgtttcggtttcggtttaggaggacgatttttgtattgatttcgcggagggtacgtcggttaatttttttagcgtcgtttcg

SEQ ID NO: 35448 - DNA, 669 bp, Artificial Sequence
  chemically treated genomic DNA (Homo sapiens) CpG-island No: 35448
cgaaacgacgctaaaaaaattaaccgacgtaccctccgcgaaatcaatacaaaaatcgtcctcctaaaccgaaaccgaaacgaacaccaacatataaacgaacacgaaaaatacgcgacgacctaacaccaacgcgaaaaccaccttacgcaaccgaacaaacacgacgactcccaaacactcccgcaacaattccaactcctaatccgcgacgccgcgaaaacgaaaacccgtaaacgccgacccctcctcccgccgccgataccctacaaaataaaaaccgacgcccccgacgcccccgccgcgctcgaaacaaaccgaaaacaacaaccgcaactccacgtcctactacacgtaatactcgtacaaaaccaacgcgctaaaactaaaaacgcacgaaaaattctcgtctaacttctccacgataaaacgcacgctacctacgtccaactcaaataacaaccgacaacgctcccgacaatcgacgatatccaaaaaacgcttcacgtaactctcccactacaaactaaactaaataacctcgaaaaaaccctataacgcgaacgccaacgataacgtcttactccgactaaaaaacataatctatccgaaactatcgaacaactcgctaaaactaataataccgctaccctacccgctacaaaattc

SEQ ID NO: 35449 - DNA, 511 bp, Artificial Sequence
  chemically treated genomic DNA (Homo sapiens) CpG-island No: 35449
atcgtcgtcgttaaagtagttcgaatcggaagtatagttttgggttaggtcgtttaggtgtcgtaggggcggtagcggttttttagtggcggtttcggttgtcggcgggttttgtttttttaggtgttttagcgtttgcgcgaggtgtcgtgcgtttagttcggtttttagcgttcgttgtttgcgtacgtataggttgggtacgtagttgtttggggatacggcggtggcggtcgtttggtgtttggcgggtcgatgggttagtaggttgcgtagggcggcggcgttgtttatggcgattattttgtgtttggagtgtattagattacgtagtatgtttacggcgtttaggttttatagtagtttttggttacgggcgttgcgggtcgataggttttagagcgtgtcgtacgcgttgtttacgatggttaggttgtgcgaagttagatgttgtagtagcgtttgtagatagttgtgatttcggagtatttgtttgtaggtatagggcggg

SEQ ID NO: 35450 - DNA, 511 bp, Artificial Sequence
  chemically treated genomic DNA (Homo sapiens) CpG-island No: 35450
cccgccctatacctacaaacaaatactccgaaatcacaactatctacaaacgctactacaacatctaacttcgcacaacctaaccatcgtaaacaacgcgtacgacacgctctaaaacctatcgacccgcaacgcccgtaaccaaaaactactataaaacctaaacgccgtaaacatactacgtaatctaatacactccaaacacaaaataatcgccataaacaacgccgccgccctacgcaacctactaacccatcgacccgccaaacaccaaacgaccgccaccgccgtatccccaaacaactacgtacccaacctatacgtacgcaaacaacgaacgctaaaaaccgaactaaacgcacgacacctcgcgcaaacgctaaaacacctaaaaaaacaaaacccgccgacaaccgaaaccgccactaaaaaaccgctaccgcccctacgacacctaaacgacctaacccaaaactatacttccgattcgaactactttaacgacgacgat

SEQ ID NO: 35451 - DNA, 511 bp, Artificial Sequence
  chemically treated genomic DNA (Homo sapiens) CpG-island No: 35451
ttcgttttgtgtttataggtaggtgtttcgggattataattgtttgtagacgttgttgtagtatttgatttcgtatagtttgattatcgtgagtaacgcgtgcggtacgttttggaatttgtcggttcgtagcgttcgtgattaggagttgttgtgggatttgggcgtcgtgggtatgttgcgtaatttggtgtattttaagtataagatgatcgttatgggtagcgtcgtcgttttgcgtaatttgttggtttatcggttcgttaagtattaggcggtcgttatcgtcgtgtttttaggtagttgcgtgtttagtttgtacgtgcgtaagtagcgggcgttggaggtcgagttggacgtacggtatttcgcgtaggcgttggagtatttggagaagtagggttcgtcggtagtcgaggtcgttattaagaagtcgttgtcgtttttgcgatatttggacggtttggtttaagattatgttttcgattcgggttgttttgacgacgacgat

SEQ ID NO: 35452 - DNA, 511 bp, Artificial Sequence
  chemically treated genomic DNA (Homo sapiens) CpG-island No: 35452
atcgtcgtcgtcaaaacaacccgaatcgaaaacataatcttaaaccaaaccgtccaaatatcgcaaaaacgacaacgacttcttaataacgacctcgactaccgacgaaccctacttctccaaatactccaacgcctacgcgaaataccgtacgtccaactcgacctccaacgcccgctacttacgcacgtacaaactaaacacgcaactacctaaaaacacgacgataacgaccgcctaatacttaacgaaccgataaaccaacaaattacgcaaaacgacgacgctacccataacgatcatcttatacttaaaatacaccaaattacgcaacatacccacgacgcccaaatcccacaacaactcctaatcacgaacgctacgaaccgacaaattccaaaacgtaccgcacgcgttactcacgataatcaaactatacgaaatcaaatactacaacaacgtctacaaacaattataatcccgaaacacctacctataaacacaaaacgaa

SEQ ID NO: 35453 - DNA, 507 bp, Artificial Sequence
  chemically treated genomic DNA (Homo sapiens) CpG-island No: 35453
ggtcgcgtttttgttttttttttcgaggatatatattcgtttacgtgtagttgggttggcggggcgtttgggtttggggttttttttttttgcgcggtttcgcgggttttatcggaaatttcggttcggggtggtttcggagcgcgcgggtttcggggttttcgcggcgcgggtaggggtttcggggcggataaagttcggttcgggtttgggtaggcggcgttgtcgtttttagcgttgggcgagattatcgcgagcgggggaggatgcgggatgagggatgcgggtgagatagttaatgagggcgcgggaagacgggttggtgttatggtaatagttaatggcggttcggggcggggatcggcgtcggtcgcggggcgtcgggttttcgcgcgggtttaggggtcgtgagtgcggggggcgaaattttttcgagggaagggggtgtttcgaggattaagatttttgtgtttcgtattttattgtagggtgtaacggttttttaaa

SEQ ID NO: 35454 - DNA, 507 bp, Artificial Sequence
  chemically treated genomic DNA (Homo sapiens) CpG-island No: 35454
tttaaaaaaccgttacaccctacaataaaatacgaaacacaaaaatcttaatcctcgaaacacccccttccctcgaaaaaatttcgccccccgcactcacgacccctaaacccgcgcgaaaacccgacgccccgcgaccgacgccgatccccgccccgaaccgccattaactattaccataacaccaacccgtcttcccgcgccctcattaactatctcacccgcatccctcatcccgcatcctcccccgctcgcgataatctcgcccaacgctaaaaacgacaacgccgcctacccaaacccgaaccgaactttatccgccccgaaacccctacccgcgccgcgaaaaccccgaaacccgcgcgctccgaaaccaccccgaaccgaaatttccgataaaacccgcgaaaccgcgcaaaaaaaaaaaaccccaaacccaaacgccccgccaacccaactacacgtaaacgaatatatatcctcgaaaaaaaaaacaaaaacgcgacc

SEQ ID NO: 35455 - DNA, 507 bp, Artificial Sequence
  chemically treated genomic DNA (Homo sapiens) CpG-island No: 35455
tttaagaggtcgttgtattttgtaataaagtgcgggatataggaattttggttttcggggtatttttttttttcgggggggtttcgtttttcgtatttacggtttttgagttcgcgcggaggttcgacgtttcgcggtcgacgtcggttttcgtttcgggtcgttattggttgttgttatggtattagttcgttttttcgcgtttttattggttgttttattcgtattttttatttcgtattttttttcgttcgcggtggtttcgtttagcgttaggagcggtagcgtcgtttgtttaggttcggatcgggttttgttcgtttcggagtttttgttcgcgtcgcggagatttcggagttcgcgcgtttcgaggttatttcgggtcgggattttcggtggggttcgcggagtcgcgtagagggaggaggttttagatttaggcgtttcgttagtttagttgtacgtaagcgggtgtgtgttttcggggaggagggtaggggcgcgatt

SEQ ID NO: 35456 - DNA, 507 bp, Artificial Sequence
  chemically treated genomic DNA (Homo sapiens) CpG-island No: 35456
aatcgcgcccctaccctcctccccgaaaacacacacccgcttacgtacaactaaactaacgaaacgcctaaatctaaaacctcctccctctacgcgactccgcgaaccccaccgaaaatcccgacccgaaataacctcgaaacgcgcgaactccgaaatctccgcgacgcgaacaaaaactccgaaacgaacaaaacccgatccgaacctaaacaaacgacgctaccgctcctaacgctaaacgaaaccaccgcgaacgaaaaaaaatacgaaataaaaaatacgaataaaacaaccaataaaaacgcgaaaaaacgaactaataccataacaacaaccaataacgacccgaaacgaaaaccgacgtcgaccgcgaaacgtcgaacctccgcgcgaactcaaaaaccgtaaatacgaaaaacgaaacccccccgaaaaaaaaaaataccccgaaaaccaaaattcctatatcccgcactttattacaaaatacaacgacctcttaaa

SEQ ID NO: 35457 - DNA, 1043 bp, Artificial Sequence
  chemically treated genomic DNA (Homo sapiens) CpG-island No: 35457
gtcgttttagttggcgtagttttcgcgtcggcgtagtgaggaggggttcgagggttttttgtagaggtcgagggttgggttgggcgagttttgcgtttgcgtagattcggggttgggggtcgtagcggcgtacgagaggggtttttattttcgttagtttttcgaggcggtttttcggtaacggtttttacggcgacggtattagattttcgattttgtagttttcgcgcgttcgttttatgcgtttttcgtcgtcgcgttcgttgttttcgcggtgtggatttcgtttcgtttttgcgcggttcggagttttttttaacggttcgatttacgcgttttatttggttttcgaagaaggtcgagtgtagtaggtttaggagttttaggagttttatggagtcgcggtcgtttcggattcgtcgcgtttcgtttttcggcggttagggtgggggtgcgggacgcgaacggggtcgttttgcgtttgcgcggagaggggcgggaggggttagttcgcgggttcggggcggggtttttttcgaaaggggcgagggcgtatcgtggggtttgggggtgttcgcgggggttggggagtttcgcgggatcgaggttgcggaggggcggtgggagatttaaggatgggagagaggggaggggattcgcgtgggtcgagcggcgttagggttcgggttcgattacgttggggagttcgaatgcggaggaggttgggggggttcgaggcggcggggaggaggtcgggtgggggtgggggtacgagaggttttacggggaatgggggtcgcggggggttagaggcggcgtcgttatgcggttgtggttcgttgttcgcggacggttattttgcggaagttcggaattattttcgaattagttcggtttggcgcgttgaggtttattagttatttagtaaatattatttgcgcgtataaggtttgttgggcgtcgagttgggcgcgcggggggtcgtcgtaagggggcgatatcgaacgcggatatttatgtaataagtatttataaagtattta

SEQ ID NO: 35458 - DNA, 1043 bp, Artificial Sequence
  chemically treated genomic DNA (Homo sapiens) CpG-island No: 35458
taaatactttataaatacttattacataaatatccgcgttcgatatcgcccccttacgacgaccccccgcgcgcccaactcgacgcccaacaaaccttatacgcgcaaataatatttactaaataactaataaacctcaacgcgccaaaccgaactaattcgaaaataattccgaacttccgcaaaataaccgtccgcgaacaacgaaccacaaccgcataacgacgccgcctctaaccccccgcgacccccattccccgtaaaacctctcgtacccccacccccacccgacctcctccccgccgcctcgaacccccccaacctcctccgcattcgaactccccaacgtaatcgaacccgaaccctaacgccgctcgacccacgcgaatcccctcccctctctcccatccttaaatctcccaccgcccctccgcaacctcgatcccgcgaaactccccaacccccgcgaacacccccaaaccccacgatacgccctcgcccctttcgaaaaaaaccccgccccgaacccgcgaactaacccctcccgcccctctccgcgcaaacgcaaaacgaccccgttcgcgtcccgcacccccaccctaaccgccgaaaaacgaaacgcgacgaatccgaaacgaccgcgactccataaaactcctaaaactcctaaacctactacactcgaccttcttcgaaaaccaaataaaacgcgtaaatcgaaccgttaaaaaaaactccgaaccgcgcaaaaacgaaacgaaatccacaccgcgaaaacaacgaacgcgacgacgaaaaacgcataaaacgaacgcgcgaaaactacaaaatcgaaaatctaataccgtcgccgtaaaaaccgttaccgaaaaaccgcctcgaaaaactaacgaaaataaaaacccctctcgtacgccgctacgacccccaaccccgaatctacgcaaacgcaaaactcgcccaacccaaccctcgacctctacaaaaaaccctcgaacccctcctcactacgccgacgcgaaaactacgccaactaaaacgac

SEQ ID NO: 35459 - DNA, 1043 bp, Artificial Sequence
  chemically treated genomic DNA (Homo sapiens) CpG-island No: 35459
taggtgttttataaatgtttgttgtatgaatgttcgcgttcggtgtcgtttttttacggcggtttttcgcgcgtttagttcggcgtttagtaagttttgtgcgcgtaggtgatgtttgttgaatgattaatgaattttagcgcgttaagtcgggttgattcgggggtggtttcgagttttcgtagggtgatcgttcgcgggtagcggattatagtcgtatggcgacgtcgtttttggtttttcgcgatttttatttttcgtgggatttttcgtgtttttatttttattcggtttttttttcgtcgtttcgggtttttttagtttttttcgtattcgaattttttagcgtggtcggattcggattttggcgtcgttcggtttacgcgagttttttttttttttttttatttttggattttttatcgttttttcgtagtttcggtttcgcgagattttttagttttcgcgagtatttttagattttacggtacgttttcgtttttttcgggaggagtttcgtttcgggttcgcggattgatttttttcgttttttttcgcgtaggcgtagggcggtttcgttcgcgtttcgtatttttattttggtcgtcgaggggcggggcgcggcgggttcggggcggtcgcggttttatggggtttttggggtttttgagtttgttgtattcggtttttttcggggattaggtagggcgcgtgggtcgagtcgttggggagggtttcgggtcgcgtaggaacggggcggggtttatatcgcgggaatagcgggcgcggcggcggggggcgtatggggcgagcgcgcggaggttgtagagtcgggggtttagtgtcgtcgtcgtagagatcgttgtcgggaaatcgtttcggaaggttggcggggatggaagtttttttcgtgcgtcgttgcgatttttagtttcgggtttgcgtaagcgtagggttcgtttagtttagttttcggtttttgtaggagattttcggatttttttttattgcgtcgacgcggaggttgcgttagttggggcggt

SEQ ID NO: 35460 - DNA, 1043 bp, Artificial Sequence
  chemically treated genomic DNA (Homo sapiens) CpG-island No: 35460
accgccccaactaacgcaacctccgcgtcgacgcaataaaaaaaaatccgaaaatctcctacaaaaaccgaaaactaaactaaacgaaccctacgcttacgcaaacccgaaactaaaaatcgcaacgacgcacgaaaaaaacttccatccccgccaaccttccgaaacgatttcccgacaacgatctctacgacgacgacactaaacccccgactctacaacctccgcgcgctcgccccatacgccccccgccgccgcgcccgctattcccgcgatataaaccccgccccgttcctacgcgacccgaaaccctccccaacgactcgacccacgcgccctacctaatccccgaaaaaaaccgaatacaacaaactcaaaaaccccaaaaaccccataaaaccgcgaccgccccgaacccgccgcgccccgcccctcgacgaccaaaataaaaatacgaaacgcgaacgaaaccgccctacgcctacgcgaaaaaaaacgaaaaaaatcaatccgcgaacccgaaacgaaactcctcccgaaaaaaacgaaaacgtaccgtaaaatctaaaaatactcgcgaaaactaaaaaatctcgcgaaaccgaaactacgaaaaaacgataaaaaatccaaaaataaaaaaaaaaaaaaaaaactcgcgtaaaccgaacgacgccaaaatccgaatccgaccacgctaaaaaattcgaatacgaaaaaaactaaaaaaacccgaaacgacgaaaaaaaaaccgaataaaaataaaaacacgaaaaatcccacgaaaaataaaaatcgcgaaaaaccaaaaacgacgtcgccatacgactataatccgctacccgcgaacgatcaccctacgaaaactcgaaaccacccccgaatcaacccgacttaacgcgctaaaattcattaatcattcaacaaacatcacctacgcgcacaaaacttactaaacgccgaactaaacgcgcgaaaaaccgccgtaaaaaaacgacaccgaacgcgaacattcatacaacaaacatttataaaacaccta

SEQ ID NO: 35461 - DNA, 893 bp, Artificial Sequence
  chemically treated genomic DNA (Homo sapiens) CpG-island No: 35461
taacggggggtaggttgtaaataagtaaaaattttaacgtttttggatagttttttgggcgtaagattatatttagttttaaattcgcgcggagatcgtgttcgtttatcgtcgtagaggcgtttggattttcgtttcgtcgtttttattcggataagttttatcgttggtttagtttttgttcgcgattttcgcggtcgtttttattaggatatgtttagtagttggtcgaggtttacgtcgcggtaggtgaatttgcggaaggttcgtttttttttttgttttatttttgtttgtgcgggcgcggatcgggcgttagcgggatttcgatatttatttttcggggttatcgggttcgaggatatcgcggaagacgcgcggcgtcgtcggggatagaagttcgatagggatatatcgtttcgattcgttttcggggattattcgcggtttcgggttacgaggattcggatatgaaggttcggataggtttttttagtttcgcgtcgtttcgatatttattaagttcgtttttcgttttaatatttagtcgtttgtagggtcgggagtaagtcgtcgtagtcgcggggacgaattgcggttttcgcgagacggttagaggttggatggagtcggataggttcggtagagacgcgttaaatcgtaatatttattattttgtcggatttttagaagagatcgttttggttcgcgtttgcgtagttatcgcgagattgtcggtatgtttcgttttttcggtcgtgcgcgtatacgcgttttcgttttttcggcggcgaatacgcgttttttgtcgtttggagggtaaaatataggttgtagggattagagtagtcgtcgtttgaggtttgtagagtcgttttttttacggagtggga

SEQ ID NO: 35462 - DNA, 893 bp, Artificial Sequence
  chemically treated genomic DNA (Homo sapiens) CpG-island No: 35462
tcccactccgtaaaaaaaacgactctacaaacctcaaacgacgactactctaatccctacaacctatattttaccctccaaacgacaaaaaacgcgtattcgccgccgaaaaaacgaaaacgcgtatacgcgcacgaccgaaaaaacgaaacataccgacaatctcgcgataactacgcaaacgcgaaccaaaacgatctcttctaaaaatccgacaaaataataaatattacgatttaacgcgtctctaccgaacctatccgactccatccaacctctaaccgtctcgcgaaaaccgcaattcgtccccgcgactacgacgacttactcccgaccctacaaacgactaaatattaaaacgaaaaacgaacttaataaatatcgaaacgacgcgaaactaaaaaaacctatccgaaccttcatatccgaatcctcgtaacccgaaaccgcgaataatccccgaaaacgaatcgaaacgatatatccctatcgaacttctatccccgacgacgccgcgcgtcttccgcgatatcctcgaacccgataaccccgaaaaataaatatcgaaatcccgctaacgcccgatccgcgcccgcacaaacaaaaataaaacaaaaaaaaaaacgaaccttccgcaaattcacctaccgcgacgtaaacctcgaccaactactaaacatatcctaataaaaacgaccgcgaaaatcgcgaacaaaaactaaaccaacgataaaacttatccgaataaaaacgacgaaacgaaaatccaaacgcctctacgacgataaacgaacacgatctccgcgcgaatttaaaactaaatataatcttacgcccaaaaaactatccaaaaacgttaaaatttttacttatttacaacctaccccccgtta

SEQ ID NO: 35463 - DNA, 893 bp, Artificial Sequence
  chemically treated genomic DNA (Homo sapiens) CpG-island No: 35463
ttttatttcgtggaggaagcggttttgtagattttaggcggcggttgttttaatttttgtagtttgtgttttgttttttagacggtagagggcgcgtgttcgtcgtcgggaaagcggaagcgcgtgtgcgcgtacggtcgagggggcgggatatgtcggtagtttcgcgataattgcgtaggcgcggattaaagcgattttttttgaggattcggtaagatggtgagtgttgcgatttggcgcgtttttgtcgggtttattcggttttatttaatttttgatcgtttcgcgggggtcgtagttcgttttcgcggttacggcggtttgttttcgattttgtaggcggttggatgttggggcgaggggcggatttggtgggtgtcgggacgacgcggggttgggaaggtttgttcgggtttttatgttcgggttttcgtaattcggagtcgcgagtgattttcggggacgggtcgaagcggtgtgtttttgtcgggtttttgttttcggcggcgtcgcgcgtttttcgcggtgttttcgggttcggtggtttcgggagatgggtgtcgggatttcgttgacgttcgattcgcgttcgtataggtagaagtagagtagaagaagaagcggatttttcgtaagtttatttatcgcggcgtggatttcgattagttgttggatatgttttagtaagggcggtcgcgggggtcgcgggtaggggttgggttagcggtggggtttgttcgggtgagggcggcggggcgggggtttaagcgtttttgcggcggtgggcgggtacggttttcgcgcgggtttggaattgagtgtggttttgcgtttagaaaattgtttagagacgttgaggtttttgtttatttgtaatttgtttttcgttg

SEQ ID NO: 35464 - DNA, 893 bp, Artificial Sequence
  chemically treated genomic DNA (Homo sapiens) CpG-island No: 35464
caacgaaaaacaaattacaaataaacaaaaacctcaacgtctctaaacaattttctaaacgcaaaaccacactcaattccaaacccgcgcgaaaaccgtacccgcccaccgccgcaaaaacgcttaaacccccgccccgccgccctcacccgaacaaaccccaccgctaacccaacccctacccgcgacccccgcgaccgcccttactaaaacatatccaacaactaatcgaaatccacgccgcgataaataaacttacgaaaaatccgcttcttcttctactctacttctacctatacgaacgcgaatcgaacgtcaacgaaatcccgacacccatctcccgaaaccaccgaacccgaaaacaccgcgaaaaacgcgcgacgccgccgaaaacaaaaacccgacaaaaacacaccgcttcgacccgtccccgaaaatcactcgcgactccgaattacgaaaacccgaacataaaaacccgaacaaaccttcccaaccccgcgtcgtcccgacacccaccaaatccgcccctcgccccaacatccaaccgcctacaaaatcgaaaacaaaccgccgtaaccgcgaaaacgaactacgacccccgcgaaacgatcaaaaattaaataaaaccgaataaacccgacaaaaacgcgccaaatcgcaacactcaccatcttaccgaatcctcaaaaaaaatcgctttaatccgcgcctacgcaattatcgcgaaactaccgacatatcccgccccctcgaccgtacgcgcacacgcgcttccgctttcccgacgacgaacacgcgccctctaccgtctaaaaaacaaaacacaaactacaaaaattaaaacaaccgccgcctaaaatctacaaaaccgcttcctccacgaaataaaa

SEQ ID NO: 35465 - DNA, 680 bp, Artificial Sequence
  chemically treated genomic DNA (Homo sapiens) CpG-island No: 35465
ggggtgagtgttcgtcgtcgtgacgttcggggtggttttatgagtgtgcgcgtggggtgagtgttcgtcgtcgtgacgttcggggtggttttatgagtgtgcgcgtggggtgagtgttcgtcgtcgtgacgttcggggtggttttatgagtgtgcgcgtggggtgagtgttcgtcgtcgtgacgttcggggtggttttatgagtgtgcgcgtggggtgagtgttcgtcgtcgtgacgttcgggatggttttatgagtgtgcgcgtggggtgagtgttcgttgtcgtgattgtagggatggttttatgagtgtgcgcgtggggtgagtgttcgtcgtcgtgattgtagggatggttttatgagtgtgcgcgtggggtgagtgttcgtcgtcgtgattgtagggatggttttatgagtgtgcgcgtggggtgagtgttcgttgtcgttgacgatcgggatggttttatgagtgtgtgcgtggggtgagtgttcgttgtcgtgacggtcgggatggttttacgagtgtgtgcgtggggtgagtgttcgttgtcgtgacggttgggatggttttatgagtgtgtgcgtggggtgagtgttcgttgtcgtgacggtcgggatggttttatgagtgtttgtatgggttagaattattaagtggtgtagtttattacgtgtttatta

SEQ ID NO: 35466 - DNA, 680 bp, Artificial Sequence
  chemically treated genomic DNA (Homo sapiens) CpG-island No: 35466
taataaacacgtaataaactacaccacttaataattctaacccatacaaacactcataaaaccatcccgaccgtcacgacaacgaacactcaccccacgcacacactcataaaaccatcccaaccgtcacgacaacgaacactcaccccacgcacacactcgtaaaaccatcccgaccgtcacgacaacgaacactcaccccacgcacacactcataaaaccatcccgatcgtcaacgacaacgaacactcaccccacgcgcacactcataaaaccatccctacaatcacgacgacgaacactcaccccacgcgcacactcataaaaccatccctacaatcacgacgacgaacactcaccccacgcgcacactcataaaaccatccctacaatcacgacaacgaacactcaccccacgcgcacactcataaaaccatcccgaacgtcacgacgacgaacactcaccccacgcgcacactcataaaaccaccccgaacgtcacgacgacgaacactcaccccacgcgcacactcataaaaccaccccgaacgtcacgacgacgaacactcaccccacgcgcacactcataaaaccaccccgaacgtcacgacgacgaacactcaccccacgcgcacactcataaaaccaccccgaacgtcacgacgacgaacactcacccc

SEQ ID NO: 35467 - DNA, 680 bp, Artificial Sequence
  chemically treated genomic DNA (Homo sapiens) CpG-island No: 35467
taatgggtacgtagtaaattgtattatttgatgattttgatttatataaatatttatgaaattatttcgatcgttacggtagcgagtatttattttacgtatatatttatgaaattattttaatcgttacggtagcgagtatttattttacgtatatattcgtgaaattatttcgatcgttacggtagcgagtatttattttacgtatatatttatgaaattatttcgatcgttaacggtagcgagtatttattttacgcgtatatttatgaaattatttttatagttacggcggcgagtatttattttacgcgtatatttatgaaattatttttatagttacggcggcgagtatttattttacgcgtatatttatgaaattatttttatagttacggtagcgagtatttattttacgcgtatatttatgaaattatttcgaacgttacggcggcgagtatttattttacgcgtatatttatgaaattatttcgaacgttacggcggcgagtatttattttacgcgtatatttatgaaattatttcgaacgttacggcggcgagtatttattttacgcgtatatttatgaaattatttcgaacgttacggcggcgagtatttattttacgcgtatatttatgaaattatttcgaacgttacggcggcgagtatttatttt

SEQ ID NO: 35468 - DNA, 680 bp, Artificial Sequence
  chemically treated genomic DNA (Homo sapiens) CpG-island No: 35468
aaaataaatactcgccgccgtaacgttcgaaataatttcataaatatacgcgtaaaataaatactcgccgccgtaacgttcgaaataatttcataaatatacgcgtaaaataaatactcgccgccgtaacgttcgaaataatttcataaatatacgcgtaaaataaatactcgccgccgtaacgttcgaaataatttcataaatatacgcgtaaaataaatactcgccgccgtaacgttcgaaataatttcataaatatacgcgtaaaataaatactcgctaccgtaactataaaaataatttcataaatatacgcgtaaaataaatactcgccgccgtaactataaaaataatttcataaatatacgcgtaaaataaatactcgccgccgtaactataaaaataatttcataaatatacgcgtaaaataaatactcgctaccgttaacgatcgaaataatttcataaatatatacgtaaaataaatactcgctaccgtaacgatcgaaataatttcacgaatatatacgtaaaataaatactcgctaccgtaacgattaaaataatttcataaatatatacgtaaaataaatactcgctaccgtaacgatcgaaataatttcataaatatttatataaatcaaaatcatcaaataatacaatttactacgtacccatta

SEQ ID NO: 35469 - DNA, 1330 bp, Artificial Sequence
  chemically treated genomic DNA (Homo sapiens) CpG-island No: 35469
ttatatcgtgacgttcgggcgcgataaggagtcggtgttcgcggttattgggatgttcgagaacgtggatcgcgcgcgcgaggagatcgaggcgtatattacgttgcgtattggcgtttttatcgacgcgggtttcgatagcgatttttacgttaacggtatcgacgtttgtttggatttgttcggggcggtcgttagtttttgggttaagatttttaattagggacgacggttttttacggttacggtcggttttcgcggggatacggttttgggcgtttttagcgttttcgaggttttttacgcgggtagtcgcggcggttttttcgtgtcggatttaggtttcgttagtttttatagcggtttcggtaacgggggtttcgttttcggcgcggagggtttcggtgtttcggtggggacggtcgttttcgacgattgcgatttcggtttcgatttcgattttttggcgttggatttgatcgtgttcgtcgcggttattatttgggcgttttttgagcgcgtcgtttttttgttcgtttttagcggttgttttacggttaacggagtttcgggatttttcgtcgtcggcgttcggcgtagtagtggggtcgggatttttcgttattcgtttacgttgttcgagttcggcggttttcgtttggagttttcgttgtttcgtcgtggcgtttcggattcggtgggcgcgttgttttggcgattttcgtagggtttcgtattttttttaggcggcgtcgttttttttacggttatttcgttgtttagtagtttcgcggtcgtcgtttgcgtttttttggatttcggcgttttcgagaatagtcgtaagtttttttcggcgttttcggtttcggttttggcgcgagagtgcgtggtgtgcgtcgagggcgaggtgatggttgcgttggttttttgcggttataattttttttgtatggattgcgtcgttcgtatttgcggtaagagcgagttcgagtgtttcgtttgtcgtacgtcggttatttaggttatttatatttttttttagagcgcggattattacgtggtcggggttatttgcgggggttaggggtgggcgcgggagacggggcgggattcggggtgggagagggacggggagggggcgaggggcggaggtcgagggggtaggggggtgggcggcggttagtgtttatagatgagttttaattgtcgttttaggcgtggagacggagatttcgtagttcggcggcgttttagttttttaacgatagtattgagtggttaggttataataaatcggagagaaaaggttcgtttgtattttttttagttt

SEQ ID NO: 35470 - DNA, 1330 bp, Artificial Sequence
  chemically treated genomic DNA (Homo sapiens) CpG-island No: 35470
aaactaaaaaaaatacaaacgaaccttttctctccgatttattataacctaaccactcaatactatcgttaaaaaactaaaacgccgccgaactacgaaatctccgtctccacgcctaaaacgacaattaaaactcatctataaacactaaccgccgcccacccccctaccccctcgacctccgcccctcgccccctccccgtccctctcccaccccgaatcccgccccgtctcccgcgcccacccctaacccccgcaaataaccccgaccacgtaataatccgcgctctaaaaaaaaatataaataacctaaataaccgacgtacgacaaacgaaacactcgaactcgctcttaccgcaaatacgaacgacgcaatccatacaaaaaaaattataaccgcaaaaaaccaacgcaaccatcacctcgccctcgacgcacaccacgcactctcgcgccaaaaccgaaaccgaaaacgccgaaaaaaacttacgactattctcgaaaacgccgaaatccaaaaaaacgcaaacgacgaccgcgaaactactaaacaacgaaataaccgtaaaaaaaacgacgccgcctaaaaaaaatacgaaaccctacgaaaatcgccaaaacaacgcgcccaccgaatccgaaacgccacgacgaaacaacgaaaactccaaacgaaaaccgccgaactcgaacaacgtaaacgaataacgaaaaatcccgaccccactactacgccgaacgccgacgacgaaaaatcccgaaactccgttaaccgtaaaacaaccgctaaaaacgaacaaaaaaacgacgcgctcaaaaaacgcccaaataataaccgcgacgaacacgatcaaatccaacgccaaaaaatcgaaatcgaaaccgaaatcgcaatcgtcgaaaacgaccgtccccaccgaaacaccgaaaccctccgcgccgaaaacgaaacccccgttaccgaaaccgctataaaaactaacgaaacctaaatccgacacgaaaaaaccgccgcgactacccgcgtaaaaaacctcgaaaacgctaaaaacgcccaaaaccgtatccccgcgaaaaccgaccgtaaccgtaaaaaaccgtcgtccctaattaaaaatcttaacccaaaaactaacgaccgccccgaacaaatccaaacaaacgtcgataccgttaacgtaaaaatcgctatcgaaacccgcgtcgataaaaacgccaatacgcaacgtaatatacgcctcgatctcctcgcgcgcgcgatccacgttctcgaacatcccaataaccgcgaacaccgactccttatcgcgcccgaacgtcacgatataa

SEQ ID NO: 35471 - DNA, 1330 bp, Artificial Sequence
  chemically treated genomic DNA (Homo sapiens) CpG-island No: 35471
aaattaaaaaaagtgtaagcggatttttttttttcggtttattgtaatttgattatttaatattgtcgttgaagggttgaggcgtcgtcgggttgcggggttttcgtttttacgtttgaggcggtagttaaagtttatttgtaaatattggtcgtcgtttatttttttgttttttcggttttcgtttttcgtttttttttcgttttttttttatttcgggtttcgtttcgtttttcgcgtttatttttggttttcgtagatggtttcggttacgtggtggttcgcgttttaggaaaagatatgaatggtttgggtggtcggcgtgcggtaggcgggatattcgggttcgtttttgtcgtagatgcggacggcgtagtttatgtagaagaggttgtggtcgtaggggattagcgtagttattatttcgttttcggcgtatattacgtattttcgcgttagggtcggggtcgaggacgtcgaagggggtttgcggttgttttcggaggcgtcggagtttaggggggcgtaggcggcggtcgcggggttgttgggtagcgaggtggtcgtggagaaggcggcgtcgtttgggaaggatacggggttttgcgggggtcgttaggatagcgcgtttatcgggttcggggcgttacggcgagatagcgggagttttaggcggaggtcgtcgggttcgggtagcgtgggcgagtggcggggggtttcggttttattgttgcgtcgggcgtcggcggcgggaggtttcggggtttcgttgatcgtggagtagtcgttgaaggcgggtaagggggcggcgcgtttaaaaggcgtttagatggtggtcgcggcgggtacggttaggtttagcgttaggaagtcgaagtcgaagtcgaagtcgtagtcgtcgggggcggtcgtttttatcggggtatcgggatttttcgcgtcgaaggcgaagttttcgttgtcggagtcgttgtaggggttggcggggtttgggttcggtacggaggggtcgtcgcggttgttcgcgtagaaggtttcgggggcgttgggggcgtttagggtcgtgttttcgcggaggtcggtcgtggtcgtggggggtcgtcgtttttggttgggggttttggtttagaggttggcggtcgtttcgagtaggtttaggtagacgtcggtgtcgttggcgtggaagtcgttgtcggggttcgcgtcggtgaaggcgttagtgcgtagcgtgatgtgcgtttcgattttttcgcgcgcgcggtttacgttttcgggtattttagtgatcgcgaatatcggttttttgtcgcgttcgggcgttacgatgtag

SEQ ID NO: 35472 - DNA, 1330 bp, Artificial Sequence
  chemically treated genomic DNA (Homo sapiens) CpG-island No: 35472
ctacatcgtaacgcccgaacgcgacaaaaaaccgatattcgcgatcactaaaatacccgaaaacgtaaaccgcgcgcgcgaaaaaatcgaaacgcacatcacgctacgcactaacgccttcaccgacgcgaaccccgacaacgacttccacgccaacgacaccgacgtctacctaaacctactcgaaacgaccgccaacctctaaaccaaaacccccaaccaaaaacgacgaccccccacgaccacgaccgacctccgcgaaaacacgaccctaaacgcccccaacgcccccgaaaccttctacgcgaacaaccgcgacgacccctccgtaccgaacccaaaccccgccaacccctacaacgactccgacaacgaaaacttcgccttcgacgcgaaaaatcccgataccccgataaaaacgaccgcccccgacgactacgacttcgacttcgacttcgacttcctaacgctaaacctaaccgtacccgccgcgaccaccatctaaacgccttttaaacgcgccgcccccttacccgccttcaacgactactccacgatcaacgaaaccccgaaacctcccgccgccgacgcccgacgcaacaataaaaccgaaaccccccgccactcgcccacgctacccgaacccgacgacctccgcctaaaactcccgctatctcgccgtaacgccccgaacccgataaacgcgctatcctaacgacccccgcaaaaccccgtatccttcccaaacgacgccgccttctccacgaccacctcgctacccaacaaccccgcgaccgccgcctacgcccccctaaactccgacgcctccgaaaacaaccgcaaacccccttcgacgtcctcgaccccgaccctaacgcgaaaatacgtaatatacgccgaaaacgaaataataactacgctaatcccctacgaccacaacctcttctacataaactacgccgtccgcatctacgacaaaaacgaacccgaatatcccgcctaccgcacgccgaccacccaaaccattcatatcttttcctaaaacgcgaaccaccacgtaaccgaaaccatctacgaaaaccaaaaataaacgcgaaaaacgaaacgaaacccgaaataaaaaaaaaacgaaaaaaaaacgaaaaacgaaaaccgaaaaaacaaaaaaataaacgacgaccaatatttacaaataaactttaactaccgcctcaaacgtaaaaacgaaaaccccgcaacccgacgacgcctcaacccttcaacgacaatattaaataatcaaattacaataaaccgaaaaaaaaaaatccgcttacactttttttaattt

SEQ ID NO: 35473 - DNA, 710 bp, Artificial Sequence
  chemically treated genomic DNA (Homo sapiens) CpG-island No: 35473
gtatttaatcgtatttttggcgttagcgtcggaaaataacggtatcggtagttacgatttggcgatgaattttggtattcggggtttgaattcgcgtttcgttagtcgttcgatcgttttgatggacggtattttcgtttttttcgttttttacggttagtcgtagtttttattggttttcgtttcgttcggtaatatggatgttattgacgtggtacgcggtggtggtgcggtgcgttacggatcgtagagcgtgggcgtcgtggtgaattttgttattcgtgttatttcgtagattttggtatcgaggcgggcgtggaaggttagtttagtttaatttttttataaaataattcgaaagagacgtataatttgatggtgggcggtatagcggataacggttttggtaacggttgttttatttcggtacgcgcggtagtgatttgcgcgagtatagcgttattcgtatcgacgatttgatgttgaaaagtaaatatgcgtcggatgaggtgtatatttttaatagtttgttgtaatattacgacggtgaagtcgatacgttcggtggtttgtttcgcgcggattacgacgtcgatcgttggtaatttattcgttcgtatgatcgtttttggggtcgtcgtaagttggcgagtttgggttattagttttagttagatagttagtataaatttaatatttaggggttttat

SEQ ID NO: 35474 - DNA, 710 bp, Artificial Sequence
  chemically treated genomic DNA (Homo sapiens) CpG-island No: 35474
ataaaacccctaaatattaaatttatactaactatctaactaaaactaataacccaaactcgccaacttacgacgaccccaaaaacgatcatacgaacgaataaattaccaacgatcgacgtcgtaatccgcgcgaaacaaaccaccgaacgtatcgacttcaccgtcgtaatattacaacaaactattaaaaatatacacctcatccgacgcatatttacttttcaacatcaaatcgtcgatacgaataacgctatactcgcgcaaatcactaccgcgcgtaccgaaataaaacaaccgttaccaaaaccgttatccgctataccgcccaccatcaaattatacgtctctttcgaattattttataaaaaaattaaactaaactaaccttccacgcccgcctcgataccaaaatctacgaaataacacgaataacaaaattcaccacgacgcccacgctctacgatccgtaacgcaccgcaccaccaccgcgtaccacgtcaataacatccatattaccgaacgaaacgaaaaccaataaaaactacgactaaccgtaaaaaacgaaaaaaacgaaaataccgtccatcaaaacgatcgaacgactaacgaaacgcgaattcaaaccccgaataccaaaattcatcgccaaatcgtaactaccgataccgttattttccgacgctaacgccaaaaatacgattaaatac

SEQ ID NO: 35475 - DNA, 710 bp, Artificial Sequence
  chemically treated genomic DNA (Homo sapiens) CpG-island No: 35475
gtagaatttttgaatgttgaatttatgttggttgtttggttggaattggtagtttaggttcgttagtttgcgacgattttagaagcggttatacgggcgggtggattgttagcgatcggcgtcgtaattcgcgcgagataggttatcgggcgtgtcggttttatcgtcgtaatattgtagtaggttgttgaaggtgtgtattttattcggcgtatatttgttttttagtattaggtcgtcgatgcgggtggcgttgtgttcgcgtaggttattgtcgcgcgtgtcggagtagagtagtcgttgttaaaatcgttgttcgttgtgtcgtttattattaggttgtgcgtttttttcgggttgttttgtgaagaggttgggttgagttgattttttacgttcgtttcgatattaaagtttgcggaatggtacgggtaataaagtttattacgacgtttacgttttgcggttcgtaacgtatcgtattattatcgcgtattacgttaatggtatttatgttgtcgagcgaaacgggagttagtgaaagttgcggttgatcgtaaggggcgaaggggacggggatgtcgtttattaggacggtcgagcggttggcgaggcgcgggtttaggtttcggatgttaaagtttatcgttaggtcgtggttgtcggtgtcgttgtttttcggcgttgacgttagggatgcggttaagtat

SEQ ID NO: 35476 - DNA, 710 bp, Artificial Sequence
  chemically treated genomic DNA (Homo sapiens) CpG-island No: 35476
atacttaaccgcatccctaacgtcaacgccgaaaaacaacgacaccgacaaccacgacctaacgataaactttaacatccgaaacctaaacccgcgcctcgccaaccgctcgaccgtcctaataaacgacatccccgtccccttcgccccttacgatcaaccgcaactttcactaactcccgtttcgctcgacaacataaataccattaacgtaatacgcgataataatacgatacgttacgaaccgcaaaacgtaaacgtcgtaataaactttattacccgtaccattccgcaaactttaatatcgaaacgaacgtaaaaaatcaactcaacccaacctcttcacaaaacaacccgaaaaaaacgcacaacctaataataaacgacacaacgaacaacgattttaacaacgactactctactccgacacgcgcgacaataacctacgcgaacacaacgccacccgcatcgacgacctaatactaaaaaacaaatatacgccgaataaaatacacaccttcaacaacctactacaatattacgacgataaaaccgacacgcccgataacctatctcgcgcgaattacgacgccgatcgctaacaatccacccgcccgtataaccgcttctaaaatcgtcgcaaactaacgaacctaaactaccaattccaaccaaacaaccaacataaattcaacattcaaaaattctac

SEQ ID NO: 35477 - DNA, 547 bp, Artificial Sequence
  chemically treated genomic DNA (Homo sapiens) CpG-island No: 35477
tcggtgtcgttattggtgatagtgttttcgttttcgttattgacgatggtttggtcgtcgttaatttggatatcgatggatttcggatcggtgacggttatggtgtttttgttatttatcgttgcgttgtcgtcggtgatattaatatcgtgatcgtcgtcgttgatatttagatcgtcgttttgaattattttttcgttattgttagtaattttcgtatcggtggaatttttgtcgttaacggtggttttgtcgttgttgtttgtcgtggcgttattatcgttaatttgcgtgtcggtgttatcgttggtgatggcgtttcgttttcgttgttaataatcgtttggtcgtcgttaatttggatatcgatggatttcggatcggtgacggttatggtgtttttgttatttatcgttgcgtgtcgtcggtgatattaatatcgtgatcgtcgtcgttgatatttagatcgtcgttttgaataattttttcgttattatcgttgatttacgtatcggtggaatttttgtcgttaacggtggttttgtcg

SEQ ID NO: 35478 - DNA, 547 bp, Artificial Sequence
  chemically treated genomic DNA (Homo sapiens) CpG-island No: 35478
cgacaaaaccaccgttaacgacaaaaattccaccgatacgtaaatcaacgataataacgaaaaaattattcaaaacgacgatctaaatatcaacgacgacgatcacgatattaatatcaccgacgacacgcaacgataaataacaaaaacaccataaccgtcaccgatccgaaatccatcgatatccaaattaacgacgaccaaacgattattaacaacgaaaacgaaacgccatcaccaacgataacaccgacacgcaaattaacgataataacgccacgacaaacaacaacgacaaaaccaccgttaacgacaaaaattccaccgatacgaaaattactaacaataacgaaaaaataattcaaaacgacgatctaaatatcaacgacgacgatcacgatattaatatcaccgacgacaacgcaacgataaataacaaaaacaccataaccgtcaccgatccgaaatccatcgatatccaaattaacgacgaccaaaccatcgtcaataacgaaaacgaaaacactatcaccaataacgacaccga

SEQ ID NO: 35479 - DNA, 547 bp, Artificial Sequence
  chemically treated genomic DNA (Homo sapiens) CpG-island No: 35479
cggtaaaattatcgttgacggtaaggattttatcggtacgtaaattaacggtaataacggaaaagttatttaggacggcgatttggatgttagcggcggcggttacggtattgatattatcggcgatacgtaacggtggataataagggtattatgatcgttatcgattcggagtttatcggtatttaggttgacggcgattaggcggttgttaataacgaaggcgagacgttattattaacggtggtatcggtacgtagattaacggtgatgacgttacggtaaataataacggtaaaattatcgttgacggtaaggattttatcggtacggaaattgttggtaataacgggaaggtgatttaggacggcgatttggatgttagcggcggcggttacggtattgatattatcggcgatagcgtaacggtggataataagggtattatgatcgttatcgattcggagtttatcggtatttagattgacggcgattaggttatcgttaataacgaaggcgagagtattattattaatggcggtatcgg

SEQ ID NO: 35480 - DNA, 547 bp, Artificial Sequence
  chemically treated genomic DNA (Homo sapiens) CpG-island No: 35480
ccgataccgccattaataataatactctcgccttcgttattaacgataacctaatcgccgtcaatctaaataccgataaactccgaatcgataacgatcataatacccttattatccaccgttacgctatcgccgataatatcaataccgtaaccgccgccgctaacatccaaatcgccgtcctaaatcaccttcccgttattaccaacaatttccgtaccgataaaatccttaccgtcaacgataattttaccgttattatttaccgtaacgtcatcaccgttaatctacgtaccgataccaccgttaataataacgtctcgccttcgttattaacaaccgcctaatcgccgtcaacctaaataccgataaactccgaatcgataacgatcataatacccttattatccaccgttacgtatcgccgataatatcaataccgtaaccgccgccgctaacatccaaatcgccgtcctaaataacttttccgttattaccgttaatttacgtaccgataaaatccttaccgtcaacgataattttaccg

SEQ ID NO: 35481 - DNA, 887 bp, Artificial Sequence
  chemically treated genomic DNA (Homo sapiens) CpG-island No: 35481
ggaagcgattgttcgcgtcggggatgtggtgcgttttttcgtagatagcgaattgttcgttttttatgacggtttgatttttgggtaggagagtttgaaggtttacgtttgcgttggtttgttattgtttgtcgggtaaaatttgatcggcgtattgacgttcgacgggatgtagttcgattagttcgatgtttttagcgacgaagagttacggttgattgttgcgttggcggcgggagttttaagtaatgcgttgttgattgaataattggaaagttagaatatgttgttaggcgatgttacgtcgtttgaagcggtgaaatagacgtagatgattggtttgttttttggtatgacgtaattgataaaagagattgatattgtggcggcgttcgattttaacgttttgattagcggtgagattggaatcggtaaggagttggtggcgaaagcgtatttatgaagtttcgttacgggcggtgaattcgttggtttattttaattgtgttgtattgtcggaaagtgtggcggaaagtgagttgttcgggtatgtgaaaggagcgtttattggcgttattagtaatcgtagcgggaagtttgaaatggcggataacggtacgttgtttttggatgagatcggcgagttgtcgttggtattgtaggttaagttgttgaaggtgttgtagtatggcgatatttagcgcgttggcgatgatcgttgtttgtaggtcgatgtgcgtatgattggggcgattaatcgtaatttaagggaagaggtgttggtagggcgatttcgcgtcgatttgttatatcgtttgaacgtgttattaatttcggtgtcgcgttgcgtaaagagggcgtgatgtattatgttggcggggtatttt

SEQ ID NO: 35482 - DNA, 887 bp, Artificial Sequence
  chemically treated genomic DNA (Homo sapiens) CpG-island No: 35482
aaaataccccgccaacataatacatcacgccctctttacgcaacgcgacaccgaaattaataacacgttcaaacgatataacaaatcgacgcgaaatcgccctaccaacacctcttcccttaaattacgattaatcgccccaatcatacgcacatcgacctacaaacaacgatcatcgccaacgcgctaaatatcgccatactacaacaccttcaacaacttaacctacaataccaacgacaactcgccgatctcatccaaaaacaacgtaccgttatccgccatttcaaacttcccgctacgattactaataacgccaataaacgctcctttcacatacccgaacaactcactttccgccacactttccgacaatacaacacaattaaaataaaccaacgaattcaccgcccgtaacgaaacttcataaatacgctttcgccaccaactccttaccgattccaatctcaccgctaatcaaaacgttaaaatcgaacgccgccacaatatcaatctcttttatcaattacgtcataccaaaaaacaaaccaatcatctacgtctatttcaccgcttcaaacgacgtaacatcgcctaacaacatattctaactttccaattattcaatcaacaacgcattacttaaaactcccgccgccaacgcaacaatcaaccgtaactcttcgtcgctaaaaacatcgaactaatcgaactacatcccgtcgaacgtcaatacgccgatcaaattttacccgacaaacaataacaaaccaacgcaaacgtaaaccttcaaactctcctacccaaaaatcaaaccgtcataaaaaacgaacaattcgctatctacgaaaaaacgcaccacatccccgacgcgaacaatcgcttcc

SEQ ID NO: 35483 - DNA, 887 bp, Artificial Sequence
  chemically treated genomic DNA (Homo sapiens) CpG-island No: 35483
aaaatatttcgttagtataatatattacgttttttttacgtagcgcggtatcgaaattgataatacgtttaggcgatataataaatcggcgcggaatcgttttgttagtatttttttttttaaattgcggttagtcgttttagttatgcgtatatcgatttgtaaataacggttatcgttaacgcgttgaatatcgttatattgtaatatttttagtagtttggtttgtaatgttaacgataattcgtcgattttatttagaaatagcgtgtcgttattcgttattttaaatttttcgttgcgattattgatagcgttagtaaacgttttttttatatgttcgaataatttatttttcgttatatttttcggtagtgtagtatagttgagatagattagcggatttatcgttcgtggcgaggttttatgaatgcgttttcgttattagttttttatcggttttagttttatcgttgattaggacgttgagatcggacgtcgttataatgttaattttttttgttagttgcgttatgttaggggataagttaattatttgcgtttgttttatcgttttaaacggcgtggtatcgtttggtagtatattttggttttttagttgtttaattagtaacgtattgtttaaggttttcgtcgttagcgtagtaattagtcgtagtttttcgtcgttgaaaatatcgaattgatcgggttgtatttcgtcgagcgttagtgcgtcgattaggttttgttcggtaaataatggtagattaacgtaggcgtgaatttttagatttttttgtttaggaattaaatcgttatagggagcgggtaattcgttgtttgcgggaaagcgtattatattttcggcgcgggtaatcgttttt

SEQ ID NO: 35484 - DNA, 887 bp, Artificial Sequence
  chemically treated genomic DNA (Homo sapiens) CpG-island No: 35484
aaaaacgattacccgcgccgaaaatataatacgctttcccgcaaacaacgaattacccgctccctataacgatttaattcctaaacaaaaaaatctaaaaattcacgcctacgttaatctaccattatttaccgaacaaaacctaatcgacgcactaacgctcgacgaaatacaacccgatcaattcgatattttcaacgacgaaaaactacgactaattactacgctaacgacgaaaaccttaaacaatacgttactaattaaacaactaaaaaaccaaaatatactaccaaacgataccacgccgtttaaaacgataaaacaaacgcaaataattaacttatcccctaacataacgcaactaacaaaaaaaattaacattataacgacgtccgatctcaacgtcctaatcaacgataaaactaaaaccgataaaaaactaataacgaaaacgcattcataaaacctcgccacgaacgataaatccgctaatctatctcaactatactacactaccgaaaaatataacgaaaaataaattattcgaacatataaaaaaaacgtttactaacgctatcaataatcgcaacgaaaaatttaaaataacgaataacgacacgctatttctaaataaaatcgacgaattatcgttaacattacaaaccaaactactaaaaatattacaatataacgatattcaacgcgttaacgataaccgttatttacaaatcgatatacgcataactaaaacgactaaccgcaatttaaaaaaaaaaatactaacaaaacgattccgcgccgatttattatatcgcctaaacgtattatcaatttcgataccgcgctacgtaaaaaaaacgtaatatattatactaacgaaatatttt

SEQ ID NO: 35485 - DNA, 707 bp, Artificial Sequence
  chemically treated genomic DNA (Homo sapiens) CpG-island No: 35485
ttttggagttggagcgtaatacgcgtatcggtaagtacgttcgttttttgtcgacggtttatagcgacgtttgtatcggttgcggtaagtgcgaaaaagtatgcgtgttggaataatcggtaattaaggtgttatcgttgttattggcgaaaggggagttaggttattattatcgtttcggttggttggaggggaataatggtaaatcgtaaacgtgacgtcgggcgcgaggcgttggagaaaaaaggttggtggcgtagttatcgttggttggtgttacgtcgtttttgttagtttttcgtgttggggatgtttttgaggcggtttatggtttggtgtgtggattttgtacggtaattatagtagtagtttgttattcgatatcgtttcgttgatcgattcgttgatgacgttgtaaagttttgttagtggtatttgtttgttacggtggcgttgatcggtgcggtgattattatcgtgttttacgtttttggcgggaaagcgattattttgtagttgggtttgttcgttgaattcgattatcgatttagcgaattggttacgtaggcgttttgattttaattagtttgcgacgatttttcgttatattcgttacgtgttgttggtggttattttggtgggattagttttaattggtacgtttatttgggaatggattaatttcgtttttttgatggggcgtagtt

SEQ ID NO: 35486 - DNA, 707 bp, Artificial Sequence
  chemically treated genomic DNA (Homo sapiens) CpG-island No: 35486
aactacgccccatcaaaaaaacgaaattaatccattcccaaataaacgtaccaattaaaactaatcccaccaaaataaccaccaacaacacgtaacgaatataacgaaaaatcgtcgcaaactaattaaaatcaaaacgcctacgtaaccaattcgctaaatcgataatcgaattcaacgaacaaacccaactacaaaataatcgctttcccgccaaaaacgtaaaacacgataataatcaccgcaccgatcaacgccaccgtaacaaacaaataccactaacaaaactttacaacgtcatcaacgaatcgatcaacgaaacgatatcgaataacaaactactactataattaccgtacaaaatccacacaccaaaccataaaccgcctcaaaaacatccccaacacgaaaaactaacaaaaacgacgtaacaccaaccaacgataactacgccaccaaccttttttctccaacgcctcgcgcccgacgtcacgtttacgatttaccattattcccctccaaccaaccgaaacgataataataacctaactcccctttcgccaataacaacgataacaccttaattaccgattattccaacacgcatactttttcgcacttaccgcaaccgatacaaacgtcgctataaaccgtcgacaaaaaacgaacgtacttaccgatacgcgtattacgctccaactccaaaa

SEQ ID NO: 35487 - DNA, 707 bp, Artificial Sequence
  chemically treated genomic DNA (Homo sapiens) CpG-island No: 35487
ggttacgttttattagagaaacggggttgatttatttttaaatgagcgtgttagttaaggttgattttattagaatgattattaatagtacgtagcgaatgtggcgagggatcgtcgtagattgattgaggttaaagcgtttgcgtaattagttcgttaagtcggtaatcgggtttagcgggtagatttagttgtaaaataatcgttttttcgttagggacgtagagtacggtgataattatcgtatcggttaacgttatcgtggtaggtagatattattggtaagattttgtagcgttattagcggatcggttagcggaacggtgtcgaataataggttattgttgtagttgtcgtgtaagatttatatattaaattatggatcgttttaaaaatatttttagtacgaagaattgataaaggcgacgtaatattagttaacggtgattgcgttattagttttttttttttagcgtttcgcgttcggcgttacgtttacgatttgttattgtttttttttagttagtcgaagcggtaatggtgatttaatttttttttcgttagtgatagcggtaatattttgattgtcggttgttttagtacgtatattttttcgtatttatcgtaatcggtataggcgtcgttgtgaatcgtcggtagaaagcgggcgtgtttatcggtacgcgtgttgcgttttagttttaggg

SEQ ID NO: 35488 - DNA, 707 bp, Artificial Sequence
  chemically treated genomic DNA (Homo sapiens) CpG-island No: 35488
ccctaaaactaaaacgcaacacgcgtaccgataaacacgcccgctttctaccgacgattcacaacgacgcctataccgattacgataaatacgaaaaaatatacgtactaaaacaaccgacaatcaaaatattaccgctatcactaacgaaaaaaaaattaaatcaccattaccgcttcgactaactaaaaaaaaacaataacaaatcgtaaacgtaacgccgaacgcgaaacgctaaaaaaaaaaaactaataacgcaatcaccgttaactaatattacgtcgcctttatcaattcttcgtactaaaaatatttttaaaacgatccataatttaatatataaatcttacacgacaactacaacaataacctattattcgacaccgttccgctaaccgatccgctaataacgctacaaaatcttaccaataatatctacctaccacgataacgttaaccgatacgataattatcaccgtactctacgtccctaacgaaaaaacgattattttacaactaaatctacccgctaaacccgattaccgacttaacgaactaattacgcaaacgctttaacctcaatcaatctacgacgatccctcgccacattcgctacgtactattaataatcattctaataaaatcaaccttaactaacacgctcatttaaaaataaatcaaccccgtttctctaataaaacgtaacc

SEQ ID NO: 35489 - DNA, 614 bp, Artificial Sequence
  chemically treated genomic DNA (Homo sapiens) CpG-island No: 35489
ttttttcggcgtttaatttatttagtatgtcgttggcgtttttaaatagtcgttgcgttttaacgtttattattttattttttagaatgcgcggatatttttcggttagcgattaggttataaagaacggtgtttagtcgatgtaattacgtagcgtttcgatgttggtttcgattttttgtacgtcgagacggtgcgttatcggcggcgtgtaagtttgttagttaaaagcgaaatcgttatcgcgcgtcgtttttagcgtgatcggtggtgtgcgcggttttttgcgttcgtgttgaatacgtacgggttcgtattttttgcgggtacgagcgataaaattattacgttgggtatcggaaagtagcgtcgttattatattaacggtacgcgaggtattttgtatatatatcgtcgggtcgttgtagttttgttcgatttttatcgtcgcgtgcgtttttgaggtcgtcgcgtcgttaattagtaacggaatagtgaagttttgacgttttatttttttcgttacgttaattatttcgtttaacgacgggggtgataagttttcgaaagggttaattagaatagtaatttattttttttaagcgggaatcgga

SEQ ID NO: 35490 - DNA, 614 bp, Artificial Sequence
  chemically treated genomic DNA (Homo sapiens) CpG-island No: 35490
tccgattcccgcttaaaaaaaataaattactattctaattaaccctttcgaaaacttatcacccccgtcgttaaacgaaataattaacgtaacgaaaaaaataaaacgtcaaaacttcactattccgttactaattaacgacgcgacgacctcaaaaacgcacgcgacgataaaaatcgaacaaaactacaacgacccgacgatatatatacaaaatacctcgcgtaccgttaatataataacgacgctactttccgatacccaacgtaataattttatcgctcgtacccgcaaaaaatacgaacccgtacgtattcaacacgaacgcaaaaaaccgcgcacaccaccgatcacgctaaaaacgacgcgcgataacgatttcgcttttaactaacaaacttacacgccgccgataacgcaccgtctcgacgtacaaaaaatcgaaaccaacatcgaaacgctacgtaattacatcgactaaacaccgttctttataacctaatcgctaaccgaaaaatatccgcgcattctaaaaaataaaataataaacgttaaaacgcaacgactatttaaaaacgccaacgacatactaaataaattaaacgccgaaaaaa

SEQ ID NO: 35491 - DNA, 614 bp, Artificial Sequence
  chemically treated genomic DNA (Homo sapiens) CpG-island No: 35491
ttcggttttcgtttaaagaaagtgaattgttgttttgattggttttttcgggggtttattattttcgtcgttgaacgagatggttaacgtggcgaaagagatggagcgttagggttttattatttcgttattgattggcggcgcgacgattttaaaagcgtacgcggcggtgaaaatcgagtagaattatagcggttcgacggtgtatgtgtagaatgtttcgcgtatcgttggtgtggtggcggcgttgtttttcgatatttagcgtgatgattttgtcgttcgtattcgtaaggagtacgaattcgtacgtatttagtacgggcgtaagaaatcgcgtatattatcggttacgttggaagcggcgcgcgataacgatttcgtttttgattggtaggtttatacgtcgtcggtggcgtatcgtttcggcgtgtaggaagtcgaagttagtatcgaaacgttgcgtaattatatcgattggatatcgttttttatgatttggtcgttggtcgggaagtattcgcgtattttggaagatgaagtggtgggcgttgaggcgtagcggttgtttaaagacgttaacgatatgttggataaattaagcgtcgagaaaa

SEQ ID NO: 35492 - DNA, 614 bp, Artificial Sequence
  chemically treated genomic DNA (Homo sapiens) CpG-island No: 35492
ttttctcgacgcttaatttatccaacatatcgttaacgtctttaaacaaccgctacgcctcaacgcccaccacttcatcttccaaaatacgcgaatacttcccgaccaacgaccaaatcataaaaaacgatatccaatcgatataattacgcaacgtttcgatactaacttcgacttcctacacgccgaaacgatacgccaccgacgacgtataaacctaccaatcaaaaacgaaatcgttatcgcgcgccgcttccaacgtaaccgataatatacgcgatttcttacgcccgtactaaatacgtacgaattcgtactccttacgaatacgaacgacaaaatcatcacgctaaatatcgaaaaacaacgccgccaccacaccaacgatacgcgaaacattctacacatacaccgtcgaaccgctataattctactcgattttcaccgccgcgtacgcttttaaaatcgtcgcgccgccaatcaataacgaaataataaaaccctaacgctccatctctttcgccacgttaaccatctcgttcaacgacgaaaataataaacccccgaaaaaaccaatcaaaacaacaattcactttctttaaacgaaaaccgaa

SEQ ID NO: 35493 - DNA, 637 bp, Artificial Sequence
  chemically treated genomic DNA (Homo sapiens) CpG-island No: 35493
gcgttaggtttcgtttttttttcgggttcgttttcggtttggttattggtcgtagagttcgggggcgtggtcgagttggggttgggggcgttcgcggtgttcgttcgcgagtttcgttgtttttttttcggggttgcgggttcggcggtcgggttggttgggtcgcgtttgggttttcgcgtcggttttcgtattcgtaatggggaatttatattataagaggaaggtttttagcggttttcgggttcgtagtttttggcggttcgggcggtcggcgaagcggtcggtaggtaggggtcggggtgggggcggggtaggtagggaagagggtttttattgcggtcgtcgttatcgttgttgtcgtttttcggggtttggagggtgtgagtgtgggggggtcgggaatcgtcgcgtagattttattttttataggtatacggagatatacgtatacggtaatatttacgggcgggtatacgtatatgttcgtagtttatatagttatacgtataatatttatttaaatgtacggatacgtagatataggattatatatattattatatttatattttcgtattatcgtagtaggacgtatatagtttgagatataggtatatgtatatttatgtatgcg

SEQ ID NO: 35494 - DNA, 637 bp, Artificial Sequence
  chemically treated genomic DNA (Homo sapiens) CpG-island No: 35494
cgcatacataaatatacatatacctatatctcaaactatatacgtcctactacgataatacgaaaatataaatataataatatatataatcctatatctacgtatccgtacatttaaataaatattatacgtataactatataaactacgaacatatacgtatacccgcccgtaaatattaccgtatacgtatatctccgtatacctataaaaaataaaatctacgcgacgattcccgacccccccacactcacaccctccaaaccccgaaaaacgacaacaacgataacgacgaccgcaataaaaaccctcttccctacctaccccgcccccaccccgacccctacctaccgaccgcttcgccgaccgcccgaaccgccaaaaactacgaacccgaaaaccgctaaaaaccttcctcttataatataaattccccattacgaatacgaaaaccgacgcgaaaacccaaacgcgacccaaccaacccgaccgccgaacccgcaaccccgaaaaaaaaacaacgaaactcgcgaacgaacaccgcgaacgcccccaaccccaactcgaccacgcccccgaactctacgaccaataaccaaaccgaaaacgaacccgaaaaaaaaacgaaacctaacgc

SEQ ID NO: 35495 - DNA, 637 bp, Artificial Sequence
  chemically treated genomic DNA (Homo sapiens) CpG-island No: 35495
cgtatgtataggtatatatgtatttatgttttaggttgtgtgcgttttattgcgatggtacgagagtgtgggtgtgatggtgtatgtgattttgtgtttgcgtgttcgtatatttgagtgggtgttgtgcgtgtgattgtgtaaattgcgaatatgtacgtgtgttcgttcgtaggtattatcgtgtacgtgtgttttcgtgtgtttgtgaggggtggggtttgcgcggcgattttcgatttttttatatttatattttttaagtttcgggaggcggtagtagcggtggcgacgatcgtagtagggatttttttttttgtttgtttcgtttttatttcggtttttatttgtcggtcgtttcgtcgatcgttcgaatcgttagaagttgcggattcggggatcgttgggggttttttttttgtggtgtgagttttttattgcgggtgcgggagtcggcgcgggaatttaagcgcggtttagttagttcggtcgtcgggttcgtagtttcgggagggaggtagcgagattcgcgggcgggtatcgcgggcgtttttagttttagttcgattacgttttcgagttttgcggttaatggttaggtcgggggcgggttcggaggaggggcggggtttggcgt

SEQ ID NO: 35496 - DNA, 637 bp, Artificial Sequence
  chemically treated genomic DNA (Homo sapiens) CpG-island No: 35496
acgccaaaccccgcccctcctccgaacccgcccccgacctaaccattaaccgcaaaactcgaaaacgtaatcgaactaaaactaaaaacgcccgcgatacccgcccgcgaatctcgctacctccctcccgaaactacgaacccgacgaccgaactaactaaaccgcgcttaaattcccgcgccgactcccgcacccgcaataaaaaactcacaccacaaaaaaaaaacccccaacgatccccgaatccgcaacttctaacgattcgaacgatcgacgaaacgaccgacaaataaaaaccgaaataaaaacgaaacaaacaaaaaaaaaaatccctactacgatcgtcgccaccgctactaccgcctcccgaaacttaaaaaatataaatataaaaaaatcgaaaatcgccgcgcaaaccccacccctcacaaacacacgaaaacacacgtacacgataatacctacgaacgaacacacgtacatattcgcaatttacacaatcacacgcacaacacccactcaaatatacgaacacgcaaacacaaaatcacatacaccatcacacccacactctcgtaccatcgcaataaaacgcacacaacctaaaacataaatacatatatacctatacatacg

SEQ ID NO: 35497 - DNA, 800 bp, Artificial Sequence
  chemically treated genomic DNA (Homo sapiens) CpG-island No: 35497
tcgcgcgcggattttcggtagagttttttcggtcgtattttcgacgttttttcgcgtttagtttaggtgtcgatcgttttatttcggtttttgtttttggtttttttggttttgtttttcgtttttttggttcggggggcggtcggttcggcgttttcggttttcgtcgttttttttttgcgtcgtttgtttcgtagttagttgaaggcgcggcggaggtcggacgcgtcggagcgggatttttttttgcgcggggggtcgttcgggtttttcggtttttcggtcgtaggtgcggcggggggcgcgcgggtcgttatggtaggcgggggcggagcgggcggcgggttaggttttttgcggcgcggtgtttatgtcgggggcggtcgtcggggacgcgcgttcggagaaaagtttgggcggcggaggtcgagcgggcgcggagagcggacggcgggagcggcgcgggaggggtcggtcgagcggcgggcggggcgtaggtcggcgggagggaaggagcggggcgggagcggtcgtagggcgggagcgtcgttgtttgcggttttttttcgtttttttcggtttcggcggagggcgaggtttagtttcgagaggagggggtttcgggagttcggggtcgtgtttttcgttggggttcgagagggcgggtcgtggggtcgttcgggagggggcggtattgagggttcgtttcgtagggggttattcgcggggagatttgttcggaagaagggggtatgggggtggggatcgaaaaggggaagggttttagaaaaggaggaata

SEQ ID NO: 35498 - DNA, 800 bp, Artificial Sequence
  chemically treated genomic DNA (Homo sapiens) CpG-island No: 35498
tattcctccttttctaaaacccttccccttttcgatccccacccccatacccccttcttccgaacaaatctccccgcgaataaccccctacgaaacgaaccctcaataccgccccctcccgaacgaccccacgacccgccctctcgaaccccaacgaaaaacacgaccccgaactcccgaaaccccctcctctcgaaactaaacctcgccctccgccgaaaccgaaaaaaacgaaaaaaaaccgcaaacaacgacgctcccgccctacgaccgctcccgccccgctccttccctcccgccgacctacgccccgcccgccgctcgaccgacccctcccgcgccgctcccgccgtccgctctccgcgcccgctcgacctccgccgcccaaacttttctccgaacgcgcgtccccgacgaccgcccccgacataaacaccgcgccgcaaaaaacctaacccgccgcccgctccgcccccgcctaccataacgacccgcgcgccccccgccgcacctacgaccgaaaaaccgaaaaacccgaacgaccccccgcgcaaaaaaaaatcccgctccgacgcgtccgacctccgccgcgccttcaactaactacgaaacaaacgacgcaaaaaaaaaacgacgaaaaccgaaaacgccgaaccgaccgccccccgaaccaaaaaaacgaaaaacaaaaccaaaaaaaccaaaaacaaaaaccgaaataaaacgatcgacacctaaactaaacgcgaaaaaacgtcgaaaatacgaccgaaaaaactctaccgaaaatccgcgcgcga

SEQ ID NO: 35499 - DNA, 800 bp, Artificial Sequence
  chemically treated genomic DNA (Homo sapiens) CpG-island No: 35499
tgtttttttttttttggggtttttttttttttcggtttttatttttatatttttttttttcgaatagattttttcgcgggtggttttttgcgggacggatttttagtgtcgttttttttcgggcggttttacgattcgttttttcgggttttagcggggggtacgatttcgggttttcgggatttttttttttcgggattggatttcgtttttcgtcgggatcgggggaggcggggaggggtcgtaggtagcggcgttttcgttttgcggtcgttttcgtttcgttttttttttttcgtcggtttgcgtttcgttcgtcgttcggtcggtttttttcgcgtcgttttcgtcgttcgtttttcgcgttcgttcggttttcgtcgtttaaattttttttcgggcgcgcgttttcggcggtcgttttcggtatgggtatcgcgtcgtagggggtttgattcgtcgttcgtttcgttttcgtttgttatggcggttcgcgcgtttttcgtcgtatttgcggtcgaggagtcggggaattcgggcggtttttcgcgtaggaagaagtttcgtttcggcgcgttcggttttcgtcgcgtttttagttggttgcggggtaagcggcgtaagaagaaggcggcgggggtcgagggcgtcgaatcggtcgtttttcgggttaagaaggcggaggataaggttaagagggttaagggtaaaggtcgaggtaaggcggtcggtatttgggttgagcgcgggggggcgtcgagggtgcggtcgagggggttttgtcgggggttcgcgcgcgg

SEQ ID NO: 35500 - DNA, 800 bp, Artificial Sequence
  chemically treated genomic DNA (Homo sapiens) CpG-island No: 35500
ccgcgcgcgaacccccgacaaaaccccctcgaccgcaccctcgacgcccccccgcgctcaacccaaataccgaccgccttacctcgacctttacccttaaccctcttaaccttatcctccgccttcttaacccgaaaaacgaccgattcgacgccctcgacccccgccgccttcttcttacgccgcttaccccgcaaccaactaaaaacgcgacgaaaaccgaacgcgccgaaacgaaacttcttcctacgcgaaaaaccgcccgaattccccgactcctcgaccgcaaatacgacgaaaaacgcgcgaaccgccataacaaacgaaaacgaaacgaacgacgaatcaaaccccctacgacgcgatacccataccgaaaacgaccgccgaaaacgcgcgcccgaaaaaaaatttaaacgacgaaaaccgaacgaacgcgaaaaacgaacgacgaaaacgacgcgaaaaaaaccgaccgaacgacgaacgaaacgcaaaccgacgaaaaaaaaaaaacgaaacgaaaacgaccgcaaaacgaaaacgccgctacctacgacccctccccgcctcccccgatcccgacgaaaaacgaaatccaatcccgaaaaaaaaaaatcccgaaaacccgaaatcgtaccccccgctaaaacccgaaaaaacgaatcgtaaaaccgcccgaaaaaaaacgacactaaaaatccgtcccgcaaaaaaccacccgcgaaaaaatctattcgaaaaaaaaaaatataaaaataaaaaccgaaaaaaaaaaaaaccccaaaaaaaaaaaaaca

SEQ ID NO: 35501 - DNA, 553 bp, Artificial Sequence
  chemically treated genomic DNA (Homo sapiens) CpG-island No: 35501
ggcggggttcgggattaggtgaacgttgatttgatagttgatacgggacgattgtggtattatttttgttgtcgttaatatttcgagagggaggaggttgggtcgggagggtttttcggggcggggcggaggaggagggaatgtaaaatagagtttcgttttcggaatttaagaagtagtaacgttttttattataaattcggagttgttttttcgttaatgattttagcgtttgatagttaggattttaggtagtagcgagtgataggacgtttggatcggcgcgtcgttagtagttttgtcgggtcgcggcggtgatcgatggggagcggttggagcggatttagcgagtgagggcgtatagtcgggacgtcgaggcggcgggcgggagattcgtattagcgtagtcggttttcggcgggacgtgacgtagcgttcggggcgcgggtgagttcgcgcggatcgttaggtatgtttgggggattttaagggcggggtgttaagttttatgttacggtgttttaattgttggttttatattgggaagttttcg

SEQ ID NO: 35502 - DNA, 553 bp, Artificial Sequence
  chemically treated genomic DNA (Homo sapiens) CpG-island No: 35502
cgaaaacttcccaatataaaaccaacaattaaaacaccgtaacataaaacttaacaccccgcccttaaaatcccccaaacatacctaacgatccgcgcgaactcacccgcgccccgaacgctacgtcacgtcccgccgaaaaccgactacgctaatacgaatctcccgcccgccgcctcgacgtcccgactatacgccctcactcgctaaatccgctccaaccgctccccatcgatcaccgccgcgacccgacaaaactactaacgacgcgccgatccaaacgtcctatcactcgctactacctaaaatcctaactatcaaacgctaaaatcattaacgaaaaaacaactccgaatttataataaaaaacgttactacttcttaaattccgaaaacgaaactctattttacattccctcctcctccgccccgccccgaaaaaccctcccgacccaacctcctccctctcgaaatattaacgacaacaaaaataataccacaatcgtcccgtatcaactatcaaatcaacgttcacctaatcccgaaccccgcc

SEQ ID NO: 35503 - DNA, 553 bp, Artificial Sequence
  chemically treated genomic DNA (Homo sapiens) CpG-island No: 35503
cgagagttttttagtatagagttagtagttaggatatcgtgatatgaaatttagtatttcgtttttgaagttttttaagtatgtttggcggttcgcgcggatttattcgcgtttcgggcgttgcgttacgtttcgtcgagggtcggttgcgttggtgcgggtttttcgttcgtcgtttcggcgtttcggttgtgcgtttttattcgttgggttcgttttagtcgttttttatcgattatcgtcgcggttcggtagagttgttagcggcgcgtcggtttagacgttttgttattcgttgttgtttggggttttggttgttaggcgttggaattattggcgaggaggtagtttcgaatttatagtgaggggcgttgttgttttttgggtttcggggacgaggttttgttttgtatttttttttttttcgtttcgtttcgggagattttttcggtttaattttttttttttcgggatattgacggtagtaaggatgatgttatagtcgtttcgtgttaattattagattagcgtttatttggtttcgaatttcgtt

SEQ ID NO: 35504 - DNA, 553 bp, Artificial Sequence
  chemically treated genomic DNA (Homo sapiens) CpG-island No: 35504
aacgaaattcgaaaccaaataaacgctaatctaataattaacacgaaacgactataacatcatccttactaccgtcaatatcccgaaaaaaaaaaaattaaaccgaaaaaatctcccgaaacgaaacgaaaaaaaaaaaaatacaaaacaaaacctcgtccccgaaacccaaaaaacaacaacgcccctcactataaattcgaaactacctcctcgccaataattccaacgcctaacaaccaaaaccccaaacaacaacgaataacaaaacgtctaaaccgacgcgccgctaacaactctaccgaaccgcgacgataatcgataaaaaacgactaaaacgaacccaacgaataaaaacgcacaaccgaaacgccgaaacgacgaacgaaaaacccgcaccaacgcaaccgaccctcgacgaaacgtaacgcaacgcccgaaacgcgaataaatccgcgcgaaccgccaaacatacttaaaaaacttcaaaaacgaaatactaaatttcatatcacgatatcctaactactaactctatactaaaaaactctcg

SEQ ID NO: 35505 - DNA, 525 bp, Artificial Sequence
  chemically treated genomic DNA (Homo sapiens) CpG-island No: 35505
ttacggtattagtttttggaaagttagggagacgcggattttttagattcgtagttcggtcgcgtggggcggcgcgtaggtgacggattaggagttgcgttttgttacgagtgaggggcggacgggagacgtcgaggtcggcgagggggtacgcgttagttttatagttcggcgggtaagaaggagggtaggtaggggtttcgagtcgcgggcggcgggggttcgttatatatatatttattgtcgtagttgcgaataggaagtattaatcgggaattaaaacgcgtagagggacggggaggggcgaggataaatgaggtaaggaggtcgcgttcgcgtagattcgggagggaaggtattttcggggataatatagttttagttatcgttttttcgttttcgtttatttgtcgcgtttgatgtgcgtatgcgtagtgggtgcgaatcgttttttgtttcgtttataattattaggtttgttttttttgttttttttttttttttttttaattttttttgaagtta

SEQ ID NO: 35506 - DNA, 525 bp, Artificial Sequence
  chemically treated genomic DNA (Homo sapiens) CpG-island No: 35506
taacttcaaaaaaaattaaaaaaaaaaaaaaaaaaaacaaaaaaaacaaacctaataattataaacgaaacaaaaaacgattcgcacccactacgcatacgcacatcaaacgcgacaaataaacgaaaacgaaaaaacgataactaaaactatattatccccgaaaataccttccctcccgaatctacgcgaacgcgacctccttacctcatttatcctcgcccctccccgtccctctacgcgttttaattcccgattaatacttcctattcgcaactacgacaataaatatatatataacgaacccccgccgcccgcgactcgaaacccctacctaccctccttcttacccgccgaactataaaactaacgcgtaccccctcgccgacctcgacgtctcccgtccgcccctcactcgtaacaaaacgcaactcctaatccgtcacctacgcgccgccccacgcgaccgaactacgaatctaaaaaatccgcgtctccctaactttccaaaaactaataccgtaa

SEQ ID NO: 35507 - DNA, 525 bp, Artificial Sequence
  chemically treated genomic DNA (Homo sapiens) CpG-island No: 35507
tagttttaagagaagttgggaaggggaagggggaaagtaaggaaggtaaatttaataattatgggcggggtagagaacggttcgtatttattacgtatgcgtatattaggcgcggtaggtgggcggggacggaaaggcggtgattagagttgtgttgttttcggaagtgttttttttttcgggtttgcgcggacgcggtttttttattttatttgttttcgttttttttcgtttttttacgcgttttggttttcggttggtgttttttgttcgtagttgcggtagtgagtatgtgtgtgacggattttcgtcgttcgcggttcgggatttttgtttatttttttttttgttcgtcgggttgtggaattagcgcgtgttttttcgtcggtttcgacgtttttcgttcgttttttattcgtggtagggcgtagtttttggttcgttatttgcgcgtcgttttacgcggtcgggttgcgggtttagggggttcgcgtttttttggttttttaagggttaatgtcgtga

SEQ ID NO: 35508 - DNA, 525 bp, Artificial Sequence
  chemically treated genomic DNA (Homo sapiens) CpG-island No: 35508
tcacgacattaacccttaaaaaaccaaaaaaacgcgaaccccctaaacccgcaacccgaccgcgtaaaacgacgcgcaaataacgaaccaaaaactacgccctaccacgaataaaaaacgaacgaaaaacgtcgaaaccgacgaaaaaacacgcgctaattccacaacccgacgaacaaaaaaaaaaataaacaaaaatcccgaaccgcgaacgacgaaaatccgtcacacacatactcactaccgcaactacgaacaaaaaacaccaaccgaaaaccaaaacgcgtaaaaaaacgaaaaaaaacgaaaacaaataaaataaaaaaaccgcgtccgcgcaaacccgaaaaaaaaaacacttccgaaaacaacacaactctaatcaccgcctttccgtccccgcccacctaccgcgcctaatatacgcatacgtaataaatacgaaccgttctctaccccgcccataattattaaatttaccttccttactttcccccttccccttcccaacttctcttaaaacta

SEQ ID NO: 35509 - DNA, 1098 bp, Artificial Sequence
  chemically treated genomic DNA (Homo sapiens) CpG-island No: 35509
atttgtagcgaggttcggaaatcggtttcgttagagtcgattttattcgttaggaatgcgtttcgttttcgtcgttttttcgcggtaatcgtttttgggtttttttcgttttaggggtaggagatagttcgaggggagcgtcgtttcggttcgttataatatcgtcgggtcggtcgtcggtcgtataggtattaggaggatagggtttggggcggattttacgttttatttcggttttcgcggttcgggagacgttcgcgtttgggtcgggtaggggattcggagttgatcgaggtttgattttttaagtcggttacggtttcgagtttacgttggatattggaggagacgttttttttatcggattttcgaatttatttttgtttcgggtaggggcgttagggttgcggttcggttagagttttttgggtcgtaagcgagagtcgttttttttttttcgtttcggggcgtaagttttttcgggtgttcgttcgtatttttaattttttagagcggcggtagcgtagggtggcgggcgagtaggtttattttttagtagcggcgatagtagtttgaggaagcgcgggggagggttttttcgatgcgtcgaggcgttttttaatcggggcggagacgacggaggggaggagtttcgacggtcgttttttcgaatttttttttcgtagttgtggttcgacggttgttttcgggaattagcgtcgtaattattatttttttttttcgtagttttcgtttttttttttttttttttttatttttttttttcgttttcggtcgtttcgttttagcgcgtcgttcgcgtgttgtgcgttatggcgttacgtttatcgggttcgttgcgggcggttttggacgcggttgtttttttgcgtacgttcgtttcgcgttcgcgtaggagtcgtttcgttgtattcgggtggtttcgattgcggtttttacgtttgtttttggcggaggggatttcgtttcgagcgcgtcgggtagtggggtcggtgtttttttggtcggtttttcgtggtttagagagcgttttttttaaggataggtcggggtggttggagttgcgttcggttgaag

SEQ ID NO: 35510 - DNA, 1098 bp, Artificial Sequence
  chemically treated genomic DNA (Homo sapiens) CpG-island No: 35510
cttcaaccgaacgcaactccaaccaccccgacctatccttaaaaaaaacgctctctaaaccacgaaaaaccgaccaaaaaaacaccgaccccactacccgacgcgctcgaaacgaaatcccctccgccaaaaacaaacgtaaaaaccgcaatcgaaaccacccgaatacaacgaaacgactcctacgcgaacgcgaaacgaacgtacgcaaaaaaacaaccgcgtccaaaaccgcccgcaacgaacccgataaacgtaacgccataacgcacaacacgcgaacgacgcgctaaaacgaaacgaccgaaaacgaaaaaaaaaaataaaaaaaaaaaaaaaaaaaaacgaaaactacgaaaaaaaaaaataataattacgacgctaattcccgaaaacaaccgtcgaaccacaactacgaaaaaaaaattcgaaaaaacgaccgtcgaaactcctcccctccgtcgtctccgccccgattaaaaaacgcctcgacgcatcgaaaaaaccctcccccgcgcttcctcaaactactatcgccgctactaaaaaataaacctactcgcccgccaccctacgctaccgccgctctaaaaaattaaaaatacgaacgaacacccgaaaaaacttacgccccgaaacgaaaaaaaaaaaacgactctcgcttacgacccaaaaaactctaaccgaaccgcaaccctaacgcccctacccgaaacaaaaataaattcgaaaatccgataaaaaaaacgtctcctccaatatccaacgtaaactcgaaaccgtaaccgacttaaaaaatcaaacctcgatcaactccgaatcccctacccgacccaaacgcgaacgtctcccgaaccgcgaaaaccgaaataaaacgtaaaatccgccccaaaccctatcctcctaatacctatacgaccgacgaccgacccgacgatattataacgaaccgaaacgacgctcccctcgaactatctcctacccctaaaacgaaaaaaacccaaaaacgattaccgcgaaaaaacgacgaaaacgaaacgcattcctaacgaataaaatcgactctaacgaaaccgatttccgaacctcgctacaaat

SEQ ID NO: 35511 - DNA, 1098 bp, Artificial Sequence
  chemically treated genomic DNA (Homo sapiens) CpG-island No: 35511
ttttaatcgggcgtagttttagttatttcgatttgtttttggaggagacgttttttgggttacggagaatcggttagggagatatcggttttattgttcggcgcgttcgaggcgaagtttttttcgttagggataggcgtgggggtcgtagtcggggttattcgggtgtagcggggcggtttttgcgcgggcgcggaacgaacgtgcgtaagggaatagtcgcgtttagagtcgttcgtagcgggttcggtgggcgtgacgttatgacgtatagtacgcgggcggcgcgttggggcggggcggtcgggggcgggaggaagaagtgggaggaggaggaggggaaagcgggggttgcgggagggggaggtggtagttgcggcgttggttttcgggagtagtcgtcgagttataattgcggaggaggagttcgggaaagcggtcgtcgggatttttttttttcgtcgttttcgtttcggttgagaggcgtttcggcgtatcggagggattttttttcgcgtttttttaggttgttgtcgtcgttgttgggagatgggtttattcgttcgttattttgcgttgtcgtcgttttgaggagttaaaggtacgggcgggtattcggaggagtttgcgtttcggagcgggagagaaggggcggttttcgtttacgatttagggagttttggtcgggtcgtagttttagcgtttttgttcgggatagaaatggattcggaagttcggtgggaaaggcgttttttttagtgtttagcgtgggttcggggtcgtggtcggtttagggggttaggtttcggttagtttcgggttttttattcggtttaggcgcgggcgtttttcgggtcgcgggggtcgaggtggagcgtgggattcgttttaagttttgtttttttggtgtttgtgcggtcggcggtcggttcggcgatattatgacgggtcgaggcggcgtttttttcgagttgttttttgtttttaaagcgggggagatttaagggcggttgtcgcggggaggcggcgggggcggaacgtatttttgacgggtgaaatcggttttaacgggatcgattttcgggtttcgttgtaaat

SEQ ID NO: 35512 - DNA, 1098 bp, Artificial Sequence
  chemically treated genomic DNA (Homo sapiens) CpG-island No: 35512
atttacaacgaaacccgaaaatcgatcccgttaaaaccgatttcacccgtcaaaaatacgttccgcccccgccgcctccccgcgacaaccgcccttaaatctcccccgctttaaaaacaaaaaacaactcgaaaaaaacgccgcctcgacccgtcataatatcgccgaaccgaccgccgaccgcacaaacaccaaaaaaacaaaacttaaaacgaatcccacgctccacctcgacccccgcgacccgaaaaacgcccgcgcctaaaccgaataaaaaacccgaaactaaccgaaacctaaccccctaaaccgaccacgaccccgaacccacgctaaacactaaaaaaaacgcctttcccaccgaacttccgaatccatttctatcccgaacaaaaacgctaaaactacgacccgaccaaaactccctaaatcgtaaacgaaaaccgccccttctctcccgctccgaaacgcaaactcctccgaatacccgcccgtacctttaactcctcaaaacgacgacaacgcaaaataacgaacgaataaacccatctcccaacaacgacgacaacaacctaaaaaaacgcgaaaaaaaatccctccgatacgccgaaacgcctctcaaccgaaacgaaaacgacgaaaaaaaaaaatcccgacgaccgctttcccgaactcctcctccgcaattataactcgacgactactcccgaaaaccaacgccgcaactaccacctccccctcccgcaacccccgctttcccctcctcctcctcccacttcttcctcccgcccccgaccgccccgccccaacgcgccgcccgcgtactatacgtcataacgtcacgcccaccgaacccgctacgaacgactctaaacgcgactattcccttacgcacgttcgttccgcgcccgcgcaaaaaccgccccgctacacccgaataaccccgactacgacccccacgcctatccctaacgaaaaaaacttcgcctcgaacgcgccgaacaataaaaccgatatctccctaaccgattctccgtaacccaaaaaacgtctcctccaaaaacaaatcgaaataactaaaactacgcccgattaaaa

SEQ ID NO: 35513 - DNA, 557 bp, Artificial Sequence
  chemically treated genomic DNA (Homo sapiens) CpG-island No: 35513
taattggaaaaaaagttacgtacgcgttgattttcggtaaatttattattagattaacggattgcgattacgtaacgcgaaatcgaatttttcgtacgtatcggagtgtcgagcgtttattcgaacgcgtatcgaaatttttttaatttaatcgttatagtattcgttatagttttttttcgtttatggttatatttttaattttttatatcgaatttttacgtatagcgtatattcgcgttagttatcgttatattagtatcgattatttatttttataagttcgcgaggggttattattcgaatatttattttcgttaacgtattacgtttttattttattaagttacgtattatatatgttcgaaattaacgtacgagcgacgatatatattacgtcggatttaatttaagatataattttttgtatttagttacgatcgtttttttttcggtttagtaattatttatttatttagtttcggtacggtacggattattttttattaatatttttatttatgttacgtagtaagtacgtttttattacgattatt

SEQ ID NO: 35514 - DNA, 557 bp, Artificial Sequence
  chemically treated genomic DNA (Homo sapiens) CpG-island No: 35514
aataatcgtaataaaaacgtacttactacgtaacataaataaaaatattaataaaaaataatccgtaccgtaccgaaactaaataaataaataattactaaaccgaaaaaaaaacgatcgtaactaaatacaaaaaattatatcttaaattaaatccgacgtaatatatatcgtcgctcgtacgttaatttcgaacatatataatacgtaacttaataaaataaaaacgtaatacgttaacgaaaataaatattcgaataataacccctcgcgaacttataaaaataaataatcgatactaatataacgataactaacgcgaatatacgctatacgtaaaaattcgatataaaaaattaaaaatataaccataaacgaaaaaaaactataacgaatactataacgattaaattaaaaaaatttcgatacgcgttcgaataaacgctcgacactccgatacgtacgaaaaattcgatttcgcgttacgtaatcgcaatccgttaatctaataataaatttaccgaaaatcaacgcgtacgtaactttttttccaatta

SEQ ID NO: 35515 - DNA, 557 bp, Artificial Sequence
  chemically treated genomic DNA (Homo sapiens) CpG-island No: 35515
agtggtcgtagtgggggcgtgtttgttgcgtagtatggatgagggtgttaatgagggatggttcgtatcgtgtcggagttgggtggatgggtgattgttgagtcgggaggagaacggtcgtagttgggtgtagggagttgtgttttaggttgggttcgacgtgatgtgtgtcgtcgttcgtacgttagtttcgggtatgtgtggtgcgtagtttagtggggtggaagcgtggtacgttggcgagggtgggtgttcgggtgatggtttttcgcgggtttgtagagataggtaatcggtgttggtgtagcggtggttggcgcgagtgtgcgttatgcgtaggagttcggtatggagagttaagggtatagttatgagcggagggaggttatagcgggtattgtagcgattaggttgaagaggtttcggtgcgcgttcgagtaagcgttcgatatttcgatacgtgcggggagttcggtttcgcgttgcgtaatcgtagttcgttagtttggtgatgagtttgtcggaagttagcgcgtgcgtagttttttttttaattg

SEQ ID NO: 35516 - DNA, 557 bp, Artificial Sequence
  chemically treated genomic DNA (Homo sapiens) CpG-island No: 35516
caattaaaaaaaaaactacgcacgcgctaacttccgacaaactcatcaccaaactaacgaactacgattacgcaacgcgaaaccgaactccccgcacgtatcgaaatatcgaacgcttactcgaacgcgcaccgaaacctcttcaacctaatcgctacaatacccgctataacctccctccgctcataactatacccttaactctccataccgaactcctacgcataacgcacactcgcgccaaccaccgctacaccaacaccgattacctatctctacaaacccgcgaaaaaccatcacccgaacacccaccctcgccaacgtaccacgcttccaccccactaaactacgcaccacacatacccgaaactaacgtacgaacgacgacacacatcacgtcgaacccaacctaaaacacaactccctacacccaactacgaccgttctcctcccgactcaacaatcacccatccacccaactccgacacgatacgaaccatccctcattaacaccctcatccatactacgcaacaaacacgcccccactacgaccact

SEQ ID NO: 35517 - DNA, 1009 bp, Artificial Sequence
  chemically treated genomic DNA (Homo sapiens) CpG-island No: 35517
tttttacgtacggttttagaaagacggggatagggcgcggtttaggttttatatattttgttagttaatgatcgcgtcgtttttttttcggtcggcgattcgattaatttaagaaggttggtgtaattttcggttttattcggttgttttcgttgatgcgggtagtttgggggtcgtcgtcgttaaatagacgtttttttttttaattttttttttatgtgtttattttcgggttcggcgtcgattcggatgttcgaggtagaaggatgtttgattttcggataagcgaggcgttgttgtgtatttatttcgggttgtatcggtggcgatagtagaggttcgggcggcgatttttcggttagcggcggcggtaggaggtattagcggtagtgtagggatcgaattcgagtagcgttgcgttatttttttttttcgtttttttttttttatttcgttcgttcgttcgttcgttttttgcgtggttcgtttttttttttcggtcgtcggcgggtgtgatgtgtcgtcgtcgttgttttcgtcggcgttgacggattgggggcgtcgttcgcgttcgggatcgatttttttgttcgcggtcgcgtttttgaggtaaagttttttgcgcgtaggtgtttcgttgttagtttcggttcggcggttgtttcggcgcggtcgcggcgttttttttttcgggtggggttggggtttcgggcgggtggggtggggtgcggcgggggcggcgtcgtaggcgcgggtgtcgggggaggggtgggcgagattatggcgggtggttcggagcgttggtaggagggggtcgcggtcggagttgaaggcgcggagggttaggggtagcgggggtcgcgggtggcgggtcgggttgggtgtaaaagttgtcggagtggtgcggcgcgattggggcggcgagggaggtgggttaattgggtcggcgggggtttttttaggagagattgggaggtggggagtgtcgtttacggtgttttttgattgt

SEQ ID NO: 35518 - DNA, 1009 bp, Artificial Sequence
  chemically treated genomic DNA (Homo sapiens) CpG-island No: 35518
acaatcaaaaaacaccgtaaacgacactccccacctcccaatctctcctaaaaaaacccccgccgacccaattaacccacctccctcgccgccccaatcgcgccgcaccactccgacaacttttacacccaacccgacccgccacccgcgacccccgctacccctaaccctccgcgccttcaactccgaccgcgaccccctcctaccaacgctccgaaccacccgccataatctcgcccacccctcccccgacacccgcgcctacgacgccgcccccgccgcaccccaccccacccgcccgaaaccccaaccccacccgaaaaaaaaaacgccgcgaccgcgccgaaacaaccgccgaaccgaaactaacaacgaaacacctacgcgcaaaaaactttacctcaaaaacgcgaccgcgaacaaaaaaatcgatcccgaacgcgaacgacgcccccaatccgtcaacgccgacgaaaacaacgacgacgacacatcacacccgccgacgaccgaaaaaaaaaaacgaaccacgcaaaaaacgaacgaacgaacgaacgaaataaaaaaaaaaaaacgaaaaaaaaaaataacgcaacgctactcgaattcgatccctacactaccgctaatacctcctaccgccgccgctaaccgaaaaatcgccgcccgaacctctactatcgccaccgatacaacccgaaataaatacacaacaacgcctcgcttatccgaaaatcaaacatccttctacctcgaacatccgaatcgacgccgaacccgaaaataaacacataaaaaaaaaattaaaaaaaaaaacgtctatttaacgacgacgacccccaaactacccgcatcaacgaaaacaaccgaataaaaccgaaaattacaccaaccttcttaaattaatcgaatcgccgaccgaaaaaaaaacgacgcgatcattaactaacaaaatatataaaacctaaaccgcgccctatccccgtctttctaaaaccgtacgtaaaaa

SEQ ID NO: 35519 - DNA, 1009 bp, Artificial Sequence
  chemically treated genomic DNA (Homo sapiens) CpG-island No: 35519
atagttaaggagtatcgtgggcgatattttttattttttaattttttttaaggaagttttcgtcggtttagttggtttatttttttcgtcgttttagtcgcgtcgtattatttcggtaatttttgtatttagttcgattcgttattcgcggttttcgttgtttttagtttttcgcgtttttagtttcgatcgcggtttttttttgttaacgtttcgggttattcgttatggtttcgtttatttttttttcgatattcgcgtttgcggcgtcgttttcgtcgtattttattttattcgttcgggattttagttttattcgggagggagggcgtcgcggtcgcgtcgaggtagtcgtcgggtcggggttggtagcggagtatttacgcgtagggggttttattttaaaggcgcggtcgcgagtagaggggtcggtttcgggcgcgggcggcgtttttagttcgttagcgtcggcgggggtagcggcggcggtatattatattcgtcggcggtcggaggaggaaagcgagttacgtagggagcgagcgagcgagcgagcgaggtaggggggaaggagcgagagagagaggtaacgtagcgttgttcggattcggtttttgtattgtcgttggtgttttttatcgtcgtcgttggtcggagagtcgtcgttcgagtttttgttgtcgttatcgatgtagttcggaatgaatgtatagtagcgtttcgtttattcggaggttaaatatttttttgtttcgggtattcggatcgacgtcggattcggaagtgaatatatggaaaaaaaattaaaaaggaaagcgtttgtttagcggcggcggtttttaagttgttcgtattagcgaaaatagtcgagtagagtcgaagattgtattaatttttttggattggtcggatcgtcgatcggaaaggagacggcgcggttattggttggtaaggtgtataaagtttaagtcgcgttttattttcgtttttttagagtcgtgcgtgaggg

SEQ ID NO: 35520 - DNA, 1009 bp, Artificial Sequence
  chemically treated genomic DNA (Homo sapiens) CpG-island No: 35520
ccctcacgcacgactctaaaaaaacgaaaataaaacgcgacttaaactttatacaccttaccaaccaataaccgcgccgtctcctttccgatcgacgatccgaccaatccaaaaaaattaatacaatcttcgactctactcgactattttcgctaatacgaacaacttaaaaaccgccgccgctaaacaaacgctttcctttttaattttttttccatatattcacttccgaatccgacgtcgatccgaatacccgaaacaaaaaaatatttaacctccgaataaacgaaacgctactatacattcattccgaactacatcgataacgacaacaaaaactcgaacgacgactctccgaccaacgacgacgataaaaaacaccaacgacaatacaaaaaccgaatccgaacaacgctacgttacctctctctctcgctccttcccccctacctcgctcgctcgctcgctcgctccctacgtaactcgctttcctcctccgaccgccgacgaatataatataccgccgccgctacccccgccgacgctaacgaactaaaaacgccgcccgcgcccgaaaccgacccctctactcgcgaccgcgcctttaaaataaaaccccctacgcgtaaatactccgctaccaaccccgacccgacgactacctcgacgcgaccgcgacgccctccctcccgaataaaactaaaatcccgaacgaataaaataaaatacgacgaaaacgacgccgcaaacgcgaatatcgaaaaaaaaataaacgaaaccataacgaataacccgaaacgttaacaaaaaaaaaccgcgatcgaaactaaaaacgcgaaaaactaaaaacaacgaaaaccgcgaataacgaatcgaactaaatacaaaaattaccgaaataatacgacgcgactaaaacgacgaaaaaaataaaccaactaaaccgacgaaaacttccttaaaaaaaattaaaaaataaaaaatatcgcccacgatactccttaactat

SEQ ID NO: 35521 - DNA, 680 bp, Artificial Sequence
  chemically treated genomic DNA (Homo sapiens) CpG-island No: 35521
attacgaggttttacgagaaggggaggtatttgcgaggcggttaggttattattaggcggcgcgtcggattcgagtagcgaagagtagttagcgaggttttgtaggtttatggtggtgagggttgcgcggggagatcgggagatacgcgtcgggcgggttttgagttttttcgttaggttcgtagttaggacgttagagttcgggggagagaagttttttcgagttgtgcgcgtcgtattttttcggcgcggggaattcgaggggtagcgtgggtgttacggggtttatttggtagcgttgtgggttcggcgttcgggggattttcgtatatcgatatcgggttttcgtttgtgtattcggggaagaattttcgcggaggagcgaattggtcgggtatataaacgttgaacgcgggttagttttcggggtatcgagcgcgtagatttcgttcggttcgaattaatcgttttattttttttttcggttttttcggtttgtagagtagcgttcggttcggtagtgttagtattttgttggggtagatgttgtcgaaggttcgacggtcggtcgcgtcgttttcgtacgtttgtattgtgttttttgttttcgggtgtcgattgttcggaggcggcggttcgggttggggtagcgatttatattttgtattttttttagtgtt

SEQ ID NO: 35522 - DNA, 680 bp, Artificial Sequence
  chemically treated genomic DNA (Homo sapiens) CpG-island No: 35522
aacactaaaaaaaatacaaaatataaatcgctaccccaacccgaaccgccgcctccgaacaatcgacacccgaaaacaaaaaacacaatacaaacgtacgaaaacgacgcgaccgaccgtcgaaccttcgacaacatctaccccaacaaaatactaacactaccgaaccgaacgctactctacaaaccgaaaaaaccgaaaaaaaaaataaaacgattaattcgaaccgaacgaaatctacgcgctcgataccccgaaaactaacccgcgttcaacgtttatatacccgaccaattcgctcctccgcgaaaattcttccccgaatacacaaacgaaaacccgatatcgatatacgaaaatcccccgaacgccgaacccacaacgctaccaaataaaccccgtaacacccacgctacccctcgaattccccgcgccgaaaaaatacgacgcgcacaactcgaaaaaacttctctcccccgaactctaacgtcctaactacgaacctaacgaaaaaactcaaaacccgcccgacgcgtatctcccgatctccccgcgcaaccctcaccaccataaacctacaaaacctcgctaactactcttcgctactcgaatccgacgcgccgcctaataataacctaaccgcctcgcaaatacctccccttctcgtaaaacctcgtaat

SEQ ID NO: 35523 - DNA, 680 bp, Artificial Sequence
  chemically treated genomic DNA (Homo sapiens) CpG-island No: 35523
ggtattgaagggagtgtagggtgtggatcgttgttttagttcgggtcgtcgttttcgagtagtcggtattcggaggtaggaggtataatgtaggcgtgcgggggcggcgcggtcggtcgtcgggttttcgatagtatttgttttaatagaatgttggtattgtcgggtcgggcgttgttttgtaagtcggggaagtcggagaggaaggtggggcggttgattcgggtcgggcggggtttgcgcgttcggtgtttcgagggttgattcgcgtttaacgtttgtgtgttcggttagttcgttttttcgcggaagttttttttcggatgtataggcgggagttcggtgtcggtgtacgaggatttttcggacgtcgagtttatagcgttgttaggtgagtttcgtggtatttacgttatttttcgggtttttcgcgtcgggagggtgcggcgcgtatagttcggaggagtttttttttttcgggttttgacgttttagttgcgagtttggcggagaggtttagggttcgttcggcgcgtgtttttcggttttttcgcgtagtttttattattatagatttgtaggatttcgttgattgtttttcgttattcgggttcgacgcgtcgtttggtggtgatttggtcgtttcgtaggtatttttttttttcgtggagtttcgtggt

SEQ ID NO: 35524 - DNA, 680 bp, Artificial Sequence
  chemically treated genomic DNA (Homo sapiens) CpG-island No: 35524
accacgaaactccacgaaaaaaaaaaatacctacgaaacgaccaaatcaccaccaaacgacgcgtcgaacccgaataacgaaaaacaatcaacgaaatcctacaaatctataataataaaaactacgcgaaaaaaccgaaaaacacgcgccgaacgaaccctaaacctctccgccaaactcgcaactaaaacgtcaaaacccgaaaaaaaaaaactcctccgaactatacgcgccgcaccctcccgacgcgaaaaacccgaaaaataacgtaaataccacgaaactcacctaacaacgctataaactcgacgtccgaaaaatcctcgtacaccgacaccgaactcccgcctatacatccgaaaaaaaacttccgcgaaaaaacgaactaaccgaacacacaaacgttaaacgcgaatcaaccctcgaaacaccgaacgcgcaaaccccgcccgacccgaatcaaccgccccaccttcctctccgacttccccgacttacaaaacaacgcccgacccgacaataccaacattctattaaaacaaatactatcgaaaacccgacgaccgaccgcgccgcccccgcacgcctacattatacctcctacctccgaataccgactactcgaaaacgacgacccgaactaaaacaacgatccacaccctacactcccttcaatacc

SEQ ID NO: 35525 - DNA, 883 bp, Artificial Sequence
  chemically treated genomic DNA (Homo sapiens) CpG-island No: 35525
gtttttcgcgggtggaagtggtttttttgcgttttgcggaaggcgtagtagttttggtcgtagtcgcggaaggtttgtagatttagttgcgttacgggttgggtcgggtcgggtagggggttattatttcgcgtcgtagaggggttttttgcgtcgtttgagtcggagttgggggattcgaataggtcgtaaatgtcggagtttttcgggagcgggtacgggtttaggggatgtagcggttgtttttttcggaggcgcggacgtttgtttttttttatcggggcgcgaaggttttggtcgttgtttcgttttttcgttcgggcggcggggttcgaggggttggtgggatagggggttattatgatgcggtcgggtggtcgttttattatttttaacgttcgggttgcggcgggtagtaaacgcgtattcgaaagtgcgaaggaggtcgggtttagaggttggcgcggttttaagtattcggtcggttttttttttttattatattttcggttttttattggttgagtttagagcggtatcggagtcgcgatttttcggttggagaattattcgttttagggcgtaggtagcgcgtcgttttcgcggttcgtcggggggagggggagttgtagcgcgcgttcggtattcgtttttcgcgtttgcgttttgcgttatttgggtaatcggagttcgggtcgttgcgggagttcgggttattgcggagttcggtgtacggagtgggagtagggttgcggcgggcgtagttaagcggtttcgttgcgtcggttaaaatatttttttagggggtatttttttgtttttggttagatggtttcgatacgtgcgggtatttttaatttaggtcggtaattttgtaaaggtt

SEQ ID NO: 35526 - DNA, 883 bp, Artificial Sequence
  chemically treated genomic DNA (Homo sapiens) CpG-island No: 35526
aacctttacaaaattaccgacctaaattaaaaatacccgcacgtatcgaaaccatctaaccaaaaacaaaaaaataccccctaaaaaaatattttaaccgacgcaacgaaaccgcttaactacgcccgccgcaaccctactcccactccgtacaccgaactccgcaataacccgaactcccgcaacgacccgaactccgattacccaaataacgcaaaacgcaaacgcgaaaaacgaataccgaacgcgcgctacaactccccctccccccgacgaaccgcgaaaacgacgcgctacctacgccctaaaacgaataattctccaaccgaaaaatcgcgactccgataccgctctaaactcaaccaataaaaaaccgaaaatataataaaaaaaaaaaaccgaccgaatacttaaaaccgcgccaacctctaaacccgacctccttcgcactttcgaatacgcgtttactacccgccgcaacccgaacgttaaaaataataaaacgaccacccgaccgcatcataataaccccctatcccaccaacccctcgaaccccgccgcccgaacgaaaaaacgaaacaacgaccaaaaccttcgcgccccgataaaaaaaaacaaacgtccgcgcctccgaaaaaaacaaccgctacatcccctaaacccgtacccgctcccgaaaaactccgacatttacgacctattcgaatcccccaactccgactcaaacgacgcaaaaaacccctctacgacgcgaaataataaccccctacccgacccgacccaacccgtaacgcaactaaatctacaaaccttccgcgactacgaccaaaactactacgccttccgcaaaacgcaaaaaaaccacttccacccgcgaaaaac

SEQ ID NO: 35527 - DNA, 883 bp, Artificial Sequence
  chemically treated genomic DNA (Homo sapiens) CpG-island No: 35527
gatttttataaaattatcgatttgggttagaggtgttcgtacgtgtcgagattatttggttaaggatagaaagatgttttttgggagaatgttttaatcggcgtagcggagtcgtttggttgcgttcgtcgtagttttatttttatttcgtgtatcgggtttcgtagtgattcgggttttcgtagcgattcgggtttcggttgtttaggtaacgtaggacgtaggcgcgaaaggcgggtgtcgggcgcgcgttgtagtttttttttttttcggcgggtcgcggaggcgacgcgttgtttgcgttttgaggcgagtggttttttagtcggaaaatcgcggtttcggtgtcgttttgggtttagttagtgagaggtcgggggtgtggtagagagaaggagtcggtcgggtatttaggatcgcgttagtttttgagttcggtttttttcgtattttcgagtgcgcgtttgttgttcgtcgtagttcgggcgttgaaggtagtaaagcggttattcggtcgtattatggtgattttttgttttattagtttttcgagtttcgtcgttcgagcggggaggcgggataacgattagaattttcgcgtttcggtgaagaagagtaggcgttcgcgttttcggaggaagtagtcgttgtattttttgaattcgtgttcgttttcgggagatttcggtatttgcgatttgttcgagttttttagtttcggtttagacggcgtagagagtttttttgcggcgcggggtggtagttttttgttcggttcggtttagttcgtggcgtagttagatttatagatttttcgcgattacggttagagttgttacgtttttcgtaaggcgtaggagagttatttttattcgcgggaggt

SEQ ID NO: 35528 - DNA, 883 bp, Artificial Sequence
  chemically treated genomic DNA (Homo sapiens) CpG-island No: 35528
acctcccgcgaataaaaataactctcctacgccttacgaaaaacgtaacaactctaaccgtaatcgcgaaaaatctataaatctaactacgccacgaactaaaccgaaccgaacaaaaaactaccaccccgcgccgcaaaaaaactctctacgccgtctaaaccgaaactaaaaaactcgaacaaatcgcaaataccgaaatctcccgaaaacgaacacgaattcaaaaaatacaacgactacttcctccgaaaacgcgaacgcctactcttcttcaccgaaacgcgaaaattctaatcgttatcccgcctccccgctcgaacgacgaaactcgaaaaactaataaaacaaaaaatcaccataatacgaccgaataaccgctttactaccttcaacgcccgaactacgacgaacaacaaacgcgcactcgaaaatacgaaaaaaaccgaactcaaaaactaacgcgatcctaaatacccgaccgactccttctctctaccacacccccgacctctcactaactaaacccaaaacgacaccgaaaccgcgattttccgactaaaaaaccactcgcctcaaaacgcaaacaacgcgtcgcctccgcgacccgccgaaaaaaaaaaaaactacaacgcgcgcccgacacccgcctttcgcgcctacgtcctacgttacctaaacaaccgaaacccgaatcgctacgaaaacccgaatcactacgaaacccgatacacgaaataaaaataaaactacgacgaacgcaaccaaacgactccgctacgccgattaaaacattctcccaaaaaacatctttctatccttaaccaaataatctcgacacgtacgaacacctctaacccaaatcgataattttataaaaatc

SEQ ID NO: 35529 - DNA, 686 bp, Artificial Sequence
  chemically treated genomic DNA (Homo sapiens) CpG-island No: 35529
tttttgttttttttttggtttgttttcggtttttttttcgttattttcgtttcgcgtttggtacggcgtcggcgcgttttagtcgtttaatttcggttcgtagttttgattttttgttcgtcgggttttttcggtacgtgtttcgcgttttatgggatcgcgcgttttttcggggcgttttttcgcggtttttcgtttgggggagtcgggtttgggggagcgggtcgtttcggttcggaggtggggtcggcgggggcgggcgggtcggcgcggcggcgggaagggacgttgtttttttaaggtgttatcgtcgcgtggtagggaaatagtttgtgttagttttatttcgttcggtttcgttcgttataagaaatataatgtataataattaggcgcgcgtttggagttatgttacgcggcgggggcggggcggggtcgcgcgtcgggcggggcgggggattcggggtttcggttttcgatttgcgttttgggttcgtaggggagttttgttttatgttattcgcggggtcgttttgtgttttagcgaggtgtttcggtgtttttcgtttcgttcgcgtttgttttttttttttcgttatttcgttttttataaagtttatttttattaatttttttttaggttattttttttttatatttgataatcggggttttttattttttta

SEQ ID NO: 35530 - DNA, 686 bp, Artificial Sequence
  chemically treated genomic DNA (Homo sapiens) CpG-island No: 35530
taaaaaaataaaaaaccccgattatcaaatataaaaaaaaaataacctaaaaaaaaattaataaaaataaactttataaaaaacgaaataacgaaaaaaaaaaaacaaacgcgaacgaaacgaaaaacaccgaaacacctcgctaaaacacaaaacgaccccgcgaataacataaaacaaaactcccctacgaacccaaaacgcaaatcgaaaaccgaaaccccgaatcccccgccccgcccgacgcgcgaccccgccccgcccccgccgcgtaacataactccaaacgcgcgcctaattattatacattatatttcttataacgaacgaaaccgaacgaaataaaactaacacaaactatttccctaccacgcgacgataacaccttaaaaaaacaacgtcccttcccgccgccgcgccgacccgcccgcccccgccgaccccacctccgaaccgaaacgacccgctcccccaaacccgactcccccaaacgaaaaaccgcgaaaaaacgccccgaaaaaacgcgcgatcccataaaacgcgaaacacgtaccgaaaaaacccgacgaacaaaaaatcaaaactacgaaccgaaattaaacgactaaaacgcgccgacgccgtaccaaacgcgaaacgaaaataacgaaaaaaaaaccgaaaacaaaccaaaaaaaaaacaaaaa

SEQ ID NO: 35531 - DNA, 686 bp, Artificial Sequence
  chemically treated genomic DNA (Homo sapiens) CpG-island No: 35531
tgggagaatgaggggtttcgattgttagatgtgagggggaagtggtttggaaaagagttagtgggaatgaattttgtagggagcgagatggcggggagggaggggtaagcgcgggcgaggcggggggtatcggggtatttcgttggggtatagggcggtttcgcgggtagtatggggtaggatttttttgcgggtttaggacgtaggtcgggggtcgagatttcggatttttcgtttcgttcggcgcgcggtttcgtttcgttttcgtcgcgtggtatggttttaagcgcgcgtttgattgttatgtattgtgttttttgtagcgaacggagtcgggcggaatggggttggtataagttgtttttttgttacgcggcggtggtattttaaaggggtagcgttttttttcgtcgtcgcgtcggttcgttcgttttcgtcgattttattttcgagtcggggcgattcgtttttttaagttcggtttttttaagcgggaggtcgcggggaggcgtttcgggagggcgcgcggttttatggggcgcggggtacgtgtcgagggagttcggcgggtaggaagttagggttgcgagtcgggattgggcggttggggcgcgtcggcgtcgtgttaggcgcggggcgggggtggcgaggagagaatcgggagtaagttaggagaaggataagga

SEQ ID NO: 35532 - DNA, 686 bp, Artificial Sequence
  chemically treated genomic DNA (Homo sapiens) CpG-island No: 35532
tccttatccttctcctaacttactcccgattctctcctcgccacccccgccccgcgcctaacacgacgccgacgcgccccaaccgcccaatcccgactcgcaaccctaacttcctacccgccgaactccctcgacacgtaccccgcgccccataaaaccgcgcgccctcccgaaacgcctccccgcgacctcccgcttaaaaaaaccgaacttaaaaaaacgaatcgccccgactcgaaaataaaatcgacgaaaacgaacgaaccgacgcgacgacgaaaaaaaacgctacccctttaaaataccaccgccgcgtaacaaaaaaacaacttataccaaccccattccgcccgactccgttcgctacaaaaaacacaatacataacaatcaaacgcgcgcttaaaaccataccacgcgacgaaaacgaaacgaaaccgcgcgccgaacgaaacgaaaaatccgaaatctcgacccccgacctacgtcctaaacccgcaaaaaaatcctaccccatactacccgcgaaaccgccctataccccaacgaaataccccgataccccccgcctcgcccgcgcttacccctccctccccgccatctcgctccctacaaaattcattcccactaactcttttccaaaccacttccccctcacatctaacaatcgaaacccctcattctccca

SEQ ID NO: 35533 - DNA, 604 bp, Artificial Sequence
  chemically treated genomic DNA (Homo sapiens) CpG-island No: 35533
gtcggggagcgcgagggagcgaggtatagatttggtttagcgagcgcgggggcgagtttcgagtttcgagagtttggggggtcgtagttcgggcgtcgattttttttcgtttttcgcgtttttttttcggcgggtacggtatttttattcgtgcgcgaatagtttttttttttttttcgtcgtatagttcgcgtttgcgcgggggagtttagtatagatcgtcgtcgggatttcgagtcgcgtattttagttttatcgtttatttcgcgcgttatggattttaaggatcgtaagaagatttagttttcggtgttcgcgttttttagttagttcgattttcgttaggtggagatggtaaggggttcgtgttttatttcggtagcgtattcgatatatttcgcggggttttttcgtttttttaaggcgttgtttcggtcggattggtttgggggtgggggcgtaaggagagtcgggttttgtttcggttaggacggggcgcggggtcgcgtgtgaagttagttggagattcgtgtaattttttttcgcggttttggttttgatttcggggtaagagagtttttggtagtgaggttgggggtgcggg

SEQ ID NO: 35534 - DNA, 604 bp, Artificial Sequence
  chemically treated genomic DNA (Homo sapiens) CpG-island No: 35534
cccgcacccccaacctcactaccaaaaactctcttaccccgaaatcaaaaccaaaaccgcgaaaaaaaattacacgaatctccaactaacttcacacgcgaccccgcgccccgtcctaaccgaaacaaaacccgactctccttacgcccccacccccaaaccaatccgaccgaaacaacgccttaaaaaaacgaaaaaaccccgcgaaatatatcgaatacgctaccgaaataaaacacgaaccccttaccatctccacctaacgaaaatcgaactaactaaaaaacgcgaacaccgaaaactaaatcttcttacgatccttaaaatccataacgcgcgaaataaacgataaaactaaaatacgcgactcgaaatcccgacgacgatctatactaaactcccccgcgcaaacgcgaactatacgacgaaaaaaaaaaaaaaactattcgcgcacgaataaaaataccgtacccgccgaaaaaaaaacgcgaaaaacgaaaaaaaatcgacgcccgaactacgaccccccaaactctcgaaactcgaaactcgcccccgcgctcgctaaaccaaatctatacctcgctccctcgcgctccccgac

SEQ ID NO: 35535 - DNA, 604 bp, Artificial Sequence
  chemically treated genomic DNA (Homo sapiens) CpG-island No: 35535
ttcgtatttttagttttattgttaggaatttttttgtttcgggattaggattaaagtcgcggggaaaagttgtacgagtttttagttaattttatacgcggtttcgcgtttcgttttgatcgaggtagagttcggttttttttgcgtttttatttttaggttagttcggtcggggtagcgttttgggagggcgaagaagtttcgcggggtgtgtcgggtacgttgtcggggtggggtacgggttttttattatttttatttggcgggggtcgagttggttagggggcgcgggtatcgagaattggatttttttgcggtttttggggtttatggcgcgcggggtgggcggtggggttggggtgcgcgattcggggtttcggcggcggtttgtgttgggttttttcgcgtaggcgcgggttgtgcggcgagaggaggaggagggttgttcgcgtacggataaaaatatcgtgttcgtcgaggggagggcgcgggaagcggaggagggtcggcgttcgggttgcggttttttaggttttcgggattcggggttcgttttcgcgttcgttgagttaggtttgtgtttcgttttttcgcgtttttcggt

SEQ ID NO: 35536 - DNA, 604 bp, Artificial Sequence
  chemically treated genomic DNA (Homo sapiens) CpG-island No: 35536
accgaaaaacgcgaaaaaacgaaacacaaacctaactcaacgaacgcgaaaacgaaccccgaatcccgaaaacctaaaaaaccgcaacccgaacgccgaccctcctccgcttcccgcgccctcccctcgacgaacacgatatttttatccgtacgcgaacaaccctcctcctcctctcgccgcacaacccgcgcctacgcgaaaaaacccaacacaaaccgccgccgaaaccccgaatcgcgcaccccaaccccaccgcccaccccgcgcgccataaaccccaaaaaccgcaaaaaaatccaattctcgatacccgcgccccctaaccaactcgacccccgccaaataaaaataataaaaaacccgtaccccaccccgacaacgtacccgacacaccccgcgaaacttcttcgccctcccaaaacgctaccccgaccgaactaacctaaaaataaaaacgcaaaaaaaaccgaactctacctcgatcaaaacgaaacgcgaaaccgcgtataaaattaactaaaaactcgtacaacttttccccgcgactttaatcctaatcccgaaacaaaaaaattcctaacaataaaactaaaaatacgaa

SEQ ID NO: 35537 - DNA, 686 bp, Artificial Sequence
  chemically treated genomic DNA (Homo sapiens) CpG-island No: 35537
  misc_feature (209)..(209): n is either a, c, g or t
gagtaaggcgtcgacggtgcggtcgtttttacggttcgggcggttcgttcgttatgtatttttattcgtattcgtgttcgcgtttgggggtaagttaggtgttaggcggtcggcggttgggcggcgggcggcgtacgttttgcgagatttacggttattgcgtcgtttacgagacgttgtatgcggcggtaggcggtggcggtcgattnggattataatagtttcgagtacgagggttcgtttagtttttcgttttgttttaatggtaattttttatttaagtaggatttttcgttcgattacgagaaaagttattattattttatgtattattcggcgttgtcggttcgcggtttacgtcgacgggttagttttcggttcgtcggttgtgcgcgggggcgtttattcggagaattttttgttttacgatatgtatttttattacgatcggggttttatgtacgaggagtttaatgcgtttttttataattgagatttcgcgtcggttttttttttttttttttgtttttgttcgtttttttgtttttagtttttagagcgtagggatatttttattttatttcggcgtcggcggatgttcgggtttacggttttcgtcgtttttttggggtagcgtagttttgttatttgtgggtggtttgttttaggggtttcgttttttttag

SEQ ID NO: 35538 - DNA, 686 bp, Artificial Sequence
  chemically treated genomic DNA (Homo sapiens) CpG-island No: 35538
  misc_feature (478)..(478): n is either a, c, g or t
ctaaaaaaaacgaaacccctaaaacaaaccacccacaaataacaaaactacgctaccccaaaaaaacgacgaaaaccgtaaacccgaacatccgccgacgccgaaataaaataaaaatatccctacgctctaaaaactaaaaacaaaaaaacgaacaaaaacaaaaaaaaaaaaaaaaaaccgacgcgaaatctcaattataaaaaaacgcattaaactcctcgtacataaaaccccgatcgtaataaaaatacatatcgtaaaacaaaaaattctccgaataaacgcccccgcgcacaaccgacgaaccgaaaactaacccgtcgacgtaaaccgcgaaccgacaacgccgaataatacataaaataataataacttttctcgtaatcgaacgaaaaatcctacttaaataaaaaattaccattaaaacaaaacgaaaaactaaacgaaccctcgtactcgaaactattataatccnaatcgaccgccaccgcctaccgccgcatacaacgtctcgtaaacgacgcaataaccgtaaatctcgcaaaacgtacgccgcccgccgcccaaccgccgaccgcctaacacctaacttacccccaaacgcgaacacgaatacgaataaaaatacataacgaacgaaccgcccgaaccgtaaaaacgaccgcaccgtcgacgccttactc

SEQ ID NO: 35539 - DNA, 686 bp, Artificial Sequence
  chemically treated genomic DNA (Homo sapiens) CpG-island No: 35539
  misc_feature (478)..(478): n is either a, c, g or t
ttgggggaagcgaggtttttgggataggttatttataggtaataggattgcgttgttttaggagagcggcgaggatcgtggattcgaatattcgtcggcgtcggggtaggatgggggtgtttttgcgttttgggggttggggataggggggcgggtaaaggtaaaagaaaaagaagggagtcggcgcgaagttttagttatgaaaaaacgtattgagtttttcgtatatggggtttcggtcgtggtgaaggtgtatatcgtaagataagagatttttcgagtggacgttttcgcgtatagtcgacgagtcgaagattagttcgtcggcgtgggtcgcgaatcggtagcgtcgagtagtgtatagagtagtggtagtttttttcgtggtcgggcgaggagttttgtttgagtgagaagttgttattgagatagagcggggggttgagcgggttttcgtattcggagttgttgtagtttnggtcggtcgttatcgtttgtcgtcgtatatagcgtttcgtaggcggcgtagtagtcgtgggtttcgtaggacgtgcgtcgttcgtcgtttagtcgtcggtcgtttggtatttggtttgtttttaggcgcgagtacgggtacgggtaggggtgtatggcgaacgggtcgttcgagtcgtggaagcggtcgtatcgtcggcgttttgttt

SEQ ID NO: 35540 - DNA, 686 bp, Artificial Sequence
  chemically treated genomic DNA (Homo sapiens) CpG-island No: 35540
  misc_feature (209)..(209): n is either a, c, g or t
aaacaaaacgccgacgatacgaccgcttccacgactcgaacgacccgttcgccatacacccctacccgtacccgtactcgcgcctaaaaacaaaccaaataccaaacgaccgacgactaaacgacgaacgacgcacgtcctacgaaacccacgactactacgccgcctacgaaacgctatatacgacgacaaacgataacgaccgaccnaaactacaacaactccgaatacgaaaacccgctcaaccccccgctctatctcaataacaacttctcactcaaacaaaactcctcgcccgaccacgaaaaaaactaccactactctatacactactcgacgctaccgattcgcgacccacgccgacgaactaatcttcgactcgtcgactatacgcgaaaacgtccactcgaaaaatctcttatcttacgatatacaccttcaccacgaccgaaaccccatatacgaaaaactcaatacgttttttcataactaaaacttcgcgccgactcccttctttttcttttacctttacccgcccccctatccccaacccccaaaacgcaaaaacacccccatcctaccccgacgccgacgaatattcgaatccacgatcctcgccgctctcctaaaacaacgcaatcctattacctataaataacctatcccaaaaacctcgcttcccccaa

SEQ ID NO: 35541 - DNA, 798 bp, Artificial Sequence
  chemically treated genomic DNA (Homo sapiens) CpG-island No: 35541
cgatttcgggatatttaggttgaaaatcgagtataatataatagtgttggttttcgacgttaatgataacgttttcgtttttatttaaattttttatattttgttcgttcgcgagaataatagtttcgttttgtatatcggtagcgttagcgttatagatagagattcgggtattaacgtttaggttatttattcgttgttgtcgttttaggattcgtatttgtttttcgtttttttggtttttattaacgcggataacggttatttgttcgttttttagtcgttggattacgaggttttgtaggcgttcgagtttcgcgtgggcgtcgtagatcgcggtttttcggcgttgagtagcgaggcgttggtgcgcgtgttggtgttggacgttaacgataattcgtttttcgtgttgtattcgttgtagaacggtttcgcgttttgtatcgagttggtgtttcgggcggtcgagtcgggttatttggtgattaaggtggtggcggtggacggcgattcgggttagaacgtttggttgtcgtattagttgtttaaggttacggagttcgggttgttcggcgtgtgggcgtataatggcgaggtgcgtatcgttaggttgttgagggagcgcgacgttgttaagtagaggttggtggtgttggttaaggataatggcgagttttcgcgttcggttatcgtttacgttgtacgtgtttttggtggacggttttttttagttttatttgttgttttcggaggcggtatcggtttaggtttaggtcgatttgtttatcgtttatt

SEQ ID NO: 35542 - DNA, 798 bp, Artificial Sequence
  chemically treated genomic DNA (Homo sapiens) CpG-island No: 35542
aataaacgataaacaaatcgacctaaacctaaaccgataccgcctccgaaaacaacaaataaaactaaaaaaaaccgtccaccaaaaacacgtacaacgtaaacgataaccgaacgcgaaaactcgccattatccttaaccaacaccaccaacctctacttaacaacgtcgcgctccctcaacaacctaacgatacgcacctcgccattatacgcccacacgccgaacaacccgaactccgtaaccttaaacaactaatacgacaaccaaacgttctaacccgaatcgccgtccaccgccaccaccttaatcaccaaataacccgactcgaccgcccgaaacaccaactcgatacaaaacgcgaaaccgttctacaacgaatacaacacgaaaaacgaattatcgttaacgtccaacaccaacacgcgcaccaacgcctcgctactcaacgccgaaaaaccgcgatctacgacgcccacgcgaaactcgaacgcctacaaaacctcgtaatccaacgactaaaaaacgaacaaataaccgttatccgcgttaataaaaaccaaaaaaacgaaaaacaaatacgaatcctaaaacgacaacaacgaataaataacctaaacgttaatacccgaatctctatctataacgctaacgctaccgatatacaaaacgaaactattattctcgcgaacgaacaaaatataaaaaatttaaataaaaacgaaaacgttatcattaacgtcgaaaaccaacactattatattatactcgattttcaacctaaatatcccgaaatcg

SEQ ID NO: 35543 - DNA, 798 bp, Artificial Sequence
  chemically treated genomic DNA (Homo sapiens) CpG-island No: 35543
ggtagacggtgagtaagtcggtttgggtttgggtcggtgtcgttttcgggagtagtaggtagggttgggagaagtcgtttattaggagtacgtgtagcgtgggcggtggtcgagcgcggaggttcgttattgtttttgattagtattattagtttttgtttggtagcgtcgcgtttttttagtagtttggcggtgcgtatttcgttattgtgcgtttatacgtcgaatagttcgggtttcgtggttttgagtagttggtacgatagttaggcgttttggttcgagtcgtcgtttatcgttattattttggttattaggtagttcggttcggtcgttcggggtattagttcggtgtagggcgcggagtcgttttgtagcgggtatagtacgaagggcgagttgtcgttggcgtttagtattagtacgcgtattagcgtttcgttgtttaacgtcggggagtcgcggtttgcggcgtttacgcggaattcgaacgtttgtagggtttcgtagtttagcgattggagagcgaataggtggtcgttgttcgcgttgatggagattagggaggcgaggggtaggtgcgggttttggggcggtagtagcgagtaggtgatttgggcgttggtgttcgagtttttgtttgtggcgttgacgttgtcgatgtgtagggcggggttgttgttttcgcggacgaatagggtgtaggaggtttgggtgaaggcgggggcgttgttattgacgtcggagattagtattgttatgttgtgttcggtttttagtttgggtgtttcgaagtcg

SEQ ID NO: 35544 - DNA, 798 bp, Artificial Sequence
  chemically treated genomic DNA (Homo sapiens) CpG-island No: 35544
cgacttcgaaacacccaaactaaaaaccgaacacaacataacaatactaatctccgacgtcaataacaacgcccccgccttcacccaaacctcctacaccctattcgtccgcgaaaacaacaaccccgccctacacatcgacaacgtcaacgccacaaacaaaaactcgaacaccaacgcccaaatcacctactcgctactaccgccccaaaacccgcacctacccctcgcctccctaatctccatcaacgcgaacaacgaccacctattcgctctccaatcgctaaactacgaaaccctacaaacgttcgaattccgcgtaaacgccgcaaaccgcgactccccgacgttaaacaacgaaacgctaatacgcgtactaatactaaacgccaacgacaactcgcccttcgtactatacccgctacaaaacgactccgcgccctacaccgaactaataccccgaacgaccgaaccgaactacctaataaccaaaataataacgataaacgacgactcgaaccaaaacgcctaactatcgtaccaactactcaaaaccacgaaacccgaactattcgacgtataaacgcacaataacgaaatacgcaccgccaaactactaaaaaaacgcgacgctaccaaacaaaaactaataatactaatcaaaaacaataacgaacctccgcgctcgaccaccgcccacgctacacgtactcctaataaacgacttctcccaaccctacctactactcccgaaaacgacaccgacccaaacccaaaccgacttactcaccgtctacc

SEQ ID NO: 35545 - DNA, 578 bp, Artificial Sequence
  chemically treated genomic DNA (Homo sapiens) CpG-island No: 35545
tgcgtttcgtttttttggtttttattaacgcggataacggttatttgtttgtttttaggtcgttggattacgaggttttgtaggcgttcgagtttcgcgtgggagttatagatcgcggtttttcggcgttgagtagcgaggcgttggtgcgcgtgttggtgttggacgttaacgataattcgtttttcgtgttgtattcgttgtagaacggttcggcgttttgtatcgagttggtgtttcgggcggtcgagtcgggttatttggtgattaaggtggtggcggtggacggtgattcgggttagaacgtttggttgtcgtattagttgtttaaggttacggagttcgggttgtttagtatgtgggcgtataatggcgaggtgcgtatcgttaggttgttgagcgagcgcgacgcggttaagtataggttggtggtgttggttaaggataatggcgagttttcgcgttcggttatcgttacgttgtacgtgtttttggtggacggttttttttagttttatttgtcgttgtcggaggcggtttcggtttaggtttaggtcgattcgtttattgtttatttg

SEQ ID NO: 35546 - DNA, 578 bp, Artificial Sequence
  chemically treated genomic DNA (Homo sapiens) CpG-island No: 35546
caaataaacaataaacgaatcgacctaaacctaaaccgaaaccgcctccgacaacgacaaataaaactaaaaaaaaccgtccaccaaaaacacgtacaacgtaacgataaccgaacgcgaaaactcgccattatccttaaccaacaccaccaacctatacttaaccgcgtcgcgctcgctcaacaacctaacgatacgcacctcgccattatacgcccacatactaaacaacccgaactccgtaaccttaaacaactaatacgacaaccaaacgttctaacccgaatcaccgtccaccgccaccaccttaatcaccaaataacccgactcgaccgcccgaaacaccaactcgatacaaaacgccgaaccgttctacaacgaatacaacacgaaaaacgaattatcgttaacgtccaacaccaacacgcgcaccaacgcctcgctactcaacgccgaaaaaccgcgatctataactcccacgcgaaactcgaacgcctacaaaacctcgtaatccaacgacctaaaaacaaacaaataaccgttatccgcgttaataaaaaccaaaaaaacgaaacgca

SEQ ID NO: 35547 - DNA, 578 bp, Artificial Sequence
  chemically treated genomic DNA (Homo sapiens) CpG-island No: 35547
taggtagatagtgagcgagtcggtttgggtttgggtcggggtcgttttcggtagcggtaggtagggttgggagaagtcgtttattaggagtacgtgtagcgtggcggtggtcgagcgcggaggttcgttattgtttttgattagtattattagtttgtgtttggtcgcgtcgcgttcgtttagtagtttggcggtgcgtatttcgttattgtgcgtttatatgttgaatagttcgggtttcgtggttttgagtagttggtacgatagttaggcgttttggttcgagttatcgtttatcgttattattttggttattaggtagttcggttcggtcgttcggggtattagttcggtgtaaggcgtcgagtcgttttgtagcggatatagtacgaagggcgagttgtcgttggcgtttagtattagtacgcgtattagcgtttcgttgtttagcgtcggggagtcgcggtttgtggtttttacgcggaattcgaacgtttgtagggtttcgtagtttagcgatttgagggtaaataggtggtcgttgttcgcgttgatggagattagggaggcgaggcgta

SEQ ID NO: 35548 - DNA, 578 bp, Artificial Sequence
  chemically treated genomic DNA (Homo sapiens) CpG-island No: 35548
tacgcctcgcctccctaatctccatcaacgcgaacaacgaccacctatttaccctcaaatcgctaaactacgaaaccctacaaacgttcgaattccgcgtaaaaaccacaaaccgcgactccccgacgctaaacaacgaaacgctaatacgcgtactaatactaaacgccaacgacaactcgcccttcgtactatatccgctacaaaacgactcgacgccttacaccgaactaataccccgaacgaccgaaccgaactacctaataaccaaaataataacgataaacgataactcgaaccaaaacgcctaactatcgtaccaactactcaaaaccacgaaacccgaactattcaacatataaacgcacaataacgaaatacgcaccgccaaactactaaacgaacgcgacgcgaccaaacacaaactaataatactaatcaaaaacaataacgaacctccgcgctcgaccaccgccacgctacacgtactcctaataaacgacttctcccaaccctacctaccgctaccgaaaacgaccccgacccaaacccaaaccgactcgctcactatctaccta

SEQ ID NO: 35549 - DNA, 602 bp, Artificial Sequence
  chemically treated genomic DNA (Homo sapiens) CpG-island No: 35549
atcgcgagttttcgggcgttaaagttaggagaagtcgtttatttcgtagggtcggtttgttagcgagacgagagttggcgagggcggaggagtgtcgggaatttcgttatatcggttatagttaggtttttagcgcgggttttggagagcgcgtgaaggcgggtatttttttgattcggtcgattattttcgtgtttttgcgtttttgcgttttaacgttcgcgcggttattatgatgtaaatttgcgatatttataattagaagtattcgttttttaacgttatgaatcgttttattggcgtcgtgaataatatggattagacggtgatggtgtttagtttgttgcgcgacgtgtttttggttgatttcgggttagataacgatgttggcgtggaggtaggcggtagtggcggttgtttggaggagcgtacgtttttagttttcgattcgggaagcgttaatggtagttttttcgcgttttttcgggatatgtatagttattacgtgttttttaagtttattcgtaacgatatcgagtggggggttttgtattagtcgtttttatcggttgggagcgaggagggtagtgtttggaagttta

SEQ ID NO: 35550 - DNA, 602 bp, Artificial Sequence
  chemically treated genomic DNA (Homo sapiens) CpG-island No: 35550
taaacttccaaacactaccctcctcgctcccaaccgataaaaacgactaatacaaaaccccccactcgatatcgttacgaataaacttaaaaaacacgtaataactatacatatcccgaaaaaacgcgaaaaaactaccattaacgcttcccgaatcgaaaactaaaaacgtacgctcctccaaacaaccgccactaccgcctacctccacgccaacatcgttatctaacccgaaatcaaccaaaaacacgtcgcgcaacaaactaaacaccatcaccgtctaatccatattattcacgacgccaataaaacgattcataacgttaaaaaacgaatacttctaattataaatatcgcaaatttacatcataataaccgcgcgaacgttaaaacgcaaaaacgcaaaaacacgaaaataatcgaccgaatcaaaaaaatacccgccttcacgcgctctccaaaacccgcgctaaaaacctaactataaccgatataacgaaattcccgacactcctccgccctcgccaactctcgtctcgctaacaaaccgaccctacgaaataaacgacttctcctaactttaacgcccgaaaactcgcgat

SEQ ID NO: 35551 - DNA, 602 bp, Artificial Sequence
  chemically treated genomic DNA (Homo sapiens) CpG-island No: 35551
tggatttttaggtattgtttttttcgtttttagtcggtggaggcggttggtgtaggattttttattcgatgtcgttgcggatggatttgagaagtacgtagtggttgtatatgtttcgagagggcgcgaaaaagttgttattggcgtttttcgagtcggggattgggggcgtgcgtttttttaggtagtcgttattgtcgtttatttttacgttaatatcgttgtttaattcggggttagttaggggtacgtcgcgtagtaagttgggtattattatcgtttggtttatgttgtttacggcgttaatgaagcgatttatggcgttaaagagcgagtgtttttggttgtaggtgtcgtagatttgtattatggtggtcgcgcggacgttggagcgtagggacgtaggggtacggggatggtcggtcgggttaaggggatgttcgtttttacgcgttttttaaggttcgcgttgggggtttggttatagtcggtgtggcgggattttcggtattttttcgttttcgttaattttcgtttcgttggtagatcggttttgcgggatgggcggttttttttggttttggcgttcggaaattcgcgat

SEQ ID NO: 35552 - DNA, 602 bp, Artificial Sequence
  chemically treated genomic DNA (Homo sapiens) CpG-island No: 35552
atcgcgaatttccgaacgccaaaaccaaaaaaaaccgcccatcccgcaaaaccgatctaccaacgaaacgaaaattaacgaaaacgaaaaaataccgaaaatcccgccacaccgactataaccaaacccccaacgcgaaccttaaaaaacgcgtaaaaacgaacatccccttaacccgaccgaccatccccgtacccctacgtccctacgctccaacgtccgcgcgaccaccataatacaaatctacgacacctacaaccaaaaacactcgctctttaacgccataaatcgcttcattaacgccgtaaacaacataaaccaaacgataataatacccaacttactacgcgacgtacccctaactaaccccgaattaaacaacgatattaacgtaaaaataaacgacaataacgactacctaaaaaaacgcacgcccccaatccccgactcgaaaaacgccaataacaactttttcgcgccctctcgaaacatatacaaccactacgtacttctcaaatccatccgcaacgacatcgaataaaaaatcctacaccaaccgcctccaccgactaaaaacgaaaaaaacaatacctaaaaatcca

SEQ ID NO: 35553 - DNA, 1106 bp, Artificial Sequence
  chemically treated genomic DNA (Homo sapiens) CpG-island No: 35553
atataaagaggggcggtgcgttttgaggaggtggtacggtttatgcgagcggaagttcgttagtcgtcgattggttgggataaatgttcgtttcgtttttttttcgttttatttttcggtggtttagcggcgcggttcgcgggcgcgttgaggaggttggcggtgttagattggtagggggcgtgattcgaggaggcggggcgggggggcgtgttttgtttggtttcggcgtcgggttcgttacggtttgcggtttcgttttcgaatttttttttttacgcggtttttttttttttcgttcggttcgtcggttcgtttagttttagttttaggttttacgtcgtggtttcgtttttttattagagttagtttagtagtcgtagcgcgtatacgtacgtttcgcgtttttcgcgttcggcgttcggttttttttacgcgcgtatatttcggtacggacgtatttacgtttgttttcgcgcgtcgggggttcggcggcggcggtaggggtagcggtagaagtaggtagatcgcgcggggtagtatcgtagcggtcgttacgggttggtcggtcggttatggaggttgatggggtcggcgagtagatgagatcgttatttattcgggtaacgagtagggtgagggcgtcgcggcggtggggttttttcgtagggggagggcgcggggcgaggtagataaaggcggggggcgcggcgggcgtcgcggttcggttatttcgttttaggttcgtcgtttttttatttttcggcggtcggcgcgtttcgttattttttttgtgtggcggtttggggcgcgggtgggagggggttagcggttgcgttcgggaggttcgagtcggggcggtcggcggcgcgtcgcgggtattttttgcgcggtttaggcgggatttcgatattttcgtagaggtcgtttgtgatttcgattatttatttttttttttagcgttcgttttttttgttttttagcgcgttttttaggcggggtttcggtttcggttgttttggcgtaggagttttagattagttttcgaaaatttattttttttttttttttaaggaggacggcggttttatttgtttttagtttta

SEQ ID NO: 35554 - DNA, 1106 bp, Artificial Sequence
  chemically treated genomic DNA (Homo sapiens) CpG-island No: 35554
taaaactaaaaacaaataaaaccgccgtcctccttaaaaaaaaaaaaaaaataaattttcgaaaactaatctaaaactcctacgccaaaacaaccgaaaccgaaaccccgcctaaaaaacgcgctaaaaaacaaaaaaaacgaacgctaaaaaaaaaaataaataatcgaaatcacaaacgacctctacgaaaatatcgaaatcccgcctaaaccgcgcaaaaaatacccgcgacgcgccgccgaccgccccgactcgaacctcccgaacgcaaccgctaaccccctcccacccgcgccccaaaccgccacacaaaaaaaataacgaaacgcgccgaccgccgaaaaataaaaaaacgacgaacctaaaacgaaataaccgaaccgcgacgcccgccgcgccccccgcctttatctacctcgccccgcgccctccccctacgaaaaaaccccaccgccgcgacgccctcaccctactcgttacccgaataaataacgatctcatctactcgccgaccccatcaacctccataaccgaccgaccaacccgtaacgaccgctacgatactaccccgcgcgatctacctacttctaccgctacccctaccgccgccgccgaacccccgacgcgcgaaaacaaacgtaaatacgtccgtaccgaaatatacgcgcgtaaaaaaaaccgaacgccgaacgcgaaaaacgcgaaacgtacgtatacgcgctacgactactaaactaactctaataaaaaaacgaaaccacgacgtaaaacctaaaactaaaactaaacgaaccgacgaaccgaacgaaaaaaaaaaaaaccgcgtaaaaaaaaaaattcgaaaacgaaaccgcaaaccgtaacgaacccgacgccgaaaccaaacaaaacacgcccccccgccccgcctcctcgaatcacgccccctaccaatctaacaccgccaacctcctcaacgcgcccgcgaaccgcgccgctaaaccaccgaaaaataaaacgaaaaaaaaacgaaacgaacatttatcccaaccaatcgacgactaacgaacttccgctcgcataaaccgtaccacctcctcaaaacgcaccgcccctctttatat

SEQ ID NO: 35555 - DNA, 1106 bp, Artificial Sequence
  chemically treated genomic DNA (Homo sapiens) CpG-island No: 35555
tggggttagagataggtggagtcgtcgttttttttagaaggagaagaaagataggttttcgagggttaatttgaaatttttgcgttaaggtaatcggaatcgggatttcgtttggggagcgcgttaagaaataggggaggcgagcgttgagggaagggatggatggtcggggttataggcggtttttgcggggatgtcggggtttcgtttgagtcgcgtagaggatgttcgcggcgcgtcgtcggtcgtttcgattcgggtttttcgagcgtagtcgttggtttttttttattcgcgttttaggtcgttatataaaggggatggcgaggcgcgtcggtcgtcgggaggtggaggggcgacgggtttgggacgaggtggtcgagtcgcgacgttcgtcgcgtttttcgtttttgtttgtttcgtttcgcgttttttttttgcggaggagttttatcgtcgcggcgtttttattttgttcgttattcgggtgagtagcggttttatttgttcgtcggttttattagtttttatggtcggtcggttagttcgtgacggtcgttacggtattgtttcgcgcggtttgtttgtttttgtcgttgtttttgtcgtcgtcgtcgagttttcggcgcgcgaggataaacgtgggtgcgttcgtgtcgaggtgtgcgcgcgtggggagagtcgggcgtcgggcgcgggagacgcggggcgtgcgtgtgcgcgttgcgattgttgggttggttttagtaggagagcgaggttacggcgtggaatttgaagttagaattgagcgaatcggcggatcgagcgggaaggaggagagtcgcgtaggaggaggggttcgggggcggagtcgtaaatcgtgacgagttcggcgtcggggttaggtaagatacgttttttcgtttcgttttttcgggttacgttttttgttagtttggtatcgttagtttttttagcgcgttcgcgggtcgcgtcgttaggttatcgggagatggggcgggagggaggcgggacggatatttgttttagttaatcggcggttggcggattttcgttcgtataaatcgtgttatttttttaggacgtatcgtttttttttgtat

SEQ ID NO: 35556 - DNA, 1106 bp, Artificial Sequence
  chemically treated genomic DNA (Homo sapiens) CpG-island No: 35556
atacaaaaaaaaacgatacgtcctaaaaaaataacacgatttatacgaacgaaaatccgccaaccgccgattaactaaaacaaatatccgtcccgcctccctcccgccccatctcccgataacctaacgacgcgacccgcgaacgcgctaaaaaaactaacgataccaaactaacaaaaaacgtaacccgaaaaaacgaaacgaaaaaacgtatcttacctaaccccgacgccgaactcgtcacgatttacgactccgcccccgaacccctcctcctacgcgactctcctccttcccgctcgatccgccgattcgctcaattctaacttcaaattccacgccgtaacctcgctctcctactaaaaccaacccaacaatcgcaacgcgcacacgcacgccccgcgtctcccgcgcccgacgcccgactctccccacgcgcgcacacctcgacacgaacgcacccacgtttatcctcgcgcgccgaaaactcgacgacgacgacaaaaacaacgacaaaaacaaacaaaccgcgcgaaacaataccgtaacgaccgtcacgaactaaccgaccgaccataaaaactaataaaaccgacgaacaaataaaaccgctactcacccgaataacgaacaaaataaaaacgccgcgacgataaaactcctccgcaaaaaaaaaacgcgaaacgaaacaaacaaaaacgaaaaacgcgacgaacgtcgcgactcgaccacctcgtcccaaacccgtcgcccctccacctcccgacgaccgacgcgcctcgccatcccctttatataacgacctaaaacgcgaataaaaaaaaaccaacgactacgctcgaaaaacccgaatcgaaacgaccgacgacgcgccgcgaacatcctctacgcgactcaaacgaaaccccgacatccccgcaaaaaccgcctataaccccgaccatccatcccttccctcaacgctcgcctcccctatttcttaacgcgctccccaaacgaaatcccgattccgattaccttaacgcaaaaatttcaaattaaccctcgaaaacctatctttcttctccttctaaaaaaaacgacgactccacctatctctaacccca

SEQ ID NO: 35557 - DNA, 633 bp, Artificial Sequence
  chemically treated genomic DNA (Homo sapiens) CpG-island No: 35557
gttgttttcgtattcgcgggtagtgacgaggtggtagtcgggatacgggcggtagggtcgggagggtttcgttgcggttggatcgaacggttggggaggttcgtttaacgttcgggtttacgtatttattcgaagggtcgcgcggggcgcggggcgattgtatacgggattcgcggtcgagtatagttttcggcgcgtcggcggtttcgttgggaagcgcggcgagacgggtcggcggcgtcgttgtcgttgttgttgttacggagttataaatatcggttcggtttatattcgtcgtcgtttacgtcgggcgtttttcgcgtcggtgttttatcgcgtcgcgttttcgtcgtaaagttcgcggtcgcgggtcgggtaacgcgagcgtaagggtatcggcgtcgcgtaggtgatcgcgattatgttagttgtgtgtaaattttgtagttggaggtatggttttttttcgtttttgttttttcgttcgtattacgggttgattttagttcgcgggtcgcgtgcgttacgggtcgagtttgttcgggtcggttcgtttttgtagagcggtagttgtaggcgagggacggatttaggaatatggtgggggttggggggcggttgatagaaaattta

SEQ ID NO: 35558 - DNA, 633 bp, Artificial Sequence
  chemically treated genomic DNA (Homo sapiens) CpG-island No: 35558
taaattttctatcaaccgccccccaacccccaccatattcctaaatccgtccctcgcctacaactaccgctctacaaaaacgaaccgacccgaacaaactcgacccgtaacgcacgcgacccgcgaactaaaatcaacccgtaatacgaacgaaaaaacaaaaacgaaaaaaaaccatacctccaactacaaaatttacacacaactaacataatcgcgatcacctacgcgacgccgatacccttacgctcgcgttacccgacccgcgaccgcgaactttacgacgaaaacgcgacgcgataaaacaccgacgcgaaaaacgcccgacgtaaacgacgacgaatataaaccgaaccgatatttataactccgtaacaacaacaacgacaacgacgccgccgacccgtctcgccgcgcttcccaacgaaaccgccgacgcgccgaaaactatactcgaccgcgaatcccgtatacaatcgccccgcgccccgcgcgacccttcgaataaatacgtaaacccgaacgttaaacgaacctccccaaccgttcgatccaaccgcaacgaaaccctcccgaccctaccgcccgtatcccgactaccacctcgtcactacccgcgaatacgaaaacaac

SEQ ID NO: 35559 - DNA, 633 bp, Artificial Sequence
  chemically treated genomic DNA (Homo sapiens) CpG-island No: 35559
tggattttttgttagtcgttttttaatttttattatgtttttgagttcgtttttcgtttgtagttgtcgttttgtagaggcgggtcggttcgggtaggttcggttcgtggcgtacgcggttcgcgggttggagttagttcgtggtgcgggcgagagggtaggggcggggagaagttatgtttttagttgtagagtttgtatatagttggtatgatcgcggttatttgcgcggcgtcggtgtttttgcgttcgcgttgttcggttcgcggtcgcggattttgcggcgggagcgcggcgcggtgaagtatcggcgcggagggcgttcggcgtaggcggcggcgggtgtgggtcgagtcggtatttatagtttcgtgatagtagtagcggtagcgacgtcgtcggttcgtttcgtcgcgttttttagcgaggtcgtcggcgcgtcgagggttgtgttcgatcgcgaatttcgtgtgtagtcgtttcgcgtttcgcgcgatttttcgggtgagtacgtgggttcgggcgttgggcgagtttttttagtcgttcggtttagtcgtagcggagttttttcggttttgtcgttcgtgtttcggttgttatttcgttattgttcgcgagtgcggaagtagt

SEQ ID NO: 35560 - DNA, 633 bp, Artificial Sequence
  chemically treated genomic DNA (Homo sapiens) CpG-island No: 35560
actacttccgcactcgcgaacaataacgaaataacaaccgaaacacgaacgacaaaaccgaaaaaactccgctacgactaaaccgaacgactaaaaaaactcgcccaacgcccgaacccacgtactcacccgaaaaatcgcgcgaaacgcgaaacgactacacacgaaattcgcgatcgaacacaaccctcgacgcgccgacgacctcgctaaaaaacgcgacgaaacgaaccgacgacgtcgctaccgctactactatcacgaaactataaataccgactcgacccacacccgccgccgcctacgccgaacgccctccgcgccgatacttcaccgcgccgcgctcccgccgcaaaatccgcgaccgcgaaccgaacaacgcgaacgcaaaaacaccgacgccgcgcaaataaccgcgatcataccaactatatacaaactctacaactaaaaacataacttctccccgcccctaccctctcgcccgcaccacgaactaactccaacccgcgaaccgcgtacgccacgaaccgaacctacccgaaccgacccgcctctacaaaacgacaactacaaacgaaaaacgaactcaaaaacataataaaaattaaaaaacgactaacaaaaaatcca

SEQ ID NO: 35561 - DNA, 736 bp, Artificial Sequence
  chemically treated genomic DNA (Homo sapiens) CpG-island No: 35561
  misc_feature (103)..(103): n is either a, c, g or t
aattaggtcgtttcgaaagttaatttttttcgttttttcgaatttcggattaatttgtaacgtgacggtagtagggatcgggttggaggaggacgtaggtcgngtagcgttcgggaagtaggagcgcggagaggcgtcgaggttcggttcgtttcgcgagatcgattttcggagttttcggttcgattttagttttgtcggttttgtagttttttcggttttttcggttttttcggaagttttttttttgcgagtcgcgtcgggcgttgttattttggatgtcggtttggtgggatatggcggcggtcgttagttttcggtttcggcgttgagtgtagttagcggtttcggtcggcggtttaggaagtggttgttttttcgtcggtttcggcgcgttattcgttcgcgattcgcggtcgtttcgtttcgtgaggttgattgagtgttcgagcgttttcgtcgtttcgtcgttttttttggtcgtcgggttgcggtttagttttcggtttcgttattttagttttttgtttggggttttgtttttgtttttgtcgtcgtttttttcgtttttttcgggggggatatgtcgtagaatttagattgtttagtgtttcgacgtttgttttttgataatttcgtcgacgtcgttattcgttagtttagttaaggggtgtttaaaaacggaagtgattattttattaaataggtattttttagttttttttagatgtgtata

SEQ ID NO: 35562 - DNA, 736 bp, Artificial Sequence
  chemically treated genomic DNA (Homo sapiens) CpG-island No: 35562
  misc_feature (634)..(634): n is either a, c, g or t
tatacacatctaaaaaaaactaaaaaatacctatttaataaaataatcacttccgtttttaaacaccccttaactaaactaacgaataacgacgtcgacgaaattatcaaaaaacaaacgtcgaaacactaaacaatctaaattctacgacatatcccccccgaaaaaaacgaaaaaaacgacgacaaaaacaaaaacaaaaccccaaacaaaaaactaaaataacgaaaccgaaaactaaaccgcaacccgacgaccaaaaaaaacgacgaaacgacgaaaacgctcgaacactcaatcaacctcacgaaacgaaacgaccgcgaatcgcgaacgaataacgcgccgaaaccgacgaaaaaacaaccacttcctaaaccgccgaccgaaaccgctaactacactcaacgccgaaaccgaaaactaacgaccgccgccatatcccaccaaaccgacatccaaaataacaacgcccgacgcgactcgcaaaaaaaaaacttccgaaaaaaccgaaaaaaccgaaaaaactacaaaaccgacaaaactaaaatcgaaccgaaaactccgaaaatcgatctcgcgaaacgaaccgaacctcgacgcctctccgcgctcctacttcccgaacgctacncgacctacgtcctcctccaacccgatccctactaccgtcacgttacaaattaatccgaaattcgaaaaaacgaaaaaaattaactttcgaaacgacctaatt

SEQ ID NO: 35563 - DNA, 736 bp, Artificial Sequence
  chemically treated genomic DNA (Homo sapiens) CpG-island No: 35563
  misc_feature (634)..(634): n is either a, c, g or t
tgtgtatatttggggggagttggaaaatgtttatttggtgaaatgattattttcgtttttgagtattttttgattgagttagcgaatggcggcgtcggcggggttgttagagagtagacgtcggagtattgagtagtttagattttgcggtatgtttttttcggaagaagcgggagaggcggcggtaagagtagaagtaggattttaagtagagaattaggatagcgaggtcgggggttggatcgtagttcggcggttaggaagggcggcggggcggcggggacgttcgggtatttagttaattttacggggcggggcggtcgcgggtcgcgggcggatgacgcgtcggggtcggcggaggagtagttattttttgggtcgtcggtcggggtcgttggttgtatttagcgtcggagtcgggagttagcggtcgtcgttatgttttattagatcggtatttaaggtaatagcgttcggcgcgattcgtagggaaggggttttcgggagagtcgggagagtcgggagggttgtaggatcggtagggttggagtcgggtcgggagtttcggaagtcggtttcgcggggcgagtcgggtttcggcgttttttcgcgtttttgtttttcgggcgttgtncggtttgcgtttttttttagttcggtttttgttgtcgttacgttgtagattgattcgaaattcgggggagcgaaggaaattggttttcgaggcggtttggtt

SEQ ID NO: 35564 - DNA, 736 bp, Artificial Sequence
  chemically treated genomic DNA (Homo sapiens) CpG-island No: 35564
  misc_feature (103)..(103): n is either a, c, g or t
aaccaaaccgcctcgaaaaccaatttccttcgctcccccgaatttcgaatcaatctacaacgtaacgacaacaaaaaccgaactaaaaaaaaacgcaaaccgnacaacgcccgaaaaacaaaaacgcgaaaaaacgccgaaacccgactcgccccgcgaaaccgacttccgaaactcccgacccgactccaaccctaccgatcctacaaccctcccgactctcccgactctcccgaaaaccccttccctacgaatcgcgccgaacgctattaccttaaataccgatctaataaaacataacgacgaccgctaactcccgactccgacgctaaatacaaccaacgaccccgaccgacgacccaaaaaataactactcctccgccgaccccgacgcgtcatccgcccgcgacccgcgaccgccccgccccgtaaaattaactaaatacccgaacgtccccgccgccccgccgcccttcctaaccgccgaactacgatccaacccccgacctcgctatcctaattctctacttaaaatcctacttctactcttaccgccgcctctcccgcttcttccgaaaaaaacataccgcaaaatctaaactactcaatactccgacgtctactctctaacaaccccgccgacgccgccattcgctaactcaatcaaaaaatactcaaaaacgaaaataatcatttcaccaaataaacattttccaactccccccaaatatacaca

SEQ ID NO: 35565 - DNA, 675 bp, Artificial Sequence
  chemically treated genomic DNA (Homo sapiens) CpG-island No: 35565
tgatagggttgtaatttgattagatacgtgtgtttcggtattagtgcgggacgatttataagttttagtagaatggagtacgatgttagtagtacgcgttttagtagaggttaattgagtcgcgcgcggggaacgtagtgaggaaattatgtattatagggggggaaaggtattaaaaattggcgaggaaaaagtgattgtcggaattggcgggtacgagaggtaagggttggttggtattggggaagagtcggaatggagtaacgtgaaaaatattatcggtatatcgttcgtatattttggcggtcggaggttagttataacggtcgagtttgtttaaattcgggtatcgcgcgttcgggttcgttatagtgacgaaaattataattttagttcgtttgttgcgtattatttacggtttggtatatttcggtttgatcggcggtcgtattgtcgtttttgttttgacggagtttattcgggttagaggggacgatttgaagggaattatgcgatgttttgcgaattcggcggtttgcgatatgtgggttcgggatatcgaattgaaacggggttggcgcgcggacggtgtttattacgttgcgttgacgagacgataagaaataatgatttaggttgaattaatttcgagaatatttgaggatatgattattg

SEQ ID NO: 35566 - DNA, 675 bp, Artificial Sequence
  chemically treated genomic DNA (Homo sapiens) CpG-island No: 35566
caataatcatatcctcaaatattctcgaaattaattcaacctaaatcattatttcttatcgtctcgtcaacgcaacgtaataaacaccgtccgcgcgccaaccccgtttcaattcgatatcccgaacccacatatcgcaaaccgccgaattcgcaaaacatcgcataattcccttcaaatcgtcccctctaacccgaataaactccgtcaaaacaaaaacgacaatacgaccgccgatcaaaccgaaatataccaaaccgtaaataatacgcaacaaacgaactaaaattataattttcgtcactataacgaacccgaacgcgcgatacccgaatttaaacaaactcgaccgttataactaacctccgaccgccaaaatatacgaacgatataccgataatatttttcacgttactccattccgactcttccccaataccaaccaacccttacctctcgtacccgccaattccgacaatcactttttcctcgccaatttttaatacctttccccccctataatacataatttcctcactacgttccccgcgcgcgactcaattaacctctactaaaacgcgtactactaacatcgtactccattctactaaaacttataaatcgtcccgcactaataccgaaacacacgtatctaatcaaattacaaccctatca

SEQ ID NO: 35567 - DNA, 675 bp, Artificial Sequence
  chemically treated genomic DNA (Homo sapiens) CpG-island No: 35567
tagtaattatgtttttaagtgttttcggggttaatttagtttaaattattattttttgtcgtttcgttagcgtagcgtagtaggtatcgttcgcgcgttagtttcgttttaattcggtgtttcgggtttatatgtcgtaaatcgtcgagttcgtaaggtatcgtatggttttttttaaatcgttttttttggttcgggtaagtttcgttaaaataaaagcggtagtacggtcgtcggttaggtcggggtatgttaggtcgtgggtaatgcgtagtaggcgggttggggttgtagttttcgttattatgacgggttcgggcgcgcggtgttcgggtttgggtaagttcgatcgttatggttagttttcggtcgttaaagtatgcgggcggtgtgtcggtagtgttttttacgttattttatttcggtttttttttagtgttaattaatttttgtttttcgtgttcgttagtttcggtagttatttttttttcgttagtttttaatatttttttttttttatagtatatggtttttttattgcgtttttcgcgcgcggtttaattagtttttgttgaaacgcgtattattaatatcgtattttattttattggggtttgtaggtcgtttcgtattagtgtcggggtatacgtatttggttaggttatagttttgtta

SEQ ID NO: 35568 - DNA, 675 bp, Artificial Sequence
  chemically treated genomic DNA (Homo sapiens) CpG-island No: 35568
taacaaaactataacctaaccaaatacgtataccccgacactaatacgaaacgacctacaaaccccaataaaataaaatacgatattaataatacgcgtttcaacaaaaactaattaaaccgcgcgcgaaaaacgcaataaaaaaaccatatactataaaaaaaaaaaaatattaaaaactaacgaaaaaaaaataactaccgaaactaacgaacacgaaaaacaaaaattaattaacactaaaaaaaaaccgaaataaaataacgtaaaaaacactaccgacacaccgcccgcatactttaacgaccgaaaactaaccataacgatcgaacttacccaaacccgaacaccgcgcgcccgaacccgtcataataacgaaaactacaaccccaacccgcctactacgcattacccacgacctaacataccccgacctaaccgacgaccgtactaccgcttttattttaacgaaacttacccgaaccaaaaaaaacgatttaaaaaaaaccatacgataccttacgaactcgacgatttacgacatataaacccgaaacaccgaattaaaacgaaactaacgcgcgaacgatacctactacgctacgctaacgaaacgacaaaaaataataatttaaactaaattaaccccgaaaacacttaaaaacataattacta

SEQ ID NO: 35569 - DNA, 798 bp, Artificial Sequence
  chemically treated genomic DNA (Homo sapiens) CpG-island No: 35569
  misc_feature (38)..(38): n is either a, c, g or t
acgtcgtcgaggggggggcggggtcgcggtcgcgcggntttcggcgagcgcgcgtagttcgtttttcgtatatattttatttttttttttcgcgtttcgttcgtgcgtgtttttatttcgttttcgtttgtagtttgcgagagcgattacgagtcgtcggttgtagtcgtcgtttgtaagtcgtcgttttattttagcgatgatgagagcgcggttggtatataaaattttcgaagttgagtgttcggggtttcgcgaaacgttcgtgtttatttcgtttttatttcgttgttacgtcgtgagaagagttcgtcgtcgtaacgggtcggtgtgcgcggggacggcgttacgtcgacggattgtttgttatcggcgatagcgttgtagcgtcgtagatgtttatagtatattgacggcggcgttgcgcgcgtttattattatttcgatatattttttcgtgttcgttcgtcgttatttatatattttgttcgttgtatataaatagattgcggtatgcgtttcgatgttttattagttagtatatgtagcgtcgtcgtcggggtttatcgtcgatcgcgcgttacggattattatcgacgttttcgtttacgcgtcgtttgtttatttcgatttcgtcgtcggatcgtcggtatattcgagtttgttcgtcgcgtttcgttacgatttcgcggcgcgacggttatcgatcgtaacgtttcggcgtcgttatcgtcgttcgatattttttttcgcgttatttttatttttttttttttttacgcgcgtacgttatttttt

SEQ ID NO: 35570 - DNA, 798 bp, Artificial Sequence
  chemically treated genomic DNA (Homo sapiens) CpG-island No: 35570
  misc_feature (761)..(761): n is either a, c, g or t
aaaaaataacgtacgcgcgtaaaaaaaaaaaaaaataaaaataacgcgaaaaaaaatatcgaacgacgataacgacgccgaaacgttacgatcgataaccgtcgcgccgcgaaatcgtaacgaaacgcgacgaacaaactcgaatataccgacgatccgacgacgaaatcgaaataaacaaacgacgcgtaaacgaaaacgtcgataataatccgtaacgcgcgatcgacgataaaccccgacgacgacgctacatatactaactaataaaacatcgaaacgcataccgcaatctatttatatacaacgaacaaaatatataaataacgacgaacgaacacgaaaaaatatatcgaaataataataaacgcgcgcaacgccgccgtcaatatactataaacatctacgacgctacaacgctatcgccgataacaaacaatccgtcgacgtaacgccgtccccgcgcacaccgacccgttacgacgacgaactcttctcacgacgtaacaacgaaataaaaacgaaataaacacgaacgtttcgcgaaaccccgaacactcaacttcgaaaattttatataccaaccgcgctctcatcatcgctaaaataaaacgacgacttacaaacgacgactacaaccgacgactcgtaatcgctctcgcaaactacaaacgaaaacgaaataaaaacacgcacgaacgaaacgcgaaaaaaaaaaataaaatatatacgaaaaacgaactacgcgcgctcgccgaaanccgcgcgaccgcgaccccgcccccccctcgacgacgt

SEQ ID NO: 35571 - DNA, 798 bp, Artificial Sequence
  chemically treated genomic DNA (Homo sapiens) CpG-island No: 35571
  misc_feature (761)..(761): n is either a, c, g or t
aaaggatagcgtacgcgcgtgggaagggggagaggtgaaggtgacgcgaggaggggtgtcggacgacggtgacggcgtcggagcgttgcggtcgatagtcgtcgcgtcgcggggtcgtgacgagacgcggcgggtaggttcggatgtatcggcggttcgacgacggagtcgaggtaggtaggcggcgcgtgggcgagggcgtcggtggtggttcgtagcgcgcgatcggcgatgggtttcggcggcggcgttgtatatgttagttggtgaggtatcgaggcgtatgtcgtaatttatttgtatgtaacgggtaggatatgtgagtgacggcggacggatacgaagaggtgtatcggagtagtgatggacgcgcgtagcgtcgtcgttagtatgttgtgagtatttacggcgttgtagcgttgtcgtcgatagtaagtagttcgtcggcgtggcgtcgttttcgcgtatatcgattcgttacggcgacggattttttttacgacgtggtagcggagtgagaacggggtgggtacgaacgtttcgcggagtttcgaatatttagtttcgaaggttttgtatgttaatcgcgtttttattatcgttaaggtggggcggcgatttgtaggcgacgattatagtcggcggttcgtgatcgttttcgtagattatagacgggggcggaataggaatacgtacgagcgagacgcggggaggagagatgaggtgtgtgcggggggcggattgcgcgcgttcgtcggggntcgcgcggtcgcgatttcgtttttttttcggcggcgt

SEQ ID NO: 35572 - DNA, 798 bp, Artificial Sequence
  chemically treated genomic DNA (Homo sapiens) CpG-island No: 35572
  misc_feature (38)..(38): n is either a, c, g or t
acgccgccgaaaaaaaaacgaaatcgcgaccgcgcganccccgacgaacgcgcgcaatccgccccccgcacacacctcatctctcctccccgcgtctcgctcgtacgtattcctattccgcccccgtctataatctacgaaaacgatcacgaaccgccgactataatcgtcgcctacaaatcgccgccccaccttaacgataataaaaacgcgattaacatacaaaaccttcgaaactaaatattcgaaactccgcgaaacgttcgtacccaccccgttctcactccgctaccacgtcgtaaaaaaaatccgtcgccgtaacgaatcgatatacgcgaaaacgacgccacgccgacgaactacttactatcgacgacaacgctacaacgccgtaaatactcacaacatactaacgacgacgctacgcgcgtccatcactactccgatacacctcttcgtatccgtccgccgtcactcacatatcctacccgttacatacaaataaattacgacatacgcctcgatacctcaccaactaacatatacaacgccgccgccgaaacccatcgccgatcgcgcgctacgaaccaccaccgacgccctcgcccacgcgccgcctacctacctcgactccgtcgtcgaaccgccgatacatccgaacctacccgccgcgtctcgtcacgaccccgcgacgcgacgactatcgaccgcaacgctccgacgccgtcaccgtcgtccgacacccctcctcgcgtcaccttcacctctcccccttcccacgcgcgtacgctatccttt

SEQ ID NO: 35573 - DNA, 685 bp, Artificial Sequence
  chemically treated genomic DNA (Homo sapiens) CpG-island No: 35573
  misc_feature (541)..(541): n is either a, c, g or t
  misc_feature (567)..(568): n is either a, c, g or t
  misc_feature (570)..(570): n is either a, c, g or t
tacgcgttttggattgcgggtcgagggcgggcggcgtgtattttatttttaggagttagaagggaagcgcggtatatggttttgtagttttacgtagggttggcggttagttaagcgtagggttttttaaggcgcgtagggtgcgtacgggtgtgggagggagatttcggcgtcggagggtttgcggtcgttttagttttattttgggacggcgtgtttttttttttcgttgtttattttggtttttaagagtcgggcggtcgtagtaagtaaagttatggcgggcgattttcgggatttggtggggaggtaagaaagggagagagttgcggtaggaataggagtcgtcgtcgttgtattagaggtcgcgtcgacgggttgataaggttgaaaggaggcggttgaaggaaagagtagacgaatcggcggcggcgtttagttcggggtttttaaggaggtttcgtttattggtcggaattcgagttcgttttttttaagggatttttttcgggttcggttattggttcggtttggaagcggngcgggattttagtatttgatagtagnngngacggggaggattggatcgttcggattagggttaattaagggtggatgggtggcgggcggggaagtgcgggtggttaataggtgtttgataatttagttattttttttttgggtt

SEQ ID NO: 35574 - DNA, 685 bp, Artificial Sequence
  chemically treated genomic DNA (Homo sapiens) CpG-island No: 35574
  misc_feature (116)..(116): n is either a, c, g or t
  misc_feature (118)..(119): n is either a, c, g or t
  misc_feature (145)..(145): n is either a, c, g or t
aacccaaaaaaaaaataactaaattatcaaacacctattaaccacccgcacttccccgcccgccacccatccacccttaattaaccctaatccgaacgatccaatcctccccgtcncnnctactatcaaatactaaaatcccgcnccgcttccaaaccgaaccaataaccgaacccgaaaaaaatcccttaaaaaaaacgaactcgaattccgaccaataaacgaaacctccttaaaaaccccgaactaaacgccgccgccgattcgtctactctttccttcaaccgcctcctttcaaccttatcaacccgtcgacgcgacctctaatacaacgacgacgactcctattcctaccgcaactctctccctttcttacctccccaccaaatcccgaaaatcgcccgccataactttacttactacgaccgcccgactcttaaaaaccaaaataaacaacgaaaaaaaaaaacacgccgtcccaaaataaaactaaaacgaccgcaaaccctccgacgccgaaatctccctcccacacccgtacgcaccctacgcgccttaaaaaaccctacgcttaactaaccgccaaccctacgtaaaactacaaaaccatataccgcgcttcccttctaactcctaaaaataaaatacacgccgcccgccctcgacccgcaatccaaaacgcgta

SEQ ID NO: 35575 - DNA, 685 bp, Artificial Sequence
  chemically treated genomic DNA (Homo sapiens) CpG-island No: 35575
  misc_feature (116)..(116): n is either a, c, g or t
  misc_feature (118)..(119): n is either a, c, g or t
  misc_feature (145)..(145): n is either a, c, g or t
agtttaagaggaaagtaattgagttattaggtatttattagttattcgtattttttcgttcgttatttatttatttttaattagttttaattcgggcggtttaatttttttcgttntnnttgttgttaagtgttaaggtttcgtntcgtttttaaatcggattaatggtcgggttcggggagagttttttgagaggggcgggttcgggtttcggttagtgggcggggtttttttgaggatttcgggttgggcgtcgtcgtcggttcgtttatttttttttttagtcgtttttttttaattttgttaattcgtcggcgcggtttttggtgtagcggcggcggtttttgtttttgtcgtagtttttttttttttttatttttttattagatttcggagatcgttcgttatggttttatttattgcggtcgttcggtttttgggaattaaggtgagtagcgaggggagggagtacgtcgttttagggtggggttgaggcgatcgtaggtttttcggcgtcggggttttttttttatattcgtgcgtattttgcgcgttttaaagggttttgcgtttggttggtcgttagttttgcgtgaagttataggattatgtgtcgcgttttttttttggtttttgggggtgaagtgtacgtcgttcgttttcggttcgtagtttagaacgcgtg

SEQ ID NO: 35576 - DNA, 685 bp, Artificial Sequence
  chemically treated genomic DNA (Homo sapiens) CpG-island No: 35576
  misc_feature (541)..(541): n is either a, c, g or t
  misc_feature (567)..(568): n is either a, c, g or t
  misc_feature (570)..(570): n is either a, c, g or t
cacgcgttctaaactacgaaccgaaaacgaacgacgtacacttcacccccaaaaaccaaaaaaaaaacgcgacacataatcctataacttcacgcaaaactaacgaccaaccaaacgcaaaaccctttaaaacgcgcaaaatacgcacgaatataaaaaaaaaaccccgacgccgaaaaacctacgatcgcctcaaccccaccctaaaacgacgtactccctcccctcgctactcaccttaattcccaaaaaccgaacgaccgcaataaataaaaccataacgaacgatctccgaaatctaataaaaaaataaaaaaaaaaaaaaactacgacaaaaacaaaaaccgccgccgctacaccaaaaaccgcgccgacgaattaacaaaattaaaaaaaaacgactaaaaaaaaaaataaacgaaccgacgacgacgcccaacccgaaatcctcaaaaaaaccccgcccactaaccgaaacccgaacccgcccctctcaaaaaactctccccgaacccgaccattaatccgatttaaaaacganacgaaaccttaacacttaacaacaannanaacgaaaaaaattaaaccgcccgaattaaaactaattaaaaataaataaataacgaacgaaaaaatacgaataactaataaatacctaataactcaattactttcctcttaaact

SEQ ID NO: 35577 - DNA, 730 bp, Artificial Sequence
  chemically treated genomic DNA (Homo sapiens) CpG-island No: 35577
tttgattcgtcgggcgggagaagttgatggtaaaagtattaatttgattatttaggtagttaacgttgaatattagtttttgcggtagcgttttttcgttacgttagataatttagtcgtagtttagcggagttagatcgaatttatggtttgaagtattgatcgattttatacgcggtaggcggaagttttagacgatattcggggcgacgaacggtgttaggaagttatcgttggtagcgtcgatgtgtatgtcgatgtcgatatcggtatcggtttggaatttatttagcgtatcgtgtagcggttgtgggaatttatagttattagtgtaggttacgtcgaaagtcggtattacgtcgatggtgttttcgttataggttttaattatgcgtttcgggtttataaataattgatcggggcgtatagggattttacgtagttttatattttagtagcgggcgaatttatgttagtagatttgtatcggatcgtatattaggtttggtttattcgttggtttgtttgtagtttttatacgtttgcgttaacgttattttatcgttatttcgtcgagtatataggtttcggaagaattaatggtgttggtgttaacggtttgattatttttcggcgtaggcgtatgttatagatcggtaattatatttacgtaacgtaggtcgatggttgcggattgcggatatttttttttgtcgatttagtttttgtt

SEQ ID NO: 35578 - DNA, 730 bp, Artificial Sequence
  chemically treated genomic DNA (Homo sapiens) CpG-island No: 35578
aacaaaaactaaatcgacaaaaaaaaatatccgcaatccgcaaccatcgacctacgttacgtaaatataattaccgatctataacatacgcctacgccgaaaaataatcaaaccgttaacaccaacaccattaattcttccgaaacctatatactcgacgaaataacgataaaataacgttaacgcaaacgtataaaaactacaaacaaaccaacgaataaaccaaacctaatatacgatccgatacaaatctactaacataaattcgcccgctactaaaatataaaactacgtaaaatccctatacgccccgatcaattatttataaacccgaaacgcataattaaaacctataacgaaaacaccatcgacgtaataccgactttcgacgtaacctacactaataactataaattcccacaaccgctacacgatacgctaaataaattccaaaccgataccgatatcgacatcgacatacacatcgacgctaccaacgataacttcctaacaccgttcgtcgccccgaatatcgtctaaaacttccgcctaccgcgtataaaatcgatcaatacttcaaaccataaattcgatctaactccgctaaactacgactaaattatctaacgtaacgaaaaaacgctaccgcaaaaactaatattcaacgttaactacctaaataatcaaattaatacttttaccatcaacttctcccgcccgacgaatcaaa

SEQ ID NO: 35579 - DNA, 730 bp, Artificial Sequence
  chemically treated genomic DNA (Homo sapiens) CpG-island No: 35579
aataaaaattggatcgataaagaagaatattcgtaattcgtagttatcgatttgcgttgcgtaaatatggttgtcgatttgtggtatgcgtttgcgtcgaaaaatggttaggtcgttggtattaatattattggttttttcgaggtttgtatgttcggcgggatggcgatgaaatggcgttggcgtaagcgtatggaagttgtaggtaaattaacggataaattaaatttggtgtgcggttcggtataaatttgttggtataaattcgttcgttattgggatgtggagttgcgtgagatttttatgcgtttcggttagttgtttatggattcgaaacgtatgattgaagtttgtgacgaaaatattatcggcgtggtgtcgattttcggcgtgatttatattggtaattatgagtttttataatcgttgtacgatgcgttggataaattttaggtcgatatcggtatcgatatcgatatgtatatcgacgttgttagcggtggttttttggtatcgttcgtcgtttcggatatcgtttgggattttcgtttgtcgcgtgtgaaatcgattagtgttttaggttataaattcggtttggtttcgttgggttgcggttgggttatttggcgtgacgaagaagcgttgtcgtaggaattggtgtttaacgttgattatttgggtggttaaattggtatttttgttattaatttttttcgttcggcgggttagg

SEQ ID NO: 35580 - DNA, 730 bp, Artificial Sequence
  chemically treated genomic DNA (Homo sapiens) CpG-island No: 35580
cctaacccgccgaacgaaaaaaattaataacaaaaataccaatttaaccacccaaataatcaacgttaaacaccaattcctacgacaacgcttcttcgtcacgccaaataacccaaccgcaacccaacgaaaccaaaccgaatttataacctaaaacactaatcgatttcacacgcgacaaacgaaaatcccaaacgatatccgaaacgacgaacgataccaaaaaaccaccgctaacaacgtcgatatacatatcgatatcgataccgatatcgacctaaaatttatccaacgcatcgtacaacgattataaaaactcataattaccaatataaatcacgccgaaaatcgacaccacgccgataatattttcgtcacaaacttcaatcatacgtttcgaatccataaacaactaaccgaaacgcataaaaatctcacgcaactccacatcccaataacgaacgaatttataccaacaaatttataccgaaccgcacaccaaatttaatttatccgttaatttacctacaacttccatacgcttacgccaacgccatttcatcgccatcccgccgaacatacaaacctcgaaaaaaccaataatattaataccaacgacctaaccatttttcgacgcaaacgcataccacaaatcgacaaccatatttacgcaacgcaaatcgataactacgaattacgaatattcttctttatcgatccaatttttatt

SEQ ID NO: 35581 - DNA, 663 bp, Artificial Sequence
  chemically treated genomic DNA (Homo sapiens) CpG-island No: 35581
  misc_feature (221)..(221): n is either a, c, g or t
  misc_feature (424)..(424): n is either a, c, g or t
  misc_feature (507)..(507): n is either a, c, g or t
  misc_feature (511)..(511): n is either a, c, g or t
  misc_feature (538)..(538): n is either a, c, g or t
ttcggcggcgtagtttacgtggaagtcgtgttcgtataggtagttttgttattatcgggcggaggtcggtattattttttttgttaagtttttaaatttttcgtgcgttcgttatcggtgtcgcgattattagtaggttacgtgtgcgattttttgtaattaaggttttcgcgattttatttttagattcgggttttatttattttgttttagttttcggngaggtgggacgtttgggagcgcgttttaggtttcgtaattatagcgtcggttatcgaggtttttcgtcgatcgataggttttttagattcgtattcgagttcgggtgtttaaagtagtagcgcgcgtttcgcgggatcgggtattattcgggttgtttcggcgttgggatgtttacgagagcgttttatttattcggtacggnttgttgttcgcggtcgcgagtttattgcgttgcggcgtatcggttggaggcggggtagcgtgggtacgtttcgggtcgtgttntagntttcggtttcgttttcgttagtcgggntcgtaagtggtggtaagttcggaagttttggttatttcggcggtggtttcgcggtttacgttcggggcggtttttttaggtttatatgggaaggaaaataaatggtttttttttttttttatttt

SEQ ID NO: 35582 - DNA, 663 bp, Artificial Sequence
  chemically treated genomic DNA (Homo sapiens) CpG-island No: 35582
  misc_feature (126)..(126): n is either a, c, g or t
  misc_feature (153)..(153): n is either a, c, g or t
  misc_feature (157)..(157): n is either a, c, g or t
  misc_feature (240)..(240): n is either a, c, g or t
  misc_feature (443)..(443): n is either a, c, g or t
aaaataaaaaaaaaaaaaaaccatttattttccttcccatataaacctaaaaaaaccgccccgaacgtaaaccgcgaaaccaccgccgaaataaccaaaacttccgaacttaccaccacttacgancccgactaacgaaaacgaaaccgaaanctanaacacgacccgaaacgtacccacgctaccccgcctccaaccgatacgccgcaacgcaataaactcgcgaccgcgaacaacaanccgtaccgaataaataaaacgctctcgtaaacatcccaacgccgaaacaacccgaataatacccgatcccgcgaaacgcgcgctactactttaaacacccgaactcgaatacgaatctaaaaaacctatcgatcgacgaaaaacctcgataaccgacgctataattacgaaacctaaaacgcgctcccaaacgtcccacctcnccgaaaactaaaacaaaataaataaaacccgaatctaaaaataaaatcgcgaaaaccttaattacaaaaaatcgcacacgtaacctactaataatcgcgacaccgataacgaacgcacgaaaaatttaaaaacttaacaaaaaaaataataccgacctccgcccgataataacaaaactacctatacgaacacgacttccacgtaaactacgccgccgaa

SEQ ID NO: 35583 - DNA, 663 bp, Artificial Sequence
  chemically treated genomic DNA (Homo sapiens) CpG-island No: 35583
  misc_feature (126)..(126): n is either a, c, g or t
  misc_feature (153)..(153): n is either a, c, g or t
  misc_feature (157)..(157): n is either a, c, g or t
  misc_feature (240)..(240): n is either a, c, g or t
  misc_feature (443)..(443): n is either a, c, g or t
aaaatggagaaaaaaaagggttatttatttttttttttatatggatttaaagaaatcgtttcgggcgtgaatcgcgaaattatcgtcggggtagttagggttttcgggtttgttattatttgcggnttcggttggcgggggcggggtcggggnttgnagtacggttcggagcgtgtttacgttgtttcgtttttagtcggtgcgtcgtaacgtagtgggttcgcggtcgcgagtaatagntcgtgtcgggtgagtggggcgttttcgtgggtattttagcgtcggggtagttcgggtagtgttcgatttcgcggggcgcgcgttgttgttttaggtattcgggttcgggtgcgggtttgggagatttgtcggtcggcgagaagtttcggtggtcggcgttgtggttgcgggatttgggacgcgtttttaggcgttttattttntcggagattggggtagggtgggtggggttcggatttaggggtagggtcgcggaagttttggttatagagagtcgtatacgtggtttgttaatggtcgcgatatcggtgacgagcgtacggaaagtttggaggtttagtaaggagggtggtgtcggttttcgttcggtggtggtagaattgtttgtgcgagtacggtttttacgtgggttgcgtcgtcggg

SEQ ID NO: 35584 - DNA, 663 bp, Artificial Sequence
  chemically treated genomic DNA (Homo sapiens) CpG-island No: 35584
  misc_feature (221)..(221): n is either a, c, g or t
  misc_feature (424)..(424): n is either a, c, g or t
  misc_feature (507)..(507): n is either a, c, g or t
  misc_feature (511)..(511): n is either a, c, g or t
  misc_feature (538)..(538): n is either a, c, g or t
cccgacgacgcaacccacgtaaaaaccgtactcgcacaaacaattctaccaccaccgaacgaaaaccgacaccaccctccttactaaacctccaaactttccgtacgctcgtcaccgatatcgcgaccattaacaaaccacgtatacgactctctataaccaaaacttccgcgaccctacccctaaatccgaaccccacccaccctaccccaatctccganaaaataaaacgcctaaaaacgcgtcccaaatcccgcaaccacaacgccgaccaccgaaacttctcgccgaccgacaaatctcccaaacccgcacccgaacccgaatacctaaaacaacaacgcgcgccccgcgaaatcgaacactacccgaactaccccgacgctaaaatacccacgaaaacgccccactcacccgacacganctattactcgcgaccgcgaacccactacgttacgacgcaccgactaaaaacgaaacaacgtaaacacgctccgaaccgtactncaanccccgaccccgcccccgccaaccgaanccgcaaataataacaaacccgaaaaccctaactaccccgacgataatttcgcgattcacgcccgaaacgatttctttaaatccatataaaaaaaaaaataaataacccttttttttctccatttt

SEQ ID NO: 35585 - DNA, 857 bp, Artificial Sequence
  chemically treated genomic DNA (Homo sapiens) CpG-island No: 35585
tattcggatagtatttttagtatgtggtcggataatcgtatcgttcgtgacgcgtattatttttatcggtatgatcgttacggtaggttgacggagaaaatcgattttatttcggaaggggttattcgtacggatgatgagcgtatttatcggtattattacgatagttagtatcggttggtgtattatacgcggatataatatgaagagtcgttggtcgaaagtcgttatttttacgattcgttgggtcgtaggtggtaaaacgggtgtggcggcgtgaacgggatttgacgggttggatgtcgttgttacggaaatcgtaagtgatttggtacggttgggacggcgatcggttgattataatatagaacgatagaattcgtatttagacgatttattagtcggggagttttacgttatttattagagttgaaatcgttatcggtgagttggcgaaaacgtagcgtcgtagtttggcggatgcgttttagtagttcggcggcgaagacggtggtagtgtggtgttttcgtcggtgttggtgtagatgttcgatcggttggaaagtgaaattttggttgatcgggtgagtgaggaaagtcgtcgttggttggtatcgtgcggtttgatcgtggagtagatgtaaaattagatggattcggtgtatacgtcggcgcgaaaaatttatttgtattattgcgattatcgcggtttgtcgttggtttttattagtacggaagggataatagcgtggtacgtagaatacgatgaatggggtaatttgttgaatgaagagaattcgtattagttgtagtagtttattcgtttgtcggggtagtagtatgatgaggagttcggt

SEQ ID NO: 35586 - DNA, 857 bp, Artificial Sequence
  chemically treated genomic DNA (Homo sapiens) CpG-island No: 35586
accgaactcctcatcatactactaccccgacaaacgaataaactactacaactaatacgaattctcttcattcaacaaattaccccattcatcgtattctacgtaccacgctattatcccttccgtactaataaaaaccaacgacaaaccgcgataatcgcaataatacaaataaatttttcgcgccgacgtatacaccgaatccatctaattttacatctactccacgatcaaaccgcacgataccaaccaacgacgactttcctcactcacccgatcaaccaaaatttcactttccaaccgatcgaacatctacaccaacaccgacgaaaacaccacactaccaccgtcttcgccgccgaactactaaaacgcatccgccaaactacgacgctacgttttcgccaactcaccgataacgatttcaactctaataaataacgtaaaactccccgactaataaatcgtctaaatacgaattctatcgttctatattataatcaaccgatcgccgtcccaaccgtaccaaatcacttacgatttccgtaacaacgacatccaacccgtcaaatcccgttcacgccgccacacccgttttaccacctacgacccaacgaatcgtaaaaataacgactttcgaccaacgactcttcatattatatccgcgtataatacaccaaccgatactaactatcgtaataataccgataaatacgctcatcatccgtacgaataaccccttccgaaataaaatcgattttctccgtcaacctaccgtaacgatcataccgataaaaataatacgcgtcacgaacgatacgattatccgaccacatactaaaaatactatccgaata

SEQ ID NO: 35587 - DNA, 857 bp, Artificial Sequence
  chemically treated genomic DNA (Homo sapiens) CpG-island No: 35587
gtcggattttttattatattgttgtttcggtaggcggataagttgttgtagttgatgcgggttttttttatttagtaggttattttatttatcgtattttgcgtattacgttgttgtttttttcgtgttgataagggttagcggtaggtcgcgatggtcgtagtggtataggtggatttttcgcgtcggcgtgtatatcgggtttatttggttttgtatttgttttacggttaggtcgtacgatgttagttagcggcggttttttttatttattcggttagttaggattttattttttagtcggtcgagtatttgtattagtatcggcgggaatattatattgttatcgttttcgtcgtcggattgttgaagcgtattcgttaggttgcggcgttgcgttttcgttagtttatcggtggcggttttaattttgatgagtggcgtgaagtttttcggttgataaatcgtttggatgcgggttttgtcgttttgtattgtggttagtcggtcgtcgttttagtcgtattaggttatttgcggttttcgtgatagcgatatttagttcgttaggtttcgtttacgtcgttatattcgttttgttatttgcggtttagcgggtcgtaaagatagcgattttcgattagcggttttttatattgtgttcgcgtgtagtgtattagtcggtgttgattgtcgtaatggtatcggtgggtgcgtttattattcgtgcggataatttttttcgggatgaggtcggtttttttcgttagtttgtcgtgacggttatatcggtaaagatagtgcgcgttacgggcgatacggttattcggttatatgttgagggtgttgttcgggtg

SEQ ID NO: 35588 - DNA, 857 bp, Artificial Sequence
  chemically treated genomic DNA (Homo sapiens) CpG-island No: 35588
cacccgaacaacaccctcaacatataaccgaataaccgtatcgcccgtaacgcgcactatctttaccgatataaccgtcacgacaaactaacgaaaaaaaccgacctcatcccgaaaaaaattatccgcacgaataataaacgcacccaccgataccattacgacaatcaacaccgactaatacactacacgcgaacacaatataaaaaaccgctaatcgaaaatcgctatctttacgacccgctaaaccgcaaataacaaaacgaatataacgacgtaaacgaaacctaacgaactaaatatcgctatcacgaaaaccgcaaataacctaatacgactaaaacgacgaccgactaaccacaatacaaaacgacaaaacccgcatccaaacgatttatcaaccgaaaaacttcacgccactcatcaaaattaaaaccgccaccgataaactaacgaaaacgcaacgccgcaacctaacgaatacgcttcaacaatccgacgacgaaaacgataacaatataatattcccgccgatactaatacaaatactcgaccgactaaaaaataaaatcctaactaaccgaataaataaaaaaaaccgccgctaactaacatcgtacgacctaaccgtaaaacaaatacaaaaccaaataaacccgatatacacgccgacgcgaaaaatccacctataccactacgaccatcgcgacctaccgctaacccttatcaacacgaaaaaaacaacaacgtaatacgcaaaatacgataaataaaataacctactaaataaaaaaaacccgcatcaactacaacaacttatccgcctaccgaaacaacaatataataaaaaatccgac

SEQ ID NO: 35589 - DNA, 666 bp, Artificial Sequence
  chemically treated genomic DNA (Homo sapiens) CpG-island No: 35589
tgtcggagcgaatattgcgcgaaggattgcgttaggtagtgtcgcgttcggcggtttttcgtgcgttgacgtaggtagggttggtgttgcgatcgtttttatcggaataggttagagtaaaattgtttgttgaaacggtgaaagttaaatcgcgttcgtcgttgtttataagcgtcgggttttaatgttggaaggttgcgttagtttacgttttcgtttaatattaacgcggtaattgcgcgagtgttggatcgtttggggattagcgttatgttagttaacgaagtaggttgttgtggcgcggtggattattattttaatgcgtaggagaaagggttggtacgggcgcgtaataatattgatgtttggtggttcgcgattgaagtaggtgtcgaggttattttgttaatcgttagcgttgtcgcgcgtttgtttaagagtattggtagatgtcgaaaacgatgttttatatgtcgattaagtacgtttagttagtgaatcggtcgtcgatttagtcggatttttgcgtaagaatcgttggaaaatttggtatttcgcgcgataaaagtttgtcgttaattgtcgtgtattttatatatgcgtaaagttgaacgttaatgggaaaaaggttgtttttttgggattattttatcggcgttttcgaag

SEQ ID NO: 35590 - DNA, 666 bp, Artificial Sequence
  chemically treated genomic DNA (Homo sapiens) CpG-island No: 35590
cttcgaaaacgccgataaaataatcccaaaaaaacaacctttttcccattaacgttcaactttacgcatatataaaatacacgacaattaacgacaaacttttatcgcgcgaaataccaaattttccaacgattcttacgcaaaaatccgactaaatcgacgaccgattcactaactaaacgtacttaatcgacatataaaacatcgttttcgacatctaccaatactcttaaacaaacgcgcgacaacgctaacgattaacaaaataacctcgacacctacttcaatcgcgaaccaccaaacatcaatattattacgcgcccgtaccaaccctttctcctacgcattaaaataataatccaccgcgccacaacaacctacttcgttaactaacataacgctaatccccaaacgatccaacactcgcgcaattaccgcgttaatattaaacgaaaacgtaaactaacgcaaccttccaacattaaaacccgacgcttataaacaacgacgaacgcgatttaactttcaccgtttcaacaaacaattttactctaacctattccgataaaaacgatcgcaacaccaaccctacctacgtcaacgcacgaaaaaccgccgaacgcgacactacctaacgcaatccttcgcgcaatattcgctccgaca

SEQ ID NO: 35591 - DNA, 666 bp, Artificial Sequence
  chemically treated genomic DNA (Homo sapiens) CpG-island No: 35591
tttcgggaacgtcggtaggataattttaggggagtaattttttttttattggcgtttagttttgcgtatgtgtagggtatacgatagttgacggtaggtttttatcgcgcgaaatgttaggttttttagcgatttttgcgtagaggttcgattaaatcgacggtcggtttattgattggacgtgtttaatcggtatataaggtatcgttttcggtatttgttaatatttttggataaacgcgcggtagcgttggcggttggtaaaatggtttcggtatttgttttaatcgcgggttattaggtattaatattattgcgcgttcgtgttagtttttttttttgcgtattaagatgatagtttatcgcgttataatagtttgtttcgttagttggtatgacgttgatttttagacgatttagtattcgcgtagttgtcgcgttggtgttgggcgaaagcgtaggttggcgtagttttttaatattaaaattcgacgtttatgggtagcggcggacgcggtttagtttttatcgttttagtaggtagttttgttttgatttgtttcggtaaaaacggtcgtagtattagttttatttgcgttagcgtacggaagatcgtcggacgcggtattatttggcgtaatttttcgcgtagtattcgtttcggta

SEQ ID NO: 35592 - DNA, 666 bp, Artificial Sequence
  chemically treated genomic DNA (Homo sapiens) CpG-island No: 35592
taccgaaacgaatactacgcgaaaaattacgccaaataataccgcgtccgacgatcttccgtacgctaacgcaaataaaactaatactacgaccgtttttaccgaaacaaatcaaaacaaaactacctactaaaacgataaaaactaaaccgcgtccgccgctacccataaacgtcgaattttaatattaaaaaactacgccaacctacgctttcgcccaacaccaacgcgacaactacgcgaatactaaatcgtctaaaaatcaacgtcataccaactaacgaaacaaactattataacgcgataaactatcatcttaatacgcaaaaaaaaaaactaacacgaacgcgcaataatattaatacctaataacccgcgattaaaacaaataccgaaaccattttaccaaccgccaacgctaccgcgcgtttatccaaaaatattaacaaataccgaaaacgataccttatataccgattaaacacgtccaatcaataaaccgaccgtcgatttaatcgaacctctacgcaaaaatcgctaaaaaacctaacatttcgcgcgataaaaacctaccgtcaactatcgtataccctacacatacgcaaaactaaacgccaataaaaaaaaaattactcccctaaaattatcctaccgacgttcccgaaa

SEQ ID NO: 35593 - DNA, 651 bp, Artificial Sequence
  chemically treated genomic DNA (Homo sapiens) CpG-island No: 35593
atcgcgatggcgatatcgtataatgtttggaagttttggcgtaggtcgggtttgtcggattcgaagatatttttgtaaattagttttcggtcgggtaataacgtcgcgtcgttttagcgcgtttgtggttgattcgtgttacgttatggattttcgacgagttttttatcgcgattgacgttaacggtgtcgatcgtttgatttagcgtatggcgtagtatacggagtagggggggattgtgattttgattatttattagtcgtttaacgttgttgaaagtaaaattcgtcgtattttattgacgtaaacgagggtcgtatgatgttttggcgtatttttcgttttgagttgcgtgtagcgtttcgttatagcgtcgaaatcgttaattcgttgtggttttttttgattgtaattatttttttttcgtttagtatcggttcggagtcgtaattgttggcgcgtattgtatcgggtattatttgggttgtgcgttgtttttatttttgttggcgttggaacgattgtttcgtgacgatttgtaggacggtagttttgaataattgatgttgttgtcgttatttttgttcgtcgttgtgttggcgaaggtgatggcgtattggatggtaatcggtttgtcgttatttattttt

SEQ ID NO: 35594 - DNA, 651 bp, Artificial Sequence
  chemically treated genomic DNA (Homo sapiens) CpG-island No: 35594
aaaaataaataacgacaaaccgattaccatccaatacgccatcaccttcgccaacacaacgacgaacaaaaataacgacaacaacatcaattattcaaaactaccgtcctacaaatcgtcacgaaacaatcgttccaacgccaacaaaaataaaaacaacgcacaacccaaataatacccgatacaatacgcgccaacaattacgactccgaaccgatactaaacgaaaaaaaaataattacaatcaaaaaaaaccacaacgaattaacgatttcgacgctataacgaaacgctacacgcaactcaaaacgaaaaatacgccaaaacatcatacgaccctcgtttacgtcaataaaatacgacgaattttactttcaacaacgttaaacgactaataaataatcaaaatcacaatccccccctactccgtatactacgccatacgctaaatcaaacgatcgacaccgttaacgtcaatcgcgataaaaaactcgtcgaaaatccataacgtaacacgaatcaaccacaaacgcgctaaaacgacgcgacgttattacccgaccgaaaactaatttacaaaaatatcttcgaatccgacaaacccgacctacgccaaaacttccaaacattatacgatatcgccatcgcgat

SEQ ID NO: 35595 - DNA, 651 bp, Artificial Sequence
  chemically treated genomic DNA (Homo sapiens) CpG-island No: 35595
aaggatgagtaacggtagatcggttattatttagtgcgttattattttcgttagtataacggcgggtaagggtaacggtaataatattaattgtttaagattgtcgttttgtaaatcgttacggaatagtcgttttagcgttagtaaggatgaaagtagcgtatagtttagataatgttcggtgtaatacgcgttagtagttgcggtttcggatcgatattgagcggaaaaagggtaattataattaggaagaattatagcgggttggcgatttcggcgttatggcgaaacgttatacgtagtttaagacggaaaatgcgttagaatattatgcggttttcgtttgcgttagtgaaatgcggcgaattttatttttagtaacgttgagcggttggtgggtagttagaattataatttttttttgtttcgtatgttgcgttatacgttgggttagacgatcgatatcgttaacgttaatcgcggtaaaaggttcgtcgaggatttataacgtggtacgggttagttatagacgcgttaaagcgacgcggcgttgttgttcggtcgagagttgatttataggaatattttcgaattcggtaagttcggtttgcgttagggtttttagatattgtgcggtatcgttatcgcgat

SEQ ID NO: 35596 - DNA, 651 bp, Artificial Sequence
  chemically treated genomic DNA (Homo sapiens) CpG-island No: 35596
atcgcgataacgataccgcacaatatctaaaaaccctaacgcaaaccgaacttaccgaattcgaaaatattcctataaatcaactctcgaccgaacaacaacgccgcgtcgctttaacgcgtctataactaacccgtaccacgttataaatcctcgacgaaccttttaccgcgattaacgttaacgatatcgatcgtctaacccaacgtataacgcaacatacgaaacaaaaaaaaattataattctaactacccaccaaccgctcaacgttactaaaaataaaattcgccgcatttcactaacgcaaacgaaaaccgcataatattctaacgcattttccgtcttaaactacgtataacgtttcgccataacgccgaaatcgccaacccgctataattcttcctaattataattaccctttttccgctcaatatcgatccgaaaccgcaactactaacgcgtattacaccgaacattatctaaactatacgctactttcatccttactaacgctaaaacgactattccgtaacgatttacaaaacgacaatcttaaacaattaatattattaccgttacccttacccgccgttatactaacgaaaataataacgcactaaataataaccgatctaccgttactcatcctt

SEQ ID NO: 35597 - DNA, 744 bp, Artificial Sequence
  chemically treated genomic DNA (Homo sapiens) CpG-island No: 35597
  misc_feature (333)..(333): n is either a, c, g or t
  misc_feature (446)..(447): n is either a, c, g or t
ttaatttgttacgttagatcgcgattatcggtattttcgcggtaggaatggtgttcgttataatttttgttgaaatcgattttttcgtcggtttaatgatggggttgttaggtggcgtcgcggcgatttgtgacgtttggttaggttggtttttgttatttattattattgtgacgttggttttgggattgtttttcggtgtttggaacggatggtgggtcgcgtatcgtaaagtttttttatttattgttattttcgcgggtatgttggtatttcgcggtatatttattggtattattaacggtacgattgtattttttattagcgtcgcgntgttataaattgggtaaagttattttttcgttagtatcggttttattattggcgcgtttggtttaatggtttttgttggttggtaatggcgcggaagaatgcgtcgttaggtnntgggtttatagttttcggtttttatcgtagtagtcggtcgttaggttttaatcgttattatcgtattaggcgtaatttggttgttgaattattatcgggggcgttttatttttgttttgttgttgacgttgttgttattcggcggaatgtttatggtaacgcggacggtatttggacgacgtatttatgttatcggcggtaatttggaagtagtacgttttttcgggattaacgttgaacgtattaaatttgtcgtgttcgcgattaacggattaatggtagttatcgtcggattaa

SEQ ID NO: 35598 - DNA, 744 bp, Artificial Sequence
  chemically treated genomic DNA (Homo sapiens) CpG-island No: 35598
  misc_feature (298)..(299): n is either a, c, g or t
  misc_feature (412)..(412): n is either a, c, g or t
ttaatccgacgataactaccattaatccgttaatcgcgaacacgacaaatttaatacgttcaacgttaatcccgaaaaaacgtactacttccaaattaccgccgataacataaatacgtcgtccaaataccgtccgcgttaccataaacattccgccgaataacaacaacgtcaacaacaaaacaaaaataaaacgcccccgataataattcaacaaccaaattacgcctaatacgataataacgattaaaacctaacgaccgactactacgataaaaaccgaaaactataaacccannacctaacgacgcattcttccgcgccattaccaaccaacaaaaaccattaaaccaaacgcgccaataataaaaccgatactaacgaaaaaataactttacccaatttataacancgcgacgctaataaaaaatacaatcgtaccgttaataataccaataaatataccgcgaaataccaacatacccgcgaaaataacaataaataaaaaaactttacgatacgcgacccaccatccgttccaaacaccgaaaaacaatcccaaaaccaacgtcacaataataataaataacaaaaaccaacctaaccaaacgtcacaaatcgccgcgacgccacctaacaaccccatcattaaaccgacgaaaaaatcgatttcaacaaaaattataacgaacaccattcctaccgcgaaaataccgataatcgcgatctaacgtaacaaattaa

SEQ ID NO: 35599 - DNA, 744 bp, Artificial Sequence
  chemically treated genomic DNA (Homo sapiens) CpG-island No: 35599
  misc_feature (298)..(299): n is either a, c, g or t
  misc_feature (412)..(412): n is either a, c, g or t
ttaattcggcgatggttattattaattcgttaatcgcgaatacggtaagtttggtgcgtttaacgttaatttcggagagacgtgttgtttttagattgtcgtcgatggtataaatgcgtcgtttaaatgtcgttcgcgttgttataaatatttcgtcgagtaatagtaacgttagtagtagaataggagtggaacgttttcggtaataatttaatagttagattgcgtttaatacgatgatagcggttaaagtttggcgatcgattattgcggtagaggtcggagattgtaaatttannatttgacggcgtattttttcgcgttattgttaattaataaaagttattaagttaagcgcgttaatgatgaagtcggtattggcggggagatagttttgtttaatttgtgatancgcggcgttggtgggggatatagtcgtgtcgttggtgatgttaatgagtatgtcgcgaaatgttaatatgttcgcgagggtgataataaatgaagggattttacggtacgcgatttattattcgttttaggtatcgagaagtagttttagaattagcgttataatgatggtaagtggtaaaggttagtttaattagacgttataaatcgtcgcgacgttatttaatagttttattattgagtcgacggaaaggtcgattttagtagaaattatgacgaatattatttttatcgcgaggatgtcggtaatcgcggtttggcgtaataggttgg

SEQ ID NO: 35600 - DNA, 744 bp, Artificial Sequence
  chemically treated genomic DNA (Homo sapiens) CpG-island No: 35600
  misc_feature (333)..(333): n is either a, c, g or t
  misc_feature (446)..(447): n is either a, c, g or t
ccaacctattacgccaaaccgcgattaccgacatcctcgcgataaaaataatattcgtcataatttctactaaaatcgacctttccgtcgactcaataataaaactattaaataacgtcgcgacgatttataacgtctaattaaactaacctttaccacttaccatcattataacgctaattctaaaactacttctcgatacctaaaacgaataataaatcgcgtaccgtaaaatcccttcatttattatcaccctcgcgaacatattaacatttcgcgacatactcattaacatcaccaacgacacgactatatcccccaccaacgccgcgntatcacaaattaaacaaaactatctccccgccaataccgacttcatcattaacgcgcttaacttaataacttttattaattaacaataacgcgaaaaaatacgccgtcaaatnntaaatttacaatctccgacctctaccgcaataatcgatcgccaaactttaaccgctatcatcgtattaaacgcaatctaactattaaattattaccgaaaacgttccactcctattctactactaacgttactattactcgacgaaatatttataacaacgcgaacgacatttaaacgacgcatttataccatcgacgacaatctaaaaacaacacgtctctccgaaattaacgttaaacgcaccaaacttaccgtattcgcgattaacgaattaataataaccatcgccgaattaa

SEQ ID NO: 35601 - DNA, 582 bp, Artificial Sequence
  chemically treated genomic DNA (Homo sapiens) CpG-island No: 35601
atgcggttggaaacgcgatcgaggaaatcgtacggtagatgcgtttagtgtgcggttataaagtcgatggtttcgatagtacgtagagagataatttagttatatttacgattatcgtttattacgttaacggaacgtatcggtaggaatatagtgaacgtttggttgattttgtcgtataggttcgttttacgtagttttttaatgaagatggcgttagtacggcgtagtaggttatagtattttttttttattttatttagaatacgaacgttaaggtttggtttcgggaacgggtgacggtatagtatgtcgtacggtaggtttagttttagattaattttacgtatttcgtttttgaatagtttttttagcggtttaattaggtttatttttatttttttcggtaggtcgtttacgttgtggtgagatttgatgacgtgtgttttatcggttgtagacgtcgtagattcgataacgttagggtagatggtgttttgcgttagttattttacgttttttagttttagcgtttttttatcgaatattttaacgaaaacgcgatcgatgattttacggttt

SEQ ID NO: 35602 - DNA, 582 bp, Artificial Sequence
  chemically treated genomic DNA (Homo sapiens) CpG-island No: 35602
aaaccgtaaaatcatcgatcgcgttttcgttaaaatattcgataaaaaaacgctaaaactaaaaaacgtaaaataactaacgcaaaacaccatctaccctaacgttatcgaatctacgacgtctacaaccgataaaacacacgtcatcaaatctcaccacaacgtaaacgacctaccgaaaaaaataaaaataaacctaattaaaccgctaaaaaaactattcaaaaacgaaatacgtaaaattaatctaaaactaaacctaccgtacgacatactataccgtcacccgttcccgaaaccaaaccttaacgttcgtattctaaataaaataaaaaaaaaatactataacctactacgccgtactaacgccatcttcattaaaaaactacgtaaaacgaacctatacgacaaaatcaaccaaacgttcactatattcctaccgatacgttccgttaacgtaataaacgataatcgtaaatataactaaattatctctctacgtactatcgaaaccatcgactttataaccgcacactaaacgcatctaccgtacgatttcctcgatcgcgtttccaaccgcat

SEQ ID NO: 35603 - DNA, 582 bp, Artificial Sequence
  chemically treated genomic DNA (Homo sapiens) CpG-island No: 35603
aaatcgtaaaattatcggtcgcgttttcgttgaagtattcgatgaagaagcgttgaaattggaagacgtgaagtggttggcgtagggtattatttattttgacgttatcgaatttgcggcgtttgtaatcggtaaagtatacgttattaaattttattataacgtgggcggtttgtcgaaagagatgaagatgggtttggttgaatcgttgaaagagttgtttaaagacgaagtgcgtaagattggtttggagttgggtttgtcgtacgatatgttgtatcgttattcgttttcgggattaggttttggcgttcgtgttttgggtgaagtgaagaaagagtattgtgatttgttgcgtcgtgttgacgttatttttattgaagaattgcgtaaagcggatttgtacgataaagttagttaggcgtttattgtgtttttgtcggtacgtttcgttggcgtaatgggcgatggtcgtaagtatgattgggttgtttttttgcgtgttgtcgaaattatcgattttatgatcgtatattgggcgtatttgtcgtacgattttttcggtcgcgtttttaatcgtat

SEQ ID NO: 35604 - DNA, 582 bp, Artificial Sequence
  chemically treated genomic DNA (Homo sapiens) CpG-island No: 35604
atacgattaaaaacgcgaccgaaaaaatcgtacgacaaatacgcccaatatacgatcataaaatcgataatttcgacaacacgcaaaaaaacaacccaatcatacttacgaccatcgcccattacgccaacgaaacgtaccgacaaaaacacaataaacgcctaactaactttatcgtacaaatccgctttacgcaattcttcaataaaaataacgtcaacacgacgcaacaaatcacaatactctttcttcacttcacccaaaacacgaacgccaaaacctaatcccgaaaacgaataacgatacaacatatcgtacgacaaacccaactccaaaccaatcttacgcacttcgtctttaaacaactctttcaacgattcaaccaaacccatcttcatctctttcgacaaaccgcccacgttataataaaatttaataacgtatactttaccgattacaaacgccgcaaattcgataacgtcaaaataaataataccctacgccaaccacttcacgtcttccaatttcaacgcttcttcatcgaatacttcaacgaaaacgcgaccgataattttacgattt

SEQ ID NO: 35605 - DNA, 947 bp, Artificial Sequence
  chemically treated genomic DNA (Homo sapiens) CpG-island No: 35605
ttcgtagtaattttaggatacgcgtggtatagtttttgttgtcgtttcgtcgatgggtttagggatgaagggtgagagcgggtcggcgattgggagtggaggcgataatgggtagagttggattaaattgtttttagtagtttcgaaggtaaagtatggggtaggggcggatatatcgcggtttggagggcgttgggcgcggaggaacggagttcgggggtcgggtcggcgttcggttagtagcgtcgttttttcggaggaaggcgggggtcgggaggagggagcgggagaaggcggagggcggaggagggcggtgcgttgagaggttatttgtggttcgttttgatttcgagggggaatttgaaatttttatatttttggtatagtagtcgttttcggcgcgggtcgattttggggttgcgcgttggggcgcgaatagttagagcgtcggcgttacggtcgagaatatattttcgtcgtcgagttgagttgggtcgagtcggaggttgtggtgtttgattgcgttgggtattttcgggtcgtagcggtaaggaaggtcgttcggcgttcgggagagcgcgcgaggttatagaaacgtgttttagttaaagttggagtttcggcgtaattcggtttttttcgggagtcggagtttcgaggatcgagcgttttcggggcgtagtgcgttttttcgaggtagtcgtagtgtttggtaagggtcgttttgtttagggagcgtagcgcgttgggttttgcggggttttagaaacgcgcgggttttttggggttgggggagaggggagagggtcgatttcggagataatagttatagtgtttcgggttgtaggtcggcgggggtgggggtggcgggggatagggatggaggcgtcgtttggagtttaagttgtagggttttgcgggttgatttggttaggtgggggttatag

SEQ ID NO: 35606 - DNA, 947 bp, Artificial Sequence
  chemically treated genomic DNA (Homo sapiens) CpG-island No: 35606
ctataacccccacctaaccaaatcaacccgcaaaaccctacaacttaaactccaaacgacgcctccatccctatcccccgccacccccacccccgccgacctacaacccgaaacactataactattatctccgaaatcgaccctctcccctctcccccaaccccaaaaaacccgcgcgtttctaaaaccccgcaaaacccaacgcgctacgctccctaaacaaaacgacccttaccaaacactacgactacctcgaaaaaacgcactacgccccgaaaacgctcgatcctcgaaactccgactcccgaaaaaaaccgaattacgccgaaactccaactttaactaaaacacgtttctataacctcgcgcgctctcccgaacgccgaacgaccttccttaccgctacgacccgaaaatacccaacgcaatcaaacaccacaacctccgactcgacccaactcaactcgacgacgaaaatatattctcgaccgtaacgccgacgctctaactattcgcgccccaacgcgcaaccccaaaatcgacccgcgccgaaaacgactactataccaaaaatataaaaatttcaaattccccctcgaaatcaaaacgaaccacaaataacctctcaacgcaccgccctcctccgccctccgccttctcccgctccctcctcccgacccccgccttcctccgaaaaaacgacgctactaaccgaacgccgacccgacccccgaactccgttcctccgcgcccaacgccctccaaaccgcgatatatccgcccctaccccatactttaccttcgaaactactaaaaacaatttaatccaactctacccattatcgcctccactcccaatcgccgacccgctctcacccttcatccctaaacccatcgacgaaacgacaacaaaaactataccacgcgtatcctaaaattactacgaa

SEQ ID NO: 35607 - DNA, 947 bp, Artificial Sequence
  chemically treated genomic DNA (Homo sapiens) CpG-island No: 35607
ttgtaatttttatttaattaaattagttcgtaggattttgtaatttgagttttaagcggcgtttttatttttgtttttcgttatttttattttcgtcgatttgtaattcgaaatattgtggttgttgttttcggagtcggttttttttttttttttttagttttaagagattcgcgcgtttttagagtttcgtaaagtttagcgcgttgcgttttttgggtagagcggtttttgttaggtattgcggttgtttcgaaagggcgtattgcgtttcgaggacgttcgattttcgaggtttcgattttcggaaaaggtcgggttgcgtcgagattttagttttggttggggtacgtttttgtggtttcgcgcgttttttcgagcgtcgagcggttttttttatcgttgcggttcgagggtgtttagcgtagttagatattataattttcggttcggtttagtttagttcggcggcgaagatgtgttttcggtcgtggcgtcgacgttttggttgttcgcgttttagcgcgtagttttagggtcggttcgcgtcggaggcggttgttatgttaggaatgtgagagttttaggttttttttcgggattaaagcgaattataaataattttttagcgtatcgttttttttcgtttttcgttttttttcgtttttttttttcggttttcgttttttttcggggaggcggcgttgttggtcgagcgtcggttcggttttcgagtttcgttttttcgcgtttagcgttttttaggtcgcggtgtgttcgtttttgttttatgttttgttttcggagttgttggagataatttaatttaattttgtttattatcgtttttatttttagtcgtcgattcgtttttattttttatttttaaatttatcgacgggacgatagtaagggttgtattacgcgtgttttggggttgttgcggg

SEQ ID NO: 35608 - DNA, 947 bp, Artificial Sequence
  chemically treated genomic DNA (Homo sapiens) CpG-island No: 35608
cccgcaacaaccccaaaacacgcgtaatacaacccttactatcgtcccgtcgataaatttaaaaataaaaaataaaaacgaatcgacgactaaaaataaaaacgataataaacaaaattaaattaaattatctccaacaactccgaaaacaaaacataaaacaaaaacgaacacaccgcgacctaaaaaacgctaaacgcgaaaaaacgaaactcgaaaaccgaaccgacgctcgaccaacaacgccgcctccccgaaaaaaaacgaaaaccgaaaaaaaaaaacgaaaaaaaacgaaaaacgaaaaaaaacgatacgctaaaaaattatttataattcgctttaatcccgaaaaaaaacctaaaactctcacattcctaacataacaaccgcctccgacgcgaaccgaccctaaaactacgcgctaaaacgcgaacaaccaaaacgtcgacgccacgaccgaaaacacatcttcgccgccgaactaaactaaaccgaaccgaaaattataatatctaactacgctaaacaccctcgaaccgcaacgataaaaaaaaccgctcgacgctcgaaaaaacgcgcgaaaccacaaaaacgtaccccaaccaaaactaaaatctcgacgcaacccgaccttttccgaaaatcgaaacctcgaaaatcgaacgtcctcgaaacgcaatacgccctttcgaaacaaccgcaatacctaacaaaaaccgctctacccaaaaaacgcaacgcgctaaactttacgaaactctaaaaacgcgcgaatctcttaaaactaaaaaaaaaaaaaaaaaaccgactccgaaaacaacaaccacaatatttcgaattacaaatcgacgaaaataaaaataacgaaaaacaaaaataaaaacgccgcttaaaactcaaattacaaaatcctacgaactaatttaattaaataaaaattacaa

SEQ ID NO: 35609 - DNA, 629 bp, Artificial Sequence
  chemically treated genomic DNA (Homo sapiens) CpG-island No: 35609
ttggacgatatagaaattcgcggttcggtgttgattttgaatgatgtttttggtgcgttaagttgcgtattggcggaatataagtcgtatagtatgggcgatttatatattagtgaacgggcgacgcgcgagaatttacgttttaacgggattgatgagtcgagcgtgaagtttttcgatagtatcgtcgattattcgtaatagtcgggtgtggtgttgattaaagtgtcgaaaatattggtattgttggaatagtaattgcgtgcgttgcgtaaagtggttacgtcggatatacgtattattgtcggtgttaaggttcgtgatatttatatttttacgttggaattgttcgaaaaagtgttcggtttaattattattacgttggtatggaaaaaagcgcgtttgattaattgtatttttaatgaatcgtagttggtcgatgcgtcgtagatcgttagttggaagttggaaggtattgattggattatttataattatgcgaatgttttttttcgtatcgggtttgatatcggcgcgcgtttttttatgtaatatttgttagagaatttcgaaggggagattgtcgatttcggttgcggtaatggcgttattggtttgacgttgtttga

SEQ ID NO: 35610 - DNA, 629 bp, Artificial Sequence
  chemically treated genomic DNA (Homo sapiens) CpG-island No: 35610
tcaaacaacgtcaaaccaataacgccattaccgcaaccgaaatcgacaatctccccttcgaaattctctaacaaatattacataaaaaaacgcgcgccgatatcaaacccgatacgaaaaaaaacattcgcataattataaataatccaatcaataccttccaacttccaactaacgatctacgacgcatcgaccaactacgattcattaaaaatacaattaatcaaacgcgcttttttccataccaacgtaataataattaaaccgaacactttttcgaacaattccaacgtaaaaatataaatatcacgaaccttaacaccgacaataatacgtatatccgacgtaaccactttacgcaacgcacgcaattactattccaacaataccaatattttcgacactttaatcaacaccacacccgactattacgaataatcgacgatactatcgaaaaacttcacgctcgactcatcaatcccgttaaaacgtaaattctcgcgcgtcgcccgttcactaatatataaatcgcccatactatacgacttatattccgccaatacgcaacttaacgcaccaaaaacatcattcaaaatcaacaccgaaccgcgaatttctatatcgtccaa

SEQ ID NO: 35611 - DNA, 629 bp, Artificial Sequence
  chemically treated genomic DNA (Homo sapiens) CpG-island No: 35611
ttaagtagcgttagattaataacgttattatcgtaatcgagatcgataatttttttttcgagattttttggtagatgttgtataaagaagcgcgcgtcgatattaagttcggtgcgggagaagatattcgtatggttgtggatagtttagttagtattttttagtttttagttaacggtttgcggcgtatcggttagttgcggtttattgaaagtgtaattaattaggcgcgtttttttttatgttagcgtggtggtggttgggtcgagtattttttcgaatagttttagcgtggaagtgtgaatgttacgggttttggtatcggtaataatacgtgtattcgacgtgattattttgcgtagcgtacgtagttgttgttttagtaatgttagtgttttcggtattttgattagtattatattcggttgttgcgggtagtcggcggtgttgtcgagaaattttacgttcgatttattaatttcgttgaggcgtaaattttcgcgcgtcgttcgtttattgatgtatgagtcgtttatgttgtacggtttatgtttcgttagtgcgtagtttaacgtattaaaggtattatttaggattaatatcgggtcgcggatttttgtgtcgtttaa

SEQ ID NO: 35612 - DNA, 629 bp, Artificial Sequence
  chemically treated genomic DNA (Homo sapiens) CpG-island No: 35612
ttaaacgacacaaaaatccgcgacccgatattaatcctaaataatacctttaatacgttaaactacgcactaacgaaacataaaccgtacaacataaacgactcatacatcaataaacgaacgacgcgcgaaaatttacgcctcaacgaaattaataaatcgaacgtaaaatttctcgacaacaccgccgactacccgcaacaaccgaatataatactaatcaaaataccgaaaacactaacattactaaaacaacaactacgtacgctacgcaaaataatcacgtcgaatacacgtattattaccgataccaaaacccgtaacattcacacttccacgctaaaactattcgaaaaaatactcgacccaaccaccaccacgctaacataaaaaaaaacgcgcctaattaattacactttcaataaaccgcaactaaccgatacgccgcaaaccgttaactaaaaactaaaaaatactaactaaactatccacaaccatacgaatatcttctcccgcaccgaacttaatatcgacgcgcgcttctttatacaacatctaccaaaaaatctcgaaaaaaaaattatcgatctcgattacgataataacgttattaatctaacgctacttaa

SEQ ID NO: 35613 - DNA, 1100 bp, Artificial Sequence
  chemically treated genomic DNA (Homo sapiens) CpG-island No: 35613
ttgtttacggcgttaattgattttgcgtgacgttgtcgttcgcgtgttttttttttattattcgttttagttcggtttcgttttgcgtgtgtagtattttacggcggtttaggttgtcggtgatggtgatgcggttttttttatattgatacgtgtagtttaagtttgtcgggtttagttgttttgttattcgttcgtcgttgtcgtaacggtaacggattttcggtcggttcgtgtgacggtgcgttattattcggtttcggtatttattatcgtaagtaaagttgcgtatttgtttgttattacggttatatattatcgttagttcgtcgcggggcgtttagttatagcgtattagcggcgcggtaggtaaatttttcgggtatttcgggtcgtgcgttagttatacggtagatagacggatgtcgttgtttcggttatattcggtgtaattcggtagggtattaggaaaagcggacggttttcgtttcgtcggaaatggtttgttgtcgggttttttttgttcgttgcgtttgcgtggttagtattagtcggaagtgacgttaggtattattcgttacgtcggtgatttcgtcgttgaatttatcggcggtttcgcggtggaacgtttgtgtgcgttcgaagcggtttattagttcggttagtattcggtacggcggtagcggcgtaggtagtattttattcgttttcggtattcgtttatattaatcgagtagttattacggtttttgcggattgtttgtcgttagataacgatgcggatttaagcggagttttttcggtagcgtttgttagagtgcggttagtcggtgatttttatttagtttcgttacgtcgtcgcgtattagttatagtgattcgttgcggttgtaatcgtttttatcgggaaatacggtgttttaaatataggtttttgtcgtcgttattattgagtatttagtgtgttatcgcgtagttgtaagcggagtatttcgtaggcgtttttttacgttcggggcgtagggtttttttcgggcgcgcgtgtttgtgcgcggatacgttcgtgtgtgtcgggagagatgtattcggcgatagggttt

SEQ ID NO: 35614 - DNA, 1100 bp, Artificial Sequence
  chemically treated genomic DNA (Homo sapiens) CpG-island No: 35614
aaaccctatcgccgaatacatctctcccgacacacacgaacgtatccgcgcacaaacacgcgcgcccgaaaaaaaccctacgccccgaacgtaaaaaaacgcctacgaaatactccgcttacaactacgcgataacacactaaatactcaataataacgacgacaaaaacctatatttaaaacaccgtatttcccgataaaaacgattacaaccgcaacgaatcactataactaatacgcgacgacgtaacgaaactaaataaaaatcaccgactaaccgcactctaacaaacgctaccgaaaaaactccgcttaaatccgcatcgttatctaacgacaaacaatccgcaaaaaccgtaataactactcgattaatataaacgaataccgaaaacgaataaaatactacctacgccgctaccgccgtaccgaatactaaccgaactaataaaccgcttcgaacgcacacaaacgttccaccgcgaaaccgccgataaattcaacgacgaaatcaccgacgtaacgaataatacctaacgtcacttccgactaatactaaccacgcaaacgcaacgaacaaaaaaaacccgacaacaaaccatttccgacgaaacgaaaaccgtccgcttttcctaataccctaccgaattacaccgaatataaccgaaacaacgacatccgtctatctaccgtataactaacgcacgacccgaaatacccgaaaaatttacctaccgcgccgctaatacgctataactaaacgccccgcgacgaactaacgataatatataaccgtaataacaaacaaatacgcaactttacttacgataataaataccgaaaccgaataataacgcaccgtcacacgaaccgaccgaaaatccgttaccgttacgacaacgacgaacgaataacaaaacaactaaacccgacaaacttaaactacacgtatcaatataaaaaaaaccgcatcaccatcaccgacaacctaaaccgccgtaaaatactacacacgcaaaacgaaaccgaactaaaacgaataataaaaaaaaaacacgcgaacgacaacgtcacgcaaaatcaattaacgccgtaaacaa

SEQ ID NO: 35615 - DNA, 1100 bp, Artificial Sequence
  chemically treated genomic DNA (Homo sapiens) CpG-island No: 35615
gggttttgtcgtcggatatatttttttcggtatatacgggcgtgttcgcgtataaatacgcgcgttcgggggggattttgcgtttcgggcgtgaaaaaacgtttgcggaatatttcgtttatagttgcgcgataatatattagatatttagtgataacggcggtagaagtttgtatttggagtatcgtgtttttcggtgaggacggttatagtcgtagcgagttattgtggttggtgcgcggcggcgtggcgaaattggatgaaggttatcggttggtcgtattttggtaggcgttgtcggaagaatttcgtttaagttcgtatcgttatttggcgataaatagttcgtaggggtcgtggtggttgttcggttggtgtgagcgggtgtcggaagcggatgaggtgttgtttgcgtcgttgtcgtcgtatcgggtattgatcgggttggtggatcgtttcgggcgtatatagacgttttatcgcgaagtcgtcggtgaatttagcggcgaaattatcggcgtgacggatggtgtttggcgttattttcggttggtattgattacgtaggcgtagcgggtagaagaagttcggtagtaggttattttcggcgggacgggaatcgttcgttttttttgatattttgtcgggttatatcgaatatggtcgggataacggtattcgtttgtttgtcgtgtggttgacgtacgattcggaatattcggagaatttatttgtcgcgtcgttggtgcgttatggttggacgtttcgcggcgaattggcggtggtgtatgatcgtagtggtaaataggtgcgtagttttatttacgatgataaatatcggggtcggatggtggcgtatcgttatacgggtcggtcggaaattcgttatcgttacgatagcgacgggcgggtgatagaatagttaaattcggtaggtttaagttatacgtattagtatgagaaagatcgtattattattatcgatagtttggatcgtcgtgaagtgttgtatacgtagggcgaagtcgggttgaagcgggtggtgaaaaaggaatacgcggacggtagcgttacgtagagttagttgacgtcgtgggtag

SEQ ID NO: 35616 - DNA, 1100 bp, Artificial Sequence
  chemically treated genomic DNA (Homo sapiens) CpG-island No: 35616
ctacccacgacgtcaactaactctacgtaacgctaccgtccgcgtattcctttttcaccacccgcttcaacccgacttcgccctacgtatacaacacttcacgacgatccaaactatcgataataataatacgatctttctcatactaatacgtataacttaaacctaccgaatttaactattctatcacccgcccgtcgctatcgtaacgataacgaatttccgaccgacccgtataacgatacgccaccatccgaccccgatatttatcatcgtaaataaaactacgcacctatttaccactacgatcatacaccaccgccaattcgccgcgaaacgtccaaccataacgcaccaacgacgcgacaaataaattctccgaatattccgaatcgtacgtcaaccacacgacaaacaaacgaataccgttatcccgaccatattcgatataacccgacaaaatatcaaaaaaaacgaacgattcccgtcccgccgaaaataacctactaccgaacttcttctacccgctacgcctacgtaatcaataccaaccgaaaataacgccaaacaccatccgtcacgccgataatttcgccgctaaattcaccgacgacttcgcgataaaacgtctatatacgcccgaaacgatccaccaacccgatcaatacccgatacgacgacaacgacgcaaacaacacctcatccgcttccgacacccgctcacaccaaccgaacaaccaccacgacccctacgaactatttatcgccaaataacgatacgaacttaaacgaaattcttccgacaacgcctaccaaaatacgaccaaccgataaccttcatccaatttcgccacgccgccgcgcaccaaccacaataactcgctacgactataaccgtcctcaccgaaaaacacgatactccaaatacaaacttctaccgccgttatcactaaatatctaatatattatcgcgcaactataaacgaaatattccgcaaacgttttttcacgcccgaaacgcaaaatcccccccgaacgcgcgtatttatacgcgaacacgcccgtatataccgaaaaaaatatatccgacgacaaaaccc

SEQ ID NO: 35617 - DNA, 1058 bp, Artificial Sequence
  chemically treated genomic DNA (Homo sapiens) CpG-island No: 35617
aagttgttcgtttcgggttgcggcggggtttgttgtttcgtttcggcgttggcgggcgcgttttatattggtcgtcgaggggcgagcgcgggattcggaggcgggcggcgggcggggaaggcgcggggcgtggtttgtcgtttttcgagcgttaaggagcggagcgcgtttagttgcgtttagagttttcggtcggatttgaaaaagcgagagggagagcgagtaaaaggcgcgatttagagagttaggtaagcggggcgtcgatttcgggcggtttcggttcgcgtttttgtttttcggtcgggcggacggtgggtgagcgcggtcgcggggttttagtatttcggtgcgtttcggagagagtgggagggaggggaaggggcgggggcgagagagggaaaggtttttgagtcgggggcgggggcggcgggagacgggaatcgattcgatgtcggggttcgagtcgggttataggaaattttgttcgggtggggagagcggggtgcgcggagggcgtcgtaaatttgttagcgggcggggcgtttcggggattggagcgagcgttagcgggtggcgtttgtttttttgggttttttgtgttattttcgggttttagttcgtcggttcgttcggttcgggtaggcgttgcgcgggaggttgtgttcgggtgtttcggtcgttttttttcgggtttaggtttcggttttcgggggtcgttgattgtttttatttttcgcgttacgtttgggcgggaaagattttgaacgtcgcgtgagttggaaggcggatagtcgcggcgtagagattgtaggatcgtgagcggtgcggtgttcgtttcggggattcgggaattcgcgggtcggggcgtatcggggttggagagggcgcggggacgggcggttcgggtattggaggggcggcggcgggtgcggtagtttagcgttttcgcgggggcgggggggcgtttcgacggtcgggattataattttattttgattgtttggggtttttgttgtttgaaattgtttttagggtttgacggtggtattttttttttt

SEQ ID NO: 35618 - DNA, 1058 bp, Artificial Sequence
  chemically treated genomic DNA (Homo sapiens) CpG-island No: 35618
aaaaaaaaaaataccaccgtcaaaccctaaaaacaatttcaaacaacaaaaaccccaaacaatcaaaataaaattataatcccgaccgtcgaaacgcccccccgcccccgcgaaaacgctaaactaccgcacccgccgccgcccctccaatacccgaaccgcccgtccccgcgccctctccaaccccgatacgccccgacccgcgaattcccgaatccccgaaacgaacaccgcaccgctcacgatcctacaatctctacgccgcgactatccgccttccaactcacgcgacgttcaaaatctttcccgcccaaacgtaacgcgaaaaataaaaacaatcaacgacccccgaaaaccgaaacctaaacccgaaaaaaaacgaccgaaacacccgaacacaacctcccgcgcaacgcctacccgaaccgaacgaaccgacgaactaaaacccgaaaataacacaaaaaacccaaaaaaacaaacgccacccgctaacgctcgctccaatccccgaaacgccccgcccgctaacaaatttacgacgccctccgcgcaccccgctctccccacccgaacaaaatttcctataacccgactcgaaccccgacatcgaatcgattcccgtctcccgccgcccccgcccccgactcaaaaacctttccctctctcgcccccgccccttcccctccctcccactctctccgaaacgcaccgaaatactaaaaccccgcgaccgcgctcacccaccgtccgcccgaccgaaaaacaaaaacgcgaaccgaaaccgcccgaaatcgacgccccgcttacctaactctctaaatcgcgccttttactcgctctccctctcgctttttcaaatccgaccgaaaactctaaacgcaactaaacgcgctccgctccttaacgctcgaaaaacgacaaaccacgccccgcgccttccccgcccgccgcccgcctccgaatcccgcgctcgcccctcgacgaccaatataaaacgcgcccgccaacgccgaaacgaaacaacaaaccccgccgcaacccgaaacgaacaactt

SEQ ID NO: 35619 - DNA, 1058 bp, Artificial Sequence
  chemically treated genomic DNA (Homo sapiens) CpG-island No: 35619
ggaggagaaggtgttatcgttagattttaaaggtaattttagataataaagattttaagtaattaaaatggaattataatttcggtcgtcggagcgttttttcgttttcgcggaggcgttaggttgtcgtattcgtcgtcgtttttttagtgttcgggtcgttcgttttcgcgttttttttagtttcggtgcgtttcgattcgcgggttttcgggttttcggggcgagtatcgtatcgtttacgattttgtaatttttgcgtcgcggttgttcgttttttagtttacgcggcgtttaaaatttttttcgtttaggcgtgacgcgaggaatgaaaataattagcggttttcgagggtcggggtttgggttcgggagggggcggtcggggtattcgggtatagtttttcgcgtagcgtttgttcgagtcgggcggatcggcgggttggggttcggaggtgatataaagaatttagagagataaacgttattcgttggcgttcgttttaattttcggagcgtttcgttcgttgataagtttacggcgtttttcgcgtatttcgttttttttattcgagtaaagttttttgtggttcggttcggatttcggtatcgggtcggttttcgtttttcgtcgttttcgttttcggtttagagatttttttttttttcgttttcgttttttttttttttttttatttttttcggggcgtatcggggtgttggggtttcgcggtcgcgtttatttatcgttcgttcggtcgaggggtaagggcgcgggtcggggtcgttcgaggtcggcgtttcgtttgtttggttttttggatcgcgttttttgttcgttttttttttcgtttttttaggttcggtcgaaggttttgggcgtagttgagcgcgtttcgttttttggcgttcggaaagcggtaaattacgtttcgcgtttttttcgttcgtcgttcgttttcgggtttcgcgttcgtttttcggcggttagtgtagagcgcgttcgttagcgtcggggcggagtagtaggtttcgtcgtagttcggggcgggtaattt

SEQ ID NO: 35620 - DNA, 1058 bp, Artificial Sequence
  chemically treated genomic DNA (Homo sapiens) CpG-island No: 35620
aaattacccgccccgaactacgacgaaacctactactccgccccgacgctaacgaacgcgctctacactaaccgccgaaaaacgaacgcgaaacccgaaaacgaacgacgaacgaaaaaaacgcgaaacgtaatttaccgctttccgaacgccaaaaaacgaaacgcgctcaactacgcccaaaaccttcgaccgaacctaaaaaaacgaaaaaaaaaacgaacaaaaaacgcgatccaaaaaaccaaacaaacgaaacgccgacctcgaacgaccccgacccgcgcccttacccctcgaccgaacgaacgataaataaacgcgaccgcgaaaccccaacaccccgatacgccccgaaaaaaataaaaaaaaaaaaaaaaaacgaaaacgaaaaaaaaaaaaatctctaaaccgaaaacgaaaacgacgaaaaacgaaaaccgacccgataccgaaatccgaaccgaaccacaaaaaactttactcgaataaaaaaaacgaaatacgcgaaaaacgccgtaaacttatcaacgaacgaaacgctccgaaaattaaaacgaacgccaacgaataacgtttatctctctaaattctttatatcacctccgaaccccaacccgccgatccgcccgactcgaacaaacgctacgcgaaaaactatacccgaataccccgaccgccccctcccgaacccaaaccccgaccctcgaaaaccgctaattattttcattcctcgcgtcacgcctaaacgaaaaaaattttaaacgccgcgtaaactaaaaaacgaacaaccgcgacgcaaaaattacaaaatcgtaaacgatacgatactcgccccgaaaacccgaaaacccgcgaatcgaaacgcaccgaaactaaaaaaaacgcgaaaacgaacgacccgaacactaaaaaaacgacgacgaatacgacaacctaacgcctccgcgaaaacgaaaaaacgctccgacgaccgaaattataattccattttaattacttaaaatctttattatctaaaattacctttaaaatctaacgataacaccttctcctcc

SEQ ID NO: 35621 - DNA, 585 bp, Artificial Sequence
  chemically treated genomic DNA (Homo sapiens) CpG-island No: 35621
tcggtttcggtttagttcgttcggttttcggggtaagagttttcgtttacgttattttcgtcgtcgttttttcggttttttagcgaaagagataaagagtcggcgttttaattcgcgaagtcgcggttgtcgggagcggtagatcgggggattttgttttaaaacgaggggcgggcgtagggagggcgaggtggtggtattcgggttaagttgtcgcgcgttcggttgcgcgggtagcgggatacgcggatgtggggcgggtagtttcggcgtatggaagtagtggttttaggcgagagtttgcgggtttcgacggacggacgggcgggtattagcgcgcggtggtcggagttcggtagtttcgcggcgggtcggtcgagcgtttggggtagcgtcgttgggcgggtcggtcgtagttgtatttatcggatcggaagaaggtcgcgatgtcggttaggtttttggtcgttttttttgttttttcgtcggtatcgttttcgtagttcgagttagtcgcgttggtcgtcgcggcggggtcggaggacgcggcgggggcggcggtttcgtcgttgttgtcgtttatgg

SEQ ID NO: 35622 - DNA, 585 bp, Artificial Sequence
  chemically treated genomic DNA (Homo sapiens) CpG-island No: 35622
ccataaacgacaacaacgacgaaaccgccgcccccgccgcgtcctccgaccccgccgcgacgaccaacgcgactaactcgaactacgaaaacgataccgacgaaaaaacaaaaaaaacgaccaaaaacctaaccgacatcgcgaccttcttccgatccgataaatacaactacgaccgacccgcccaacgacgctaccccaaacgctcgaccgacccgccgcgaaactaccgaactccgaccaccgcgcgctaatacccgcccgtccgtccgtcgaaacccgcaaactctcgcctaaaaccactacttccatacgccgaaactacccgccccacatccgcgtatcccgctacccgcgcaaccgaacgcgcgacaacttaacccgaataccaccacctcgccctccctacgcccgcccctcgttttaaaacaaaatcccccgatctaccgctcccgacaaccgcgacttcgcgaattaaaacgccgactctttatctctttcgctaaaaaaccgaaaaaacgacgacgaaaataacgtaaacgaaaactcttaccccgaaaaccgaacgaactaaaccgaaaccga

SEQ ID NO: 35623 - DNA, 585 bp, Artificial Sequence
  chemically treated genomic DNA (Homo sapiens) CpG-island No: 35623
ttatgagcggtagtagcggcggagtcgtcgttttcgtcgcgtttttcggtttcgtcgcggcggttagcgcggttggttcgggttgcgggggcggtgtcggcgagggggtagaggaggcggttaaggatttggtcgatatcgcggttttttttcgattcggtgagtgtaattgcggtcggttcgtttagcggcgttgttttaagcgttcggtcgattcgtcgcggagttgtcgagtttcggttatcgcgcgttggtgttcgttcgttcgttcgtcggggttcgtaggttttcgtttgggattattgtttttatgcgtcggggttgttcgttttatattcgcgtgtttcgttgttcgcgtagtcgggcgcgcggtagtttggttcgaatgttattatttcgttttttttgcgttcgtttttcgttttagggtagaatttttcggtttgtcgttttcggtagtcgcggtttcgcgggttggggcgtcggttttttgtttttttcgttggaggatcgaggaggcggcggcggagatggcgtgggcggaggtttttatttcggaggtcgagcggattgagtcggggtcgg

SEQ ID NO: 35624 - DNA, 585 bp, Artificial Sequence
  chemically treated genomic DNA (Homo sapiens) CpG-island No: 35624
ccgaccccgactcaatccgctcgacctccgaaataaaaacctccgcccacgccatctccgccgccgcctcctcgatcctccaacgaaaaaaacaaaaaaccgacgccccaacccgcgaaaccgcgactaccgaaaacgacaaaccgaaaaattctaccctaaaacgaaaaacgaacgcaaaaaaaacgaaataataacattcgaaccaaactaccgcgcgcccgactacgcgaacaacgaaacacgcgaatataaaacgaacaaccccgacgcataaaaacaataatcccaaacgaaaacctacgaaccccgacgaacgaacgaacgaacaccaacgcgcgataaccgaaactcgacaactccgcgacgaatcgaccgaacgcttaaaacaacgccgctaaacgaaccgaccgcaattacactcaccgaatcgaaaaaaaaccgcgatatcgaccaaatccttaaccgcctcctctaccccctcgccgacaccgcccccgcaacccgaaccaaccgcgctaaccgccgcgacgaaaccgaaaaacgcgacgaaaacgacgactccgccgctactaccgctcataa

SEQ ID NO: 35625 - DNA, 683 bp, Artificial Sequence
  chemically treated genomic DNA (Homo sapiens) CpG-island No: 35625
aattaaatcgaacgtttttgtagttttttcgttagttttgcgggagttatcgtttaacgcggtttcgttttttttttaggtttcgtttatcgtcgagtttaggttcggttttgacgaagttcgtcggaaattatcgaagttttttttttttttttttttttttcgttttttgtttttttttttttttttattcgggttttttcggtcgtgattttttttttttttttttttttttttttattgaaattaagatggaggttcgcggtagtcgtcggcgttcgtgatttcggaggtttcgtcggttacgggttttcgttttcgcgattgcgcgtcgggaggcgcgtgttgttgttcgcgtttcggtcggcgttcgggaggtcgtggtttcgcgttttcgttttcggtagttcgcggattatcgggcggagttttcgtttatgtgggtagcgttttttggagttaaagtcgacgatagaatagattattcgtacgatttcggggttttgcgtatcgtagcgtacgagagagcgggtaagatgggtagttagagaatacggacgaaaatttaggaaaggcgagaatagaggtcggatatcggcgagtagtataaaggagacgcggagagatcgacggacgggacgcgagacggaaggacgtacgataataataaattaattaggaaa

SEQ ID NO: 35626 - DNA, 683 bp, Artificial Sequence
  chemically treated genomic DNA (Homo sapiens) CpG-island No: 35626
tttcctaattaatttattattatcgtacgtccttccgtctcgcgtcccgtccgtcgatctctccgcgtctcctttatactactcgccgatatccgacctctattctcgcctttcctaaattttcgtccgtattctctaactacccatcttacccgctctctcgtacgctacgatacgcaaaaccccgaaatcgtacgaataatctattctatcgtcgactttaactccaaaaaacgctacccacataaacgaaaactccgcccgataatccgcgaactaccgaaaacgaaaacgcgaaaccacgacctcccgaacgccgaccgaaacgcgaacaacaacacgcgcctcccgacgcgcaatcgcgaaaacgaaaacccgtaaccgacgaaacctccgaaatcacgaacgccgacgactaccgcgaacctccatcttaatttcaataaaaaaaaaaaaaaaaaaaaaaaaaaaatcacgaccgaaaaaacccgaataaaaaaaaaaaaaaaaacaaaaaacgaaaaaaaaaaaaaaaaaaaaaaaacttcgataatttccgacgaacttcgtcaaaaccgaacctaaactcgacgataaacgaaacctaaaaaaaaaacgaaaccgcgttaaacgataactcccgcaaaactaacgaaaaaactacaaaaacgttcgatttaatt

SEQ ID NO: 35627 - DNA, 683 bp, Artificial Sequence
  chemically treated genomic DNA (Homo sapiens) CpG-island No: 35627
ttttttgattagtttgttgttgtcgtgcgttttttcgtttcgcgtttcgttcgtcggttttttcgcgttttttttatgttgttcgtcgatgttcggtttttgttttcgttttttttgggttttcgttcgtgttttttagttatttattttgttcgttttttcgtgcgttgcggtacgtagagtttcggggtcgtgcgggtggtttgttttgtcgtcggttttggttttaaggagcgttgtttatatagacgaggatttcgttcggtagttcgcgagttgtcgagggcggaggcgcggagttacggtttttcgggcgtcggtcggagcgcgggtagtagtacgcgtttttcgacgcgtagtcgcgagggcgggggttcgtggtcggcgagattttcgggattacgggcgtcggcggttgtcgcgagtttttattttgattttaatggggaaggaaggaggggggagggggaaattacggtcgagggaattcgggtgaaaggaaaagggagaatagggaacggagaggaaggaaaaaaaagaggggtttcggtaattttcggcgaatttcgttagggtcgagtttgggttcggcggtgggcggagtttgggggaggggcggggtcgcgttgggcgatggttttcgtagggttggcggggaggttgtaggaacgttcggtttggtt

SEQ ID NO: 35628 - DNA, 683 bp, Artificial Sequence
  chemically treated genomic DNA (Homo sapiens) CpG-island No: 35628
aaccaaaccgaacgttcctacaacctccccgccaaccctacgaaaaccatcgcccaacgcgaccccgcccctcccccaaactccgcccaccgccgaacccaaactcgaccctaacgaaattcgccgaaaattaccgaaacccctcttttttttccttcctctccgttccctattctcccttttcctttcacccgaattccctcgaccgtaatttccccctcccccctccttccttccccattaaaatcaaaataaaaactcgcgacaaccgccgacgcccgtaatcccgaaaatctcgccgaccacgaacccccgccctcgcgactacgcgtcgaaaaacgcgtactactacccgcgctccgaccgacgcccgaaaaaccgtaactccgcgcctccgccctcgacaactcgcgaactaccgaacgaaatcctcgtctatataaacaacgctccttaaaaccaaaaccgacgacaaaacaaaccacccgcacgaccccgaaactctacgtaccgcaacgcacgaaaaaacgaacaaaataaataactaaaaaacacgaacgaaaacccaaaaaaaacgaaaacaaaaaccgaacatcgacgaacaacataaaaaaaacgcgaaaaaaccgacgaacgaaacgcgaaacgaaaaaacgcacgacaacaacaaactaatcaaaaaa

SEQ ID NO: 35629 - DNA, 632 bp, Artificial Sequence
  chemically treated genomic DNA (Homo sapiens) CpG-island No: 35629
taggcgtcgggatagtttttggcgttttttcgggtttttatatcgcgtgatttcggggtattcgggtttttttaggtttcggtttcgcgtatattttttgggtcgtagttttttcgcggttcggtcgcgtttttgttcgcgtttcgcgttcggtcgcgtttcgggggttcgttttcgcggaggtcgcggcgtttttcgtagtttaggtcggcgcgttcggagcgtatcgttggcgatgagtttggtcgatagttgtttgacgagtttagggattcgtttttattggtattcggagcggtattttcgattttcgtttttagtcgcgagtttgtttttttggtcgttatcgcggtttggtcgggttcgtcgttcgtttcgtaggttttatcgtcgtcgtcgcggattttttcgtcgtttttcgtcgtcgtcgggggttcgggtttcggttttcggtttcgcggcgtaacgggagcgtcggttggggaaggggcggggaggcgggcggcggcggcgggcgcggcggggtttcgggcgtcgcgaggagcggtttttgtcggttagggtcggagtcgtagtattgatcggggtcggagttagggttggggtaggggcgggggttagggcgggagata

SEQ ID NO: 35630 - DNA, 632 bp, Artificial Sequence
  chemically treated genomic DNA (Homo sapiens) CpG-island No: 35630
tatctcccgccctaacccccgcccctaccccaaccctaactccgaccccgatcaatactacgactccgaccctaaccgacaaaaaccgctcctcgcgacgcccgaaaccccgccgcgcccgccgccgccgcccgcctccccgccccttccccaaccgacgctcccgttacgccgcgaaaccgaaaaccgaaacccgaacccccgacgacgacgaaaaacgacgaaaaaatccgcgacgacgacgataaaacctacgaaacgaacgacgaacccgaccaaaccgcgataacgaccaaaaaaacaaactcgcgactaaaaacgaaaatcgaaaataccgctccgaataccaataaaaacgaatccctaaactcgtcaaacaactatcgaccaaactcatcgccaacgatacgctccgaacgcgccgacctaaactacgaaaaacgccgcgacctccgcgaaaacgaacccccgaaacgcgaccgaacgcgaaacgcgaacaaaaacgcgaccgaaccgcgaaaaaactacgacccaaaaaatatacgcgaaaccgaaacctaaaaaaacccgaataccccgaaatcacgcgatataaaaacccgaaaaaacgccaaaaactatcccgacgccta

SEQ ID NO: 35631 - DNA, 632 bp, Artificial Sequence
  chemically treated genomic DNA (Homo sapiens) CpG-island No: 35631
tgtttttcgttttagttttcgtttttgttttagttttggtttcggtttcggttagtgttgcggtttcggttttggtcggtaggggtcgtttttcgcggcgttcggggtttcgtcgcgttcgtcgtcgtcgttcgttttttcgttttttttttagtcggcgttttcgttacgtcgcggagtcgggagtcggagttcgagttttcggcggcggcgggaggcggcgagggggttcgcggcggcggcggtggggtttgcggggcgggcgacgggttcggttaggtcgcgatggcgattaagaaggtaggttcgcggttggagacggagatcgagggtgtcgtttcgagtgttagtgggagcggatttttgagttcgttaagtagttgtcggttaagtttatcgttaacggtacgtttcgggcgcgtcggtttgggttgcggggggcgtcgcggttttcgcgggaacgggttttcgaggcgcggtcgggcgcggggcgcgggtaggggcgcggtcgggtcgcgagggagttgcggtttaggggatgtgcgcgggatcggggtttgggggagttcgggtgtttcggagttacgcggtgtgggggttcgggggggcgttaggggttgtttcggcgtttg

SEQ ID NO: 35632 - DNA, 632 bp, Artificial Sequence
  chemically treated genomic DNA (Homo sapiens) CpG-island No: 35632
caaacgccgaaacaacccctaacgcccccccgaacccccacaccgcgtaactccgaaacacccgaactcccccaaaccccgatcccgcgcacatcccctaaaccgcaactccctcgcgacccgaccgcgcccctacccgcgccccgcgcccgaccgcgcctcgaaaacccgttcccgcgaaaaccgcgacgccccccgcaacccaaaccgacgcgcccgaaacgtaccgttaacgataaacttaaccgacaactacttaacgaactcaaaaatccgctcccactaacactcgaaacgacaccctcgatctccgtctccaaccgcgaacctaccttcttaatcgccatcgcgacctaaccgaacccgtcgcccgccccgcaaaccccaccgccgccgccgcgaaccccctcgccgcctcccgccgccgccgaaaactcgaactccgactcccgactccgcgacgtaacgaaaacgccgactaaaaaaaaaacgaaaaaacgaacgacgacgacgaacgcgacgaaaccccgaacgccgcgaaaaacgacccctaccgaccaaaaccgaaaccgcaacactaaccgaaaccgaaaccaaaactaaaacaaaaacgaaaactaaaacgaaaaaca

SEQ ID NO: 35633 - DNA, 899 bp, Artificial Sequence
  chemically treated genomic DNA (Homo sapiens) CpG-island No: 35633
tttaatcggcgtagcggagtcgtttggttgcgttcgtcgtagttttatttttatttcgtgtatcgggtttcgtagtgattcgggtttcgtagtgattcgggttttcgtagcgattcgggtttcggttgtttaggtaacgtaggacgtaggcgcgaaaggcgggtgtttggcgcgcgttgtagtttttttttttttcggcgggtcgcggaggcgacgcgttgtttgcgttttgaggcgagtggttttttagtcggaaaatcgcggtttcggtgtcgttttgggtttagttagtgagaggtcgggggtgtggtagagagaaggagtcggtcgggtatttaggatcgcgttagtttttgagttcggtttttttcgtattttcgagtgcgcgtttgttgttcgtcgtagttcgggcgttgaaggtagtaaagcggttattcggtcgtattatggtgattttttgttttattagtttttcgagtttcgtcgttcgagcggggaggcgggataacgattagaattttcgcgtttcggtgaagaagagtaggcgttcgcgttttcggaggaagtagtcgttgtattttttgaattcgtgttcgttttcgggagatttcggtatttgcgatttgttcgagttttttagtttcggtttagacggcgtagagagtttttttgcggcgcggggtggtagttttttgttcggttcggtttagttcgtggcgtagttagatttatagatttttcgcgattacggttagagttgttacgtttttcgtaaggcgtaggagagttatttttattcgcgggaggcgttggtacggtagttataagtgaggtgttggtagagttagttttacgtcgtcgttttttttttttttttaggttttttttttttttgtcgg

SEQ ID NO: 35634 - DNA, 899 bp, Artificial Sequence
  chemically treated genomic DNA (Homo sapiens) CpG-island No: 35634
ccgacaaaaaaaaaaaaaacctaaaaaaaaaaaaaaaacgacgacgtaaaactaactctaccaacacctcacttataactaccgtaccaacgcctcccgcgaataaaaataactctcctacgccttacgaaaaacgtaacaactctaaccgtaatcgcgaaaaatctataaatctaactacgccacgaactaaaccgaaccgaacaaaaaactaccaccccgcgccgcaaaaaaactctctacgccgtctaaaccgaaactaaaaaactcgaacaaatcgcaaataccgaaatctcccgaaaacgaacacgaattcaaaaaatacaacgactacttcctccgaaaacgcgaacgcctactcttcttcaccgaaacgcgaaaattctaatcgttatcccgcctccccgctcgaacgacgaaactcgaaaaactaataaaacaaaaaatcaccataatacgaccgaataaccgctttactaccttcaacgcccgaactacgacgaacaacaaacgcgcactcgaaaatacgaaaaaaaccgaactcaaaaactaacgcgatcctaaatacccgaccgactccttctctctaccacacccccgacctctcactaactaaacccaaaacgacaccgaaaccgcgattttccgactaaaaaaccactcgcctcaaaacgcaaacaacgcgtcgcctccgcgacccgccgaaaaaaaaaaaaactacaacgcgcgccaaacacccgcctttcgcgcctacgtcctacgttacctaaacaaccgaaacccgaatcgctacgaaaacccgaatcactacgaaacccgaatcactacgaaacccgatacacgaaataaaaataaaactacgacgaacgcaaccaaacgactccgctacgccgattaaa

SEQ ID NO: 35635 - DNA, 899 bp, Artificial Sequence
  chemically treated genomic DNA (Homo sapiens) CpG-island No: 35635
tcggtaggagaggagagagtttgggaggagaggaagagcggcggcgtggagttggttttattagtattttatttgtggttgtcgtgttagcgtttttcgcgggtggaagtggtttttttgcgttttgcggaaggcgtagtagttttggtcgtagtcgcggaaggtttgtagatttagttgcgttacgggttgggtcgggtcgggtagggggttattatttcgcgtcgtagaggggttttttgcgtcgtttgagtcggagttgggggattcgaataggtcgtaaatgtcggagtttttcgggagcgggtacgggtttaggggatgtagcggttgtttttttcggaggcgcggacgtttgtttttttttatcggggcgcgaaggttttggtcgttgtttcgttttttcgttcgggcggcggggttcgaggggttggtgggatagggggttattatgatgcggtcgggtggtcgttttattatttttaacgttcgggttgcggcgggtagtaaacgcgtattcgaaagtgcgaaggaggtcgggtttagaggttggcgcggttttaagtattcggtcggttttttttttttattatattttcggttttttattggttgagtttagagcggtatcggagtcgcgatttttcggttggagaattattcgttttagggcgtaggtagcgcgtcgttttcgcggttcgtcggggggagggggagttgtagcgcgcgttaggtattcgtttttcgcgtttgcgttttgcgttatttgggtaatcggagttcgggtcgttgcgggagttcgggttattgcggagttcgggttattgcggagttcggtgtacggagtgggagtagggttgcggcgggcgtagttaagcggtttcgttgcgtcggttaaa

SEQ ID NO: 35636 - DNA, 899 bp, Artificial Sequence
  chemically treated genomic DNA (Homo sapiens) CpG-island No: 35636
tttaaccgacgcaacgaaaccgcttaactacgcccgccgcaaccctactcccactccgtacaccgaactccgcaataacccgaactccgcaataacccgaactcccgcaacgacccgaactccgattacccaaataacgcaaaacgcaaacgcgaaaaacgaatacctaacgcgcgctacaactccccctccccccgacgaaccgcgaaaacgacgcgctacctacgccctaaaacgaataattctccaaccgaaaaatcgcgactccgataccgctctaaactcaaccaataaaaaaccgaaaatataataaaaaaaaaaaaccgaccgaatacttaaaaccgcgccaacctctaaacccgacctccttcgcactttcgaatacgcgtttactacccgccgcaacccgaacgttaaaaataataaaacgaccacccgaccgcatcataataaccccctatcccaccaacccctcgaaccccgccgcccgaacgaaaaaacgaaacaacgaccaaaaccttcgcgccccgataaaaaaaaacaaacgtccgcgcctccgaaaaaaacaaccgctacatcccctaaacccgtacccgctcccgaaaaactccgacatttacgacctattcgaatcccccaactccgactcaaacgacgcaaaaaacccctctacgacgcgaaataataaccccctacccgacccgacccaacccgtaacgcaactaaatctacaaaccttccgcgactacgaccaaaactactacgccttccgcaaaacgcaaaaaaaccacttccacccgcgaaaaacgctaacacgacaaccacaaataaaatactaataaaaccaactccacgccgccgctcttcctctcctcccaaactctctcctctcctaccga

SEQ ID NO: 35637 - DNA, 680 bp, Artificial Sequence
  chemically treated genomic DNA (Homo sapiens) CpG-island No: 35637
aggcgtgcgggggcggcgcggtcggtcgtcgggttttcgatagtatttgttttaatagaatgttggtattgtcgggtcgggcgttgttttgtaagtcggggaagtcggagaggaaggtggggcggttgattcgggtcgggcggggtttgcgcgttcggtgtttcgagggttgattcgcgtttaacgtttgtgtgttcggttagttcgttttttcgcggaagttttttttcggatgtataggcgggagttcggtgtcggtgtacgaggatttttcggacgtcgagtttatagcgttgttaggtgagtttcgtggtatttacgttatttttcgggtttttcgcgtcgggagggtgcggcgcgtatagttcggaggagtttttttttttcgggttttgacgttttagttgcgagtttggcggagaggtttagggttcgttcggcgcgtgtttttcggttttttcgcgtagtttttattattatagatttgtaggatttcgttgattgtttttcgttattcgggttcgacgcgtcgtttggtggtgatttggtcgtttcgtaggtatttttttttttcgtggagtttcgtggttttacgtaatttaaattttttttcggggtggtggttttaattttttaaaagtttttttcgggtcgggagcgtaggtatatttagttggtga

SEQ ID NO: 35638 - DNA, 680 bp, Artificial Sequence
  chemically treated genomic DNA (Homo sapiens) CpG-island No: 35638
tcaccaactaaatatacctacgctcccgacccgaaaaaaacttttaaaaaattaaaaccaccaccccgaaaaaaaatttaaattacgtaaaaccacgaaactccacgaaaaaaaaaaatacctacgaaacgaccaaatcaccaccaaacgacgcgtcgaacccgaataacgaaaaacaatcaacgaaatcctacaaatctataataataaaaactacgcgaaaaaaccgaaaaacacgcgccgaacgaaccctaaacctctccgccaaactcgcaactaaaacgtcaaaacccgaaaaaaaaaaactcctccgaactatacgcgccgcaccctcccgacgcgaaaaacccgaaaaataacgtaaataccacgaaactcacctaacaacgctataaactcgacgtccgaaaaatcctcgtacaccgacaccgaactcccgcctatacatccgaaaaaaaacttccgcgaaaaaacgaactaaccgaacacacaaacgttaaacgcgaatcaaccctcgaaacaccgaacgcgcaaaccccgcccgacccgaatcaaccgccccaccttcctctccgacttccccgacttacaaaacaacgcccgacccgacaataccaacattctattaaaacaaatactatcgaaaacccgacgaccgaccgcgccgcccccgcacgcct

SEQ ID NO: 35639 - DNA, 680 bp, Artificial Sequence
  chemically treated genomic DNA (Homo sapiens) CpG-island No: 35639
ttattagttgagtgtgtttgcgttttcgattcgagaggagtttttggggaattaaaattattatttcggaggagggtttgggttgcgtgaaattacgaggttttacgagaaggggaggtatttgcgaggcggttaggttattattaggcggcgcgtcggattcgagtagcgaagagtagttagcgaggttttgtaggtttatggtggtgagggttgcgcggggagatcgggagatacgcgtcgggcgggttttgagttttttcgttaggttcgtagttaggacgttagagttcgggggagagaagttttttcgagttgtgcgcgtcgtattttttcggcgcggggaattcgaggggtagcgtgggtgttacggggtttatttggtagcgttgtgggttcggcgttcgggggattttcgtatatcgatatcgggttttcgtttgtgtattcggggaagaattttcgcggaggagcgaattggtcgggtatataaacgttgaacgcgggttagttttcggggtatcgagcgcgtagatttcgttcggttcgaattaatcgttttattttttttttcggttttttcggtttgtagagtagcgttcggttcggtagtgttagtattttgttggggtagatgttgtcgaaggttcgacggtcggtcgcgtcgttttcgtacgttt

SEQ ID NO: 35640 - DNA, 680 bp, Artificial Sequence
  chemically treated genomic DNA (Homo sapiens) CpG-island No: 35640
aaacgtacgaaaacgacgcgaccgaccgtcgaaccttcgacaacatctaccccaacaaaatactaacactaccgaaccgaacgctactctacaaaccgaaaaaaccgaaaaaaaaaataaaacgattaattcgaaccgaacgaaatctacgcgctcgataccccgaaaactaacccgcgttcaacgtttatatacccgaccaattcgctcctccgcgaaaattcttccccgaatacacaaacgaaaacccgatatcgatatacgaaaatcccccgaacgccgaacccacaacgctaccaaataaaccccgtaacacccacgctacccctcgaattccccgcgccgaaaaaatacgacgcgcacaactcgaaaaaacttctctcccccgaactctaacgtcctaactacgaacctaacgaaaaaactcaaaacccgcccgacgcgtatctcccgatctccccgcgcaaccctcaccaccataaacctacaaaacctcgctaactactcttcgctactcgaatccgacgcgccgcctaataataacctaaccgcctcgcaaatacctccccttctcgtaaaacctcgtaatttcacgcaacccaaaccctcctccgaaataataattttaattccccaaaaactcctctcgaatcgaaaacgcaaacacactcaactaataa

SEQ ID NO: 35641 - DNA, 640 bp, Artificial Sequence
  chemically treated genomic DNA (Homo sapiens) CpG-island No: 35641
cgtgtagttgaaggaattcgttagtcgaattcggtatttggtttcggtgttggatgtaagtggggcgcgggcgtgtgggaattgtagtacgtcggaattgaatagtttagtgtattttcgtttagtatcgggattcgtgggggtttcggagaggagagtatcgttgagtgcgtggtgcgtagcgcgtttaggttattttttgtacgtttcgaattcggagggttcggtaggttttagggcggcgtttttttttgtttttcgtagaagttgatgattatatagtttcgggattgtggggcggcggtcgagttttttttgtttaaggcgaaggttaaaaggagtttggaggagttggttagcgttgcggggtaggattgcgcggaagtggacgttattttgagggagattttcgagcgttgcgatgaagttttttagagtcgcgattttaagcggtttcgattgttgttagagttcgcgaatattgatattaggttcgggaatttgtatggcgtttttcgggggttgcgtatagattgtagtcggagcgcgttgaatttgagttatagtgagttggaggagggcggtttttttagtattcgtattcgtagttatagtattattcgtattttcgttttttttt

SEQ ID NO: 35642 - DNA, 640 bp, Artificial Sequence
  chemically treated genomic DNA (Homo sapiens) CpG-island No: 35642
aaaaaaaaacgaaaatacgaataatactataactacgaatacgaatactaaaaaaaccgccctcctccaactcactataactcaaattcaacgcgctccgactacaatctatacgcaacccccgaaaaacgccatacaaattcccgaacctaatatcaatattcgcgaactctaacaacaatcgaaaccgcttaaaatcgcgactctaaaaaacttcatcgcaacgctcgaaaatctccctcaaaataacgtccacttccgcgcaatcctaccccgcaacgctaaccaactcctccaaactccttttaaccttcgccttaaacaaaaaaaactcgaccgccgccccacaatcccgaaactatataatcatcaacttctacgaaaaacaaaaaaaaacgccgccctaaaacctaccgaaccctccgaattcgaaacgtacaaaaaataacctaaacgcgctacgcaccacgcactcaacgatactctcctctccgaaacccccacgaatcccgatactaaacgaaaatacactaaactattcaattccgacgtactacaattcccacacgcccgcgccccacttacatccaacaccgaaaccaaataccgaattcgactaacgaattccttcaactacacg

SEQ ID NO: 35643 - DNA, 640 bp, Artificial Sequence
  chemically treated genomic DNA (Homo sapiens) CpG-island No: 35643
gggggaaggcgagggtgcggatggtgttgtggttgcggatgcgggtgttgaaggagtcgtttttttttagtttattgtggtttaggtttaacgcgtttcggttgtagtttgtgcgtagttttcggaaggcgttatgtaggttttcgggtttggtgttagtattcgcgggttttggtagtagtcggggtcgtttgggatcgcggttttgaagggttttatcgtagcgttcggaaattttttttaggatggcgtttattttcgcgtaattttgtttcgtagcgttgattaatttttttaggttttttttggttttcgttttgagtaggaagggttcggtcgtcgttttataatttcgggattgtgtgattattagtttttacgaaagatagggaagagcgtcgttttggggtttgtcggatttttcgggttcggagcgtgtaaaaggtgatttaggcgcgttacgtattacgtatttagcggtattttttttttcggggtttttacgggtttcgatgttgggcggggatgtattgaattgtttagtttcgacgtgttgtagtttttatacgttcgcgttttatttatatttagtatcgaggttaggtgtcgggttcggttggcgagtttttttagttgtacg

SEQ ID NO: 35644 - DNA, 640 bp, Artificial Sequence
  chemically treated genomic DNA (Homo sapiens) CpG-island No: 35644
cgtacaactaaaaaaactcgccaaccgaacccgacacctaacctcgatactaaatataaataaaacgcgaacgtataaaaactacaacacgtcgaaactaaacaattcaatacatccccgcccaacatcgaaacccgtaaaaaccccgaaaaaaaaaataccgctaaatacgtaatacgtaacgcgcctaaatcaccttttacacgctccgaacccgaaaaatccgacaaaccccaaaacgacgctcttccctatctttcgtaaaaactaataatcacacaatcccgaaattataaaacgacgaccgaacccttcctactcaaaacgaaaaccaaaaaaaacctaaaaaaattaatcaacgctacgaaacaaaattacgcgaaaataaacgccatcctaaaaaaaatttccgaacgctacgataaaacccttcaaaaccgcgatcccaaacgaccccgactactaccaaaacccgcgaatactaacaccaaacccgaaaacctacataacgccttccgaaaactacgcacaaactacaaccgaaacgcgttaaacctaaaccacaataaactaaaaaaaaacgactccttcaacacccgcatccgcaaccacaacaccatccgcaccctcgccttccccc

SEQ ID NO: 35645 - DNA, 783 bp, Artificial Sequence
  chemically treated genomic DNA (Homo sapiens) CpG-island No: 35645
tcgaggtgtggttcgagtttgggtattatttacgtcggtcgggtgatttcggttttttggggttttcgcgtttcgttagtaggcgacgttgggaggttggggtaggtttagagcgaggacgggttcggattgggtagtggggatgtattagggtcgggtgcggcgggagacggttcgggaggcggaaggtcgcggatttgttcgatagaagagtagatgaggggagatcgaggacgttcgggttcggggagtttacgaggaggttaggatcgcggggtaaggaattcgcgggtagttattttcgttaggggtagggttcggttagttaggcgcgagaaggttaggcgaggtcgattgcgcggggtgaagacgttaggtcgatagttgcgggttttatcgttagttttgacgcgagtttgcgttttggcgacggcggagggcgggtagggggcgcgggcgttgttacggcgtttgtttagaatcggtcgggaacgtcgcgggcgggttttttcggtttttcgtttttttagttttgtttttaggttttcgttcgggttttttaagttgttagtcgcgttcgttttcgggtttttcgttttttttttcgcgcgtttttttttttagcggtcgtcggatttttttagtttattttttttagttaacgcgtttttcggacgttgttagtttgagcgtataggtattgggcggggtttacgggggagtcgtttaataatcgattaatatgaaatttaagggttgtttttttttagcggggatttttgt

SEQ ID NO: 35646 - DNA, 783 bp, Artificial Sequence
  chemically treated genomic DNA (Homo sapiens) CpG-island No: 35646
acaaaaatccccgctaaaaaaaaacaacccttaaatttcatattaatcgattattaaacgactcccccgtaaaccccgcccaatacctatacgctcaaactaacaacgtccgaaaaacgcgttaactaaaaaaaataaactaaaaaaatccgacgaccgctaaaaaaaaaaacgcgcgaaaaaaaaaacgaaaaacccgaaaacgaacgcgactaacaacttaaaaaacccgaacgaaaacctaaaaacaaaactaaaaaaacgaaaaaccgaaaaaacccgcccgcgacgttcccgaccgattctaaacaaacgccgtaacaacgcccgcgccccctacccgccctccgccgtcgccaaaacgcaaactcgcgtcaaaactaacgataaaacccgcaactatcgacctaacgtcttcaccccgcgcaatcgacctcgcctaaccttctcgcgcctaactaaccgaaccctacccctaacgaaaataactacccgcgaattccttaccccgcgatcctaacctcctcgtaaactccccgaacccgaacgtcctcgatctcccctcatctactcttctatcgaacaaatccgcgaccttccgcctcccgaaccgtctcccgccgcacccgaccctaatacatccccactacccaatccgaacccgtcctcgctctaaacctaccccaacctcccaacgtcgcctactaacgaaacgcgaaaaccccaaaaaaccgaaatcacccgaccgacgtaaataatacccaaactcgaaccacacctcga

SEQ ID NO: 35647 - DNA, 783 bp, Artificial Sequence
  chemically treated genomic DNA (Homo sapiens) CpG-island No: 35647
gtaggggttttcgttaggaaggggtagtttttgagttttatgttggtcggttattaagcggttttttcgtgagtttcgtttaatgtttgtgcgtttaaattagtagcgttcgaggaacgcgttaattgggagaagtgaattgagggggttcggcggtcgttgaggaggggagcgcgcgggaggaggggcgaggagttcggaggcgggcgcggttggtagtttagagggttcgggcggaggtttgagagtagggttggaggggcggaggatcggggagattcgttcgcggcgttttcggtcggttttgagtaggcgtcgtggtagcgttcgcgttttttgttcgtttttcgtcgtcgttaggacgtaggttcgcgttagggttggcggtagggttcgtagttgtcggtttggcgtttttatttcgcgtagtcggtttcgtttagttttttcgcgtttgattggtcggattttgtttttggcggaggtaattgttcgcggattttttatttcgcgattttggttttttcgtaagtttttcggattcgggcgttttcggtttttttttatttatttttttgtcgggtaggttcgcgatttttcgtttttcgggtcgtttttcgtcgtattcggttttggtatatttttattatttagttcgggttcgttttcgttttgggtttattttagttttttagcgtcgtttgttgacggagcgcgggagttttaaggggtcggggttattcggtcggcgtgggtggtgtttaggttcgggttatatttcgg

SEQ ID NO: 35648 - DNA, 783 bp, Artificial Sequence
  chemically treated genomic DNA (Homo sapiens) CpG-island No: 35648
ccgaaatataacccgaacctaaacaccacccacgccgaccgaataaccccgaccccttaaaactcccgcgctccgtcaacaaacgacgctaaaaaactaaaataaacccaaaacgaaaacgaacccgaactaaataataaaaatataccaaaaccgaatacgacgaaaaacgacccgaaaaacgaaaaatcgcgaacctacccgacaaaaaaataaataaaaaaaaaccgaaaacgcccgaatccgaaaaacttacgaaaaaaccaaaatcgcgaaataaaaaatccgcgaacaattacctccgccaaaaacaaaatccgaccaatcaaacgcgaaaaaactaaacgaaaccgactacgcgaaataaaaacgccaaaccgacaactacgaaccctaccgccaaccctaacgcgaacctacgtcctaacgacgacgaaaaacgaacaaaaaacgcgaacgctaccacgacgcctactcaaaaccgaccgaaaacgccgcgaacgaatctccccgatcctccgcccctccaaccctactctcaaacctccgcccgaaccctctaaactaccaaccgcgcccgcctccgaactcctcgcccctcctcccgcgcgctcccctcctcaacgaccgccgaaccccctcaattcacttctcccaattaacgcgttcctcgaacgctactaatttaaacgcacaaacattaaacgaaactcacgaaaaaaccgcttaataaccgaccaacataaaactcaaaaactaccccttcctaacgaaaacccctac

SEQ ID NO: 35649 - DNA, 612 bp, Artificial Sequence
  chemically treated genomic DNA (Homo sapiens) CpG-island No: 35649
tagtgtcgtttgcgttagtgtcggaatgttttttttgcgtatattaatattacgtaaatgtggcggaatatcgatattacggttgagagtaaatatcgttttaatagcggtattacgcgttttttttaggtttatattttttatttttacgtttataacgcgcgcgatatcgcggtattttttatcggtaaagttagcgttataacgtatgatatgcggtaataggatggcgttcgtaatatcgtgtggagtgttataaaacgcgtttagtggatgcgttatattatgtattaattttaatttaatattcgagaagtttatattcgtaatatattgttcgagcgttatttttttttcggtatttttattattagtaatcgattttttagcgttttagtaatgattttaatcgttttaatgtgtagtgtatcggttagcgtttacgcgttacgggtaatatattttttaatagtatggagtagcgtatcgatattcgtcgtagtttttagcgttggaggtatattatttattatgttagcgttaataaacgttatttgcgggatattatgcggattaacgtaaataaatttgcgtcgttttttttcgttagtg

SEQ ID NO: 35650 - DNA, 612 bp, Artificial Sequence
  chemically treated genomic DNA (Homo sapiens) CpG-island No: 35650
cactaacgaaaaaaaacgacgcaaatttatttacgttaatccgcataatatcccgcaaataacgtttattaacgctaacataataaataatatacctccaacgctaaaaactacgacgaatatcgatacgctactccatactattaaaaaatatattacccgtaacgcgtaaacgctaaccgatacactacacattaaaacgattaaaatcattactaaaacgctaaaaaatcgattactaataataaaaataccgaaaaaaaaataacgctcgaacaatatattacgaatataaacttctcgaatattaaattaaaattaatacataatataacgcatccactaaacgcgttttataacactccacacgatattacgaacgccatcctattaccgcatatcatacgttataacgctaactttaccgataaaaaataccgcgatatcgcgcgcgttataaacgtaaaaataaaaaatataaacctaaaaaaaacgcgtaataccgctattaaaacgatatttactctcaaccgtaatatcgatattccgccacatttacgtaatattaatatacgcaaaaaaaacattccgacactaacgcaaacgacacta

SEQ ID NO: 35651 - DNA, 612 bp, Artificial Sequence
  chemically treated genomic DNA (Homo sapiens) CpG-island No: 35651
tattgacgaagagaaacggcgtaagtttgtttgcgttgattcgtatgatatttcgtaggtggcgtttattgacgttgatatgatggatggtatgtttttagcgttgaaagttgcgacgggtgtcgatgcgttattttatgttattgaggggtatattattcgtggcgcgtgggcgttaatcgatgtattgtatattaaagcgattgaaattattgttggggcgttggaggatcggttgttggtgataaggatgtcggagaagaaatggcgttcgggtagtatgttgcgggtatgggtttttcgaatgttgggttagggttggtgtatggtatggcgtatttattgggcgcgttttataatattttatacggtgttgcgaacgttattttgttatcgtatgttatgcgttataacgttgattttatcggtgagaagtatcgcgatatcgcgcgcgttatgggcgtgaaagtggaaggtatgagtttggaagaggcgcgtaatgtcgttgttgaagcggtgtttgtttttaatcgtgatgtcggtatttcgttatatttgcgtgatgttggtgtacgtaaggaagatatttcggtattggcgtaggcggtattg

SEQ ID NO: 35652 - DNA, 612 bp, Artificial Sequence
  chemically treated genomic DNA (Homo sapiens) CpG-island No: 35652
caataccgcctacgccaataccgaaatatcttccttacgtacaccaacatcacgcaaatataacgaaataccgacatcacgattaaaaacaaacaccgcttcaacaacgacattacgcgcctcttccaaactcataccttccactttcacgcccataacgcgcgcgatatcgcgatacttctcaccgataaaatcaacgttataacgcataacatacgataacaaaataacgttcgcaacaccgtataaaatattataaaacgcgcccaataaatacgccataccatacaccaaccctaacccaacattcgaaaaacccatacccgcaacatactacccgaacgccatttcttctccgacatccttatcaccaacaaccgatcctccaacgccccaacaataatttcaatcgctttaatatacaatacatcgattaacgcccacgcgccacgaataatatacccctcaataacataaaataacgcatcgacacccgtcgcaactttcaacgctaaaaacataccatccatcatatcaacgtcaataaacgccacctacgaaatatcatacgaatcaacgcaaacaaacttacgccgtttctcttcgtcaata

SEQ ID NO: 35653 - DNA, 885 bp, Artificial Sequence
  chemically treated genomic DNA (Homo sapiens) CpG-island No: 35653
ggcgtagcgatttcgagtttttttatattgggagtttcggggtagtattttcggggtttatgttatcgcggggacggtgcggaaaaaaaggttttatttttaattttttcggaggaaatcgtttcgttttgcggtttgtttaatattgttcgtataacgggttttagggttggagagaattagggatacgagtttttttttgcgcgtataaagtagttgcgtcggggcgcgcggttttttttttcgttattcgttaatttggaagaatttttttgggagtttgtttatttttttggttttatagttattcgtttcggacggagcgttaggcgttttaatagtcgtggcggttgtaatcgtatttttcgggtttggttttcgttttgatcgtttggtttttttcgtttcggttttatcgtgtagtttggttcgcgtttttgtcgtgttagtgcgcggtacgcgttttagagtacgaggttttttttcggggggttgtttcgcgcggggtttcgggtttcggataaggtttagtcggttcgggtgttggttcgtcgtcgttcgcggttttcgcgtcggtttttgttgtcgcgcgcgaaaagggaggggttggggggaaattttcggtaattttaatttcgggcgttggagttttagttgtagtcgcgcgttcgttcgtcgtcgagtgcgagcgtttgcgaagtaaatttgttcgcgcggtcgtttttgagtatgtttagtgtcgtcgtgggcgagttcgagcgttttggttcggggtaaagagtagcggttaggggttgggggttgggggtcgggattcgcgattcgttttaggtttcggagcgcggaggtggtagaggaagggaaaggttaatgtaggggcggggg

SEQ ID NO: 35654 - DNA, 885 bp, Artificial Sequence
  chemically treated genomic DNA (Homo sapiens) CpG-island No: 35654
cccccgcccctacattaacctttcccttcctctaccacctccgcgctccgaaacctaaaacgaatcgcgaatcccgacccccaacccccaacccctaaccgctactctttaccccgaaccaaaacgctcgaactcgcccacgacgacactaaacatactcaaaaacgaccgcgcgaacaaatttacttcgcaaacgctcgcactcgacgacgaacgaacgcgcgactacaactaaaactccaacgcccgaaattaaaattaccgaaaatttccccccaacccctcccttttcgcgcgcgacaacaaaaaccgacgcgaaaaccgcgaacgacgacgaaccaacacccgaaccgactaaaccttatccgaaacccgaaaccccgcgcgaaacaaccccccgaaaaaaaacctcgtactctaaaacgcgtaccgcgcactaacacgacaaaaacgcgaaccaaactacacgataaaaccgaaacgaaaaaaaccaaacgatcaaaacgaaaaccaaacccgaaaaatacgattacaaccgccacgactattaaaacgcctaacgctccgtccgaaacgaataactataaaaccaaaaaaataaacaaactcccaaaaaaattcttccaaattaacgaataacgaaaaaaaaaaccgcgcgccccgacgcaactactttatacgcgcaaaaaaaaactcgtatccctaattctctccaaccctaaaacccgttatacgaacaatattaaacaaaccgcaaaacgaaacgatttcctccgaaaaaattaaaaataaaacctttttttccgcaccgtccccgcgataacataaaccccgaaaatactaccccgaaactcccaatataaaaaaactcgaaatcgctacgcc

SEQ ID NO: 35655 - DNA, 885 bp, Artificial Sequence
  chemically treated genomic DNA (Homo sapiens) CpG-island No: 35655
ttttcgtttttatattggtttttttttttttttgttattttcgcgtttcgaggtttggggcgggtcgcgggtttcggtttttagtttttagtttttagtcgttgttttttgtttcgggttagggcgttcgggttcgtttacggcggtattgagtatgtttagaggcggtcgcgcgggtaggtttgtttcgtaggcgttcgtattcggcggcgggcgggcgcgcggttgtagttggagttttagcgttcggagttggagttgtcgggagtttttttttaattttttttttttcgcgcgcggtagtaggagtcggcgcgggagtcgcgagcggcggcgagttagtattcgggtcggttaagttttgttcggagttcggagtttcgcgcggggtagtttttcggggaggagtttcgtgttttgggacgcgtgtcgcgtattggtacggtaggggcgcgagttaggttgtacggtaggatcggggcgaggggagttaggcggttagggcggaggttaagttcgggagatgcggttgtagtcgttacggttgttggggcgtttggcgtttcgttcgaggcgggtggttgtgaggttaggggagtaggtaggtttttagagagatttttttaagttggcgggtggcgggagagggggtcgcgcgtttcggcgtagttgttttgtgcgcgtagagagggattcgtgtttttggttttttttaattttgggattcgttgtgcgggtagtattgggtaagtcgtagaacggagcgatttttttcgagaaagttgaggatggagttttttttttcgtatcgttttcgcgatggtatgggtttcgagaatgttgtttcgaggtttttagtgtgggggagttcggggtcgttgcgtt

SEQ ID NO: 35656 - DNA, 885 bp, Artificial Sequence
  chemically treated genomic DNA (Homo sapiens) CpG-island No: 35656
aacgcaacgaccccgaactcccccacactaaaaacctcgaaacaacattctcgaaacccataccatcgcgaaaacgatacgaaaaaaaaaactccatcctcaactttctcgaaaaaaatcgctccgttctacgacttacccaatactacccgcacaacgaatcccaaaattaaaaaaaaccaaaaacacgaatccctctctacgcgcacaaaacaactacgccgaaacgcgcgaccccctctcccgccacccgccaacttaaaaaaatctctctaaaaacctacctactcccctaacctcacaaccacccgcctcgaacgaaacgccaaacgccccaacaaccgtaacgactacaaccgcatctcccgaacttaacctccgccctaaccgcctaactcccctcgccccgatcctaccgtacaacctaactcgcgcccctaccgtaccaatacgcgacacgcgtcccaaaacacgaaactcctccccgaaaaactaccccgcgcgaaactccgaactccgaacaaaacttaaccgacccgaatactaactcgccgccgctcgcgactcccgcgccgactcctactaccgcgcgcgaaaaaaaaaaaattaaaaaaaaactcccgacaactccaactccgaacgctaaaactccaactacaaccgcgcgcccgcccgccgccgaatacgaacgcctacgaaacaaacctacccgcgcgaccgcctctaaacatactcaataccgccgtaaacgaacccgaacgccctaacccgaaacaaaaaacaacgactaaaaactaaaaactaaaaaccgaaacccgcgacccgccccaaacctcgaaacgcgaaaataacaaaaaaaaaaaaaaaccaatataaaaacgaaaa

SEQ ID NO: 35657 - DNA, 763 bp, Artificial Sequence
  chemically treated genomic DNA (Homo sapiens) CpG-island No: 35657
cgtcgcggtttttttttttttatttcgttttagttttttgttcgttacggttttttgttttttgttttcgcggttttttgttttttgttttcgcggttttttgttttcgcggttttttgttcgattcggttttttgatttttcgtcgtcgttgttttttgtattttcgtcgtcgttgttttttgtattttcgtcgtcgtggttttttgttcgtcgcggtttttttcgtttatcgtcgcggttttttgtcgtcgcggttttttgttaatcgaggttttttattttacgtcgtcgcggtttttttttcgattcggttttttgttttttcgtcgtcgcgatttttttattttcgtcgtcgtggttttttgtcgtttcggtgtcgcggttatttgttcgtcgcggttttttgtattttcgtcgtcgcggttttttgttttttgttgtcggttttttgttcgaatcggttttttgtttttttttttttttatcgttacggtttttttattttcgtcgtcgcggttttttgttttttcggtgtcgcggttatttgttttttttcggtgtcgcggttatttgttcgtcgcggttttttgtattttcgtcgtcgcggttttttgtttttttgtcgtcgcggttttttgttttcgtagttttttgtattttcgtcgttttcgtggttttttgttgtttcggtttttttttttttttttttcggtttgttgtcggttgcggttttttgttttttttttttcgttattgtggtt

SEQ ID NO: 35658 - DNA, 763 bp, Artificial Sequence
  chemically treated genomic DNA (Homo sapiens) CpG-island No: 35658
aaccacaataacgaaaaaaaaaaaacaaaaaaccgcaaccgacaacaaaccgaaaaaaaaaaaaaaaaaaaccgaaacaacaaaaaaccacgaaaacgacgaaaatacaaaaaactacgaaaacaaaaaaccgcgacgacaaaaaaacaaaaaaccgcgacgacgaaaatacaaaaaaccgcgacgaacaaataaccgcgacaccgaaaaaaaacaaataaccgcgacaccgaaaaaacaaaaaaccgcgacgacgaaaataaaaaaaccgtaacgataaaaaaaaaaaaaaacaaaaaaccgattcgaacaaaaaaccgacaacaaaaaacaaaaaaccgcgacgacgaaaatacaaaaaaccgcgacgaacaaataaccgcgacaccgaaacgacaaaaaaccacgacgacgaaaataaaaaaatcgcgacgacgaaaaaacaaaaaaccgaatcgaaaaaaaaaccgcgacgacgtaaaataaaaaacctcgattaacaaaaaaccgcgacgacaaaaaaccgcgacgataaacgaaaaaaaccgcgacgaacaaaaaaccacgacgacgaaaatacaaaaaacaacgacgacgaaaatacaaaaaacaacgacgacgaaaaatcaaaaaaccgaatcgaacaaaaaaccgcgaaaacaaaaaaccgcgaaaacaaaaaacaaaaaaccgcgaaaacaaaaaacaaaaaaccgtaacgaacaaaaaactaaaacgaaataaaaaaaaaaaaaccgcgacg

SEQ ID NO: 35659 - DNA, 763 bp, Artificial Sequence
  chemically treated genomic DNA (Homo sapiens) CpG-island No: 35659
agttatagtggcgggggggggggggtaaaaagtcgtagtcggtaataagtcggggggggggggggaaaaagtcggggtaataaaaaattacgggggcggcggggatgtaaaaagttgcggaggtaaaaagtcgcggcggtaggggggtaaaaagtcgcggcgacggggatgtaaaaagtcgcgacgggtaaataatcgcggtatcgggggggggtaaataatcgcggtatcgggagggtaaaaagtcgcggcggcgggggtgaaaaagtcgtggcggtgggggggggggggggtaaaaagtcggttcgagtaaaaagtcggtagtagggggtaaaaagtcgcggcgacgggggtgtaaaaagtcgcgacgggtaaataatcgcggtatcggggcggtaaaaagttacggcggcgggggtgaaaaagtcgcggcggcgggggagtaaaaagtcgggtcggggaaaaagtcgcggcggcgtaggataaaaagtttcggttggtaaaaagtcgcggcgataaaaagtcgcggcggtgggcggaaagagtcgcggcgggtaaaaagttacggcggcggggatgtaaaaagtagcggcggcggggatgtaaaaagtagcggcggcggggggttaaaaagtcgggtcgggtaaaaagtcgcggaggtaaaaagtcgcggaggtagggggtaaaaagtcgcggaggtagggggtaaaaagtcgtggcgggtaaaaagttgaggcggggtgggggggaaaaagtcgcggcg

SEQ ID NO: 35660 - DNA, 763 bp, Artificial Sequence
  chemically treated genomic DNA (Homo sapiens) CpG-island No: 35660
cgccgcgactttttcccccccaccccgcctcaactttttacccgccacgactttttaccccctacctccgcgactttttaccccctacctccgcgactttttacctccgcgactttttacccgacccgactttttaaccccccgccgccgctactttttacatccccgccgccgctactttttacatccccgccgccgtaactttttacccgccgcgactctttccgcccaccgccgcgactttttatcgccgcgactttttaccaaccgaaactttttatcctacgccgccgcgactttttccccgacccgactttttactcccccgccgccgcgactttttcacccccgccgccgtaactttttaccgccccgataccgcgattatttacccgtcgcgactttttacacccccgtcgccgcgactttttaccccctactaccgactttttactcgaaccgactttttacccccccccccccccaccgccacgactttttcacccccgccgccgcgactttttaccctcccgataccgcgattatttacccccccccgataccgcgattatttacccgtcgcgactttttacatccccgtcgccgcgactttttacccccctaccgccgcgactttttacctccgcaactttttacatccccgccgcccccgtaattttttattaccccgactttttccccccccccccccgacttattaccgactacgactttttacccccccccccccgccactataact

SEQ ID NO: 35661 - DNA, 582 bp, Artificial Sequence
  chemically treated genomic DNA (Homo sapiens) CpG-island No: 35661
tggtttttgcgtttcgtatttcgtttttttgttggtttttcggttttttcgttggttgtcgtggatttttggtatttgggtattcgttgtatttgtttcgtgtagtatgtggttgttggtttgtgttatgttttatcggtttgttttcgtgtttttgttacgcgtcgtttgtcgtttcgttggtttttgtttttgtcgtaattttggtgttttttcgtgtcgttgtcgttggttttgtgtttttttgttttgggttttttttttttttttattatttgtttttaggtgtttgttgttcgttttttttcgttttgtttgttcgtcgtttgttttttttcgttcgaggtgtttttttttcgttttcgtggtcgtttgcgttttagtggtgttttgttttttatcgttgttgtttgtttttttgttcgttttttttttttttttttgtttcgtttttcgtgttagtgtttttttttcggtttgttttttcgttttagcggttttttttggttttttttttttgtttgtggtcgtggtttttcgtttttttttttttcgtttttcgttcggttttttgttttcgtt

SEQ ID NO: 35662 - DNA, 582 bp, Artificial Sequence
  chemically treated genomic DNA (Homo sapiens) CpG-island No: 35662
aacgaaaacaaaaaaccgaacgaaaaacgaaaaaaaaaaaaacgaaaaaccacgaccacaaacaaaaaaaaaaaaccaaaaaaaaccgctaaaacgaaaaaacaaaccgaaaaaaaaacactaacacgaaaaacgaaacaaaaaaaaaaaaaaaaaacgaacaaaaaaacaaacaacaacgataaaaaacaaaacaccactaaaacgcaaacgaccacgaaaacgaaaaaaaaacacctcgaacgaaaaaaaacaaacgacgaacaaacaaaacgaaaaaaaacgaacaacaaacacctaaaaacaaataataaaaaaaaaaaaaaaacccaaaacaaaaaaacacaaaaccaacgacaacgacacgaaaaaacaccaaaattacgacaaaaacaaaaaccaacgaaacgacaaacgacgcgtaacaaaaacacgaaaacaaaccgataaaacataacacaaaccaacaaccacatactacacgaaacaaatacaacgaatacccaaataccaaaaatccacgacaaccaacgaaaaaaccgaaaaaccaacaaaaaaacgaaatacgaaacgcaaaaacca

SEQ ID NO: 35663 - DNA, 582 bp, Artificial Sequence
  chemically treated genomic DNA (Homo sapiens) CpG-island No: 35663
aacgaagatagaaggtcgaacgaagggcgagaagagaagaaacgagaaattacgattatagataaaaaaaagaaattagagagagtcgttgagacggggaggtagatcgagagaggagtattgatacgaaagacgggatagaaaaggggaaagagaacgaataagagagtaggtagtagcgatgaagaatagagtattattaaaacgtagacgattacggaagcgaaagagagatatttcggacgaaaaagggtaagcggcgaataggtagagcgaggaagaacgagtagtagatatttgagagtaggtagtggaagaaagaggaaaatttaagataaaagaatatagaattagcgataacggtacgaaaggatattaggattacggtagaggtagaggttaacgggacgataggcggcgcgtgataagagtacgagagtaagtcgatggagtatagtatagattagtagttatatattatacgagataagtgtagcgagtgtttaagtattaagagtttacgataattagcgagaagatcgggagattagtaggagaacggagtacggagcgtaagggtta

SEQ ID NO: 35664 - DNA, 582 bp, Artificial Sequence
  chemically treated genomic DNA (Homo sapiens) CpG-island No: 35664
taacccttacgctccgtactccgttctcctactaatctcccgatcttctcgctaattatcgtaaactcttaatacttaaacactcgctacacttatctcgtataatatataactactaatctatactatactccatcgacttactctcgtactcttatcacgcgccgcctatcgtcccgttaacctctacctctaccgtaatcctaatatcctttcgtaccgttatcgctaattctatattcttttatcttaaattttcctctttcttccactacctactctcaaatatctactactcgttcttcctcgctctacctattcgccgcttaccctttttcgtccgaaatatctctctttcgcttccgtaatcgtctacgttttaataatactctattcttcatcgctactacctactctcttattcgttctctttccccttttctatcccgtctttcgtatcaatactcctctctcgatctacctccccgtctcaacgactctctctaatttcttttttttatctataatcgtaatttctcgtttcttctcttctcgcccttcgttcgaccttctatcttcgtt

SEQ ID NO: 35665 - DNA, 580 bp, Artificial Sequence
  chemically treated genomic DNA (Homo sapiens) CpG-island No: 35665
  misc_feature (72)..(72): n is either a, c, g or t
gcggtttcggtacggcgcggttgtgttttgttttgtttttaattttttatgggttcgcgggtttcggtcgtnttcgttttttttcgtcgtatttcgtttttagttttcgtttttcgatttcgttgtagaaatatttttttttcggagaagtcgcgcgtacggcgttgtaggtttttttcggcgtttcggtcggtcggggtttgggtcgttattcgttcggttcgcggttttcggttgttttttaggttcgtcgttcgtcgttcggggtttaggttcgttcgttcggggtttaggtcgtcgtcgtcgtcgtttttaggggatttaggggaattcgtagggtttcgcgtggcgtcggggggcgagcggttcgtaacgcggggaagaggtcgggggcggacgatagttttcgtttatttcgatacgtatttcgtcgtttttaatttaatttttttggggtttcggcgttattcgcgttcggtagtcggcggagttcgttatttattaattcgtttgggataacgtcgcgtcggttatttgggttatggtagttgtttaggtcgggggtggtggggggttgggg

SEQ ID NO: 35666 - DNA, 580 bp, Artificial Sequence
  chemically treated genomic DNA (Homo sapiens) CpG-island No: 35666
  misc_feature (509)..(509): n is either a, c, g or t
ccccaaccccccaccacccccgacctaaacaactaccataacccaaataaccgacgcgacgttatcccaaacgaattaataaataacgaactccgccgactaccgaacgcgaataacgccgaaaccccaaaaaaattaaattaaaaacgacgaaatacgtatcgaaataaacgaaaactatcgtccgcccccgacctcttccccgcgttacgaaccgctcgccccccgacgccacgcgaaaccctacgaattcccctaaatcccctaaaaacgacgacgacgacgacctaaaccccgaacgaacgaacctaaaccccgaacgacgaacgacgaacctaaaaaacaaccgaaaaccgcgaaccgaacgaataacgacccaaaccccgaccgaccgaaacgccgaaaaaaacctacaacgccgtacgcgcgacttctccgaaaaaaaaatatttctacaacgaaatcgaaaaacgaaaactaaaaacgaaatacgacgaaaaaaaacgaanacgaccgaaacccgcgaacccataaaaaattaaaaacaaaacaaaacacaaccgcgccgtaccgaaaccgc

SEQ ID NO: 35667 - DNA, 580 bp, Artificial Sequence
  chemically treated genomic DNA (Homo sapiens) CpG-island No: 35667
  misc_feature (509)..(509): n is either a, c, g or t
ttttagttttttattattttcggtttaagtagttattatggtttaggtggtcggcgcggcgttgttttaggcgggttggtaagtggcgagtttcgtcggttgtcgggcgcgggtggcgtcggggttttagggaggttgggttgggggcggcggggtgcgtgtcggggtaggcggaggttgtcgttcgttttcggtttttttttcgcgttacgggtcgttcgtttttcggcgttacgcggagttttgcgagtttttttaggttttttggaggcggcggcggcggcggtttgggtttcgggcgagcgggtttgggtttcgggcggcgggcggcgggtttggggagtagtcgggggtcgcgagtcgggcgggtggcggtttagatttcggtcgatcggagcgtcggggaggatttgtagcgtcgtacgcgcggttttttcggggagggggtgtttttgtagcgggatcgggaggcgagggttgggaacgaagtgcggcggagagggacgaanacggtcggagttcgcgggtttataggaagttgagggtagagtagagtatagtcgcgtcgtgtcggagtcgt

SEQ ID NO: 35668 - DNA, 580 bp, Artificial Sequence
  chemically treated genomic DNA (Homo sapiens) CpG-island No: 35668
  misc_feature (72)..(72): n is either a, c, g or t
acgactccgacacgacgcgactatactctactctaccctcaacttcctataaacccgcgaactccgaccgtnttcgtccctctccgccgcacttcgttcccaaccctcgcctcccgatcccgctacaaaaacaccccctccccgaaaaaaccgcgcgtacgacgctacaaatcctccccgacgctccgatcgaccgaaatctaaaccgccacccgcccgactcgcgacccccgactactccccaaacccgccgcccgccgcccgaaacccaaacccgctcgcccgaaacccaaaccgccgccgccgccgcctccaaaaaacctaaaaaaactcgcaaaactccgcgtaacgccgaaaaacgaacgacccgtaacgcgaaaaaaaaaccgaaaacgaacgacaacctccgcctaccccgacacgcaccccgccgcccccaacccaacctccctaaaaccccgacgccacccgcgcccgacaaccgacgaaactcgccacttaccaacccgcctaaaacaacgccgcgccgaccacctaaaccataataactacttaaaccgaaaataataaaaaactaaaa

SEQ ID NO: 35669 - DNA, 546 bp, Artificial Sequence
  chemically treated genomic DNA (Homo sapiens) CpG-island No: 35669
tgttcgacgggaatttttggggagcggatatttgtagtaacgttaggtagtaggcgtttagggatagtatcgcgtcgggtttcgcgttcgagttcgagttcgtcgagttgtcgttattttcggatttttcgtcgttttcgacggcgtcggtttttagttcgtcggtcgcgcgttttttgtttcgtcgtttttttagatttatttttatcgagcgagggcgtattttcgtttcgttcgtcgaggtagtcgtcgtcgtcgagtcgtcgtcgtcgttcgtagggggcgttcgggtgttgttttcgttggtcgcgtttcgtcgttgtcggcggttgtcgcgatcgtagtcgtcgtcgtcgcgtttttgttaggcggatttggagcggaagttgaagtcgaagttttcggttagggggtcgttatcgtttagcggaggatcgtcgtcgtcgtcgttgcgttagcggttggttaggcgttgttgttgttgcggggttatcgttttttcgggttttttggtggagtcgcgggtagagttttcgggggtatggg

SEQ ID NO: 35670 - DNA, 546 bp, Artificial Sequence
  chemically treated genomic DNA (Homo sapiens) CpG-island No: 35670
cccatacccccgaaaactctacccgcgactccaccaaaaaacccgaaaaaacgataaccccgcaacaacaacaacgcctaaccaaccgctaacgcaacgacgacgacgacgatcctccgctaaacgataacgaccccctaaccgaaaacttcgacttcaacttccgctccaaatccgcctaacaaaaacgcgacgacgacgactacgatcgcgacaaccgccgacaacgacgaaacgcgaccaacgaaaacaacacccgaacgccccctacgaacgacgacgacgactcgacgacgacgactacctcgacgaacgaaacgaaaatacgccctcgctcgataaaaataaatctaaaaaaacgacgaaacaaaaaacgcgcgaccgacgaactaaaaaccgacgccgtcgaaaacgacgaaaaatccgaaaataacgacaactcgacgaactcgaactcgaacgcgaaacccgacgcgatactatccctaaacgcctactacctaacgttactacaaatatccgctccccaaaaattcccgtcgaaca

SEQ ID NO: 35671 - DNA, 546 bp, Artificial Sequence
  chemically treated genomic DNA (Homo sapiens) CpG-island No: 35671
tttatgttttcgggggttttgttcgcggttttattaagaaattcgggggggcggtgatttcgtagtagtagtagcgtttggttagtcgttggcgtagcgacgacgacgacgatttttcgttgagcggtgacgattttttggtcgggggtttcggttttagttttcgttttaagttcgtttggtaggagcgcggcggcgacgattgcggtcgcggtagtcgtcggtagcggcggggcgcggttagcgggggtagtattcgggcgttttttgcgggcggcggcggcggttcggcggcggcggttgtttcggcgggcgggacggaggtgcgttttcgttcggtggaggtgggtttggaggagcggcggggtaaggggcgcgcggtcgacgagttggaggtcggcgtcgtcgagggcggcgaggggttcggggatggcggtagttcggcggattcgggttcgggcgcggggttcggcgcggtgttgtttttgggcgtttgttgtttggcgttgttgtagatattcgttttttagaagttttcgtcggata

SEQ ID NO: 35672 - DNA, 546 bp, Artificial Sequence
  chemically treated genomic DNA (Homo sapiens) CpG-island No: 35672
tatccgacgaaaacttctaaaaaacgaatatctacaacaacgccaaacaacaaacgcccaaaaacaacaccgcgccgaaccccgcgcccgaacccgaatccgccgaactaccgccatccccgaacccctcgccgccctcgacgacgccgacctccaactcgtcgaccgcgcgccccttaccccgccgctcctccaaacccacctccaccgaacgaaaacgcacctccgtcccgcccgccgaaacaaccgccgccgccgaaccgccgccgccgcccgcaaaaaacgcccgaatactacccccgctaaccgcgccccgccgctaccgacgactaccgcgaccgcaatcgtcgccgccgcgctcctaccaaacgaacttaaaacgaaaactaaaaccgaaacccccgaccaaaaaatcgtcaccgctcaacgaaaaatcgtcgtcgtcgtcgctacgccaacgactaaccaaacgctactactactacgaaatcaccgcccccccgaatttcttaataaaaccgcgaacaaaacccccgaaaacataaa

SEQ ID NO: 35673 - DNA, 724 bp, Artificial Sequence
  chemically treated genomic DNA (Homo sapiens) CpG-island No: 35673
gcgttacggcggttaggtgggtcgcgaagtgttggtggtagttttcggcgtaggtcgttacgacgtcgaattcggcggggaatagcggttttagtcgttttattacggtttttaggtttttttttatggtgcggtttaagtgtagaaagacgttttcggggatttcggcgttcgcggtcggtcgttggtttatgcgtttttcggtcgttttcgttacgtcgcgtcgttatagttgtagttagcgtcgcgggcgcgtggtcgttagtttcgaggttttcggtttcgtcgtcgtcgtttggcggttttcgcgtttttgtttcgttattacggttagcgtttggcgtagtcgttcgggcggcgtttttagcggtcgtcgtagtacgtttagtatttggtcgcgtagtagttcgtatagcgtttttattttgttttggcgtcgtattagttttttttcgtttatatcgttcgtcgtcgtcgtcgtcgttagttttcgttttagcgttagtagcggtcgcgtcgtttttagttgttcgcgttttagcgtcgtttttagtttttttattgcgtcgggaaagtcgcgttagtttcggttttagtttatcgtttatcgggcggggcggttagcgttaagcggggatcgtttttttttagacgcgtatagggtcggcggttaatattttaaagggtgatgtcggtgtttttgattaggttgaaggttttttag

SEQ ID NO: 35674 - DNA, 724 bp, Artificial Sequence
  chemically treated genomic DNA (Homo sapiens) CpG-island No: 35674
ctaaaaaaccttcaacctaatcaaaaacaccgacatcaccctttaaaatattaaccgccgaccctatacgcgtctaaaaaaaaacgatccccgcttaacgctaaccgccccgcccgataaacgataaactaaaaccgaaactaacgcgactttcccgacgcaataaaaaaactaaaaacgacgctaaaacgcgaacaactaaaaacgacgcgaccgctactaacgctaaaacgaaaactaacgacgacgacgacgacgaacgatataaacgaaaaaaaactaatacgacgccaaaacaaaataaaaacgctatacgaactactacgcgaccaaatactaaacgtactacgacgaccgctaaaaacgccgcccgaacgactacgccaaacgctaaccgtaataacgaaacaaaaacgcgaaaaccgccaaacgacgacgacgaaaccgaaaacctcgaaactaacgaccacgcgcccgcgacgctaactacaactataacgacgcgacgtaacgaaaacgaccgaaaaacgcataaaccaacgaccgaccgcgaacgccgaaatccccgaaaacgtctttctacacttaaaccgcaccataaaaaaaaacctaaaaaccgtaataaaacgactaaaaccgctattccccgccgaattcgacgtcgtaacgacctacgccgaaaactaccaccaacacttcgcgacccacctaaccgccgtaacgc

SEQ ID NO: 35675 - DNA, 724 bp, Artificial Sequence
  chemically treated genomic DNA (Homo sapiens) CpG-island No: 35675
ttgggaggtttttagtttagttagggatatcgatattattttttagggtgttggtcgtcggttttgtgcgcgtttaggggaggacggttttcgtttggcgttggtcgtttcgttcggtgggcggtgggttggggtcggggttgacgcggttttttcggcgtagtggaggagttgaaggcggcgttggagcgcgggtagttggaggcggcgcggtcgttgttggcgttggagcgggagttggcggcggcggcggcggcgggcggtgtgagcgaggaggagttggtgcggcgttagagtaaggtggaggcgttgtacgagttgttgcgcgattaggtgttgggcgtgttgcggcggtcgttggaggcgtcgttcgaacggttgcgttaggcgttggtcgtggtggcggagtaggagcgcgaggatcgttaggcggcggcggcggggtcggggatttcggggttggcggttacgcgttcgcggcgttggttgtagttgtggcggcgcggcgtggcggaggcggtcgaggagcgtatgggttagcggtcggtcgcgggcgtcgaggttttcgagagcgtttttttgtatttgggtcgtattatgaaggaggatttggaggtcgtggtggagcggttgaagtcgttgtttttcgtcgagttcggcgtcgtggcggtttacgtcgagagttattattagtatttcgcggtttatttggtcgtcgtggcgt

SEQ ID NO: 35676 - DNA, 724 bp, Artificial Sequence
  chemically treated genomic DNA (Homo sapiens) CpG-island No: 35676
acgccacgacgaccaaataaaccgcgaaatactaataataactctcgacgtaaaccgccacgacgccgaactcgacgaaaaacaacgacttcaaccgctccaccacgacctccaaatcctccttcataatacgacccaaatacaaaaaaacgctctcgaaaacctcgacgcccgcgaccgaccgctaacccatacgctcctcgaccgcctccgccacgccgcgccgccacaactacaaccaacgccgcgaacgcgtaaccgccaaccccgaaatccccgaccccgccgccgccgcctaacgatcctcgcgctcctactccgccaccacgaccaacgcctaacgcaaccgttcgaacgacgcctccaacgaccgccgcaacacgcccaacacctaatcgcgcaacaactcgtacaacgcctccaccttactctaacgccgcaccaactcctcctcgctcacaccgcccgccgccgccgccgccgccaactcccgctccaacgccaacaacgaccgcgccgcctccaactacccgcgctccaacgccgccttcaactcctccactacgccgaaaaaaccgcgtcaaccccgaccccaacccaccgcccaccgaacgaaacgaccaacgccaaacgaaaaccgtcctcccctaaacgcgcacaaaaccgacgaccaacaccctaaaaaataatatcgatatccctaactaaactaaaaacctcccaa

SEQ ID NO: 35677 - DNA, 777 bp, Artificial Sequence
  chemically treated genomic DNA (Homo sapiens) CpG-island No: 35677
cgagatttatttgtcgtagacgttggcggtttagtttagtaggatatagagttgttcgtagtcgcgggcgtcgcgcgcgagtttttggaggcgttgggttacggcgttgtggaaggtacgtagatagattttttacgttgggaagtcggtcgtcgtatacgcgggttgtattttttgtcgtattttttgtaggtcgcggcgaattaagttatttagttcggttagaagttgggttaaattcgacgcgtttttcgttttttcgaaggtttatttcgcgttcggtcgtcgtacgcgtttttgagcgtttcgtcgtatcgtttttttttagtgttggcgttagcggcgcggcgtgcgtaggaagtcgtcgtcgtcggggggagaagggtgggttttttttttcgcgtttattacgcgggttagttcggttagcgcggtcgcgtttatatcgtcgttgtttagcgtttcgcgtacgatggcgtcgatttcggttgttagttcgtcgtaaagtaggtatacgtttatagcgcgtcgcgcgaaggtcgtagggttttgtttaaaggtgcgcgaggttttttcggttattagtagcgtttttaggcgtagaagttgttcgaaggtcgttagtagttgtcgtttagtaatgaggtcggttacggatttgttttttgtataggcgggcgagaagggcggtgagagggatcgttttaagattcgaatttggacgaagatttgtaggttacggtttaatttatcggggttggattgtttgttttttgt

SEQ ID NO: 35678 - DNA, 777 bp, Artificial Sequence
  chemically treated genomic DNA (Homo sapiens) CpG-island No: 35678
acaaaaaacaaacaatccaaccccgataaattaaaccgtaacctacaaatcttcgtccaaattcgaatcttaaaacgatccctctcaccgcccttctcgcccgcctatacaaaaaacaaatccgtaaccgacctcattactaaacgacaactactaacgaccttcgaacaacttctacgcctaaaaacgctactaataaccgaaaaaacctcgcgcacctttaaacaaaaccctacgaccttcgcgcgacgcgctataaacgtatacctactttacgacgaactaacaaccgaaatcgacgccatcgtacgcgaaacgctaaacaacgacgatataaacgcgaccgcgctaaccgaactaacccgcgtaataaacgcgaaaaaaaaaacccacccttctccccccgacgacgacgacttcctacgcacgccgcgccgctaacgccaacactaaaaaaaaacgatacgacgaaacgctcaaaaacgcgtacgacgaccgaacgcgaaataaaccttcgaaaaaacgaaaaacgcgtcgaatttaacccaacttctaaccgaactaaataacttaattcgccgcgacctacaaaaaatacgacaaaaaatacaacccgcgtatacgacgaccgacttcccaacgtaaaaaatctatctacgtaccttccacaacgccgtaacccaacgcctccaaaaactcgcgcgcgacgcccgcgactacgaacaactctatatcctactaaactaaaccgccaacgtctacgacaaataaatctcg

SEQ ID NO: 35679 - DNA, 777 bp, Artificial Sequence
  chemically treated genomic DNA (Homo sapiens) CpG-island No: 35679
gtagaggatagataatttagtttcgatggattgagtcgtggtttgtaggttttcgtttaggttcgggttttggggcggttttttttatcgtttttttcgttcgtttgtgtagaaggtaaattcgtggtcgattttattattgaacggtaattgttggcggttttcgaatagtttttgcgtttggagacgttgttggtggtcgagaaggtttcgcgtatttttgagtaggattttacggttttcgcgcggcgcgttatggacgtgtgtttgttttacgacgggttggtagtcgagatcggcgttatcgtgcgcgagacgttggatagcgacggtgtggacgcggtcgcgttggtcgagttggttcgcgtggtgagcgcggaggaggaagtttattttttttttttcgacgacggcgattttttgcgtacgtcgcgtcgttggcgttagtattgggaggaggcggtgcggcgaagcgtttaggagcgcgtgcggcggtcgggcgcggggtgggttttcggggaggcggagggcgcgtcgggtttggtttagtttttggtcgagttgggtggtttggttcgtcgcgatttgtagaaggtgcggtaggaggtgtagttcgcgtatgcggcggtcggttttttagcgtgggaggtttatttgcgtgttttttatagcgtcgtggtttagcgtttttaggagttcgcgcgcgacgttcgcggttgcgagtagttttatattttgttggattgggtcgttaacgtttacggtaggtgagtttcg

SEQ ID NO: 35680 - DNA, 777 bp, Artificial Sequence
  chemically treated genomic DNA (Homo sapiens) CpG-island No: 35680
cgaaactcacctaccgtaaacgttaacgacccaatccaacaaaatataaaactactcgcaaccgcgaacgtcgcgcgcgaactcctaaaaacgctaaaccacgacgctataaaaaacacgcaaataaacctcccacgctaaaaaaccgaccgccgcatacgcgaactacacctcctaccgcaccttctacaaatcgcgacgaaccaaaccacccaactcgaccaaaaactaaaccaaacccgacgcgccctccgcctccccgaaaacccaccccgcgcccgaccgccgcacgcgctcctaaacgcttcgccgcaccgcctcctcccaatactaacgccaacgacgcgacgtacgcaaaaaatcgccgtcgtcgaaaaaaaaaaaataaacttcctcctccgcgctcaccacgcgaaccaactcgaccaacgcgaccgcgtccacaccgtcgctatccaacgtctcgcgcacgataacgccgatctcgactaccaacccgtcgtaaaacaaacacacgtccataacgcgccgcgcgaaaaccgtaaaatcctactcaaaaatacgcgaaaccttctcgaccaccaacaacgtctccaaacgcaaaaactattcgaaaaccgccaacaattaccgttcaataataaaatcgaccacgaatttaccttctacacaaacgaacgaaaaaaacgataaaaaaaaccgccccaaaacccgaacctaaacgaaaacctacaaaccacgactcaatccatcgaaactaaattatctatcctctac

SEQ ID NO: 35681 - DNA, 627 bp, Artificial Sequence
  chemically treated genomic DNA (Homo sapiens) CpG-island No: 35681
tcgggcgggattagggttttcgtttcgcgtatcgttagcgtgaatatttggtttatttttcgttggattttggtcgtgattttcgggaacgggtagggtttttcgcgggttcgcgttattagtatttggcgttcggagtttcggtcggtttgggtgtttattagtattagtaggacggtttcgggtttttatagttcgcgtaggcgttcgcgtagcgttttacggtcgggaacgaggtttcgttgtatacgtttcggagtatcgtagacgcgtcgtcgtggcggatgtttaggttttggagcgtgattaggtgttcggcgttcgtcgcgtttacgatttttagtagcgcgggcgtcgcgtttgtttcgattttttcgcggatcgttttttcgtttacgtcgcgtattgttcggggagcggtcgtacgcgaattgcgtgtttagcgtggttttgtttacgttacgttttttagtagtatatttcggtagttttggcggggcgcgggattagttcgtagtgttcgggacgcggcggggaggggaggagagggaggaaggggaggggaaggaggaaggggaaggggtttgggagcgtagggaacggcgtattaggattgttcgggtaggg

SEQ ID NO: 35682 - DNA, 627 bp, Artificial Sequence
  chemically treated genomic DNA (Homo sapiens) CpG-island No: 35682
ccctacccgaacaatcctaatacgccgttccctacgctcccaaaccccttccccttcctccttcccctccccttcctccctctcctcccctccccgccgcgtcccgaacactacgaactaatcccgcgccccgccaaaactaccgaaatatactactaaaaaacgtaacgtaaacaaaaccacgctaaacacgcaattcgcgtacgaccgctccccgaacaatacgcgacgtaaacgaaaaaacgatccgcgaaaaaatcgaaacaaacgcgacgcccgcgctactaaaaatcgtaaacgcgacgaacgccgaacacctaatcacgctccaaaacctaaacatccgccacgacgacgcgtctacgatactccgaaacgtatacaacgaaacctcgttcccgaccgtaaaacgctacgcgaacgcctacgcgaactataaaaacccgaaaccgtcctactaatactaataaacacccaaaccgaccgaaactccgaacgccaaatactaataacgcgaacccgcgaaaaaccctacccgttcccgaaaatcacgaccaaaatccaacgaaaaataaaccaaatattcacgctaacgatacgcgaaacgaaaaccctaatcccgcccga

SEQ ID NO: 35683 - DNA, 627 bp, Artificial Sequence
  chemically treated genomic DNA (Homo sapiens) CpG-island No: 35683
ttttgttcggatagttttggtacgtcgttttttgcgtttttaggttttttttttttttttttttttttttttttttttttttttttttttttttcgtcgcgtttcggatattgcgggttggtttcgcgtttcgttagggttgtcggggtgtgttgttggggagcgtgacgtgggtaggattacgttggatacgtagttcgcgtgcggtcgtttttcgagtagtgcgcggcgtgggcggaggagcggttcgcgaggagatcgaggtaaacgcggcgttcgcgttgttggaaatcgtggacgcggcggacgtcgagtatttggttacgttttaggatttggatattcgttacggcgacgcgtttgcggtgtttcggggcgtgtgtagcgaggtttcgttttcggtcgtgaggcgttgcgcgagcgtttgcgcgggttgtgggaattcggggtcgttttgttggtgttggtgggtatttaggtcgatcgggatttcgagcgttaggtgttgatggcgcgggttcgcgaggggttttgttcgttttcgggggttacggttaagatttagcggaggatggattaggtgtttacgttggcggtgcgcgagacggaggttttgatttcgttcga

SEQ ID NO: 35684 - DNA, 627 bp, Artificial Sequence
  chemically treated genomic DNA (Homo sapiens) CpG-island No: 35684
tcgaacgaaatcaaaacctccgtctcgcgcaccgccaacgtaaacacctaatccatcctccgctaaatcttaaccgtaacccccgaaaacgaacaaaacccctcgcgaacccgcgccatcaacacctaacgctcgaaatcccgatcgacctaaatacccaccaacaccaacaaaacgaccccgaattcccacaacccgcgcaaacgctcgcgcaacgcctcacgaccgaaaacgaaacctcgctacacacgccccgaaacaccgcaaacgcgtcgccgtaacgaatatccaaatcctaaaacgtaaccaaatactcgacgtccgccgcgtccacgatttccaacaacgcgaacgccgcgtttacctcgatctcctcgcgaaccgctcctccgcccacgccgcgcactactcgaaaaacgaccgcacgcgaactacgtatccaacgtaatcctacccacgtcacgctccccaacaacacaccccgacaaccctaacgaaacgcgaaaccaacccgcaatatccgaaacgcgacgaaaaaaaaaaaaaaaaaaaaaaaaaaaaaaaaaaaaaaaaaaaaaaaaaacctaaaaacgcaaaaaacgacgtaccaaaactatccgaacaaaa

SEQ ID NO: 35685 - DNA, 1058 bp, Artificial Sequence
  chemically treated genomic DNA (Homo sapiens) CpG-island No: 35685
aggttagcgcggcggcggtcggtttcgtagtggttggttgcgttggtgttggtcgcgttttggttggttgcgggtcgcggggttgggtcgtcgggtcggggttggggtcgggttcgggcgtcggtcgggtttgcgtatcgttaggattttagaagataatagtttgcggcggcggcggcggggagggcgcgtcgcgggcggggttgagggcggcgggggcgggtcgttcgagttgggagggcgcggcgtcgaggggaggagagcggtttatggattcgcggggttcggcgttttagattttgcgtcgtcgggacggagtttaagatgtcggtttaggtcggggcgcgacgacgcggacggggcggcgaggaggcgtcgttgttgtcggggttcgtagtcgtcgagttttcgagggcgcgttttgacggattggtcgagtcggcggtgagaggtcggcgcgtcgggagcgggtcgcgcggtattatgtcggttaaggtgcggtttaagaagttggagtagttgtttttggacgggttttggcgtaacgagagcgttttgagcgtggaaacgttgttcgacgtgttcgtttgtttgtatatcgagtgtagttattcggttttgcgtcgcgataagtacgtggtcgagtttttcgagtggggtaagtgcgcgtcggtagggtcggatttgcggttttgcgattttcgcgttttagttcgcgtatttttacgttcgtttattttcgttcggatagattttgtcgtttttttgtttatttagttcgtgcgttcgttttttttcgttttggtagcgtttttaggttcgtagtttatttttttttagtcgtttttggtattttcgttttttcgttagttttttatttttttttgttttttttaggttcgatattcgcgttcgatcgtttcgtttttttattttgttttttggagttatattttacgtttttatttttattttttttttttcgtcgggttttcgtttggcggttttttagatttatttttcgagtttggatattattttttgtagtatttattggg

SEQ ID NO: 35686 - DNA, 1058 bp, Artificial Sequence
  chemically treated genomic DNA (Homo sapiens) CpG-island No: 35686
cccaataaatactacaaaaaataatatccaaactcgaaaaataaatctaaaaaaccgccaaacgaaaacccgacgaaaaaaaaaaaataaaaataaaaacgtaaaatataactccaaaaaacaaaataaaaaaacgaaacgatcgaacgcgaatatcgaacctaaaaaaaacaaaaaaaaataaaaaactaacgaaaaaacgaaaataccaaaaacgactaaaaaaaaataaactacgaacctaaaaacgctaccaaaacgaaaaaaaacgaacgcacgaactaaataaacaaaaaaacgacaaaatctatccgaacgaaaataaacgaacgtaaaaatacgcgaactaaaacgcgaaaatcgcaaaaccgcaaatccgaccctaccgacgcgcacttaccccactcgaaaaactcgaccacgtacttatcgcgacgcaaaaccgaataactacactcgatatacaaacaaacgaacacgtcgaacaacgtttccacgctcaaaacgctctcgttacgccaaaacccgtccaaaaacaactactccaacttcttaaaccgcaccttaaccgacataataccgcgcgacccgctcccgacgcgccgacctctcaccgccgactcgaccaatccgtcaaaacgcgccctcgaaaactcgacgactacgaaccccgacaacaacgacgcctcctcgccgccccgtccgcgtcgtcgcgccccgacctaaaccgacatcttaaactccgtcccgacgacgcaaaatctaaaacgccgaaccccgcgaatccataaaccgctctcctcccctcgacgccgcgccctcccaactcgaacgacccgcccccgccgccctcaaccccgcccgcgacgcgccctccccgccgccgccgccgcaaactattatcttctaaaatcctaacgatacgcaaacccgaccgacgcccgaacccgaccccaaccccgacccgacgacccaaccccgcgacccgcaaccaaccaaaacgcgaccaacaccaacgcaaccaaccactacgaaaccgaccgccgccgcgctaacct

SEQ ID NO: 35687 - DNA, 1058 bp, Artificial Sequence
  chemically treated genomic DNA (Homo sapiens) CpG-island No: 35687
tttagtgagtgttgtaggaaatgatatttagattcggagggtggatttaggaagtcgttaggcgagggttcggcgggggggagggggtgggagtgggaacgtaggatgtggttttaaggggtaggatgagggggcgggacgatcgaacgcggatgtcgagtttagggagggtaaggagggatgaaaagttagcggagggacgagggtgttaggagcggttggagagagatgggttgcgggtttgggggcgttgttagagcgagaggaggcgaacgtacgagttgggtgggtaggagggcggtagggtttgttcgggcggggatgggcgggcgtggggatgcgcgggttggggcgcgggggtcgtagagtcgtaggttcggttttgtcggcgcgtatttattttattcgaggaattcggttacgtatttgtcgcggcgtagggtcgagtggttgtattcggtgtataggtagacgagtacgtcgagtagcgtttttacgtttagggcgttttcgttgcgttagggttcgtttaggagtagttgttttagttttttgagtcgtattttggtcgatatggtgtcgcgcggttcgttttcgacgcgtcggttttttatcgtcggttcggttagttcgttagggcgcgttttcgggggttcggcggttgcgagtttcggtagtagcggcgttttttcgtcgtttcgttcgcgtcgtcgcgtttcggtttaggtcgatattttgggtttcgtttcgacggcgtagagtttggggcgtcgggtttcgcgggtttatgggtcgttttttttttttcggcgtcgcgtttttttagttcgggcggttcgttttcgtcgtttttagtttcgttcgcggcgcgtttttttcgtcgtcgtcgtcgtagattattattttttaggattttagcgatgcgtaagttcggtcggcgttcgagttcgattttagtttcgattcggcggtttagtttcgcggttcgtagttaattagggcgcggttagtattagcgtagttaattattacggggtcggtcgtcgtcgcgttgattt

SEQ ID NO: 35688 - DNA, 1058 bp, Artificial Sequence
  chemically treated genomic DNA (Homo sapiens) CpG-island No: 35688
aaatcaacgcgacgacgaccgaccccgtaataattaactacgctaatactaaccgcgccctaattaactacgaaccgcgaaactaaaccgccgaatcgaaactaaaatcgaactcgaacgccgaccgaacttacgcatcgctaaaatcctaaaaaataataatctacgacgacgacgacgaaaaaaacgcgccgcgaacgaaactaaaaacgacgaaaacgaaccgcccgaactaaaaaaacgcgacgccgaaaaaaaaaaaacgacccataaacccgcgaaacccgacgccccaaactctacgccgtcgaaacgaaacccaaaatatcgacctaaaccgaaacgcgacgacgcgaacgaaacgacgaaaaaacgccgctactaccgaaactcgcaaccgccgaacccccgaaaacgcgccctaacgaactaaccgaaccgacgataaaaaaccgacgcgtcgaaaacgaaccgcgcgacaccatatcgaccaaaatacgactcaaaaaactaaaacaactactcctaaacgaaccctaacgcaacgaaaacgccctaaacgtaaaaacgctactcgacgtactcgtctacctatacaccgaatacaaccactcgaccctacgccgcgacaaatacgtaaccgaattcctcgaataaaataaatacgcgccgacaaaaccgaacctacgactctacgacccccgcgccccaacccgcgcatccccacgcccgcccatccccgcccgaacaaaccctaccgccctcctacccacccaactcgtacgttcgcctcctctcgctctaacaacgcccccaaacccgcaacccatctctctccaaccgctcctaacaccctcgtccctccgctaacttttcatccctccttaccctccctaaactcgacatccgcgttcgatcgtcccgccccctcatcctaccccttaaaaccacatcctacgttcccactcccaccccctcccccccgccgaaccctcgcctaacgacttcctaaatccaccctccgaatctaaatatcatttcctacaacactcactaaa

SEQ ID NO: 35689 - DNA, 608 bp, Artificial Sequence
  chemically treated genomic DNA (Homo sapiens) CpG-island No: 35689
aacgagttttttaatcgaaattcgtatattaattataattcgagggaacgtttcgtaggttgtttatatgggtcggtcgtttttttcgacggttttcgcgacgttcgttttttattggatagatcgagtttacgttttaaggaagtcgggttaatcgaagtttagcgtatggtttgaaatcgaggttaaaggagatagaggtagcgtcgggtcgagggggaggggatacggagtgtttaattagcgtttagggattgcgcgacgtttcgtttagcgttgtgggaagcggtttaatcgtttttgtagggggcgttgttttttagtggtttttcggtttttgtcgttgcggtggttttgggttttttttcgtttggttttcgtagtcgaggagattttttggaaaatgggttattcgaagagagatgtttcgttgttttaggcggagggcggggacgtcgggtttgcgatattttatttttttttggtttcgaggtggttgggattcgttttattttcggtttagttttttagttaggtttttgagtcgtttagttcggatttgcgattcgtgaggttttgaggataagtgaaaagagttttttgtgtgg

SEQ ID NO: 35690 - DNA, 608 bp, Artificial Sequence
  chemically treated genomic DNA (Homo sapiens) CpG-island No: 35690
ccacacaaaaaactcttttcacttatcctcaaaacctcacgaatcgcaaatccgaactaaacgactcaaaaacctaactaaaaaactaaaccgaaaataaaacgaatcccaaccacctcgaaaccaaaaaaaaataaaatatcgcaaacccgacgtccccgccctccgcctaaaacaacgaaacatctctcttcgaataacccattttccaaaaaatctcctcgactacgaaaaccaaacgaaaaaaaacccaaaaccaccgcaacgacaaaaaccgaaaaaccactaaaaaacaacgccccctacaaaaacgattaaaccgcttcccacaacgctaaacgaaacgtcgcgcaatccctaaacgctaattaaacactccgtatcccctccccctcgacccgacgctacctctatctcctttaacctcgatttcaaaccatacgctaaacttcgattaacccgacttccttaaaacgtaaactcgatctatccaataaaaaacgaacgtcgcgaaaaccgtcgaaaaaaacgaccgacccatataaacaacctacgaaacgttccctcgaattataattaatatacgaatttcgattaaaaaactcgtt

SEQ ID NO: 35691 - DNA, 608 bp, Artificial Sequence
  chemically treated genomic DNA (Homo sapiens) CpG-island No: 35691
ttatataaagagttttttttatttgtttttaaaattttacgggtcgtaaattcgggttaaacggtttaggggtttggttggggaattgggtcgaaggtggaacggattttagttatttcggggttaggaaaagatgaagtgtcgtaggttcggcgttttcgtttttcgtttgaggtaacggagtattttttttcgagtagtttattttttagagagttttttcggttgcgaaagttagacgaagagggatttaaagttatcgtagcggtaagagtcggagaattattgagggatagcgttttttgtagaggcggttgaatcgttttttatagcgttgggcggggcgtcgcgtagtttttgggcgttgattgggtatttcgtgttttttttttttcggttcggcgttgtttttgttttttttgatttcgattttaagttatgcgttgagtttcggttggttcggtttttttgaggcgtaagttcggtttgtttaatgaggagcgagcgtcgcgggggtcgtcgggaagggcggtcgatttatataagtagtttgcggggcgttttttcgggttgtggttggtgtgcgggtttcggttggaggattcgtt

SEQ ID NO: 35692 - DNA, 608 bp, Artificial Sequence
  chemically treated genomic DNA (Homo sapiens) CpG-island No: 35692
aacgaatcctccaaccgaaacccgcacaccaaccacaacccgaaaaaacgccccgcaaactacttatataaatcgaccgcccttcccgacgacccccgcgacgctcgctcctcattaaacaaaccgaacttacgcctcaaaaaaaccgaaccaaccgaaactcaacgcataacttaaaatcgaaatcaaaaaaaacaaaaacaacgccgaaccgaaaaaaaaaaaacacgaaatacccaatcaacgcccaaaaactacgcgacgccccgcccaacgctataaaaaacgattcaaccgcctctacaaaaaacgctatccctcaataattctccgactcttaccgctacgataactttaaatccctcttcgtctaactttcgcaaccgaaaaaactctctaaaaaataaactactcgaaaaaaaatactccgttacctcaaacgaaaaacgaaaacgccgaacctacgacacttcatcttttcctaaccccgaaataactaaaatccgttccaccttcgacccaattccccaaccaaacccctaaaccgtttaacccgaatttacgacccgtaaaattttaaaaacaaataaaaaaaactctttatataa

SEQ ID NO: 35693 - DNA, 555 bp, Artificial Sequence
  chemically treated genomic DNA (Homo sapiens) CpG-island No: 35693
tagttttcgtttagtaagggaaagcggcggttttattcgtagatagttgcgaggtatcgcgttaagcgtatgcgtttgtttttaggtattttttttttcgtttttatttttttgttattttcgttttttatttagtttcgtcgtgcgtttgcgcgtttcggttcgtgggttagcgggtagtttatttacgtgggttttcgtatggtttagcgtcgttaagggtaaggcggagtttcgcgatcgtttcgtttttttcgtgtttcgttttttgtagggagcgcgggattttcggttggcgcgggtattttttagtttagttcggggcgtcggtttcgtcgcgtgcgcgtgcgtatggtggggtttggttggttgcgggatgcggtcgaggtcgtcgaggtcgtaaattttagtgggaaggcggcgtgtcgcggtcggtttcggtggaggagggggcgttttttcggaaaaggaaggaagtgggtgttacgggttttaatacggtttttttgacgttttgagtgggaaattataagatattgttttagatttttttat

SEQ ID NO: 35694 - DNA, 555 bp, Artificial Sequence
  chemically treated genomic DNA (Homo sapiens) CpG-island No: 35694
ataaaaaaatctaaaacaatatcttataatttcccactcaaaacgtcaaaaaaaccgtattaaaacccgtaacacccacttccttccttttccgaaaaaacgccccctcctccaccgaaaccgaccgcgacacgccgccttcccactaaaatttacgacctcgacgacctcgaccgcatcccgcaaccaaccaaaccccaccatacgcacgcgcacgcgacgaaaccgacgccccgaactaaactaaaaaatacccgcgccaaccgaaaatcccgcgctccctacaaaaaacgaaacacgaaaaaaacgaaacgatcgcgaaactccgccttacccttaacgacgctaaaccatacgaaaacccacgtaaataaactacccgctaacccacgaaccgaaacgcgcaaacgcacgacgaaactaaataaaaaacgaaaataacaaaaaaataaaaacgaaaaaaaaaatacctaaaaacaaacgcatacgcttaacgcgatacctcgcaactatctacgaataaaaccgccgctttcccttactaaacgaaaacta

SEQ ID NO: 35695 - DNA, 555 bp, Artificial Sequence
  chemically treated genomic DNA (Homo sapiens) CpG-island No: 35695
atgggaaaatttggagtagtattttgtgattttttatttaagacgttaaaggggtcgtattgaggttcgtgatatttattttttttttttttcggggaaacgtttttttttttatcgaagtcggtcgcggtacgtcgtttttttattggagtttgcggtttcggcggtttcgatcgtatttcgtagttagttaaattttattatgcgtacgcgtacgcggcgaagtcggcgtttcgggttgggttgggaagtgttcgcgttagtcgagggtttcgcgttttttataggaggcggggtacggagggggcggggcgatcgcgaggtttcgttttgtttttggcggcgttgggttatgcggaggtttacgtgagtagattgttcgttggtttacgggtcggggcgcgtaggcgtacggcggggttgggtggagggcggaggtggtaaaagggtgaaggcggaggagggagtgtttgggaataggcgtatacgtttggcgcggtgtttcgtagttgtttgcgggtggggtcgtcgtttttttttgttagacgaaagttg

SEQ ID NO: 35696 - DNA, 555 bp, Artificial Sequence
  chemically treated genomic DNA (Homo sapiens) CpG-island No: 35696
caactttcgtctaacaaaaaaaaacgacgaccccacccgcaaacaactacgaaacaccgcgccaaacgtatacgcctattcccaaacactccctcctccgccttcacccttttaccacctccgccctccacccaaccccgccgtacgcctacgcgccccgacccgtaaaccaacgaacaatctactcacgtaaacctccgcataacccaacgccgccaaaaacaaaacgaaacctcgcgatcgccccgccccctccgtaccccgcctcctataaaaaacgcgaaaccctcgactaacgcgaacacttcccaacccaacccgaaacgccgacttcgccgcgtacgcgtacgcataataaaatttaactaactacgaaatacgatcgaaaccgccgaaaccgcaaactccaataaaaaaacgacgtaccgcgaccgacttcgataaaaaaaaaaacgtttccccgaaaaaaaaaaaaaataaatatcacgaacctcaatacgacccctttaacgtcttaaataaaaaatcacaaaatactactccaaattttcccat

SEQ ID NO: 35697 - DNA, 523 bp, Artificial Sequence
  chemically treated genomic DNA (Homo sapiens) CpG-island No: 35697
  misc_feature (37)..(38): n is either a, c, g or t
  misc_feature (41)..(41): n is either a, c, g or t
  misc_feature (69)..(72): n is either a, c, g or t
  misc_feature (159)..(160): n is either a, c, g or t
  misc_feature (165)..(170): n is either a, c, g or t
  misc_feature (178)..(178): n is either a, c, g or t
  misc_feature (184)..(184): n is either a, c, g or t
  misc_feature (186)..(186): n is either a, c, g or t
  misc_feature (202)..(203): n is either a, c, g or t
  misc_feature (213)..(216): n is either a, c, g or t
  misc_feature (266)..(269): n is either a, c, g or t
  misc_feature (307)..(307): n is either a, c, g or t
  misc_feature (512)..(515): n is either a, c, g or t
ttgtgggaggttttgaaacgcgcgggagttttttttnnttnttagtgtttttttagcgagagtgaaatnnnntttgaaattcggattaattggtagtcgttgttggtagaacgttttaaggattttttttcgcgggacggagggaggattcgggatagnnaattnnnnnngggagaanacgcgngnggggcgttcgagacgnntcgtgaaagnnnngtcgatttttgggaggattgataggtttagagatacgcgttgtttgttgnnnngggtttttcgggaataagtgaggggttttgtgtttcgnggatggttttagcgtagagtcgggtgtttgtcggggtgggtttttcgtattgttcgggtttcggcgggggcggttttgatttttttttatggttcgttttttatttcgggaatttttagtgttttttttttacggtttttttggcgttttttcgattttttcgcggtattttggtttatttttttttagcgtcgtggtttttttnnnngatttttt

SEQ ID NO: 35698 - DNA, 523 bp, Artificial Sequence
  chemically treated genomic DNA (Homo sapiens) CpG-island No: 35698
  misc_feature (9)..(12): n is either a, c, g or t
  misc_feature (217)..(217): n is either a, c, g or t
  misc_feature (255)..(258): n is either a, c, g or t
  misc_feature (308)..(311): n is either a, c, g or t
  misc_feature (321)..(322): n is either a, c, g or t
  misc_feature (338)..(338): n is either a, c, g or t
  misc_feature (340)..(340): n is either a, c, g or t
  misc_feature (346)..(346): n is either a, c, g or t
  misc_feature (354)..(359): n is either a, c, g or t
  misc_feature (364)..(365): n is either a, c, g or t
  misc_feature (452)..(455): n is either a, c, g or t
  misc_feature (483)..(483): n is either a, c, g or t
  misc_feature (486)..(487): n is either a, c, g or t
aaaaaatcnnnnaaaaaaaccacgacgctaaaaaaaaataaaccaaaataccgcgaaaaaatcgaaaaaacgccaaaaaaaccgtaaaaaaaaaacactaaaaattcccgaaataaaaaacgaaccataaaaaaaaatcaaaaccgcccccgccgaaacccgaacaatacgaaaaacccaccccgacaaacacccgactctacgctaaaaccatccncgaaacacaaaacccctcacttattcccgaaaaacccnnnncaacaaacaacgcgtatctctaaacctatcaatcctcccaaaaatcgacnnnnctttcacganncgtctcgaacgccccncncgcgtnttctcccnnnnnnaattnnctatcccgaatcctccctccgtcccgcgaaaaaaaatccttaaaacgttctaccaacaacgactaccaattaatccgaatttcaaannnnatttcactctcgctaaaaaaacactaanaannaaaaaaaactcccgcgcgtttcaaaacctcccacaa

SEQ ID NO: 35699 - DNA, 523 bp, Artificial Sequence
  chemically treated genomic DNA (Homo sapiens) CpG-island No: 35699
  misc_feature (9)..(12): n is either a, c, g or t
  misc_feature (217)..(217): n is either a, c, g or t
  misc_feature (255)..(258): n is either a, c, g or t
  misc_feature (308)..(311): n is either a, c, g or t
  misc_feature (321)..(322): n is either a, c, g or t
  misc_feature (338)..(338): n is either a, c, g or t
  misc_feature (340)..(340): n is either a, c, g or t
  misc_feature (346)..(346): n is either a, c, g or t
  misc_feature (354)..(359): n is either a, c, g or t
  misc_feature (364)..(365): n is either a, c, g or t
  misc_feature (452)..(455): n is either a, c, g or t
  misc_feature (483)..(483): n is either a, c, g or t
  misc_feature (486)..(487): n is either a, c, g or t
agggggttnnnngggaggattacggcgttgggggaaggtaggttaaagtgtcgcgggagagtcggggggacgttagaaaagtcgtggaaaaggagtattggggattttcggggtgggaggcgggttatggaaaggaattagagtcgttttcgtcggagttcgaataatgcggggagtttatttcggtagatattcggttttgcgttagaattatttncgaaatatagagttttttatttattttcgggaggtttnnnntaatagatagcgcgtgtttttagatttgttagtttttttaagggtcggtnnnntttttacggnncgtttcggacgttttntncgcgtntttttttnnnnnnaattnnttgtttcgagtttttttttcgtttcgcggggaggggtttttagggcgttttattaataacgattgttagttgattcgagttttaagnnnnattttattttcgttgggaaagtattggnggnngagggaagttttcgcgcgttttagggttttttatag

SEQ ID NO: 35700 - DNA, 523 bp, Artificial Sequence
  chemically treated genomic DNA (Homo sapiens) CpG-island No: 35700
  misc_feature (37)..(38): n is either a, c, g or t
  misc_feature (41)..(41): n is either a, c, g or t
  misc_feature (69)..(72): n is either a, c, g or t
  misc_feature (159)..(160): n is either a, c, g or t
  misc_feature (165)..(170): n is either a, c, g or t
  misc_feature (178)..(178): n is either a, c, g or t
  misc_feature (184)..(184): n is either a, c, g or t
  misc_feature (186)..(186): n is either a, c, g or t
  misc_feature (202)..(203): n is either a, c, g or t
  misc_feature (213)..(216): n is either a, c, g or t
  misc_feature (266)..(269): n is either a, c, g or t
  misc_feature (307)..(307): n is either a, c, g or t
  misc_feature (512)..(515): n is either a, c, g or t
ctataaaaaaccctaaaacgcgcgaaaacttccctcnnccnccaatactttcccaacgaaaataaaatnnnncttaaaactcgaatcaactaacaatcgttattaataaaacgccctaaaaacccctccccgcgaaacgaaaaaaaaactcgaaacaannaattnnnnnnaaaaaaanacgcgnanaaaacgtccgaaacgnnccgtaaaaannnnaccgacccttaaaaaaactaacaaatctaaaaacacgcgctatctattannnnaaacctcccgaaaataaataaaaaactctatatttcgnaaataattctaacgcaaaaccgaatatctaccgaaataaactccccgcattattcgaactccgacgaaaacgactctaattcctttccataacccgcctcccaccccgaaaatccccaatactccttttccacgacttttctaacgtccccccgactctcccgcgacactttaacctaccttcccccaacgccgtaatcctcccnnnnaaccccct

SEQ ID NO: 35701 - DNA, 502 bp, Artificial Sequence
  chemically treated genomic DNA (Homo sapiens) CpG-island No: 35701
gtaggcgtcgcggtcgttagttttgtgaacgtagcggcggttttatttttaggttatttttaatttttcgttcggtcgggggtttttttacggtcgttattattgggtcgcggtttttagcgttattattttggatttcgcgtttgggttaggtagaattttcggtgcgtttttcgggattgcggtttttagttcgcgtttcgtttagtcgtttttcgtcggttttagttaattcgcgcgcgtttttttggtcgttttttatcggattaggtgttttttttgcgtagatttttttacgacgttagtcggcgtggcgtagttcgtttagttcggcggagtttgattttcggaggtatatcggcgcgttggttggttattaaggttatcgtcgagaggtcgcgtttttagttggttttagatatgcgtggcgtcggggttgtggtacggtcgggttcggggtgagtgatttttttaagtaattacgtttttgttttgttttttt

SEQ ID NO: 35702 - DNA, 502 bp, Artificial Sequence
  chemically treated genomic DNA (Homo sapiens) CpG-island No: 35702
aaaaaaacaaaacaaaaacgtaattacttaaaaaaatcactcaccccgaacccgaccgtaccacaaccccgacgccacgcatatctaaaaccaactaaaaacgcgacctctcgacgataaccttaataaccaaccaacgcgccgatatacctccgaaaatcaaactccgccgaactaaacgaactacgccacgccgactaacgtcgtaaaaaaatctacgcaaaaaaaacacctaatccgataaaaaacgaccaaaaaaacgcgcgcgaattaactaaaaccgacgaaaaacgactaaacgaaacgcgaactaaaaaccgcaatcccgaaaaacgcaccgaaaattctacctaacccaaacgcgaaatccaaaataataacgctaaaaaccgcgacccaataataacgaccgtaaaaaaacccccgaccgaacgaaaaattaaaaataacctaaaaataaaaccgccgctacgttcacaaaactaacgaccgcgacgcctac

SEQ ID NO: 35703 - DNA, 502 bp, Artificial Sequence
  chemically treated genomic DNA (Homo sapiens) CpG-island No: 35703
aaaagggtagaataaaaacgtagttatttgaaggggttatttatttcggattcgatcgtgttatagtttcgacgttacgtatgtttaggattagttgaggacgcggtttttcggcggtaattttggtaattagttagcgcgtcggtgtgttttcggaagttagatttcgtcgggttgagcgagttacgttacgtcgattggcgtcgtggaggagtttgcgtagaggagatatttgattcggtgggagacggttaggggagcgcgcgcggattggttggagtcgacgggggacggttgggcggggcgcggattggggatcgtagtttcggggagcgtatcggaagttttgtttggtttaggcgcggggtttaagatggtggcgttaggagtcgcgatttagtgatagcggtcgtggaggggttttcgatcgagcgggaggttgggggtagtttggaggtgagatcgtcgttgcgtttatagagttggcggtcgcggcgtttgt

SEQ ID NO: 35704 - DNA, 502 bp, Artificial Sequence
  chemically treated genomic DNA (Homo sapiens) CpG-island No: 35704
acaaacgccgcgaccgccaactctataaacgcaacgacgatctcacctccaaactacccccaacctcccgctcgatcgaaaacccctccacgaccgctatcactaaatcgcgactcctaacgccaccatcttaaaccccgcgcctaaaccaaacaaaacttccgatacgctccccgaaactacgatccccaatccgcgccccgcccaaccgtcccccgtcgactccaaccaatccgcgcgcgctcccctaaccgtctcccaccgaatcaaatatctcctctacgcaaactcctccacgacgccaatcgacgtaacgtaactcgctcaacccgacgaaatctaacttccgaaaacacaccgacgcgctaactaattaccaaaattaccgccgaaaaaccgcgtcctcaactaatcctaaacatacgtaacgtcgaaactataacacgatcgaatccgaaataaataaccccttcaaataactacgtttttattctaccctttt

SEQ ID NO: 35705 - DNA, 670 bp, Artificial Sequence
  chemically treated genomic DNA (Homo sapiens) CpG-island No: 35705
gtttttcggtcgttggggagaatttcgcgggggtcggggtcgtttttcgggttttttcggggcgttcgttattttttagtttttattaattagtttgtttcggtcgtcgtcgtcggatttttcgaacgtttaatgggtacgcgttacggttttcgtttcgttcgtcgggggaggcgcgtcggggttgggatagcgcgcgggcggtcgcgggcgcgggggcggggggcgtcgcgcggtcggaattgcgggcggggggtttttcgggggcggggggcgttgagcggttgcggcgcggttgtaggagcgcgaggaggaggtggcggcggcggcggaattggcgggggttttttcgcggcgttcgggattttcggtttttaggtatgggcgtttttgcggtgtagagtagtttagggtcggttggtgcgcgatttcggaaagcgggggtggagaggcgagcggagttcgcggggttaggtgaggggttgtcggggtggcgggaggtgggtttcggagaggtcgggtaatttcgggttttcggtggatgtttttgggcgggttcggggttacgtcggagtttcgtttggaaattggggagtcgggggggggattggatttttagcggaatcgttggtttcgagttagtttttaagggcgacggttaaggtttttt

SEQ ID NO: 35706 - DNA, 670 bp, Artificial Sequence
  chemically treated genomic DNA (Homo sapiens) CpG-island No: 35706
aaaaaaccttaaccgtcgcccttaaaaactaactcgaaaccaacgattccgctaaaaatccaatcccccccccgactccccaatttccaaacgaaactccgacgtaaccccgaacccgcccaaaaacatccaccgaaaacccgaaattacccgacctctccgaaacccacctcccgccaccccgacaacccctcacctaaccccgcgaactccgctcgcctctccacccccgctttccgaaatcgcgcaccaaccgaccctaaactactctacaccgcaaaaacgcccatacctaaaaaccgaaaatcccgaacgccgcgaaaaaacccccgccaattccgccgccgccgccacctcctcctcgcgctcctacaaccgcgccgcaaccgctcaacgccccccgcccccgaaaaaccccccgcccgcaattccgaccgcgcgacgccccccgcccccgcgcccgcgaccgcccgcgcgctatcccaaccccgacgcgcctcccccgacgaacgaaacgaaaaccgtaacgcgtacccattaaacgttcgaaaaatccgacgacgacgaccgaaacaaactaattaataaaaactaaaaaataacgaacgccccgaaaaaacccgaaaaacgaccccgacccccgcgaaattctccccaacgaccgaaaaac

SEQ ID NO: 35707 - DNA, 670 bp, Artificial Sequence
  chemically treated genomic DNA (Homo sapiens) CpG-island No: 35707
agaaagttttggtcgtcgtttttgggggttgattcggagttagcggtttcgttgggaatttagtttttttttcgattttttagtttttaagcgggatttcggcgtggtttcgagttcgtttaaaggtatttatcgaagattcgagattgttcggttttttcggggtttatttttcgttatttcggtagttttttatttggtttcgcgggtttcgttcgtttttttattttcgtttttcggggtcgcgtattagtcggttttgagttgttttgtatcgtaggggcgtttatgtttggaggtcgggggtttcgggcgtcgcgaggggattttcgttagtttcgtcgtcgtcgttatttttttttcgcgtttttgtagtcgcgtcgtagtcgtttagcgtttttcgttttcgggaagtttttcgttcgtagtttcggtcgcgcggcgtttttcgttttcgcgttcgcggtcgttcgcgcgttgttttagtttcggcgcgtttttttcggcgggcggggcggggatcgtgacgcgtgtttattgaacgttcgggaaattcggcggcggcggtcgaagtaaattaattaatgggggttaaaaaatagcgggcgtttcggaaaaattcgggaggcggtttcggttttcgcggggttttttttaacggtcggaaaat

SEQ ID NO: 35708 - DNA, 670 bp, Artificial Sequence
  chemically treated genomic DNA (Homo sapiens) CpG-island No: 35708
attttccgaccgttaaaaaaaaccccgcgaaaaccgaaaccgcctcccgaatttttccgaaacgcccgctattttttaacccccattaattaatttacttcgaccgccgccgccgaatttcccgaacgttcaataaacacgcgtcacgatccccgccccgcccgccgaaaaaaacgcgccgaaactaaaacaacgcgcgaacgaccgcgaacgcgaaaacgaaaaacgccgcgcgaccgaaactacgaacgaaaaacttcccgaaaacgaaaaacgctaaacgactacgacgcgactacaaaaacgcgaaaaaaaaataacgacgacgacgaaactaacgaaaatcccctcgcgacgcccgaaacccccgacctccaaacataaacgcccctacgatacaaaacaactcaaaaccgactaatacgcgaccccgaaaaacgaaaataaaaaaacgaacgaaacccgcgaaaccaaataaaaaactaccgaaataacgaaaaataaaccccgaaaaaaccgaacaatctcgaatcttcgataaatacctttaaacgaactcgaaaccacgccgaaatcccgcttaaaaactaaaaaatcgaaaaaaaaactaaattcccaacgaaaccgctaactccgaatcaacccccaaaaacgacgaccaaaactttct

SEQ ID NO: 35709 - DNA, 569 bp, Artificial Sequence
  chemically treated genomic DNA (Homo sapiens) CpG-island No: 35709
gcggcgggcgcgaggagtttatttatagattaaataattcgcgttttttgcgttaatggaatttcgcgtgcgttacgcgcgtagatattttaggtttttttttttcgtttcgttttttcgggtttttcgggtcgtatttttttttggtcgtttttcgtcggaatcgtatcgtttttcgcgtttttgtatggttaaagttcgacgggcggtttgcgttagtggcgttttcgttttttttcgtgcgttacggagcgtttaagaggagggtcgggttcggtcggggagttttagtggcggaggttacgaaatttgggggagtgtatagaagaatttcgggagcgtacgcgggattagggattaggttgagattcggggcgttagttcgggtaggggtagcgggagtcggtcgggtaggtttttttcggggaacgtgtatttgtttttaggagcggtgtatgaaggagatgggtgtacgcgcgggtagagaggatgttgtagggtcggtatgtaagagggtaggtgtagtgtgtagttgtagtataacgggatgagaatttaggttagattgg

SEQ ID NO: 35710 - DNA, 569 bp, Artificial Sequence
  chemically treated genomic DNA (Homo sapiens) CpG-island No: 35710
ccaatctaacctaaattctcatcccgttatactacaactacacactacacctaccctcttacataccgaccctacaacatcctctctacccgcgcgtacacccatctccttcatacaccgctcctaaaaacaaatacacgttccccgaaaaaaacctacccgaccgactcccgctacccctacccgaactaacgccccgaatctcaacctaatccctaatcccgcgtacgctcccgaaattcttctatacactcccccaaatttcgtaacctccgccactaaaactccccgaccgaacccgaccctcctcttaaacgctccgtaacgcacgaaaaaaaacgaaaacgccactaacgcaaaccgcccgtcgaactttaaccatacaaaaacgcgaaaaacgatacgattccgacgaaaaacgaccaaaaaaaaatacgacccgaaaaacccgaaaaaacgaaacgaaaaaaaaaaacctaaaatatctacgcgcgtaacgcacgcgaaattccattaacgcaaaaaacgcgaattatttaatctataaataaactcctcgcgcccgccgc

SEQ ID NO: 35711 - DNA, 569 bp, Artificial Sequence
  chemically treated genomic DNA (Homo sapiens) CpG-island No: 35711
ttagtttgatttgggtttttatttcgttgtgttatagttgtatattatatttatttttttgtatgtcggttttataatattttttttgttcgcgcgtatatttattttttttatgtatcgtttttaaaaatagatgtacgtttttcgaagggaatttattcggtcggttttcgttgtttttgttcggattggcgtttcgagttttagtttggtttttggtttcgcgtgcgttttcgaagtttttttgtgtatttttttaagtttcgtagttttcgttattgggatttttcggtcgagttcgattttttttttaagcgtttcgtgacgtacggggaggggcgggggcgttattgacgtaggtcgttcgtcgagttttggttatataagggcgcggggggcggtgcggtttcggcgggaggcggttagggggaggtgcggttcggggagttcgagggggcggggcgaggagggggggtttggaatgtttgcgcgcgtgacgtacgcggggttttattgacgtagggagcgcggattgtttgatttataaataggtttttcgcgttcgtcgt

SEQ ID NO: 35712 - DNA, 569 bp, Artificial Sequence
  chemically treated genomic DNA (Homo sapiens) CpG-island No: 35712
acgacgaacgcgaaaaacctatttataaatcaaacaatccgcgctccctacgtcaataaaaccccgcgtacgtcacgcgcgcaaacattccaaaccccccctcctcgccccgccccctcgaactccccgaaccgcacctccccctaaccgcctcccgccgaaaccgcaccgccccccgcgcccttatataaccaaaactcgacgaacgacctacgtcaataacgcccccgcccctccccgtacgtcacgaaacgcttaaaaaaaaaatcgaactcgaccgaaaaatcccaataacgaaaactacgaaacttaaaaaaatacacaaaaaaacttcgaaaacgcacgcgaaaccaaaaaccaaactaaaactcgaaacgccaatccgaacaaaaacaacgaaaaccgaccgaataaattcccttcgaaaaacgtacatctatttttaaaaacgatacataaaaaaaataaatatacgcgcgaacaaaaaaaatattataaaaccgacatacaaaaaaataaatataatatacaactataacacaacgaaataaaaacccaaatcaaactaa

SEQ ID NO: 35713 - DNA, 1634 bp, Artificial Sequence
  chemically treated genomic DNA (Homo sapiens) CpG-island No: 35713
ttttcgttattacgggtcggagcggagggggaggacggcgttacgaggcggggagttcgaggtttagggcggggcgttcgggaattttagttcgagtaagtcggggaggtgcgggcgcgggcgggaagcggagggcggcgcggagggaggtgagcggcgcgcgcggagtcggcgggcgaggaggaggattgtatagaggtttcgtttatcgtcgtcgcgagtcggtttttcgtcgttttcgaattcgtttattttgtttttcgtttttggacggcggcgggttcgtcggattcgcggtcgtagggagcgtcggagacggggagttatttcgttcggcgttttattcggcgttcgtagtttttagggggtcggtttcgcggtttgggagagggtatcgcggtttcggtgtgcgtagttttcgggcgcgagggtcggcgagcggatatagtcgcgtttttagtcggtggggtttagtcgtggcgtcggcgaggatttttcggttattcgtaggtaacgtcgggcggagggacgcgttattagtagcgtcggagatattcgagtttagggattttcgggttagcggagggtaggagcggagtttcgagggagcgcgggtttcgacggcgcgttttttcgttagttacgggtaggtaggttcgcgtggcggtttggggtggggggttgtagcggggttttcgggtcgaaagtttttcgggcggttagttatgattttcgggcgtagcggggcggtttcggtggtgttgaacgtgggcggcgttcggtattcgttgtttcgggagttgttgaaggatttttcgttgcgtcgcgtgagtcggttgtacggttgtcgtttcgagcgcgacgtgttcgaggtgtgcgacgattacgatcgcgagcgtaacgagtattttttcgatcggtattcggaggttttcggttttattttgttttacgtgcgcggttacggtaagttgcgtttcgcgcgcggatgtgcgagttttttttttataacgagatgatttattggggtttggagggcgcgtatttcgagtattgttgttagcgtcgtttcgacgatcgtatgttcgatatttatattttttattcggtcgacgagtcgggcgtgttgggtcgcgacgaggcgcgtttcggcgcgcgaggcggttttttttaggcgttggttggagcgtatgcggcggattttcgaggagtttacgtcgtcgttggtcgcgtagattttggttagcgtgtcggtggtgttcgtgatcgtgtttatggtggtgttgtgcgttagtacgttgttcgattggcgtaacgtagtcgtcgataatcgtagtttggatgatcggagtaggtatttcgtcggttttgggagggagtttttcgggtaggacgtattgtttttttattcgtttcgttcgttttgtcgcgtttgttcgtttcgtttatacgtttcgttttcgttttgttcgttttcgggcgatcgagttagcggggtgcgcgtttagcgaggtttaggcgcggttaattacgggatcggtcggtttttatttttatttcgttgttcggggtattagcggggtttggtttttatattagacgtattttttgagggcgaaatttttaggtatggg

SEQ ID NO: 35714 - DNA, 1634 bp, Artificial Sequence
  chemically treated genomic DNA (Homo sapiens) CpG-island No: 35714
cccatacctaaaaatttcgccctcaaaaaatacgtctaatataaaaaccaaaccccgctaataccccgaacaacgaaataaaaataaaaaccgaccgatcccgtaattaaccgcgcctaaacctcgctaaacgcgcaccccgctaactcgatcgcccgaaaacgaacaaaacgaaaacgaaacgtataaacgaaacgaacaaacgcgacaaaacgaacgaaacgaataaaaaaacaatacgtcctacccgaaaaactccctcccaaaaccgacgaaatacctactccgatcatccaaactacgattatcgacgactacgttacgccaatcgaacaacgtactaacgcacaacaccaccataaacacgatcacgaacaccaccgacacgctaaccaaaatctacgcgaccaacgacgacgtaaactcctcgaaaatccgccgcatacgctccaaccaacgcctaaaaaaaaccgcctcgcgcgccgaaacgcgcctcgtcgcgacccaacacgcccgactcgtcgaccgaataaaaaatataaatatcgaacatacgatcgtcgaaacgacgctaacaacaatactcgaaatacgcgccctccaaaccccaataaatcatctcgttataaaaaaaaaactcgcacatccgcgcgcgaaacgcaacttaccgtaaccgcgcacgtaaaacaaaataaaaccgaaaacctccgaataccgatcgaaaaaatactcgttacgctcgcgatcgtaatcgtcgcacacctcgaacacgtcgcgctcgaaacgacaaccgtacaaccgactcacgcgacgcaacgaaaaatccttcaacaactcccgaaacaacgaataccgaacgccgcccacgttcaacaccaccgaaaccgccccgctacgcccgaaaatcataactaaccgcccgaaaaactttcgacccgaaaaccccgctacaaccccccaccccaaaccgccacgcgaacctacctacccgtaactaacgaaaaaacgcgccgtcgaaacccgcgctccctcgaaactccgctcctaccctccgctaacccgaaaatccctaaactcgaatatctccgacgctactaataacgcgtccctccgcccgacgttacctacgaataaccgaaaaatcctcgccgacgccacgactaaaccccaccgactaaaaacgcgactatatccgctcgccgaccctcgcgcccgaaaactacgcacaccgaaaccgcgataccctctcccaaaccgcgaaaccgaccccctaaaaactacgaacgccgaataaaacgccgaacgaaataactccccgtctccgacgctccctacgaccgcgaatccgacgaacccgccgccgtccaaaaacgaaaaacaaaataaacgaattcgaaaacgacgaaaaaccgactcgcgacgacgataaacgaaacctctatacaatcctcctcctcgcccgccgactccgcgcgcgccgctcacctccctccgcgccgccctccgcttcccgcccgcgcccgcacctccccgacttactcgaactaaaattcccgaacgccccgccctaaacctcgaactccccgcctcgtaacgccgtcctccccctccgctccgacccgtaataacgaaaa

SEQ ID NO: 35715 - DNA, 1634 bp, Artificial Sequence
  chemically treated genomic DNA (Homo sapiens) CpG-island No: 35715
tttatgtttgaggatttcgtttttaagaggtgcgtttagtgtaagggttagatttcgttggtgtttcggataacggggtaggagtggggatcgatcggtttcgtagttggtcgcgtttgggtttcgttgggcgcgtatttcgttggttcggtcgttcggaggcggataggacggagacgggacgtatggacgggacggatagacgcgataggacggacgggacgggtagagaagtagtgcgttttattcggagggtttttttttagggtcggcggagtatttgtttcggttatttaggttgcggttgtcggcggttgcgttgcgttagtcgggtaacgtgttggcgtatagtattattatggatacgattacgaatattatcgatacgttagttaggatttgcgcggttagcgacgacgtgggtttttcgaaggttcgtcgtatgcgttttagttagcgtttggagggagtcgtttcgcgcgtcggggcgcgtttcgtcgcggtttagtacgttcggttcgtcggtcgagtagaaggtgtaggtgtcggatatgcggtcgtcgaggcggcgttggtagtagtattcgaggtgcgcgttttttaggttttagtagattatttcgttgtagaaggagagttcgtatattcgcgcgcgaagcgtagtttgtcgtggtcgcgtacgtagagtaggatgaagtcgaaggttttcgagtgtcggtcgaagaagtattcgttgcgttcgcggtcgtagtcgtcgtatatttcgagtacgtcgcgttcggagcggtagtcgtgtagtcggtttacgcggcgtagcgggaagttttttagtagttttcgggatagcgaatatcgggcgtcgtttacgtttagtattatcgaggtcgtttcgttgcgttcgaaggttatggttggtcgttcgggggattttcggttcgagggtttcgttgtagttttttattttaagtcgttacgcgggtttgtttgttcgtggttgacgggggagcgcgtcgtcggggttcgcgttttttcggggtttcgtttttgtttttcgttggttcgggggtttttgggttcgagtattttcggcgttgttagtagcgcgttttttcgttcggcgttatttgcgggtggtcggggagttttcgtcggcgttacggttgagttttatcggttgggaacgcggttgtgttcgttcgtcgattttcgcgttcgagggttgcgtatatcgaggtcgcggtgtttttttttaagtcgcggggtcgattttttgagggttgcgggcgtcgaatggagcgtcgggcggaatagtttttcgttttcggcgttttttgcggtcgcgaattcggcgagttcgtcgtcgtttagaggcgagaggtaaagtgagcgggttcggaggcggcgaagagtcggttcgcggcggcggtgggcggggtttttgtgtagttttttttttcgttcgtcggtttcgcgcgcgtcgtttattttttttcgcgtcgtttttcgtttttcgttcgcgttcgtattttttcggtttgttcgggttgggattttcgggcgtttcgttttggatttcgggtttttcgtttcgtgacgtcgtttttttttttcgtttcggttcgtagtggcgggga

SEQ ID NO: 35716 - DNA, 1634 bp, Artificial Sequence
  chemically treated genomic DNA (Homo sapiens) CpG-island No: 35716
tccccgccactacgaaccgaaacgaaaaaaaaaaacgacgtcacgaaacgaaaaacccgaaatccaaaacgaaacgcccgaaaatcccaacccgaacaaaccgaaaaaatacgaacgcgaacgaaaaacgaaaaacgacgcgaaaaaaaataaacgacgcgcgcgaaaccgacgaacgaaaaaaaaaactacacaaaaaccccgcccaccgccgccgcgaaccgactcttcgccgcctccgaacccgctcactttacctctcgcctctaaacgacgacgaactcgccgaattcgcgaccgcaaaaaacgccgaaaacgaaaaactattccgcccgacgctccattcgacgcccgcaaccctcaaaaaatcgaccccgcgacttaaaaaaaaacaccgcgacctcgatatacgcaaccctcgaacgcgaaaatcgacgaacgaacacaaccgcgttcccaaccgataaaactcaaccgtaacgccgacgaaaactccccgaccacccgcaaataacgccgaacgaaaaaacgcgctactaacaacgccgaaaatactcgaacccaaaaacccccgaaccaacgaaaaacaaaaacgaaaccccgaaaaaacgcgaaccccgacgacgcgctcccccgtcaaccacgaacaaacaaacccgcgtaacgacttaaaataaaaaactacaacgaaaccctcgaaccgaaaatcccccgaacgaccaaccataaccttcgaacgcaacgaaacgacctcgataatactaaacgtaaacgacgcccgatattcgctatcccgaaaactactaaaaaacttcccgctacgccgcgtaaaccgactacacgactaccgctccgaacgcgacgtactcgaaatatacgacgactacgaccgcgaacgcaacgaatacttcttcgaccgacactcgaaaaccttcgacttcatcctactctacgtacgcgaccacgacaaactacgcttcgcgcgcgaatatacgaactctccttctacaacgaaataatctactaaaacctaaaaaacgcgcacctcgaatactactaccaacgccgcctcgacgaccgcatatccgacacctacaccttctactcgaccgacgaaccgaacgtactaaaccgcgacgaaacgcgccccgacgcgcgaaacgactccctccaaacgctaactaaaacgcatacgacgaaccttcgaaaaacccacgtcgtcgctaaccgcgcaaatcctaactaacgtatcgataatattcgtaatcgtatccataataatactatacgccaacacgttacccgactaacgcaacgcaaccgccgacaaccgcaacctaaataaccgaaacaaatactccgccgaccctaaaaaaaaaccctccgaataaaacgcactacttctctacccgtcccgtccgtcctatcgcgtctatccgtcccgtccatacgtcccgtctccgtcctatccgcctccgaacgaccgaaccaacgaaatacgcgcccaacgaaacccaaacgcgaccaactacgaaaccgatcgatccccactcctaccccgttatccgaaacaccaacgaaatctaacccttacactaaacgcacctcttaaaaacgaaatcctcaaacataaa

SEQ ID NO: 35717 - DNA, 500 bp, Artificial Sequence
  chemically treated genomic DNA (Homo sapiens) CpG-island No: 35717
atatgcgtatatcgtaaatcgacgggcgtacgtagatataaaggagataaaagatagtatagggagggagaggaaagtaaaaacgaggtcgatagcgaaagatcgataagaaattcgaataggacgggtcgggagaagtcggaataagaaattcgtagaaacgtagatttcgacgaaataaggagcggagatagagcgcggaggtagtagcgatagacgcgacgtaagagagagagcggatagtaaggtatcgaaggggagtttacggaatagtattaaacgaggataacggggacgagttagtagagcgttatttattagtagtcgttatagtagattataatcgttagtagtatattagtaatagatagcgtacgagcggaggttaaggttacgtttcgcgagattaacgcgatttcgtagttacgagttttaatttattttattttatttgtttatataggatttttatttttagtttgttgtagagtgttggtata

SEQ ID NO: 35718 - DNA, 500 bp, Artificial Sequence
  chemically treated genomic DNA (Homo sapiens) CpG-island No: 35718
tataccaacactctacaacaaactaaaaataaaaatcctatataaacaaataaaataaaataaattaaaactcgtaactacgaaatcgcgttaatctcgcgaaacgtaaccttaacctccgctcgtacgctatctattactaatatactactaacgattataatctactataacgactactaataaataacgctctactaactcgtccccgttatcctcgtttaatactattccgtaaactccccttcgataccttactatccgctctctctcttacgtcgcgtctatcgctactacctccgcgctctatctccgctccttatttcgtcgaaatctacgtttctacgaatttcttattccgacttctcccgacccgtcctattcgaatttcttatcgatctttcgctatcgacctcgtttttactttcctctccctccctatactatcttttatctcctttatatctacgtacgcccgtcgatttacgatatacgcatat

SEQ ID NO: 35719 - DNA, 500 bp, Artificial Sequence
  chemically treated genomic DNA (Homo sapiens) CpG-island No: 35719
tatattagtattttatagtaggttggagatggaagttttgtgtggatagatgggatggggtgggttgaagttcgtagttacggagtcgcgttggtttcgcgggacgtggttttagttttcgttcgtgcgttgtttgttgttggtgtgttgttggcgattgtggtttgttgtggcgattgttggtgaatggcgttttgttggttcgttttcgttgttttcgtttggtattgtttcgtggattttttttcggtattttattgttcgtttttttttttgcgtcgcgtttgtcgttgttgttttcgcgttttgttttcgttttttgtttcgtcggggtttgcgtttttgcgggttttttgtttcggtttttttcggttcgttttgttcgagttttttgtcggtttttcgttgtcggtttcgtttttgtttttttttttttttttgtgttgttttttgttttttttgtgtttgcgtgcgttcgtcggtttgcggtgtgcgtatgt

SEQ ID NO: 35720 - DNA, 500 bp, Artificial Sequence
  chemically treated genomic DNA (Homo sapiens) CpG-island No: 35720
acatacgcacaccgcaaaccgacgaacgcacgcaaacacaaaaaaaacaaaaaacaacacaaaaaaaaaaaaaaaaacaaaaacgaaaccgacaacgaaaaaccgacaaaaaactcgaacaaaacgaaccgaaaaaaaccgaaacaaaaaacccgcaaaaacgcaaaccccgacgaaacaaaaaacgaaaacaaaacgcgaaaacaacaacgacaaacgcgacgcaaaaaaaaaaacgaacaataaaataccgaaaaaaaatccacgaaacaataccaaacgaaaacaacgaaaacgaaccaacaaaacgccattcaccaacaatcgccacaacaaaccacaatcgccaacaacacaccaacaacaaacaacgcacgaacgaaaactaaaaccacgtcccgcgaaaccaacgcgactccgtaactacgaacttcaacccaccccatcccatctatccacacaaaacttccatctccaacctactataaaatactaatata

SEQ ID NO: 35721 - DNA, 742 bp, Artificial Sequence
  chemically treated genomic DNA (Homo sapiens) CpG-island No: 35721
ttgtttttcgaagtgagttgcgaaatcgttttttagcgcgtacggggtttttatttttttcgtgtatgcgaacggtttttcgagatgttttttttatgggtttggttatcgttatttttgttataaattaacgtttgggattcggattgttgttaataggaaattttcgcgattcgttgtttagttcgtcgtttttataagattggattttgtataggttatttatgttcgttggtgtatttcgttttttcgtacgtttaattcgcggggacgttttcgattttttattttagttttcgttatagttagtttcgttttttcgcgtagatttcgtggagttttgttacgtttttcgcgcgttgcggtagtcgggagattgtgaagggtattttcggtagttaattaatattcgtatattgggcgggattacgtttgggtaggcggagggggtcgatcgaaggcggggatttttgagtgataaggatgatggttaatcgtcggaggtttttttattgcgtttcgtttttgagtcggtcgtttagtttttagtggggttttcggcgcggggaatgtttcgggtggagttggttgagtcgcgcgttttgttttattcgacggggttgtgtgtgttgggtttggttcgcggcgaatcgagatggtagagtagtcggacgaggtcgtgaagtattatattttagaggagatttagaagtataattatagtaagagtatttggttgatt

SEQ ID NO: 35722 - DNA, 742 bp, Artificial Sequence
  chemically treated genomic DNA (Homo sapiens) CpG-island No: 35722
aatcaaccaaatactcttactataattatacttctaaatctcctctaaaatataatacttcacgacctcgtccgactactctaccatctcgattcgccgcgaaccaaacccaacacacacaaccccgtcgaataaaacaaaacgcgcgactcaaccaactccacccgaaacattccccgcgccgaaaaccccactaaaaactaaacgaccgactcaaaaacgaaacgcaataaaaaaacctccgacgattaaccatcatccttatcactcaaaaatccccgccttcgatcgaccccctccgcctacccaaacgtaatcccgcccaatatacgaatattaattaactaccgaaaatacccttcacaatctcccgactaccgcaacgcgcgaaaaacgtaacaaaactccacgaaatctacgcgaaaaaacgaaactaactataacgaaaactaaaataaaaaatcgaaaacgtccccgcgaattaaacgtacgaaaaaacgaaatacaccaacgaacataaataacctatacaaaatccaatcttataaaaacgacgaactaaacaacgaatcgcgaaaatttcctattaacaacaatccgaatcccaaacgttaatttataacaaaaataacgataaccaaacccataaaaaaaacatctcgaaaaaccgttcgcatacacgaaaaaaataaaaaccccgtacgcgctaaaaaacgatttcgcaactcacttcgaaaaacaa

SEQ ID NO: 35723 - DNA, 742 bp, Artificial Sequence
  chemically treated genomic DNA (Homo sapiens) CpG-island No: 35723
gattagttaggtgtttttgttgtggttgtgtttttgaattttttttagggtgtagtattttacggtttcgttcgattgttttgttatttcggttcgtcgcgagttaggtttagtatatatagtttcgtcgggtggagtagagcgcgcgatttagttagttttattcgggatatttttcgcgtcgggaattttattgggggttgggcggtcggtttaggggcggggcgtagtagaagggttttcgacggttggttattatttttgttatttaaaagttttcgttttcggtcgatttttttcgtttgtttaagcgtggtttcgtttagtatgcgggtgttaattggttgtcggaggtgttttttataatttttcggttgtcgtagcgcgcggagagcgtgataggattttacggagtttgcgcggaagggcgggattaattgtggcgagggttgaggtgggaggtcgggggcgttttcgcgggttaagcgtgcgagagagcgaggtgtattagcgggtatggatggtttgtgtagagtttagttttgtgagggcggcgaattaggtagcgaatcgcgggagttttttattggtagtagttcgagttttagacgttaatttgtaataaaagtagcgatggttaagtttataaagggggtatttcggaaagtcgttcgtatgtacggaagagatgaaagtttcgtgcgcgttagaaaacggtttcgtaatttatttcgggaagtaa

SEQ ID NO: 35724 - DNA, 742 bp, Artificial Sequence
  chemically treated genomic DNA (Homo sapiens) CpG-island No: 35724
ttacttcccgaaataaattacgaaaccgttttctaacgcgcacgaaactttcatctcttccgtacatacgaacgactttccgaaataccccctttataaacttaaccatcgctacttttattacaaattaacgtctaaaactcgaactactaccaataaaaaactcccgcgattcgctacctaattcgccgccctcacaaaactaaactctacacaaaccatccatacccgctaatacacctcgctctctcgcacgcttaacccgcgaaaacgcccccgacctcccacctcaaccctcgccacaattaatcccgcccttccgcgcaaactccgtaaaatcctatcacgctctccgcgcgctacgacaaccgaaaaattataaaaaacacctccgacaaccaattaacacccgcatactaaacgaaaccacgcttaaacaaacgaaaaaaatcgaccgaaaacgaaaacttttaaataacaaaaataataaccaaccgtcgaaaacccttctactacgccccgcccctaaaccgaccgcccaacccccaataaaattcccgacgcgaaaaatatcccgaataaaactaactaaatcgcgcgctctactccacccgacgaaactatatatactaaacctaactcgcgacgaaccgaaataacaaaacaatcgaacgaaaccgtaaaatactacaccctaaaaaaaattcaaaaacacaaccacaacaaaaacacctaactaatc

SEQ ID NO: 35725 - DNA, 526 bp, Artificial Sequence
  chemically treated genomic DNA (Homo sapiens) CpG-island No: 35725
gcggggtcgcgggacgggcggaggcgggggtggggcgcgggttttatttgatcgggttgtgtttcgtcgttatcgttttcgggttgttttgggattcgggggcggcggtaaggttacgggagttttcggttttaatggggaattttcgattttgcgggggtttttggggggcgtttatgtttaagtttcggggcgttttgcgcggggagtggcggttaggtttttttcgggtcgtcgggcgtcgtcgtttcgcgttcgttttttgggtcgtcgtttatttttcggcggttgagatcggttttaggttagaagtagttgtcggagttttggtcgcgggagaacgtttcggtttaggcggagtcgggtaggtttttgtggcgtgttcgggttcgggcgtcgaggagggtagtattgtgattcgggtcgcggcgcgttgattttatagagtacgttttttttattggagaatttttaacggtgttttttgtcgtttttggtatttagcgcgggttagaatcggggattg

SEQ ID NO: 35726 - DNA, 526 bp, Artificial Sequence
  chemically treated genomic DNA (Homo sapiens) CpG-island No: 35726
caatccccgattctaacccgcgctaaataccaaaaacgacaaaaaacaccgttaaaaattctccaataaaaaaaacgtactctataaaatcaacgcgccgcgacccgaatcacaatactaccctcctcgacgcccgaacccgaacacgccacaaaaacctacccgactccgcctaaaccgaaacgttctcccgcgaccaaaactccgacaactacttctaacctaaaaccgatctcaaccgccgaaaaataaacgacgacccaaaaaacgaacgcgaaacgacgacgcccgacgacccgaaaaaaacctaaccgccactccccgcgcaaaacgccccgaaacttaaacataaacgccccccaaaaacccccgcaaaatcgaaaattccccattaaaaccgaaaactcccgtaaccttaccgccgcccccgaatcccaaaacaacccgaaaacgataacgacgaaacacaacccgatcaaataaaacccgcgccccacccccgcctccgcccgtcccgcgaccccgc

SEQ ID NO: 35727 - DNA, 526 bp, Artificial Sequence
  chemically treated genomic DNA (Homo sapiens) CpG-island No: 35727
tagttttcgattttggttcgcgttgagtgttaggggcggtagggggtatcgttgggggttttttagtgggaggaacgtgttttgtgaggttagcgcgtcgcggttcgggttataatgttgtttttttcgacgttcgggttcgggtacgttatagagatttgttcggtttcgtttggatcggagcgttttttcgcggttagggtttcggtagttgtttttagtttgggatcggttttaatcgtcgggaggtgagcgacggtttagggggcgggcgcgaggcggcggcgttcggcgattcgggagaggtttgatcgttatttttcgcgtagagcgtttcggggtttggatatgagcgttttttaggagttttcgtagggtcggagattttttattgaggtcggagattttcgtggttttgtcgtcgttttcgagttttaggatagttcggaggcggtagcgacggagtataattcggttaggtaaggttcgcgttttattttcgttttcgttcgtttcgcggtttcgt

SEQ ID NO: 35728 - DNA, 526 bp, Artificial Sequence
  chemically treated genomic DNA (Homo sapiens) CpG-island No: 35728
acgaaaccgcgaaacgaacgaaaacgaaaataaaacgcgaaccttacctaaccgaattatactccgtcgctaccgcctccgaactatcctaaaactcgaaaacgacgacaaaaccacgaaaatctccgacctcaataaaaaatctccgaccctacgaaaactcctaaaaaacgctcatatccaaaccccgaaacgctctacgcgaaaaataacgatcaaacctctcccgaatcgccgaacgccgccgcctcgcgcccgccccctaaaccgtcgctcacctcccgacgattaaaaccgatcccaaactaaaaacaactaccgaaaccctaaccgcgaaaaaacgctccgatccaaacgaaaccgaacaaatctctataacgtacccgaacccgaacgtcgaaaaaaacaacattataacccgaaccgcgacgcgctaacctcacaaaacacgttcctcccactaaaaaacccccaacgataccccctaccgcccctaacactcaacgcgaaccaaaatcgaaaacta

SEQ ID NO: 35729 - DNA, 909 bp, Artificial Sequence
  chemically treated genomic DNA (Homo sapiens) CpG-island No: 35729
ggtcgcgttcgtagagatttcggtttcggttttgttttgtttttttcgcgcgttttcgcggcggtcgttcgtttttgtttcgcgtagttcgagtttttttagagttcgcggcgttcgacggttttagatacgttcggcgtcgttttcgtcgttttttcgtcgtcgtttttaggaggtttcgcgcgttttttcgttttttttcgggtcgggtcgggcggcgaggcgggcgcgggcggcgacggcgcggttattgtttcgtagtttttttcgggcgcgtagaaagggtcggtttcgcgggttgggaggcgcggtcgggcgcggggaggggcggtcgggagtcggtgtttattaacgttcgtcgtcgtttcgggttgggttcgtcgtcgtcgtcgtagtcgttcgcgtttttttcgtggtcgtttatagtttttcggagtcggcgtcgtcgtcgtcgttattgcgtttcgggttgtaaatggcgttcgttcgtttcggcgtttttcgtcgcgttttcggttcggggacgtttgggggaggcgcgttcggggttcgtattttagtattgtcgtcgttcgggtcgttagagttcgcggttaggttcgcggcgggtttcgggtagtttcgacgttcgttcgtttttcgtcggcgtcgcgtgtagttatttatcgcgggtcgcggcgtatcggtcggtcgcgcgcgcgggtcgagggaagatttttggttttcggttggggaaggattttttttcgaggtcgtttttttgcgttttaaaataagtagttttaacgtgagagaaataaaaggtatttgttgacgtgggcgttggatagaaacgttcgagggttggggatataattaaaggggtaacgtatagattttaggtattaattagtagtttcgtttattttt

SEQ ID NO: 35730 - DNA, 909 bp, Artificial Sequence
  chemically treated genomic DNA (Homo sapiens) CpG-island No: 35730
aaaaataaacgaaactactaattaatacctaaaatctatacgttacccctttaattatatccccaaccctcgaacgtttctatccaacgcccacgtcaacaaataccttttatttctctcacgttaaaactacttattttaaaacgcaaaaaaacgacctcgaaaaaaaatccttccccaaccgaaaaccaaaaatcttccctcgacccgcgcgcgcgaccgaccgatacgccgcgacccgcgataaataactacacgcgacgccgacgaaaaacgaacgaacgtcgaaactacccgaaacccgccgcgaacctaaccgcgaactctaacgacccgaacgacgacaatactaaaatacgaaccccgaacgcgcctcccccaaacgtccccgaaccgaaaacgcgacgaaaaacgccgaaacgaacgaacgccatttacaacccgaaacgcaataacgacgacgacgacgccgactccgaaaaactataaacgaccacgaaaaaaacgcgaacgactacgacgacgacgacgaacccaacccgaaacgacgacgaacgttaataaacaccgactcccgaccgcccctccccgcgcccgaccgcgcctcccaacccgcgaaaccgaccctttctacgcgcccgaaaaaaactacgaaacaataaccgcgccgtcgccgcccgcgcccgcctcgccgcccgacccgacccgaaaaaaaacgaaaaaacgcgcgaaacctcctaaaaacgacgacgaaaaaacgacgaaaacgacgccgaacgtatctaaaaccgtcgaacgccgcgaactctaaaaaaactcgaactacgcgaaacaaaaacgaacgaccgccgcgaaaacgcgcgaaaaaaacaaaacaaaaccgaaaccgaaatctctacgaacgcgacc

SEQ ID NO: 35731 - DNA, 909 bp, Artificial Sequence
  chemically treated genomic DNA (Homo sapiens) CpG-island No: 35731
gggagtgggcgaagttgttggttggtgtttgaaatttgtgcgttgtttttttaattgtgtttttagttttcgggcgtttttgtttaacgtttacgttagtaaatattttttgttttttttacgttggggttatttgttttagggcgtaaaggaacggtttcgaaagggggtttttttttagtcgagaattaggaattttttttcggttcgcgcgcgcgatcggtcggtgcgtcgcggttcgcggtaagtggttgtacgcggcgtcggcggagggcgggcgggcgtcggggttgttcgggattcgtcgcgagtttggtcgcgggttttgacggttcgggcggcggtagtgttgggatgcgggtttcgggcgcgttttttttagacgttttcgggtcgggagcgcggcgggaggcgtcgaggcgagcgggcgttatttgtagttcggggcgtagtggcggcggcggcggcgtcggtttcgaggggttgtgggcggttacggaggaggcgcgggcggttgcggcggcggcggcgggtttagttcggggcggcggcgggcgttggtgggtatcggttttcggtcgttttttttcgcgttcggtcgcgttttttagttcgcggggtcggttttttttgcgcgttcgggaggggttgcgggataatggtcgcgtcgtcgtcgttcgcgttcgtttcgtcgttcggttcggttcggggaaaggcgggaaggcgcgcggagttttttggaggcggcggcgggaaggcggcggggacggcgtcgggcgtgtttggagtcgtcgggcgtcgcggattttggaggggttcgggttgcgcggagtaaagacgggcggtcgtcgcgggggcgcgcggggagggtagggtagggtcggggtcggagtttttgcgggcgcggtt

SEQ ID NO: 35732 - DNA, 909 bp, Artificial Sequence
  chemically treated genomic DNA (Homo sapiens) CpG-island No: 35732
aaccgcgcccgcaaaaactccgaccccgaccctaccctaccctccccgcgcgcccccgcgacgaccgcccgtctttactccgcgcaacccgaacccctccaaaatccgcgacgcccgacgactccaaacacgcccgacgccgtccccgccgccttcccgccgccgcctccaaaaaactccgcgcgccttcccgcctttccccgaaccgaaccgaacgacgaaacgaacgcgaacgacgacgacgcgaccattatcccgcaacccctcccgaacgcgcaaaaaaaaccgaccccgcgaactaaaaaacgcgaccgaacgcgaaaaaaaacgaccgaaaaccgatacccaccaacgcccgccgccgccccgaactaaacccgccgccgccgccgcaaccgcccgcgcctcctccgtaaccgcccacaacccctcgaaaccgacgccgccgccgccgccactacgccccgaactacaaataacgcccgctcgcctcgacgcctcccgccgcgctcccgacccgaaaacgtctaaaaaaaacgcgcccgaaacccgcatcccaacactaccgccgcccgaaccgtcaaaacccgcgaccaaactcgcgacgaatcccgaacaaccccgacgcccgcccgccctccgccgacgccgcgtacaaccacttaccgcgaaccgcgacgcaccgaccgatcgcgcgcgcgaaccgaaaaaaaattcctaattctcgactaaaaaaaaaccccctttcgaaaccgttcctttacgccctaaaacaaataaccccaacgtaaaaaaaacaaaaaatatttactaacgtaaacgttaaacaaaaacgcccgaaaactaaaaacacaattaaaaaaacaacgcacaaatttcaaacaccaaccaacaacttcgcccactccc

SEQ ID NO: 35733 - DNA, 583 bp, Artificial Sequence
  chemically treated genomic DNA (Homo sapiens) CpG-island No: 35733
gcgcgggtagagggcgagagggcgagagggcgggagggcgtcggggttgtttcggatttgtaattagtttggtagcgggcggcggcggcggcggcgttgggatgcgggttacgggcgtgcggtttttagtcgtttttcggtcgagagcgaggtcggaggcgttaagtcgagcgggcgttatttgtagtttggggcgtagtagttgtagcgttgttttcgaggggttgggaacggttaaggaggaggcgcgggcggcggcggtgggcgttggcgggtatcggttttcggtcgttttttttcgcgttcggtcggtcggttttttttgcgcgttcggaaggggttgcggaataatggtcgcgtcgttgtcgtcgttcggttcggttcggggaaagtcgggaaggcgcgcggagttttttggcggcggcggcggcggcggcgggaaggcggcggggacggcgtcgggcgtgtttggagtcgttcggcgcggcggatttcggggaggtttggtttgcgtcgcgtagagatagtagtcgtcgggggcggggcgcgagttagcgaatttgtagaattttttttaattggg

SEQ ID NO: 35734 - DNA, 583 bp, Artificial Sequence
  chemically treated genomic DNA (Homo sapiens) CpG-island No: 35734
cccaattaaaaaaaattctacaaattcgctaactcgcgccccgcccccgacgactactatctctacgcgacgcaaaccaaacctccccgaaatccgccgcgccgaacgactccaaacacgcccgacgccgtccccgccgccttcccgccgccgccgccgccgccgccaaaaaactccgcgcgccttcccgactttccccgaaccgaaccgaacgacgacaacgacgcgaccattattccgcaaccccttccgaacgcgcaaaaaaaaccgaccgaccgaacgcgaaaaaaaacgaccgaaaaccgatacccgccaacgcccaccgccgccgcccgcgcctcctccttaaccgttcccaacccctcgaaaacaacgctacaactactacgccccaaactacaaataacgcccgctcgacttaacgcctccgacctcgctctcgaccgaaaaacgactaaaaaccgcacgcccgtaacccgcatcccaacgccgccgccgccgccgcccgctaccaaactaattacaaatccgaaacaaccccgacgccctcccgccctctcgccctctcgccctctacccgcgc

SEQ ID NO: 35735 - DNA, 583 bp, Artificial Sequence
  chemically treated genomic DNA (Homo sapiens) CpG-island No: 35735
tttaattgagggaagttttgtaaattcgttggttcgcgtttcgttttcggcggttgttgtttttgcgcggcgtagattaagttttttcggagttcgtcgcgtcggacggttttagatacgttcgacgtcgttttcgtcgttttttcgtcgtcgtcgtcgtcgtcgttaggaggtttcgcgcgttttttcggtttttttcgggtcgggtcgggcggcgatagcggcgcggttattgtttcgtagtttttttcgggcgcgtaggagaggtcggtcggtcgggcgcggggagggacggtcgggagtcggtgttcgttaacgtttatcgtcgtcgttcgcgttttttttttggtcgtttttaatttttcggagatagcgttgtagttgttgcgttttaggttgtaaatggcgttcgttcggtttggcgttttcggtttcgttttcggtcgggagacggttgagggtcgtacgttcgtggttcgtattttaacgtcgtcgtcgtcgtcgttcgttattaggttggttgtaggttcggggtagtttcgacgttttttcgttttttcgttttttcgttttttgttcgcgt

SEQ ID NO: 35736 - DNA, 583 bp, Artificial Sequence
  chemically treated genomic DNA (Homo sapiens) CpG-island No: 35736
acgcgaacaaaaaacgaaaaaacgaaaaaacgaaaaaacgtcgaaactaccccgaacctacaaccaacctaataacgaacgacgacgacgacgacgttaaaatacgaaccacgaacgtacgaccctcaaccgtctcccgaccgaaaacgaaaccgaaaacgccaaaccgaacgaacgccatttacaacctaaaacgcaacaactacaacgctatctccgaaaaattaaaaacgaccaaaaaaaaaacgcgaacgacgacgataaacgttaacgaacaccgactcccgaccgtccctccccgcgcccgaccgaccgacctctcctacgcgcccgaaaaaaactacgaaacaataaccgcgccgctatcgccgcccgacccgacccgaaaaaaaccgaaaaaacgcgcgaaacctcctaacgacgacgacgacgacgacgaaaaaacgacgaaaacgacgtcgaacgtatctaaaaccgtccgacgcgacgaactccgaaaaaacttaatctacgccgcgcaaaaacaacaaccgccgaaaacgaaacgcgaaccaacgaatttacaaaacttccctcaattaaa

SEQ ID NO: 35737 - DNA, 675 bp, Artificial Sequence
  chemically treated genomic DNA (Homo sapiens) CpG-island No: 35737
gaggcgttcgaacgaggtcgtagttttttgattttttttttttatttttttttcgtaggtgcgtacggttttggttcgcggagatatggtgtcggtcgagatcgttttacgcgaggttcggaattttttttttatttttttggtcgtgggtatcgcggttatggtgttttgtattatttttatcgtagttattattatcgtcgcgtagtattacgagaattattgggatttttaaaaacgtttttggttcggttttattttgcgtttttcgattttttaggttttttttgtagttatatcgcggatttaatgggcgttttgtatattcgtttttggggtcgttagatttggatatatcgtaaatttcgtttttacggaacgtttcgttttgcgagtaagttcggaatttagttttttaggaatttttttaaaatttatatttttagggacgtcgtttttcgggatttcggttaaacgtcggatttttagtcgttttaggtttttttatttttaaagtgtagcgtttttaatcgagtaatttcggtttggtttttaaaatttcgttttttttataagtatcgttttagttttgataaaatttcgtttttaggtcggtaggtttcgtttttttttttttttcgcggggtgatttagtttagtgattgggtttgtggt

SEQ ID NO: 35738 - DNA, 675 bp, Artificial Sequence
  chemically treated genomic DNA (Homo sapiens) CpG-island No: 35738
accacaaacccaatcactaaactaaatcaccccgcgaaaaaaaaaaaaaaacgaaacctaccgacctaaaaacgaaattttatcaaaactaaaacgatacttataaaaaaaacgaaattttaaaaaccaaaccgaaattactcgattaaaaacgctacactttaaaaataaaaaaacctaaaacgactaaaaatccgacgtttaaccgaaatcccgaaaaacgacgtccctaaaaatataaattttaaaaaaattcctaaaaaactaaattccgaacttactcgcaaaacgaaacgttccgtaaaaacgaaatttacgatatatccaaatctaacgaccccaaaaacgaatatacaaaacgcccattaaatccgcgatataactacaaaaaaaacctaaaaaatcgaaaaacgcaaaataaaaccgaaccaaaaacgtttttaaaaatcccaataattctcgtaatactacgcgacgataataataactacgataaaaataatacaaaacaccataaccgcgatacccacgaccaaaaaaataaaaaaaaaattccgaacctcgcgtaaaacgatctcgaccgacaccatatctccgcgaaccaaaaccgtacgcacctacgaaaaaaaaataaaaaaaaaaaatcaaaaaactacgacctcgttcgaacgcctc

SEQ ID NO: 35739 - DNA, 675 bp, Artificial Sequence
  chemically treated genomic DNA (Homo sapiens) CpG-island No: 35739
gttataaatttaattattggattgaattatttcgcggagaagaaaagaaggcggagtttgtcgatttggaggcggggttttgttagagttggggcggtgtttatagaggaggcggggttttagggattaaatcgaggttgttcggttgggggcgttatattttgagggtgagggggtttggagcgattgagggttcggcgtttggtcgggatttcggaaagcggcgtttttgggggtgtgggttttggaggggtttttgaggaattggatttcgagtttgttcgtaaggcgagacgtttcgtggaggcggagtttacgatgtatttaagtttgacggttttagaaacgggtgtgtagggcgtttattgggttcgcggtatgattgtagaaagagtttgggagatcgaggggcgtagagtggggtcggattaggggcgtttttagggattttagtagttttcgtggtgttgcgcggcgatgatgatgattacggtgaggatggtatagagtattatggtcgcgatgtttacggttagggagatgaaggagaagtttcgggtttcgcgtgaagcgatttcggtcgatattatgttttcgcgggttaaggtcgtgcgtatttacggaggaggggtgggggaaggaggttaaagagttgcggtttcgttcgaacgtttt

SEQ ID NO: 35740 - DNA, 675 bp, Artificial Sequence
  chemically treated genomic DNA (Homo sapiens) CpG-island No: 35740
aaaacgttcgaacgaaaccgcaactctttaacctccttcccccacccctcctccgtaaatacgcacgaccttaacccgcgaaaacataatatcgaccgaaatcgcttcacgcgaaacccgaaacttctccttcatctccctaaccgtaaacatcgcgaccataatactctataccatcctcaccgtaatcatcatcatcgccgcgcaacaccacgaaaactactaaaatccctaaaaacgcccctaatccgaccccactctacgcccctcgatctcccaaactctttctacaatcataccgcgaacccaataaacgccctacacacccgtttctaaaaccgtcaaacttaaatacatcgtaaactccgcctccacgaaacgtctcgccttacgaacaaactcgaaatccaattcctcaaaaacccctccaaaacccacacccccaaaaacgccgctttccgaaatcccgaccaaacgccgaaccctcaatcgctccaaaccccctcaccctcaaaatataacgcccccaaccgaacaacctcgatttaatccctaaaaccccgcctcctctataaacaccgccccaactctaacaaaaccccgcctccaaatcgacaaactccgccttcttttcttctccgcgaaataattcaatccaataattaaatttataac

SEQ ID NO: 35741 - DNA, 739 bp, Artificial Sequence
  chemically treated genomic DNA (Homo sapiens) CpG-island No: 35741
tacggcgcggtaagcgggttggttcgaggtcgaggttaaacgcgttcgaggttaaacgcgttcgaggttggcgtttttacgttcgtttgaaaggacgtttaggagcggcgttttcggaaaggtcgtgttcgttttatagtttagaattcgcgtagtttcgcggtttacggtatttttacgattcggtttagttttaattcgttttagattcgtattcgcgcgcggacgtttagggttttgaagtcgaagtttttcgcggttattttcgcgcgtttttttcgttattttcggagtttttagcgtcgggttcgtaataaatttattgaatttataaaagacgtcgtcgtcgagtcgcgttcgcgcgttcgcggtttcgcgattacgtgatatcgttcgtttttcgtgtttcgcgtacgcgtttaaatcgtcggtttttgtgcgttttcgggcggtttcgaacgggtcgggacgagtcggggattgtatacgcgtatattcgtacgcgcgtatacgcgtatattttttttttacgtggtagcgaaggataaagaggaagaacgggttatttgtaagtattattaagagtgtatgtgcgtatgcgcgaaggaaggagtttcgcgaatttaattttttatagtgtttcgcgttcggaagtgtttgtcgtttggagacggagtgattttaaacgggtttatacggttttttgagaaatataaagggaaatcgaatttattaatat

SEQ ID NO: 35742 - DNA, 739 bp, Artificial Sequence
  chemically treated genomic DNA (Homo sapiens) CpG-island No: 35742
atattaataaattcgatttccctttatatttctcaaaaaaccgtataaacccgtttaaaatcactccgtctccaaacgacaaacacttccgaacgcgaaacactataaaaaattaaattcgcgaaactccttccttcgcgcatacgcacatacactcttaataatacttacaaataacccgttcttcctctttatccttcgctaccacgtaaaaaaaaaatatacgcgtatacgcgcgtacgaatatacgcgtatacaatccccgactcgtcccgacccgttcgaaaccgcccgaaaacgcacaaaaaccgacgatttaaacgcgtacgcgaaacacgaaaaacgaacgatatcacgtaatcgcgaaaccgcgaacgcgcgaacgcgactcgacgacgacgtcttttataaattcaataaatttattacgaacccgacgctaaaaactccgaaaataacgaaaaaaacgcgcgaaaataaccgcgaaaaacttcgacttcaaaaccctaaacgtccgcgcgcgaatacgaatctaaaacgaattaaaactaaaccgaatcgtaaaaataccgtaaaccgcgaaactacgcgaattctaaactataaaacgaacacgacctttccgaaaacgccgctcctaaacgtcctttcaaacgaacgtaaaaacgccaacctcgaacgcgtttaacctcgaacgcgtttaacctcgacctcgaaccaacccgcttaccgcgccgta

SEQ ID NO: 35743 - DNA, 739 bp, Artificial Sequence
  chemically treated genomic DNA (Homo sapiens) CpG-island No: 35743
atattggtggattcggtttttttttatgttttttagaaaatcgtgtgagttcgtttggagttatttcgtttttaagcgataggtattttcggacgcggggtattgtgggaagttgagttcgcggggttttttttttcgcgtatgcgtatatgtatttttggtaatgtttgtaggtggttcgttttttttttttgtttttcgttgttacgtgagaggggagtgtacgcgtgtgcgcgcgtgcgagtgtgcgcgtgtgtagttttcgattcgtttcggttcgttcggagtcgttcgggagcgtataaaggtcgacggtttgggcgcgtgcgcgggatacgggggacgggcggtgttacgtgatcgcgaggtcgcgggcgcgcgggcgcgattcggcggcggcgttttttgtgagtttagtgagtttattgcgggttcggcgttgggggtttcgggaatggcgggggaggcgcgcgggagtggtcgcggggagtttcggttttaaggttttgggcgttcgcgcgcggatgcgggtttggggcgggttggggttgggtcgggtcgtgaagatgtcgtgggtcgcggagttgcgcggattttgggttgtggggcgggtacggttttttcggaggcgtcgtttttgggcgtttttttaggcgggcgtggaggcgttagtttcgggcgcgtttagtttcgggcgcgtttagtttcgatttcgggttagttcgtttgtcgcgtcgtg

SEQ ID NO: 35744 - DNA, 739 bp, Artificial Sequence
  chemically treated genomic DNA (Homo sapiens) CpG-island No: 35744
cacgacgcgacaaacgaactaacccgaaatcgaaactaaacgcgcccgaaactaaacgcgcccgaaactaacgcctccacgcccgcctaaaaaaacgcccaaaaacgacgcctccgaaaaaaccgtacccgccccacaacccaaaatccgcgcaactccgcgacccacgacatcttcacgacccgacccaaccccaacccgccccaaacccgcatccgcgcgcgaacgcccaaaaccttaaaaccgaaactccccgcgaccactcccgcgcgcctcccccgccattcccgaaacccccaacgccgaacccgcaataaactcactaaactcacaaaaaacgccgccgccgaatcgcgcccgcgcgcccgcgacctcgcgatcacgtaacaccgcccgtcccccgtatcccgcgcacgcgcccaaaccgtcgacctttatacgctcccgaacgactccgaacgaaccgaaacgaatcgaaaactacacacgcgcacactcgcacgcgcgcacacgcgtacactcccctctcacgtaacaacgaaaaacaaaaaaaaaaaacgaaccacctacaaacattaccaaaaatacatatacgcatacgcgaaaaaaaaaaccccgcgaactcaacttcccacaataccccgcgtccgaaaatacctatcgcttaaaaacgaaataactccaaacgaactcacacgattttctaaaaaacataaaaaaaaaccgaatccaccaatat

SEQ ID NO: 35745 - DNA, 516 bp, Artificial Sequence
  chemically treated genomic DNA (Homo sapiens) CpG-island No: 35745
  misc_feature (75)..(75): n is either a, c, g or t
ttaaatttttttcgatatttatatttagcgtttcgtcgtcgttcgttttataggttttattttattttttggttnttattttcgcgcgtttttagagttttcgtttgaggtcgtttttcgcgtatgcgtttaggtcggtttttaggtttttttcgttttagtcggtaagtagttcgttcgcgttggggttacgcgagtcggttcgtagcggggttatcgcgatttcgggcgtagatatagaggtcgtttttagtttcgtcgtttcgtggtttcggtttcgttgtacgtttttttatttttcggatttcgtagggtcgcggcggatacggttcgatcggggacgtgaacgcgtagaattatattttttagcgtttcgttcgcgttggaattatatttttcggggggttcggcggtgtattcgtcggggtcgcggattggaggttttcggttggaaaagttttttggcggttaattggggaggattggaagaaatttaggatggagttagtattgttg

SEQ ID NO: 35746 - DNA, 516 bp, Artificial Sequence
  chemically treated genomic DNA (Homo sapiens) CpG-island No: 35746
  misc_feature (442)..(442): n is either a, c, g or t
caacaatactaactccatcctaaatttcttccaatcctccccaattaaccgccaaaaaacttttccaaccgaaaacctccaatccgcgaccccgacgaatacaccgccgaaccccccgaaaaatataattccaacgcgaacgaaacgctaaaaaatataattctacgcgttcacgtccccgatcgaaccgtatccgccgcgaccctacgaaatccgaaaaataaaaaaacgtacaacgaaaccgaaaccacgaaacgacgaaactaaaaacgacctctatatctacgcccgaaatcgcgataaccccgctacgaaccgactcgcgtaaccccaacgcgaacgaactacttaccgactaaaacgaaaaaaacctaaaaaccgacctaaacgcatacgcgaaaaacgacctcaaacgaaaactctaaaaacgcgcgaaaataanaaccaaaaaataaaataaaacctataaaacgaacgacgacgaaacgctaaatataaatatcgaaaaaaatttaa

SEQ ID NO: 35747 - DNA, 516 bp, Artificial Sequence
  chemically treated genomic DNA (Homo sapiens) CpG-island No: 35747
  misc_feature (442)..(442): n is either a, c, g or t
tagtagtgttggttttattttagattttttttagttttttttagttagtcgttaaggggtttttttaatcggaaatttttaattcgcgatttcggcgggtgtatcgtcgagtttttcggaaagtgtagttttagcgcgagcgggacgttgggaaatgtagttttgcgcgtttacgttttcgatcgggtcgtgttcgtcgcggttttgcgaggttcgaggggtaagggagcgtgtagcggggtcgggattacgaggcggcggggttgagggcggtttttgtgtttgcgttcgggatcgcggtgatttcgttgcggatcggttcgcgtgattttagcgcgaacgagttgtttgtcggttggggcgagaaaggtttggggatcggtttgggcgtatgcgcgaaaggcggttttaggcgggggttttgggggcgcgcgggggtggnagttaaagggtggggtggggtttgtagggcgggcggcggcggggcgttgaatgtgggtgtcgggggagatttgg

SEQ ID NO: 35748 - DNA, 516 bp, Artificial Sequence
  chemically treated genomic DNA (Homo sapiens) CpG-island No: 35748
  misc_feature (75)..(75): n is either a, c, g or t
ccaaatctcccccgacacccacattcaacgccccgccgccgcccgccctacaaaccccaccccaccctttaactnccacccccgcgcgcccccaaaacccccgcctaaaaccgcctttcgcgcatacgcccaaaccgatccccaaacctttctcgccccaaccgacaaacaactcgttcgcgctaaaatcacgcgaaccgatccgcaacgaaatcaccgcgatcccgaacgcaaacacaaaaaccgccctcaaccccgccgcctcgtaatcccgaccccgctacacgctcccttacccctcgaacctcgcaaaaccgcgacgaacacgacccgatcgaaaacgtaaacgcgcaaaactacatttcccaacgtcccgctcgcgctaaaactacactttccgaaaaactcgacgatacacccgccgaaatcgcgaattaaaaatttccgattaaaaaaaccccttaacgactaactaaaaaaaactaaaaaaaatctaaaataaaaccaacactacta

SEQ ID NO: 35749 - DNA, 1404 bp, Artificial Sequence
  chemically treated genomic DNA (Homo sapiens) CpG-island No: 35749
atgcgggggcggcggttgggggttcgggatgtggaggtgaggttcgaggtgcggggatcgggttgcgggggcgaggttttaggtgcgggggatgtaggagtcgggtgcggggtcgaggttttaggtgcgggagatgtaggagtcgggtgcgggggcgaggttttaggtgtgggagatgtaggagtcgggtgcgggggcgaggttttaggtgtaagggatgtaggagtcgggtgcgggggcgaggttttaggtgcgggagatgtaggagtcgggtgcgggggcgaggttttaggtgtgggagatgtaggagtcgggtgcgggggcgaggttttaggtgcgggagatgtagaagtcgggtgcgggggcgaggttttaggtgtgggagatgtaggagtcgggtgcgggggcgaggttttaggtgcgggggatgtaggagtcgggtgcgggggcgaggttttaggtgtgggagatgtaggagtcgggtgcgggggcgaggttttaggtgcgggggatgtaggagtcgggtgcgggggcgaggttttaggtttgggagatgtaggagtttggggtgtaggggtcggggtgcgggggcgatgtattaggtgtggggggtgcggggtcggggggaagcgttgaggttcgatttgtcggggttgtagggtcggggtgcgggggtgtaggggtcggggtgcgggggcgaggttttaggtgtaggggtcggggtgagaggttgaggtttgagttgtcgggggtgcgggggcggaggttttcgtattggcggtcgtgcgtgagattgcggggatttgagagttttgtaggagggttttcgggatttttcgtattatttacgcggtcgcggggcgcgatttttgcggagggcgagggttttttttcgcgttcgtcgtcgttgcgttgcgttttcgggagttttgggagtcggacgttgggaagaggacggaatttcggaggattttaagtgaggcggcgatcgcgacggtcgggttttgcgaggttcgggggttttcgcgggtgttggcggttcggtttttggtatttgtggagggaaaggggcggcggggcggtggcgttttgggatggatgttttcgtcgtttttagtttcggcggtttttagggtaaagtcggttgtatttttgcgtagtttgttttttgagcgttttttttttcgtttttaagttgtggttagagagatttcgttcgtatagaatgtatcgtttaacggtttttaggcgtgtggcgcggtggtggtttttacgtgtacggcgtggttttgagtttagcgtcggagggacgttaggtggaagcgtttttggtagagttggtagcgaatcggagaggtgatttttagcgagtgtggttattggaagtatatatttgttttttga

SEQ ID NO: 35750 - DNA, 1404 bp, Artificial Sequence
  chemically treated genomic DNA (Homo sapiens) CpG-island No: 35750
tcaaaaaacaaatatatacttccaataaccacactcgctaaaaatcacctctccgattcgctaccaactctaccaaaaacgcttccacctaacgtccctccgacgctaaactcaaaaccacgccgtacacgtaaaaaccaccaccgcgccacacgcctaaaaaccgttaaacgatacattctatacgaacgaaatctctctaaccacaacttaaaaacgaaaaaaaaaacgctcaaaaaacaaactacgcaaaaatacaaccgactttaccctaaaaaccgccgaaactaaaaacgacgaaaacatccatcccaaaacgccaccgccccgccgcccctttccctccacaaataccaaaaaccgaaccgccaacacccgcgaaaacccccgaacctcgcaaaacccgaccgtcgcgatcgccgcctcacttaaaatcctccgaaattccgtcctcttcccaacgtccgactcccaaaactcccgaaaacgcaacgcaacgacgacgaacgcgaaaaaaaaccctcgccctccgcaaaaatcgcgccccgcgaccgcgtaaataatacgaaaaatcccgaaaaccctcctacaaaactctcaaatccccgcaatctcacgcacgaccgccaatacgaaaacctccgcccccgcacccccgacaactcaaacctcaacctctcaccccgacccctacacctaaaacctcgcccccgcaccccgacccctacacccccgcaccccgaccctacaaccccgacaaatcgaacctcaacgcttccccccgaccccgcaccccccacacctaatacatcgcccccgcaccccgacccctacaccccaaactcctacatctcccaaacctaaaacctcgcccccgcacccgactcctacatcccccgcacctaaaacctcgcccccgcacccgactcctacatctcccacacctaaaacctcgcccccgcacccgactcctacatcccccgcacctaaaacctcgcccccgcacccgactcctacatctcccacacctaaaacctcgcccccgcacccgacttctacatctcccgcacctaaaacctcgcccccgcacccgactcctacatctcccacacctaaaacctcgcccccgcacccgactcctacatctcccgcacctaaaacctcgcccccgcacccgactcctacatcccttacacctaaaacctcgcccccgcacccgactcctacatctcccacacctaaaacctcgcccccgcacccgactcctacatctcccgcacctaaaacctcgaccccgcacccgactcctacatcccccgcacctaaaacctcgcccccgcaacccgatccccgcacctcgaacctcacctccacatcccgaacccccaaccgccgcccccgcat

SEQ ID NO: 35751 - DNA, 1404 bp, Artificial Sequence
  chemically treated genomic DNA (Homo sapiens) CpG-island No: 35751
ttagaaagtaagtgtgtgtttttaataattatattcgttggaaattattttttcgattcgttattagttttgttaaagacgtttttatttaacgttttttcggcgttgagtttaggattacgtcgtgtacgtgggaattattatcgcgttatacgtttaaaaatcgttgagcggtatattttatgcgagcggggtttttttggttataatttaaaaacgaaaagaaaagcgtttagagaataggttgcgtaggggtgtagtcggttttgttttggaggtcgtcggggttgaagacggcgagagtatttattttaggacgttatcgtttcgtcgtttttttttttttataggtgttaagggtcgggtcgttagtattcgcgaggattttcgggtttcgtagagttcggtcgtcgcggtcgtcgttttatttggggtttttcggagtttcgttttttttttaacgttcggtttttaaggttttcgggggcgtagcgtagcggcggcggacgcgggaaggggttttcgtttttcgtagagatcgcgtttcgcggtcgcgtgggtagtgcgggaggtttcgaaggtttttttgtagagtttttaggttttcgtagttttacgtacggtcgttaatgcggagattttcgttttcgtattttcggtaatttaggttttagttttttatttcggtttttgtatttgggatttcgttttcgtatttcggtttttgtattttcgtatttcggttttatagtttcggtaagtcgggttttagcgttttttttcggtttcgtattttttatatttgatatatcgttttcgtatttcggtttttgtattttaggtttttgtattttttaaatttgggatttcgttttcgtattcggtttttgtatttttcgtatttgggatttcgttttcgtattcggtttttgtattttttatatttgggatttcgttttcgtattcggtttttgtatttttcgtatttgggatttcgttttcgtattcggtttttgtattttttatatttgggatttcgttttcgtattcggtttttgtatttttcgtatttgggatttcgttttcgtattcggtttttgtattttttatatttgggatttcgttttcgtattcggtttttgtatttttcgtatttgggatttcgttttcgtattcggtttttgtattttttgtatttgggatttcgttttcgtattcggtttttgtattttttatatttgggatttcgttttcgtattcggtttttgtatttttcgtatttgggatttcgatttcgtattcggtttttgtatttttcgtatttgggatttcgttttcgtaattcggttttcgtatttcgagttttatttttatatttcggatttttagtcgtcgttttcgtat

SEQ ID NO: 35752 - DNA, 1404 bp, Artificial Sequence
  chemically treated genomic DNA (Homo sapiens) CpG-island No: 35752
atacgaaaacgacgactaaaaatccgaaatataaaaataaaactcgaaatacgaaaaccgaattacgaaaacgaaatcccaaatacgaaaaatacaaaaaccgaatacgaaatcgaaatcccaaatacgaaaaatacaaaaaccgaatacgaaaacgaaatcccaaatataaaaaatacaaaaaccgaatacgaaaacgaaatcccaaatacaaaaaatacaaaaaccgaatacgaaaacgaaatcccaaatacgaaaaatacaaaaaccgaatacgaaaacgaaatcccaaatataaaaaatacaaaaaccgaatacgaaaacgaaatcccaaatacgaaaaatacaaaaaccgaatacgaaaacgaaatcccaaatataaaaaatacaaaaaccgaatacgaaaacgaaatcccaaatacgaaaaatacaaaaaccgaatacgaaaacgaaatcccaaatataaaaaatacaaaaaccgaatacgaaaacgaaatcccaaatacgaaaaatacaaaaaccgaatacgaaaacgaaatcccaaatttaaaaaatacaaaaacctaaaatacaaaaaccgaaatacgaaaacgatatatcaaatataaaaaatacgaaaccgaaaaaaaacgctaaaacccgacttaccgaaactataaaaccgaaatacgaaaatacaaaaaccgaaatacgaaaacgaaatcccaaatacaaaaaccgaaataaaaaactaaaacctaaattaccgaaaatacgaaaacgaaaatctccgcattaacgaccgtacgtaaaactacgaaaacctaaaaactctacaaaaaaaccttcgaaacctcccgcactacccacgcgaccgcgaaacgcgatctctacgaaaaacgaaaaccccttcccgcgtccgccgccgctacgctacgcccccgaaaaccttaaaaaccgaacgttaaaaaaaaaacgaaactccgaaaaaccccaaataaaacgacgaccgcgacgaccgaactctacgaaacccgaaaatcctcgcgaatactaacgacccgacccttaacacctataaaaaaaaaaaaacgacgaaacgataacgtcctaaaataaatactctcgccgtcttcaaccccgacgacctccaaaacaaaaccgactacacccctacgcaacctattctctaaacgcttttcttttcgtttttaaattataaccaaaaaaaccccgctcgcataaaatataccgctcaacgatttttaaacgtataacgcgataataattcccacgtacacgacgtaatcctaaactcaacgccgaaaaaacgttaaataaaaacgtctttaacaaaactaataacgaatcgaaaaaataatttccaacgaatataattattaaaaacacacacttactttctaa

SEQ ID NO: 35753 - DNA, 637 bp, Artificial Sequence
  chemically treated genomic DNA (Homo sapiens) CpG-island No: 35753
gcgcgttggtaattatgtcgtttattgtcgtaacggtattgacgttattgttttttagaattttcgatattatacgtaaggttggatttgtttgtagtatcggtttacgcgtggtttgggtttttgcgtttaaacgaaaaatgtcgtcgttatcgcgttgtatttcgttgttcgtggtttttattagtttaagacgttttattggcgtaatcgtatttgtcggatcgttcggattgagcgtcgagattgtgttatcggtagtaatagtgattttcgtttttttcggatagtaattggtttagtttcgtttattatcggatgtttttgaattgttagttgttcggtgggattaatttgaatgttgttattacgcgtatatttttcgttgtcgttagcggtttgtacggttagtttagttattttgttgtaacgcgaacgtttatcggtcgttaggtgtaattaattttgtcggtcgtaatatttgcgttcgtcggtgacgttcggaataaacgtggtcgtgggtcgagaaagtttttttatttggaatcggcggtaaataattaaatggttcgttaaaatcgggcgttggaggtattggttaaataattgggggtaatcgttcggggaataaaagggt

SEQ ID NO: 35754 - DNA, 637 bp, Artificial Sequence
  chemically treated genomic DNA (Homo sapiens) CpG-island No: 35754
acccttttattccccgaacgattacccccaattatttaaccaatacctccaacgcccgattttaacgaaccatttaattatttaccgccgattccaaataaaaaaactttctcgacccacgaccacgtttattccgaacgtcaccgacgaacgcaaatattacgaccgacaaaattaattacacctaacgaccgataaacgttcgcgttacaacaaaataactaaactaaccgtacaaaccgctaacgacaacgaaaaatatacgcgtaataacaacattcaaattaatcccaccgaacaactaacaattcaaaaacatccgataataaacgaaactaaaccaattactatccgaaaaaaacgaaaatcactattactaccgataacacaatctcgacgctcaatccgaacgatccgacaaatacgattacgccaataaaacgtcttaaactaataaaaaccacgaacaacgaaatacaacgcgataacgacgacatttttcgtttaaacgcaaaaacccaaaccacgcgtaaaccgatactacaaacaaatccaaccttacgtataatatcgaaaattctaaaaaacaataacgtcaataccgttacgacaataaacgacataattaccaacgcgc

SEQ ID NO: 35755 - DNA, 637 bp, Artificial Sequence
  chemically treated genomic DNA (Homo sapiens) CpG-island No: 35755
atttttttatttttcgggcggttatttttaattatttggttaatgtttttaacgttcggttttggcgggttatttaattgtttatcgtcggttttaaatgaaagggttttttcggtttacggttacgtttgtttcgggcgttatcggcgggcgtaaatattacggtcggtaaaattgattatatttggcggtcggtggacgttcgcgttgtagtagaatggttgggttggtcgtgtagatcgttgacggtagcgaagggtatacgcgtaatggtagtatttaggttgattttatcgggtaattgataatttaggggtattcggtgataggcgaggttgggttaattgttgttcggaaggggcggaaattattattgttgtcgatggtataatttcggcgtttaattcgggcgattcggtaaatacggttgcgttagtagggcgttttaaattggtgaaagttacgggtagcgaagtgtagcgcggtgacgacggtatttttcgtttaagcgtagaaatttaggttacgcgtgggtcggtattgtaggtagatttaattttgcgtgtgatgtcgggggttttggaaggtagtaacgttaatgtcgttgcggtaatgagcgatatgattgttagcgcgt

SEQ ID NO: 35756 - DNA, 637 bp, Artificial Sequence
  chemically treated genomic DNA (Homo sapiens) CpG-island No: 35756
acgcgctaacaatcatatcgctcattaccgcaacgacattaacgttactaccttccaaaacccccgacatcacacgcaaaattaaatctacctacaataccgacccacgcgtaacctaaatttctacgcttaaacgaaaaataccgtcgtcaccgcgctacacttcgctacccgtaactttcaccaatttaaaacgccctactaacgcaaccgtatttaccgaatcgcccgaattaaacgccgaaattataccatcgacaacaataataatttccgccccttccgaacaacaattaacccaacctcgcctatcaccgaatacccctaaattatcaattacccgataaaatcaacctaaatactaccattacgcgtatacccttcgctaccgtcaacgatctacacgaccaacccaaccattctactacaacgcgaacgtccaccgaccgccaaatataatcaattttaccgaccgtaatatttacgcccgccgataacgcccgaaacaaacgtaaccgtaaaccgaaaaaaccctttcatttaaaaccgacgataaacaattaaataacccgccaaaaccgaacgttaaaaacattaaccaaataattaaaaataaccgcccgaaaaataaaaaaat

SEQ ID NO: 35757 - DNA, 513 bp, Artificial Sequence
  chemically treated genomic DNA (Homo sapiens) CpG-island No: 35757
aatgcgcgtgttcggtaaagttttcgcgttttttttttttaagttatttcgttagtttcggttttttttattttttttcgtttttgtcgttttttcgtcgtgggacgtttttcgtttattttcgttagagtttagtttgcgcgcgggatttagttgttattttattttttttcgtcgtttttttattttttttttcgaattcgcggggtagttcgttcgagcgcgtttcgttttcgttttttcgcggtcgcgcgtcggaggaggaggggcggggggaggagggacgcgcggcgtcgtatggtcgacgtggggttcgttttcgcggtttttttcgggcgggcgcgtaggtacgtatttgcgggtgcgcgcgcggacggtcgggcggcggcggttttcggaggtggtggttttattttttaggatttaggggtagttatagcgatatcgcggtagtagttttaggagtcggagttggaacggtcgggggcggcggtagcggcggcgttgagggtg

SEQ ID NO: 35758 - DNA, 513 bp, Artificial Sequence
  chemically treated genomic DNA (Homo sapiens) CpG-island No: 35758
caccctcaacgccgccgctaccgccgcccccgaccgttccaactccgactcctaaaactactaccgcgatatcgctataactacccctaaatcctaaaaaataaaaccaccacctccgaaaaccgccgccgcccgaccgtccgcgcgcgcacccgcaaatacgtacctacgcgcccgcccgaaaaaaaccgcgaaaacgaaccccacgtcgaccatacgacgccgcgcgtccctcctccccccgcccctcctcctccgacgcgcgaccgcgaaaaaacgaaaacgaaacgcgctcgaacgaactaccccgcgaattcgaaaaaaaaaataaaaaaacgacgaaaaaaaataaaataacaactaaatcccgcgcgcaaactaaactctaacgaaaataaacgaaaaacgtcccacgacgaaaaaacgacaaaaacgaaaaaaaataaaaaaaaccgaaactaacgaaataacttaaaaaaaaaaaacgcgaaaactttaccgaacacgcgcatt

SEQ ID NO: 35759 - DNA, 513 bp, Artificial Sequence
  chemically treated genomic DNA (Homo sapiens) CpG-island No: 35759
tatttttagcgtcgtcgttgtcgtcgttttcggtcgttttagtttcggtttttgaggttgttgtcgcggtgtcgttgtggttgtttttgagttttggaaagtgaagttattattttcgggagtcgtcgtcgttcggtcgttcgcgcgcgtattcgtagatgcgtgtttgcgcgttcgttcgggagagatcgcgagagcgagttttacgtcggttatgcggcgtcgcgcgtttttttttttttcgttttttttttttcggcgcgcggtcgcgagggggcgggggcgggacgcgttcgggcgggttgtttcgcggattcgggagagggggtggggaggcggcgaggaaaagtaaagtgatagttgggtttcgcgcgtagattgggttttgacgggggtgagcgaggggcgttttacggcgaaggaacgataaggacggggagaagtgggggaaatcgaggttgacggggtggtttgaggggaggggacgcgaggattttgtcgggtacgcgtatt

SEQ ID NO: 35760 - DNA, 513 bp, Artificial Sequence
  chemically treated genomic DNA (Homo sapiens) CpG-island No: 35760
aatacgcgtacccgacaaaatcctcgcgtcccctcccctcaaaccaccccgtcaacctcgatttcccccacttctccccgtccttatcgttccttcgccgtaaaacgcccctcgctcacccccgtcaaaacccaatctacgcgcgaaacccaactatcactttacttttcctcgccgcctccccaccccctctcccgaatccgcgaaacaacccgcccgaacgcgtcccgcccccgccccctcgcgaccgcgcgccgaaaaaaaaaaaacgaaaaaaaaaaaaacgcgcgacgccgcataaccgacgtaaaactcgctctcgcgatctctcccgaacgaacgcgcaaacacgcatctacgaatacgcgcgcgaacgaccgaacgacgacgactcccgaaaataataacttcactttccaaaactcaaaaacaaccacaacgacaccgcgacaacaacctcaaaaaccgaaactaaaacgaccgaaaacgacgacaacgacgacgctaaaaata

SEQ ID NO: 35761 - DNA, 509 bp, Artificial Sequence
  chemically treated genomic DNA (Homo sapiens) CpG-island No: 35761
cgtaagttgtaattgagtttcgcggcggtggtgtttgtatcgtatagcgcgagtagtaggagtaggtggaggcgtattttgagatttcgcgttatcgagatgtggagagatcgaaaggtagcgttgtaagggatcggcggtgaagttatttattttttcggaagtagtcgaggttttaggttttcgtttcggtttcgtttttaggttagttgagcgtttttcgggcgtagtcgcgggcgggaggggaacgaggaggttgcgtttgtattcgttgaaagtcgggcgtcgcgggtgcgggagttgtagttttcgagaatagttataggttggggggtattgcggtttgagttttttttcggcgttttttttcgtcgttttagtatatataattggaggtaagaattttgtacggtaattgggatagaaagatttttgggcgcgtagtggtataaagtttcgggagattagagatcgattgtacgtggagattatagttggagagttttttt

SEQ ID NO: 35762 - DNA, 509 bp, Artificial Sequence
  chemically treated genomic DNA (Homo sapiens) CpG-island No: 35762
aaaaaaactctccaactataatctccacgtacaatcgatctctaatctcccgaaactttataccactacgcgcccaaaaatctttctatcccaattaccgtacaaaattcttacctccaattatatatactaaaacgacgaaaaaaaacgccgaaaaaaaactcaaaccgcaataccccccaacctataactattctcgaaaactacaactcccgcacccgcgacgcccgactttcaacgaatacaaacgcaacctcctcgttcccctcccgcccgcgactacgcccgaaaaacgctcaactaacctaaaaacgaaaccgaaacgaaaacctaaaacctcgactacttccgaaaaaataaataacttcaccgccgatcccttacaacgctacctttcgatctctccacatctcgataacgcgaaatctcaaaatacgcctccacctactcctactactcgcgctatacgatacaaacaccaccgccgcgaaactcaattacaacttacg

SEQ ID NO: 35763 - DNA, 509 bp, Artificial Sequence
  chemically treated genomic DNA (Homo sapiens) CpG-island No: 35763
gaggggattttttagttatggtttttacgtatagtcggtttttgatttttcgaggttttgtgttattgcgcgtttagggatttttttgttttaattatcgtgtaagatttttgtttttagttgtatgtattgaggcggcgggaagaagcgtcgagggaaggtttagatcgtaatgttttttagtttgtagttattttcgggggttgtagttttcgtattcgcgacgttcggtttttagcgggtgtaggcgtagttttttcgtttttttttcgttcgcggttgcgttcggagagcgtttagttgatttaggggcggggtcggggcggggatttaaagtttcggttattttcgagggggtgagtggttttatcgtcggttttttgtagcgttgtttttcgatttttttatatttcggtggcgcgggattttaagatgcgtttttatttgtttttgttgttcgcgttgtgcggtgtaggtattatcgtcgcggagtttagttatagtttgcg

SEQ ID NO: 35764 - DNA, 509 bp, Artificial Sequence
  chemically treated genomic DNA (Homo sapiens) CpG-island No: 35764
cgcaaactataactaaactccgcgacgataatacctacaccgcacaacgcgaacaacaaaaacaaataaaaacgcatcttaaaatcccgcgccaccgaaatataaaaaaatcgaaaaacaacgctacaaaaaaccgacgataaaaccactcaccccctcgaaaataaccgaaactttaaatccccgccccgaccccgcccctaaatcaactaaacgctctccgaacgcaaccgcgaacgaaaaaaaaacgaaaaaactacgcctacacccgctaaaaaccgaacgtcgcgaatacgaaaactacaacccccgaaaataactacaaactaaaaaacattacgatctaaaccttccctcgacgcttcttcccgccgcctcaatacatacaactaaaaacaaaaatcttacacgataattaaaacaaaaaaatccctaaacgcgcaataacacaaaacctcgaaaaatcaaaaaccgactatacgtaaaaaccataactaaaaaatcccctc

SEQ ID NO: 35765 - DNA, 526 bp, Artificial Sequence
  chemically treated genomic DNA (Homo sapiens) CpG-island No: 35765
ttttttttgcgtttttgggaagtggatattagtcgtcgtattagtttcgattcgtcgttgtcggtataggtattggaagttagttcgaaaggttattatatttaattagtggtgtagtcgttggggtggtataacgaatcgttgacggtcgtgatgtatggcgacgatgtttcgtagcgtggcgagcgtttattcgttggtttgtaatatgcgcggttgtataacggcgacgagcgtatcgaaattcgcgatgaggaatttgttttcgtataaagcgtttgataggttgagtgaatgttaaacgttcggaggcgtttttcgcgattcgggttttttaatggtaaggtttgtaatttgtagatttgataagacgcgtaaagcgtcgtattaggtatggcgtacgattgtcggatgcggcgtgaacgttttattcggtttatatttcgtttataaatcgtaggtttgataagacgcgtatagcgtcgtattaggtatttgcgtacgatttatttatgtttattatatt

SEQ ID NO: 35766 - DNA, 526 bp, Artificial Sequence
  chemically treated genomic DNA (Homo sapiens) CpG-island No: 35766
aatataataaacataaataaatcgtacgcaaatacctaatacgacgctatacgcgtcttatcaaacctacgatttataaacgaaatataaaccgaataaaacgttcacgccgcatccgacaatcgtacgccatacctaatacgacgctttacgcgtcttatcaaatctacaaattacaaaccttaccattaaaaaacccgaatcgcgaaaaacgcctccgaacgtttaacattcactcaacctatcaaacgctttatacgaaaacaaattcctcatcgcgaatttcgatacgctcgtcgccgttatacaaccgcgcatattacaaaccaacgaataaacgctcgccacgctacgaaacatcgtcgccatacatcacgaccgtcaacgattcgttataccaccccaacgactacaccactaattaaatataataacctttcgaactaacttccaatacctataccgacaacgacgaatcgaaactaatacgacgactaatatccacttcccaaaaacgcaaaaaaaa

SEQ ID NO: 35767 - DNA, 526 bp, Artificial Sequence
  chemically treated genomic DNA (Homo sapiens) CpG-island No: 35767
gatgtggtaaatatagataagtcgtgcgtagatgtttgatgcgacgttatgcgcgttttattaggtttacggtttatgggcgaagtgtagatcggataaggcgtttacgtcgtattcggtagtcgtgcgttatgtttgatgcgacgttttgcgcgttttattaggtttataggttataaattttgttattaaaaagttcggatcgcgggaagcgttttcgggcgtttaatatttatttaatttattaggcgttttgtgcgagagtaagttttttatcgcgggtttcgatacgttcgtcgtcgttatatagtcgcgtatgttgtagattaacgaataaacgttcgttacgttgcggggtatcgtcgttatgtattacgatcgttagcggttcgttgtattattttagcggttgtattattaattgggtgtagtgatttttcgggttggtttttagtatttgtatcggtagcggcgaatcgaggttggtacggcggttgatatttattttttaagggcgtaggaagag

SEQ ID NO: 35768 - DNA, 526 bp, Artificial Sequence
  chemically treated genomic DNA (Homo sapiens) CpG-island No: 35768
ctcttcctacgcccttaaaaaataaatatcaaccgccgtaccaacctcgattcgccgctaccgatacaaatactaaaaaccaacccgaaaaatcactacacccaattaataatacaaccgctaaaataatacaacgaaccgctaacgatcgtaatacataacgacgataccccgcaacgtaacgaacgtttattcgttaatctacaacatacgcgactatataacgacgacgaacgtatcgaaacccgcgataaaaaacttactctcgcacaaaacgcctaataaattaaataaatattaaacgcccgaaaacgcttcccgcgatccgaactttttaataacaaaatttataacctataaacctaataaaacgcgcaaaacgtcgcatcaaacataacgcacgactaccgaatacgacgtaaacgccttatccgatctacacttcgcccataaaccgtaaacctaataaaacgcgcataacgtcgcatcaaacatctacgcacgacttatctatatttaccacatc

SEQ ID NO: 35769 - DNA, 613 bp, Artificial Sequence
  chemically treated genomic DNA (Homo sapiens) CpG-island No: 35769
ggagtcgcgggtcgagggggttgtcgcgggtcgaggggttgtcgcgggtcgaggggtagttcggagcgggacgcggttcggttggtcgggttttttttagggtcggggaaggcgcggcgttggattcgcggggaggttatttattagttcgagcgcgaagaagacggcgagtagggcgaggtaggagtttatgacgatgagtagtaggaagacgatgagcgggtgttgttggtttatgtagtagtaggattcgtagagttagtttcgggatcgcggtagttcgttttcgtcgttcgtcgttttttcggagcggtttcgtaggtagtaggcggcgtcgtatcgtttttttgttttatatcggggtcgtttatagaggcgtttagtcgtgcgcgttcggttcgggtagcgtcgttcgtcgcggtcgttttgtgttttattttcgcgttcgttttaggttcggttcggattgtcggttattcggagttgcgtttaagggattttcgtgtacgggacggtatattcggaagttttcgagtttgtagacgcgattgtaacgtatcgtgatacgataggttattggaaagaaggaattattgatttatattcgattaaa

SEQ ID NO: 35770 - DNA, 613 bp, Artificial Sequence
  chemically treated genomic DNA (Homo sapiens) CpG-island No: 35770
tttaatcgaatataaatcaataattccttctttccaataacctatcgtatcacgatacgttacaatcgcgtctacaaactcgaaaacttccgaatataccgtcccgtacacgaaaatcccttaaacgcaactccgaataaccgacaatccgaaccgaacctaaaacgaacgcgaaaataaaacacaaaacgaccgcgacgaacgacgctacccgaaccgaacgcgcacgactaaacgcctctataaacgaccccgatataaaacaaaaaaacgatacgacgccgcctactacctacgaaaccgctccgaaaaaacgacgaacgacgaaaacgaactaccgcgatcccgaaactaactctacgaatcctactactacataaaccaacaacacccgctcatcgtcttcctactactcatcgtcataaactcctacctcgccctactcgccgtcttcttcgcgctcgaactaataaataacctccccgcgaatccaacgccgcgccttccccgaccctaaaaaaaacccgaccaaccgaaccgcgtcccgctccgaactacccctcgacccgcgacaacccctcgacccgcgacaaccccctcgacccgcgactcc

SEQ ID NO: 35771 - DNA, 613 bp, Artificial Sequence
  chemically treated genomic DNA (Homo sapiens) CpG-island No: 35771
tttggtcgaatgtgagttagtagttttttttttttagtgatttatcgtgttacgatacgttatagtcgcgtttgtagattcggggattttcgagtatgtcgtttcgtgtacggaggttttttgagcgtagtttcgggtagtcggtagttcgggtcggatttgaggcggacgcgagggtgggatatagggcggtcgcggcgagcggcgttgttcgggtcgggcgcgtacggttgggcgtttttgtgagcggtttcgatgtaggataggaggacgatgcggcgtcgtttgttatttgcgggatcgtttcgaggaggcggcgggcggcggagacgggttgtcgcggtttcgggattggttttacgagttttattattgtatgagttagtagtattcgtttatcgtttttttgttgtttatcgttatgggtttttgtttcgttttgttcgtcgtttttttcgcgttcgggttggtgagtggttttttcgcgggtttagcgtcgcgtttttttcggttttgagaggagttcggttagtcgagtcgcgtttcgtttcgggttgtttttcggttcgcggtagtttttcggttcgcggtagttttttcggttcgcggtttt

SEQ ID NO: 35772 - DNA, 613 bp, Artificial Sequence
  chemically treated genomic DNA (Homo sapiens) CpG-island No: 35772
aaaaccgcgaaccgaaaaaactaccgcgaaccgaaaaactaccgcgaaccgaaaaacaacccgaaacgaaacgcgactcgactaaccgaactcctctcaaaaccgaaaaaaacgcgacgctaaacccgcgaaaaaaccactcaccaacccgaacgcgaaaaaaacgacgaacaaaacgaaacaaaaacccataacgataaacaacaaaaaaacgataaacgaatactactaactcatacaataataaaactcgtaaaaccaatcccgaaaccgcgacaacccgtctccgccgcccgccgcctcctcgaaacgatcccgcaaataacaaacgacgccgcatcgtcctcctatcctacatcgaaaccgctcacaaaaacgcccaaccgtacgcgcccgacccgaacaacgccgctcgccgcgaccgccctatatcccaccctcgcgtccgcctcaaatccgacccgaactaccgactacccgaaactacgctcaaaaaacctccgtacacgaaacgacatactcgaaaatccccgaatctacaaacgcgactataacgtatcgtaacacgataaatcactaaaaaaaaaaaactactaactcacattcgaccaaa

SEQ ID NO: 35773 - DNA, 521 bp, Artificial Sequence
  chemically treated genomic DNA (Homo sapiens) CpG-island No: 35773
cgatacgattttagtattttaaattgttcgatgacgtttagtatttttttttttttatttcgtgattatatttcgttattagtgttgtattggtttttcggattaatttgtaatgacgagaattttattattaaggcgggtgtttagcgggtagcggcggaattggggattgtattggtgatgttagatattagttcgcgcggcgaaaaggttgttaacgacgatggttacgatttaggttaggcgtaggtttttattttaatgttacgtaatcgtcgtgggcgacgtattatcggatgtatgatatttgcgcgatgaatatcggcgttggtttagtcgtaatttaatgttagcgatcgttgcgttattagcggttatttaatgggtggttacggtgcgttgattatggcgttgaaaaattcgggtaaatatattagcgtttcggtttttgcgttaattgtgaattcgtgtagcgtttcgtggggaattaaagcgtttagtagttatttaggtgaggataa

SEQ ID NO: 35774 - DNA, 521 bp, Artificial Sequence
  chemically treated genomic DNA (Homo sapiens) CpG-island No: 35774
ttatcctcacctaaataactactaaacgctttaattccccacgaaacgctacacgaattcacaattaacgcaaaaaccgaaacgctaatatatttacccgaatttttcaacgccataatcaacgcaccgtaaccacccattaaataaccgctaataacgcaacgatcgctaacattaaattacgactaaaccaacgccgatattcatcgcgcaaatatcatacatccgataatacgtcgcccacgacgattacgtaacattaaaataaaaacctacgcctaacctaaatcgtaaccatcgtcgttaacaaccttttcgccgcgcgaactaatatctaacatcaccaatacaatccccaattccgccgctacccgctaaacacccgccttaataataaaattctcgtcattacaaattaatccgaaaaaccaatacaacactaataacgaaatataatcacgaaataaaaaaaaaaaaatactaaacgtcatcgaacaatttaaaatactaaaatcgtatcg

SEQ ID NO: 35775 - DNA, 521 bp, Artificial Sequence
  chemically treated genomic DNA (Homo sapiens) CpG-island No: 35775
ttgtttttatttaaatagttgttaaacgttttgattttttacgggacgttgtacggatttataattggcgtaaaggtcgaaacgttggtgtatttattcggattttttagcgttataattagcgtatcgtgattatttattgagtgatcgttaatggcgtagcggtcgttgatattaaattgcgattgaattagcgtcggtatttatcgcgtagatattatatattcggtaatgcgtcgtttacggcggttgcgtggtattaagataaaagtttgcgtttggtttaaatcgtagttatcgtcgttggtaattttttcgtcgcgcgggttggtgtttggtattattagtataatttttagtttcgtcgttattcgttgggtattcgttttggtggtgaagttttcgttattgtaggttaattcggaaagttagtatagtattggtggcggagtgtgattacgaggtggagggagaaagatattgaacgttatcgggtagtttaaggtattggagtcgtgtcg

SEQ ID NO: 35776 - DNA, 521 bp, Artificial Sequence
  chemically treated genomic DNA (Homo sapiens) CpG-island No: 35776
cgacacgactccaataccttaaactacccgataacgttcaatatctttctccctccacctcgtaatcacactccgccaccaatactatactaactttccgaattaacctacaataacgaaaacttcaccaccaaaacgaatacccaacgaataacgacgaaactaaaaattatactaataataccaaacaccaacccgcgcgacgaaaaaattaccaacgacgataactacgatttaaaccaaacgcaaacttttatcttaataccacgcaaccgccgtaaacgacgcattaccgaatatataatatctacgcgataaataccgacgctaattcaatcgcaatttaatatcaacgaccgctacgccattaacgatcactcaataaataatcacgatacgctaattataacgctaaaaaatccgaataaatacaccaacgtttcgacctttacgccaattataaatccgtacaacgtcccgtaaaaaatcaaaacgtttaacaactatttaaataaaaacaa

SEQ ID NO: 35777 - DNA, 534 bp, Artificial Sequence
  chemically treated genomic DNA (Homo sapiens) CpG-island No: 35777
cgtttaggatttagtcgcgttcgggcgtttcgattcggaggttggcggcgggtaggtacgttttttcgcgttgagagtttttttgcggagatgaattttcgagtgtcgtcgtcgcgcgcgggttcgatcgatatcggcgggcggacgtgttttcgtcgtcgatagtagttatagggcggtgtagttagttgttcggtcgttcggtcgtattttttattagtttaatattcgtagaggacgtgtatcggttttttttcggatatttatttcgtggttttcgtcgtattttttgtttatcgtttttttcgttcggtcgttcggcgtagagcgggagttttttagttagacgttttcgcgttgggggtagtcgggtttcggttcgagcggagggcgtcgtgaggtggttttttcgttcggttttttagtgggacgtttcgcggaggtagttaaggcggggagtgtcgagtttttttatattttggattttattttttggcgttttcgttcgggaggttgtagggggaggcggattta

SEQ ID NO: 35778 - DNA, 534 bp, Artificial Sequence
  chemically treated genomic DNA (Homo sapiens) CpG-island No: 35778
taaatccgcctccccctacaacctcccgaacgaaaacgccaaaaaataaaatccaaaatataaaaaaactcgacactccccgccttaactacctccgcgaaacgtcccactaaaaaaccgaacgaaaaaaccacctcacgacgccctccgctcgaaccgaaacccgactacccccaacgcgaaaacgtctaactaaaaaactcccgctctacgccgaacgaccgaacgaaaaaaacgataaacaaaaaatacgacgaaaaccacgaaataaatatccgaaaaaaaaccgatacacgtcctctacgaatattaaactaataaaaaatacgaccgaacgaccgaacaactaactacaccgccctataactactatcgacgacgaaaacacgtccgcccgccgatatcgatcgaacccgcgcgcgacgacgacactcgaaaattcatctccgcaaaaaaactctcaacgcgaaaaaacgtacctacccgccgccaacctccgaatcgaaacgcccgaacgcgactaaatcctaaacg

SEQ ID NO: 35779 - DNA, 534 bp, Artificial Sequence
  chemically treated genomic DNA (Homo sapiens) CpG-island No: 35779
tgggttcgtttttttttgtagtttttcgggcgaagacgttagaaggtaaggtttagagtgtgagggagttcgatatttttcgttttggttgttttcgcggagcgttttattggggagtcgggcgaaaaggttattttacgacgtttttcgttcgggtcgggattcggttgtttttaacgcgagggcgtttggttgaaaagttttcgttttgcgtcggacggtcgagcggaaggggcggtgggtagaaggtgcggcggagattacggggtgggtgttcgggagggaatcggtgtacgttttttgcgggtattgagttgatgagaagtgcgatcgagcggtcggatagttgattgtatcgttttgtggttgttgtcggcggcgggagtacgttcgttcgtcggtatcgatcgggttcgcgcgcggcggcgatattcgagagtttattttcgtagaagggtttttagcgcgggagagcgtgtttgttcgtcgttagttttcgagtcgggacgttcgagcgcggttgggttttgggcg

SEQ ID NO: 35780 - DNA, 534 bp, Artificial Sequence
  chemically treated genomic DNA (Homo sapiens) CpG-island No: 35780
cgcccaaaacccaaccgcgctcgaacgtcccgactcgaaaactaacgacgaacaaacacgctctcccgcgctaaaaacccttctacgaaaataaactctcgaatatcgccgccgcgcgcgaacccgatcgataccgacgaacgaacgtactcccgccgccgacaacaaccacaaaacgatacaatcaactatccgaccgctcgatcgcacttctcatcaactcaatacccgcaaaaaacgtacaccgattccctcccgaacacccaccccgtaatctccgccgcaccttctacccaccgccccttccgctcgaccgtccgacgcaaaacgaaaacttttcaaccaaacgccctcgcgttaaaaacaaccgaatcccgacccgaacgaaaaacgtcgtaaaataaccttttcgcccgactccccaataaaacgctccgcgaaaacaaccaaaacgaaaaatatcgaactccctcacactctaaaccttaccttctaacgtcttcgcccgaaaaactacaaaaaaaaacgaaccca

SEQ ID NO: 35781 - DNA, 573 bp, Artificial Sequence
  chemically treated genomic DNA (Homo sapiens) CpG-island No: 35781
ggtatacgcgtcgtggtaaggtaagcgagggcgttcggtttcggtatcgtttcgcgtcggttttcgtttttttttttttcgaaaggcggttttgtgttgttgcgtagcgcggcggttgggggtggggtttatcgcggttttcgatttcgttatcgcgagaagtcggttcgcgattttgtggtcgttttttttttttttttgtttttcggattcgggttgcggcgttacgtttttcgggtttcggtagcggtacgattcgttcgttttagttttagcgtttttcggttattttcggtttaggttcgtagcgtcgttcgttttcggtcgtttcgacgtcggtttgggcgtcggtcgtagtttcgggttcgcgtaggcgtcgatcgttttcggttcgttttttatgggtttcggttagaggcgtcgcgtcgtcggttcgcggagtttcgatgttggttcggaggaagtcggtgttgtcggcgtttattattaattttattatcgtcgagggtttattttttattagcgagggcgttttcgagtgagtgggtaggggttagtcggaggtttggggtg

SEQ ID NO: 35782 - DNA, 573 bp, Artificial Sequence
  chemically treated genomic DNA (Homo sapiens) CpG-island No: 35782
caccccaaacctccgactaacccctacccactcactcgaaaacgccctcgctaataaaaaataaaccctcgacgataataaaattaataataaacgccgacaacaccgacttcctccgaaccaacatcgaaactccgcgaaccgacgacgcgacgcctctaaccgaaacccataaaaaacgaaccgaaaacgatcgacgcctacgcgaacccgaaactacgaccgacgcccaaaccgacgtcgaaacgaccgaaaacgaacgacgctacgaacctaaaccgaaaataaccgaaaaacgctaaaactaaaacgaacgaatcgtaccgctaccgaaacccgaaaaacgtaacgccgcaacccgaatccgaaaaacaaaaaaaaaaaaaaaacgaccacaaaatcgcgaaccgacttctcgcgataacgaaatcgaaaaccgcgataaaccccacccccaaccgccgcgctacgcaacaacacaaaaccgcctttcgaaaaaaaaaaaaacgaaaaccgacgcgaaacgataccgaaaccgaacgccctcgcttaccttaccacgacgcgtatacc

SEQ ID NO: 35783 - DNA, 573 bp, Artificial Sequence
  chemically treated genomic DNA (Homo sapiens) CpG-island No: 35783
tattttaagttttcggttgatttttgtttatttattcggaggcgttttcgttggtaggggatgggttttcggcgatggtagggttgatggtgagcgtcggtagtatcggtttttttcgggttagtatcggggtttcgcgggtcggcggcgcggcgtttttagtcggggtttatagggggcgggtcgggagcggtcggcgtttacgcgagttcggggttgcggtcggcgtttaggtcggcgtcggggcggtcgagggcgggcggcgttgcgggtttgggtcgagggtagtcgaggggcgttggggttgaggcgagcgagtcgtatcgttgtcgaggttcgaagaacgtgacgtcgtagttcgagttcgagaggtagggggaggggaggggcggttataagatcgcggatcggtttttcgcgataacgggatcgggagtcgcgatggattttatttttagtcgtcgcgttgcgtagtagtataaggtcgtttttcggaggggaaaggggcggagatcgacgcgaggcggtgtcgggatcgggcgttttcgtttgttttattacggcgcgtgtgtt

SEQ ID NO: 35784 - DNA, 573 bp, Artificial Sequence
  chemically treated genomic DNA (Homo sapiens) CpG-island No: 35784
aacacacgcgccgtaataaaacaaacgaaaacgcccgatcccgacaccgcctcgcgtcgatctccgcccctttcccctccgaaaaacgaccttatactactacgcaacgcgacgactaaaaataaaatccatcgcgactcccgatcccgttatcgcgaaaaaccgatccgcgatcttataaccgcccctcccctccccctacctctcgaactcgaactacgacgtcacgttcttcgaacctcgacaacgatacgactcgctcgcctcaaccccaacgcccctcgactaccctcgacccaaacccgcaacgccgcccgccctcgaccgccccgacgccgacctaaacgccgaccgcaaccccgaactcgcgtaaacgccgaccgctcccgacccgccccctataaaccccgactaaaaacgccgcgccgccgacccgcgaaaccccgatactaacccgaaaaaaaccgatactaccgacgctcaccatcaaccctaccatcgccgaaaacccatcccctaccaacgaaaacgcctccgaataaataaacaaaaatcaaccgaaaacttaaaata

SEQ ID NO: 35785 - DNA, 576 bp, Artificial Sequence
  chemically treated genomic DNA (Homo sapiens) CpG-island No: 35785
tcggatgttggtttggcgttggggtagcgttcgggaagtaggtggttttaggtgagggaggtcgaggtttcggggcgttttttgtttttcgggttttgcgtagggaggagcgtatcgggcgttagcgttttcgtgtggtcgcgagtatcgcgcgcgtaaagggggggcgagcgtcgttcggggcgtgggtgacggggttggtattaaggtagagggcggtcgggtagggaggaggggtagtttcgttagcgtcgagtttagttttgaagtcgtttcggttgtgtagatgatgagcgatttaggtcgaggcgaattaggagtttaggtgtttgtttaagtatagttggacgaaatgtttgttatttcgacggttggggcgcgggattttgtagggacgtggtgttgtagcggtttttgtttgggtttggcgtgcggttattttaggttaattttttattcgttgcgtggattcgttttcgggaggcggttttacgtttttagtttgtggattaataaggcggagaattatttttgtattttcgtcgggaaattagtttttattttcggttttttgtt

SEQ ID NO: 35786 - DNA, 576 bp, Artificial Sequence
  chemically treated genomic DNA (Homo sapiens) CpG-island No: 35786
aacaaaaaaccgaaaataaaaactaatttcccgacgaaaatacaaaaataattctccgccttattaatccacaaactaaaaacgtaaaaccgcctcccgaaaacgaatccacgcaacgaataaaaaattaacctaaaataaccgcacgccaaacccaaacaaaaaccgctacaacaccacgtccctacaaaatcccgcgccccaaccgtcgaaataacaaacatttcgtccaactatacttaaacaaacacctaaactcctaattcgcctcgacctaaatcgctcatcatctacacaaccgaaacgacttcaaaactaaactcgacgctaacgaaactacccctcctccctacccgaccgccctctaccttaataccaaccccgtcacccacgccccgaacgacgctcgccccccctttacgcgcgcgatactcgcgaccacacgaaaacgctaacgcccgatacgctcctccctacgcaaaacccgaaaaacaaaaaacgccccgaaacctcgacctccctcacctaaaaccacctacttcccgaacgctaccccaacgccaaaccaacatccga

SEQ ID NO: 35787 - DNA, 576 bp, Artificial Sequence
  chemically treated genomic DNA (Homo sapiens) CpG-island No: 35787
aatagggggtcggaggtaggagttggtttttcggcgagggtgtaaaggtggtttttcgttttgttgatttataggttggaaacgtggggtcgtttttcgggggcgaatttacgtagcgaatggagaattagtttgaggtagtcgtacgttaggtttaggtagaggtcgttgtagtattacgtttttgtaaggtttcgcgttttagtcgtcggggtaatagatatttcgtttagttgtgtttgggtaagtatttgggtttttgattcgtttcgatttgggtcgtttattatttgtatagtcgaaacgattttagggttgggttcggcgttggcggggttgttttttttttttgttcggtcgttttttattttgatgttagtttcgttatttacgtttcgggcggcgttcgttttttttttgcgcgcgcggtgttcgcggttatacgggggcgttggcgttcgatgcgtttttttttgcgtagaattcggagaataaagggcgtttcgggatttcggttttttttatttggagttatttgtttttcgggcgttgttttagcgttaggttagtattcgg

SEQ ID NO: 35788 - DNA, 576 bp, Artificial Sequence
  chemically treated genomic DNA (Homo sapiens) CpG-island No: 35788
ccgaatactaacctaacgctaaaacaacgcccgaaaaacaaataactccaaataaaaaaaaccgaaatcccgaaacgccctttattctccgaattctacgcaaaaaaaaacgcatcgaacgccaacgcccccgtataaccgcgaacaccgcgcgcgcaaaaaaaaaacgaacgccgcccgaaacgtaaataacgaaactaacatcaaaataaaaaacgaccgaacaaaaaaaaaaaacaaccccgccaacgccgaacccaaccctaaaatcgtttcgactatacaaataataaacgacccaaatcgaaacgaatcaaaaacccaaatacttacccaaacacaactaaacgaaatatctattaccccgacgactaaaacgcgaaaccttacaaaaacgtaatactacaacgacctctacctaaacctaacgtacgactacctcaaactaattctccattcgctacgtaaattcgcccccgaaaaacgaccccacgtttccaacctataaatcaacaaaacgaaaaaccacctttacaccctcgccgaaaaaccaactcctacctccgaccccctatt

SEQ ID NO: 35789 - DNA, 612 bp, Artificial Sequence
  chemically treated genomic DNA (Homo sapiens) CpG-island No: 35789
aacggtatttttcggaacggtcgtaaattcgtttaaattcgattggatatcgttatcgatttttatttcggattcggatattcgtacgcgcgtttgatatttcggtatcggtaagcgatttgtggtttcgtatttcgaatatcggcgtttcgttattgcgaatatcggaatcgagacggcgatattcgtatttttgaaattttaaatttcgttttcgtatttcgcgatttttcgaaatcgacgtattatcgaatcgaatattcggttatcgcggattttcgaatttcgtttagtcgatatcggttattcgttaattttttaatttcgtatgcggttaatttttatttcgatatttttaattttgagtttttagatttcggtatacgtggtttacgggcgatcgtagaattcgagattgaggtatttcgttatgttggagaatcgtattttcgtattttcgggttttcgcgatttcggtatattgttttttcgcgatcgtcgggtatcgttatttcgtgttattttttatatttttacgatttatattttacgaaattatcgtgtcgtttgtatttttatttttttttatttttcggaaattcgcgaatttta

SEQ ID NO: 35790 - DNA, 612 bp, Artificial Sequence
  chemically treated genomic DNA (Homo sapiens) CpG-island No: 35790
taaaattcgcgaatttccgaaaaataaaaaaaaataaaaatacaaacgacacgataatttcgtaaaatataaatcgtaaaaatataaaaaataacacgaaataacgatacccgacgatcgcgaaaaaacaatataccgaaatcgcgaaaacccgaaaatacgaaaatacgattctccaacataacgaaatacctcaatctcgaattctacgatcgcccgtaaaccacgtataccgaaatctaaaaactcaaaattaaaaatatcgaaataaaaattaaccgcatacgaaattaaaaaattaacgaataaccgatatcgactaaacgaaattcgaaaatccgcgataaccgaatattcgattcgataatacgtcgatttcgaaaaatcgcgaaatacgaaaacgaaatttaaaatttcaaaaatacgaatatcgccgtctcgattccgatattcgcaataacgaaacgccgatattcgaaatacgaaaccacaaatcgcttaccgataccgaaatatcaaacgcgcgtacgaatatccgaatccgaaataaaaatcgataacgatatccaatcgaatttaaacgaatttacgaccgttccgaaaaataccgtt

SEQ ID NO: 35791 - DNA, 612 bp, Artificial Sequence
  chemically treated genomic DNA (Homo sapiens) CpG-island No: 35791
tggaattcgcgagttttcgaagagtaagagagagtggaagtataggcgatacggtagtttcgtgaagtatgagtcgtgagaatgtgagaggtggtacggggtggcgatgttcggcgatcgcgggagagtaatatgtcggagtcgcggagattcggaagtacggaggtgcggttttttagtatgacggagtattttaatttcggattttacgatcgttcgtggattacgtgtatcgaagtttaggagtttagagttggaggtgtcgggatggaggttagtcgtatgcgaggttgagaagttggcgagtgatcgatatcggttgagcggagttcgagagttcgcgatgatcgagtattcgattcggtagtgcgtcggtttcgagaagtcgcggagtgcgagagcgaagtttgggattttaagaatgcgagtatcgtcgtttcggtttcggtgttcgtaatagcgagacgtcgatgttcgaagtacgaagttatagatcgtttgtcggtatcggaatattagacgcgcgtgcgggtattcgagttcgaggtgggaatcgatagcgatatttaatcggatttgggcgagtttgcgatcgtttcggaaggtatcgtt

SEQ ID NO: 35792 - DNA, 612 bp, Artificial Sequence
  chemically treated genomic DNA (Homo sapiens) CpG-island No: 35792
aacgataccttccgaaacgatcgcaaactcgcccaaatccgattaaatatcgctatcgattcccacctcgaactcgaatacccgcacgcgcgtctaatattccgataccgacaaacgatctataacttcgtacttcgaacatcgacgtctcgctattacgaacaccgaaaccgaaacgacgatactcgcattcttaaaatcccaaacttcgctctcgcactccgcgacttctcgaaaccgacgcactaccgaatcgaatactcgatcatcgcgaactctcgaactccgctcaaccgatatcgatcactcgccaacttctcaacctcgcatacgactaacctccatcccgacacctccaactctaaactcctaaacttcgatacacgtaatccacgaacgatcgtaaaatccgaaattaaaatactccgtcatactaaaaaaccgcacctccgtacttccgaatctccgcgactccgacatattactctcccgcgatcgccgaacatcgccaccccgtaccacctctcacattctcacgactcatacttcacgaaactaccgtatcgcctatacttccactctctcttactcttcgaaaactcgcgaattcca

SEQ ID NO: 35793 - DNA, 990 bp, Artificial Sequence
  chemically treated genomic DNA (Homo sapiens) CpG-island No: 35793
tagtcgggaggcggattgggtttagtagtatcgacgcgggggtagcgaggcgtcgcgcggggcgaaataggtgggattcggcgtagattttagggtgtattttcgggtttgtttatttatttttattcgcgcgttttttcgtcgcggtttttgtttcgcgtttcgttttagtcggtttgcgagtcgcggaggattcgggaagaattttttttttaatttggtcgggttttttcgttttatttttatttttatttttttttttttttttgttttagatttgtttttcgtagatacgtgggttgcggcggtggattagggaaaaagttgcgggaatttcggagtggaagtcgtttaagcgtattcgatcggggcgttcggttttaagtagtttttcgcgtttcgagttttagatataaaaggcggggatacgagttcggggattttcgcgtcgggaggttttttaatttcgtgtcgcgtatttattttatcgaggcggcggcggcgtttttcggatttagttggttgttttatttcgttcgtcgtttttttaggaaaacgcggtcgtcgggttcgttttttgttcggttttttgcgtcgtagtttttttttttttttcgttgcgggggttagtgggcgtcgagttttcgggttaggtcggcggggcgggggtagcggtagtattattacgtggtcgtcgggcgtcggttttcgtcgatttggatttagtgggagcgggaagggaggcgttaattattttttttttattttatttttcgcggttttaaatttcgcgagttaggtgattcggtttcgggttttggtcgggatttgcggggggtgtttttcgttttttagttttcggcgtattttttcggttcgcgcgtttcggttgttcgtggtttgtttttagtttttagggatcgtgggattttttttcgcggatttgttttatttttttaatttgaagttagtggaagttttttacgtttt

SEQ ID NO: 35794 - DNA, 990 bp, Artificial Sequence
  chemically treated genomic DNA (Homo sapiens) CpG-island No: 35794
aaaacgtaaaaaacttccactaacttcaaattaaaaaaataaaacaaatccgcgaaaaaaaatcccacgatccctaaaaactaaaaacaaaccacgaacaaccgaaacgcgcgaaccgaaaaaatacgccgaaaactaaaaaacgaaaaacaccccccgcaaatcccgaccaaaacccgaaaccgaatcacctaactcgcgaaatttaaaaccgcgaaaaataaaataaaaaaaaaataattaacgcctcccttcccgctcccactaaatccaaatcgacgaaaaccgacgcccgacgaccacgtaataatactaccgctacccccgccccgccgacctaacccgaaaactcgacgcccactaacccccgcaacgaaaaaaaaaaaaaaactacgacgcaaaaaaccgaacaaaaaacgaacccgacgaccgcgttttcctaaaaaaacgacgaacgaaataaaacaaccaactaaatccgaaaaacgccgccgccgcctcgataaaataaatacgcgacacgaaattaaaaaacctcccgacgcgaaaatccccgaactcgtatccccgccttttatatctaaaactcgaaacgcgaaaaactacttaaaaccgaacgccccgatcgaatacgcttaaacgacttccactccgaaattcccgcaactttttccctaatccaccgccgcaacccacgtatctacgaaaaacaaatctaaaacaaaaaaaaaaaaaaaaataaaaataaaaataaaacgaaaaaacccgaccaaattaaaaaaaaaattcttcccgaatcctccgcgactcgcaaaccgactaaaacgaaacgcgaaacaaaaaccgcgacgaaaaaacgcgcgaataaaaataaataaacaaacccgaaaatacaccctaaaatctacgccgaatcccacctatttcgccccgcgcgacgcctcgctacccccgcgtcgatactactaaacccaatccgcctcccgacta

SEQ ID NO: 35795 - DNA, 990 bp, Artificial Sequence
  chemically treated genomic DNA (Homo sapiens) CpG-island No: 35795
agagcgtggggggtttttattaattttaggttaagaggatgaaatagattcgcggagaagggttttacgatttttggagattaaaagtaagttacgaatagtcgggacgcgcgggtcggggagatgcgtcgggggttggagggcggagagtatttttcgtaggtttcggttagagttcggggtcgggttatttgattcgcggaatttggggtcgcgaggggtggaatgggaggggaatggttagcgttttttttttcgtttttattggatttaggtcggcgggggtcggcgttcggcggttacgtggtggtgttgtcgttgttttcgtttcgtcggtttagttcgggagttcggcgtttattgattttcgtagcgggggaggaggagggattgcggcgtaggaagtcgagtaggaagcgagttcggcggtcgcgtttttttggggaagcggcgggcggggtggagtagttagttgggttcggggagcgtcgtcgtcgtttcgatggggtgagtgcgcggtacggagttgggaggtttttcggcgcgggggttttcgggttcgtgttttcgttttttgtgtttggagttcggggcgcgggaggttgtttgggatcgggcgtttcggtcggatgcgtttgagcggtttttatttcggggttttcgtaattttttttttggtttatcgtcgtagtttacgtgtttgcggagagtagatttgggataagagaaggagaggaagtggagatgagggtagagcgggaagattcggttaagttaggagaagggtttttttcgggtttttcgcgattcgtaggtcggttggggcggggcgcggggtaggggtcgcggcggaggagcgcgcgggtgggaatgaatgagtagattcggagatgtattttggagtttgcgtcgggttttatttgtttcgtttcgcgcggcgtttcgttgttttcgcgtcggtgttgttgagtttaattcgtttttcggttg

SEQ ID NO: 35796 - DNA, 990 bp, Artificial Sequence
  chemically treated genomic DNA (Homo sapiens) CpG-island No: 35796
caaccgaaaaacgaattaaactcaacaacaccgacgcgaaaacaacgaaacgccgcgcgaaacgaaacaaataaaacccgacgcaaactccaaaatacatctccgaatctactcattcattcccacccgcgcgctcctccgccgcgacccctaccccgcgccccgccccaaccgacctacgaatcgcgaaaaacccgaaaaaaacccttctcctaacttaaccgaatcttcccgctctaccctcatctccacttcctctccttctcttatcccaaatctactctccgcaaacacgtaaactacgacgataaaccaaaaaaaaaattacgaaaaccccgaaataaaaaccgctcaaacgcatccgaccgaaacgcccgatcccaaacaacctcccgcgccccgaactccaaacacaaaaaacgaaaacacgaacccgaaaacccccgcgccgaaaaacctcccaactccgtaccgcgcactcaccccatcgaaacgacgacgacgctccccgaacccaactaactactccaccccgcccgccgcttccccaaaaaaacgcgaccgccgaactcgcttcctactcgacttcctacgccgcaatccctcctcctcccccgctacgaaaatcaataaacgccgaactcccgaactaaaccgacgaaacgaaaacaacgacaacaccaccacgtaaccgccgaacgccgacccccgccgacctaaatccaataaaaacgaaaaaaaaaacgctaaccattcccctcccattccacccctcgcgaccccaaattccgcgaatcaaataacccgaccccgaactctaaccgaaacctacgaaaaatactctccgccctccaacccccgacgcatctccccgacccgcgcgtcccgactattcgtaacttacttttaatctccaaaaatcgtaaaacccttctccgcgaatctatttcatcctcttaacctaaaattaataaaaaccccccacgctct

SEQ ID NO: 35797 - DNA, 1010 bp, Artificial Sequence
  chemically treated genomic DNA (Homo sapiens) CpG-island No: 35797
agacgagttgggatcgagcgcggtttttattagcgagcgttgcgaagagcgtggtggggacgcggtcgatttacgtcggggagattatcgttcggatttggcgcgacgtcgcgttattttggtagtttggacgagtcggcgcgggcggcgacggcgacgattataagagtagtagcgaggagatcggtagtagcgaggatttatagttacgtggcggttatttcgagggttatttatgttcgtatttggttatgggagttcgagagtttcggtgataatttgtacgtgtgtatttcgtgcggtaagggtttttttagttttgagtagttgaacgcgtacgtggaggtttacgtggaggaggaggaagcgttgtacggtagggcgaggcgcgaagtggcgggggcgtcggttagggttttttttggaggcggcggggataaggtcgtcggggtttcgggtggtttgggagagttgttgcgttttatcgttgcggtcgtgcgataagagttataaggattcggttacgttgcggtatacgagaagacgtattggttgattcggttttatttatgtattatttgcgggaagaagtttacgtagcgtgggattatgacgcgttatatgcgagttatttgggttttaagttttcgcgtggatttgcgtatgcggtttacggttagtatcgttttacggagtatatgcgtatttattcgggcgagaagtttacgagtgttaggtgtgcggcggtaagttcgtatagtaacgtaattttattagttatatgaagatgtacgtcgtgggggggcggcggggcgggcgttggcgggtttgggggggtttttcggcgttttcggtttcgacgtaagggtaagttcgattttttcgagggcgtttttgttgtggttcgttttacggtcgagtagttgagtttgaagtagtaggataaggcggtcgggtagttgttggcgtagattacgtattttttgtacgattttaaggtggcgttggag

SEQ ID NO: 35798 - DNA, 1010 bp, Artificial Sequence
  chemically treated genomic DNA (Homo sapiens) CpG-island No: 35798
ctccaacgccaccttaaaatcgtacaaaaaatacgtaatctacgccaacaactacccgaccgccttatcctactacttcaaactcaactactcgaccgtaaaacgaaccacaacaaaaacgccctcgaaaaaatcgaacttacccttacgtcgaaaccgaaaacgccgaaaaacccccccaaacccgccaacgcccgccccgccgcccccccacgacgtacatcttcatataactaataaaattacgttactatacgaacttaccgccgcacacctaacactcgtaaacttctcgcccgaataaatacgcatatactccgtaaaacgatactaaccgtaaaccgcatacgcaaatccacgcgaaaacttaaaacccaaataactcgcatataacgcgtcataatcccacgctacgtaaacttcttcccgcaaataatacataaataaaaccgaatcaaccaatacgtcttctcgtataccgcaacgtaaccgaatccttataactcttatcgcacgaccgcaacgataaaacgcaacaactctcccaaaccacccgaaaccccgacgaccttatccccgccgcctccaaaaaaaaccctaaccgacgcccccgccacttcgcgcctcgccctaccgtacaacgcttcctcctcctccacgtaaacctccacgtacgcgttcaactactcaaaactaaaaaaacccttaccgcacgaaatacacacgtacaaattatcaccgaaactctcgaactcccataaccaaatacgaacataaataaccctcgaaataaccgccacgtaactataaatcctcgctactaccgatctcctcgctactactcttataatcgtcgccgtcgccgcccgcgccgactcgtccaaactaccaaaataacgcgacgtcgcgccaaatccgaacgataatctccccgacgtaaatcgaccgcgtccccaccacgctcttcgcaacgctcgctaataaaaaccgcgctcgatcccaactcgtct

SEQ ID NO: 35799 - DNA, 1010 bp, Artificial Sequence
  chemically treated genomic DNA (Homo sapiens) CpG-island No: 35799
ttttagcgttattttggggtcgtgtaggaagtgcgtggtttgcgttagtagttgttcggtcgttttgttttgttgttttaggtttagttgttcggtcgtgaggcgagttatagtaaagacgttttcggggaagtcgagtttgtttttgcgtcggggtcggggacgtcggggagtttttttaagttcgttagcgttcgtttcgtcgtttttttacggcgtgtatttttatgtggttgatgaggttgcgttgttgtgcgaatttgtcgtcgtatatttggtattcgtaggtttttcgttcgagtggatgcgtatgtgtttcgtgaggcggtattggtcgtgaatcgtatgcgtaggtttacgcgaaggtttgaggtttaggtggttcgtatgtggcgcgttatggttttacgttgcgtgaattttttttcgtagatggtgtatgggtagggtcgggttagttagtgcgttttttcgtgtgtcgtagcgtggtcgggtttttgtagtttttgtcgtacgatcgtagcggtagggcgtagtagtttttttaggttattcggagtttcggcgattttgttttcgtcgtttttaaaaggggttttagtcggcgttttcgttatttcgcgtttcgttttgtcgtatagcgttttttttttttttacgtgagtttttacgtgcgcgtttagttgtttagagttggggaagtttttgtcgtacggaatgtatacgtataggttgttatcgaagttttcgggtttttatagttaggtgcgggtatgggtagttttcgaggtggtcgttacgtggttgtgggttttcgttgttatcggttttttcgttgttgtttttgtagtcgtcgtcgtcgtcgttcgcgtcggttcgtttaggttgttagggtagcgcggcgtcgcgttaggttcgagcggtggttttttcggcgtagatcggtcgcgtttttattacgtttttcgtagcgttcgttggtgggagtcgcgttcggttttagttcgttt

SEQ ID NO: 35800 - DNA, 1010 bp, Artificial Sequence
  chemically treated genomic DNA (Homo sapiens) CpG-island No: 35800
aaacgaactaaaaccgaacgcgactcccaccaacgaacgctacgaaaaacgtaataaaaacgcgaccgatctacgccgaaaaaaccaccgctcgaacctaacgcgacgccgcgctaccctaacaacctaaacgaaccgacgcgaacgacgacgacgacgactacaaaaacaacaacgaaaaaaccgataacaacgaaaacccacaaccacgtaacgaccacctcgaaaactacccatacccgcacctaactataaaaacccgaaaacttcgataacaacctatacgtatacattccgtacgacaaaaacttccccaactctaaacaactaaacgcgcacgtaaaaactcacgtaaaaaaaaaaaaaacgctatacgacaaaacgaaacgcgaaataacgaaaacgccgactaaaaccccttttaaaaacgacgaaaacaaaatcgccgaaactccgaataacctaaaaaaactactacgccctaccgctacgatcgtacgacaaaaactacaaaaacccgaccacgctacgacacacgaaaaaacgcactaactaacccgaccctacccatacaccatctacgaaaaaaaattcacgcaacgtaaaaccataacgcgccacatacgaaccacctaaacctcaaaccttcgcgtaaacctacgcatacgattcacgaccaataccgcctcacgaaacacatacgcatccactcgaacgaaaaacctacgaataccaaatatacgacgacaaattcgcacaacaacgcaacctcatcaaccacataaaaatacacgccgtaaaaaaacgacgaaacgaacgctaacgaacttaaaaaaactccccgacgtccccgaccccgacgcaaaaacaaactcgacttccccgaaaacgtctttactataactcgcctcacgaccgaacaactaaacctaaaacaacaaaacaaaacgaccgaacaactactaacgcaaaccacgcacttcctacacgaccccaaaataacgctaaaa

SEQ ID NO: 35801 - DNA, 578 bp, Artificial Sequence
  chemically treated genomic DNA (Homo sapiens) CpG-island No: 35801
gcgcgtttcgcgagcggttttttaaatgggtgcgagagggaagagggtagagcgcggcggggcgttcggggggcgttcggtattcgaggcgggcgtacgtatttaaataggagagcggcgttcggagttatttagtgcgggtagaagagcggggcgaggagcggggtcgcgttcgttggaggcgcggggcgagcggaggaagaggaggaggagagtagaaggaaggggaagcggttcgtatttgttgcgcgtcggggcgtttgttgtttttttttcggtatgatgttttttcggcgattgttattgtcgtcgtcgtcgtcgttgtcgggttgaggatagggagggagggggcggcgggttcgcgggggggcgaggcgggtttgtttttagtttttttttcggagagcggcgttcgtaggatgttgttgcgtttaggtttttcgcgtgtttttcgcgtcgcgtttcggcgcgaatttcgaacgtgcggagggaagaaggagggcgggcgagggaggttcggggagggaggagtacgggggggaggaggaggtaaggaagacgacgtggaggaggaggaa

SEQ ID NO: 35802 - DNA, 578 bp, Artificial Sequence
  chemically treated genomic DNA (Homo sapiens) CpG-island No: 35802
ttcctcctcctccacgtcgtcttccttacctcctcctcccccccgtactcctccctccccgaacctccctcgcccgccctccttcttccctccgcacgttcgaaattcgcgccgaaacgcgacgcgaaaaacacgcgaaaaacctaaacgcaacaacatcctacgaacgccgctctccgaaaaaaaaactaaaaacaaacccgcctcgcccccccgcgaacccgccgccccctccctccctatcctcaacccgacaacgacgacgacgacgacaataacaatcgccgaaaaaacatcataccgaaaaaaaaacaacaaacgccccgacgcgcaacaaatacgaaccgcttccccttccttctactctcctcctcctcttcctccgctcgccccgcgcctccaacgaacgcgaccccgctcctcgccccgctcttctacccgcactaaataactccgaacgccgctctcctatttaaatacgtacgcccgcctcgaataccgaacgccccccgaacgccccgccgcgctctaccctcttccctctcgcacccatttaaaaaaccgctcgcgaaacgcgc

SEQ ID NO: 35803 - DNA, 578 bp, Artificial Sequence
  chemically treated genomic DNA (Homo sapiens) CpG-island No: 35803
tttttttttttttacgtcgttttttttgtttttttttttttttcgtgttttttttttttcgagtttttttcgttcgttttttttttttttttcgtacgttcggggttcgcgtcggagcgcggcgcggggggtacgcggagagtttgggcgtagtagtattttgcgggcgtcgtttttcgggggggaggttgagagtaggttcgtttcgttttttcgcgggttcgtcgttttttttttttttgtttttagttcggtagcggcggcggcggcggtagtggtagtcgtcggagaagtattatgtcgaggaggaagtagtaggcgtttcggcgcgtagtaggtacgagtcgtttttttttttttttgttttttttttttttttttttcgttcgtttcgcgtttttagcgggcgcgatttcgtttttcgtttcgtttttttgttcgtattgagtaatttcgggcgtcgtttttttgtttgggtgcgtgcgttcgtttcgggtatcgggcgtttttcggacgtttcgtcgcgttttgtttttttttttttcgtatttatttggggagtcgttcgcggagcgcgt

SEQ ID NO: 35804 - DNA, 578 bp, Artificial Sequence
  chemically treated genomic DNA (Homo sapiens) CpG-island No: 35804
acgcgctccgcgaacgactccccaaataaatacgaaaaaaaaaaaaacaaaacgcgacgaaacgtccgaaaaacgcccgatacccgaaacgaacgcacgcacccaaacaaaaaaacgacgcccgaaattactcaatacgaacaaaaaaacgaaacgaaaaacgaaatcgcgcccgctaaaaacgcgaaacgaacgaaaaaaaaaaaaaaaaaaaacaaaaaaaaaaaaaaacgactcgtacctactacgcgccgaaacgcctactacttcctcctcgacataatacttctccgacgactaccactaccgccgccgccgccgctaccgaactaaaaacaaaaaaaaaaaaaacgacgaacccgcgaaaaaacgaaacgaacctactctcaacctcccccccgaaaaacgacgcccgcaaaatactactacgcccaaactctccgcgtaccccccgcgccgcgctccgacgcgaaccccgaacgtacgaaaaaaaaaaaaaaaacgaacgaaaaaaactcgaaaaaaaaaaaacacgaaaaaaaaaaaaaaacaaaaaaaacgacgtaaaaaaaaaaaaa

SEQ ID NO: 35805 - DNA, 854 bp, Artificial Sequence
  chemically treated genomic DNA (Homo sapiens) CpG-island No: 35805
tagttcgtgttgtgcgtggcgggttgtcgttgtaatgtgtagtttattgatattgatggatgcgttaatggttggacggatagatgttagggcggatcgtatagcgttcggcgtttgagcgggggagggttaggtagcgatttagcggcggcggtcggttacgcggagattcgagtttaggtcgcggttcgtagtgggagggggtcgaaggaatagaggtttgtaagaatagcgaggggatggaaaggaggagaaaagcgcgattagggagaattatacgttttcgtgtgcggcgtttcgcgttgtgtatacgtcgtatcgggcgcgtttaagtgggagtttcgaaggtgagttgggagtcggcgggagttgatttcgtgcggcgtaattcgtttttaggcgataggagtttagcgcggttattagaatggtgaggtcgtcggcggtgtcggttaatttatcgttttttcgtttgtaagaagcgttttacgttttacggtcgcgttttttcggtttggaggagtagcggttttggtttttgcggtcgcgggtatttaacgcgtacggcgttttagttttcgagttcgttagttcgagagtttcgtcgtagttcgtttcggattttttgtttcgtttggggttcgtattttataatttcgagcgtttttgcgcgcggaaaggcgttggaggcggttttatagtcggggaggttagcggcggcgtatttgtattttgggagacgtttggatttagtttaagttcgtaggttgggcgagcggagatttttgattttatcgtgtgggtgagattattgtttttcggtttaaaagaaaagaaagtatgttgtgaatttt

SEQ ID NO: 35806 - DNA, 854 bp, Artificial Sequence
  chemically treated genomic DNA (Homo sapiens) CpG-island No: 35806
aaaattcacaacatactttcttttcttttaaaccgaaaaacaataatctcacccacacgataaaatcaaaaatctccgctcgcccaacctacgaacttaaactaaatccaaacgtctcccaaaatacaaatacgccgccgctaacctccccgactataaaaccgcctccaacgcctttccgcgcgcaaaaacgctcgaaattataaaatacgaaccccaaacgaaacaaaaaatccgaaacgaactacgacgaaactctcgaactaacgaactcgaaaactaaaacgccgtacgcgttaaatacccgcgaccgcaaaaaccaaaaccgctactcctccaaaccgaaaaaacgcgaccgtaaaacgtaaaacgcttcttacaaacgaaaaaacgataaattaaccgacaccgccgacgacctcaccattctaataaccgcgctaaactcctatcgcctaaaaacgaattacgccgcacgaaatcaactcccgccgactcccaactcaccttcgaaactcccacttaaacgcgcccgatacgacgtatacacaacgcgaaacgccgcacacgaaaacgtataattctccctaatcgcgcttttctcctcctttccatcccctcgctattcttacaaacctctattccttcgaccccctcccactacgaaccgcgacctaaactcgaatctccgcgtaaccgaccgccgccgctaaatcgctacctaaccctcccccgctcaaacgccgaacgctatacgatccgccctaacatctatccgtccaaccattaacgcatccatcaatatcaataaactacacattacaacgacaacccgccacgcacaacacgaacta

SEQ ID NO: 35807 - DNA, 854 bp, Artificial Sequence
  chemically treated genomic DNA (Homo sapiens) CpG-island No: 35807
aaagtttatagtatgttttttttttttttagatcgggagatagtgattttatttatacggtaagattaaaagttttcgttcgtttagtttgcgggtttgggttgggtttagacgttttttaggatgtagatgcgtcgtcgttggttttttcggttataaagtcgtttttagcgttttttcgcgcgtaggagcgttcggagttgtggggtacggattttaggcggggtagggagttcgaggcgggttgcggcggggttttcgggttggcggattcgggggttgaggcgtcgtgcgcgttgggtgttcgcggtcgtagaggttagaatcgttatttttttaggtcggggagacgcggtcgtggagcgtgaaacgttttttgtaagcgaggaaacggtgagttggtcgatatcgtcggcggttttattattttggtggtcgcgttgagtttttgtcgtttggaggcgggttgcgtcgtacggggttagttttcgtcggtttttagtttattttcgaagtttttatttaggcgcgttcggtgcggcgtgtgtatagcgcggggcgtcgtatacggaagcgtgtagttttttttggtcgcgtttttttttttttttttattttttcgttgtttttgtaaatttttgttttttcggtttttttttattgcgggtcgcggtttgaattcgggttttcgcgtagtcggtcgtcgtcgttgggtcgttgtttggttttttttcgtttaggcgtcgagcgttgtgcgattcgttttaatatttgttcgtttaattattggcgtatttattagtgttaatgggttgtatattgtagcgatagttcgttacgtataatacgggtta

SEQ ID NO: 35808 - DNA, 854 bp, Artificial Sequence
  chemically treated genomic DNA (Homo sapiens) CpG-island No: 35808
taacccgtattatacgtaacgaactatcgctacaatatacaacccattaacactaataaatacgccaataattaaacgaacaaatattaaaacgaatcgcacaacgctcgacgcctaaacgaaaaaaaaccaaacaacgacccaacgacgacgaccgactacgcgaaaacccgaattcaaaccgcgacccgcaataaaaaaaaaccgaaaaaacaaaaatttacaaaaacaacgaaaaaataaaaaaaaaaaaaaaaacgcgaccaaaaaaaactacacgcttccgtatacgacgccccgcgctatacacacgccgcaccgaacgcgcctaaataaaaacttcgaaaataaactaaaaaccgacgaaaactaaccccgtacgacgcaacccgcctccaaacgacaaaaactcaacgcgaccaccaaaataataaaaccgccgacgatatcgaccaactcaccgtttcctcgcttacaaaaaacgtttcacgctccacgaccgcgtctccccgacctaaaaaaataacgattctaacctctacgaccgcgaacacccaacgcgcacgacgcctcaacccccgaatccgccaacccgaaaaccccgccgcaacccgcctcgaactccctaccccgcctaaaatccgtaccccacaactccgaacgctcctacgcgcgaaaaaacgctaaaaacgactttataaccgaaaaaaccaacgacgacgcatctacatcctaaaaaacgtctaaacccaacccaaacccgcaaactaaacgaacgaaaacttttaatcttaccgtataaataaaatcactatctcccgatctaaaaaaaaaaaaaacatactataaacttt

SEQ ID NO: 35809 - DNA, 694 bp, Artificial Sequence
  chemically treated genomic DNA (Homo sapiens) CpG-island No: 35809
gcggggcgttcgttttcgtcgggattgtcggtttcggggtttgcgagagcgttagagttttagtcggcgcgttcgggcgtagggtcgtttcggggatagtgggttcggaggtcgttttcgcgttttagtagtcgtcgttcggtagcgttcggagtcggtttcggcgcggtcgttttattttcggtttgagagttggtttagggagacgtaatcgagttcgtagcgtatcgatgcgtcgtcgttcgcgtcgttcgggtttcggttttcgtttagtcgtcgtcgttcgggggtcgttcgtatgagtttcggtttattcgcgtttttatcgtcgttcgtaagtgagttcgcgtcgtttcgtcgtttacgtcgtttagttagtttttttttgtcgcggttagtcggtcgggtcggttcggagttttagcgatttcgattattaattaataattaatttttttagtttagtagtttcggtaggtcgggcgcgggatacggcgcggcggttttttaggttttcggggggagtttttggcgggggatgggtaggggagttcggtttttttttttcgttttcgtttcgttttaggatcggttcgcgtcgtggatggggggcgcggttcggttttcgggggcgaggggcggggtggagggattttgattattttaaagttaggagaggaaatttgaaggaatt

SEQ ID NO: 35810 - DNA, 694 bp, Artificial Sequence
  chemically treated genomic DNA (Homo sapiens) CpG-island No: 35810
aattccttcaaatttcctctcctaactttaaaataatcaaaatccctccaccccgcccctcgcccccgaaaaccgaaccgcgccccccatccacgacgcgaaccgatcctaaaacgaaacgaaaacgaaaaaaaaaaaccgaactcccctacccatcccccgccaaaaactccccccgaaaacctaaaaaaccgccgcgccgtatcccgcgcccgacctaccgaaactactaaactaaaaaaattaattattaattaataatcgaaatcgctaaaactccgaaccgacccgaccgactaaccgcgacaaaaaaaaactaactaaacgacgtaaacgacgaaacgacgcgaactcacttacgaacgacgataaaaacgcgaataaaccgaaactcatacgaacgacccccgaacgacgacgactaaacgaaaaccgaaacccgaacgacgcgaacgacgacgcatcgatacgctacgaactcgattacgtctccctaaaccaactctcaaaccgaaaataaaacgaccgcgccgaaaccgactccgaacgctaccgaacgacgactactaaaacgcgaaaacgacctccgaacccactatccccgaaacgaccctacgcccgaacgcgccgactaaaactctaacgctctcgcaaaccccgaaaccgacaatcccgacgaaaacgaacgccccgc

SEQ ID NO: 35811 - DNA, 694 bp, Artificial Sequence
  chemically treated genomic DNA (Homo sapiens) CpG-island No: 35811
ggtttttttaagtttttttttttgattttgggatgattagggtttttttatttcgtttttcgttttcgggagtcgggtcgcgttttttatttacggcgcgggtcgattttagggcgggacgggggcgggagaaggaaatcgggtttttttgtttatttttcgttaggggtttttttcgagagtttagggggtcgtcgcgtcgtgtttcgcgttcggtttgtcggggttgttggattagagggattgattattgattggtgatcggggtcgttgaggtttcgggtcggttcggtcgattggtcgcggtaagaaggagttggttgggcggcgtgggcggcggggcgacgcgggtttatttacgggcggcggtgagggcgcgggtgggtcggagtttatgcgggcgattttcgggcggcggcggttgagcgggagtcggagttcgagcggcgcgggcggcggcgtatcgatgcgttgcgggttcgattgcgtttttttgggttagtttttaggtcgggaatggggcggtcgcgtcggggtcggtttcgggcgttgtcgggcggcggttgttggagcgcgggggcggttttcgggtttattattttcgaggcggttttgcgttcgggcgcgtcggttggggttttggcgttttcgtaggtttcgaggtcgatagtttcggcgagggcgggcgtttcgt

SEQ ID NO: 35812 - DNA, 694 bp, Artificial Sequence
  chemically treated genomic DNA (Homo sapiens) CpG-island No: 35812
acgaaacgcccgccctcgccgaaactatcgacctcgaaacctacgaaaacgccaaaaccccaaccgacgcgcccgaacgcaaaaccgcctcgaaaataataaacccgaaaaccgcccccgcgctccaacaaccgccgcccgacaacgcccgaaaccgaccccgacgcgaccgccccattcccgacctaaaaactaacccaaaaaaacgcaatcgaacccgcaacgcatcgatacgccgccgcccgcgccgctcgaactccgactcccgctcaaccgccgccgcccgaaaatcgcccgcataaactccgacccacccgcgccctcaccgccgcccgtaaataaacccgcgtcgccccgccgcccacgccgcccaaccaactccttcttaccgcgaccaatcgaccgaaccgacccgaaacctcaacgaccccgatcaccaatcaataatcaatccctctaatccaacaaccccgacaaaccgaacgcgaaacacgacgcgacgaccccctaaactctcgaaaaaaacccctaacgaaaaataaacaaaaaaacccgatttccttctcccgcccccgtcccgccctaaaatcgacccgcgccgtaaataaaaaacgcgacccgactcccgaaaacgaaaaacgaaataaaaaaaccctaatcatcccaaaatcaaaaaaaaaaacttaaaaaaacc

SEQ ID NO: 35813 - DNA, 578 bp, Artificial Sequence
  chemically treated genomic DNA (Homo sapiens) CpG-island No: 35813
ggagtgcgagtcgggtggggtagttggggggtggttggggacgaacgttgggtgggaataggggtggggggtaacgagcgtttcgggtacgggttcgcgcggggcgattggcgtcgcgttttcgcgtgtgcgtacggggcggaggcggaggggcggtatttttttcgttggcggggcgggggttttacgcgggtttggggtcgggggcgggggcgcggcgttttcgcgggcgggcgattgatacgattattttttttttttttaagtttgtttgttgtcgacgtcgtcgttttagtcgcgttacgggtagaagattggatcgtcgagtttcgggtcgcggcggcggttgcgcgttttttcggatgtcgtgattttcggtttaggggcgggggtcggggtagtatcggttcgggtcgttttcgcgtttttttttttatcgttttgttcgtttttttttcgttttttagtttcgaatttcgcgtatttcgtttggggacggggcgggggggggtagggtcgtcgttttttttcgttttttttttttttggtttttggagcgatttgttaaattttttatt

SEQ ID NO: 35814 - DNA, 578 bp, Artificial Sequence
  chemically treated genomic DNA (Homo sapiens) CpG-island No: 35814
aataaaaaatttaacaaatcgctccaaaaaccaaaaaaaaaaaaaacgaaaaaaaacgacgaccctacccccccccgccccgtccccaaacgaaatacgcgaaattcgaaactaaaaaacgaaaaaaaaacgaacaaaacgataaaaaaaaaaacgcgaaaacgacccgaaccgatactaccccgacccccgcccctaaaccgaaaatcacgacatccgaaaaaacgcgcaaccgccgccgcgacccgaaactcgacgatccaatcttctacccgtaacgcgactaaaacgacgacgtcgacaacaaacaaacttaaaaaaaaaaaaaataatcgtatcaatcgcccgcccgcgaaaacgccgcgcccccgcccccgaccccaaacccgcgtaaaacccccgccccgccaacgaaaaaaataccgcccctccgcctccgccccgtacgcacacgcgaaaacgcgacgccaatcgccccgcgcgaacccgtacccgaaacgctcgttaccccccacccctattcccacccaacgttcgtccccaaccaccccccaactaccccacccgactcgcactcc

SEQ ID NO: 35815 - DNA, 578 bp, Artificial Sequence
  chemically treated genomic DNA (Homo sapiens) CpG-island No: 35815
aatgggaagtttgataaatcgttttagaggttagaggaggagggggcggggaggagcggcggttttgttttttttcgtttcgtttttagacgaggtgcgcggggttcggggttggggggcggggagagggcgggtagagcggtgggaggaggagcgcgggagcggttcggatcggtattgtttcggttttcgtttttaggtcgggggttacggtattcggggggacgcgtagtcgtcgtcgcggttcggggttcggcggtttagttttttgttcgtggcgcggttggagcggcggcgtcggtaataggtaagtttaaaggaaaaggagatgatcgtgttaatcgttcgttcgcgggggcgtcgcgttttcgttttcggttttaggttcgcgtgggattttcgtttcgttagcgaaaggggtgtcgttttttcgttttcgtttcgtgcgtatacgcgggggcgcggcgttagtcgtttcgcgcgagttcgtgttcggggcgttcgttattttttatttttatttttatttagcgttcgtttttagttattttttagttgttttattcggttcgtatttt

SEQ ID NO: 35816 - DNA, 578 bp, Artificial Sequence
  chemically treated genomic DNA (Homo sapiens) CpG-island No: 35816
aaaatacgaaccgaataaaacaactaaaaaataactaaaaacgaacgctaaataaaaataaaaataaaaaataacgaacgccccgaacacgaactcgcgcgaaacgactaacgccgcgcccccgcgtatacgcacgaaacgaaaacgaaaaaacgacacccctttcgctaacgaaacgaaaatcccacgcgaacctaaaaccgaaaacgaaaacgcgacgcccccgcgaacgaacgattaacacgatcatctccttttcctttaaacttacctattaccgacgccgccgctccaaccgcgccacgaacaaaaaactaaaccgccgaaccccgaaccgcgacgacgactacgcgtccccccgaataccgtaacccccgacctaaaaacgaaaaccgaaacaataccgatccgaaccgctcccgcgctcctcctcccaccgctctacccgccctctccccgccccccaaccccgaaccccgcgcacctcgtctaaaaacgaaacgaaaaaaaacaaaaccgccgctcctccccgccccctcctcctctaacctctaaaacgatttatcaaacttcccatt

SEQ ID NO: 35817 - DNA, 952 bp, Artificial Sequence
  chemically treated genomic DNA (Homo sapiens) CpG-island No: 35817
cgtattcggtattcggtgtttaatgtttgatgcgacgtttgtcgcgttttattaggtttataacgatataaatcgtaggttagataaggcgtttacgtcgtattcggtaacggtgtcgattgtttgatgcgacgtttgcgcgttttattaggtttataaattttcgtatttttcgtaggtcggataaggcgtttacgtcgtattcggtaatagtgttaattgtttgatgcgacgtttgcgcgttttattaggtttataaattttcgtattattcgtaggtcggataaggcgtttacgtcgtattcggtaacggtgtcgattgtttgatgcgacgtttgcgcgttttattaggtttataaattttcgtatttttcgtatgtcggataaggcgtttacgtcgtattcggtaatggtgtcgattgtttgatgcgacgtttgcgcgttttattaggtttataaattttcgtatttttcgtaggtcggataaggcgtttacgtcgtattcggaaattggtgtatgatgtttgatgcgacgttgtcgcgttttatcgtgtttataaatagttcgaatcgtagtcggataaggcgtttacgtcgtattcggtaattggtgtatgatgtttgatgcgacgttggcgcgttttattaggtttatattggtgtcggatcggtagatcggataaggcgtttacgtcgtattcggtaagtggttaaattcgtttaaatatcgtcgtaatattttgatttagatcgatatatatcgtcgttagattaaattgaacgtttttgcgttttattagatttagtagcgtggtgttgatacgcgtatcggaataatttagcggatgatttagcgcgatcgcgttatcgttgaggttgattttttcgttaatttgtttaattagttttagatttttaatatatggtaggatttgcgcggtaaaggtttcgt

SEQ ID NO: 35818 - DNA, 952 bp, Artificial Sequence
  chemically treated genomic DNA (Homo sapiens) CpG-island No: 35818
acgaaacctttaccgcgcaaatcctaccatatattaaaaatctaaaactaattaaacaaattaacgaaaaaatcaacctcaacgataacgcgatcgcgctaaatcatccgctaaattattccgatacgcgtatcaacaccacgctactaaatctaataaaacgcaaaaacgttcaatttaatctaacgacgatatatatcgatctaaatcaaaatattacgacgatatttaaacgaatttaaccacttaccgaatacgacgtaaacgccttatccgatctaccgatccgacaccaatataaacctaataaaacgcgccaacgtcgcatcaaacatcatacaccaattaccgaatacgacgtaaacgccttatccgactacgattcgaactatttataaacacgataaaacgcgacaacgtcgcatcaaacatcatacaccaatttccgaatacgacgtaaacgccttatccgacctacgaaaaatacgaaaatttataaacctaataaaacgcgcaaacgtcgcatcaaacaatcgacaccattaccgaatacgacgtaaacgccttatccgacatacgaaaaatacgaaaatttataaacctaataaaacgcgcaaacgtcgcatcaaacaatcgacaccgttaccgaatacgacgtaaacgccttatccgacctacgaataatacgaaaatttataaacctaataaaacgcgcaaacgtcgcatcaaacaattaacactattaccgaatacgacgtaaacgccttatccgacctacgaaaaatacgaaaatttataaacctaataaaacgcgcaaacgtcgcatcaaacaatcgacaccgttaccgaatacgacgtaaacgccttatctaacctacgatttatatcgttataaacctaataaaacgcgacaaacgtcgcatcaaacattaaacaccgaataccgaatacg

SEQ ID NO: 35819 - DNA, 952 bp, Artificial Sequence
  chemically treated genomic DNA (Homo sapiens) CpG-island No: 35819
acgaagtttttgtcgcgtagattttgttatgtattaaagatttgggattaattgagtagattgacgagaagattaattttaacggtggcgcgatcgcgttgggttattcgttgggttgtttcggtgcgcgtattagtattacgttgttgaatttgatggaacgtaaagacgtttagtttggtttggcgacgatgtgtatcggtttgggttagggtattgcgacggtgtttgagcgggtttaattatttgtcggatgcggcgtgaacgttttattcggtttatcgattcggtattaatgtaggtttgataagacgcgttagcgtcgtattaggtattatgtattaattgtcggatgcggcgtaaacgttttattcggttacggttcggattatttgtaggtacgataagacgcgatagcgtcgtattaggtattatgtattaattttcggatgcggcgtaaacgttttattcggtttacggagggtgcgggaatttgtaggtttgataagacgcgtaagcgtcgtattaggtagtcggtattattgtcggatgcggcgtaaacgttttattcggtatacggagggtgcgggaatttgtaggtttgataagacgcgtaagcgtcgtattaggtagtcggtatcgttgtcggatgcggcgtaaacgttttattcggtttacggatggtgcgggaatttgtaggtttgataagacgcgtaagcgtcgtattaggtagttggtattgttgtcggatgcggcgtaaacgttttattcggtttacggagggtgcgggaatttgtaggtttgataagacgcgtaagcgtcgtattaggtagtcggtatcgttgtcggatgcggcgtaaacgttttatttgatttacggtttgtatcgttgtaggtttgataagacgcggtaagcgtcgtattaggtattgagtatcgaatgtcggatgcg

SEQ ID NO: 35820 - DNA, 952 bp, Artificial Sequence
  chemically treated genomic DNA (Homo sapiens) CpG-island No: 35820
cgcatccgacattcgatactcaatacctaatacgacgcttaccgcgtcttatcaaacctacaacgatacaaaccgtaaatcaaataaaacgtttacgccgcatccgacaacgataccgactacctaatacgacgcttacgcgtcttatcaaacctacaaattcccgcaccctccgtaaaccgaataaaacgtttacgccgcatccgacaacaataccaactacctaatacgacgcttacgcgtcttatcaaacctacaaattcccgcaccatccgtaaaccgaataaaacgtttacgccgcatccgacaacgataccgactacctaatacgacgcttacgcgtcttatcaaacctacaaattcccgcaccctccgtataccgaataaaacgtttacgccgcatccgacaataataccgactacctaatacgacgcttacgcgtcttatcaaacctacaaattcccgcaccctccgtaaaccgaataaaacgtttacgccgcatccgaaaattaatacataatacctaatacgacgctatcgcgtcttatcgtacctacaaataatccgaaccgtaaccgaataaaacgtttacgccgcatccgacaattaatacataatacctaatacgacgctaacgcgtcttatcaaacctacattaataccgaatcgataaaccgaataaaacgttcacgccgcatccgacaaataattaaacccgctcaaacaccgtcgcaataccctaacccaaaccgatacacatcgtcgccaaaccaaactaaacgtctttacgttccatcaaattcaacaacgtaatactaatacgcgcaccgaaacaacccaacgaataacccaacgcgatcgcgccaccgttaaaattaatcttctcgtcaatctactcaattaatcccaaatctttaatacataacaaaatctacgcgacaaaaacttcgt

SEQ ID NO: 35821 - DNA, 995 bp, Artificial Sequence
  chemically treated genomic DNA (Homo sapiens) CpG-island No: 35821
tttggcgacggttttgttggtaagcgtattgttatttttttggtatcgtcgttatttgcgttcgcgttagtttttataagatgaaatgaagcgtaaagagaagttggtggcgttgttgtattagcgcgttaattagcgcgtagcgttcggcgtgttgtttattacgtttttgtatttagttgtagtcgagcgtgtcgttagttaggcgtacggcggcgcgggttagcgtggcgtcgtcggtaaaaaaacgttcgtcggtgtcgtttattcgcgtttgaatttgtattaggttagttttagcggcgcggattattttatagtcggcggtgatgtttagcgcgtttaggcgtgttgttagtttagtcggttggttgtgcgttagtacggatatttagtgttggcgggtcgcggtatttgcgtgtatttagtgttttatagtgaatttaattatgtcggcgcgcgttaggttgacggagtatttcgtcgggttgtttttatcgttacggtggttaagggtgcgtacgtatagtagcggcgatatattcgggattttaagacgttggtattttttggtttgggcgcggcgggcgttgattcgcgtttggttgcggcgtagcgtaatttcggtttgttcgcgtagaaaatcgtgtagcgagtcgttgtcgaagcgttgtagcgtcggttagagggtgaggttcgcgaagtagtggtcgattaaatagagcgcgacgtcgttgatacgacgtagggtgcgtaggtggatgacgttttttttttcggtaatttttagtgcgttagcgacgtggtcggacgcggggcgtaatatcgaaagtagtttttcgttggtgggatggttgttttgatttagtagattttggttaaaacgcgtttgggcgttaagtcgggttatcgaacgggcgtattagtattagtacgtcgacgttttgacggcgttgttttttagtttttttttttttagttgttttaagggcggg

SEQ ID NO: 35822 - DNA, 995 bp, Artificial Sequence
  chemically treated genomic DNA (Homo sapiens) CpG-island No: 35822
cccgcccttaaaacaactaaaaaaaaaaaaactaaaaaacaacgccgtcaaaacgtcgacgtactaatactaatacgcccgttcgataacccgacttaacgcccaaacgcgttttaaccaaaatctactaaatcaaaacaaccatcccaccaacgaaaaactactttcgatattacgccccgcgtccgaccacgtcgctaacgcactaaaaattaccgaaaaaaaaaacgtcatccacctacgcaccctacgtcgtatcaacgacgtcgcgctctatttaatcgaccactacttcgcgaacctcaccctctaaccgacgctacaacgcttcgacaacgactcgctacacgattttctacgcgaacaaaccgaaattacgctacgccgcaaccaaacgcgaatcaacgcccgccgcgcccaaaccaaaaaataccaacgtcttaaaatcccgaatatatcgccgctactatacgtacgcacccttaaccaccgtaacgataaaaacaacccgacgaaatactccgtcaacctaacgcgcgccgacataattaaattcactataaaacactaaatacacgcaaataccgcgacccgccaacactaaatatccgtactaacgcacaaccaaccgactaaactaacaacacgcctaaacgcgctaaacatcaccgccgactataaaataatccgcgccgctaaaactaacctaatacaaattcaaacgcgaataaacgacaccgacgaacgtttttttaccgacgacgccacgctaacccgcgccgccgtacgcctaactaacgacacgctcgactacaactaaatacaaaaacgtaataaacaacacgccgaacgctacgcgctaattaacgcgctaatacaacaacgccaccaacttctctttacgcttcatttcatcttataaaaactaacgcgaacgcaaataacgacgataccaaaaaaataacaatacgcttaccaacaaaaccgtcgccaaa

SEQ ID NO: 35823 - DNA, 995 bp, Artificial Sequence
  chemically treated genomic DNA (Homo sapiens) CpG-island No: 35823
ttcgtttttgggataattggggggaaaaagattggggaatagcgtcgttagggcgtcggcgtgttggtgttgatgcgttcgttcgataattcggtttaacgtttaggcgcgttttagttagaatttgttggattagggtagttattttattagcgaaaaattgttttcggtattgcgtttcgcgttcggttacgtcgttgacgtattggggattatcgagggggagaacgttatttatttgcgtattttgcgtcgtgttaacggcgtcgcgttttgtttaatcgattattatttcgcggattttattttttggtcgacgttgtaacgtttcgatagcggttcgttgtacgattttttgcgcgagtaaatcggaattgcgttgcgtcgtagttagacgcggattagcgttcgtcgcgtttaggttaaagagtgttagcgttttgaaatttcgaatatgtcgtcgttgttgtgcgtgcgtatttttaattatcgtgacggtgaaagtagttcggcggagtatttcgttagtttgacgcgcgtcgatatgattgaatttattatggagtattgaatgtacgtagatatcgcgattcgttagtattggatgttcgtgttggcgtatagttaatcggttgaattggtagtacgtttgaacgcgttaaatattatcgtcgattatgaggtgattcgcgtcgttgaaattggtttggtatagatttaggcgcggatgggcggtatcggcgaacgtttttttgtcggcgacgttacgttgattcgcgtcgtcgtgcgtttgattgacggtacgttcggttatagttgggtgtaggggcgtgataaatagtacgtcgaacgttgcgcgttgattgacgcgttgatgtagtagcgttattagtttttttttgcgttttattttattttgtagaagttggcgcgagcgtagatagcggcgatattagaagaatgataatacgtttgttagtaagatcgtcgttagg

SEQ ID NO: 35824 - DNA, 995 bp, Artificial Sequence
  chemically treated genomic DNA (Homo sapiens) CpG-island No: 35824
cctaacgacgatcttactaacaaacgtattatcattcttctaatatcgccgctatctacgctcgcgccaacttctacaaaataaaataaaacgcaaaaaaaaactaataacgctactacatcaacgcgtcaatcaacgcgcaacgttcgacgtactatttatcacgcccctacacccaactataaccgaacgtaccgtcaatcaaacgcacgacgacgcgaatcaacgtaacgtcgccgacaaaaaaacgttcgccgataccgcccatccgcgcctaaatctataccaaaccaatttcaacgacgcgaatcacctcataatcgacgataatatttaacgcgttcaaacgtactaccaattcaaccgattaactatacgccaacacgaacatccaatactaacgaatcgcgatatctacgtacattcaatactccataataaattcaatcatatcgacgcgcgtcaaactaacgaaatactccgccgaactactttcaccgtcacgataattaaaaatacgcacgcacaacaacgacgacatattcgaaatttcaaaacgctaacactctttaacctaaacgcgacgaacgctaatccgcgtctaactacgacgcaacgcaattccgatttactcgcgcaaaaaatcgtacaacgaaccgctatcgaaacgttacaacgtcgaccaaaaaataaaatccgcgaaataataatcgattaaacaaaacgcgacgccgttaacacgacgcaaaatacgcaaataaataacgttctccccctcgataatccccaatacgtcaacgacgtaaccgaacgcgaaacgcaataccgaaaacaatttttcgctaataaaataactaccctaatccaacaaattctaactaaaacgcgcctaaacgttaaaccgaattatcgaacgaacgcatcaacaccaacacgccgacgccctaacgacgctattccccaatctttttccccccaattatcccaaaaacgaa

SEQ ID NO: 35825 - DNA, 975 bp, Artificial Sequence
  chemically treated genomic DNA (Homo sapiens) CpG-island No: 35825
gtatcgaatggggcgtggtgtattagtatttattcgacggtttgcgtcgttaggtgtcggtaggcggtaatatcggcgagcggttgatggcgatcggggtacgttattacggcgatattcgtgttatcgcgtagaagtggttggaagaggtggagattttcgttaatcggatcgacgatttgtcgattatttttttcggcggtatgtagtagcgtttgtagattgttcgtaatttggtgacgtattcgaagttggtgtttatggatgaatcgatcggcgggttggatgtgtcggtgtaggttcgtttgttcgatttgttgcgcggtttggtggtggagttgaatttcgcggtggtgattgttatttatgatttaggcgtcgttcgtttgttggcggatcgtttgttggtgatgaagtaggggtaagtggtggagagtgggttaatcgatcgcgtgttcgacgattcgtattattcgtatatatagttgttggtgttatcggttttgtagaattgagtcggtgtcggatgcggcgtaaacgttttattcggtttataaatgcgtttttcgtaggtcggataagacgcgttagcgtcgtattcggtaattagtattcggtaattattattaggtattttttatttttagtattttatgcgtttttgttataatattttcggcggtaaagttaaagaacgggaatagtttattcgtcggagtagatttttcgtaattcgttatttcgataattgttttttttagattaatatatttgtattagtaatcggtaatatttgtttttatcgttacgcgagtcgtaacgttagaaggtaatatcgattttcgatattttttattttgggcgtcgaaaatatcggtcgagggtagggaaattacgcgtatattgcgatttttttttgttaatttttttgtcgtttgtagggtaatttttatttttgaatcggtggtaattaga

SEQ ID NO: 35826 - DNA, 975 bp, Artificial Sequence
  chemically treated genomic DNA (Homo sapiens) CpG-island No: 35826
tctaattaccaccgattcaaaaataaaaattaccctacaaacgacaaaaaaattaacaaaaaaaaatcgcaatatacgcgtaatttccctaccctcgaccgatattttcgacgcccaaaataaaaaatatcgaaaatcgatattaccttctaacgttacgactcgcgtaacgataaaaacaaatattaccgattactaatacaaatatattaatctaaaaaaaacaattatcgaaataacgaattacgaaaaatctactccgacgaataaactattcccgttctttaactttaccgccgaaaatattataacaaaaacgcataaaatactaaaaataaaaaatacctaataataattaccgaatactaattaccgaatacgacgctaacgcgtcttatccgacctacgaaaaacgcatttataaaccgaataaaacgtttacgccgcatccgacaccgactcaattctacaaaaccgataacaccaacaactatatatacgaataatacgaatcgtcgaacacgcgatcgattaacccactctccaccacttacccctacttcatcaccaacaaacgatccgccaacaaacgaacgacgcctaaatcataaataacaatcaccaccgcgaaattcaactccaccaccaaaccgcgcaacaaatcgaacaaacgaacctacaccgacacatccaacccgccgatcgattcatccataaacaccaacttcgaatacgtcaccaaattacgaacaatctacaaacgctactacataccgccgaaaaaaataatcgacaaatcgtcgatccgattaacgaaaatctccacctcttccaaccacttctacgcgataacacgaatatcgccgtaataacgtaccccgatcgccatcaaccgctcgccgatattaccgcctaccgacacctaacgacgcaaaccgtcgaataaatactaatacaccacgccccattcgatac

SEQ ID NO: 35827 - DNA, 975 bp, Artificial Sequence
  chemically treated genomic DNA (Homo sapiens) CpG-island No: 35827
tttgattgttatcggtttagagatggaaattattttgtaagcggtagagaaattagtaggagaaggtcgtaatgtacgcgtagtttttttgttttcgatcgatattttcgacgtttaggatgaggaatatcgggagtcggtgttgttttttaacgttgcggttcgcgtggcggtggaagtaggtattgtcgattattggtataagtatgttggtttgaaaggggtaattgtcgggatgacgggttacggggaatttgtttcggcggataagttgttttcgttttttggttttatcgtcgagaatattgtggtaaaagcgtataaggtgttgggagtgaaaggtgtttgatggtgattgtcggatgttgattgtcggatgcgacgttgacgcgttttattcgatttacggggagcgtatttgtaggtcggataaggcgtttacgtcgtattcggtatcggtttaattttgtaaaatcgatgatattagtagttgtgtatacggatgatgcgggtcgtcgagtacgcggtcggttaatttattttttattatttgtttttgttttattattagtaaacggttcgttagtaggcgggcgacgtttaaattatgggtgataattattatcgcgaggtttagttttattattaggtcgcgtagtaggtcgagtaggcgggtttgtatcgatatatttagttcgtcggtcggtttatttataaatattagtttcggatgcgttattaggttgcgggtaatttgtaaacgttgttgtatatcgtcggaaaaggtggtcggtaggtcgtcgattcggttggcgggaatttttattttttttagttatttttgcgcggtggtacgaatatcgtcgtaatgacgtgtttcggtcgttattagtcgttcgtcgatattgtcgtttgtcgatatttggcggcgtaggtcgtcgagtggatgttgatgtattacgttttattcggtat

SEQ ID NO: 35828 - DNA, 975 bp, Artificial Sequence
  chemically treated genomic DNA (Homo sapiens) CpG-island No: 35828
ataccgaataaaacgtaatacatcaacatccactcgacgacctacgccgccaaatatcgacaaacgacaatatcgacgaacgactaataacgaccgaaacacgtcattacgacgatattcgtaccaccgcgcaaaaataactaaaaaaaataaaaattcccgccaaccgaatcgacgacctaccgaccaccttttccgacgatatacaacaacgtttacaaattacccgcaacctaataacgcatccgaaactaatatttataaataaaccgaccgacgaactaaatatatcgatacaaacccgcctactcgacctactacgcgacctaataataaaactaaacctcgcgataataattatcacccataatttaaacgtcgcccgcctactaacgaaccgtttactaataataaaacaaaaacaaataataaaaaataaattaaccgaccgcgtactcgacgacccgcatcatccgtatacacaactactaatatcatcgattttacaaaattaaaccgataccgaatacgacgtaaacgccttatccgacctacaaatacgctccccgtaaatcgaataaaacgcgtcaacgtcgcatccgacaatcaacatccgacaatcaccatcaaacacctttcactcccaacaccttatacgcttttaccacaatattctcgacgataaaaccaaaaaacgaaaacaacttatccgccgaaacaaattccccgtaacccgtcatcccgacaattacccctttcaaaccaacatacttataccaataatcgacaatacctacttccaccgccacgcgaaccgcaacgttaaaaaacaacaccgactcccgatattcctcatcctaaacgtcgaaaatatcgatcgaaaacaaaaaaactacgcgtacattacgaccttctcctactaatttctctaccgcttacaaaataatttccatctctaaaccgataacaatcaaa

SEQ ID NO: 35829 - DNA, 1047 bp, Artificial Sequence
  chemically treated genomic DNA (Homo sapiens) CpG-island No: 35829
atttgtcgggttgtgaaaaagcggtgtaggtaaaagtgaaagttttgtttgatgtttagttcgaagtggtttatttattggcgaagtggaaacgttagattttagggtaatacgattttagcgcgggcgaagggttgtatacgtatatgaaagtttttcgtttcgatgaagatcgttttttttcgttgtattcggtttatgttgattagtgggattgggaacgcgtaatgggcgacggtgagcgtttaattttcgattttgaaaagtacggtagaggcgatttgggcgggaattaaagtaatcgaagttgcggttagcgaagagtttggtttggtatcgtttttgtcggattagatttatttcgtatatagttaggagttattgtttcgttattcggattttgatgttaaagggcgtgagcgggcgatagcgaaagattttggcgcggtattttttgtcgggattggcggtaagttgagcgatggttatcgttacgacgtgcgcgtatcggattatgatgattggagtatttcgttagagttgggttatgcgggtttgaacggcgatattttggtgtggaattcggtattggaagatgcgtttgagtttttttttatggggattcgtgtagatgtcgatacgttgaagtattaattggcgttgatcggtgacgaagatcgtttggagttggagtggtattaggcgttgttgcgcggtgaaatgtcgtagattatcggcggcggtatcggttagtttcgtttgattatgttgttgttgtaattgtcgtatatcggttaggtttagtgtggagtatggttagttgttgttcgcgagagcgttttttttttgttgtaataatttatcgtcggtagcgtttgagtaggcggtttcgttattcggtattaagcggtcgatttgatcgaaaatgggtttgtgtcggttggtcgttgcgattggtcggtttaaaggttgttttttcgggggttttttttatttcgcgttgggagcggagaataaaatcggttatgtcggtttgagcgtagagaa

SEQ ID NO: 35830 - DNA, 1047 bp, Artificial Sequence
  chemically treated genomic DNA (Homo sapiens) CpG-island No: 35830
ttctctacgctcaaaccgacataaccgattttattctccgctcccaacgcgaaataaaaaaaacccccgaaaaaacaacctttaaaccgaccaatcgcaacgaccaaccgacacaaacccattttcgatcaaatcgaccgcttaataccgaataacgaaaccgcctactcaaacgctaccgacgataaattattacaacaaaaaaaaaacgctctcgcgaacaacaactaaccatactccacactaaacctaaccgatatacgacaattacaacaacaacataatcaaacgaaactaaccgataccgccgccgataatctacgacatttcaccgcgcaacaacgcctaataccactccaactccaaacgatcttcgtcaccgatcaacgccaattaatacttcaacgtatcgacatctacacgaatccccataaaaaaaaactcaaacgcatcttccaataccgaattccacaccaaaatatcgccgttcaaacccgcataacccaactctaacgaaatactccaatcatcataatccgatacgcgcacgtcgtaacgataaccatcgctcaacttaccgccaatcccgacaaaaaataccgcgccaaaatctttcgctatcgcccgctcacgccctttaacatcaaaatccgaataacgaaacaataactcctaactatatacgaaataaatctaatccgacaaaaacgataccaaaccaaactcttcgctaaccgcaacttcgattactttaattcccgcccaaatcgcctctaccgtacttttcaaaatcgaaaattaaacgctcaccgtcgcccattacgcgttcccaatcccactaatcaacataaaccgaatacaacgaaaaaaaacgatcttcatcgaaacgaaaaactttcatatacgtatacaacccttcgcccgcgctaaaatcgtattaccctaaaatctaacgtttccacttcgccaataaataaaccacttcgaactaaacatcaaacaaaactttcacttttacctacaccgctttttcacaacccgacaaat

SEQ ID NO: 35831 - DNA, 1047 bp, Artificial Sequence
  chemically treated genomic DNA (Homo sapiens) CpG-island No: 35831
ttttttacgtttagatcgatatgatcgattttatttttcgtttttaacgcgggataagagaagttttcggaaaaataatttttaaatcggttaatcgtaacggttaatcggtataagtttattttcgattaaatcggtcgtttgatatcggatggcgaagtcgtttgtttagacgttgtcggcgataaattattatagtagagaagggacgttttcgcgaatagtagttggttatattttatattgaatttggtcgatatgcggtagttgtagtagtagtatagttaaacgagattggtcgatatcgtcgtcgatggtttgcggtattttatcgcgtagtagcgtttgatgttattttagttttaggcgattttcgttatcggttagcgttagttgatgttttagcgtgtcggtatttatacggatttttatggaggaaagtttaaacgtattttttagtatcgggttttatattagaatatcgtcgtttagattcgtatggtttagttttgacggggtgttttagttattataattcggtgcgcgtacgtcgtggcgatgattatcgtttagtttgtcgttaatttcgataaggaatatcgcgttaagatttttcgttatcgttcgtttacgttttttggtattaagattcggataacgagatagtaatttttggttgtgtacgaagtggatttgattcggtaggaacggtgttaggttaaatttttcgttaatcgtagtttcggttgttttaattttcgtttagatcgtttttatcgtgttttttagagtcgagaattggacgtttatcgtcgtttattacgcgtttttagttttattggttaatatagatcgagtgtaacggagaaagacggtttttatcggggcgaagggtttttatgtgcgtgtatagtttttcgttcgcgttgaagtcgtgttgttttaaggtttgacgtttttatttcgttagtgaatgaattatttcgaattgggtattaggtagagtttttatttttatttgtatcgtttttttatagttcgataagt

SEQ ID NO: 35832 - DNA, 1047 bp, Artificial Sequence
  chemically treated genomic DNA (Homo sapiens) CpG-island No: 35832
acttatcgaactataaaaaaacgatacaaataaaaataaaaactctacctaatacccaattcgaaataattcattcactaacgaaataaaaacgtcaaaccttaaaacaacacgacttcaacgcgaacgaaaaactatacacgcacataaaaacccttcgccccgataaaaaccgtctttctccgttacactcgatctatattaaccaataaaactaaaaacgcgtaataaacgacgataaacgtccaattctcgactctaaaaaacacgataaaaacgatctaaacgaaaattaaaacaaccgaaactacgattaacgaaaaatttaacctaacaccgttcctaccgaatcaaatccacttcgtacacaaccaaaaattactatctcgttatccgaatcttaataccaaaaaacgtaaacgaacgataacgaaaaatcttaacgcgatattccttatcgaaattaacgacaaactaaacgataatcatcgccacgacgtacgcgcaccgaattataataactaaaacaccccgtcaaaactaaaccatacgaatctaaacgacgatattctaatataaaacccgatactaaaaaatacgtttaaactttcctccataaaaatccgtataaataccgacacgctaaaacatcaactaacgctaaccgataacgaaaatcgcctaaaactaaaataacatcaaacgctactacgcgataaaataccgcaaaccatcgacgacgatatcgaccaatctcgtttaactatactactactacaactaccgcatatcgaccaaattcaatataaaatataaccaactactattcgcgaaaacgtcccttctctactataataatttatcgccgacaacgtctaaacaaacgacttcgccatccgatatcaaacgaccgatttaatcgaaaataaacttataccgattaaccgttacgattaaccgatttaaaaattatttttccgaaaacttctcttatcccgcgttaaaaacgaaaaataaaatcgatcatatcgatctaaacgtaaaaaa

SEQ ID NO: 35833 - DNA, 518 bp, Artificial Sequence
  chemically treated genomic DNA (Homo sapiens) CpG-island No: 35833
atttatcggtagttacgcgtcggttgtttagtttttaggttggcgtattggcgggcgggtaaattgttttataagtagtaaaacgtagtgtcgatggcgagttgttgttagttattcgtaatcgtttaagtagcgttgtgtcgttgtcgtttgatgtttggtaaatgttgagcgcgtcgttacgttagtcgggtattgtggttttgcgggaatatttacgttagcgttttttcgtttgtatacggttttttaattaggtcgataatttatttattttgtcggtcgttgagtgtatttcgttcggttgggatagtagtcgttagacgttggatgcgtaggttattagcggcgaaggggaagataatgtttgacgttattattattagttttagttagcgtattttatgtcgttgaacgtatggcggcgtttttgtaataaatagacgatttcgtgtgtttggtttttggttttgttagttttgttgaagggtaattgatattggaattacgggtgatga

SEQ ID NO: 35834 - DNA, 518 bp, Artificial Sequence
  chemically treated genomic DNA (Homo sapiens) CpG-island No: 35834
tcatcacccgtaattccaatatcaattacccttcaacaaaactaacaaaaccaaaaaccaaacacacgaaatcgtctatttattacaaaaacgccgccatacgttcaacgacataaaatacgctaactaaaactaataataataacgtcaaacattatcttccccttcgccgctaataacctacgcatccaacgtctaacgactactatcccaaccgaacgaaatacactcaacgaccgacaaaataaataaattatcgacctaattaaaaaaccgtatacaaacgaaaaaacgctaacgtaaatattcccgcaaaaccacaatacccgactaacgtaacgacgcgctcaacatttaccaaacatcaaacgacaacgacacaacgctacttaaacgattacgaataactaacaacaactcgccatcgacactacgttttactacttataaaacaatttacccgcccgccaatacgccaacctaaaaactaaacaaccgacgcgtaactaccgataaat

SEQ ID NO: 35835 - DNA, 518 bp, Artificial Sequence
  chemically treated genomic DNA (Homo sapiens) CpG-island No: 35835
ttattattcgtggttttagtgttaattgttttttaataaaattgataaagttagaaattagatatacggggtcgtttgtttgttgtaaaagcgtcgttatgcgtttaacggtataaggtgcgttggttgaggttggtaatgataacgttagatattattttttttttcgtcgttaatgatttgcgtatttagcgtttggcggttgttgttttaatcgagcgaaatatatttagcgatcggtagaataaataagttatcgatttgattaagaggtcgtatgtaggcggggggacgttggcgtaaatattttcgtaaagttataatgttcggttggcgtaacggcgcgtttaatatttgttaggtattaggcgatagcggtataacgttgtttaagcggttgcgggtagttaatagtagttcgttatcggtattgcgttttgttgtttgtgaaataatttgttcgttcgttagtgcgttagtttgaaaattaaatagtcgacgcgtagttgtcggtgagt

SEQ ID NO: 35836 - DNA, 518 bp, Artificial Sequence
  chemically treated genomic DNA (Homo sapiens) CpG-island No: 35836
actcaccgacaactacgcgtcgactatttaattttcaaactaacgcactaacgaacgaacaaattatttcacaaacaacaaaacgcaataccgataacgaactactattaactacccgcaaccgcttaaacaacgttataccgctatcgcctaatacctaacaaatattaaacgcgccgttacgccaaccgaacattataactttacgaaaatatttacgccaacgtccccccgcctacatacgacctcttaatcaaatcgataacttatttattctaccgatcgctaaatatatttcgctcgattaaaacaacaaccgccaaacgctaaatacgcaaatcattaacgacgaaaaaaaaaataatatctaacgttatcattaccaacctcaaccaacgcaccttataccgttaaacgcataacgacgcttttacaacaaacaaacgaccccgtatatctaatttctaactttatcaattttattaaaaaacaattaacactaaaaccacgaataataa

SEQ ID NO: 35837 - DNA, 502 bp, Artificial Sequence
  chemically treated genomic DNA (Homo sapiens) CpG-island No: 35837
ttttttcggtgttgatttggcgaatttggtgaacgaagcggtattgttcgttgttcgtggtaataaacgcgttgtgtcgatggttgagttcgagaaagcgaaagataaaattatgatgggtgcggaacgtcgttttatggtgatgacggaagcgtagaaagaatcgacggtttattacgaagcgggttatgcgattatcggtcgtttggtgtcggaatacgattcggtgtataaagtgacgattattttacgcggtcgtgcgttgggtgtgattttttttttgtttgagggcgacgtaattagcgttagtcgttagaaattggaaagttagatttttacgttgtacggtggtcgtttggtagaagagattatttacgggtcggaatatgtatttatcggtgcgtttaacgatattaaagttgcgattaatttggtacgtaatatggtgatttagtggggtttttttgagaaattgggtttattgttgtacgcggaagaagaa

SEQ ID NO: 35838 - DNA, 502 bp, Artificial Sequence
  chemically treated genomic DNA (Homo sapiens) CpG-island No: 35838
ttcttcttccgcgtacaacaataaacccaatttctcaaaaaaaccccactaaatcaccatattacgtaccaaattaatcgcaactttaatatcgttaaacgcaccgataaatacatattccgacccgtaaataatctcttctaccaaacgaccaccgtacaacgtaaaaatctaactttccaatttctaacgactaacgctaattacgtcgccctcaaacaaaaaaaaaatcacacccaacgcacgaccgcgtaaaataatcgtcactttatacaccgaatcgtattccgacaccaaacgaccgataatcgcataacccgcttcgtaataaaccgtcgattctttctacgcttccgtcatcaccataaaacgacgttccgcacccatcataattttatctttcgctttctcgaactcaaccatcgacacaacgcgtttattaccacgaacaacgaacaataccgcttcgttcaccaaattcgccaaatcaacaccgaaaaaa

SEQ ID NO: 35839 - DNA, 502 bp, Artificial Sequence
  chemically treated genomic DNA (Homo sapiens) CpG-island No: 35839
tttttttttcgcgtatagtagtggatttaattttttagagaagttttattgagttattatgttacgtgttaggttggtcgtaattttaatatcgttggacgtatcggtagatatatgtttcggttcgtagatgattttttttgttagacgattatcgtatagcgtagaaatttggttttttagtttttgacggttggcgttgattgcgtcgtttttaggtaagaagaaagttatatttagcgtacgatcgcgtgggataatcgttattttgtgtatcggatcgtgtttcggtattaggcgatcgataatcgtatgattcgtttcgtggtaagtcgtcgattttttttgcgttttcgttattattatggagcgacgtttcgtatttattatgattttgtttttcgttttttcgaatttaattatcgatataacgcgtttgttgttacgagtagcgaatagtgtcgtttcgtttattaggttcgttaggttagtatcggagaaa

SEQ ID NO: 35840 - DNA, 502 bp, Artificial Sequence
  chemically treated genomic DNA (Homo sapiens) CpG-island No: 35840
tttctccgatactaacctaacgaacctaataaacgaaacgacactattcgctactcgtaacaacaaacgcgttatatcgataattaaattcgaaaaaacgaaaaacaaaatcataataaatacgaaacgtcgctccataataataacgaaaacgcaaaaaaaatcgacgacttaccacgaaacgaatcatacgattatcgatcgcctaataccgaaacacgatccgatacacaaaataacgattatcccacgcgatcgtacgctaaatataactttcttcttacctaaaaacgacgcaatcaacgccaaccgtcaaaaactaaaaaaccaaatttctacgctatacgataatcgtctaacaaaaaaaatcatctacgaaccgaaacatatatctaccgatacgtccaacgatattaaaattacgaccaacctaacacgtaacataataactcaataaaacttctctaaaaaattaaatccactactatacgcgaaaaaaaaa

SEQ ID NO: 35841 - DNA, 573 bp, Artificial Sequence
  chemically treated genomic DNA (Homo sapiens) CpG-island No: 35841
tggagttgcgtgttaggcggggttgtgcggagtagttgagcgtagagcggagtattaggtatttagcgggtcggattttgggcggtattcgagcgggtcgggtagtagtgggcgttcgcgatttttttttgtttaacgcgtttttttttcgggttcggtttttttcgttttttttttttgttttcgttttttttttcgttttttttttttttcgggattgagtattaaaacgttcgtttgtaaggttttttgcgttttggtagttaggagtcgtcgttacgatcgtcgggttttagtgggtgtttgcgtttttttttcgttcgtttgtttcgggttatttagaaatttgttttattcgtcgcgggtgttcggtagtgttgtttatggtttagtttaggagtttatttagggcgtcggacgggttggatagaggcgcggtttaggtgagtgcggcgcgcgcggggtgggagagtggtaggacgtaggtgtagagggtttcgaggtgtttttgtttggcgttttggatttcgggtaagtgtagaatttaagaagaatcgaggttggagtaggtgg

SEQ ID NO: 35842 - DNA, 573 bp, Artificial Sequence
  chemically treated genomic DNA (Homo sapiens) CpG-island No: 35842
ccacctactccaacctcgattcttcttaaattctacacttacccgaaatccaaaacgccaaacaaaaacacctcgaaaccctctacacctacgtcctaccactctcccaccccgcgcgcgccgcactcacctaaaccgcgcctctatccaacccgtccgacgccctaaataaactcctaaactaaaccataaacaacactaccgaacacccgcgacgaataaaacaaatttctaaataacccgaaacaaacgaacgaaaaaaaaacgcaaacacccactaaaacccgacgatcgtaacgacgactcctaactaccaaaacgcaaaaaaccttacaaacgaacgttttaatactcaatcccgaaaaaaaaaaaaaacgaaaaaaaaaacgaaaacaaaaaaaaaaaacgaaaaaaaccgaacccgaaaaaaaaacgcgttaaacaaaaaaaaatcgcgaacgcccactactacccgacccgctcgaataccgcccaaaatccgacccgctaaatacctaatactccgctctacgctcaactactccgcacaaccccgcctaacacgcaactcca

SEQ ID NO: 35843 - DNA, 573 bp, Artificial Sequence
  chemically treated genomic DNA (Homo sapiens) CpG-island No: 35843
ttatttgttttagtttcgattttttttaggttttgtatttgttcgaagtttagaacgttagataaaggtatttcggagttttttatatttgcgttttgttatttttttatttcgcgcgcgtcgtatttatttgagtcgcgtttttgtttagttcgttcggcgttttaaataggtttttgggttgggttatgggtagtattgtcgagtattcgcggcgggtagagtaagtttttggatggttcggggtaggcgggcggggagaaggcgtaggtatttattgagattcggcggtcgtggcggcgatttttggttgttagggcgtagaggattttgtaggcgggcgttttggtgtttaatttcgaggagggggaggagcgggaggaggagcgggagtaaaaggaggggacggaggaggtcgggttcggagggagagcgcgttgggtagaggaggatcgcgagcgtttattgttgttcggttcgttcgggtgtcgtttagagttcggttcgttaggtgtttggtgtttcgttttgcgtttagttgtttcgtatagtttcgtttggtacgtagtttta

SEQ ID NO: 35844 - DNA, 573 bp, Artificial Sequence
  chemically treated genomic DNA (Homo sapiens) CpG-island No: 35844
taaaactacgtaccaaacgaaactatacgaaacaactaaacgcaaaacgaaacaccaaacacctaacgaaccgaactctaaacgacacccgaacgaaccgaacaacaataaacgctcgcgatcctcctctacccaacgcgctctccctccgaacccgacctcctccgtcccctccttttactcccgctcctcctcccgctcctccccctcctcgaaattaaacaccaaaacgcccgcctacaaaatcctctacgccctaacaaccaaaaatcgccgccacgaccgccgaatctcaataaatacctacgccttctccccgcccgcctaccccgaaccatccaaaaacttactctacccgccgcgaatactcgacaatactacccataacccaacccaaaaacctatttaaaacgccgaacgaactaaacaaaaacgcgactcaaataaatacgacgcgcgcgaaataaaaaaataacaaaacgcaaatataaaaaactccgaaatacctttatctaacgttctaaacttcgaacaaatacaaaacctaaaaaaaatcgaaactaaaacaaataa

SEQ ID NO: 35845 - DNA, 819 bp, Artificial Sequence
  chemically treated genomic DNA (Homo sapiens) CpG-island No: 35845
ttttcggtcgttacgatttttaagggttagagttcggtcgtttatttttttttagttttagtttcgtgtcgcgtcggcgacggaagcggaatttatcgttttacgatattcgatggttttcgagagttttgggttcgtttattacgtacggagaaagtttttattttcgtaagatttacgtcgtcgggagtcgttacgatgtttcggtcggggggttaggagggtaaaagcgtagcggttcgggagtaatggggcggcggattgtagcgtcgttatgtcgaggttgaggggcgttgggggtatttgaggagtcgagcggtgggggtggggttgcgcgtcgggtttgtttcgattcgtataaagagatcgcgtttttttcgttttagttttataagagttttatcgtacgttcggggcgtcggttatttaaaagatcgttttcggtttttttatagattcgataagatgttaagagattcggtttggacgtttattagttttaattacggggattagatttttatttgagtcgggtttcggttaatatcgaagttattttaaattcgttagttttaggcgttaatttttttttttttttttacgtcgttttttttttttatatttttcggaggaacggcgtttattggttgacgttttgcgtgcgcgtttttttgatcgtttaatacgtttggttttttcgttacgaaaggggaaatagagcgcgtttaagggttgttttggtttcgtttaataatgagcggggttatatgttttgcgtttgttttgaaggaagggtttttttttgggtgggaaggaaag

SEQ ID NO: 35846 - DNA, 819 bp, Artificial Sequence
  chemically treated genomic DNA (Homo sapiens) CpG-island No: 35846
ctttccttcccacccaaaaaaaaacccttccttcaaaacaaacgcaaaacatataaccccgctcattattaaacgaaaccaaaacaacccttaaacgcgctctatttcccctttcgtaacgaaaaaaccaaacgtattaaacgatcaaaaaaacgcgcacgcaaaacgtcaaccaataaacgccgttcctccgaaaaatataaaaaaaaaaaacgacgtaaaaaaaaaaaaaaaaattaacgcctaaaactaacgaatttaaaataacttcgatattaaccgaaacccgactcaaataaaaatctaatccccgtaattaaaactaataaacgtccaaaccgaatctcttaacatcttatcgaatctataaaaaaaccgaaaacgatcttttaaataaccgacgccccgaacgtacgataaaactcttataaaactaaaacgaaaaaaacgcgatctctttatacgaatcgaaacaaacccgacgcgcaaccccacccccaccgctcgactcctcaaatacccccaacgcccctcaacctcgacataacgacgctacaatccgccgccccattactcccgaaccgctacgcttttaccctcctaaccccccgaccgaaacatcgtaacgactcccgacgacgtaaatcttacgaaaataaaaactttctccgtacgtaataaacgaacccaaaactctcgaaaaccatcgaatatcgtaaaacgataaattccgcttccgtcgccgacgcgacacgaaactaaaactaaaaaaaaataaacgaccgaactctaacccttaaaaatcgtaacgaccgaaaa

SEQ ID NO: 35847 - DNA, 819 bp, Artificial Sequence
  chemically treated genomic DNA (Homo sapiens) CpG-island No: 35847
tttttttttttatttaaaggaaagttttttttttagagtaagcgtaagatatatagtttcgtttattgttaagcgaggttaaggtaatttttaggcgcgttttattttttttttcgtagcgaaagggttaggcgtattgagcggttaggggagcgcgtacgtagaacgttagttagtaagcgtcgttttttcgggagatgtggaggaggggggcggcgtggaggaagagggggaagttggcgtttaaagttgacgggtttgaaatggtttcgatgttagtcgggattcgatttaggtgaaggtttggttttcgtagttggagttagtgggcgtttaagtcgggttttttaatattttgtcgaatttgtggaagggtcgggagcgattttttgggtagtcggcgtttcgggcgtacggtggggtttttgtgggattgggacgggagggacgcggtttttttgtgcgggtcggagtaggttcggcgcgtagttttatttttatcgttcggttttttaggtgtttttagcgttttttagtttcggtatggcgacgttgtagttcgtcgttttattgttttcgagtcgttgcgtttttatttttttggtttttcggtcgggatatcgtggcggttttcggcggcgtgggttttgcgggaatagaggtttttttcgtgcgtggtaaacgagtttaaggttttcgggagttatcgagtgtcgtggggcggtgggtttcgttttcgtcgtcggcgcggtacggagttgggattggaggaagatggacggtcgagttttggtttttgagggtcgtggcggtcgagga

SEQ ID NO: 35848 - DNA, 819 bp, Artificial Sequence
  chemically treated genomic DNA (Homo sapiens) CpG-island No: 35848
tcctcgaccgccacgaccctcaaaaaccaaaactcgaccgtccatcttcctccaatcccaactccgtaccgcgccgacgacgaaaacgaaacccaccgccccacgacactcgataactcccgaaaaccttaaactcgtttaccacgcacgaaaaaaacctctattcccgcaaaacccacgccgccgaaaaccgccacgatatcccgaccgaaaaaccaaaaaaataaaaacgcaacgactcgaaaacaataaaacgacgaactacaacgtcgccataccgaaactaaaaaacgctaaaaacacctaaaaaaccgaacgataaaaataaaactacgcgccgaacctactccgacccgcacaaaaaaaccgcgtccctcccgtcccaatcccacaaaaaccccaccgtacgcccgaaacgccgactacccaaaaaatcgctcccgacccttccacaaattcgacaaaatattaaaaaacccgacttaaacgcccactaactccaactacgaaaaccaaaccttcacctaaatcgaatcccgactaacatcgaaaccatttcaaacccgtcaactttaaacgccaacttccccctcttcctccacgccgcccccctcctccacatctcccgaaaaaacgacgcttactaactaacgttctacgtacgcgctcccctaaccgctcaatacgcctaaccctttcgctacgaaaaaaaaaataaaacgcgcctaaaaattaccttaacctcgcttaacaataaacgaaactatatatcttacgcttactctaaaaaaaaaactttcctttaaataaaaaaaaaaa

SEQ ID NO: 35849 - DNA, 682 bp, Artificial Sequence
  chemically treated genomic DNA (Homo sapiens) CpG-island No: 35849
cgttttcgtggcgggcgcgcgcggcgttcgttgttttcgtcgttttttgttcgtcgcgggtcgtttgtcggtcggcgcggtttttcgtcgcgttcgtttcgttcggcgttttcggttgtcgtattttttttcggttggtagaggtttttttttttcgtttcgtcgcgtttggcgtttttttttttttttttcgcgcggcggtagggcgtcggtttcgatttcgttgttaggagacgcgcggcggttcgggtgtcggtcgtcgcgtcgcggcggggaacgttggtgcgttttttttttggttcgtcgcgcggggggggcgcgcgttgtatgtggtcgcgttcggttggcgatggcggtttggattcgtgtcgatttgtatcgtttttgtgttcgcgtttcgcgttcgttggttagtttcgttcgtttttgttgtcgttttttacgtcggcgtcgtcgttgttcgcgtttgttttgttgagtcgttgtttttttgtttggtgggtacgtgcgtagggtttgtcgcggattgacgttggcgggacgttggttcgtgattgggcgttgtgtagagcgtcgtaagggtaacgttagcgtttacgtagtagattagtgttggaagagttttttgtagagaagtagaagaggaggttagggatggttagaatggagagcgcgtttatgt

SEQ ID NO: 35850 - DNA, 682 bp, Artificial Sequence
  chemically treated genomic DNA (Homo sapiens) CpG-island No: 35850
acataaacgcgctctccattctaaccatccctaacctcctcttctacttctctacaaaaaactcttccaacactaatctactacgtaaacgctaacgttacccttacgacgctctacacaacgcccaatcacgaaccaacgtcccgccaacgtcaatccgcgacaaaccctacgcacgtacccaccaaacaaaaaaacaacgactcaacaaaacaaacgcgaacaacgacgacgccgacgtaaaaaacgacaacaaaaacgaacgaaactaaccaacgaacgcgaaacgcgaacacaaaaacgatacaaatcgacacgaatccaaaccgccatcgccaaccgaacgcgaccacatacaacgcgcgccccccccgcgcgacgaaccaaaaaaaaaacgcaccaacgttccccgccgcgacgcgacgaccgacacccgaaccgccgcgcgtctcctaacaacgaaatcgaaaccgacgccctaccgccgcgcgaaaaaaaaaaaaaaaaacgccaaacgcgacgaaacgaaaaaaaaaaacctctaccaaccgaaaaaaaatacgacaaccgaaaacgccgaacgaaacgaacgcgacgaaaaaccgcgccgaccgacaaacgacccgcgacgaacaaaaaacgacgaaaacaacgaacgccgcgcgcgcccgccacgaaaacg

SEQ ID NO: 35851 - DNA, 682 bp, Artificial Sequence
  chemically treated genomic DNA (Homo sapiens) CpG-island No: 35851
atataggcgcgttttttattttgattatttttggtttttttttttgtttttttgtagaggatttttttagtattaatttgttgcgtgaacgttggcgttgtttttgcggcgttttatataacgtttagttacgagttaacgtttcgttagcgttaattcgcggtaagttttacgtacgtgtttattaagtaggagggtagcggtttagtagggtaagcgcggataacggcggcgtcggcgtgagaggcggtagtaggagcgagcgggattggttagcgagcgcggagcgcgggtataggggcggtgtaggtcggtacggatttaggtcgttatcgttagtcgggcgcggttatatgtagcgcgcgtttttttcgcgcgacgggttagagaagaggcgtattagcgtttttcgtcgcggcgcgacggtcggtattcgagtcgtcgcgcgttttttagtagcgaggtcggaatcgacgttttgtcgtcgcgcggagggggggaagggaggcgttaggcgcggcgaggcgggggggagagatttttgttagtcggaggggagtacgatagtcggaggcgtcgagcgggacgggcgcggcgaggggtcgcgtcgatcggtaggcggttcgcggcgggtaggagacgacgggagtagcgagcgtcgcgcgcgttcgttacgaggacg

SEQ ID NO: 35852 - DNA, 682 bp, Artificial Sequence
  chemically treated genomic DNA (Homo sapiens) CpG-island No: 35852
cgtcctcgtaacgaacgcgcgcgacgctcgctactcccgtcgtctcctacccgccgcgaaccgcctaccgatcgacgcgacccctcgccgcgcccgtcccgctcgacgcctccgactatcgtactcccctccgactaacaaaaatctctcccccccgcctcgccgcgcctaacgcctcccttccccccctccgcgcgacgacaaaacgtcgattccgacctcgctactaaaaaacgcgcgacgactcgaataccgaccgtcgcgccgcgacgaaaaacgctaatacgcctcttctctaacccgtcgcgcgaaaaaaacgcgcgctacatataaccgcgcccgactaacgataacgacctaaatccgtaccgacctacaccgcccctatacccgcgctccgcgctcgctaaccaatcccgctcgctcctactaccgcctctcacgccgacgccgccgttatccgcgcttaccctactaaaccgctaccctcctacttaataaacacgtacgtaaaacttaccgcgaattaacgctaacgaaacgttaactcgtaactaaacgttatataaaacgccgcaaaaacaacgccaacgttcacgcaacaaattaatactaaaaaaatcctctacaaaaaaacaaaaaaaaaaaccaaaaataatcaaaataaaaaacgcgcctatat

SEQ ID NO: 35853 - DNA, 573 bp, Artificial Sequence
  chemically treated genomic DNA (Homo sapiens) CpG-island No: 35853
gggcgtcgtgcgtattgtattttttttggcggattattcgttgggtcggtaggcgcgcgtatttaggtgttattttttagcgtcgtgcgcggataggtaggcgcgtgtttcggcgcgtcgtttcgtatttatttacgcgcggtttttttgtatttcggttagtattcgtagcgcgttgggcgagtcggatcggaagttgaagaagtgaagcgtcgcgcgcgtcgtttgttgtaggagtttgcgcgggattttagtattttgaggttgtttagggtcgtcggggttttcggatttcgcgggcgtcgttatcggggcgagtaatagtagtagcgcgagtagcggggcggtggggcgcgggtttttgggttcggattagggagtaggtagtcgttgtcggcggggttgtatggacgtaggaaagttggttcggtattcgatagatacgggttcggagcgggtagtgtcggcgttcgcggaaataaggtcgtggtggggtttttttttttcgtttttagggcgaaggtttgtagcgaagttcgggtttttatggggtttttttttttttaacgtttt

SEQ ID NO: 35854 - DNA, 573 bp, Artificial Sequence
  chemically treated genomic DNA (Homo sapiens) CpG-island No: 35854
aaaacgttaaaaaaaaaaaaaccccataaaaacccgaacttcgctacaaaccttcgccctaaaaacgaaaaaaaaaaaccccaccacgaccttatttccgcgaacgccgacactacccgctccgaacccgtatctatcgaataccgaaccaactttcctacgtccatacaaccccgccgacaacgactacctactccctaatccgaacccaaaaacccgcgccccaccgccccgctactcgcgctactactattactcgccccgataacgacgcccgcgaaatccgaaaaccccgacgaccctaaacaacctcaaaatactaaaatcccgcgcaaactcctacaacaaacgacgcgcgcgacgcttcacttcttcaacttccgatccgactcgcccaacgcgctacgaatactaaccgaaatacaaaaaaaccgcgcgtaaataaatacgaaacgacgcgccgaaacacgcgcctacctatccgcgcacgacgctaaaaaataacacctaaatacgcgcgcctaccgacccaacgaataatccgccaaaaaaaatacaatacgcacgacgccc

SEQ ID NO: 35855 - DNA, 573 bp, Artificial Sequence
  chemically treated genomic DNA (Homo sapiens) CpG-island No: 35855
gaaacgttgaaaaaggaggggttttatggggattcgggtttcgttatagattttcgttttgggggcggaggggaggggttttattacggttttattttcgcgagcgtcggtattgttcgtttcgagttcgtgtttgtcgggtgtcgagttaatttttttgcgtttatgtagtttcgtcggtaacggttgtttgttttttggttcgggtttaggggttcgcgttttatcgtttcgttgttcgcgttgttgttgttgttcgtttcggtggcggcgttcgcggggttcggggatttcgacgattttgggtagttttaggatgttggggtttcgcgtaggtttttgtagtaggcggcgcgcgcggcgttttatttttttaattttcggttcggttcgtttagcgcgttacgagtgttggtcgaggtgtaggagggtcgcgcgtgggtgagtgcggagcgacgcgtcggggtacgcgtttgtttgttcgcgtacggcgttgggaggtgatatttgggtacgcgcgtttgtcggtttaacggatggttcgttagggaaggtgtagtgcgtacgacgttt

SEQ ID NO: 35856 - DNA, 573 bp, Artificial Sequence
  chemically treated genomic DNA (Homo sapiens) CpG-island No: 35856
aaacgtcgtacgcactacaccttccctaacgaaccatccgttaaaccgacaaacgcgcgtacccaaatatcacctcccaacgccgtacgcgaacaaacaaacgcgtaccccgacgcgtcgctccgcactcacccacgcgcgaccctcctacacctcgaccaacactcgtaacgcgctaaacgaaccgaaccgaaaattaaaaaaataaaacgccgcgcgcgccgcctactacaaaaacctacgcgaaaccccaacatcctaaaactacccaaaatcgtcgaaatccccgaaccccgcgaacgccgccaccgaaacgaacaacaacaacaacgcgaacaacgaaacgataaaacgcgaacccctaaacccgaaccaaaaaacaaacaaccgttaccgacgaaactacataaacgcaaaaaaattaactcgacacccgacaaacacgaactcgaaacgaacaataccgacgctcgcgaaaataaaaccgtaataaaacccctcccctccgcccccaaaacgaaaatctataacgaaacccgaatccccataaaacccctcctttttcaacgtttc

SEQ ID NO: 35857 - DNA, 1108 bp, Artificial Sequence
  chemically treated genomic DNA (Homo sapiens) CpG-island No: 35857
ttcgttttcgtattttatttcgtttttgcgggaggttcggcgtatgaatcgcgattatttttgcgttttcgcggagtcgggtagaagagacgcgcgcgttgttttagtagtttcggttttcgtcgttcgtatttgagatttgtatcgtttggaagcggggtacgtaggttaggaagtcggcgacgttttcgtagttttcgggaaaggtgattaggcggttgttaagtattcgtaggttggggtttacgaatacgcgtagggggaagggttttatttggcggagcgcgcgttggcggggcgggtattttcgatatagcgtttcggggagttttagcgttagtatttgtcgcggtatttttagttgcggcgcgtttaggtttacgtagcgtcgtcgtcgtattatttggattagtcgttgcgttagtcgttgtagttcgggttcgtttagttgcgttcgttttatcggggtcgttacgtcgcgtagtatcgggttttcgatttggtatacgtgcgagaacggcggttcgggaggatttagtattagacgttttaggtggcgttaataggagcgtcgtagcgtcgggttttcgacgtcgttcggggcggtcgtggagttgtaagttcggatatcgacggttgtcgtttcgttttacggtacggtcgtttatagtggttaaagatttagcgcgttttatagtcgggttatggcggtttttttaatagtgattcggttcgtttttttcggtcgtagcgcggggtacgtcgggaagcgtcgtcggttagtatatagcgaagtcgcgattggattttcgtttttttgtttagattggtagtgagtatcgttttttttcgtttttttttcgggagcgttttttcgtttttcgaattcgtttcggattttttagggcgaggtagttttggttatttcgcgtcgggaattttacgtatcgcgttttggaggtaggggacgtcggttagggttttacgttgggcggttcggtttgcgttttcgttcgtttttttttcgggtaggttgggttcgcgggttttaggcgtggtttttcggcgggaggttttggtgttggagttgtgagttcgggttttagcg

SEQ ID NO: 35858 - DNA, 1108 bp, Artificial Sequence
  chemically treated genomic DNA (Homo sapiens) CpG-island No: 35858
cgctaaaacccgaactcacaactccaacaccaaaacctcccgccgaaaaaccacgcctaaaacccgcgaacccaacctacccgaaaaaaaaacgaacgaaaacgcaaaccgaaccgcccaacgtaaaaccctaaccgacgtcccctacctccaaaacgcgatacgtaaaattcccgacgcgaaataaccaaaactacctcgccctaaaaaatccgaaacgaattcgaaaaacgaaaaaacgctcccgaaaaaaaaacgaaaaaaaacgatactcactaccaatctaaacaaaaaaacgaaaatccaatcgcgacttcgctatatactaaccgacgacgcttcccgacgtaccccgcgctacgaccgaaaaaaacgaaccgaatcactattaaaaaaaccgccataacccgactataaaacgcgctaaatctttaaccactataaacgaccgtaccgtaaaacgaaacgacaaccgtcgatatccgaacttacaactccacgaccgccccgaacgacgtcgaaaacccgacgctacgacgctcctattaacgccacctaaaacgtctaatactaaatcctcccgaaccgccgttctcgcacgtataccaaatcgaaaacccgatactacgcgacgtaacgaccccgataaaacgaacgcaactaaacgaacccgaactacaacgactaacgcaacgactaatccaaataatacgacgacgacgctacgtaaacctaaacgcgccgcaactaaaaataccgcgacaaatactaacgctaaaactccccgaaacgctatatcgaaaatacccgccccgccaacgcgcgctccgccaaataaaacccttccccctacgcgtattcgtaaaccccaacctacgaatacttaacaaccgcctaatcacctttcccgaaaactacgaaaacgtcgccgacttcctaacctacgtaccccgcttccaaacgatacaaatctcaaatacgaacgacgaaaaccgaaactactaaaacaacgcgcgcgtctcttctacccgactccgcgaaaacgcaaaaataatcgcgattcatacgccgaacctcccgcaaaaacgaaataaaatacgaaaacgaa

SEQ ID NO: 35859 - DNA, 1108 bp, Artificial Sequence
  chemically treated genomic DNA (Homo sapiens) CpG-island No: 35859
cgttggggttcgagtttatagttttagtattagagtttttcgtcgaggagttacgtttggagttcgcgggtttagtttgttcggagggagggcgagcggagacgtaggtcgaatcgtttagcgtggggttttagtcggcgttttttgtttttagaacgcggtgcgtgaggttttcggcgcggggtggttaggattgtttcgttttggaaggttcggggcgggttcgggaggcgggaaggcgttttcgggaggagagcggaagggggcggtgtttattgttagtttaagtaggaaggcggggatttagtcgcggtttcgttgtgtgttggtcgacggcgtttttcggcgtgtttcgcgttgcggtcggaaggggcgggtcgggttattgttaagggggtcgttatggttcggttgtggggcgcgttgagtttttggttattgtgggcggtcgtgtcgtggggcggggcggtagtcgtcggtgttcgggtttgtagttttacggtcgtttcggacggcgtcgagggttcggcgttgcggcgtttttattggcgttatttgaggcgtttggtgttgggttttttcgaatcgtcgttttcgtacgtgtgttaagtcggggattcggtgttgcgcggcgtggcggtttcggtggagcgggcgtagttaggcgggttcgagttgtagcggttgacgtaacggttggtttaggtgatgcggcggcggcgttgcgtgggtttaagcgcgtcgtagttgggggtgtcgcggtaggtgttggcgttggagtttttcgaggcgttgtgtcgggagtgttcgtttcgttagcgcgcgtttcgttaaatggagtttttttttttgcgcgtgttcgtgaattttagtttgcgagtgtttgatagtcgtttggttatttttttcgagggttgcgagagcgtcgtcggttttttggtttgcgtgtttcgtttttaggcggtgtagattttaggtgcgggcggcggggatcggggttgttggagtagcgcgcgcgttttttttgttcgatttcgcgagagcgtagaagtggtcgcggtttatacgtcggatttttcgtaggagcgaagtgggatgcgggagcgga

SEQ ID NO: 35860 - DNA, 1108 bp, Artificial Sequence
  chemically treated genomic DNA (Homo sapiens) CpG-island No: 35860
tccgctcccgcatcccacttcgctcctacgaaaaatccgacgtataaaccgcgaccacttctacgctctcgcgaaatcgaacaaaaaaaacgcgcgcgctactccaacaaccccgatccccgccgcccgcacctaaaatctacaccgcctaaaaacgaaacacgcaaaccaaaaaaccgacgacgctctcgcaaccctcgaaaaaaataaccaaacgactatcaaacactcgcaaactaaaattcacgaacacgcgcaaaaaaaaaaactccatttaacgaaacgcgcgctaacgaaacgaacactcccgacacaacgcctcgaaaaactccaacgccaacacctaccgcgacacccccaactacgacgcgcttaaacccacgcaacgccgccgccgcatcacctaaaccaaccgttacgtcaaccgctacaactcgaacccgcctaactacgcccgctccaccgaaaccgccacgccgcgcaacaccgaatccccgacttaacacacgtacgaaaacgacgattcgaaaaaacccaacaccaaacgcctcaaataacgccaataaaaacgccgcaacgccgaaccctcgacgccgtccgaaacgaccgtaaaactacaaacccgaacaccgacgactaccgccccgccccacgacacgaccgcccacaataaccaaaaactcaacgcgccccacaaccgaaccataacgacccccttaacaataacccgacccgccccttccgaccgcaacgcgaaacacgccgaaaaacgccgtcgaccaacacacaacgaaaccgcgactaaatccccgccttcctacttaaactaacaataaacaccgcccccttccgctctcctcccgaaaacgccttcccgcctcccgaacccgccccgaaccttccaaaacgaaacaatcctaaccaccccgcgccgaaaacctcacgcaccgcgttctaaaaacaaaaaacgccgactaaaaccccacgctaaacgattcgacctacgtctccgctcgccctccctccgaacaaactaaacccgcgaactccaaacgtaactcctcgacgaaaaactctaatactaaaactataaactcgaaccccaacg

SEQ ID NO: 35861 - DNA, 526 bp, Artificial Sequence
  chemically treated genomic DNA (Homo sapiens) CpG-island No: 35861
  misc_feature (372)..(372): n is either a, c, g or t
ggtttgggcggtgtggattttaagttttagtgaggtattgcggcggtatatcgggaattacggcgtttgagaagggggtcgggtttttcgagttttttttttttttagaagttcgcgggcggttcggaatcgtttttttttttttattggtcgcgcggagtcgggacggtcggcgtttcgtttttcggtttcgggcgttcgtgttgtatttatcggtcgttttatgttcgatttaacgtcgtgtttcgtgtcgggatgggcggtcggagcggcgcgcgcgttattcgcgtttcgattcgcgcgtgagtgtagtgcgggtagttgtcgacgtgtagtttgcgttggttattttcgtaatggtcgggttttttngttatttatttgtgtgttcgcgtgttttgcgtgtgggcgttacgaagtttttggtttcggggcgttcggtagtgagtagtaggtagcgcgcgcgaggttacggttggtatatggaggttagtttaatttgttcgtgtgttttaagtttttattt

SEQ ID NO: 35862 - DNA, 526 bp, Artificial Sequence
  chemically treated genomic DNA (Homo sapiens) CpG-island No: 35862
  misc_feature (155)..(155): n is either a, c, g or t
aaataaaaacttaaaacacacgaacaaattaaactaacctccatataccaaccgtaacctcgcgcgcgctacctactactcactaccgaacgccccgaaaccaaaaacttcgtaacgcccacacgcaaaacacgcgaacacacaaataaataacnaaaaaacccgaccattacgaaaataaccaacgcaaactacacgtcgacaactacccgcactacactcacgcgcgaatcgaaacgcgaataacgcgcgcgccgctccgaccgcccatcccgacacgaaacacgacgttaaatcgaacataaaacgaccgataaatacaacacgaacgcccgaaaccgaaaaacgaaacgccgaccgtcccgactccgcgcgaccaataaaaaaaaaaaaacgattccgaaccgcccgcgaacttctaaaaaaaaaaaaaactcgaaaaacccgacccccttctcaaacgccgtaattcccgatataccgccgcaatacctcactaaaacttaaaatccacaccgcccaaacc

SEQ ID NO: 35863 - DNA, 526 bp, Artificial Sequence
  chemically treated genomic DNA (Homo sapiens) CpG-island No: 35863
  misc_feature (155)..(155): n is either a, c, g or t
aagtggaaatttgaagtatacgagtagattggattagtttttatatattagtcgtggtttcgcgcgcgttgtttgttgtttattgtcgggcgtttcgagattaggggtttcgtggcgtttatacgtagggtacgcgagtatataggtgaatagtngggaagttcgattattgcgagagtggttagcgtaagttgtacgtcggtaattgttcgtattgtatttacgcgcgagtcgagacgcgaatagcgcgcgcgtcgtttcggtcgtttatttcggtacggagtacgacgttagatcggatatgagacgatcgatgggtatagtacgagcgttcggagtcggaaagcggggcgtcgatcgtttcggtttcgcgcggttaatgagagaaagaaagcgatttcgagtcgttcgcgggtttttgggagggaaaggaattcggagggttcggttttttttttagacgtcgtagttttcgatgtgtcgtcgtaatgttttattggggtttgaagtttatatcgtttaggtt

SEQ ID NO: 35864 - DNA, 526 bp, Artificial Sequence
  chemically treated genomic DNA (Homo sapiens) CpG-island No: 35864
  misc_feature (372)..(372): n is either a, c, g or t
aacctaaacgatataaacttcaaaccccaataaaacattacgacgacacatcgaaaactacgacgtctaaaaaaaaaaccgaaccctccgaattcctttccctcccaaaaacccgcgaacgactcgaaatcgctttctttctctcattaaccgcgcgaaaccgaaacgatcgacgccccgctttccgactccgaacgctcgtactatacccatcgatcgtctcatatccgatctaacgtcgtactccgtaccgaaataaacgaccgaaacgacgcgcgcgctattcgcgtctcgactcgcgcgtaaatacaatacgaacaattaccgacgtacaacttacgctaaccactctcgcaataatcgaacttcccnactattcacctatatactcgcgtaccctacgtataaacgccacgaaacccctaatctcgaaacgcccgacaataaacaacaaacaacgcgcgcgaaaccacgactaatatataaaaactaatccaatctactcgtatacttcaaatttccactt

SEQ ID NO: 35865 - DNA, 903 bp, Artificial Sequence
  chemically treated genomic DNA (Homo sapiens) CpG-island No: 35865
aaaagtcgggtcgagtaaaaagtcgcggcggcggcggggggtaaaaagtcgcggtaggtagaaagtcgcggaggcggggggtaaaaagttacggcggcgggggtgaaaaagtcgcggcggtgggtgggggggtaaaaagtcgtagcgataaaaagtcgcggcgggggggaaaaagtcgcggtagcgggggggggggcggggataaaaagttaggtcgggtaaaaagtcgtagtagcggggggtaaaagtcgtagcgggtagaaaggcgcggcggcggggtaaaaagtcgaggtcggtaaaaagtcgcggcggtagggggaaaaagtcgcggcggcgggggtgtaaaaagtcgcggtgggtaaataatcgcggtatcgggggcgttaaaaagtcgcggagggtaaaaagtcgcgtcggcggggggggtaaaaagtcgcggcgggtaaataatcgcggtatcggaggtaggggttaaaaagtcgcgtcggcggaggagcgaaaagtcggggcgggtaaaaagtcgcgagggcggttgaggggcggggaatcgcggcggtaggggggtaaaaagtcgcggcgggtataaattcgaggcggcggggaaaaggttacggcgttagggggtaaaaagtcgtcgcggtaaaaagttatcgcggcgggggtgaaaaagtcgcggcggtcggggggagtaaaaagtcgcggcggtaaaaagttacggtagtgggggtgaaaaagtcgcggcggtgggggggtaaaaagtcgggtcgagtaaaaagtcgcggcggcgagggggtaaaaagtcgcggcgacgcggggtaaaatagtggagatggggtagaaggtcggtatagtttggttttgttggagtgtgatatgataggaaatgtgtagttaaagataaaa

SEQ ID NO: 35866 - DNA, 903 bp, Artificial Sequence
  chemically treated genomic DNA (Homo sapiens) CpG-island No: 35866
ttttatctttaactacacatttcctatcatatcacactccaacaaaaccaaactataccgaccttctaccccatctccactattttaccccgcgtcgccgcgactttttaccccctcgccgccgcgactttttactcgacccgactttttacccccccaccgccgcgactttttcacccccactaccgtaactttttaccgccgcgactttttactccccccgaccgccgcgactttttcacccccgccgcgataactttttaccgcgacgactttttaccccctaacgccgtaaccttttccccgccgcctcgaatttatacccgccgcgactttttacccccctaccgccgcgattccccgcccctcaaccgccctcgcgactttttacccgccccgacttttcgctcctccgccgacgcgactttttaacccctacctccgataccgcgattatttacccgccgcgactttttaccccccccgccgacgcgactttttaccctccgcgactttttaacgcccccgataccgcgattatttacccaccgcgactttttacacccccgccgccgcgactttttccccctaccgccgcgactttttaccgacctcgactttttaccccgccgccgcgcctttctacccgctacgacttttaccccccgctactacgactttttacccgacctaactttttatccccgcccccccccccgctaccgcgactttttcccccccgccgcgactttttatcgctacgactttttacccccccacccaccgccgcgactttttcacccccgccgccgtaactttttaccccccgcctccgcgactttctacctaccgcgactttttaccccccgccgccgccgcgactttttactcgacccgactttt

SEQ ID NO: 35867 - DNA, 903 bp, Artificial Sequence
  chemically treated genomic DNA (Homo sapiens) CpG-island No: 35867
ttttgtttttggttgtatattttttattatattatattttagtaaagttaagttgtgtcggttttttattttatttttattattttgtttcgcgtcgtcgcggttttttgttttttcgtcgtcgcggttttttgttcgattcggttttttgtttttttatcgtcgcggtttttttatttttattgtcgtggttttttgtcgtcgcggttttttgtttttttcgatcgtcgcggtttttttattttcgtcgcggtggttttttgtcgcggcggttttttgttttttgacgtcgtggtttttttttcgtcgtttcgggtttatgttcgtcgcggttttttgtttttttgtcgtcgcggtttttcgttttttaatcgttttcgcggttttttgttcgtttcggtttttcgttttttcgtcgacgcggttttttgatttttgttttcggtgtcgcggttatttgttcgtcgcggttttttgtttttttcgtcgacgcggttttttgtttttcgcgattttttggcgttttcggtgtcgcggttatttgtttatcgcggttttttgtattttcgtcgtcgcggttttttttttttgtcgtcgcggttttttgtcggtttcggttttttgtttcgtcgtcgcgtttttttgttcgttgcggtttttatttttcgttgttgcggttttttgttcgatttggttttttgttttcgttttttttttcgttgtcgcggttttttttttttcgtcgcggttttttgtcgttgcggttttttgtttttttatttatcgtcgcggtttttttattttcgtcgtcgtggttttttgtttttcgttttcgcggttttttgtttgtcgcggttttttatttttcgtcgtcgtcgcggttttttgttcgattcggttttt

SEQ ID NO: 35868 - DNA, 903 bp, Artificial Sequence
  chemically treated genomic DNA (Homo sapiens) CpG-island No: 35868
aaaaaccgaatcgaacaaaaaaccgcgacgacgacgaaaaataaaaaaccgcgacaaacaaaaaaccgcgaaaacgaaaaacaaaaaaccacgacgacgaaaataaaaaaaccgcgacgataaataaaaaaacaaaaaaccgcaacgacaaaaaaccgcgacgaaaaaaaaaaaaccgcgacaacgaaaaaaaaaacgaaaacaaaaaaccaaatcgaacaaaaaaccgcaacaacgaaaaataaaaaccgcaacgaacaaaaaaacgcgacgacgaaacaaaaaaccgaaaccgacaaaaaaccgcgacgacaaaaaaaaaaaaccgcgacgacgaaaatacaaaaaaccgcgataaacaaataaccgcgacaccgaaaacgccaaaaaatcgcgaaaaacaaaaaaccgcgtcgacgaaaaaaacaaaaaaccgcgacgaacaaataaccgcgacaccgaaaacaaaaatcaaaaaaccgcgtcgacgaaaaaacgaaaaaccgaaacgaacaaaaaaccgcgaaaacgattaaaaaacgaaaaaccgcgacgacaaaaaaacaaaaaaccgcgacgaacataaacccgaaacgacgaaaaaaaaaccacgacgtcaaaaaacaaaaaaccgccgcgacaaaaaaccaccgcgacgaaaataaaaaaaccgcgacgatcgaaaaaaacaaaaaaccgcgacgacaaaaaaccacgacaataaaaataaaaaaaccgcgacgataaaaaaacaaaaaaccgaatcgaacaaaaaaccgcgacgacgaaaaaacaaaaaaccgcgacgacgcgaaacaaaataataaaaataaaataaaaaaccgacacaacttaactttactaaaatataatataataaaaaatatacaaccaaaaacaaaa

SEQ ID NO: 35869 - DNA, 1375 bp, Artificial Sequence
  chemically treated genomic DNA (Homo sapiens) CpG-island No: 35869
cgtaggttgttaacggagatgtcgatgagtttttggagttgttcgtattgttgtagtgttcggttggtcgcggtttttgtattttttttcgcgatagtcgcgttattttcgttatcgttttttttttttttttttaacgcggtcgagcgtagcgttgttttatgtaggttgtagcggtttaggagtagagttcggggcgttagcgtttaggtaaggaacgttcgaattaggagagttggataaggagcgtttttcggcgttgttttagttaggacgtcggtagagttggtagtcgagtttgtcgatttcgtttttagattcgcggcggtgggggtaaaaagtcgcggtgatgggggtaataagtcgcggtggcgggggtaaaagtcgcggcggcggaggtaaaaagtcgtaaaaagtcgtagcgtcgggggtaaaaagtcgcgacggcgggggtaaaaagtcgcggtggcgggggtaagaagtcgcggtggcgggggtaaaaagtaggggcgggaaaaatttgcggcggtgggggaaaaaagtttcggtggcggggattaaaagttttaaaaagtcgcggcgttgggtgttaaaagtcgtaaaaagtcgcggcggagggggttaaaagtcgcggcggtaaaaagttacgatagcggggatataaagtcgtaaaaatttttagaggtaggggtagaaagtcgtcgttgtgggggtaaaaagtcgcggcgaggggggtaagaagtcgcggcggtaaaaattcgcggcggggggtttaaaaagcggttggggtgataaaaagttacggtggcggaggtaggaagtcgcgtagggggtaaggagtcgcggttgcgggggtaaaacgtcgcggtggtagggataaatagtagtaaaaagtcgcggcgtaaaaagttcgggcggtgggggtaagaagtcgcggtaggaaaaattcgcggcggtaaaaagtcgtaaaaagtcgcggcgtcgggggttaaaagttataaaaagtcgcggcggaaaaagtcgcggtggcgggggtaaaaagttgcggtagtagggggaaaaaagtcgtcgcggcggggggagaaagacgtaaaaagtcgcggtagtaaaaagtcgcggcggcgagggtaaagagttttaaaaagttacggcggtaggggttaaatttcgcgaggtcgggggtagaaagtcgcggtggtaggggtagaaagtcgcggtggcgggggtagaaagtaacggcggcgggggtaaaaagtcgtaaaaattcgtagtggcgggggtaaaaatttatggcggtaaaaagtcgcgtttgcgggtgtaaaatagtggaaatggggtagaaggttagtatagtttggtatttttgaagtgtgat

SEQ ID NO: 35870 - DNA, 1375 bp, Artificial Sequence
  chemically treated genomic DNA (Homo sapiens) CpG-island No: 35870
atcacacttcaaaaataccaaactatactaaccttctaccccatttccactattttacacccgcaaacgcgactttttaccgccataaatttttacccccgccactacgaatttttacgactttttacccccgccgccgttactttctacccccgccaccgcgactttctacccctaccaccgcgactttctacccccgacctcgcgaaatttaacccctaccgccgtaactttttaaaactctttaccctcgccgccgcgactttttactaccgcgactttttacgtctttctccccccgccgcgacgacttttttccccctactaccgcaactttttacccccgccaccgcgactttttccgccgcgactttttataacttttaacccccgacgccgcgactttttacgactttttaccgccgcgaatttttcctaccgcgacttcttacccccaccgcccgaactttttacgccgcgactttttactactatttatccctaccaccgcgacgttttacccccgcaaccgcgactccttaccccctacgcgacttcctacctccgccaccgtaactttttatcaccccaaccgctttttaaaccccccgccgcgaatttttaccgccgcgacttcttacccccctcgccgcgactttttacccccacaacgacgactttctacccctacctctaaaaatttttacgactttatatccccgctatcgtaactttttaccgccgcgacttttaaccccctccgccgcgactttttacgacttttaacacccaacgccgcgactttttaaaacttttaatccccgccaccgaaacttttttcccccaccgccgcaaatttttcccgcccctactttttacccccgccaccgcgacttcttacccccgccaccgcgactttttacccccgccgtcgcgactttttacccccgacgctacgactttttacgactttttacctccgccgccgcgacttttacccccgccaccgcgacttattacccccatcaccgcgactttttacccccaccgccgcgaatctaaaaacgaaatcgacaaactcgactaccaactctaccgacgtcctaactaaaacaacgccgaaaaacgctccttatccaactctcctaattcgaacgttccttacctaaacgctaacgccccgaactctactcctaaaccgctacaacctacataaaacaacgctacgctcgaccgcgttaaaaaaaaaaaaaaaaaacgataacgaaaataacgcgactatcgcgaaaaaaaatacaaaaaccgcgaccaaccgaacactacaacaatacgaacaactccaaaaactcatcgacatctccgttaacaacctacg

SEQ ID NO: 35871 - DNA, 1375 bp, Artificial Sequence
  chemically treated genomic DNA (Homo sapiens) CpG-island No: 35871
attatattttaggaatgttaagttgtgttggttttttattttatttttattgttttgtattcgtagacgcggttttttgtcgttatggatttttgttttcgttattgcgggtttttgcgattttttgttttcgtcgtcgttgttttttgttttcgttatcgcggttttttgtttttgttatcgcggttttttgttttcggtttcgcggaatttagtttttgtcgtcgtggttttttggggttttttgttttcgtcgtcgcggttttttgttgtcgcggttttttgcgttttttttttttcgtcgcggcggtttttttttttttgttgtcgtagttttttgttttcgttatcgcgatttttttcgtcgcggttttttatggtttttggttttcggcgtcgcggttttttgcggttttttgtcgtcgcgggttttttttgtcgcggttttttgtttttatcgttcgggttttttgcgtcgcggttttttgttgttatttgtttttgttatcgcggcgttttgttttcgtagtcgcggttttttgttttttacgcggttttttgttttcgttatcgtggttttttattattttagtcgttttttgaatttttcgtcgcgggtttttgtcgtcgcggttttttgtttttttcgtcgcggttttttatttttatagcggcggttttttgtttttgtttttgagggtttttgcggttttatgttttcgttgtcgtggttttttgtcgtcgcggtttttggtttttttcgtcgcggttttttgcggtttttggtatttaacgtcgcggttttttggggtttttggttttcgttatcggggttttttttttttatcgtcgtaggtttttttcgtttttgttttttgttttcgttatcgcggttttttattttcgttatcgcgattttttgttttcgtcgtcgcggttttttgttttcgacgttgcggttttttacggttttttgttttcgtcgtcgcggtttttgttttcgttatcgcggtttgttgtttttattatcgcggttttttgtttttatcgtcgcgggtttgagggcgggatcggtagattcggttgttagttttatcggcgttttggttaaggtagcgtcgaggggcgttttttgtttagtttttttggttcgggcgttttttgtttagacgttggcgtttcgggttttgtttttgggtcgttgtagtttgtatagagtagcgttgcgttcggtcgcgttgggagagaagaaggagggcggtggcgggggtgacgcggttatcgcggagggaggtgtaggggtcgcggttagtcggatattgtagtagtgcgggtagttttagaagtttatcggtattttcgttggtagtttgcg

SEQ ID NO: 35872 - DNA, 1375 bp, Artificial Sequence
  chemically treated genomic DNA (Homo sapiens) CpG-island No: 35872
cgcaaactaccaacgaaaataccgataaacttctaaaactacccgcactactacaatatccgactaaccgcgacccctacacctccctccgcgataaccgcgtcacccccgccaccgccctccttcttctctcccaacgcgaccgaacgcaacgctactctatacaaactacaacgacccaaaaacaaaacccgaaacgccaacgtctaaacaaaaaacgcccgaaccaaaaaaactaaacaaaaaacgcccctcgacgctaccttaaccaaaacgccgataaaactaacaaccgaatctaccgatcccgccctcaaacccgcgacgataaaaacaaaaaaccgcgataataaaaacaacaaaccgcgataacgaaaacaaaaaccgcgacgacgaaaacaaaaaaccgtaaaaaaccgcaacgtcgaaaacaaaaaaccgcgacgacgaaaacaaaaaatcgcgataacgaaaataaaaaaccgcgataacgaaaacaaaaaacaaaaacgaaaaaaacctacgacgataaaaaaaaaaaaccccgataacgaaaaccaaaaaccccaaaaaaccgcgacgttaaataccaaaaaccgcaaaaaaccgcgacgaaaaaaaccaaaaaccgcgacgacaaaaaaccacgacaacgaaaacataaaaccgcaaaaaccctcaaaaacaaaaacaaaaaaccgccgctataaaaataaaaaaccgcgacgaaaaaaacaaaaaaccgcgacgacaaaaacccgcgacgaaaaattcaaaaaacgactaaaataataaaaaaccacgataacgaaaacaaaaaaccgcgtaaaaaacaaaaaaccgcgactacgaaaacaaaacgccgcgataacaaaaacaaataacaacaaaaaaccgcgacgcaaaaaacccgaacgataaaaacaaaaaaccgcgacaaaaaaaacccgcgacgacaaaaaaccgcaaaaaaccgcgacgccgaaaaccaaaaaccataaaaaaccgcgacgaaaaaaatcgcgataacgaaaacaaaaaactacgacaacaaaaaaaaaaaaaccgccgcgacgaaaaaaaaaaaacgcaaaaaaccgcgacaacaaaaaaccgcgacgacgaaaacaaaaaaccccaaaaaaccacgacgacaaaaactaaattccgcgaaaccgaaaacaaaaaaccgcgataacaaaaacaaaaaaccgcgataacgaaaacaaaaaacaacgacgacgaaaacaaaaaatcgcaaaaacccgcaataacgaaaacaaaaatccataacgacaaaaaaccgcgtctacgaatacaaaacaataaaaataaaataaaaaaccaacacaacttaacattcctaaaatataat

SEQ ID NO: 35873 - DNA, 869 bp, Artificial Sequence
  chemically treated genomic DNA (Homo sapiens) CpG-island No: 35873
tattttcgtagaatattggtatgtagtttggagtattttatagcggttatatgaggcgcgagggtaaagttacggtttcgtacgttcgtagaataggagtacgtgttgtttgtagtattttaacggtatttaggtaaaggttcgcgggtgagattattgtttttcgttttaatagtatagcggtacgtgtcgtttggagtattttacggtagttaacgcgaaggcgttagggtgaaattacgtttttttatttcgatagaatagcggtacgtgttgtcggcgtattttgtggtagttacgcgaaggttcgaggtcgcgagcgtgtgtttagttagggtcggttgcgggtattcggttttgcgttttatttcgttgtggtttggttgttgattcgtaggtacgtttacggttattttattatggcgaggatggcggtattgtggcggaagatgagagataatttttagagtaaggagtttcgggaatacgtgagtagtatttatttttggggtttcgcgtttagttggggtttttcgttggttgtttttaaagatatgaaggcgtcgtcggagattattagtggtcgtatgataatagcgtttattttgtattcggcgatttttatgcgtttcgtttatcgcgtatagtttcgaaatttgttgttgatggcgtgttattgtattaacgtgatggcgtagagtgtgtaggttagtcgttatttattttattattacggcggcggcggcgtcgaggttaaagttcgcgatttttcggttatcgtcgtcgttgttattagttcgggtttttagttttcgaaataagttttttaagaattgagagggtttgattttatttttgtaggttataag

SEQ ID NO: 35874 - DNA, 869 bp, Artificial Sequence
  chemically treated genomic DNA (Homo sapiens) CpG-island No: 35874
cttataacctacaaaaataaaatcaaaccctctcaattcttaaaaaacttatttcgaaaactaaaaacccgaactaataacaacgacgacgataaccgaaaaatcgcgaactttaacctcgacgccgccgccgccgtaataataaaataaataacgactaacctacacactctacgccatcacgttaatacaataacacgccatcaacaacaaatttcgaaactatacgcgataaacgaaacgcataaaaatcgccgaatacaaaataaacgctattatcatacgaccactaataatctccgacgacgccttcatatctttaaaaacaaccaacgaaaaaccccaactaaacgcgaaaccccaaaaataaatactactcacgtattcccgaaactccttactctaaaaattatctctcatcttccgccacaataccgccatcctcgccataataaaataaccgtaaacgtacctacgaatcaacaaccaaaccacaacgaaataaaacgcaaaaccgaatacccgcaaccgaccctaactaaacacacgctcgcgacctcgaaccttcgcgtaactaccacaaaatacgccgacaacacgtaccgctattctatcgaaataaaaaaacgtaatttcaccctaacgccttcgcgttaactaccgtaaaatactccaaacgacacgtaccgctatactattaaaacgaaaaacaataatctcacccgcgaacctttacctaaataccgttaaaatactacaaacaacacgtactcctattctacgaacgtacgaaaccgtaactttaccctcgcgcctcatataaccgctataaaatactccaaactacataccaatattctacgaaaata

SEQ ID NO: 35875 - DNA, 869 bp, Artificial Sequence
  chemically treated genomic DNA (Homo sapiens) CpG-island No: 35875
tttgtgatttgtagagatgagattaggtttttttagtttttaagaagtttgtttcgggggttgggaattcgggttggtggtagcggcggcggtagtcggagggtcgcgggttttagtttcggcgtcgtcgtcgtcgtagtagtagagtaggtagcgattggtttgtatattttgcgttattacgttggtatagtggtacgttattagtagtaggtttcgaggttgtacgcggtaggcgaagcgtatgaagatcgtcgagtataagatgagcgttgttgttatgcggttattgatgattttcggcgacgtttttatgtttttaaaggtagttagcggaaggttttagttgaacgcgggattttagaagtgagtgttgtttacgtattttcggaattttttgttttggaagttattttttatttttcgttatagtatcgttattttcgttatgatggaatagtcgtaggcgtgtttacggattaatagttagattataacgaaatagagcgtaaagtcgagtattcgtagtcgattttgattgggtatacgttcgcgatttcgagttttcgcgtggttgttataaagtgcgtcgatagtacgtgtcgttgttttgtcggaatgaaagggcgtggttttattttggcgttttcgcgttgattatcgtaaagtgttttagacggtacgtgtcgttgtgttattggggcgaaaggtagtggttttattcgcgggtttttgtttgaatgtcgttaaagtgttgtagatagtacgtgtttttgttttgcgggcgtgcgaggtcgtggttttgttttcgcgttttatgtaatcgttgtaaagtgttttagattatatgttaatgttttgcgggaatg

SEQ ID NO: 35876 - DNA, 869 bp, Artificial Sequence
  chemically treated genomic DNA (Homo sapiens) CpG-island No: 35876
cattcccgcaaaacattaacatataatctaaaacactttacaacgattacataaaacgcgaaaacaaaaccacgacctcgcacgcccgcaaaacaaaaacacgtactatctacaacactttaacgacattcaaacaaaaacccgcgaataaaaccactacctttcgccccaataacacaacgacacgtaccgtctaaaacactttacgataatcaacgcgaaaacgccaaaataaaaccacgccctttcattccgacaaaacaacgacacgtactatcgacgcactttataacaaccacgcgaaaactcgaaatcgcgaacgtatacccaatcaaaatcgactacgaatactcgactttacgctctatttcgttataatctaactattaatccgtaaacacgcctacgactattccatcataacgaaaataacgatactataacgaaaaataaaaaataacttccaaaacaaaaaattccgaaaatacgtaaacaacactcacttctaaaatcccgcgttcaactaaaaccttccgctaactacctttaaaaacataaaaacgtcgccgaaaatcatcaataaccgcataacaacaacgctcatcttatactcgacgatcttcatacgcttcgcctaccgcgtacaacctcgaaacctactactaataacgtaccactataccaacgtaataacgcaaaatatacaaaccaatcgctacctactctactactacgacgacgacgacgccgaaactaaaacccgcgaccctccgactaccgccgccgctaccaccaacccgaattcccaacccccgaaacaaacttcttaaaaactaaaaaaacctaatctcatctctacaaatcacaaa

SEQ ID NO: 35877 - DNA, 1521 bp, Artificial Sequence
  chemically treated genomic DNA (Homo sapiens) CpG-island No: 35877
ttttcggtttacgggtcgaaaattttggcgattgggacgcggttaggcgggtcgggggcgaggggcgttgattagaagcgggcggagtttagggttcgggtcggtagtttgatttttcgtgggtcggttttgttgggtgggtattttcgcggggcgtcgaggtataatatgagggttttttcgttgatatcgaggggttttgagggttgtaagaaatgtaggttcggcggttgttttcgagagcgggacgcgcgttcgcgcggtgggcgggaattttaaggggacgcggaggcgggcgcgcgtttcgtaggggagggggcggagagcgcgagaaggagggaggaggcgttttcgtgcgggagttcggttgatcgcgttagatttagatagagtatcgcggttttggttgtaataggcggtgggttcggttcgggggcggaggcggcgaaagggcggggagcgcgaggaggagcgatttggttttatcgttgtcgtttttttttcgtcgtatggacgagcgttttagttttttgcgttcgtcgtcgtcgtttttagttcgttatcgcgtttattttttttagcgtttagcgagtagcggcggtgtttatacgttggtgaattacggttacgcggagttcgtcgtaggtcgcgagttgtcgttcgatatgatcgtggtgttcggggattatttgttggagtcggaggtggtcgatggtggaggggtttcgttttaaggcggttgtggcggcggcggttgcgatcgttacgagtcgttgtcgtttttattgtcggtcgcgggcgagtaggattgttgcggggagcgcgtggttattaatattttcgggttgcgtttcgagacgtagttgaagattttttgttagtttttcgagacgttgttgggcgattttaagcggcgtatgaggtatttcgattcgtttcgtaacgagtattttttcgatcgtaatcggtttagtttcgacgttattttttattattattagttcgggggtcgtattcgtcggtcggttaacgtgtttatcgatatttttttcgaggagattcgtttttattagttgggcgaggaggttatggagaagtttcgcgaggacgagggttttttgcgggaggaggagcggtttttgtttcgtcgcgatttttagcgttaggtgtggttgtttttcgagtatttcgagagtttcgggtcggttcggggtatcgttatcgtgttcgtgttggttatttttatttttattgttattttttgtttggagacgttgtcggagtttcgcgacgagaaggattatttcgtttcgacgtcgtaggatttattcgaagtagtcggtaatagtacgtcggggtttcgcgtaggagtttttagttttttcgatttttttttcgtggtggagacgttgtgtattatttggttttttttcgaattgttggtgcggtttttcgtttgttttagtaaagttattttttcgcgaaatattatgaatttgatcgatattgtggttattattt

SEQ ID NO: 35878 - DNA, 1521 bp, Artificial Sequence
  chemically treated genomic DNA (Homo sapiens) CpG-island No: 35878
aaataataaccacaatatcgatcaaattcataatatttcgcgaaaaaataactttactaaaacaaacgaaaaaccgcaccaacaattcgaaaaaaaaccaaataatacacaacgtctccaccacgaaaaaaaaatcgaaaaaactaaaaactcctacgcgaaaccccgacgtactattaccgactacttcgaataaatcctacgacgtcgaaacgaaataatccttctcgtcgcgaaactccgacaacgtctccaaacaaaaaataacaataaaaataaaaataaccaacacgaacacgataacgataccccgaaccgacccgaaactctcgaaatactcgaaaaacaaccacacctaacgctaaaaatcgcgacgaaacaaaaaccgctcctcctcccgcaaaaaaccctcgtcctcgcgaaacttctccataacctcctcgcccaactaataaaaacgaatctcctcgaaaaaaatatcgataaacacgttaaccgaccgacgaatacgacccccgaactaataataataaaaaataacgtcgaaactaaaccgattacgatcgaaaaaatactcgttacgaaacgaatcgaaatacctcatacgccgcttaaaatcgcccaacaacgtctcgaaaaactaacaaaaaatcttcaactacgtctcgaaacgcaacccgaaaatattaataaccacgcgctccccgcaacaatcctactcgcccgcgaccgacaataaaaacgacaacgactcgtaacgatcgcaaccgccgccgccacaaccgccttaaaacgaaacccctccaccatcgaccacctccgactccaacaaataatccccgaacaccacgatcatatcgaacgacaactcgcgacctacgacgaactccgcgtaaccgtaattcaccaacgtataaacaccgccgctactcgctaaacgctaaaaaaaataaacgcgataacgaactaaaaacgacgacgacgaacgcaaaaaactaaaacgctcgtccatacgacgaaaaaaaaacgacaacgataaaaccaaatcgctcctcctcgcgctccccgccctttcgccgcctccgcccccgaaccgaacccaccgcctattacaaccaaaaccgcgatactctatctaaatctaacgcgatcaaccgaactcccgcacgaaaacgcctcctccctccttctcgcgctctccgccccctcccctacgaaacgcgcgcccgcctccgcgtccccttaaaattcccgcccaccgcgcgaacgcgcgtcccgctctcgaaaacaaccgccgaacctacatttcttacaaccctcaaaacccctcgatatcaacgaaaaaaccctcatattatacctcgacgccccgcgaaaatacccacccaacaaaaccgacccacgaaaaatcaaactaccgacccgaaccctaaactccgcccgcttctaatcaacgcccctcgcccccgacccgcctaaccgcgtcccaatcgccaaaattttcgacccgtaaaccgaaaa

SEQ ID NO: 35879 - DNA, 1521 bp, Artificial Sequence
  chemically treated genomic DNA (Homo sapiens) CpG-island No: 35879
gaatgatggttataatgtcgattaggtttatgatgtttcgcgagaaggtggttttgttaggataagcgaagaatcgtattagtagttcgaaggagaattagatgatgtatagcgtttttattacgaagaagggatcggagaagttggaggtttttgcgcgggatttcgacgtgttgttgtcggttgtttcgaatgagttttgcgacgtcgaggcggggtagtttttttcgtcgcggaatttcggtagcgtttttaggtagaagatgataatggagatgaggatgattagtacggatacgatggcgatgtttcgggtcggttcggagttttcggggtattcgaagagtagttatatttggcgttggaagtcgcggcggggtaagggtcgttttttttttcgtaggaagttttcgttttcgcggaatttttttatggttttttcgtttagttggtagaagcggattttttcggagaaaatgtcgatgggtacgttgatcggtcggcggatgcggttttcggattgatagtagtagaggatggcgtcgaagttgggtcggttgcggtcgaagaagtattcgttgcggagcgggtcgaagtattttatgcgtcgtttggggtcgtttagtagcgtttcggggaattggtaaagggtttttagttgcgtttcgaagcgtagttcggagatgttgatgattacgcgtttttcgtagtagttttgttcgttcgcggtcggtagtgagggcggtagcggttcgtagcggtcgtagtcgtcgtcgttatagtcgttttgaggcggggtttttttattatcggttattttcggttttagtaggtggttttcgggtattacggttatgtcgggcggtagttcgcggtttgcggcgggtttcgcgtagtcgtggtttattagcgtgtgggtatcgtcgttgttcgttgggcgttgaggagggtgggcgcggtggcgggttgagggcggcggcggcgagcgtagaaggttgaggcgttcgtttatgcggcggggaagaggcggtagcggtgaggttaggtcgttttttttcgcgtttttcgttttttcgtcgttttcgttttcgagtcgagtttatcgtttgttgtagttaaagtcgcgatgttttgtttgggtttggcgcggttagtcgggttttcgtacggggacgttttttttttttttttcgcgtttttcgtttttttttttgcggggcgcgcgttcgttttcgcgtttttttaggattttcgtttatcgcgcgggcgcgcgtttcgttttcgggggtagtcgtcgggtttgtattttttgtagtttttaaggtttttcggtgttagcgaaagagtttttatgttgtatttcggcgtttcgcgggaatgtttatttagtagagtcggtttacggggagttaggttgtcggttcgggttttaggtttcgttcgtttttggttagcgtttttcgttttcggttcgtttggtcgcgttttagtcgttagggttttcggttcgtgggtcgggag

SEQ ID NO: 35880 - DNA, 1521 bp, Artificial Sequence
  chemically treated genomic DNA (Homo sapiens) CpG-island No: 35880
ctcccgacccacgaaccgaaaaccctaacgactaaaacgcgaccaaacgaaccgaaaacgaaaaacgctaaccaaaaacgaacgaaacctaaaacccgaaccgacaacctaactccccgtaaaccgactctactaaataaacattcccgcgaaacgccgaaatacaacataaaaactctttcgctaacaccgaaaaaccttaaaaactacaaaaaatacaaacccgacgactacccccgaaaacgaaacgcgcgcccgcgcgataaacgaaaatcctaaaaaaacgcgaaaacgaacgcgcgccccgcaaaaaaaaaaacgaaaaacgcgaaaaaaaaaaaaaaaacgtccccgtacgaaaacccgactaaccgcgccaaacccaaacaaaacatcgcgactttaactacaacaaacgataaactcgactcgaaaacgaaaacgacgaaaaaacgaaaaacgcgaaaaaaaacgacctaacctcaccgctaccgcctcttccccgccgcataaacgaacgcctcaaccttctacgctcgccgccgccgccctcaacccgccaccgcgcccaccctcctcaacgcccaacgaacaacgacgatacccacacgctaataaaccacgactacgcgaaacccgccgcaaaccgcgaactaccgcccgacataaccgtaatacccgaaaaccacctactaaaaccgaaaataaccgataataaaaaaaccccgcctcaaaacgactataacgacgacgactacgaccgctacgaaccgctaccgccctcactaccgaccgcgaacgaacaaaactactacgaaaaacgcgtaatcatcaacatctccgaactacgcttcgaaacgcaactaaaaaccctttaccaattccccgaaacgctactaaacgaccccaaacgacgcataaaatacttcgacccgctccgcaacgaatacttcttcgaccgcaaccgacccaacttcgacgccatcctctactactatcaatccgaaaaccgcatccgccgaccgatcaacgtacccatcgacattttctccgaaaaaatccgcttctaccaactaaacgaaaaaaccataaaaaaattccgcgaaaacgaaaacttcctacgaaaaaaaaaacgacccttaccccgccgcgacttccaacgccaaatataactactcttcgaataccccgaaaactccgaaccgacccgaaacatcgccatcgtatccgtactaatcatcctcatctccattatcatcttctacctaaaaacgctaccgaaattccgcgacgaaaaaaactaccccgcctcgacgtcgcaaaactcattcgaaacaaccgacaacaacacgtcgaaatcccgcgcaaaaacctccaacttctccgatcccttcttcgtaataaaaacgctatacatcatctaattctccttcgaactactaatacgattcttcgcttatcctaacaaaaccaccttctcgcgaaacatcataaacctaatcgacattataaccatcattc

SEQ ID NO: 35881 - DNA, 691 bp, Artificial Sequence
  chemically treated genomic DNA (Homo sapiens) CpG-island No: 35881
tatagtttcggagcgtcgcggtgaggttcggtttacgggtcgtttttcggtggattttattattggatataaagggaggaggttttttcggtttgtggcgtttttttttcgacggcggttgtatttcggagggagttcggcgttatttcggatgtcgttgcggtattttaagttttcgcgggtcgtcgattgtttagattttttatttttggttttattttttttgttcgggatagagtagttacgtttattcgttattttttttttttcgtttttggatagcggagtagttaaatttcgtcggatttatttagttcggacggcgcgcgttcgtttatgtaaataaatatattttaagttttaaggggcggttatcgttgtcgtcgcgtatttttgttacggtttatgttcgcgcgcgtagaagtgttcgtttatttcgcggacggggcgtggttaagttttagggacgcgtcgcgtttttattaatgtcggattcgggtagcggcggcgcgttcgacgtggcgcgcgcgattttttcgttttgtttttttttttcgggtttcgtcggtttgcgcgcgttcgggagtttgaattttttcggatttggagtaatatcgtagtggaaggcgttgtgggttgaggtcgtcgtttattttttttaggggaattatggagttggtagttgaaagat

SEQ ID NO: 35882 - DNA, 691 bp, Artificial Sequence
  chemically treated genomic DNA (Homo sapiens) CpG-island No: 35882
atctttcaactaccaactccataattcccctaaaaaaaataaacgacgacctcaacccacaacgccttccactacgatattactccaaatccgaaaaaattcaaactcccgaacgcgcgcaaaccgacgaaacccgaaaaaaaaaaacaaaacgaaaaaatcgcgcgcgccacgtcgaacgcgccgccgctacccgaatccgacattaataaaaacgcgacgcgtccctaaaacttaaccacgccccgtccgcgaaataaacgaacacttctacgcgcgcgaacataaaccgtaacaaaaatacgcgacgacaacgataaccgccccttaaaacttaaaatatatttatttacataaacgaacgcgcgccgtccgaactaaataaatccgacgaaatttaactactccgctatccaaaaacgaaaaaaaaaaaataacgaataaacgtaactactctatcccgaacaaaaaaaataaaaccaaaaataaaaaatctaaacaatcgacgacccgcgaaaacttaaaataccgcaacgacatccgaaataacgccgaactccctccgaaatacaaccgccgtcgaaaaaaaaacgccacaaaccgaaaaaacctcctccctttatatccaataataaaatccaccgaaaaacgacccgtaaaccgaacctcaccgcgacgctccgaaactata

SEQ ID NO: 35883 - DNA, 691 bp, Artificial Sequence
  chemically treated genomic DNA (Homo sapiens) CpG-island No: 35883
gttttttagttgttagttttatagtttttttaggagaggtgggcggcgattttaatttatagcgttttttattgcgatattgttttaaattcgaggaaatttaaattttcgggcgcgcgtaggtcgacgggattcgaggaggaggggtaggacgaaggggtcgcgcgcgttacgtcgggcgcgtcgtcgttgttcgagttcggtattggtgggaacgcggcgcgtttttgaggtttagttacgtttcgttcgcggggtaggcgggtatttttacgcgcgcgggtatgagtcgtggtaggagtgcgcggcggtagcggtggtcgttttttggggtttggggtgtgtttatttgtataagcgggcgcgcgtcgttcgggttgggtggattcggcgggatttgattgtttcgttgtttagaggcggagaagaagaggtagcgagtggacgtgattgttttatttcgggtaaaagggatagaattagaggtggggagtttgggtagtcggcgattcgcgaagatttgaggtgtcgtagcggtattcggagtagcgtcgggtttttttcggggtgtagtcgtcgtcgggggaagggcgttataggtcgggaagattttttttttttgtgtttagtagtggggtttatcggagggcggttcgtgggtcgggttttatcgcggcgtttcgggattgtg

SEQ ID NO: 35884 - DNA, 691 bp, Artificial Sequence
  chemically treated genomic DNA (Homo sapiens) CpG-island No: 35884
cacaatcccgaaacgccgcgataaaacccgacccacgaaccgccctccgataaaccccactactaaacacaaaaaaaaaaaatcttcccgacctataacgcccttcccccgacgacgactacaccccgaaaaaaacccgacgctactccgaataccgctacgacacctcaaatcttcgcgaatcgccgactacccaaactccccacctctaattctatcccttttacccgaaataaaacaatcacgtccactcgctacctcttcttctccgcctctaaacaacgaaacaatcaaatcccgccgaatccacccaacccgaacgacgcgcgcccgcttatacaaataaacacaccccaaaccccaaaaaacgaccaccgctaccgccgcgcactcctaccacgactcatacccgcgcgcgtaaaaatacccgcctaccccgcgaacgaaacgtaactaaacctcaaaaacgcgccgcgttcccaccaataccgaactcgaacaacgacgacgcgcccgacgtaacgcgcgcgaccccttcgtcctacccctcctcctcgaatcccgtcgacctacgcgcgcccgaaaatttaaatttcctcgaatttaaaacaatatcgcaataaaaaacgctataaattaaaatcgccgcccacctctcctaaaaaaactataaaactaacaactaaaaaac

SEQ ID NO: 35885 - DNA, 640 bp, Artificial Sequence
  chemically treated genomic DNA (Homo sapiens) CpG-island No: 35885
  misc_feature (211)..(212): n is either a, c, g or t
  misc_feature (450)..(454): n is either a, c, g or t
  misc_feature (588)..(589): n is either a, c, g or t
aagatggcggcgatggcgtttggaggtagtggtagtggtggcggcgtgaatttattttttagtgattcggatgaggacgatgacgaggtagttgtaatagaggaacggcgggtagtatttcggttgggcgtcggaagtggtttagattttggttttgcgggttcgttgtcgttataggatttcgtggttttaggaagtagtgcgcggttannttttggggaggcgtcggcggttgtagtggttttggggggtatcggggagatttcggttcgattattaattgatgcgatcgttgtttagttgttgcgcgattaatatttgttgatcgttttggagttgtatatcgagttgttagagagtggtcgggagttgtttcggttgcgcgattatttttttaatttaggtaatttcgagaggtaaagtggaatttcgtcggggatgggggcgttnnnnntttttggagtagtcggcgttgggggcgttggaggtcgggaatcgagtatagcgtcgggcgggggatagtttagtaagtggacgtagtttgttatatttcggtagggtatttgggattgtacggagttattgtannggagagggggtatttttgcgtgggtttcgatagggatattttaaggaacga

SEQ ID NO: 35886 - DNA, 640 bp, Artificial Sequence
  chemically treated genomic DNA (Homo sapiens) CpG-island No: 35886
  misc_feature (52)..(53): n is either a, c, g or t
  misc_feature (187)..(191): n is either a, c, g or t
  misc_feature (429)..(430): n is either a, c, g or t
tcgttccttaaaatatccctatcgaaacccacgcaaaaataccccctctccnntacaataactccgtacaatcccaaataccctaccgaaatataacaaactacgtccacttactaaactatcccccgcccgacgctatactcgattcccgacctccaacgcccccaacgccgactactccaaaaannnnnaacgcccccatccccgacgaaattccactttacctctcgaaattacctaaattaaaaaaataatcgcgcaaccgaaacaactcccgaccactctctaacaactcgatatacaactccaaaacgatcaacaaatattaatcgcgcaacaactaaacaacgatcgcatcaattaataatcgaaccgaaatctccccgataccccccaaaaccactacaaccgccgacgcctccccaaaanntaaccgcgcactacttcctaaaaccacgaaatcctataacgacaacgaacccgcaaaaccaaaatctaaaccacttccgacgcccaaccgaaatactacccgccgttcctctattacaactacctcgtcatcgtcctcatccgaatcactaaaaaataaattcacgccgccaccactaccactacctccaaacgccatcgccgccatctt

SEQ ID NO: 35887 - DNA, 640 bp, Artificial Sequence
  chemically treated genomic DNA (Homo sapiens) CpG-island No: 35887
  misc_feature (52)..(53): n is either a, c, g or t
  misc_feature (187)..(191): n is either a, c, g or t
  misc_feature (429)..(430): n is either a, c, g or t
tcgttttttaaaatgtttttatcgggatttacgtagaaatattttttttttnntatagtaatttcgtataattttaaatattttgtcggagtgtgataggttgcgtttatttattgagttgtttttcgttcgacgttgtattcggttttcgatttttagcgtttttaacgtcggttgttttagggannnnnggcgtttttattttcggcggggttttattttgtttttcgaagttgtttggattggagaagtagtcgcgtagtcgaggtagttttcggttattttttaatagttcggtatgtagttttagggcggttagtaagtattgatcgcgtaatagttgagtagcgatcgtattaattgataatcgggtcggggttttttcggtgttttttagggttattgtagtcgtcgacgtttttttagggnntggtcgcgtattgttttttaaggttacgggattttgtggcgatagcgagttcgtagagttaggatttaggttattttcggcgtttagtcgaagtattgttcgtcgtttttttgttgtagttatttcgttatcgtttttattcgaattattgagaaatggatttacgtcgttattattgttattatttttaggcgttatcgtcgttatttt

SEQ ID NO: 35888 - DNA, 640 bp, Artificial Sequence
  chemically treated genomic DNA (Homo sapiens) CpG-island No: 35888
  misc_feature (211)..(212): n is either a, c, g or t
  misc_feature (450)..(454): n is either a, c, g or t
  misc_feature (588)..(589): n is either a, c, g or t
aaaataacgacgataacgcctaaaaataataacaataataacgacgtaaatccatttctcaataattcgaataaaaacgataacgaaataactacaacaaaaaaacgacgaacaatacttcgactaaacgccgaaaataacctaaatcctaactctacgaactcgctatcgccacaaaatcccgtaaccttaaaaaacaatacgcgaccannccctaaaaaaacgtcgacgactacaataaccctaaaaaacaccgaaaaaaccccgacccgattatcaattaatacgatcgctactcaactattacgcgatcaatacttactaaccgccctaaaactacataccgaactattaaaaaataaccgaaaactacctcgactacgcgactacttctccaatccaaacaacttcgaaaaacaaaataaaaccccgccgaaaataaaaacgccnnnnntccctaaaacaaccgacgttaaaaacgctaaaaatcgaaaaccgaatacaacgtcgaacgaaaaacaactcaataaataaacgcaacctatcacactccgacaaaatatttaaaattatacgaaattactatannaaaaaaaaaatatttctacgtaaatcccgataaaaacattttaaaaaacga

SEQ ID NO: 35889 - DNA, 596 bp, Artificial Sequence
  chemically treated genomic DNA (Homo sapiens) CpG-island No: 35889
gagtttcgacggtttcgcgtcgtttatttcggggttcgtgggtcggttgggggggtatttgggtcgtcgtggttgtagtcgtcggggatcggggtagcgtagagttcgcgtaaggtttcgcggcgttttgggtcggggatgtgcggtttagttaattggggttacgtgttgggcggtcggggtcgcggttcggacgagtacgagaagcgttatagcggcgtttttttttcgtagttgcgtgtttagatgcgcgatttggtacggggtatgttcgtttttggttacgataattatatggtttacgtttttttttaggacgagtttaattttatttattgtcgcggtcgtgggttcgatcgcggggattcgtgagtagttttcgtcgttcggggtcgtgcgtttacgcgttttttttcgtttttcgcgtcggggtgtagttttttgtttttcggggttttcgagggcgttagggtcgttagggtttcgggtagcgttttcgcgttttgtatcgtgtgagtttttgtgaagaatttcgagtttgagggtgcggggtgggtcggtggttttttttttttgattttttcggaatttttaaa

SEQ ID NO: 35890 - DNA, 596 bp, Artificial Sequence
  chemically treated genomic DNA (Homo sapiens) CpG-island No: 35890
tttaaaaattccgaaaaaatcaaaaaaaaaaaaccaccgacccaccccgcaccctcaaactcgaaattcttcacaaaaactcacacgatacaaaacgcgaaaacgctacccgaaaccctaacgaccctaacgccctcgaaaaccccgaaaaacaaaaaactacaccccgacgcgaaaaacgaaaaaaaacgcgtaaacgcacgaccccgaacgacgaaaactactcacgaatccccgcgatcgaacccacgaccgcgacaataaataaaattaaactcgtcctaaaaaaaaacgtaaaccatataattatcgtaaccaaaaacgaacataccccgtaccaaatcgcgcatctaaacacgcaactacgaaaaaaaaacgccgctataacgcttctcgtactcgtccgaaccgcgaccccgaccgcccaacacgtaaccccaattaactaaaccgcacatccccgacccaaaacgccgcgaaaccttacgcgaactctacgctaccccgatccccgacgactacaaccacgacgacccaaatacccccccaaccgacccacgaaccccgaaataaacgacgcgaaaccgtcgaaactc

SEQ ID NO: 35891 - DNA, 596 bp, Artificial Sequence
  chemically treated genomic DNA (Homo sapiens) CpG-island No: 35891
tttggagatttcgggagaattaggagaggaaggttatcggtttatttcgtatttttaagttcggggttttttatagggatttatacggtatagggcgcgggagcgttgttcgggattttaacggttttggcgttttcgggggtttcggaggatagagggttgtatttcggcgcggagggcggaaggaagcgcgtgggcgtacggtttcgggcggcgggggttatttacgggttttcgcggtcgggtttacggtcgcggtagtggatggggttgagttcgttttgggggaaggcgtgagttatgtagttgtcgtagttaaagacgaatatgtttcgtgttaggtcgcgtatttgggtacgtagttgcggagggaaggcgtcgttgtagcgtttttcgtattcgttcgggtcgcggtttcggtcgtttagtacgtagttttagttggttgggtcgtatattttcggtttaggacgtcgcggagttttgcgcgggttttgcgttgtttcggttttcggcggttgtagttacgacggtttagatatttttttagtcggtttacgggtttcgaggtgggcgacgcggggtcgtcggggttt

SEQ ID NO: 35892 - DNA, 596 bp, Artificial Sequence
  chemically treated genomic DNA (Homo sapiens) CpG-island No: 35892
aaaccccgacgaccccgcgtcgcccacctcgaaacccgtaaaccgactaaaaaaatatctaaaccgtcgtaactacaaccgccgaaaaccgaaacaacgcaaaacccgcgcaaaactccgcgacgtcctaaaccgaaaatatacgacccaaccaactaaaactacgtactaaacgaccgaaaccgcgacccgaacgaatacgaaaaacgctacaacgacgccttccctccgcaactacgtacccaaatacgcgacctaacacgaaacatattcgtctttaactacgacaactacataactcacgccttcccccaaaacgaactcaaccccatccactaccgcgaccgtaaacccgaccgcgaaaacccgtaaataacccccgccgcccgaaaccgtacgcccacgcgcttccttccgccctccgcgccgaaatacaaccctctatcctccgaaacccccgaaaacgccaaaaccgttaaaatcccgaacaacgctcccgcgccctataccgtataaatccctataaaaaaccccgaacttaaaaatacgaaataaaccgataaccttcctctcctaattctcccgaaatctccaaa

SEQ ID NO: 35893 - DNA, 1078 bp, Artificial Sequence
  chemically treated genomic DNA (Homo sapiens) CpG-island No: 35893
cgtgcgcgttttcgttttttcgcgtgcgtacgtcgttgtgttgttgtagttaattaggtcgcgaggtcgtcgcggtcgttagggttcgcgcgtacgttttagatcggagtcggggtgggggttatgggtgaatgggagagtgagcggggttgggcgcggtagcgcgagtcgtatgaatgagataaacgtgcgtcgcgcgagacgtcgcgcgagttcggattagggagttaatgggaacgttggaagggttcgagattcggtattgagggtaacggcgcgcgtcggtttcgagacgagcgacgtttggcgggagcgcgcggtagcggggcgggcgtggagcgtgcgggggtcgcgcgttgtttttttgaggtaggacggtattgtcgggaggcggcggtgataacgacggcggtggtgacgggtatcgggttcgcgggtgagtgcggaggatatcggtttttgcggaatcggaagtgtcgtattagcgaggtgggaggggagggtgatttttagggaagggggatcgaagacggggagggtattaaggttttatttttttttcgggtcgggttttttaatcgcggcgggatttatgggttttggaaacggacgacgagtagaggtcggggatttacgatcgttagggttcggaacgggttagagacggttatttagttcgagatcgcggttttcggtgtttggcgtttagtcgtcgtttttttcgttttcggttttgcgttttcgggttttgcggttttcgtagttcgtttttttaatttcggtgggtttggtcgtcgtggatttttttttttcggttttagcggtcgttagttttgttttaacgggtgatttttttttttttagtttcgtggtggggatcgggtgttgttttttttttatcgttttgcggttcgagtttttcgttttattttgttgatatttattttggtttaagttttattttgttatttgtttttttttattcgttcgttttttttttttatcgttattagtcgagtgttttatgcgtttagtattttgtattttttaaagtggagttcgaatgcgtttgttaata

SEQ ID NO: 35894 - DNA, 1078 bp, Artificial Sequence
  chemically treated genomic DNA (Homo sapiens) CpG-island No: 35894
tattaacaaacgcattcgaactccactttaaaaaatacaaaatactaaacgcataaaacactcgactaataacgataaaaaaaaaaaacgaacgaataaaaaaaaacaaataacaaaataaaacttaaaccaaaataaatatcaacaaaataaaacgaaaaactcgaaccgcaaaacgataaaaaaaaaacaacacccgatccccaccacgaaactaaaaaaaaaaaaatcacccgttaaaacaaaactaacgaccgctaaaaccgaaaaaaaaaaatccacgacgaccaaacccaccgaaattaaaaaaacgaactacgaaaaccgcaaaacccgaaaacgcaaaaccgaaaacgaaaaaaacgacgactaaacgccaaacaccgaaaaccgcgatctcgaactaaataaccgtctctaacccgttccgaaccctaacgatcgtaaatccccgacctctactcgtcgtccgtttccaaaacccataaatcccgccgcgattaaaaaacccgacccgaaaaaaaaataaaaccttaataccctccccgtcttcgatcccccttccctaaaaatcaccctcccctcccacctcgctaatacgacacttccgattccgcaaaaaccgatatcctccgcactcacccgcgaacccgatacccgtcaccaccgccgtcgttatcaccgccgcctcccgacaataccgtcctacctcaaaaaaacaacgcgcgacccccgcacgctccacgcccgccccgctaccgcgcgctcccgccaaacgtcgctcgtctcgaaaccgacgcgcgccgttaccctcaataccgaatctcgaacccttccaacgttcccattaactccctaatccgaactcgcgcgacgtctcgcgcgacgcacgtttatctcattcatacgactcgcgctaccgcgcccaaccccgctcactctcccattcacccataacccccaccccgactccgatctaaaacgtacgcgcgaaccctaacgaccgcgacgacctcgcgacctaattaactacaacaacacaacgacgtacgcacgcgaaaaaacgaaaacgcgcacg

SEQ ID NO: 35895 - DNA, 1078 bp, Artificial Sequence
  chemically treated genomic DNA (Homo sapiens) CpG-island No: 35895
tattgataaacgtattcgggttttattttaaaaagtataaagtattaaacgtatggagtattcggttggtggcggtaggaggaggaagcggacgggtgagagagaataggtaataggatgaagtttgagttaaaataagtattagtagagtggagcgagggattcgaatcgtagagcggtaaaagggaaatagtattcggtttttattacgggattggggaaaggagaattattcgttggggtagggttgacgatcgttgaaatcgaaaagaaggaatttacggcggttaggtttatcgaggttgagagagcgggttgcggggatcgtagagttcgagggcgtagggtcgggggcggaaggggcggcggttgggcgttaggtatcggggatcgcggtttcgagttgagtggtcgtttttaattcgtttcgagttttggcggtcgtggattttcggtttttattcgtcgttcgtttttaaggtttatgggtttcgtcgcggttggaagattcggttcggaggagaaatagggttttaatatttttttcgttttcggttttttttttttagaggttattttttttttttatttcgttggtacggtattttcggtttcgtagggatcggtgtttttcgtatttattcgcgagttcggtgttcgttattatcgtcgtcgttgttatcgtcgtttttcggtagtgtcgttttgttttagagaagtagcgcgcggttttcgtacgttttacgttcgtttcgttgtcgcgcgttttcgttaggcgtcgttcgtttcggagtcggcgcgcgtcgttgtttttagtgtcgggtttcgaatttttttagcgtttttattggttttttagttcgggttcgcgcgacgtttcgcgcggcgtacgtttgttttatttatgcggttcgcgttgtcgcgtttaatttcgtttatttttttatttatttatagtttttatttcgatttcgatttggggcgtgcgcgcgaattttggcgatcgcggcgatttcgcggtttgattggttgtagtaatataacgacgtacgtacgcgagaagacgagagcgcgtacg

SEQ ID NO: 35896 - DNA, 1078 bp, Artificial Sequence
  chemically treated genomic DNA (Homo sapiens) CpG-island No: 35896
cgtacgcgctctcgtcttctcgcgtacgtacgtcgttatattactacaaccaatcaaaccgcgaaatcgccgcgatcgccaaaattcgcgcgcacgccccaaatcgaaatcgaaataaaaactataaataaataaaaaaataaacgaaattaaacgcgacaacgcgaaccgcataaataaaacaaacgtacgccgcgcgaaacgtcgcgcgaacccgaactaaaaaaccaataaaaacgctaaaaaaattcgaaacccgacactaaaaacaacgacgcgcgccgactccgaaacgaacgacgcctaacgaaaacgcgcgacaacgaaacgaacgtaaaacgtacgaaaaccgcgcgctacttctctaaaacaaaacgacactaccgaaaaacgacgataacaacgacgacgataataacgaacaccgaactcgcgaataaatacgaaaaacaccgatccctacgaaaccgaaaataccgtaccaacgaaataaaaaaaaaaaataacctctaaaaaaaaaaaaccgaaaacgaaaaaaatattaaaaccctatttctcctccgaaccgaatcttccaaccgcgacgaaacccataaaccttaaaaacgaacgacgaataaaaaccgaaaatccacgaccgccaaaactcgaaacgaattaaaaacgaccactcaactcgaaaccgcgatccccgatacctaacgcccaaccgccgccccttccgcccccgaccctacgccctcgaactctacgatccccgcaacccgctctctcaacctcgataaacctaaccgccgtaaattccttcttttcgatttcaacgatcgtcaaccctaccccaacgaataattctcctttccccaatcccgtaataaaaaccgaatactatttcccttttaccgctctacgattcgaatccctcgctccactctactaatacttattttaactcaaacttcatcctattacctattctctctcacccgtccgcttcctcctcctaccgccaccaaccgaatactccatacgtttaatactttatactttttaaaataaaacccgaatacgtttatcaata

SEQ ID NO: 35897 - DNA, 874 bp, Artificial Sequence
  chemically treated genomic DNA (Homo sapiens) CpG-island No: 35897
acgttgtagttcgcgtcgaacgtcgggtagtataaaggattttcgattgtcggggagcggtgttcggagggtataggtttacgttattttttacgtagtttcggagatggagcgttgggtttatggagggaaggcggtaggttcggcggtttcggtagtttgttggggtaggggtttaaggcggtagttcgatagtggaggtcgttgagaattgttacggagttgcgtttgtatagcgagtattttttatttatttagggcgagtgtgtatttggggcggcgtgtagggggttgataaagatcggagagttttcggtgcggtcgtcggcggagcgaagattggaattcgtatgagcgttttttagcgtttttgagcgttcgtcgtcggtgtacggcgtatttcgcgggaggtagggattagtaaagtcgtgcgtttcgaggttcgttttcgttttcgtataaagatcgtgagtttcgggttcgagtttttcgcgcggggatcgggcggttgttcggcgggtcgtttttcgacggttttttggtttcgtcggagcgggtgcggggaggtttacgtagcgacggttggaggaggggtgggcggggttgtcgggggtggggttttcggggcgggtcggggcgcgttgtgttcgcggtcgaaattcggttttgttggaggttaacggttgttatatattcgggttcgatattatggcgattatgcgattgtttaaggtaatcgcgtataggatgattttttttttttggtttttttcgtttttcgtatttttttttttttttatttttttcgcggtttttcgagtatatttatttatttgtttgggtattagggttggttgaatttttgtttttttcg

SEQ ID NO: 35898 - DNA, 874 bp, Artificial Sequence
  chemically treated genomic DNA (Homo sapiens) CpG-island No: 35898
cgaaaaaaacaaaaattcaaccaaccctaatacccaaacaaataaataaatatactcgaaaaaccgcgaaaaaaataaaaaaaaaaaaaaatacgaaaaacgaaaaaaaccaaaaaaaaaaaatcatcctatacgcgattaccttaaacaatcgcataatcgccataatatcgaacccgaatatataacaaccgttaacctccaacaaaaccgaatttcgaccgcgaacacaacgcgccccgacccgccccgaaaaccccacccccgacaaccccgcccacccctcctccaaccgtcgctacgtaaacctccccgcacccgctccgacgaaaccaaaaaaccgtcgaaaaacgacccgccgaacaaccgcccgatccccgcgcgaaaaactcgaacccgaaactcacgatctttatacgaaaacgaaaacgaacctcgaaacgcacgactttactaatccctacctcccgcgaaatacgccgtacaccgacgacgaacgctcaaaaacgctaaaaaacgctcatacgaattccaatcttcgctccgccgacgaccgcaccgaaaactctccgatctttatcaaccccctacacgccgccccaaatacacactcgccctaaataaataaaaaatactcgctatacaaacgcaactccgtaacaattctcaacgacctccactatcgaactaccgccttaaacccctaccccaacaaactaccgaaaccgccgaacctaccgccttccctccataaacccaacgctccatctccgaaactacgtaaaaaataacgtaaacctataccctccgaacaccgctccccgacaatcgaaaatcctttatactacccgacgttcgacgcgaactacaacgt

SEQ ID NO: 35899 - DNA, 874 bp, Artificial Sequence
  chemically treated genomic DNA (Homo sapiens) CpG-island No: 35899
cggggaggatagggatttagttagttttggtgtttagataaataaataaatgtgttcggagagtcgcggaggggatggagggaggagggaatgcgggaggcgaggggagttaagagaaaggggttattttatacgcggttattttgaatagtcgtatggtcgttatgatgtcgggttcgagtgtgtggtaatcgttggtttttagtaggatcgagtttcgatcgcggatatagcgcgtttcggttcgtttcggggattttattttcggtagtttcgtttattttttttttagtcgtcgttgcgtgggttttttcgtattcgtttcggcgaggttaggaggtcgtcgaaggacgattcgtcggataatcgttcgattttcgcgcggaaggttcggattcgggatttacggtttttgtgcggagacgggggcgggtttcggggcgtacggttttgttgatttttgtttttcgcggggtgcgtcgtgtatcggcggcgagcgtttaggggcgttggggggcgtttatacgggttttagttttcgtttcgtcggcggtcgtatcgggagtttttcggtttttgttagttttttgtacgtcgttttaaatatatattcgttttgaataaataagggatgttcgttgtatagacgtagtttcgtgatagtttttagcggtttttattatcggattgtcgttttgagtttttgttttagtaagttgtcggagtcgtcgagtttgtcgttttttttttatgggtttagcgttttattttcgaaattgcgtgggggatggcgtagatttgtgtttttcgagtatcgtttttcggtagtcggggattttttgtgttgttcggcgttcggcgcgggttgtaacgt

SEQ ID NO: 35900 - DNA, 874 bp, Artificial Sequence
  chemically treated genomic DNA (Homo sapiens) CpG-island No: 35900
acgttacaacccgcgccgaacgccgaacaacacaaaaaatccccgactaccgaaaaacgatactcgaaaaacacaaatctacgccatcccccacgcaatttcgaaaataaaacgctaaacccataaaaaaaaaacgacaaactcgacgactccgacaacttactaaaacaaaaactcaaaacgacaatccgataataaaaaccgctaaaaactatcacgaaactacgtctatacaacgaacatcccttatttattcaaaacgaatatatatttaaaacgacgtacaaaaaactaacaaaaaccgaaaaactcccgatacgaccgccgacgaaacgaaaactaaaacccgtataaacgccccccaacgcccctaaacgctcgccgccgatacacgacgcaccccgcgaaaaacaaaaatcaacaaaaccgtacgccccgaaacccgcccccgtctccgcacaaaaaccgtaaatcccgaatccgaaccttccgcgcgaaaatcgaacgattatccgacgaatcgtccttcgacgacctcctaacctcgccgaaacgaatacgaaaaaacccacgcaacgacgactaaaaaaaaaataaacgaaactaccgaaaataaaatccccgaaacgaaccgaaacgcgctatatccgcgatcgaaactcgatcctactaaaaaccaacgattaccacacactcgaacccgacatcataacgaccatacgactattcaaaataaccgcgtataaaataacccctttctcttaactcccctcgcctcccgcattccctcctccctccatcccctccgcgactctccgaacacatttatttatttatctaaacaccaaaactaactaaatccctatcctccccg

SEQ ID NO: 35901 - DNA, 536 bp, Artificial Sequence
  chemically treated genomic DNA (Homo sapiens) CpG-island No: 35901
  misc_feature (1)..(1): n is either a, c, g or t
  misc_feature (31)..(31): n is either a, c, g or t
  misc_feature (35)..(35): n is either a, c, g or t
nacggtttcgtagttagattatatatttttntttntttttttttcgttattagcggcggttcgttcgttcggcggtgttttagcgttcgtcgtcgcgtcgggtttagtaatggcggttattcgtgttttttcgcgttgacggatttttttttttttttttcgaattttattttagtatttttttcggcgcgcgtagttatatattcgatcgggggcggagcggcggcgcggcggcgtagtttggacggtgacggcgcgcgcggcgaattcgcgttgttttttttataatttttcgttttcgtttttttatttcgcgacgtttttcgcgtcgcgtattcggtacggtttcgtttttgttttcgtttttcgggagtttgggaaggcgcgagttatttagtcggagggagggggacgagcgcgcggggtcgcgttttcgttcgcgttttcgttttttttttttttttgttttttttttttttttatttttttattggtttttatttttttttttttttttttcgttttttttattattg

SEQ ID NO: 35902 - DNA, 536 bp, Artificial Sequence
  chemically treated genomic DNA (Homo sapiens) CpG-island No: 35902
  misc_feature (502)..(502): n is either a, c, g or t
  misc_feature (506)..(506): n is either a, c, g or t
  misc_feature (536)..(536): n is either a, c, g or t
caataataaaaaaaacgaaaaaaaaaaaaaaaaaaataaaaaccaataaaaaaataaaaaaaaaaaaaaaacaaaaaaaaaaaaaaaacgaaaacgcgaacgaaaacgcgaccccgcgcgctcgtccccctccctccgactaaataactcgcgccttcccaaactcccgaaaaacgaaaacaaaaacgaaaccgtaccgaatacgcgacgcgaaaaacgtcgcgaaataaaaaaacgaaaacgaaaaattataaaaaaaacaacgcgaattcgccgcgcgcgccgtcaccgtccaaactacgccgccgcgccgccgctccgcccccgatcgaatatataactacgcgcgccgaaaaaaatactaaaataaaattcgaaaaaaaaaaaaaaaaatccgtcaacgcgaaaaaacacgaataaccgccattactaaacccgacgcgacgacgaacgctaaaacaccgccgaacgaacgaaccgccgctaataacgaaaaaaaaanaaanaaaaatatataatctaactacgaaaccgtn

SEQ ID NO: 35903 - DNA, 536 bp, Artificial Sequence
  chemically treated genomic DNA (Homo sapiens) CpG-island No: 35903
  misc_feature (502)..(502): n is either a, c, g or t
  misc_feature (506)..(506): n is either a, c, g or t
  misc_feature (536)..(536): n is either a, c, g or t
taatggtgggagaggcggaggaagaagggggaggggtagaagttaatgggggagtggaggggagggagaagtagaggggaggagggagcggggacgcgagcgaggacgcggtttcgcgcgttcgttttttttttttcgattggatagttcgcgtttttttaggttttcgggagacgagggtaggggcggggtcgtgtcgggtgcgcggcgcgggaggcgtcgcgaggtgaaggggcggggacgggggattgtggggagggtagcgcgggttcgtcgcgcgcgtcgttatcgtttaggttgcgtcgtcgcgtcgtcgtttcgttttcggtcgggtgtgtggttgcgcgcgtcgggagagatgttgaggtaaagttcgggagagagggagagaaattcgttagcgcgagggagtacgagtggtcgttattattgagttcggcgcggcggcgggcgttggggtatcgtcggacggacgggtcgtcgttggtggcgaggagggagngagngagggtgtgtgatttggttgcgggatcgtn

SEQ ID NO: 35904 - DNA, 536 bp, Artificial Sequence
  chemically treated genomic DNA (Homo sapiens) CpG-island No: 35904
  misc_feature (1)..(1): n is either a, c, g or t
  misc_feature (31)..(31): n is either a, c, g or t
  misc_feature (35)..(35): n is either a, c, g or t
nacgatcccgcaaccaaatcacacaccctcnctcnctccctcctcgccaccaacgacgacccgtccgtccgacgataccccaacgcccgccgccgcgccgaactcaataataacgaccactcgtactccctcgcgctaacgaatttctctccctctctcccgaactttacctcaacatctctcccgacgcgcgcaaccacacacccgaccgaaaacgaaacgacgacgcgacgacgcaacctaaacgataacgacgcgcgcgacgaacccgcgctaccctccccacaatcccccgtccccgccccttcacctcgcgacgcctcccgcgccgcgcacccgacacgaccccgcccctaccctcgtctcccgaaaacctaaaaaaacgcgaactatccaatcgaaaaaaaaaaaacgaacgcgcgaaaccgcgtcctcgctcgcgtccccgctccctcctcccctctacttctccctcccctccactcccccattaacttctacccctcccccttcttcctccgcctctcccaccatta

SEQ ID NO: 35905 - DNA, 687 bp, Artificial Sequence
  chemically treated genomic DNA (Homo sapiens) CpG-island No: 35905
  misc_feature (667)..(667): n is either a, c, g or t
  misc_feature (672)..(672): n is either a, c, g or t
  misc_feature (675)..(675): n is either a, c, g or t
  misc_feature (680)..(684): n is either a, c, g or t
aatcgagattgtgttttcgcgaatttgtattcgtttcgtgtattttttttaggtggaattcgttaatagtagtaattcggttaacggatatcgttattttttttttcgacggattattcgagattcgagtaagtgaggcggcgggcgagagcggacgtttggcggggtcggcgattttcggttagtattaggttttcgtcgattttggtttcgttatttgtggagaaagtattttttttttcggtttttttgttttttacgtcgaacgtatttttaacgttgtagttgttgttcgttcggtttgcgaaaatcgagcgtagcgttaggtttttttcggcggtcgcggggttttagtttttttaattggttataatcggtagcggcgatcgagcggggtagttagtcgtaggagggttttcgttcgggagggggtaggtaggtttggaggagcggggttcgtaaggttttatttaataacgtcggtttttttcgttttttttttaacggtagcggtttcggcggtggcggcggtacgatatttttggggacgttttcgtcgtcgtcgtttttttttttatttttcgttcgtttttttttttcggcgcgtttatcgagcggcgtttttttttattacgtacgtatttataaatataaaatatatttattnatttnttnttttnnnnnttt

SEQ ID NO: 35906 - DNA, 687 bp, Artificial Sequence
  chemically treated genomic DNA (Homo sapiens) CpG-island No: 35906
  misc_feature (4)..(8): n is either a, c, g or t
  misc_feature (13)..(13): n is either a, c, g or t
  misc_feature (16)..(16): n is either a, c, g or t
  misc_feature (21)..(21): n is either a, c, g or t
aaannnnnaaaanaanaaatnaataaatatattttatatttataaatacgtacgtaataaaaaaaaacgccgctcgataaacgcgccgaaaaaaaaaaacgaacgaaaaataaaaaaaaaaacgacgacgacgaaaacgtccccaaaaatatcgtaccgccgccaccgccgaaaccgctaccgttaaaaaaaaaacgaaaaaaaccgacgttattaaataaaaccttacgaaccccgctcctccaaacctacctaccccctcccgaacgaaaaccctcctacgactaactaccccgctcgatcgccgctaccgattataaccaattaaaaaaactaaaaccccgcgaccgccgaaaaaaacctaacgctacgctcgattttcgcaaaccgaacgaacaacaactacaacgttaaaaatacgttcgacgtaaaaaacaaaaaaaccgaaaaaaaaaatactttctccacaaataacgaaaccaaaatcgacgaaaacctaatactaaccgaaaatcgccgaccccgccaaacgtccgctctcgcccgccgcctcacttactcgaatctcgaataatccgtcgaaaaaaaaaataacgatatccgttaaccgaattactactattaacgaattccacctaaaaaaaatacacgaaacgaatacaaattcgcgaaaacacaatctcgatt

SEQ ID NO: 35907 - DNA, 687 bp, Artificial Sequence
  chemically treated genomic DNA (Homo sapiens) CpG-island No: 35907
  misc_feature (4)..(8): n is either a, c, g or t
  misc_feature (13)..(13): n is either a, c, g or t
  misc_feature (16)..(16): n is either a, c, g or t
  misc_feature (21)..(21): n is either a, c, g or t
gagnnnnnggggnagngggtnggtgggtgtgttttatatttataaatacgtgcgtggtgaagagaagcgtcgttcggtgagcgcgtcgaggaagagaggcgagcggagagtggaggaggaggcggcggcggcgggagcgtttttaggaatgtcgtgtcgtcgttatcgtcggggtcgttgtcgttgaggaggagacggaggagatcgacgttgttaggtaggattttgcggatttcgtttttttaagtttgtttgttttttttcggacggggatttttttgcggttagttgtttcgttcggtcgtcgttgtcggttgtaattagttgaaggggttggggtttcgcggtcgtcgaggggagtttggcgttgcgttcggttttcgtaggtcgggcgggtagtagttgtagcgttagggatacgttcggcgtgaagggtagagaggtcgggggagggggtgttttttttataggtgacggggttagggtcggcggaggtttgatgttggtcggggatcgtcggtttcgttaggcgttcgttttcgttcgtcgttttatttgttcgagtttcgggtggttcgtcgagaggggaggtggcggtgttcgttggtcgggttgttgttgttaacgagttttatttggaaagggtatacggggcgggtgtagattcgcggaaatatagtttcggtt

SEQ ID NO: 35908 - DNA, 687 bp, Artificial Sequence
  chemically treated genomic DNA (Homo sapiens) CpG-island No: 35908
  misc_feature (667)..(667): n is either a, c, g or t
  misc_feature (672)..(672): n is either a, c, g or t
  misc_feature (675)..(675): n is either a, c, g or t
  misc_feature (680)..(684): n is either a, c, g or t
aaccgaaactatatttccgcgaatctacacccgccccgtataccctttccaaataaaactcgttaacaacaacaacccgaccaacgaacaccgccacctcccctctcgacgaaccacccgaaactcgaacaaataaaacgacgaacgaaaacgaacgcctaacgaaaccgacgatccccgaccaacatcaaacctccgccgaccctaaccccgtcacctataaaaaaaacaccccctcccccgacctctctacccttcacgccgaacgtatccctaacgctacaactactacccgcccgacctacgaaaaccgaacgcaacgccaaactcccctcgacgaccgcgaaaccccaaccccttcaactaattacaaccgacaacgacgaccgaacgaaacaactaaccgcaaaaaaatccccgtccgaaaaaaaacaaacaaacttaaaaaaacgaaatccgcaaaatcctacctaacaacgtcgatctcctccgtctcctcctcaacgacaacgaccccgacgataacgacgacacgacattcctaaaaacgctcccgccgccgccgcctcctcctccactctccgctcgcctctcttcctcgacgcgctcaccgaacgacgcttctcttcaccacgcacgtatttataaatataaaacacacccaccnacccnctnccccnnnnnctc

SEQ ID NO: 35909 - DNA, 1175 bp, Artificial Sequence
  chemically treated genomic DNA (Homo sapiens) CpG-island No: 35909
gaaattcggtttttgcgtttatcgggagcgttatattttggtagttgatcggcggttgtcgtcgggggtaaggttatcgtttcgttttcgcggttggtttgcgattcggttatttgtagggtttggtaggcgttcgaatttatttttttttcgcggttcgtttcgggtcgggttttgtcgtttttcgcgatttttcgcgattcgcggcgagttttacggtttttatcgtttttcgttggtcggttttcgtttcgtttttcgggcgtttcgcggcgttagtatcgttttcgttgtcgtttattcgggtcgggatagttttgcgtcggagagatagtgtagcgcgagagggtcgggagaggacgtcggagggaaaggaagggggagcgcgtttagtatcgtttgggttttttttattcgtttaggaggggaaatacgagagtcgggagtataatagtttcgtacgttcgtcgtcgtcgcgcgttcgtcgtcgttttagttttaggggagattattacgtttcgtgttcgcgtacgtcgcgtcgtttttttcggcgttttcgtttcgtttgtttttcgtagtttcgtttatgtgtttttttgcggttgtttttttttggtttttatttcgttcgtacgtttgcgttttggttggtcgcgcgggttaatggtagcgcgtttttattatataagcgcgagggggcgggttttggttgatataaattttaggggacgtcgttttttgtttttaggcgtttttttttttcggcgcgttcggttcgggcggtttttttatttagttttgggagttacgtgatttcggttttggttggtgatcgggtcgcggcgtgttttataagtcgttcgttcgtttatttattcgggcggcggtcgggttttaggcgttgcgatttttttttcgttttttttaggttgacgcgttcgtttcggcgtcgtttttttcggtatcgattgaggcgttggttcgggagcggatcgcggggtcgcggtggttgagttatattttcggagtttcgttatttaggatatcgcggtttcggtttttagcgagttcggcggatttagcggttttgaacgcggacgtatagtttttgtttttttatagtcgttttttattttatttttatggaaattttaggtgtttttttaagttggggg

SEQ ID NO: 35910 - DNA, 1175 bp, Artificial Sequence
  chemically treated genomic DNA (Homo sapiens) CpG-island No: 35910
cccccaacttaaaaaaacacctaaaatttccataaaaataaaataaaaaacgactataaaaaaacaaaaactatacgtccgcgttcaaaaccgctaaatccgccgaactcgctaaaaaccgaaaccgcgatatcctaaataacgaaactccgaaaatataactcaaccaccgcgaccccgcgatccgctcccgaaccaacgcctcaatcgataccgaaaaaaacgacgccgaaacgaacgcgtcaacctaaaaaaaacgaaaaaaaaatcgcaacgcctaaaacccgaccgccgcccgaataaataaacgaacgaacgacttataaaacacgccgcgacccgatcaccaaccaaaaccgaaatcacgtaactcccaaaactaaataaaaaaaccgcccgaaccgaacgcgccgaaaaaaaaaaacgcctaaaaacaaaaaacgacgtcccctaaaatttatatcaaccaaaacccgccccctcgcgcttatataataaaaacgcgctaccattaacccgcgcgaccaaccaaaacgcaaacgtacgaacgaaataaaaaccaaaaaaaaacaaccgcaaaaaaacacataaacgaaactacgaaaaacaaacgaaacgaaaacgccgaaaaaaacgacgcgacgtacgcgaacacgaaacgtaataatctcccctaaaactaaaacgacgacgaacgcgcgacgacgacgaacgtacgaaactattatactcccgactctcgtatttcccctcctaaacgaataaaaaaaacccaaacgatactaaacgcgctcccccttcctttccctccgacgtcctctcccgaccctctcgcgctacactatctctccgacgcaaaactatcccgacccgaataaacgacaacgaaaacgatactaacgccgcgaaacgcccgaaaaacgaaacgaaaaccgaccaacgaaaaacgataaaaaccgtaaaactcgccgcgaatcgcgaaaaatcgcgaaaaacgacaaaacccgacccgaaacgaaccgcgaaaaaaaaataaattcgaacgcctaccaaaccctacaaataaccgaatcgcaaaccaaccgcgaaaacgaaacgataaccttacccccgacgacaaccgccgatcaactaccaaaatataacgctcccgataaacgcaaaaaccgaatttc

SEQ ID NO: 35911 - DNA, 1175 bp, Artificial Sequence
  chemically treated genomic DNA (Homo sapiens) CpG-island No: 35911
tttttagtttgggaaaatatttggggtttttatgggagtgaggtaaagggcggttgtgaaagaataaaggttgtgcgttcgcgtttagagtcgttgggttcgtcgggttcgttgggggtcggggtcgcggtgttttgggtggcggggtttcgggaatgtgatttagttatcgcggtttcgcgattcgttttcgggttagcgttttagtcggtgtcgaggagggcggcgtcgagacgggcgcgttagtttgggaggagcgggaaaagggtcgtagcgtttgaggttcggtcgtcgttcgagtggatgagcgagcgagcgatttgtgaaatacgtcgcggttcggttattaattaggatcgggattacgtggtttttagggttgggtgaagaagtcgttcggatcgagcgcgtcggagaggaggggcgtttggggatagaaggcgacgttttttgaagtttgtgttagttagggttcgttttttcgcgtttatgtaataggggcgcgttgttattggttcgcgcgattagttagggcgtaggcgtgcgagcggggtgggggttagaaggaggtagtcgtagaaaggtatatgggcggggttgcgaggagtaggcggggcgggggcgtcgaggagagcggcgcggcgtgcgcgggtacgaggcgtagtggttttttttaaggttgaggcggcggcgggcgcgcggcggcggcgggcgtgcgaggttgttgtgttttcggttttcgtgtttttttttttgagcgggtggaggaggtttaagcggtgttgggcgcgtttttttttttttttttttcggcgttttttttcggttttttcgcgttgtattgttttttcgacgtaagattgtttcggttcgggtgagcggtagcgggggcggtgttgacgtcgcgggacgttcgggaaacggggcgggggtcggttagcggggggcggtggggatcgtgggattcgtcgcgggtcgcgaggggtcgcggggggcggtagggttcggttcggggcgggtcgcgggaaggggatgagttcgggcgtttgttaggttttgtaggtggtcgggtcgtaggttagtcgcggaagcggagcggtaattttattttcggcgatagtcgtcggttagttgttagagtgtggcgttttcggtggacgtaggggtcgggtttt

SEQ ID NO: 35912 - DNA, 1175 bp, Artificial Sequence
  chemically treated genomic DNA (Homo sapiens) CpG-island No: 35912
aaaacccgacccctacgtccaccgaaaacgccacactctaacaactaaccgacgactatcgccgaaaataaaattaccgctccgcttccgcgactaacctacgacccgaccacctacaaaacctaacaaacgcccgaactcatccccttcccgcgacccgccccgaaccgaaccctaccgccccccgcgacccctcgcgacccgcgacgaatcccacgatccccaccgccccccgctaaccgacccccgccccgtttcccgaacgtcccgcgacgtcaacaccgcccccgctaccgctcacccgaaccgaaacaatcttacgtcgaaaaaacaatacaacgcgaaaaaaccgaaaaaaaacgccgaaaaaaaaaaaaaaaaaaacgcgcccaacaccgcttaaacctcctccacccgctcaaaaaaaaaaacacgaaaaccgaaaacacaacaacctcgcacgcccgccgccgccgcgcgcccgccgccgcctcaaccttaaaaaaaaccactacgcctcgtacccgcgcacgccgcgccgctctcctcgacgcccccgccccgcctactcctcgcaaccccgcccatatacctttctacgactacctccttctaacccccaccccgctcgcacgcctacgccctaactaatcgcgcgaaccaataacaacgcgcccctattacataaacgcgaaaaaacgaaccctaactaacacaaacttcaaaaaacgtcgccttctatccccaaacgcccctcctctccgacgcgctcgatccgaacgacttcttcacccaaccctaaaaaccacgtaatcccgatcctaattaataaccgaaccgcgacgtatttcacaaatcgctcgctcgctcatccactcgaacgacgaccgaacctcaaacgctacgacccttttcccgctcctcccaaactaacgcgcccgtctcgacgccgccctcctcgacaccgactaaaacgctaacccgaaaacgaatcgcgaaaccgcgataactaaatcacattcccgaaaccccgccacccaaaacaccgcgaccccgacccccaacgaacccgacgaacccaacgactctaaacgcgaacgcacaacctttattctttcacaaccgccctttacctcactcccataaaaaccccaaatattttcccaaactaaaaa

SEQ ID NO: 35913 - DNA, 595 bp, Artificial Sequence
  chemically treated genomic DNA (Homo sapiens) CpG-island No: 35913
cgtcgttcggtattttttaatcgagggttgattcgttatgattattatacgtttcgcgtgggtttatacgttgtcggtagtattgttgttgatggtttttttcgatattttcgttttattggcgatggatatttatttttttgtcgttttagcgatgttcggtattttgaatacgacgttcgttatgatttaatttacgttgagtttttatatggtgatgttcggcgtgggttaggtgatttttggttcgtttttagatagaatcgggcgacggttaattttatttgcgggcgtaacggttttcgttattgcgtttttggagtagtttggtttttaattgtatcggtttttgtcgtttttcgtttattttaagtagtgggcgcgtcggttatgttggtggcgacgttcgcgacggttcgcgacgtttatgttaatcgttttgagggtgtcgttatttacggtttttttagttcgatgttggcgttcgtgtttgcgttcgggtttatcgtcggagtattgatcggcgagtttttgggatggtaggcgatatttattaattttggttatatttggtatgttcgtatttttttaaatt

SEQ ID NO: 35914 - DNA, 595 bp, Artificial Sequence
  chemically treated genomic DNA (Homo sapiens) CpG-island No: 35914
aatttaaaaaaatacgaacataccaaatataaccaaaattaataaatatcgcctaccatcccaaaaactcgccgatcaatactccgacgataaacccgaacgcaaacacgaacgccaacatcgaactaaaaaaaccgtaaataacgacaccctcaaaacgattaacataaacgtcgcgaaccgtcgcgaacgtcgccaccaacataaccgacgcgcccactacttaaaataaacgaaaaacgacaaaaaccgatacaattaaaaaccaaactactccaaaaacgcaataacgaaaaccgttacgcccgcaaataaaattaaccgtcgcccgattctatctaaaaacgaaccaaaaatcacctaacccacgccgaacatcaccatataaaaactcaacgtaaattaaatcataacgaacgtcgtattcaaaataccgaacatcgctaaaacgacaaaaaaataaatatccatcgccaataaaacgaaaatatcgaaaaaaaccatcaacaacaatactaccgacaacgtataaacccacgcgaaacgtataataatcataacgaatcaaccctcgattaaaaaataccgaacgacg

SEQ ID NO: 35915 - DNA, 595 bp, Artificial Sequence
  chemically treated genomic DNA (Homo sapiens) CpG-island No: 35915
aatttaagggagtgcgagtatattaagtatagttaaagttaatgaatatcgtttgttattttaagaattcgtcgattaatgtttcggcgataggttcgagcgtaggtacgaacgttagtatcgaattgaaaaggtcgtagatgacgatatttttaggacggttggtataaacgtcgcgaatcgtcgcgaacgtcgttattagtatggtcgacgcgtttattgtttgaagtagacggaaagcgataaaggtcggtgtagttgaagattaagttgttttagagacgtaatgacgaaagtcgttgcgttcgtaagtagaattggtcgtcgttcgattttgtttgagagcggattaaaaattatttggtttacgtcgagtattattatatagaggtttaacgtgagttggattatagcgggcgtcgtgtttaggatgtcgggtatcgttggaacgatagggagataaatatttatcgttagtgaagcgaggatgtcgaaaggagttattagtagtagtgttgtcggtagcgtataggtttacgcggggcgtgtggtggttatgacgaattaattttcgattaaggaatatcgggcgacg

SEQ ID NO: 35916 - DNA, 595 bp, Artificial Sequence
  chemically treated genomic DNA (Homo sapiens) CpG-island No: 35916
cgtcgcccgatattccttaatcgaaaattaattcgtcataaccaccacacgccccgcgtaaacctatacgctaccgacaacactactactaataactcctttcgacatcctcgcttcactaacgataaatatttatctccctatcgttccaacgatacccgacatcctaaacacgacgcccgctataatccaactcacgttaaacctctatataataatactcgacgtaaaccaaataatttttaatccgctctcaaacaaaatcgaacgacgaccaattctacttacgaacgcaacgactttcgtcattacgtctctaaaacaacttaatcttcaactacaccgacctttatcgctttccgtctacttcaaacaataaacgcgtcgaccatactaataacgacgttcgcgacgattcgcgacgtttataccaaccgtcctaaaaatatcgtcatctacgaccttttcaattcgatactaacgttcgtacctacgctcgaacctatcgccgaaacattaatcgacgaattcttaaaataacaaacgatattcattaactttaactatacttaatatactcgcactcccttaaatt

SEQ ID NO: 35917 - DNA, 1108 bp, Artificial Sequence
  chemically treated genomic DNA (Homo sapiens) CpG-island No: 35917
ttttgggttggaaaggtttcgtttattatttgtggttagtacgaaggtcgggacgttgtggaagcgtatcggttcgtggttgcggtcgttttcgtatgttacgaaggcggttattagttcgtagggttagtggatattgacgcgggtttcgcgggtgttcgtaggggcgtcggtataagttcgaagtttaaagcgaagggtttagcgttagtattgcgtggtcgtatatggagttgtagttttcgttgtgtaggaataggacgtttagatgcgcgttcggtagttcgttcgggattaggatcgtttcgtatatgtttcggtgttttcggggttcgaatatgagtcgtcgtcgtacgtggttaaggtgttggcgtatgtagcgtcgtttggttagtagggtgggtttagatattttcggatatttcgttagtacgatacgtaagggttcgtcgttcgtgtgtatgtttattatcgatagtatcggcgtttttggattatgcgggggtagtcggggtatcgttagcgcgttttttatggtttgcgtcgggggagacgagtacggtttcgtagttatggttttaagttcgatttttatttattgatttcgcgggaggagggcgggacgttaattagttacgttcggggggcggggtttcggagtttaaattcggaagcgagggaggaatttcggagttgtcgttcgggttatcgggaggcggagtcgtcgagttcgttgtggttcggatgttcggtgtagttgttagattcgttgatttagtgtttttcgaaaaaaatttttaggcggtttatgggtgagtggtcgttaagatttcgggaagcgtttttggtagtttcgattatttttttatacggttggtttcgggttcggttttttgtaggcggttttcggttggcggcgtaggttcgttttttgatttcgttcgttttcgggtcgggtttcgtatttttgcggggttggggtggtttgttcgtaacgggttattaggggaggcgcgttgtttgcggcgaaatgttaggtttttgttgtttggttcgaaatgtttttttagttttttagtttaatgtcgagggaatatttgtttgaggg

SEQ ID NO: 35918 - DNA, 1108 bp, Artificial Sequence
  chemically treated genomic DNA (Homo sapiens) CpG-island No: 35918
ccctcaaacaaatattccctcgacattaaactaaaaaactaaaaaaacatttcgaaccaaacaacaaaaacctaacatttcgccgcaaacaacgcgcctcccctaataacccgttacgaacaaaccaccccaaccccgcaaaaatacgaaacccgacccgaaaacgaacgaaatcaaaaaacgaacctacgccgccaaccgaaaaccgcctacaaaaaaccgaacccgaaaccaaccgtataaaaaaataatcgaaactaccaaaaacgcttcccgaaatcttaacgaccactcacccataaaccgcctaaaaatttttttcgaaaaacactaaatcaacgaatctaacaactacaccgaacatccgaaccacaacgaactcgacgactccgcctcccgataacccgaacgacaactccgaaattcctccctcgcttccgaatttaaactccgaaaccccgccccccgaacgtaactaattaacgtcccgccctcctcccgcgaaatcaataaataaaaatcgaacttaaaaccataactacgaaaccgtactcgtctcccccgacgcaaaccataaaaaacgcgctaacgataccccgactacccccgcataatccaaaaacgccgatactatcgataataaacatacacacgaacgacgaacccttacgtatcgtactaacgaaatatccgaaaatatctaaacccaccctactaaccaaacgacgctacatacgccaacaccttaaccacgtacgacgacgactcatattcgaaccccgaaaacaccgaaacatatacgaaacgatcctaatcccgaacgaactaccgaacgcgcatctaaacgtcctattcctacacaacgaaaactacaactccatatacgaccacgcaatactaacgctaaacccttcgctttaaacttcgaacttataccgacgcccctacgaacacccgcgaaacccgcgtcaatatccactaaccctacgaactaataaccgccttcgtaacatacgaaaacgaccgcaaccacgaaccgatacgcttccacaacgtcccgaccttcgtactaaccacaaataataaacgaaacctttccaacccaaaa

SEQ ID NO: 35919 - DNA, 1108 bp, Artificial Sequence
  chemically treated genomic DNA (Homo sapiens) CpG-island No: 35919
tttttaagtaagtgttttttcgatattaaattaagggattgaagagatatttcggattaaataataaagatttggtatttcgtcgtagatagcgcgttttttttagtagttcgttgcggatagattattttaatttcgtaggagtgcggagttcggttcgagggcgggcggggttaaggggcgagtttgcgtcgttaatcgaaggtcgtttataaagagtcgagttcgaggttagtcgtgtaggaaagtagtcgggattattagaaacgtttttcgggattttggcgattatttatttatgggtcgtttgaaggtttttttcgagaagtattagattagcggatttggtagttgtatcgaatattcgggttatagcgagttcggcggtttcgtttttcggtaattcgggcgatagtttcgaagtttttttttcgttttcgggtttaggtttcgagatttcgtttttcggacgtggttggttagcgtttcgtttttttttcgcggagttagtgggtgagggtcgggtttgaagttatagttgcgggatcgtattcgtttttttcgacgtagattatggagagcgcgttggcggtgtttcggttgttttcgtatgatttagggacgtcggtgttgtcggtggtggatatgtatacgggcggcgagtttttgcgtatcgtgttggcggggtgttcggaggtgtttgggtttattttgttggttaagcggcgttatatgcgttagtattttgattacgtgcggcgacggtttatgttcgagtttcgagggtatcgggatatgtacggggcggttttagtttcgagcgagttgtcggacgcgtatttgggcgttttgtttttgtataacgagggttatagttttatgtgcggttacgtagtgttggcgttgggtttttcgttttggatttcgggtttgtgtcggcgtttttgcgggtattcgcgaggttcgcgttaatatttattggttttgcgggttggtgatcgttttcgtggtatgcgaggacggtcgtagttacggatcggtgcgtttttatagcgtttcggttttcgtgttggttataggtaatgggcgggatttttttagtttaggg

SEQ ID NO: 35920 - DNA, 1108 bp, Artificial Sequence
  chemically treated genomic DNA (Homo sapiens) CpG-island No: 35920
ccctaaactaaaaaaatcccgcccattacctataaccaacacgaaaaccgaaacgctataaaaacgcaccgatccgtaactacgaccgtcctcgcataccacgaaaacgatcaccaacccgcaaaaccaataaatattaacgcgaacctcgcgaatacccgcaaaaacgccgacacaaacccgaaatccaaaacgaaaaacccaacgccaacactacgtaaccgcacataaaactataaccctcgttatacaaaaacaaaacgcccaaatacgcgtccgacaactcgctcgaaactaaaaccgccccgtacatatcccgataccctcgaaactcgaacataaaccgtcgccgcacgtaatcaaaatactaacgcatataacgccgcttaaccaacaaaataaacccaaacacctccgaacaccccgccaacacgatacgcaaaaactcgccgcccgtatacatatccaccaccgacaacaccgacgtccctaaatcatacgaaaacaaccgaaacaccgccaacgcgctctccataatctacgtcgaaaaaaacgaatacgatcccgcaactataacttcaaacccgaccctcacccactaactccgcgaaaaaaaaacgaaacgctaaccaaccacgtccgaaaaacgaaatctcgaaacctaaacccgaaaacgaaaaaaaaacttcgaaactatcgcccgaattaccgaaaaacgaaaccgccgaactcgctataacccgaatattcgatacaactaccaaatccgctaatctaatacttctcgaaaaaaaccttcaaacgacccataaataaataatcgccaaaatcccgaaaaacgtttctaataatcccgactactttcctacacgactaacctcgaactcgactctttataaacgaccttcgattaacgacgcaaactcgccccttaaccccgcccgccctcgaaccgaactccgcactcctacgaaattaaaataatctatccgcaacgaactactaaaaaaaacgcgctatctacgacgaaataccaaatctttattatttaatccgaaatatctcttcaatcccttaatttaatatcgaaaaaacacttacttaaaaa

SEQ ID NO: 35921 - DNA, 1178 bp, Artificial Sequence
  chemically treated genomic DNA (Homo sapiens) CpG-island No: 35921
cgtggaagttttgcgtcgtcgcgagttttcggggcgtttcgagtagtttttagggtaaggagaagtttagggtcgttagttaggcgttcgttagtagttgtagcgcgcggcggcggtcgattttttttcgcggcggtcgtacgatagcgtagtaacggtttaacgagatgagcgttacgttgagcgtggatacgatgtcgaagtacgagttgaagaagcggttggcggcgtagaagtcgcgttagggtttcgcggcggcggtaggcgtcgaattttcgggcggagtgaagaggtttaggaaggcggcgggtaggtagagtagcgtcgtgagtagattcgatagggatagcgataggatgaaggcgttggtgacggtgcggagttgtcggtgttttataattatttttattatcgcgtagttgttaaggttagatagtaggaagatgagtaggaggacgagcgtttgggtcgttattgtagtttcgtgcgatagtagcggcgtcgttttcgtcgttagcggtcgttttatcgtcgttttcgtttttcgcgttgtttcggattcgttaaggtcgtcgttatcgggagcggtagttgtgtcgttttcgtttgcgtcgtttaggttttttagcgtcgcggtcgttacggtgttgaaggagagtacggtcgtcgtggtcgcggaggaagtttcgttaggtgggtcggtcgcggagggggcgtcggagtgttggttgtttagtaaggttatgttcgttggtgggcggggcggttgcggtttttttatggggtttagtggcggtcgcggatttttttatttcgtatcgggggcggcggtcgttaggtcggagtggtggttcggggtcgggggttagcggtcgtcgcggggagttgggttcggtcggaggggtggcggtcgttggggatttggcggagtttttgacgtgggttttagcgttgtcgagggaatcgcgtgtttacgtaggagcgcggggcgggacggtagtttagtattcgttgtaaagtcgattcgcgatatcgttatttcggaggttatcggttcgggtgttcgggttttcgagagtgttaggtcgattttttgagggattaatgttcggttagataaagtgtcgattggtatgtaaataaatgattagatttaacgaaagtttatttttgttttt

SEQ ID NO: 35922 - DNA, 1178 bp, Artificial Sequence
  chemically treated genomic DNA (Homo sapiens) CpG-island No: 35922
aaaaacaaaaataaactttcgttaaatctaatcatttatttacataccaatcgacactttatctaaccgaacattaatccctcaaaaaatcgacctaacactctcgaaaacccgaacacccgaaccgataacctccgaaataacgatatcgcgaatcgactttacaacgaatactaaactaccgtcccgccccgcgctcctacgtaaacacgcgattccctcgacaacgctaaaacccacgtcaaaaactccgccaaatccccaacgaccgccacccctccgaccgaacccaactccccgcgacgaccgctaacccccgaccccgaaccaccactccgacctaacgaccgccgcccccgatacgaaataaaaaaatccgcgaccgccactaaaccccataaaaaaaccgcaaccgccccgcccaccaacgaacataaccttactaaacaaccaacactccgacgccccctccgcgaccgacccacctaacgaaacttcctccgcgaccacgacgaccgtactctccttcaacaccgtaacgaccgcgacgctaaaaaacctaaacgacgcaaacgaaaacgacacaactaccgctcccgataacgacgaccttaacgaatccgaaacaacgcgaaaaacgaaaacgacgataaaacgaccgctaacgacgaaaacgacgccgctactatcgcacgaaactacaataacgacccaaacgctcgtcctcctactcatcttcctactatctaaccttaacaactacgcgataataaaaataattataaaacaccgacaactccgcaccgtcaccaacgccttcatcctatcgctatccctatcgaatctactcacgacgctactctacctacccgccgccttcctaaacctcttcactccgcccgaaaattcgacgcctaccgccgccgcgaaaccctaacgcgacttctacgccgccaaccgcttcttcaactcgtacttcgacatcgtatccacgctcaacgtaacgctcatctcgttaaaccgttactacgctatcgtacgaccgccgcgaaaaaaaatcgaccgccgccgcgcgctacaactactaacgaacgcctaactaacgaccctaaacttctccttaccctaaaaactactcgaaacgccccgaaaactcgcgacgacgcaaaacttccacg

SEQ ID NO: 35923 - DNA, 1178 bp, Artificial Sequence
  chemically treated genomic DNA (Homo sapiens) CpG-island No: 35923
gagagtaagagtgaattttcgttgaatttggttatttgtttgtatgttagtcggtattttatttggtcggatattggttttttaggaggtcgatttggtattttcggaaattcgaatattcgggtcggtaattttcggagtggcggtgtcgcgggtcggttttgtagcgggtattgggttgtcgtttcgtttcgcgtttttgcgtaaatacgcggttttttcggtaacgttggaatttacgttaaaggtttcgttaggtttttagcgatcgttattttttcggtcgagtttagtttttcgcggcggtcgttagttttcggtttcgagttattatttcgatttagcggtcgtcgttttcggtgcgggatgaggagattcgcggtcgttattgggttttatggaggagtcgtagtcgtttcgtttattagcgagtatggttttattgggtagttagtatttcggcgtttttttcgcggtcggtttatttggcgggatttttttcgcggttacggcggtcgtgtttttttttagtatcgtggcgatcgcggcgttggggaatttgagcgacgtaagcggaggcggtatagttgtcgttttcggtggcggcggttttggcgggttcggggtagcgcgggaggcgggggcggcggtgaggcggtcgttagcgacggaggcggcgtcgttgttgtcgtacggagttgtagtggcggtttaggcgttcgtttttttgtttatttttttgttgtttagttttggtaattgcgcggtgatgggggtgattgtgaagtatcggtagtttcgtatcgttattaacgtttttattttgtcgttgtttttatcggatttgtttacggcgttgttttgtttgttcgtcgtttttttggatttttttatttcgttcgggggttcggcgtttgtcgtcgtcgcggggttttggcgcggtttttgcgtcgttagtcgtttttttagttcgtgtttcggtatcgtgtttacgtttagcgtggcgtttatttcgttggatcgttattgcgttatcgtgcggtcgtcgcgggagaagatcggtcgtcgtcgcgcgttgtagttgttggcgggcgtttggttgacggttttgggtttttttttgttttgggagttgttcggggcgtttcgggaattcgcggcggcgtagagtttttacg

SEQ ID NO: 35924 - DNA, 1178 bp, Artificial Sequence
  chemically treated genomic DNA (Homo sapiens) CpG-island No: 35924
cgtaaaaactctacgccgccgcgaattcccgaaacgccccgaacaactcccaaaacaaaaaaaaacccaaaaccgtcaaccaaacgcccgccaacaactacaacgcgcgacgacgaccgatcttctcccgcgacgaccgcacgataacgcaataacgatccaacgaaataaacgccacgctaaacgtaaacacgataccgaaacacgaactaaaaaaacgactaacgacgcaaaaaccgcgccaaaaccccgcgacgacgacaaacgccgaacccccgaacgaaataaaaaaatccaaaaaaacgacgaacaaacaaaacaacgccgtaaacaaatccgataaaaacaacgacaaaataaaaacgttaataacgatacgaaactaccgatacttcacaatcacccccatcaccgcgcaattaccaaaactaaacaacaaaaaaataaacaaaaaaacgaacgcctaaaccgccactacaactccgtacgacaacaacgacgccgcctccgtcgctaacgaccgcctcaccgccgcccccgcctcccgcgctaccccgaacccgccaaaaccgccgccaccgaaaacgacaactataccgcctccgcttacgtcgctcaaattccccaacgccgcgatcgccacgatactaaaaaaaaacacgaccgccgtaaccgcgaaaaaaatcccgccaaataaaccgaccgcgaaaaaaacgccgaaatactaactacccaataaaaccatactcgctaataaacgaaacgactacgactcctccataaaacccaataacgaccgcgaatctcctcatcccgcaccgaaaacgacgaccgctaaatcgaaataataactcgaaaccgaaaactaacgaccgccgcgaaaaactaaactcgaccgaaaaaataacgatcgctaaaaacctaacgaaacctttaacgtaaattccaacgttaccgaaaaaaccgcgtatttacgcaaaaacgcgaaacgaaacgacaacccaatacccgctacaaaaccgacccgcgacaccgccactccgaaaattaccgacccgaatattcgaatttccgaaaataccaaatcgacctcctaaaaaaccaatatccgaccaaataaaataccgactaacatacaaacaaataaccaaattcaacgaaaattcactcttactctc

SEQ ID NO: 35925 - DNA, 509 bp, Artificial Sequence
  chemically treated genomic DNA (Homo sapiens) CpG-island No: 35925
agcgagcgtcgagttagcgtcgagttagcgcggtttttcgggtgcggcgggcgcggggtggattgagcgggttcgggcgggacgagaggtgggcgagcgtttcgtattttcggcgcgtcgcgcgggattagcgttttttagtcgcgttgtttcggtttatcgtgtagttgtagtcgcggcgcggtggcgcggtggcgtagggcgttgttgggtcgtttattgttgagcgcgttgggtttcgtcggcgatgtcgcgcgtcgttttttcggagcggcggcgaagtttgaatttggcgtcggtttggagtttcgagtagttcgggggcggcggtcgcgaggcgagcggcgatggtgagtgaggagggcggttgggtacggagagggaggcgggggtcggtcggttgttttttggagcgcgtttatttcgggttttgcggcgattttggaaagttttgtttggaggatggtttttaggggtttttacggttagtatttcggttgatgggggta

SEQ ID NO: 35926 - DNA, 509 bp, Artificial Sequence
  chemically treated genomic DNA (Homo sapiens) CpG-island No: 35926
tacccccatcaaccgaaatactaaccgtaaaaacccctaaaaaccatcctccaaacaaaactttccaaaatcgccgcaaaacccgaaataaacgcgctccaaaaaacaaccgaccgacccccgcctccctctccgtacccaaccgccctcctcactcaccatcgccgctcgcctcgcgaccgccgcccccgaactactcgaaactccaaaccgacgccaaattcaaacttcgccgccgctccgaaaaaacgacgcgcgacatcgccgacgaaacccaacgcgctcaacaataaacgacccaacaacgccctacgccaccgcgccaccgcgccgcgactacaactacacgataaaccgaaacaacgcgactaaaaaacgctaatcccgcgcgacgcgccgaaaatacgaaacgctcgcccacctctcgtcccgcccgaacccgctcaatccaccccgcgcccgccgcacccgaaaaaccgcgctaactcgacgctaactcgacgctcgct

SEQ ID NO: 35927 - DNA, 509 bp, Artificial Sequence
  chemically treated genomic DNA (Homo sapiens) CpG-island No: 35927
tgtttttattagtcggggtgttggtcgtgaaagtttttgggagttattttttagatagggttttttagagtcgtcgtagagttcgaaatagacgcgttttagaaagtagtcggtcggttttcgttttttttttcgtgtttagtcgttttttttatttattatcgtcgttcgtttcgcggtcgtcgttttcgggttgttcggggttttaggtcgacgttaagtttaaatttcgtcgtcgtttcgaggaggcggcgcgcggtatcgtcggcggggtttaacgcgtttaataatgggcggtttagtagcgttttgcgttatcgcgttatcgcgtcgcggttatagttgtacggtgggtcggggtagcgcggttggaggacgttgatttcgcgcggcgcgtcgagggtgcggggcgttcgtttatttttcgtttcgttcgggttcgtttagtttatttcgcgttcgtcgtattcgaggggtcgcgttggttcggcgttggttcggcgttcgtt

SEQ ID NO: 35928 - DNA, 509 bp, Artificial Sequence
  chemically treated genomic DNA (Homo sapiens) CpG-island No: 35928
aacgaacgccgaaccaacgccgaaccaacgcgacccctcgaatacgacgaacgcgaaataaactaaacgaacccgaacgaaacgaaaaataaacgaacgccccgcaccctcgacgcgccgcgcgaaatcaacgtcctccaaccgcgctaccccgacccaccgtacaactataaccgcgacgcgataacgcgataacgcaaaacgctactaaaccgcccattattaaacgcgttaaaccccgccgacgataccgcgcgccgcctcctcgaaacgacgacgaaatttaaacttaacgtcgacctaaaaccccgaacaacccgaaaacgacgaccgcgaaacgaacgacgataataaataaaaaaaacgactaaacacgaaaaaaaaaacgaaaaccgaccgactactttctaaaacgcgtctatttcgaactctacgacgactctaaaaaaccctatctaaaaaataactcccaaaaactttcacgaccaacaccccgactaataaaaaca

SEQ ID NO: 35929 - DNA, 510 bp, Artificial Sequence
  chemically treated genomic DNA (Homo sapiens) CpG-island No: 35929
  misc_feature (13)..(13): n is either a, c, g or t
  misc_feature (405)..(405): n is either a, c, g or t
  misc_feature (408)..(408): n is either a, c, g or t
  misc_feature (427)..(427): n is either a, c, g or t
cggggggagcgtnaataggaaggaggggtttgatatgatgttcgtaagcggtaatcgaaaacgattcggaaaggtttttcgggattaatagaaaattttcgtgcggggggtacgttcgaagcggggtcggttttatggtcgtcgtggggcgggaagtatttaagggaatttcggaattttgaggggggggtcgcgtttttttattcgttagggggggtcgcgtttcgggttcggcggttcgggtcgaattttttcgggggcgcgcggggcggtttttcggcgaatacgtcgttaattgtggggcggtgtcgatcggtgttcgggagagaagttcgtttttgcgcgcggcgtcgttttttttttttcgcgggttcgcgcggagggtcggtacgcgcgttgtaggtncgncgagcgtcgcgtttttcgncgagcgcgttttgtcgcggcgtcgcgtttatcggcgcggggttaggacggggggggcgtcgtagacggcgtcgttcgggggcg

SEQ ID NO: 35930 - DNA, 510 bp, Artificial Sequence
  chemically treated genomic DNA (Homo sapiens) CpG-island No: 35930
  misc_feature (84)..(84): n is either a, c, g or t
  misc_feature (103)..(103): n is either a, c, g or t
  misc_feature (106)..(106): n is either a, c, g or t
  misc_feature (498)..(498): n is either a, c, g or t
cgcccccgaacgacgccgtctacgacgccccccccgtcctaaccccgcgccgataaacgcgacgccgcgacaaaacgcgctcgncgaaaaacgcgacgctcgncgnacctacaacgcgcgtaccgaccctccgcgcgaacccgcgaaaaaaaaaaaacgacgccgcgcgcaaaaacgaacttctctcccgaacaccgatcgacaccgccccacaattaacgacgtattcgccgaaaaaccgccccgcgcgcccccgaaaaaattcgacccgaaccgccgaacccgaaacgcgaccccccctaacgaataaaaaaacgcgacccccccctcaaaattccgaaattcccttaaatacttcccgccccacgacgaccataaaaccgaccccgcttcgaacgtaccccccgcacgaaaattttctattaatcccgaaaaacctttccgaatcgttttcgattaccgcttacgaacatcatatcaaacccctccttcctattnacgctccccccg

SEQ ID NO: 35931 - DNA, 510 bp, Artificial Sequence
  chemically treated genomic DNA (Homo sapiens) CpG-island No: 35931
  misc_feature (84)..(84): n is either a, c, g or t
  misc_feature (103)..(103): n is either a, c, g or t
  misc_feature (106)..(106): n is either a, c, g or t
  misc_feature (498)..(498): n is either a, c, g or t
cgttttcgaacggcgtcgtttgcggcgtttttttcgttttgatttcgcgtcggtgggcgcggcgtcgcggtagggcgcgttcgncgaaaagcgcggcgttcgncgngtttatagcgcgcgtgtcgatttttcgcgcgagttcgcggggggggaagggcggcgtcgcgcgtaggggcgggtttttttttcgggtatcggtcggtatcgttttataattagcggcgtgttcgtcggggggtcgtttcgcgcgttttcgggggggttcggttcgggtcgtcgggttcggggcgcggttttttttggcgggtagaagggcgcggttttttttttagggtttcggggtttttttaggtgtttttcgttttacggcggttatgaggtcggtttcgtttcgagcgtatttttcgtacgaaggttttttattggtttcggagggttttttcgggtcgttttcggttgtcgtttgcgggtattatgttagattttttttttttattngcgtttttttcg

SEQ ID NO: 35932 - DNA, 510 bp, Artificial Sequence
  chemically treated genomic DNA (Homo sapiens) CpG-island No: 35932
  misc_feature (13)..(13): n is either a, c, g or t
  misc_feature (405)..(405): n is either a, c, g or t
  misc_feature (408)..(408): n is either a, c, g or t
  misc_feature (427)..(427): n is either a, c, g or t
cgaaaaaaacgcnaataaaaaaaaaaaatctaacataatacccgcaaacgacaaccgaaaacgacccgaaaaaaccctccgaaaccaataaaaaaccttcgtacgaaaaatacgctcgaaacgaaaccgacctcataaccgccgtaaaacgaaaaacacctaaaaaaaccccgaaaccctaaaaaaaaaaccgcgcccttctacccgccaaaaaaaaccgcgccccgaacccgacgacccgaaccgaacccccccgaaaacgcgcgaaacgaccccccgacgaacacgccgctaattataaaacgataccgaccgatacccgaaaaaaaaacccgcccctacgcgcgacgccgcccttccccccccgcgaactcgcgcgaaaaatcgacacgcgcgctataaacncgncgaacgccgcgcttttcgncgaacgcgccctaccgcgacgccgcgcccaccgacgcgaaatcaaaacgaaaaaaacgccgcaaacgacgccgttcgaaaacg

SEQ ID NO: 35933 - DNA, 687 bp, Artificial Sequence
  chemically treated genomic DNA (Homo sapiens) CpG-island No: 35933
cgaagttcggttcggcgttgatagggcgttatttttttagtttcggagaatttttagggattttcggttttcgcgtcggttattcgagattttcgcggttttttttcggacggtttcgcgcgcgaggttcggtttcgttttcggacgtcgggtttcgattttcgattcgattttgggcgggttcgtaggcgggaagtcggtaggggagtagggggtgtcgggaaagggagagggttcgcgtcgttttttgtttattttttcggacgtcgtcggtcgtcgttatttgttttattgtagtagtagtagtcgtcgcggtcgtcgtttttcgtttttcggttcgtcggttcggggcgggggagagcgtgacgttcgtcgtcgtcgcgggtcgggcgtgcgtcgttgtttatgagaagatatcgcgcgttttttttagagtttcgtcgtcgcgttcgttcggtggggcggttcggattttttcgagttcgtatcggttttgcggtcgcgttcggtttcgcgtcgtttcgtcgtttttttgtttgcgtttatcgcggtttcgggaggattttggtttcggcgcgttcgtcgttcgttttcgaattttttcgagtttcggtttggggagtaaggtgcgagggaaaatttataggtttgtttcgaggggtttttcgttatttttgtaaagtgttt

SEQ ID NO: 35934 - DNA, 687 bp, Artificial Sequence
  chemically treated genomic DNA (Homo sapiens) CpG-island No: 35934
aaacactttacaaaaataacgaaaaacccctcgaaacaaacctataaattttccctcgcaccttactccccaaaccgaaactcgaaaaaattcgaaaacgaacgacgaacgcgccgaaaccaaaatcctcccgaaaccgcgataaacgcaaacaaaaaaacgacgaaacgacgcgaaaccgaacgcgaccgcaaaaccgatacgaactcgaaaaaatccgaaccgccccaccgaacgaacgcgacgacgaaactctaaaaaaaacgcgcgatatcttctcataaacaacgacgcacgcccgacccgcgacgacgacgaacgtcacgctctcccccgccccgaaccgacgaaccgaaaaacgaaaaacgacgaccgcgacgactactactactacaataaaacaaataacgacgaccgacgacgtccgaaaaaataaacaaaaaacgacgcgaaccctctccctttcccgacaccccctactcccctaccgacttcccgcctacgaacccgcccaaaatcgaatcgaaaatcgaaacccgacgtccgaaaacgaaaccgaacctcgcgcgcgaaaccgtccgaaaaaaaaccgcgaaaatctcgaataaccgacgcgaaaaccgaaaatccctaaaaattctccgaaactaaaaaaataacgccctatcaacgccgaaccgaacttcg

SEQ ID NO: 35935 - DNA, 687 bp, Artificial Sequence
  chemically treated genomic DNA (Homo sapiens) CpG-island No: 35935
gaatattttgtagaaatgacgagaagtttttcggagtaggtttgtgggttttttttcgtattttgttttttaagtcggggttcgggagggttcgagggcggacggcgggcgcgtcggggttagggttttttcggggtcgcggtgggcgtagataaagaggcggcggggcggcgcgaggtcgggcgcggtcgtagggtcggtgcggattcgagggggttcgggtcgttttatcgggcgggcgcggcggcggagttttgggaggagcgcgcggtgtttttttatggatagcggcgtacgttcggttcgcggcggcggcgggcgttacgttttttttcgtttcgagtcgacgagtcgggaggcgggaggcggcggtcgcggcggttgttgttgttgtagtgggataggtggcggcgatcggcggcgttcgaggaggtgagtagggggcggcgcgggttttttttttttttcggtattttttgtttttttgtcggtttttcgtttgcgggttcgtttagggtcgggtcgggggtcgaagttcggcgttcgggagcggggtcgagtttcgcgcgcggagtcgttcgggaggggatcgcgggagtttcgggtggtcggcgcggaggtcgggggtttttggaggtttttcggagttggaaaagtggcgttttgttagcgtcgagtcgggtttcg

SEQ ID NO: 35936 - DNA, 687 bp, Artificial Sequence
  chemically treated genomic DNA (Homo sapiens) CpG-island No: 35936
cgaaacccgactcgacgctaacaaaacgccacttttccaactccgaaaaacctccaaaaacccccgacctccgcgccgaccacccgaaactcccgcgatcccctcccgaacgactccgcgcgcgaaactcgaccccgctcccgaacgccgaacttcgacccccgacccgaccctaaacgaacccgcaaacgaaaaaccgacaaaaaaacaaaaaataccgaaaaaaaaaaaaaacccgcgccgccccctactcacctcctcgaacgccgccgatcgccgccacctatcccactacaacaacaacaaccgccgcgaccgccgcctcccgcctcccgactcgtcgactcgaaacgaaaaaaaacgtaacgcccgccgccgccgcgaaccgaacgtacgccgctatccataaaaaaacaccgcgcgctcctcccaaaactccgccgccgcgcccgcccgataaaacgacccgaaccccctcgaatccgcaccgaccctacgaccgcgcccgacctcgcgccgccccgccgcctctttatctacgcccaccgcgaccccgaaaaaaccctaaccccgacgcgcccgccgtccgccctcgaaccctcccgaaccccgacttaaaaaacaaaatacgaaaaaaaacccacaaacctactccgaaaaacttctcgtcatttctacaaaatattc

SEQ ID NO: 35937 - DNA, 522 bp, Artificial Sequence
  chemically treated genomic DNA (Homo sapiens) CpG-island No: 35937
tttttcgcgtatttcgtggttagtagttagatagttgtgtttaattagaaattacgttataattttagacgattcgaaggggaaatttcggcgtgaagtgtagtttcgtttcggttttttttagttttttttttttttttggaattcgaggcgcggatttttttcgttttatcgttttagttttttcgggagttcgtcggtgttttttagggtgtcggttcgtgttgggaagtgttttttattttggtaatggggggcggcgaggtatcgtaggagtggcgaggcggcgtttagggtggtattgtttcggaacggggcgttgggtgcgcgcgggagggttttcgcgcgggtttcgtcgttgtcgtagttgcgagcgcgtcgcgttatcgagttttttgtagtaatggttcgttcgtgaaacgcgagttacggttgttttttttaagagtgtttgtatttttcgtttgcgtttcgtaattgttttgggtgaaaatggttgtttagattaaaatgtggtagaag

SEQ ID NO: 35938 - DNA, 522 bp, Artificial Sequence
  chemically treated genomic DNA (Homo sapiens) CpG-island No: 35938
cttctaccacattttaatctaaacaaccattttcacccaaaacaattacgaaacgcaaacgaaaaatacaaacactcttaaaaaaaacaaccgtaactcgcgtttcacgaacgaaccattactacaaaaaactcgataacgcgacgcgctcgcaactacgacaacgacgaaacccgcgcgaaaaccctcccgcgcgcacccaacgccccgttccgaaacaataccaccctaaacgccgcctcgccactcctacgatacctcgccgccccccattaccaaaataaaaaacacttcccaacacgaaccgacaccctaaaaaacaccgacgaactcccgaaaaaactaaaacgataaaacgaaaaaaatccgcgcctcgaattccaaaaaaaaaaaaaaaactaaaaaaaaccgaaacgaaactacacttcacgccgaaatttccccttcgaatcgtctaaaattataacgtaatttctaattaaacacaactatctaactactaaccacgaaatacgcgaaaaa

SEQ ID NO: 35939 - DNA, 522 bp, Artificial Sequence
  chemically treated genomic DNA (Homo sapiens) CpG-island No: 35939
tttttgttatattttagtttagatagttatttttatttaggatagttgcgaagcgtaaacggaggatgtaggtatttttaaaaagagtagtcgtggttcgcgttttacggacgagttattgttgtaggaggttcggtggcgcggcgcgttcgtagttgcggtagcggcggagttcgcgcggggattttttcgcgcgtatttagcgtttcgtttcggggtagtgttattttgggcgtcgtttcgttatttttacggtgtttcgtcgttttttattattaggatggagggtattttttagtacgagtcgatattttagagggtatcggcgagttttcgaaaaaattagggcggtggggcgaggaagattcgcgtttcggattttagagaaggaaagaaagttagagggagtcggagcggagttgtattttacgtcgaagtttttttttcgaatcgtttggagttgtaacgtggtttttgattgaatatagttgtttagttgttggttacggggtgcgcggagga

SEQ ID NO: 35940 - DNA, 522 bp, Artificial Sequence
  chemically treated genomic DNA (Homo sapiens) CpG-island No: 35940
tcctccgcgcaccccgtaaccaacaactaaacaactatattcaatcaaaaaccacgttacaactccaaacgattcgaaaaaaaaacttcgacgtaaaatacaactccgctccgactccctctaactttctttccttctctaaaatccgaaacgcgaatcttcctcgccccaccgccctaattttttcgaaaactcgccgataccctctaaaatatcgactcgtactaaaaaataccctccatcctaataataaaaaacgacgaaacaccgtaaaaataacgaaacgacgcccaaaataacactaccccgaaacgaaacgctaaatacgcgcgaaaaaatccccgcgcgaactccgccgctaccgcaactacgaacgcgccgcgccaccgaacctcctacaacaataactcgtccgtaaaacgcgaaccacgactactctttttaaaaatacctacatcctccgtttacgcttcgcaactatcctaaataaaaataactatctaaactaaaatataacaaaaa

SEQ ID NO: 35941 - DNA, 671 bp, Artificial Sequence
  chemically treated genomic DNA (Homo sapiens) CpG-island No: 35941
agggaggcgttgagggaggcggtttcggtttcggtttcggtttcgtagtatcgttcgatatttttgacgtcgttgtttaggttttggagttttcgcgttagttcggttagggcggtggtggcggttttttcgcggttcgcgtcgtggttgggttttaggtgttttgtcggtcgcgggggtttcgaggtttgttttagggtcgttattcgggcggttagttcgttttagtcgagcgtttgtttttgtagttcgttagcggcgttttgtagggttacgcggatttgttcgtagtttaggggtagcggtttcggcgtttgtttagatattttttttagtatttttttttcgaagagcgcggttagtatcgtttcgtgtcgtagcgcgttttttagtagggcggcgaaggcgttgtgtagttggcgtatttcgtggcgggtttcggtcgcggtcgtttttagcgcgtttatttcgttatttagcgtttgtatttggtttcggagtcgcgacgtggtcgttcgcgttcgttcgtttttcgttttgtgcgcgtttacggttagcgatacggcgtttacggcgttttgtagggtttgtagggaggagtcgtttagttgtcgtcgttcgtttaggtttatttgggttttttttagggtacgcgtggcgtttttttggtt

SEQ ID NO: 35942 - DNA, 671 bp, Artificial Sequence
  chemically treated genomic DNA (Homo sapiens) CpG-island No: 35942
aaccaaaaaaacgccacgcgtaccctaaaaaaaacccaaataaacctaaacgaacgacgacaactaaacgactcctccctacaaaccctacaaaacgccgtaaacgccgtatcgctaaccgtaaacgcgcacaaaacgaaaaacgaacgaacgcgaacgaccacgtcgcgactccgaaaccaaatacaaacgctaaataacgaaataaacgcgctaaaaacgaccgcgaccgaaacccgccacgaaatacgccaactacacaacgccttcgccgccctactaaaaaacgcgctacgacacgaaacgatactaaccgcgctcttcgaaaaaaaaatactaaaaaaaatatctaaacaaacgccgaaaccgctacccctaaactacgaacaaatccgcgtaaccctacaaaacgccgctaacgaactacaaaaacaaacgctcgactaaaacgaactaaccgcccgaataacgaccctaaaacaaacctcgaaacccccgcgaccgacaaaacacctaaaacccaaccacgacgcgaaccgcgaaaaaaccgccaccaccgccctaaccgaactaacgcgaaaactccaaaacctaaacaacgacgtcaaaaatatcgaacgatactacgaaaccgaaaccgaaaccgaaaccgcctccctcaacgcctccct

SEQ ID NO: 35943 - DNA, 671 bp, Artificial Sequence
  chemically treated genomic DNA (Homo sapiens) CpG-island No: 35943
ggttagagggacgttacgcgtgttttggaggagatttaggtgagtttggacgagcggcggtagttggacggtttttttttgtaggttttgtagaacgtcgtggacgtcgtgtcgttggtcgtggacgcgtataaagcggagggcgagcgggcgcgggcggttacgtcgcggtttcggagttaagtgtaggcgttggatgacgaggtgggcgcgttgaaggcggtcgcggtcgaggttcgttacgaggtgcgttagttgtatagcgttttcgtcgttttgttggaggacgcgttgcggtacgaggcggtgttggtcgcgtttttcggggaggaggtgttggaggagatgtttgagtagacgtcgggatcgttgtttttgagttacgagtagattcgcgtggttttgtaggacgtcgttagcgggttgtaggagtaggcgttcggttgggacgagttggtcgttcgagtgacggttttggagtaggtttcggagttttcgcggtcggtagagtatttggagtttagttacgacgcgggtcgcgaggaggtcgttattatcgttttggtcgggttggcgcgggagttttagagtttgagtaacgacgttaagaatgtcgggcggtgttgcgaggtcgaggtcggggtcggggtcgttttttttaacgttttttt

SEQ ID NO: 35944 - DNA, 671 bp, Artificial Sequence
  chemically treated genomic DNA (Homo sapiens) CpG-island No: 35944
aaaaaaacgttaaaaaaaacgaccccgaccccgacctcgacctcgcaacaccgcccgacattcttaacgtcgttactcaaactctaaaactcccgcgccaacccgaccaaaacgataataacgacctcctcgcgacccgcgtcgtaactaaactccaaatactctaccgaccgcgaaaactccgaaacctactccaaaaccgtcactcgaacgaccaactcgtcccaaccgaacgcctactcctacaacccgctaacgacgtcctacaaaaccacgcgaatctactcgtaactcaaaaacaacgatcccgacgtctactcaaacatctcctccaacacctcctccccgaaaaacgcgaccaacaccgcctcgtaccgcaacgcgtcctccaacaaaacgacgaaaacgctatacaactaacgcacctcgtaacgaacctcgaccgcgaccgccttcaacgcgcccacctcgtcatccaacgcctacacttaactccgaaaccgcgacgtaaccgcccgcgcccgctcgccctccgctttatacgcgtccacgaccaacgacacgacgtccacgacgttctacaaaacctacaaaaaaaaaccgtccaactaccgccgctcgtccaaactcacctaaatctcctccaaaacacgcgtaacgtccctctaacc

SEQ ID NO: 35945 - DNA, 693 bp, Artificial Sequence
  chemically treated genomic DNA (Homo sapiens) CpG-island No: 35945
cgggggtcgtttttatttcgggttcggttttaggggttgttgttcgaacgtattggtttttttagaagtattcgtcggcggtatatcggtagggcggtcggttttgttgggttttttgggcgtcggtttcgggggttcgggcggtttttttcggttttcggtttggattcgcgaacgcgcgggcgcgaggggttgggacgcgggagttttttgagtgcggagcgcggagttttggtgtttcggcgtattgtagttatattttcgggtcgcgcgttttcgtcgttttttattcgcgtcgtagggtttttttttttgaggcgtcgttcgcgtatcgtcgggggggagggggtagcgttaataaattggggagttcggttcgtcgcgtttaggttttcgtttggagtcgtcgtattcgggacggtgcgtagcgttggaagttcggtttttcgagagttagttgttcgtcgcggttttcgtacgtcgggtagtcgtttttcgtcgtttcgggcgcgttattatggggtttcggtttagcgtttggttgttgttgttgttcgtcgtttttttgttttacgaggagtatagtcgggtcgttgcgaaggtgagttttcggttagtttcgttttcggcgtttcgtttcgagtttgggcgtttcgagaggtttttttgttcgcgtttggattcgttcgtttg

SEQ ID NO: 35946 - DNA, 693 bp, Artificial Sequence
  chemically treated genomic DNA (Homo sapiens) CpG-island No: 35946
caaacgaacgaatccaaacgcgaacaaaaaaacctctcgaaacgcccaaactcgaaacgaaacgccgaaaacgaaactaaccgaaaactcaccttcgcaacgacccgactatactcctcgtaaaacaaaaaaacgacgaacaacaacaacaaccaaacgctaaaccgaaaccccataataacgcgcccgaaacgacgaaaaacgactacccgacgtacgaaaaccgcgacgaacaactaactctcgaaaaaccgaacttccaacgctacgcaccgtcccgaatacgacgactccaaacgaaaacctaaacgcgacgaaccgaactccccaatttattaacgctaccccctcccccccgacgatacgcgaacgacgcctcaaaaaaaaaaaccctacgacgcgaataaaaaacgacgaaaacgcgcgacccgaaaatataactacaatacgccgaaacaccaaaactccgcgctccgcactcaaaaaactcccgcgtcccaacccctcgcgcccgcgcgttcgcgaatccaaaccgaaaaccgaaaaaaaccgcccgaacccccgaaaccgacgcccaaaaaacccaacaaaaccgaccgccctaccgatataccgccgacgaatacttctaaaaaaaccaatacgttcgaacaacaacccctaaaaccgaacccgaaataaaaacgacccccg

SEQ ID NO: 35947 - DNA, 693 bp, Artificial Sequence
  chemically treated genomic DNA (Homo sapiens) CpG-island No: 35947
taggcggacgggtttaggcgcggataaaggggtttttcggggcgtttaagttcggggcgggacgtcgggagcggagttggtcgggaatttattttcgtagcggttcggttgtgtttttcgtggagtagaagggcggcgggtagtagtagtagttagacgttgagtcggggttttatggtggcgcgttcgaggcggcgagggacggttgttcggcgtgcgggggtcgcggcggatagttagttttcggaaggtcggatttttagcgttacgtatcgtttcgggtgcggcggttttaagcggagatttgagcgcggcgggtcgagttttttaatttgttggcgttgttttttttttttcggcggtgcgcgggcggcgttttaaaggggaggattttgcggcgcgggtaagaggcggcgggagcgcgcggttcgggagtgtggttgtagtgcgtcgggatattagggtttcgcgtttcgtatttaagaggttttcgcgttttaatttttcgcgttcgcgcgttcgcggatttaggtcgaggatcgaaaggggtcgttcgagttttcggggtcggcgtttagagagtttagtaaggtcggtcgttttgtcggtgtgtcgtcggcgggtgtttttggaagggttaatgcgttcgggtagtagtttttgaagtcgagttcgaggtgagagcgattttcg

SEQ ID NO: 35948 - DNA, 693 bp, Artificial Sequence
  chemically treated genomic DNA (Homo sapiens) CpG-island No: 35948
cgaaaatcgctctcacctcgaactcgacttcaaaaactactacccgaacgcattaacccttccaaaaacacccgccgacgacacaccgacaaaacgaccgaccttactaaactctctaaacgccgaccccgaaaactcgaacgacccctttcgatcctcgacctaaatccgcgaacgcgcgaacgcgaaaaattaaaacgcgaaaacctcttaaatacgaaacgcgaaaccctaatatcccgacgcactacaaccacactcccgaaccgcgcgctcccgccgcctcttacccgcgccgcaaaatcctcccctttaaaacgccgcccgcgcaccgccgaaaaaaaaaaaacaacgccaacaaattaaaaaactcgacccgccgcgctcaaatctccgcttaaaaccgccgcacccgaaacgatacgtaacgctaaaaatccgaccttccgaaaactaactatccgccgcgacccccgcacgccgaacaaccgtccctcgccgcctcgaacgcgccaccataaaaccccgactcaacgtctaactactactactacccgccgcccttctactccacgaaaaacacaaccgaaccgctacgaaaataaattcccgaccaactccgctcccgacgtcccgccccgaacttaaacgccccgaaaaacccctttatccgcgcctaaacccgtccgccta

SEQ ID NO: 35949 - DNA, 609 bp, Artificial Sequence
  chemically treated genomic DNA (Homo sapiens) CpG-island No: 35949
tcgaaggtggaacggattttagttatttcggggttaggaaaagatgaagtgtcgtaggttcggcgttttcgtttttcgtttgaggtaacggagtattttttttcgagtagtttattttttagagagttttttcggttgcgaaagttagacgaagagggatttaaagttatcgtagcggtaagagtcggagaattattgagggatagcgttttttgtagaggcggttgaatcgttttttatagcgttgggcggggcgtcgcgtagtttttgggcgttgattgggtatttcgtgttttttttttttcggttcggcgttgtttttgttttttttgatttcgattttaagttatgcgttgagtttcggttggttcggtttttttgaggcgtaagttcggtttgtttaatgaggagcgagcgtcgcgggggtcgtcgggaagggcggtcgatttatataagtagtttgcggggcgttttttcgggttgtggttggtgtgcgggtttcggttggaggattcgttggggaggtggtttgcgtttgtagagattgtattttcgagacgatggcggagggagataatcgtagtattaatttgttggtgagttttggtt

SEQ ID NO: 35950 - DNA, 609 bp, Artificial Sequence
  chemically treated genomic DNA (Homo sapiens) CpG-island No: 35950
aaccaaaactcaccaacaaattaatactacgattatctccctccgccatcgtctcgaaaatacaatctctacaaacgcaaaccacctccccaacgaatcctccaaccgaaacccgcacaccaaccacaacccgaaaaaacgccccgcaaactacttatataaatcgaccgcccttcccgacgacccccgcgacgctcgctcctcattaaacaaaccgaacttacgcctcaaaaaaaccgaaccaaccgaaactcaacgcataacttaaaatcgaaatcaaaaaaaacaaaaacaacgccgaaccgaaaaaaaaaaaacacgaaatacccaatcaacgcccaaaaactacgcgacgccccgcccaacgctataaaaaacgattcaaccgcctctacaaaaaacgctatccctcaataattctccgactcttaccgctacgataactttaaatccctcttcgtctaactttcgcaaccgaaaaaactctctaaaaaataaactactcgaaaaaaaatactccgttacctcaaacgaaaaacgaaaacgccgaacctacgacacttcatcttttcctaaccccgaaataactaaaatccgttccaccttcga

SEQ ID NO: 35951 - DNA, 609 bp, Artificial Sequence
  chemically treated genomic DNA (Homo sapiens) CpG-island No: 35951
agttaggatttattagtaggttggtgttgcgattattttttttcgttatcgtttcggggatgtagtttttataagcgtaggttatttttttaacgagttttttaatcgaaattcgtatattaattataattcgagggaacgtttcgtaggttgtttatatgggtcggtcgtttttttcgacggttttcgcgacgttcgttttttattggatagatcgagtttacgttttaaggaagtcgggttaatcgaagtttagcgtatggtttgaaatcgaggttaaaggagatagaggtagcgtcgggtcgagggggaggggatacggagtgtttaattagcgtttagggattgcgcgacgtttcgtttagcgttgtgggaagcggtttaatcgtttttgtagggggcgttgttttttagtggtttttcggtttttgtcgttgcggtggttttgggttttttttcgtttggttttcgtagtcgaggagattttttggaaaatgggttattcgaagagagatgtttcgttgttttaggcggagggcggggacgtcgggtttgcgatattttatttttttttggtttcgaggtggttgggattcgttttattttcgg

SEQ ID NO: 35952 - DNA, 609 bp, Artificial Sequence
  chemically treated genomic DNA (Homo sapiens) CpG-island No: 35952
ccgaaaataaaacgaatcccaaccacctcgaaaccaaaaaaaaataaaatatcgcaaacccgacgtccccgccctccgcctaaaacaacgaaacatctctcttcgaataacccattttccaaaaaatctcctcgactacgaaaaccaaacgaaaaaaaacccaaaaccaccgcaacgacaaaaaccgaaaaaccactaaaaaacaacgccccctacaaaaacgattaaaccgcttcccacaacgctaaacgaaacgtcgcgcaatccctaaacgctaattaaacactccgtatcccctccccctcgacccgacgctacctctatctcctttaacctcgatttcaaaccatacgctaaacttcgattaacccgacttccttaaaacgtaaactcgatctatccaataaaaaacgaacgtcgcgaaaaccgtcgaaaaaaacgaccgacccatataaacaacctacgaaacgttccctcgaattataattaatatacgaatttcgattaaaaaactcgttaaaaaaataacctacgcttataaaaactacatccccgaaacgataacgaaaaaaaataatcgcaacaccaacctactaataaatcctaact

SEQ ID NO: 35953 - DNA, 702 bp, Artificial Sequence
  chemically treated genomic DNA (Homo sapiens) CpG-island No: 35953
cgtttattcgtgtttttttaaggagttttttgtttttgtagggatttcgacggatttaagtcgatgagggaaggtggtgcgcgtattagtagtcgggcggcggtatcgggaagggagagcgaggcgcgtagattttcgcgtcgagtgttttgggttggcgggtatttcgcggcgttcgggtagcgttagcgtttagatcggtcgagcgtaattttagtttggatcgtagttttcgttaaaatattttttttggcgttttgagatcgaatttgagaatttattaattagcggcggtcggcggggcggtttcggttaatcgtgcggcggtacggttcgggtttatcgtttttcggagttttggcgtttcgagtcgcgcgttttgtttttattcgtttaattgttgtcgtttcggttttttttttttttcgggtatttggaaatttcgggttcgggagttaatttttgttggggacgcgggtttcggcggtcgcgggaagttaaggtgggggcggcgcggggcggcgcggggcggcgggagaaggaagaggaggaggagggtttttttgttatgtatagaagattcgcgtacgttttcgcggtttgtcgcgttcggggatttcgggtatagttagaggataggaaagtagatggggtttggaagaacgatttatattttttggatgttgttgtcgttattttcgt

SEQ ID NO: 35954 - DNA, 702 bp, Artificial Sequence
  chemically treated genomic DNA (Homo sapiens) CpG-island No: 35954
acgaaaataacgacaacaacatccaaaaaatataaatcgttcttccaaaccccatctactttcctatcctctaactatacccgaaatccccgaacgcgacaaaccgcgaaaacgtacgcgaatcttctatacataacaaaaaaaccctcctcctcctcttccttctcccgccgccccgcgccgccccgcgccgcccccaccttaacttcccgcgaccgccgaaacccgcgtccccaacaaaaattaactcccgaacccgaaatttccaaatacccgaaaaaaaaaaaaaaccgaaacgacaacaattaaacgaataaaaacaaaacgcgcgactcgaaacgccaaaactccgaaaaacgataaacccgaaccgtaccgccgcacgattaaccgaaaccgccccgccgaccgccgctaattaataaattctcaaattcgatctcaaaacgccaaaaaaaatattttaacgaaaactacgatccaaactaaaattacgctcgaccgatctaaacgctaacgctacccgaacgccgcgaaatacccgccaacccaaaacactcgacgcgaaaatctacgcgcctcgctctcccttcccgataccgccgcccgactactaatacgcgcaccaccttccctcatcgacttaaatccgtcgaaatccctacaaaaacaaaaaactccttaaaaaaacacgaataaacg

SEQ ID NO: 35955 - DNA, 702 bp, Artificial Sequence
  chemically treated genomic DNA (Homo sapiens) CpG-island No: 35955
gcggggatggcggtagtagtatttagagggtgtagatcgtttttttaaattttatttgtttttttgttttttggttgtgttcggggttttcgggcgcggtaagtcgcggggacgtgcgcgggttttttatgtataataaaagagttttttttttttttttttttttttcgtcgtttcgcgtcgtttcgcgtcgtttttattttggtttttcgcggtcgtcggggttcgcgtttttagtaggaattggttttcgggttcgaggtttttaggtattcggaagggggagggggtcgaggcggtaataattgggcgggtgagggtaaaacgcgcggttcggagcgttaagatttcgaggggcggtgagttcgggtcgtgtcgtcgtacgattggtcggggtcgtttcgtcggtcgtcgttgattggtggatttttaaattcggttttaaggcgttagaggaggtgttttagcggggattacgatttaggttggagttgcgttcggtcggtttgagcgttggcgttgttcggacgtcgcggggtattcgttagtttagggtattcggcgcggggatttgcgcgtttcgtttttttttttcgatgtcgtcgttcggttgttgatacgcgtattatttttttttatcggtttgggttcgtcgaggtttttgtagaggtaggaagttttttaggaaagtacgggtaaacg

SEQ ID NO: 35956 - DNA, 702 bp, Artificial Sequence
  chemically treated genomic DNA (Homo sapiens) CpG-island No: 35956
cgtttacccgtactttcctaaaaaacttcctacctctacaaaaacctcgacgaacccaaaccgataaaaaaaaataatacgcgtatcaacaaccgaacgacgacatcgaaaaaaaaaaacgaaacgcgcaaatccccgcgccgaataccctaaactaacgaataccccgcgacgtccgaacaacgccaacgctcaaaccgaccgaacgcaactccaacctaaatcgtaatccccgctaaaacacctcctctaacgccttaaaaccgaatttaaaaatccaccaatcaacgacgaccgacgaaacgaccccgaccaatcgtacgacgacacgacccgaactcaccgcccctcgaaatcttaacgctccgaaccgcgcgttttaccctcacccgcccaattattaccgcctcgaccccctcccccttccgaatacctaaaaacctcgaacccgaaaaccaattcctactaaaaacgcgaaccccgacgaccgcgaaaaaccaaaataaaaacgacgcgaaacgacgcgaaacgacgaaaaaaaaaaaaaaaaaaaaaaaactcttttattatacataaaaaacccgcgcacgtccccgcgacttaccgcgcccgaaaaccccgaacacaaccaaaaaacaaaaaaacaaataaaatttaaaaaaacgatctacaccctctaaatactactaccgccatccccgc

SEQ ID NO: 35957 - DNA, 647 bp, Artificial Sequence
  chemically treated genomic DNA (Homo sapiens) CpG-island No: 35957
  misc_feature (233)..(233): n is either a, c, g or t
  misc_feature (367)..(367): n is either a, c, g or t
  misc_feature (396)..(396): n is either a, c, g or t
  misc_feature (611)..(612): n is either a, c, g or t
  misc_feature (636)..(636): n is either a, c, g or t
  misc_feature (640)..(640): n is either a, c, g or t
tatcgcgtcgtcggtatggatttggtaggtgcgaggtcgaggttagggtttagcgaaggacgtcgagtttatagagcgcgcgcgttttagaggaggtagtagtagtcgtagtttggttcgttcgaattttgcgagtttggcgggggagatagaggcgggcgatttgttcgttagcgttgaggaacgattttttttatgttagttcgttgttcgttttttcgtagcgtagagtnttttttaaagaatttgcggttttttataatcgttttaaataataaatttttgttttcgttttcgtaggaattggggtagttgggggttcgcgttatagatttaagttcgttagtagaagggtaggtcggaagtntgcgttcgaatttcgttttagttggggantaggtcgttatcggtaggagggagtcggcgcgagagatttgacgggaggaggtggagagcgggaggcgggaatgagggcgcgggatcgggcgggcggagcgtgcgagatttgcgtagcgagtttagtagggcggagggcggggcgtggcgcgttcggttttcgtttcgcgcgttgtaattttgtcgagtttttttgaaaatttttgtcgttaaannagggggaatttttttaggaacgtncganatttcgt

SEQ ID NO: 35958 - DNA, 647 bp, Artificial Sequence
  chemically treated genomic DNA (Homo sapiens) CpG-island No: 35958
  misc_feature (8)..(8): n is either a, c, g or t
  misc_feature (12)..(12): n is either a, c, g or t
  misc_feature (36)..(37): n is either a, c, g or t
  misc_feature (252)..(252): n is either a, c, g or t
  misc_feature (281)..(281): n is either a, c, g or t
  misc_feature (415)..(415): n is either a, c, g or t
acgaaatntcgnacgttcctaaaaaaattccccctnntttaacgacaaaaattttcaaaaaaactcgacaaaattacaacgcgcgaaacgaaaaccgaacgcgccacgccccgccctccgccctactaaactcgctacgcaaatctcgcacgctccgcccgcccgatcccgcgccctcattcccgcctcccgctctccacctcctcccgtcaaatctctcgcgccgactccctcctaccgataacgacctantccccaactaaaacgaaattcgaacgcanacttccgacctacccttctactaacgaacttaaatctataacgcgaacccccaactaccccaattcctacgaaaacgaaaacaaaaatttattatttaaaacgattataaaaaaccgcaaattctttaaaaaanactctacgctacgaaaaaacgaacaacgaactaacataaaaaaaatcgttcctcaacgctaacgaacaaatcgcccgcctctatctcccccgccaaactcgcaaaattcgaacgaaccaaactacgactactactacctcctctaaaacgcgcgcgctctataaactcgacgtccttcgctaaaccctaacctcgacctcgcacctaccaaatccataccgacgacgcgata

SEQ ID NO: 35959 - DNA, 647 bp, Artificial Sequence
  chemically treated genomic DNA (Homo sapiens) CpG-island No: 35959
  misc_feature (8)..(8): n is either a, c, g or t
  misc_feature (12)..(12): n is either a, c, g or t
  misc_feature (36)..(37): n is either a, c, g or t
  misc_feature (252)..(252): n is either a, c, g or t
  misc_feature (281)..(281): n is either a, c, g or t
  misc_feature (415)..(415): n is either a, c, g or t
gcgaggtntcgnacgtttttagagagattttttttnntttaacggtagagatttttaaggaggttcggtagagttgtagcgcgcggggcgaaggtcgggcgcgttacgtttcgtttttcgttttgttgggttcgttgcgtagatttcgtacgtttcgttcgttcggtttcgcgtttttattttcgtttttcgttttttattttttttcgttaagtttttcgcgtcggtttttttttgtcggtagcggtttgntttttagttggagcggggttcggacgtangttttcggtttgtttttttgttggcgggtttgagtttgtgacgcgaatttttagttgttttaatttttacgggggcgaggataggggtttgttatttaagacggttgtggagggtcgtaggttttttggagggngttttacgttgcgggaaggcggatagcgagttggtataaagggagtcgttttttagcgttagcgggtaggtcgttcgtttttgtttttttcgttaggttcgtaaagttcgggcgggttaggttgcggttgttgttgttttttttagggcgcgcgcgttttgtaaattcggcgtttttcgttgagttttggtttcggtttcgtatttgttagatttatgtcgacggcgcggtg

SEQ ID NO: 35960 - DNA, 647 bp, Artificial Sequence
  chemically treated genomic DNA (Homo sapiens) CpG-island No: 35960
  misc_feature (233)..(233): n is either a, c, g or t
  misc_feature (367)..(367): n is either a, c, g or t
  misc_feature (396)..(396): n is either a, c, g or t
  misc_feature (611)..(612): n is either a, c, g or t
  misc_feature (636)..(636): n is either a, c, g or t
  misc_feature (640)..(640): n is either a, c, g or t
caccgcgccgtcgacataaatctaacaaatacgaaaccgaaaccaaaactcaacgaaaaacgccgaatttacaaaacgcgcgcgccctaaaaaaaacaacaacaaccgcaacctaacccgcccgaactttacgaacctaacgaaaaaaacaaaaacgaacgacctacccgctaacgctaaaaaacgactccctttataccaactcgctatccgccttcccgcaacgtaaaacnccctccaaaaaacctacgaccctccacaaccgtcttaaataacaaacccctatcctcgcccccgtaaaaattaaaacaactaaaaattcgcgtcacaaactcaaacccgccaacaaaaaaacaaaccgaaaacntacgtccgaaccccgctccaactaaaaancaaaccgctaccgacaaaaaaaaaccgacgcgaaaaacttaacgaaaaaaaataaaaaacgaaaaacgaaaataaaaacgcgaaaccgaacgaacgaaacgtacgaaatctacgcaacgaacccaacaaaacgaaaaacgaaacgtaacgcgcccgaccttcgccccgcgcgctacaactctaccgaacctccttaaaaatctctaccgttaaannaaaaaaaatctctctaaaaacgtncganacctcgc

SEQ ID NO: 35961 - DNA, 685 bp, Artificial Sequence
  chemically treated genomic DNA (Homo sapiens) CpG-island No: 35961
tgatttcgtcggttgggtgaggtagtattcggtgacggcggttatgattgtgttttgggcgtaggaacgagtttttcgcgttgtttcgaaggtttttgatttttcgcgttttgcgttgtttcgcgtcgtcgggtggatttatatacgttaggagtaaattgcgtaggattcggtcgttatttttttgcgtttttttatcgcggagattttgcgtttttagtttagcgttttttattttatttgggtagcgttgcgtttgcggttcgtcggtttcgggttcgttcgtcgcggattttggtttaggtttcggtttcggttggggtttcggatttagttttggttttggtattgtacggtttttcggtttttgttggttcgttatattttagcgcgcgaggtcggggttttttcggttcggttcgtttttttcgtcgtcgtcgttcgtcgttcgcggggaaggcggggatattggtcgggaggcgggaagggtggggggaggggaagttagtgttcgtcgggatttgcggggagaggggcggcgcgtagtttcgtcggttaggggttttggtttttttcggggcgtaggttggggttcgcgcggttggcggtcgggtttcgaggtcggggagcgcgttttgggattttcgtggaggggttttgtcgtatgcggacgaagttagagcgg

SEQ ID NO: 35962 - DNA, 685 bp, Artificial Sequence
  chemically treated genomic DNA (Homo sapiens) CpG-island No: 35962
ccgctctaacttcgtccgcatacgacaaaacccctccacgaaaatcccaaaacgcgctccccgacctcgaaacccgaccgccaaccgcgcgaaccccaacctacgccccgaaaaaaaccaaaacccctaaccgacgaaactacgcgccgcccctctccccgcaaatcccgacgaacactaacttcccctccccccacccttcccgcctcccgaccaatatccccgccttccccgcgaacgacgaacgacgacgacgaaaaaaacgaaccgaaccgaaaaaaccccgacctcgcgcgctaaaatataacgaaccaacaaaaaccgaaaaaccgtacaataccaaaaccaaaactaaatccgaaaccccaaccgaaaccgaaacctaaaccaaaatccgcgacgaacgaacccgaaaccgacgaaccgcaaacgcaacgctacccaaataaaataaaaaacgctaaactaaaaacgcaaaatctccgcgataaaaaaacgcaaaaaaataacgaccgaatcctacgcaatttactcctaacgtatataaatccacccgacgacgcgaaacaacgcaaaacgcgaaaaatcaaaaaccttcgaaacaacgcgaaaaactcgttcctacgcccaaaacacaatcataaccgccgtcaccgaatactacctcacccaaccgacgaaatca

SEQ ID NO: 35963 - DNA, 685 bp, Artificial Sequence
  chemically treated genomic DNA (Homo sapiens) CpG-island No: 35963
tcgttttggtttcgttcgtatgcggtagggtttttttacggaggttttagggcgcgtttttcggtttcgaggttcggtcgttagtcgcgcggattttagtttacgtttcgagggaggttaggatttttagtcggcgggattgcgcgtcgttttttttttcgtaggtttcggcgaatattagttttttttttttttatttttttcgtttttcggttagtgttttcgtttttttcgcgggcgacgggcggcggcggcgggaggagcgggtcgagtcgaggaagtttcggtttcgcgcgttgggatgtagcgaattagtaggggtcgaagaatcgtgtagtgttagagttagagttggattcggggttttagtcggagtcgaaatttgagttagagttcgcggcgggcgagttcggagtcgacgagtcgtagacgtagcgttgtttaggtggggtaagagacgttgggttaggggcgtagggttttcgcggtggaggggcgtagggaggtggcggtcgagttttgcgtagtttgtttttggcgtgtgtgggtttattcggcggcgcgggatagcgtaaggcgcggaaggttaggagttttcgaggtagcgcgaggagttcgtttttgcgtttagggtatagttatagtcgtcgttatcgggtgttattttatttaatcggcgggatta

SEQ ID NO: 35964 - DNA, 685 bp, Artificial Sequence
  chemically treated genomic DNA (Homo sapiens) CpG-island No: 35964
taatcccgccgattaaataaaataacacccgataacgacgactataactataccctaaacgcaaaaacgaactcctcgcgctacctcgaaaactcctaaccttccgcgccttacgctatcccgcgccgccgaataaacccacacacgccaaaaacaaactacgcaaaactcgaccgccacctccctacgcccctccaccgcgaaaaccctacgcccctaacccaacgtctcttaccccacctaaacaacgctacgtctacgactcgtcgactccgaactcgcccgccgcgaactctaactcaaatttcgactccgactaaaaccccgaatccaactctaactctaacactacacgattcttcgacccctactaattcgctacatcccaacgcgcgaaaccgaaacttcctcgactcgacccgctcctcccgccgccgccgcccgtcgcccgcgaaaaaaacgaaaacactaaccgaaaaacgaaaaaaataaaaaaaaaaaaaactaatattcgccgaaacctacgaaaaaaaaaacgacgcgcaatcccgccgactaaaaatcctaacctccctcgaaacgtaaactaaaatccgcgcgactaacgaccgaacctcgaaaccgaaaaacgcgccctaaaacctccgtaaaaaaaccctaccgcatacgaacgaaaccaaaacga

SEQ ID NO: 35965 - DNA, 590 bp, Artificial Sequence
  chemically treated genomic DNA (Homo sapiens) CpG-island No: 35965
gagcggttttataattttttttcgttttttttcgacggttcgcgaaggtaagcgttatcgggaagggatgggtaggatagaggagatcggtcgggtttagtattcggaattcgtttttacgagtttttacgtagttcgttcgcgtggagattgatatttttgcgtggtcggtgttaagcgtttcggattttgtatataatttcgcgcgtattttaaatacgttttgtagtttttggagttttagtttttgtgcgtagtaatcgagcgttcgtttcgtgttggttttttttttcgagtttttagttttaggggacgcggattaattatatcgttcgtcggttcggttggcgttttttaggttttacggtttttcgtttgtttttttttttatttgttgtcgtcgcggtcgtttttatttttatttgtttttgattcgggttcgtttcggttcgggtttttcgtagattcgttttcggttcgttttagttcgtttacgggcgttaggtttttcgtagattcgttttagatttttagtaaatacgtttttttttttatttcgtttagattgtcgtttaggaaagggttgtgtt

SEQ ID NO: 35966 - DNA, 590 bp, Artificial Sequence
  chemically treated genomic DNA (Homo sapiens) CpG-island No: 35966
aacacaaccctttcctaaacgacaatctaaacgaaataaaaaaaaaaacgtatttactaaaaatctaaaacgaatctacgaaaaacctaacgcccgtaaacgaactaaaacgaaccgaaaacgaatctacgaaaaacccgaaccgaaacgaacccgaatcaaaaacaaataaaaataaaaacgaccgcgacgacaacaaataaaaaaaaaaacaaacgaaaaaccgtaaaacctaaaaaacgccaaccgaaccgacgaacgatataattaatccgcgtcccctaaaactaaaaactcgaaaaaaaaaaccaacacgaaacgaacgctcgattactacgcacaaaaactaaaactccaaaaactacaaaacgtatttaaaatacgcgcgaaattatatacaaaatccgaaacgcttaacaccgaccacgcaaaaatatcaatctccacgcgaacgaactacgtaaaaactcgtaaaaacgaattccgaatactaaacccgaccgatctcctctatcctacccatcccttcccgataacgcttaccttcgcgaaccgtcgaaaaaaaacgaaaaaaaattataaaaccgctc

SEQ ID NO: 35967 - DNA, 590 bp, Artificial Sequence
  chemically treated genomic DNA (Homo sapiens) CpG-island No: 35967
agtataatttttttttgagcggtagtttgggcggggtgaaagggggggcgtgtttattgggggtttggggcgggtttgcggggagtttagcgttcgtgggcgggttggggcgggtcgggggcgggtttgcgggaagttcgagtcggggcgggttcgagttaaaggtaagtgaaggtggaagcggtcgcggcggtagtaggtagggggaggggtaggcgaggggtcgtagggtttggaaggcgttagtcgggtcggcgggcggtgtgattgattcgcgttttttggagttggaggttcgggggaaagggttagtacggagcgggcgttcggttgttgcgtataaaggttgaggttttaagagttgtagggcgtgtttggggtgcgcgcgaggttgtgtgtaaggttcggggcgtttggtatcggttacgtaagggtgttagtttttacgcggacgggttgcgtagggattcgtagggacgggtttcgggtgttgggttcggtcggttttttttgttttatttattttttttcgatggcgtttgttttcgcgggtcgtcgggggagaacgggagaagattgtgggatcgttt

SEQ ID NO: 35968 - DNA, 590 bp, Artificial Sequence
  chemically treated genomic DNA (Homo sapiens) CpG-island No: 35968
aaacgatcccacaatcttctcccgttctcccccgacgacccgcgaaaacaaacgccatcgaaaaaaaataaataaaacaaaaaaaaccgaccgaacccaacacccgaaacccgtccctacgaatccctacgcaacccgtccgcgtaaaaactaacacccttacgtaaccgataccaaacgccccgaaccttacacacaacctcgcgcgcaccccaaacacgccctacaactcttaaaacctcaacctttatacgcaacaaccgaacgcccgctccgtactaaccctttcccccgaacctccaactccaaaaaacgcgaatcaatcacaccgcccgccgacccgactaacgccttccaaaccctacgacccctcgcctacccctccccctacctactaccgccgcgaccgcttccaccttcacttacctttaactcgaacccgccccgactcgaacttcccgcaaacccgcccccgacccgccccaacccgcccacgaacgctaaactccccgcaaacccgccccaaacccccaataaacacgccccccctttcaccccgcccaaactaccgctcaaaaaaaaattatact

SEQ ID NO: 35969 - DNA, 561 bp, Artificial Sequence
  chemically treated genomic DNA (Homo sapiens) CpG-island No: 35969
tcgcggggagcgaggtcgtggcgggaaaagaggggtattttcggttgggcgggttttcgagggttagggtcgaggttattcgttggagggcggggcggagaagaaagaaggttgtcggtgaacgggacggataggttggggacgttcggggaacggtagagatttcggcgcgggagatagagtttcggtaaggggtttcgcgcggaggcgggggcgggcgttgaagggcggggcggggaggggcggtcgtttcggttttttttggcggggtttcgcggtttggaagtcggagcgggtcgagtcgttatcgcggtcggagttgttttttagttagattcggcgagatacgagcggcgggagggaggcggtggcgcgttcggtttcgttcgttcgattaagcgtcggacgcggttcggcgtcgagttatggtgagtttagcgtcgtagttttttgggttttttcggttttcgcgtagttcgtttcgggtttttaagtttttagtttggtgtttttcgagtttgtttcggattgttcggtttttttgggatttttttttttttt

SEQ ID NO: 35970 - DNA, 561 bp, Artificial Sequence
  chemically treated genomic DNA (Homo sapiens) CpG-island No: 35970
aaaaaaaaaaaaaatcccaaaaaaaccgaacaatccgaaacaaactcgaaaaacaccaaactaaaaacttaaaaacccgaaacgaactacgcgaaaaccgaaaaaacccaaaaaactacgacgctaaactcaccataactcgacgccgaaccgcgtccgacgcttaatcgaacgaacgaaaccgaacgcgccaccgcctccctcccgccgctcgtatctcgccgaatctaactaaaaaacaactccgaccgcgataacgactcgacccgctccgacttccaaaccgcgaaaccccgccaaaaaaaaccgaaacgaccgcccctccccgccccgcccttcaacgcccgcccccgcctccgcgcgaaaccccttaccgaaactctatctcccgcgccgaaatctctaccgttccccgaacgtccccaacctatccgtcccgttcaccgacaaccttctttcttctccgccccgccctccaacgaataacctcgaccctaaccctcgaaaacccgcccaaccgaaaatacccctcttttcccgccacgacctcgctccccgcga

SEQ ID NO: 35971 - DNA, 561 bp, Artificial Sequence
  chemically treated genomic DNA (Homo sapiens) CpG-island No: 35971
gggagggaggagagttttagaggggtcgaatagttcgaggtaggttcgggaggtattaggttgaggatttgggggttcggagcgggttgcgcgaaggtcgaggggatttagggggttgcgacgttggatttattatggttcggcgtcgggtcgcgttcgacgtttggtcgggcgggcggggtcgggcgcgttatcgtttttttttcgtcgttcgtgtttcgtcgggtttggttaagggatagtttcggtcgcggtggcggttcggttcgtttcggtttttaggtcgcggggtttcgttagggagggtcgagacggtcgttttttttcgtttcgttttttagcgttcgttttcgttttcgcgcgggattttttgtcgggattttgtttttcgcgtcgagatttttgtcgtttttcgggcgtttttagtttattcgtttcgtttatcggtaattttttttttttttcgtttcgttttttagcgggtaatttcgattttgattttcggaggttcgtttagtcgaggatgttttttttttttcgttacggtttcgtttttcgcgg

SEQ ID NO: 35972 - DNA, 561 bp, Artificial Sequence
  chemically treated genomic DNA (Homo sapiens) CpG-island No: 35972
ccgcgaaaaacgaaaccgtaacgaaaaaaaaaaaacatcctcgactaaacgaacctccgaaaatcaaaatcgaaattacccgctaaaaaacgaaacgaaaaaaaaaaaaaattaccgataaacgaaacgaataaactaaaaacgcccgaaaaacgacaaaaatctcgacgcgaaaaacaaaatcccgacaaaaaatcccgcgcgaaaacgaaaacgaacgctaaaaaacgaaacgaaaaaaaacgaccgtctcgaccctccctaacgaaaccccgcgacctaaaaaccgaaacgaaccgaaccgccaccgcgaccgaaactatcccttaaccaaacccgacgaaacacgaacgacgaaaaaaaaacgataacgcgcccgaccccgcccgcccgaccaaacgtcgaacgcgacccgacgccgaaccataataaatccaacgtcgcaaccccctaaatcccctcgaccttcgcgcaacccgctccgaacccccaaatcctcaacctaatacctcccgaacctacctcgaactattcgacccctctaaaactctcctccctccc

SEQ ID NO: 35973 - DNA, 650 bp, Artificial Sequence
  chemically treated genomic DNA (Homo sapiens) CpG-island No: 35973
  misc_feature (146)..(146): n is either a, c, g or t
  misc_feature (211)..(211): n is either a, c, g or t
  misc_feature (331)..(331): n is either a, c, g or t
  misc_feature (336)..(336): n is either a, c, g or t
  misc_feature (343)..(343): n is either a, c, g or t
cgggggatacgataacgggacggggagggaggagaaggtattagacggtcggacggaatttacgttgatatcggggaggtaattcgtataaaaagcggaaagagggggggcgtatacggtacggagaagaaaaggcggggcggatncgtcgggcgggggggggagggcggggggggcgcgggcgtcgggggtcgggggggcgggtcgcgtncggcggcgcggggggtcgcgtcggcggggcgtttcgggcgttcgcgtcgcggttcgggtcgttcgcgggtcggtcgggggggcgggcggggtcgggcgttcgttcgcggttttttcgttntcggntcggttntcgtttttttttcggtttttcgttttcggttttggttcgtattgtgtgcggcgggaggcggttcggttattagtatgcggggggcggcgcggcggggttgggagtcgcgcgggagtcgggttttggtttcggggatagggagttggggatttcgggagtcgcgagaggcggtcgttaggggcggggtgcgggcggtttggagacggggggcgttgtcggagggagggaggaagggagggagcgggggtggggcgtatagaggattttaataggagattggaagagattttgaaaggttatttcgttt

SEQ ID NO: 35974 - DNA, 650 bp, Artificial Sequence
  chemically treated genomic DNA (Homo sapiens) CpG-island No: 35974
  misc_feature (308)..(308): n is either a, c, g or t
  misc_feature (315)..(315): n is either a, c, g or t
  misc_feature (320)..(320): n is either a, c, g or t
  misc_feature (440)..(440): n is either a, c, g or t
  misc_feature (505)..(505): n is either a, c, g or t
aaacgaaataacctttcaaaatctcttccaatctcctattaaaatcctctatacgccccacccccgctccctcccttcctccctccctccgacaacgccccccgtctccaaaccgcccgcaccccgcccctaacgaccgcctctcgcgactcccgaaatccccaactccctatccccgaaaccaaaacccgactcccgcgcgactcccaaccccgccgcgccgccccccgcatactaataaccgaaccgcctcccgccgcacacaatacgaaccaaaaccgaaaacgaaaaaccgaaaaaaaaacganaaccganccganaacgaaaaaaccgcgaacgaacgcccgaccccgcccgcccccccgaccgacccgcgaacgacccgaaccgcgacgcgaacgcccgaaacgccccgccgacgcgaccccccgcgccgccgnacgcgacccgcccccccgacccccgacgcccgcgccccccccgccctcccccccccgcccgacgnatccgccccgccttttcttctccgtaccgtatacgccccccctctttccgctttttatacgaattacctccccgatatcaacgtaaattccgtccgaccgtctaataccttctcctccctccccgtcccgttatcgtatcccccg

SEQ ID NO: 35975 - DNA, 650 bp, Artificial Sequence
  chemically treated genomic DNA (Homo sapiens) CpG-island No: 35975
  misc_feature (308)..(308): n is either a, c, g or t
  misc_feature (315)..(315): n is either a, c, g or t
  misc_feature (320)..(320): n is either a, c, g or t
  misc_feature (440)..(440): n is either a, c, g or t
  misc_feature (505)..(505): n is either a, c, g or t
ggacgagatgattttttaaaattttttttagttttttgttggaattttttgtgcgttttattttcgtttttttttttttttttttttttcgatagcgtttttcgtttttaaatcgttcgtatttcgtttttggcggtcgtttttcgcggttttcggggtttttagttttttgttttcggagttagagttcggttttcgcgcggtttttagtttcgtcgcgtcgtttttcgtatgttaatggtcgggtcgtttttcgtcgtatataatgcgggttagggtcgggggcgggggatcggggagggggcggnggtcggntcggnggcgggggggtcgcgggcgggcgttcggtttcgttcgttttttcggtcggttcgcgggcggttcgggtcgcggcgcgggcgttcggggcgtttcgtcggcgcggtttttcgcgtcgtcgngcgcggttcgttttttcggttttcggcgttcgcgtttttttcgttttttttttttcgttcggcgngttcgtttcgttttttttttttcgtgtcgtgtgcgtttttttttttttcgttttttgtacgagttgttttttcggtgttaacgtgggtttcgttcgatcgtttaatattttttttttttttttcgtttcgttgtcgtatttttcg

SEQ ID NO: 35976 - DNA, 650 bp, Artificial Sequence
  chemically treated genomic DNA (Homo sapiens) CpG-island No: 35976
  misc_feature (146)..(146): n is either a, c, g or t
  misc_feature (211)..(211): n is either a, c, g or t
  misc_feature (331)..(331): n is either a, c, g or t
  misc_feature (336)..(336): n is either a, c, g or t
  misc_feature (343)..(343): n is either a, c, g or t
cgaaaaatacgacaacgaaacgaaaaaaaaaaaaaaaatattaaacgatcgaacgaaacccacgttaacaccgaaaaaacaactcgtacaaaaaacgaaaaaaaaaaaaacgcacacgacacgaaaaaaaaaaaacgaaacgaacncgccgaacgaaaaaaaaaaaacgaaaaaaacgcgaacgccgaaaaccgaaaaaacgaaccgcgcncgacgacgcgaaaaaccgcgccgacgaaacgccccgaacgcccgcgccgcgacccgaaccgcccgcgaaccgaccgaaaaaacgaacgaaaccgaacgcccgcccgcgacccccccgccnccganccgaccnccgccccctccccgatcccccgcccccgaccctaacccgcattatatacgacgaaaaacgacccgaccattaacatacgaaaaacgacgcgacgaaactaaaaaccgcgcgaaaaccgaactctaactccgaaaacaaaaaactaaaaaccccgaaaaccgcgaaaaacgaccgccaaaaacgaaatacgaacgatttaaaaacgaaaaacgctatcgaaaaaaaaaaaaaaaaaaaaaaacgaaaataaaacgcacaaaaaattccaacaaaaaactaaaaaaaattttaaaaaatcatctcgtcc

SEQ ID NO: 35977 - DNA, 563 bp, Artificial Sequence
  chemically treated genomic DNA (Homo sapiens) CpG-island No: 35977
cgttttttgaggtggtgtcgcgtgattagtttttggtttattatagtttcgattattcggtgttttagacgtcgttttcgatttaatattcgtcggcgtttgaatagttttttttttagtttttgtcggggagaaagatgcgaattagatggagtgggttcgtcgcgattcggggtttttttattaggtagtttcggttttttattgattttatttcgtgcgagataaaagggtttaggaacgtttgaggaaataaagtcgcggtttttatatagttatcgttcggggtcggttgattttttttttcggagtttttatagtcgcgattttattttagtttacggttcgtattttcgtttagcgtcggattcgcggggtttcgtttcggtttttcgcgggttaatcgtaattcgggggcgggttttcgggttatataaaggagtttcgcggtgcgggaggtttttcggagggtggtgagttagtaagtgtggttttagttgtagtagttagattgggcggtcgggagtggtgggggtgtcgggtggaaggttttgggcggggtt

SEQ ID NO: 35978 - DNA, 563 bp, Artificial Sequence
  chemically treated genomic DNA (Homo sapiens) CpG-island No: 35978
aaccccgcccaaaaccttccacccgacacccccaccactcccgaccgcccaatctaactactacaactaaaaccacacttactaactcaccaccctccgaaaaacctcccgcaccgcgaaactcctttatataacccgaaaacccgcccccgaattacgattaacccgcgaaaaaccgaaacgaaaccccgcgaatccgacgctaaacgaaaatacgaaccgtaaactaaaataaaatcgcgactataaaaactccgaaaaaaaaaatcaaccgaccccgaacgataactatataaaaaccgcgactttatttcctcaaacgttcctaaacccttttatctcgcacgaaataaaatcaataaaaaaccgaaactacctaataaaaaaaccccgaatcgcgacgaacccactccatctaattcgcatctttctccccgacaaaaactaaaaaaaaaactattcaaacgccgacgaatattaaatcgaaaacgacgtctaaaacaccgaataatcgaaactataataaaccaaaaactaatcacgcgacaccacctcaaaaaacg

SEQ ID NO: 35979 - DNA, 563 bp, Artificial Sequence
  chemically treated genomic DNA (Homo sapiens) CpG-island No: 35979
gatttcgtttagagttttttattcggtatttttattattttcggtcgtttaatttggttattatagttaaaattatatttattagtttattatttttcgaaaggtttttcgtatcgcggagtttttttatatagttcgaggattcgttttcgagttgcgattggttcgcggaaggtcggggcggagtttcgcggattcggcgttgagcggaagtacggatcgtgaattggagtggaatcgcgattatgggagtttcggggggaaagattaatcggtttcgaacggtgattgtgtgggggtcgcgattttgtttttttaagcgtttttgagtttttttatttcgtacgagatgggattagtgaggggtcggggttgtttggtggaggggtttcgggtcgcggcgagtttattttatttgattcgtattttttttttcggtaggagttgaagaagaagttgtttaaacgtcggcgggtgttgaatcgggagcggcgtttgaggtatcgggtggtcggggttgtgatagattaagggttgattacgcggtattattttaagaagcg

SEQ ID NO: 35980 - DNA, 563 bp, Artificial Sequence
  chemically treated genomic DNA (Homo sapiens) CpG-island No: 35980
cgcttcttaaaataataccgcgtaatcaacccttaatctatcacaaccccgaccacccgatacctcaaacgccgctcccgattcaacacccgccgacgtttaaacaacttcttcttcaactcctaccgaaaaaaaaaatacgaatcaaataaaataaactcgccgcgacccgaaacccctccaccaaacaaccccgacccctcactaatcccatctcgtacgaaataaaaaaactcaaaaacgcttaaaaaaacaaaatcgcgacccccacacaatcaccgttcgaaaccgattaatctttccccccgaaactcccataatcgcgattccactccaattcacgatccgtacttccgctcaacgccgaatccgcgaaactccgccccgaccttccgcgaaccaatcgcaactcgaaaacgaatcctcgaactatataaaaaaactccgcgatacgaaaaacctttcgaaaaataataaactaataaatataattttaactataataaccaaattaaacgaccgaaaataataaaaataccgaataaaaaactctaaacgaaatc

SEQ ID NO: 35981 - DNA, 633 bp, Artificial Sequence
  chemically treated genomic DNA (Homo sapiens) CpG-island No: 35981
gttttttttaaacgggggttttgtttataaggaggtcgtagtagttttcgagtgatttcggtgtaaatttgtagagaaaaattattttattttacggaagcgggtggaggagtcgcgtttttcggtaggttacgtggggcggaaagatttatttagttttttcgtattttcgtttcgatttaggaaaacgttttggggaattttagttttgaaaaggcgcgttttattttttacgtcgggtgttggcgataaggtttagtgaaaaagcgtttcggggtcgttcgcgcggaggggaaagtgttgagggaagttaaggaattcgcgtttgcggtcgtcggaaacgtggcggggatacgattttcgcgtcggggttattttgtttattgttgaggaggtttttcgttacgtttcgttttcgtttttttcgaggatcgggcgcggtggcgtttttggtttatagtaggaaggaaggggtagtaatttacgttattaattttgtttttttgagcggcgcgcgttcgtttatcggtttcgttgttgtcggagtcggtaacgtttttacgcgtatttttcggtttggttaacgcggtgatttttttatttttatcgtttggtcggtaattcggagtttaa

SEQ ID NO: 35982 - DNA, 633 bp, Artificial Sequence
  chemically treated genomic DNA (Homo sapiens) CpG-island No: 35982
ttaaactccgaattaccgaccaaacgataaaaataaaaaaatcaccgcgttaaccaaaccgaaaaatacgcgtaaaaacgttaccgactccgacaacaacgaaaccgataaacgaacgcgcgccgctcaaaaaaacaaaattaataacgtaaattactaccccttccttcctactataaaccaaaaacgccaccgcgcccgatcctcgaaaaaaacgaaaacgaaacgtaacgaaaaacctcctcaacaataaacaaaataaccccgacgcgaaaatcgtatccccgccacgtttccgacgaccgcaaacgcgaattccttaacttccctcaacactttcccctccgcgcgaacgaccccgaaacgctttttcactaaaccttatcgccaacacccgacgtaaaaaataaaacgcgccttttcaaaactaaaattccccaaaacgttttcctaaatcgaaacgaaaatacgaaaaaactaaataaatctttccgccccacgtaacctaccgaaaaacgcgactcctccacccgcttccgtaaaataaaataatttttctctacaaatttacaccgaaatcactcgaaaactactacgacctccttataaacaaaacccccgtttaaaaaaaac

SEQ ID NO: 35983 - DNA, 633 bp, Artificial Sequence
  chemically treated genomic DNA (Homo sapiens) CpG-island No: 35983
ttgaatttcgaattgtcgattaggcgatgagggtggggaggttatcgcgttaattaaatcggaaagtgcgcgtggaggcgttgtcggtttcggtaatagcggggtcggtaagcgggcgcgcgtcgtttagaggggtagagttggtggcgtgagttgttgtttttttttttttgttgtgggttagaggcgttatcgcgttcggttttcgaggaagacgggagcgggacgtggcgagaggtttttttagtagtgggtaaaatagtttcgacgcggaggtcgtgttttcgttacgttttcggcgatcgtaggcgcggattttttggttttttttagtattttttttttcgcgcggacggtttcgagacgtttttttattgggttttgtcgttagtattcggcgtggggggtgagacgcgtttttttagggttggggttttttagagcgtttttttaagtcgaggcggaggtgcgaggaaattgagtgggttttttcgttttacgtggtttgtcgggaagcgcggtttttttattcgttttcgtggaatggaatggtttttttttgtaggtttatatcggggttattcgagagttgttgcggtttttttatgggtaggattttcgtttggggagaat

SEQ ID NO: 35984 - DNA, 633 bp, Artificial Sequence
  chemically treated genomic DNA (Homo sapiens) CpG-island No: 35984
attctccccaaacgaaaatcctacccataaaaaaaccgcaacaactctcgaataaccccgatataaacctacaaaaaaaaaccattccattccacgaaaacgaataaaaaaaccgcgcttcccgacaaaccacgtaaaacgaaaaaacccactcaatttcctcgcacctccgcctcgacttaaaaaaacgctctaaaaaaccccaaccctaaaaaaacgcgtctcaccccccacgccgaatactaacgacaaaacccaataaaaaaacgtctcgaaaccgtccgcgcgaaaaaaaaaatactaaaaaaaaccaaaaaatccgcgcctacgatcgccgaaaacgtaacgaaaacacgacctccgcgtcgaaactattttacccactactaaaaaaacctctcgccacgtcccgctcccgtcttcctcgaaaaccgaacgcgataacgcctctaacccacaacaaaaaaaaaaaaacaacaactcacgccaccaactctacccctctaaacgacgcgcgcccgcttaccgaccccgctattaccgaaaccgacaacgcctccacgcgcactttccgatttaattaacgcgataacctccccaccctcatcgcctaatcgacaattcgaaattcaa

SEQ ID NO: 35985 - DNA, 1301 bp, Artificial Sequence
  chemically treated genomic DNA (Homo sapiens) CpG-island No: 35985
tcgttttttcgtattatttttttttttgttcgttttgttcgttttttttttagtttagtaggcgttttacgatcgggggagtgaaaggtaggatggacgatatggttggggagggcgcgcgggcgcgaggagcgtttcggcgggtttgggttcgacgggacgtcggggcgtagaaggggagttcggtcggggttgtcgcggtcgtttaaatttcgttttaattttcggcgaagttgtcggggcgatcggtcgggcgcgcgttgtagtttgcggggttcggcgcgcggttttgcgttcggagcggtttttacggcgaagagaagagcggtcgggcgggcggacggtagtagtgtagggtcgggaagcgtcgaacgcggggcggaggcggcggtcgcgagattttaagtggtagtagaagtttgggttttcgtacggggtagttgtttgggtgtcgttttcgggaaggaaagtttaattttcggttaaatttcgttcgtttcgttagttttgatgcgtagattttttcgtttttgcggttttatcgtttcgttattttttttttttcggttcgcgttcgttcgttcgttggttgggtcggttcggggcgtgcgtcgcgttttcgttttcgttcgtttttagtttgtgttttatgtaaattcgcgtgtagttttttttttaagtgttgttatcgttttttcgtcgtcggggtttttcgttttttttttcgcgtttcgttattttttttcggcgttttgttcgttttttgtttcggggagggcgttcggtcggttattatttcgcgtttagtagtttacgtgggcgattcgggcggcggtagttttggttggagcgcgcgggattttgcgcggttcgatttgaagtcgggcgggcgcggggaggaagttttgggaaatacggcgagaggggtttcgggcgggagggttgagcgcggttcgtggcgttcgttttcggagtttatattcgggcggttcggttggagttgcgggtcggagagggttggattcgtagtaagtaagcgtcgttcggacgcgagtgtattttggagaggattcgagttcgagagggggcgcgcggaaggttcggtttaggaagttggggttcgtatttggtttcgcgtttgttgattttcgttagagtttttgggtcgcgtcggcgtttttgggttgtttttattttttagtcggtgagattatatcggtcgagagtttcgggaacgtgtgcggaggaggagggggtgagaagtgggtttttagaagtggagagttggggatattagtgat

SEQ ID NO: 35986 - DNA, 1301 bp, Artificial Sequence
  chemically treated genomic DNA (Homo sapiens) CpG-island No: 35986
atcactaatatccccaactctccacttctaaaaacccacttctcaccccctcctcctccgcacacgttcccgaaactctcgaccgatataatctcaccgactaaaaaataaaaacaacccaaaaacgccgacgcgacccaaaaactctaacgaaaatcaacaaacgcgaaaccaaatacgaaccccaacttcctaaaccgaaccttccgcgcgccccctctcgaactcgaatcctctccaaaatacactcgcgtccgaacgacgcttacttactacgaatccaaccctctccgacccgcaactccaaccgaaccgcccgaatataaactccgaaaacgaacgccacgaaccgcgctcaaccctcccgcccgaaacccctctcgccgtatttcccaaaacttcctccccgcgcccgcccgacttcaaatcgaaccgcgcaaaatcccgcgcgctccaaccaaaactaccgccgcccgaatcgcccacgtaaactactaaacgcgaaataataaccgaccgaacgccctccccgaaacaaaaaacgaacaaaacgccgaaaaaaaataacgaaacgcgaaaaaaaaaacgaaaaaccccgacgacgaaaaaacgataacaacacttaaaaaaaaaactacacgcgaatttacataaaacacaaactaaaaacgaacgaaaacgaaaacgcgacgcacgccccgaaccgacccaaccaacgaacgaacgaacgcgaaccgaaaaaaaaaaaataacgaaacgataaaaccgcaaaaacgaaaaaatctacgcatcaaaactaacgaaacgaacgaaatttaaccgaaaattaaactttccttcccgaaaacgacacccaaacaactaccccgtacgaaaacccaaacttctactaccacttaaaatctcgcgaccgccgcctccgccccgcgttcgacgcttcccgaccctacactactaccgtccgcccgcccgaccgctcttctcttcgccgtaaaaaccgctccgaacgcaaaaccgcgcgccgaaccccgcaaactacaacgcgcgcccgaccgatcgccccgacaacttcgccgaaaattaaaacgaaatttaaacgaccgcgacaaccccgaccgaactccccttctacgccccgacgtcccgtcgaacccaaacccgccgaaacgctcctcgcgcccgcgcgccctccccaaccatatcgtccatcctacctttcactcccccgatcgtaaaacgcctactaaactaaaaaaaaaacgaacaaaacgaacaaaaaaaaaaataatacgaaaaaacga

SEQ ID NO: 35987 - DNA, 1301 bp, Artificial Sequence
  chemically treated genomic DNA (Homo sapiens) CpG-island No: 35987
gttattggtgtttttagttttttatttttgaggatttattttttatttttttttttttcgtatacgttttcgaggttttcggtcggtgtgattttatcgattagagaataaaaatagtttaggggcgtcggcgcggtttaagggttttgacggggattagtaagcgcgaggttaagtgcgggttttaattttttgggtcgggtttttcgcgcgttttttttcgggttcgggttttttttagggtgtattcgcgttcggacgacgtttatttgttgcgagtttaatttttttcggttcgtaattttaatcgagtcgttcgagtgtggatttcgagagcggacgttacgggtcgcgtttagttttttcgttcgaggtttttttcgtcgtgttttttaggatttttttttcgcgttcgttcgattttaggtcgggtcgcgtagggtttcgcgcgttttagttaggattgtcgtcgttcgggtcgtttacgtgggttgttgggcgcggggtggtggtcggtcgggcgtttttttcggagtagggggcgggtagggcgtcgggaggaggtggcggggcgcgggggaggaggcggggagtttcggcggcgagggggcggtgatagtatttggaaaggaggttgtacgcggatttgtatgaaatatagattgggagcgggcgggagcgggagcgcggcgtacgtttcgggtcggtttagttagcgagcgagcgagcgcgagtcgggaggaggagggtggcggggcggtgaggtcgtagaggcggagggatttgcgtattaaagttagcgaggcgagcgaagtttggtcgggggttggattttttttttcggaggcggtatttaaatagttatttcgtgcggaaatttaaatttttgttgttatttggagtttcgcggtcgtcgttttcgtttcgcgttcggcgtttttcgattttgtattgttgtcgttcgttcgttcggtcgttttttttttcgtcgtgggagtcgtttcgggcgtagggtcgcgcgtcgagtttcgtaagttgtagcgcgcgttcggtcggtcgtttcggtaatttcgtcgagagttgaggcgaagtttgggcgatcgcggtagtttcggtcgagttttttttttgcgtttcggcgtttcgtcgagtttagattcgtcggggcgtttttcgcgttcgcgcgttttttttagttatgtcgtttattttgttttttattttttcgatcgtgaagcgtttgttgggttggaagaagggcgagtagaacgggtaggaggagaaatggtgcgagaaggcgg

SEQ ID NO: 35988 - DNA, 1301 bp, Artificial Sequence
  chemically treated genomic DNA (Homo sapiens) CpG-island No: 35988
ccgccttctcgcaccatttctcctcctacccgttctactcgcccttcttccaacccaacaaacgcttcacgatcgaaaaaataaaaaacaaaataaacgacataactaaaaaaaacgcgcgaacgcgaaaaacgccccgacgaatctaaactcgacgaaacgccgaaacgcaaaaaaaaaactcgaccgaaactaccgcgatcgcccaaacttcgcctcaactctcgacgaaattaccgaaacgaccgaccgaacgcgcgctacaacttacgaaactcgacgcgcgaccctacgcccgaaacgactcccacgacgaaaaaaaaaacgaccgaacgaacgaacgacaacaatacaaaatcgaaaaacgccgaacgcgaaacgaaaacgacgaccgcgaaactccaaataacaacaaaaatttaaatttccgcacgaaataactatttaaataccgcctccgaaaaaaaaaatccaacccccgaccaaacttcgctcgcctcgctaactttaatacgcaaatccctccgcctctacgacctcaccgccccgccaccctcctcctcccgactcgcgctcgctcgctcgctaactaaaccgacccgaaacgtacgccgcgctcccgctcccgcccgctcccaatctatatttcatacaaatccgcgtacaacctcctttccaaatactatcaccgccccctcgccgccgaaactccccgcctcctcccccgcgccccgccacctcctcccgacgccctacccgccccctactccgaaaaaaacgcccgaccgaccaccaccccgcgcccaacaacccacgtaaacgacccgaacgacgacaatcctaactaaaacgcgcgaaaccctacgcgacccgacctaaaatcgaacgaacgcgaaaaaaaaatcctaaaaaacacgacgaaaaaaacctcgaacgaaaaaactaaacgcgacccgtaacgtccgctctcgaaatccacactcgaacgactcgattaaaattacgaaccgaaaaaaattaaactcgcaacaaataaacgtcgtccgaacgcgaatacaccctaaaaaaaacccgaacccgaaaaaaaacgcgcgaaaaacccgacccaaaaaattaaaacccgcacttaacctcgcgcttactaatccccgtcaaaacccttaaaccgcgccgacgcccctaaactatttttattctctaatcgataaaatcacaccgaccgaaaacctcgaaaacgtatacgaaaaaaaaaaaaataaaaaataaatcctcaaaaataaaaaactaaaaacaccaataac

SEQ ID NO: 35989 - DNA, 714 bp, Artificial Sequence
  chemically treated genomic DNA (Homo sapiens) CpG-island No: 35989
gggggaaggcgtgttttcgcgtttcgtttcgtttcgtttcggaaagttttcgcggtttcgtttattttaggggttcgtttagttttcggagatttttttttttgagcgtagtcgtttggtgtcggttttcgtcgagttggagcgcgcgggttacggtttttttggggacgtagaagcgagaagcggggatttcggcgcgcgtttcgcgtttcgttttttttgttcgcgtttcggttttcggttcgcgtttcggtcgtcggtatggtgttgttggtcgggatcgggtcggagggcggcggggcgcgttgtatgattttattatcgtcgtttttatttcggggcgcgtaggtcgaggaggatttcgttgattacgaagagtttgaggatttttcgagtttgttagatattcgtagtatcgtttcggacgattttttttattttttcgaggacgaggaggagtacggcgtcgagagcgcggagagcgtttcggagggcgtttcggaaagcgtttcggagacggcgatttttttgcgcgtcgtttgcgttaataacgtggggttgttgcggacgttggtgcggcgcggggtgagcgtcgaggaggcgtaggagattgatcgtaacggtagggtaagcgggcgttttcgtaggatttgagtttttttattgtttttattttttttttttttattatattttcgcgttttttagtttttg

SEQ ID NO: 35990 - DNA, 714 bp, Artificial Sequence
  chemically treated genomic DNA (Homo sapiens) CpG-island No: 35990
caaaaactaaaaaacgcgaaaatataataaaaaaaaaaaaaataaaaacaataaaaaaactcaaatcctacgaaaacgcccgcttaccctaccgttacgatcaatctcctacgcctcctcgacgctcaccccgcgccgcaccaacgtccgcaacaaccccacgttattaacgcaaacgacgcgcaaaaaaatcgccgtctccgaaacgctttccgaaacgccctccgaaacgctctccgcgctctcgacgccgtactcctcctcgtcctcgaaaaaataaaaaaaatcgtccgaaacgatactacgaatatctaacaaactcgaaaaatcctcaaactcttcgtaatcaacgaaatcctcctcgacctacgcgccccgaaataaaaacgacgataataaaatcatacaacgcgccccgccgccctccgacccgatcccgaccaacaacaccataccgacgaccgaaacgcgaaccgaaaaccgaaacgcgaacaaaaaaaacgaaacgcgaaacgcgcgccgaaatccccgcttctcgcttctacgtccccaaaaaaaccgtaacccgcgcgctccaactcgacgaaaaccgacaccaaacgactacgctcaaaaaaaaaaatctccgaaaactaaacgaacccctaaaataaacgaaaccgcgaaaactttccgaaacgaaacgaaacgaaacgcgaaaacacgccttccccc

SEQ ID NO: 35991 - DNA, 714 bp, Artificial Sequence
  chemically treated genomic DNA (Homo sapiens) CpG-island No: 35991
taggagttgggaggcgcggggatgtggtggggaggaggggagtgggggtagtgagggggtttaaattttgcggggacgttcgtttattttgtcgttgcggttagttttttgcgttttttcgacgtttatttcgcgtcgtattagcgttcgtagtagttttacgttgttggcgtaggcggcgcgtaggagggtcgtcgttttcgggacgtttttcgggacgtttttcgggacgtttttcgcgttttcgacgtcgtgttttttttcgttttcgaaagggtagaaagagtcgttcgaggcgatgttgcgggtgtttggtagattcgagaagtttttaaatttttcgtagttagcggggtttttttcgatttgcgcgtttcggggtggggacggcggtggtggggttatgtagcgcgtttcgtcgtttttcggttcggtttcggttagtagtattatgtcggcggtcggggcgcgggtcgggggtcggggcgcgggtaggaagagcgggacgcggggcgcgcgtcgaggttttcgtttttcgtttttgcgtttttagagaagtcgtggttcgcgcgttttagttcggcggaaatcggtattaggcggttgcgtttaaagaaaaaagttttcggaggttgagcgagtttttggggtgggcgggatcgcgggggtttttcgaggcggggcggggcggggcgcggggatacgttttttttt

SEQ ID NO: 35992 - DNA, 714 bp, Artificial Sequence
  chemically treated genomic DNA (Homo sapiens) CpG-island No: 35992
aaaaaaaaacgtatccccgcgccccgccccgccccgcctcgaaaaacccccgcgatcccgcccaccccaaaaactcgctcaacctccgaaaacttttttctttaaacgcaaccgcctaataccgatttccgccgaactaaaacgcgcgaaccacgacttctctaaaaacgcaaaaacgaaaaacgaaaacctcgacgcgcgccccgcgtcccgctcttcctacccgcgccccgacccccgacccgcgccccgaccgccgacataatactactaaccgaaaccgaaccgaaaaacgacgaaacgcgctacataaccccaccaccgccgtccccaccccgaaacgcgcaaatcgaaaaaaaccccgctaactacgaaaaatttaaaaacttctcgaatctaccaaacacccgcaacatcgcctcgaacgactctttctaccctttcgaaaacgaaaaaaaacacgacgtcgaaaacgcgaaaaacgtcccgaaaaacgtcccgaaaaacgtcccgaaaacgacgaccctcctacgcgccgcctacgccaacaacgtaaaactactacgaacgctaatacgacgcgaaataaacgtcgaaaaaacgcaaaaaactaaccgcaacgacaaaataaacgaacgtccccgcaaaatttaaaccccctcactacccccactcccctcctccccaccacatccccgcgcctcccaactccta

SEQ ID NO: 35993 - DNA, 552 bp, Artificial Sequence
  chemically treated genomic DNA (Homo sapiens) CpG-island No: 35993
gtgtgtcggtatgttagtatgtgtgttagtatgtgttagtatacgtgtcggtatgtgttagtacgcgtgttagtatgtgttagcgtgcgtgtcggtatgtgttggtgtgcgtgtcggtatgtgttggtgtgcgtgtcggtatgtgttggtgtgcgtgttagtatgttagtatgtgtttgcgttagcgtgcgtgtcggtatgtgttagtatatgtgttggtatgtgttagtgtgcgtgtcggtatgtgttggtgtgcgtgtcggtatgtgttggtgtgcgtgtcggtatgtgttagtgtgcgtgttggtatgtgttagcgtgcgtgtcggtatgtgttggtgtgcgtgtcggtatgtgttagtacgtgtcggtatgttagtgtgcgtgtcggtatgtgttggtgtgcgtgtcggtatgttagtatgtgtgtcggtatgtgttagcgtgcgtgtcggtatgtgttggtgtgcgtgtcggtatgttagtttgtgtgtcggtatgtgttagtgtatgtcggtatgtgttagtgtatgtcggtatgtgttagtatgt

SEQ ID NO: 35994 - DNA, 552 bp, Artificial Sequence
  chemically treated genomic DNA (Homo sapiens) CpG-island No: 35994
acatactaacacataccgacatacactaacacataccgacatacactaacacataccgacacacaaactaacataccgacacgcacaccaacacataccgacacgcacgctaacacataccgacacacatactaacataccgacacgcacaccaacacataccgacacgcacactaacataccgacacgtactaacacataccgacacgcacaccaacacataccgacacgcacgctaacacataccaacacgcacactaacacataccgacacgcacaccaacacataccgacacgcacaccaacacataccgacacgcacactaacacataccaacacatatactaacacataccgacacgcacgctaacgcaaacacatactaacatactaacacgcacaccaacacataccgacacgcacaccaacacataccgacacgcacaccaacacataccgacacgcacgctaacacatactaacacgcgtactaacacataccgacacgtatactaacacatactaacacacatactaacataccgacacac

SEQ ID NO: 35995 - DNA, 552 bp, Artificial Sequence
  chemically treated genomic DNA (Homo sapiens) CpG-island No: 35995
atatgttaatatatgtcgatatgtattaatatatgtcgatatgtattaatatatgtcgatatataggttaatatgtcgatacgtatattaatatatgtcgatacgtacgttaatatatatcgatatatatgttaatatgtcgatacgtatattaatatatgtcgatacgtatattaatatgtcgatacgtgttaatatatgtcgatacgtatattaatatatgtcgatacgtacgttaatatatgttaatacgtatattaatatatgtcgatacgtatattaatatatgtcgatacgtatattaatatatgtcgatacgtatattaatatatgttaatatatgtgttaatatatgtcgatacgtacgttaacgtagatatatgttaatatgttgatacgtatattaatatatgtcgatacgtatattaatatatgtcgatacgtatattaatatatgtcgatacgtacgttaatatatgttgatacgcgtgttaatatatgtcgatacgtgtgttaatatatgttgatatatatgttaatatgtcgatatat

SEQ ID NO: 35996 - DNA, 552 bp, Artificial Sequence
  chemically treated genomic DNA (Homo sapiens) CpG-island No: 35996
atatatcgacatattaacatatatatcaacatatattaacacacgtatcgacatatattaacacgcgtatcaacatatattaacgtacgtatcgacatatattaatatacgtatcgacatatattaatatacgtatcgacatatattaatatacgtatcaacatattaacatatatctacgttaacgtacgtatcgacatatattaacacatatattaacatatattaatatacgtatcgacatatattaatatacgtatcgacatatattaatatacgtatcgacatatattaatatacgtattaacatatattaacgtacgtatcgacatatattaatatacgtatcgacatatattaacacgtatcgacatattaatatacgtatcgacatatattaatatacgtatcgacatattaacatatatatcgatatatattaacgtacgtatcgacatatattaatatacgtatcgacatattaacctatatatcgacatatattaatacatatcgacatatattaatacatatcgacatatattaacatat

SEQ ID NO: 35997 - DNA, 747 bp, Artificial Sequence
  chemically treated genomic DNA (Homo sapiens) CpG-island No: 35997
tcgtttatattcggcggtgggaaatcgattcgaagatgtttttgtaggcgaaacgtttagttcgcgcggttttgaattatcggggagtagcggttgttgttagtcggattacgttagtatttttttgtttagttcgggagtagtttcgtttcgtttagggtcgcgtgcgcgtgcgcggttttaggggcggggtttgttcgcgtttcgggtgtttggatatcgagcgcgttcgtagtggcggttggcgttagggaattgtagggtttagggtgttgtcggagtggtagttggttcgaatttttttcgaagttcgcggaggagcgggtaagagtttcgcgaattcggttttaatttcgggaacgggatgggaggcggttttggtcgtaagtttcgcgttgttagcgggtttatcgcgtcgtagtcgatagtcgtttttttttttcgtagcgcgtcgcgatttattagtttggttttttttgcggagagcgatgtcgtttttcgatattatgttttgcgtttagtagatttatattttttcggagttgtcggatattttgaagtaatttattaaggttgttattcgtatttagtcggtcgacgtgttgcggtggttcgcggggtaagcgtttttggttcggggagttgttcggtttatatgtttaagttagacgagtttagagagtttttttttcggattaggggttttacgcggtatttagcgtttttaagagtattaggtaaaatttt

SEQ ID NO: 35998 - DNA, 747 bp, Artificial Sequence
  chemically treated genomic DNA (Homo sapiens) CpG-island No: 35998
aaaattttacctaatactcttaaaaacgctaaataccgcgtaaaacccctaatccgaaaaaaaaactctctaaactcgtctaacttaaacatataaaccgaacaactccccgaaccaaaaacgcttaccccgcgaaccaccgcaacacgtcgaccgactaaatacgaataacaaccttaataaattacttcaaaatatccgacaactccgaaaaaatataaatctactaaacgcaaaacataatatcgaaaaacgacatcgctctccgcaaaaaaaaccaaactaataaatcgcgacgcgctacgaaaaaaaaaaacgactatcgactacgacgcgataaacccgctaacaacgcgaaacttacgaccaaaaccgcctcccatcccgttcccgaaattaaaaccgaattcgcgaaactcttacccgctcctccgcgaacttcgaaaaaaattcgaaccaactaccactccgacaacaccctaaaccctacaattccctaacgccaaccgccactacgaacgcgctcgatatccaaacacccgaaacgcgaacaaaccccgcccctaaaaccgcgcacgcgcacgcgaccctaaacgaaacgaaactactcccgaactaaacaaaaaaatactaacgtaatccgactaacaacaaccgctactccccgataattcaaaaccgcgcgaactaaacgtttcgcctacaaaaacatcttcgaatcgatttcccaccgccgaatataaacga

SEQ ID NO: 35999 - DNA, 747 bp, Artificial Sequence
  chemically treated genomic DNA (Homo sapiens) CpG-island No: 35999
aaagttttgtttgatatttttaaggacgttgagtgtcgcgtaaggtttttggttcgggaggagggttttttgggttcgtttggtttgggtatgtagatcggatagtttttcgggttaagggcgtttatttcgcggattatcgtagtacgtcggtcggttgggtgcggatggtagttttggtgaattgttttaggatgttcggtagtttcgggggaatgtggatttgttgagcgtagaatatggtgtcgggaagcggtatcgtttttcgtagaagggattaggttggtgaatcgcggcgcgttgcgaggaagaagggcggttgtcggttacgacgcggtggattcgttagtagcgcggggtttgcggttagggtcgttttttatttcgttttcgaggttggggtcggattcgcggggtttttattcgttttttcgcgggtttcgggagaaattcggattaattgttatttcgataatattttagattttgtagttttttagcgttagtcgttattacggacgcgttcggtatttaggtattcgggacgcgagtaggtttcgtttttggagtcgcgtacgcgtacgcggttttgagcgaggcggggttgttttcgggttggataaggaggtgttggcgtagttcgattagtagtagtcgttgtttttcggtggtttagagtcgcgcgagttgagcgtttcgtttataaaagtattttcggatcggttttttatcgtcgaatgtgagcgg

SEQ ID NO: 36000 - DNA, 747 bp, Artificial Sequence
  chemically treated genomic DNA (Homo sapiens) CpG-island No: 36000
ccgctcacattcgacgataaaaaaccgatccgaaaatacttttataaacgaaacgctcaactcgcgcgactctaaaccaccgaaaaacaacgactactactaatcgaactacgccaacacctccttatccaacccgaaaacaaccccgcctcgctcaaaaccgcgtacgcgtacgcgactccaaaaacgaaacctactcgcgtcccgaatacctaaataccgaacgcgtccgtaataacgactaacgctaaaaaactacaaaatctaaaatattatcgaaataacaattaatccgaatttctcccgaaacccgcgaaaaaacgaataaaaaccccgcgaatccgaccccaacctcgaaaacgaaataaaaaacgaccctaaccgcaaaccccgcgctactaacgaatccaccgcgtcgtaaccgacaaccgcccttcttcctcgcaacgcgccgcgattcaccaacctaatcccttctacgaaaaacgataccgcttcccgacaccatattctacgctcaacaaatccacattcccccgaaactaccgaacatcctaaaacaattcaccaaaactaccatccgcacccaaccgaccgacgtactacgataatccgcgaaataaacgcccttaacccgaaaaactatccgatctacatacccaaaccaaacgaacccaaaaaaccctcctcccgaaccaaaaaccttacgcgacactcaacgtccttaaaaatatcaaacaaaacttt

SEQ ID NO: 36001 - DNA, 799 bp, Artificial Sequence
  chemically treated genomic DNA (Homo sapiens) CpG-island No: 36001
cgtatcgaagttttcggcgttgtttttttttttttttttcggagtttttagtttcgtttttatttttttttcgtatttaagttttagtttcgtttttttaattttcgtttcgagtttttagagtttttttttttttcgttttacgtttttttttagttttatttcgatacgtaggttttttttttcggcggatcggcgggggtcgtattttttttattagtcgttgtatgcgtttttggaagcggcggcgattggttttgagtttttgtagtagttggtcgttttttacgttttcgttttttatggcgcgtagcgtatttagtatcggatttagttagtatttaagcgttaattcggattgtagggtttcgcgcgttataaatttaaataggagatttcgttttttttgtttttttttcggttttttattggttagagcggagaagtcgggtattgattgggttttttaaataaatttgcgttttatttttcggttaatttattttcgagtttttagttacgttttaatgttcggcggaagggagggagggttttcggtcgttacggtcggtggtagttgtataaatagttgtgtgtttatttattagcggtgttgtgcgagattcggtgggatgcgtgttatttttcgcgttgtgtatcggagataagtgcggtttgaagatttttgcgtgatttgttttgggtgtcgtcgttgggcgaggttcgttttttttattttttcgtttgggatttcggcgtagtttttagggtaggggtttaagaaagataattttaaatt

SEQ ID NO: 36002 - DNA, 799 bp, Artificial Sequence
  chemically treated genomic DNA (Homo sapiens) CpG-island No: 36002
aatttaaaattatctttcttaaacccctaccctaaaaactacgccgaaatcccaaacgaaaaaataaaaaaaacgaacctcgcccaacgacgacacccaaaacaaatcacgcaaaaatcttcaaaccgcacttatctccgatacacaacgcgaaaaataacacgcatcccaccgaatctcgcacaacaccgctaataaataaacacacaactatttatacaactaccaccgaccgtaacgaccgaaaaccctccctcccttccgccgaacattaaaacgtaactaaaaactcgaaaataaattaaccgaaaaataaaacgcaaatttatttaaaaaacccaatcaatacccgacttctccgctctaaccaataaaaaaccgaaaaaaaaacaaaaaaaacgaaatctcctatttaaatttataacgcgcgaaaccctacaatccgaattaacgcttaaatactaactaaatccgatactaaatacgctacgcgccataaaaaacgaaaacgtaaaaaacgaccaactactacaaaaactcaaaaccaatcgccgccgcttccaaaaacgcatacaacgactaataaaaaaaatacgacccccgccgatccgccgaaaaaaaaaacctacgtatcgaaataaaactaaaaaaaaacgtaaaacgaaaaaaaaaaaaactctaaaaactcgaaacgaaaattaaaaaaacgaaactaaaacttaaatacgaaaaaaaaataaaaacgaaactaaaaactccgaaaaaaaaaaaaaaaaacaacgccgaaaacttcgatacg

SEQ ID NO: 36003 - DNA, 799 bp, Artificial Sequence
  chemically treated genomic DNA (Homo sapiens) CpG-island No: 36003
aatttggggttgttttttttaggtttttgttttggaaattgcgtcgggattttaggcggaggggtgaggaaggcggatttcgtttagcggcgatatttagagtaagttacgtagaaatttttaggtcgtatttattttcggtgtatagcgcgggagatgatacgtattttatcggatttcgtatagtatcgttgatgaataagtatatagttgtttgtataattattatcggtcgtggcggtcggagattttttttttttttcgtcggatattggggcgtggttggaaattcgggagtggattggtcggaaggtgggacgtaaatttgtttgaaaggtttaattagtgttcggttttttcgttttagttaatagaaaatcgagaggaaggtaggaggggcggagttttttatttgagtttgtggcgcgcgaggttttgtagttcgggttggcgtttgggtattggttgggttcgatgttgggtacgttgcgcgttatggagggcgaggacgtggaagacgattagttgttgtagaagtttagggttagtcgtcgtcgtttttagaggcgtatgtagcggttgatagagaaggtgcggttttcgtcggttcgtcgggaggggaggtttgcgtgtcggagtgaggttgggaggggacgtaggacgggaagggaaggggttttgaggattcggagcgggggttggggaagcgggattggggtttgaatgcggagagaaggtggaggcggagttgggggtttcggagagggaaaaaggaggtagcgtcgaaggtttcggtgcg

SEQ ID NO: 36004 - DNA, 799 bp, Artificial Sequence
  chemically treated genomic DNA (Homo sapiens) CpG-island No: 36004
cgcaccgaaaccttcgacgctacctcctttttccctctccgaaacccccaactccgcctccaccttctctccgcattcaaaccccaatcccgcttccccaacccccgctccgaatcctcaaaaccccttcccttcccgtcctacgtcccctcccaacctcactccgacacgcaaacctcccctcccgacgaaccgacgaaaaccgcaccttctctatcaaccgctacatacgcctctaaaaacgacgacgactaaccctaaacttctacaacaactaatcgtcttccacgtcctcgccctccataacgcgcaacgtacccaacatcgaacccaaccaatacccaaacgccaacccgaactacaaaacctcgcgcgccacaaactcaaataaaaaactccgcccctcctaccttcctctcgattttctattaactaaaacgaaaaaaccgaacactaattaaacctttcaaacaaatttacgtcccaccttccgaccaatccactcccgaatttccaaccacgccccaatatccgacgaaaaaaaaaaaaaatctccgaccgccacgaccgataataattatacaaacaactatatacttattcatcaacgatactatacgaaatccgataaaatacgtatcatctcccgcgctatacaccgaaaataaatacgacctaaaaatttctacgtaacttactctaaatatcgccgctaaacgaaatccgccttcctcacccctccgcctaaaatcccgacgcaatttccaaaacaaaaacctaaaaaaaacaaccccaaatt

SEQ ID NO: 36005 - DNA, 717 bp, Artificial Sequence
  chemically treated genomic DNA (Homo sapiens) CpG-island No: 36005
tagagcgcgggttcgacgaaatagagcgcgggttcgacgaaatagagcgtagtttcggttcgcgttggtttttagggaaatcgttcgcggaggaatttcgggttagggtcgtgatatttgcgacgagtttcgtttggcgttagggggcgcggaagcgcgttcgtttttaggttttatgtcgggttcgtttcgtttttgtcggttatatttttttatttcgtttttttttcgtgaggatcggtcgttttcggttttcggttttcggtttcgttttcggcgtaggcgtagtttcgcgttttttcggcggttgtcggcgtagtgagttcgtcgtcgtggagtgtagcggaaagggttcgtcgttttttttcgtttttcgttgtttcgggacgcgttttttgcggttttgtgagcgtttttgagcgtcggtagcggtcgcggtgggttttttaggtgagtgcggtcgcgggagggagaggttcggagcgtagagtatcgtttttttcggcgttcgcgcgttcgtttttggcgagtcggttaggaggggcggtcgcggtaggtgtaggtgttggcgtcgtgtagggcgcggtacgcgggggttcggggggatgtttaggttcggtgagttcgtttttcgtttgggtatttgggtttcgggtttttgggggcggcgtgtgggggggattttggcgattcgggttagtcggtcgttttttgggt

SEQ ID NO: 36006 - DNA, 717 bp, Artificial Sequence
  chemically treated genomic DNA (Homo sapiens) CpG-island No: 36006
acccaaaaaacgaccgactaacccgaatcgccaaaatcccccccacacgccgcccccaaaaacccgaaacccaaatacccaaacgaaaaacgaactcaccgaacctaaacatccccccgaacccccgcgtaccgcgccctacacgacgccaacacctacacctaccgcgaccgcccctcctaaccgactcgccaaaaacgaacgcgcgaacgccgaaaaaaacgatactctacgctccgaacctctccctcccgcgaccgcactcacctaaaaaacccaccgcgaccgctaccgacgctcaaaaacgctcacaaaaccgcaaaaaacgcgtcccgaaacaacgaaaaacgaaaaaaaacgacgaaccctttccgctacactccacgacgacgaactcactacgccgacaaccgccgaaaaaacgcgaaactacgcctacgccgaaaacgaaaccgaaaaccgaaaaccgaaaacgaccgatcctcacgaaaaaaaaacgaaataaaaaaatataaccgacaaaaacgaaacgaacccgacataaaacctaaaaacgaacgcgcttccgcgccccctaacgccaaacgaaactcgtcgcaaatatcacgaccctaacccgaaattcctccgcgaacgatttccctaaaaaccaacgcgaaccgaaactacgctctatttcgtcgaacccgcgctctatttcgtcgaacccgcgctcta

SEQ ID NO: 36007 - DNA, 717 bp, Artificial Sequence
  chemically treated genomic DNA (Homo sapiens) CpG-island No: 36007
gtttagggggcggtcggttgattcgggtcgttaaagttttttttatacgtcgtttttaagggttcggagtttaagtgtttaggcggagagcgagtttatcgggtttgggtattttttcgaattttcgcgtgtcgcgttttgtacggcgttagtatttgtatttgtcgcggtcgttttttttggtcgattcgttagaggcgggcgcgcgggcgtcgaggggggcggtgttttacgtttcgggtttttttttttcgcggtcgtatttatttgaagaatttatcgcggtcgttgtcggcgtttaggggcgtttatagagtcgtagagagcgcgtttcgaagtagcgagaaacggaggaggacggcgagtttttttcgttatattttacggcggcgggtttattacgtcggtagtcgtcgagggaacgcgggattgcgtttgcgtcggaagcggggtcgggggtcgggagtcgggagcggtcggtttttacggagggagggcggggtaggggggtgtggtcggtaggggcggggcgagttcggtatggggtttgggggcggacgcgttttcgcgttttttggcgttaggcggggttcgtcgtaggtgttacggttttggttcgaggttttttcgcgggcggtttttttgggaattagcgcgagtcggagttgcgttttgtttcgtcgggttcgcgttttgtttcgtcgggttcgcgttttg

SEQ ID NO: 36008 - DNA, 717 bp, Artificial Sequence
  chemically treated genomic DNA (Homo sapiens) CpG-island No: 36008
caaaacgcgaacccgacgaaacaaaacgcgaacccgacgaaacaaaacgcaactccgactcgcgctaattcccaaaaaaaccgcccgcgaaaaaacctcgaaccaaaaccgtaacacctacgacgaaccccgcctaacgccaaaaaacgcgaaaacgcgtccgcccccaaaccccataccgaactcgccccgcccctaccgaccacacccccctaccccgccctccctccgtaaaaaccgaccgctcccgactcccgacccccgaccccgcttccgacgcaaacgcaatcccgcgttccctcgacgactaccgacgtaataaacccgccgccgtaaaatataacgaaaaaaactcgccgtcctcctccgtttctcgctacttcgaaacgcgctctctacgactctataaacgcccctaaacgccgacaacgaccgcgataaattcttcaaataaatacgaccgcgaaaaaaaaaaacccgaaacgtaaaacaccgcccccctcgacgcccgcgcgcccgcctctaacgaatcgaccaaaaaaaacgaccgcgacaaatacaaatactaacgccgtacaaaacgcgacacgcgaaaattcgaaaaaatacccaaacccgataaactcgctctccgcctaaacacttaaactccgaacccttaaaaacgacgtataaaaaaaactttaacgacccgaatcaaccgaccgccccctaaac

SEQ ID NO: 36009 - DNA, 559 bp, Artificial Sequence
  chemically treated genomic DNA (Homo sapiens) CpG-island No: 36009
tgggcgtcgggcggcggtttttttttcgggtacgggcgcgttatatattaattgcgcggtttcgcgcgttcggggtagggagttcgagtttagcgggttatttggcggcgggcgggcgcggtcgggagcggagggtcgcggtcgcgaagaggatgaagagagagttttcgaataagtcggaagtagtttataatatcggacgtcgcgcggtagggttgtggatttggggtggtttcgtgttttagttttaggaaattacgcgcgaggtatcgtgttgaggcgtagaggttattttcgggaggtttcggtgaaatttggtgggaaatttcgggtaggcgttcggagtcgcgtttaagtaggtagtttcgtgtcgttagatttgtgttcgggggagttgagacgaattgtacgggtgggattgtatggttttgtttttttagcgttgataattcgtttcgatcgtttaggaagcgcgagtttattggttttagaagtgatgatgttgggtggaagtcgtagtatgtgaagagttgtcggttgttatgggattaaaaaagat

SEQ ID NO: 36010 - DNA, 559 bp, Artificial Sequence
  chemically treated genomic DNA (Homo sapiens) CpG-island No: 36010
atcttttttaatcccataacaaccgacaactcttcacatactacgacttccacccaacatcatcacttctaaaaccaataaactcgcgcttcctaaacgatcgaaacgaattatcaacgctaaaaaaacaaaaccatacaatcccacccgtacaattcgtctcaactcccccgaacacaaatctaacgacacgaaactacctacttaaacgcgactccgaacgcctacccgaaatttcccaccaaatttcaccgaaacctcccgaaaataacctctacgcctcaacacgatacctcgcgcgtaatttcctaaaactaaaacacgaaaccaccccaaatccacaaccctaccgcgcgacgtccgatattataaactacttccgacttattcgaaaactctctcttcatcctcttcgcgaccgcgaccctccgctcccgaccgcgcccgcccgccgccaaataacccgctaaactcgaactccctaccccgaacgcgcgaaaccgcgcaattaatatataacgcgcccgtacccgaaaaaaaaaccgccgcccgacgccca

SEQ ID NO: 36011 - DNA, 559 bp, Artificial Sequence
  chemically treated genomic DNA (Homo sapiens) CpG-island No: 36011
attttttttaattttataataatcggtaattttttatatgttgcgatttttatttagtattattatttttggagttagtaagttcgcgttttttgggcggtcggggcgagttgttaacgttgggagggtagagttatgtaattttattcgtgtagttcgttttaattttttcgaatataagtttggcggtacggagttgtttatttgggcgcgatttcgggcgtttgttcggaattttttattaggttttatcgaaatttttcgagggtgatttttacgttttagtacggtgtttcgcgcgtagttttttaagattgggatacgaaattattttaggtttatagttttgtcgcgcggcgttcggtgttgtgagttgttttcgatttgttcgggaattttttttttatttttttcgcgatcgcggtttttcgttttcggtcgcgttcgttcgtcgttaggtaattcgttggattcgggttttttgtttcgggcgcgcgggatcgcgtagttaatgtgtaacgcgttcgtgttcgggggaggagtcgtcgttcgacgttta

SEQ ID NO: 36012 - DNA, 559 bp, Artificial Sequence
  chemically treated genomic DNA (Homo sapiens) CpG-island No: 36012
taaacgtcgaacgacgactcctcccccgaacacgaacgcgttacacattaactacgcgatcccgcgcgcccgaaacaaaaaacccgaatccaacgaattacctaacgacgaacgaacgcgaccgaaaacgaaaaaccgcgatcgcgaaaaaaataaaaaaaaaattcccgaacaaatcgaaaacaactcacaacaccgaacgccgcgcgacaaaactataaacctaaaataatttcgtatcccaatcttaaaaaactacgcgcgaaacaccgtactaaaacgtaaaaatcaccctcgaaaaatttcgataaaacctaataaaaaattccgaacaaacgcccgaaatcgcgcccaaataaacaactccgtaccgccaaacttatattcgaaaaaattaaaacgaactacacgaataaaattacataactctaccctcccaacgttaacaactcgccccgaccgcccaaaaaacgcgaacttactaactccaaaaataataatactaaataaaaatcgcaacatataaaaaattaccgattattataaaattaaaaaaaat

SEQ ID NO: 36013 - DNA, 565 bp, Artificial Sequence
  chemically treated genomic DNA (Homo sapiens) CpG-island No: 36013
tacgcgtttattggttttttgtttttggcgtttttgggtacgggggagttggggcggtttcgtttgcgtacggcggtgtcgggattgggggcgggtacgtcgttttcgttttttacgcgttcgttcgttcgttcgttttcgtttttttcgtttcgagcgattttttgttttagttttgtaggtttcgtattgtagatgtttgttggtttttttgcgttcggcggttttcgcggtgtttcgtaagttttcgtgattttttagtattagtcggttgtgcgttttttgtttttacgggtcggttagtcgtagatatttatttagtttcgcgagtttagtcgtttagcgagtggggtacggggacgagacggacggtagtcgtgttagagttcggggcgttttcggatgcggtaggataagttgatcgggtttttgaggcgcggggggagatgtttgaagcggtagggcggcggcgtgggtattattttgagtaatgtgtttaagaagcgtttgtatttttcggatcgcgtttcggttgttgtgtattttggagtcgggtgaggatttt

SEQ ID NO: 36014 - DNA, 565 bp, Artificial Sequence
  chemically treated genomic DNA (Homo sapiens) CpG-island No: 36014
aaaatcctcacccgactccaaaatacacaacaaccgaaacgcgatccgaaaaatacaaacgcttcttaaacacattactcaaaataatacccacgccgccgccctaccgcttcaaacatctccccccgcgcctcaaaaacccgatcaacttatcctaccgcatccgaaaacgccccgaactctaacacgactaccgtccgtctcgtccccgtaccccactcgctaaacgactaaactcgcgaaactaaataaatatctacgactaaccgacccgtaaaaacaaaaaacgcacaaccgactaatactaaaaaatcacgaaaacttacgaaacaccgcgaaaaccgccgaacgcaaaaaaaccaacaaacatctacaatacgaaacctacaaaactaaaacaaaaaatcgctcgaaacgaaaaaaacgaaaacgaacgaacgaacgaacgcgtaaaaaacgaaaacgacgtacccgcccccaatcccgacaccgccgtacgcaaacgaaaccgccccaactcccccgtacccaaaaacgccaaaaacaaaaaaccaataaacgcgta

SEQ ID NO: 36015 - DNA, 565 bp, Artificial Sequence
  chemically treated genomic DNA (Homo sapiens) CpG-island No: 36015
ggggtttttattcggttttagggtgtatagtagtcggggcgcggttcgggaaatgtaggcgttttttgagtatattgtttaggatggtgtttacgtcgtcgttttgtcgttttaggtattttttttcgcgttttagagattcggttagtttgttttgtcgtattcgagagcgtttcgggttttggtacggttatcgttcgtttcgttttcgtattttattcgttgagcggttgagttcgcggagttgggtgagtgtttgcggttgatcggttcgtgggagtagggagcgtatagtcggttggtgttggagggttacggggatttacggggtatcgcgggagtcgtcgagcgtagggaagttagtaggtatttgtagtgcggagtttgtaaggttgaggtaggagatcgttcgaggcggggagggcgggagcgagcgagcgagcgagcgcgtgggagacggaggcggcgtgttcgtttttaatttcggtatcgtcgtgcgtaggcggggtcgttttagttttttcgtgtttagaagcgttagagatagggagttagtgggcgcgta

SEQ ID NO: 36016 - DNA, 565 bp, Artificial Sequence
  chemically treated genomic DNA (Homo sapiens) CpG-island No: 36016
tacgcgcccactaactccctatctctaacgcttctaaacacgaaaaaactaaaacgaccccgcctacgcacgacgataccgaaattaaaaacgaacacgccgcctccgtctcccacgcgctcgctcgctcgctcgctcccgccctccccgcctcgaacgatctcctacctcaaccttacaaactccgcactacaaatacctactaacttccctacgctcgacgactcccgcgataccccgtaaatccccgtaaccctccaacaccaaccgactatacgctccctactcccacgaaccgatcaaccgcaaacactcacccaactccgcgaactcaaccgctcaacgaataaaatacgaaaacgaaacgaacgataaccgtaccaaaacccgaaacgctctcgaatacgacaaaacaaactaaccgaatctctaaaacgcgaaaaaaaatacctaaaacgacaaaacgacgacgtaaacaccatcctaaacaatatactcaaaaaacgcctacatttcccgaaccgcgccccgactactatacaccctaaaaccgaataaaaacccc

SEQ ID NO: 36017 - DNA, 1148 bp, Artificial Sequence
  chemically treated genomic DNA (Homo sapiens) CpG-island No: 36017
tttgcgtattattttgttgtttttttcgtgttgataagcgttagcggaaggtcgacgatggtcgtagtggtataggtgaatttttcgcgtcggcgtgtatatcgggtttatttggttttgtatttgttttatcgttaggtcgtacgatgttagttagcggcggttttttttatttattcggttagttaggattttattttttagtcggtcgagtatttgtattagtatcggcgggaatattatattgttatcgttttcgttatcggattgttgaagggtattcgttaggttgcggcgttgcgttttcgttagtttatcggtggcggttttaattttgatgagtggcgtgaagtttttcggttgataaatagtttggatgcgggttttgtcgttttgtatcgtggttaggcggtcgtcgttttagtcgtattaggttatttgcggttttcgtgatagcgatatttagttcgttaggtttcgtttacgtcgttatattcgttttgttattttgcggtttagcgggtcgtaaagatagcgattttcgattagcggttttgtatattgtgttcgcgtgtagtgtattagtcggtgttgattgtcgtaatggtatcggtgagttcgtttattattcgtgcggatatttttttcgggatgaggtcggttttttttgttagtttgtcgtgacggttatatcggtatagatgtgcgcgttacgggcgatacggttattcggttatatgttgagggtgttgttcgggtgtagtttcgggtcgggtaggcggttatttgtcgggtttgtgtatacgggatgcggatatttagattcgttgcggtggtgtgaacgtcggttagtttgtcggtggtgttgtagttgtatttcgggtttggcgcgggttgttgatgcggatgagttcgtcgttgtcgttttaggtgtatcgcggttagatagtaggttgtttaggtgttggttttgtaattgttcggtaggggtatgagcggtggtgagtttattacggtcgaagttggcgtagcgtttttcggtgtagcggtcgcgggtgtattttattagcggtgtgtcgtcgagttttatgtttgtaggtaatcgttgcgtaggttagtattttacgggggtagttgttcggttatag

SEQ ID NO: 36018 - DNA, 1148 bp, Artificial Sequence
  chemically treated genomic DNA (Homo sapiens) CpG-island No: 36018
ctataaccgaacaactacccccgtaaaatactaacctacgcaacgattacctacaaacataaaactcgacgacacaccgctaataaaatacacccgcgaccgctacaccgaaaaacgctacgccaacttcgaccgtaataaactcaccaccgctcatacccctaccgaacaattacaaaaccaacacctaaacaacctactatctaaccgcgatacacctaaaacgacaacgacgaactcatccgcatcaacaacccgcgccaaacccgaaatacaactacaacaccaccgacaaactaaccgacgttcacaccaccgcaacgaatctaaatatccgcatcccgtatacacaaacccgacaaataaccgcctacccgacccgaaactacacccgaacaacaccctcaacatataaccgaataaccgtatcgcccgtaacgcgcacatctataccgatataaccgtcacgacaaactaacaaaaaaaaccgacctcatcccgaaaaaaatatccgcacgaataataaacgaactcaccgataccattacgacaatcaacaccgactaatacactacacgcgaacacaatatacaaaaccgctaatcgaaaatcgctatctttacgacccgctaaaccgcaaaataacaaaacgaatataacgacgtaaacgaaacctaacgaactaaatatcgctatcacgaaaaccgcaaataacctaatacgactaaaacgacgaccgcctaaccacgatacaaaacgacaaaacccgcatccaaactatttatcaaccgaaaaacttcacgccactcatcaaaattaaaaccgccaccgataaactaacgaaaacgcaacgccgcaacctaacgaatacccttcaacaatccgataacgaaaacgataacaatataatattcccgccgatactaatacaaatactcgaccgactaaaaaataaaatcctaactaaccgaataaataaaaaaaaccgccgctaactaacatcgtacgacctaacgataaaacaaatacaaaaccaaataaacccgatatacacgccgacgcgaaaaattcacctataccactacgaccatcgtcgaccttccgctaacgcttatcaacacgaaaaaaacaacaaaataatacgcaaa

SEQ ID NO: 36019 - DNA, 1148 bp, Artificial Sequence
  chemically treated genomic DNA (Homo sapiens) CpG-island No: 36019
ttgtaatcggatagttgttttcgtggaatgttgatttacgtagcggttatttgtaggtatgaaattcggcgatatatcgttggtggagtatattcgcgatcgttgtatcgggaaacgttgcgttagtttcggtcgtgatgaatttattatcgtttatatttttgtcgggtagttatagagttagtatttgaatagtttgttgtttgatcgcgatatatttggaacgataacggcgaatttattcgtattagtagttcgcgttagattcggagtatagttatagtattatcggtaggttgatcggcgtttatattatcgtagcgaatttggatattcgtatttcgtatgtatagattcggtaggtaatcgtttgttcgattcggagttgtattcggatagtatttttagtatgtggtcggataatcgtatcgttcgtgacgcgtatatttgtatcggtatgatcgttacggtaggttgatagagaaaatcgattttatttcggaaggggtattcgtacggatgatgagcggatttatcggtattattacgatagttagtatcggttggtgtattatacgcggatataatatgtagagtcgttggtcgaaagtcgttatttttacgattcgttgggtcgtagggtggtaaaacgggtatggcggcgtgaacgggatttgacgggttggatgtcgttgttacggaaatcgtaagtgatttggtacggttgggacggcgatcgtttgattacgatatagaacgatagaattcgtatttagattatttattagtcggggagttttacgttatttattagggttgaaatcgttatcggtgagttggcgaaaacgtagcgtcgtagtttggcggatattttttagtagttcggtggcgaagacggtggtagtgtggtgttttcgtcggtgttggtgtagatgttcgatcggttggaaagtgaaattttggttgatcgggtgagtgaggaaagtcgtcgttggttggtatcgtgcggtttgacggtggagtagatgtaaaattagatggattcggtatatacgtcggcgcgaaaaatttatttgtattattgcgattatcgtcggtttttcgttggcgtttgttagtacggaaggggtaatagaatggtgcgtaga

SEQ ID NO: 36020 - DNA, 1148 bp, Artificial Sequence
  chemically treated genomic DNA (Homo sapiens) CpG-island No: 36020
tctacgcaccattctattaccccttccgtactaacaaacgccaacgaaaaaccgacgataatcgcaataatacaaataaatttttcgcgccgacgtatataccgaatccatctaattttacatctactccaccgtcaaaccgcacgataccaaccaacgacgactttcctcactcacccgatcaaccaaaatttcactttccaaccgatcgaacatctacaccaacaccgacgaaaacaccacactaccaccgtcttcgccaccgaactactaaaaaatatccgccaaactacgacgctacgttttcgccaactcaccgataacgatttcaaccctaataaataacgtaaaactccccgactaataaataatctaaatacgaattctatcgttctatatcgtaatcaaacgatcgccgtcccaaccgtaccaaatcacttacgatttccgtaacaacgacatccaacccgtcaaatcccgttcacgccgccatacccgttttaccaccctacgacccaacgaatcgtaaaaataacgactttcgaccaacgactctacatattatatccgcgtataatacaccaaccgatactaactatcgtaataataccgataaatccgctcatcatccgtacgaataccccttccgaaataaaatcgattttctctatcaacctaccgtaacgatcataccgatacaaatatacgcgtcacgaacgatacgattatccgaccacatactaaaaatactatccgaatacaactccgaatcgaacaaacgattacctaccgaatctatacatacgaaatacgaatatccaaattcgctacgataatataaacgccgatcaacctaccgataatactataactatactccgaatctaacgcgaactactaatacgaataaattcgccgttatcgttccaaatatatcgcgatcaaacaacaaactattcaaatactaactctataactacccgacaaaaatataaacgataataaattcatcacgaccgaaactaacgcaacgtttcccgatacaacgatcgcgaatatactccaccaacgatatatcgccgaatttcatacctacaaataaccgctacgtaaatcaacattccacgaaaacaactatccgattacaa

SEQ ID NO: 36021 - DNA, 596 bp, Artificial Sequence
  chemically treated genomic DNA (Homo sapiens) CpG-island No: 36021
cggttgaaaatgtttttttttttaaagcgcgagaaagtatttgtcgttagtacgttagtttataggtagttgtagtaatttgcggtataattatcggcgaaaatatgttgaaagcgtgcgggaaacggttttaggacggagatgtattacggtaattagttttttgatttttgttagagtttcgaggatttttgttttttgattcgggcggaattcggtatgaaggcggaaattaaataggtcgaattttagttgacgtagaataaatagcgtcgtttggtagtttttcgtcgttagtattttatttagtaattttttcggtagcggttcgtcggttttatagtgattagagataaacgttagcgttttcggtttttagtattagttttttataaattgattcggtagttcgatcgtattttacggtatatcgttgatatcggaaatattagcggtttcgatgcgggttagtatatggtgtaggtcgtgatcgaattcgtggaagagggtgattatttcgtcgtgagtgaatagcgtcggtttattatttatcgggcggttgaagttataagttaaatacgcgatcggtttttgta

SEQ ID NO: 36022 - DNA, 596 bp, Artificial Sequence
  chemically treated genomic DNA (Homo sapiens) CpG-island No: 36022
tacaaaaaccgatcgcgtatttaacttataacttcaaccgcccgataaataataaaccgacgctattcactcacgacgaaataatcaccctcttccacgaattcgatcacgacctacaccatatactaacccgcatcgaaaccgctaatatttccgatatcaacgatataccgtaaaatacgatcgaactaccgaatcaatttataaaaaactaatactaaaaaccgaaaacgctaacgtttatctctaatcactataaaaccgacgaaccgctaccgaaaaaattactaaataaaatactaacgacgaaaaactaccaaacgacgctatttattctacgtcaactaaaattcgacctatttaatttccgccttcataccgaattccgcccgaatcaaaaaacaaaaatcctcgaaactctaacaaaaatcaaaaaactaattaccgtaatacatctccgtcctaaaaccgtttcccgcacgctttcaacatattttcgccgataattataccgcaaattactacaactacctataaactaacgtactaacgacaaatactttctcgcgctttaaaaaaaaaaacattttcaaccg

SEQ ID NO: 36023 - DNA, 596 bp, Artificial Sequence
  chemically treated genomic DNA (Homo sapiens) CpG-island No: 36023
tgtaaaaatcggtcgcgtatttgatttgtaattttaatcgttcggtaaatggtaaatcggcgttgtttatttacgacgaagtgattatttttttttacgagttcggttacggtttgtattatatgttgattcgtatcgaaatcgttggtgttttcggtattagcggtgtgtcgtgggatgcggtcgaattgtcgagttagtttatggaaaattggtgttgggagtcggaggcgttggcgtttatttttggttattatgaaatcggcgaatcgttgtcgaaagagttgttggataaaatgttggcggcgaagaattattaggcggcgttgtttattttgcgttagttggagttcggtttgtttgattttcgtttttatgtcgagtttcgttcggattagggggtaaaaattttcgaaattttggtagaaattaagaaattggttgtcgtggtgtattttcgttttggggtcgtttttcgtacgtttttagtatattttcgtcggtggttatgtcgtaggttattatagttatttgtgggttgacgtattggcggtagatgttttttcgcgttttgaggaagagggtatttttaatcg

SEQ ID NO: 36024 - DNA, 596 bp, Artificial Sequence
  chemically treated genomic DNA (Homo sapiens) CpG-island No: 36024
cgattaaaaataccctcttcctcaaaacgcgaaaaaacatctaccgccaatacgtcaacccacaaataactataataacctacgacataaccaccgacgaaaatatactaaaaacgtacgaaaaacgaccccaaaacgaaaatacaccacgacaaccaatttcttaatttctaccaaaatttcgaaaatttttaccccctaatccgaacgaaactcgacataaaaacgaaaatcaaacaaaccgaactccaactaacgcaaaataaacaacgccgcctaataattcttcgccgccaacattttatccaacaactctttcgacaacgattcgccgatttcataataaccaaaaataaacgccaacgcctccgactcccaacaccaattttccataaactaactcgacaattcgaccgcatcccacgacacaccgctaataccgaaaacaccaacgatttcgatacgaatcaacatataatacaaaccgtaaccgaactcgtaaaaaaaaataatcacttcgtcgtaaataaacaacgccgatttaccatttaccgaacgattaaaattacaaatcaaatacgcgaccgatttttaca

SEQ ID NO: 36025 - DNA, 527 bp, Artificial Sequence
  chemically treated genomic DNA (Homo sapiens) CpG-island No: 36025
taaagatgcgttaaaaggatggaaaaggtagttttgtttttcgtaaattgagattttttttgttcgcgaagggttaagagttttaggttcgggggtttggtatcggcgcgggacgttcggaggttagattcggagtcggcggcgcgtagagcggggcggttcggggcgcggggttgtgattttatcggtcggcgtcgtttcgcggggttatgagattatgagatgtcggcgttcgtcgaggagtcgatttgttgggagcgcggggatagtcggtcgttcgacgcggtgattttattcgggttcgggggaggaggaggtaggcggtcgggttagttcgcgtcgttaggagggggattaatggttgtcgtcgggtggtgacgttatcggtagtattcgttgttaggtaacgcgcggttattagtttcgtttcgttggtttcgttttttatttgttgcgtttttttttattttggttcgttttttttttgttttttttttttttttttttgtattgaggtataatttata

SEQ ID NO: 36026 - DNA, 527 bp, Artificial Sequence
  chemically treated genomic DNA (Homo sapiens) CpG-island No: 36026
tataaattatacctcaatacaaaaaaaaaaaaaaaaaaaacaaaaaaaaaacgaaccaaaataaaaaaaaacgcaacaaataaaaaacgaaaccaacgaaacgaaactaataaccgcgcgttacctaacaacgaatactaccgataacgtcaccacccgacgacaaccattaatccccctcctaacgacgcgaactaacccgaccgcctacctcctcctcccccgaacccgaataaaatcaccgcgtcgaacgaccgactatccccgcgctcccaacaaatcgactcctcgacgaacgccgacatctcataatctcataaccccgcgaaacgacgccgaccgataaaatcacaaccccgcgccccgaaccgccccgctctacgcgccgccgactccgaatctaacctccgaacgtcccgcgccgataccaaacccccgaacctaaaactcttaacccttcgcgaacaaaaaaaatctcaatttacgaaaaacaaaactaccttttccatccttttaacgcatcttta

SEQ ID NO: 36027 - DNA, 527 bp, Artificial Sequence
  chemically treated genomic DNA (Homo sapiens) CpG-island No: 36027
tgtaagttatgttttaatataaaagaaaaaggaaaaaaggtaagagaagggcgagttaggatggaaagaagcgtagtaggtaggaggcggggttagcggggcggggttggtggtcgcgcgttgtttggtaacgggtgttgtcggtgacgttattattcggcggtagttattaattttttttttggcggcgcgggttggttcggtcgtttgtttttttttttttcgggttcggatgagattatcgcgtcgggcggtcggttgttttcgcgtttttaataaatcgatttttcggcgagcgtcggtattttatgattttatggtttcgcgggacggcgtcggtcgatgaggttatagtttcgcgtttcgggtcgtttcgttttgcgcgtcgtcggtttcgggtttggttttcgggcgtttcgcgtcggtattaggttttcgagtttgaggtttttagtttttcgcggataaaggagattttagtttgcgaagggtaaagttgttttttttatttttttgacgtatttttg

SEQ ID NO: 36028 - DNA, 527 bp, Artificial Sequence
  chemically treated genomic DNA (Homo sapiens) CpG-island No: 36028
caaaaatacgtcaaaaaaataaaaaaaacaactttacccttcgcaaactaaaatctcctttatccgcgaaaaactaaaaacctcaaactcgaaaacctaataccgacgcgaaacgcccgaaaaccaaacccgaaaccgacgacgcgcaaaacgaaacgacccgaaacgcgaaactataacctcatcgaccgacgccgtcccgcgaaaccataaaatcataaaataccgacgctcgccgaaaaatcgatttattaaaaacgcgaaaacaaccgaccgcccgacgcgataatctcatccgaacccgaaaaaaaaaaaaacaaacgaccgaaccaacccgcgccgccaaaaaaaaaattaataactaccgccgaataataacgtcaccgacaacacccgttaccaaacaacgcgcgaccaccaaccccgccccgctaaccccgcctcctacctactacgcttctttccatcctaactcgcccttctcttaccttttttcctttttcttttatattaaaacataacttaca

SEQ ID NO: 36029 - DNA, 604 bp, Artificial Sequence
  chemically treated genomic DNA (Homo sapiens) CpG-island No: 36029
gttagtataataaacgtataatataaggagaaatttggtgtttaggggaggttttcggcggttggagcgcggcggtagcgggcgtagaggtcggagggagaggaggcgaggggcggttcgagcgcggggcgggagcgaggttagcggttatgtgttcgtgttttttgtatcgcggtcgcggtttttcggtcgtgtgcgtttgtagcgcgggtcgtttggggttgcgttcgttcgtcgcgtagtttatcgtcgttcggtttaaggcgttaggcgacgagttgtattagcgtattatgtggcggcgtcgcgcgcggagtcggagggcgtcggcgttcggcgcgttttttatttattggttttggttgtgcgcggtcgcgtaggtggcggcgttggcggtttggttgttcggtaggcggaatttgtaggaacgcggggttttttggtggggtcggagtcgagatttagtcggagcgagtaataggtacgcgagcgagcgagcgagagtcggggcgcggtagttgggtattggagacgttgggttggttcgggagcgggagagtggtaagtttggttttttttttttttttttttttttttttttcgt

SEQ ID NO: 36030 - DNA, 604 bp, Artificial Sequence
  chemically treated genomic DNA (Homo sapiens) CpG-island No: 36030
acgaaaaaaaaaaaaaaaaaaaaaaaaaaaaaaccaaacttaccactctcccgctcccgaaccaacccaacgtctccaatacccaactaccgcgccccgactctcgctcgctcgctcgcgtacctattactcgctccgactaaatctcgactccgaccccaccaaaaaaccccgcgttcctacaaattccgcctaccgaacaaccaaaccgccaacgccgccacctacgcgaccgcgcacaaccaaaaccaataaataaaaaacgcgccgaacgccgacgccctccgactccgcgcgcgacgccgccacataatacgctaatacaactcgtcgcctaacgccttaaaccgaacgacgataaactacgcgacgaacgaacgcaaccccaaacgacccgcgctacaaacgcacacgaccgaaaaaccgcgaccgcgatacaaaaaacacgaacacataaccgctaacctcgctcccgccccgcgctcgaaccgcccctcgcctcctctccctccgacctctacgcccgctaccgccgcgctccaaccgccgaaaacctcccctaaacaccaaatttctccttatattatacgtttattatactaac

SEQ ID NO: 36031 - DNA, 604 bp, Artificial Sequence
  chemically treated genomic DNA (Homo sapiens) CpG-island No: 36031
acggaggaagaaggagaagggaaaagaagaaagttaaatttgttattttttcgttttcgggttagtttagcgtttttagtgtttagttgtcgcgtttcggttttcgttcgttcgttcgcgtatttgttgttcgtttcggttgggtttcggtttcggttttattaagaagtttcgcgtttttataagtttcgtttgtcgagtagttaggtcgttagcgtcgttatttgcgcggtcgcgtatagttaaggttagtaggtggggagcgcgtcgggcgtcggcgtttttcggtttcgcgcgcggcgtcgttatatggtgcgttggtgtagttcgtcgtttagcgttttgagtcgggcggcggtgagttgcgcggcggacgagcgtagttttaggcgattcgcgttgtaggcgtatacggtcggggggtcgcggtcgcggtgtagggggtacgggtatatgatcgttggtttcgttttcgtttcgcgttcgggtcgtttttcgtttttttttttttcggtttttgcgttcgttgtcgtcgcgttttagtcgtcgggggttttttttggatattaagtttttttttgtgttgtgcgtttgttgtgttgat

SEQ ID NO: 36032 - DNA, 604 bp, Artificial Sequence
  chemically treated genomic DNA (Homo sapiens) CpG-island No: 36032
atcaacacaacaaacgcacaacacaaaaaaaaacttaatatccaaaaaaaacccccgacgactaaaacgcgacgacaacgaacgcaaaaaccgaaaaaaaaaaaaacgaaaaacgacccgaacgcgaaacgaaaacgaaaccaacgatcatatacccgtaccccctacaccgcgaccgcgaccccccgaccgtatacgcctacaacgcgaatcgcctaaaactacgctcgtccgccgcgcaactcaccgccgcccgactcaaaacgctaaacgacgaactacaccaacgcaccatataacgacgccgcgcgcgaaaccgaaaaacgccgacgcccgacgcgctccccacctactaaccttaactatacgcgaccgcgcaaataacgacgctaacgacctaactactcgacaaacgaaacttataaaaacgcgaaacttcttaataaaaccgaaaccgaaacccaaccgaaacgaacaacaaatacgcgaacgaacgaacgaaaaccgaaacgcgacaactaaacactaaaaacgctaaactaacccgaaaacgaaaaaataacaaatttaactttcttcttttcccttctccttcttcctccgt

SEQ ID NO: 36033 - DNA, 1133 bp, Artificial Sequence
  chemically treated genomic DNA (Homo sapiens) CpG-island No: 36033
tacgttttcggtttatattagatatcgtgttttatttacgtttttcgtttatattagatatcgttttatttacgtttttcgtttatattagatatcgtgttttatttacgtttttcgtttatattagatatcgtgttttatttacgtttttcggtatatattagatatcgttttatttacgttttcggtttatattagatatcgtgttttatttacgttttcggtttatattagatatcgttttatttacgttttcggtttatattagatatcgtgttttatttacgttttcggtttatattagatatcgttttatttacgtttttcgttatattagatatcgtgttttatttacgttgtcggtttatattagatatcgtgttttatttacgttttcggtttatattagatatcgttttatttacgttttcggtttatattagataatgtgttttatttacgttttcggtttatattagatatcgttttatttacgttttcggtttatattagatatcgtgtttttatttacgttttcggtttatattagatatcgttttatttacgtttttcgtttatattagatatcgtgttttatttacgttgtcggtttatattagatatcgttttatttacgtttttcgtttatattaaagtagtaatcggtggtttatttacgttgtcggtttatattagatatcgtgttttatttacgttgtcggtttatattagatatcgttttatttacgttttcggtttatattagatatcgtgttttatttacgttttcggtttatattagatatcgttttatttacgttttcggtttatattagatatcgtgttttatttacgttttcggtttatattagatatcgtgttttatttacgttttcggtttatattagatatcgttttatttacgttttcggtttatattagatatcgtgttttatttacgtttatcgtttatattagatatcgtgttttatttacgttttcggtttatattagatattgttttatttacgttttcggtttatattattgttttatttacgttttcggtttgggtttgaagattattagatatttaatattcgtttgattttttttttttaaggtattttttt

SEQ ID NO: 36034 - DNA, 1133 bp, Artificial Sequence
  chemically treated genomic DNA (Homo sapiens) CpG-island No: 36034
aaaaaaataccttaaaaaaaaaaaatcaaacgaatattaaatatctaataatcttcaaacccaaaccgaaaacgtaaataaaacaataatataaaccgaaaacgtaaataaaacaatatctaatataaaccgaaaacgtaaataaaacacgatatctaatataaacgataaacgtaaataaaacacgatatctaatataaaccgaaaacgtaaataaaacgatatctaatataaaccgaaaacgtaaataaaacacgatatctaatataaaccgaaaacgtaaataaaacacgatatctaatataaaccgaaaacgtaaataaaacgatatctaatataaaccgaaaacgtaaataaaacacgatatctaatataaaccgaaaacgtaaataaaacgatatctaatataaaccgacaacgtaaataaaacacgatatctaatataaaccgacaacgtaaataaaccaccgattactactttaatataaacgaaaaacgtaaataaaacgatatctaatataaaccgacaacgtaaataaaacacgatatctaatataaacgaaaaacgtaaataaaacgatatctaatataaaccgaaaacgtaaataaaaacacgatatctaatataaaccgaaaacgtaaataaaacgatatctaatataaaccgaaaacgtaaataaaacacattatctaatataaaccgaaaacgtaaataaaacgatatctaatataaaccgaaaacgtaaataaaacacgatatctaatataaaccgacaacgtaaataaaacacgatatctaatataacgaaaaacgtaaataaaacgatatctaatataaaccgaaaacgtaaataaaacacgatatctaatataaaccgaaaacgtaaataaaacgatatctaatataaaccgaaaacgtaaataaaacacgatatctaatataaaccgaaaacgtaaataaaacgatatctaatatataccgaaaaacgtaaataaaacacgatatctaatataaacgaaaaacgtaaataaaacacgatatctaatataaacgaaaaacgtaaataaaacgatatctaatataaacgaaaaacgtaaataaaacacgatatctaatataaaccgaaaacgta

SEQ ID NO: 36035 - DNA, 1133 bp, Artificial Sequence
  chemically treated genomic DNA (Homo sapiens) CpG-island No: 36035
ggagaaatgttttgaaggagaagaattagacgaatgttgagtgtttagtgatttttaaatttagatcgggagcgtgggtgggatagtggtgtagatcgggaacgtgggtgggatagtgtttggtgtagatcgggagcgtgggtgggatacggtgtttggtgtagacggtaagcgtgggtgggatacggtgtttggtgtagatcgggagcgtgggtgggacggtgtttggtgtagatcgggagcgtgggtgggatacggtgtttggtgtagatcgggagcgtgggtgggatacggtgtttggtgtagatcgggagcgtgggtgggacggtgtttggtgtagatcgggagcgtgggtgggatacggtgtttggtgtagatcgggagcgtgggtgggacggtgtttggtgtagatcggtagcgtgggtgggatacggtgtttggtgtagatcggtagcgtgggtggattatcggttgttgttttggtatagacggggagcgtgggtgggacggtgtttggtgtagatcggtagcgtgggtgggatacggtgtttggtgtagacggggagcgtgggtgggacggtgtttggtgtagatcgggagcgtgggtgggaatacggtgtttggtgtagatcgggagcgtgggtgggacggtgtttggtgtagatcgggagcgtgggtgggatatattgtttggtgtagatcgggagcgtgggtgggacggtgtttggtgtagatcgggagcgtgggtgggatacggtgtttggtgtagatcggtagcgtgggtgggatacggtgtttggtgtgacggggagcgtgggtgggacggtgtttggtgtagatcgggagcgtgggtgggatacggtgtttggtgtagatcgggagcgtgggtgggacggtgtttggtgtagatcgggagcgtgggtgggatacggtgtttggtgtagatcgggagcgtgggtgggacggtgtttggtgtatatcgggagacgtgggtgggatacggtgtttggtgtagacggggagcgtgggtgggatacggtgtttggtgtagacggggagcgtgggtgggacggtgtttggtgtagacggggagcgtgggtgggatacggtgtttggtgtagatcgggagcgtg

SEQ ID NO: 36036 - DNA, 1133 bp, Artificial Sequence
  chemically treated genomic DNA (Homo sapiens) CpG-island No: 36036
cacgctcccgatctacaccaaacaccgtatcccacccacgctccccgtctacaccaaacaccgtcccacccacgctccccgtctacaccaaacaccgtatcccacccacgctccccgtctacaccaaacaccgtatcccacccacgtctcccgatatacaccaaacaccgtcccacccacgctcccgatctacaccaaacaccgtatcccacccacgctcccgatctacaccaaacaccgtcccacccacgctcccgatctacaccaaacaccgtatcccacccacgctcccgatctacaccaaacaccgtcccacccacgctccccgtcacaccaaacaccgtatcccacccacgctaccgatctacaccaaacaccgtatcccacccacgctcccgatctacaccaaacaccgtcccacccacgctcccgatctacaccaaacaatatatcccacccacgctcccgatctacaccaaacaccgtcccacccacgctcccgatctacaccaaacaccgtattcccacccacgctcccgatctacaccaaacaccgtcccacccacgctccccgtctacaccaaacaccgtatcccacccacgctaccgatctacaccaaacaccgtcccacccacgctccccgtctataccaaaacaacaaccgataatccacccacgctaccgatctacaccaaacaccgtatcccacccacgctaccgatctacaccaaacaccgtcccacccacgctcccgatctacaccaaacaccgtatcccacccacgctcccgatctacaccaaacaccgtcccacccacgctcccgatctacaccaaacaccgtatcccacccacgctcccgatctacaccaaacaccgtatcccacccacgctcccgatctacaccaaacaccgtcccacccacgctcccgatctacaccaaacaccgtatcccacccacgcttaccgtctacaccaaacaccgtatcccacccacgctcccgatctacaccaaacactatcccacccacgttcccgatctacaccactatcccacccacgctcccgatctaaatttaaaaatcactaaacactcaacattcgtctaattcttctccttcaaaacatttctcc

SEQ ID NO: 36037 - DNA, 624 bp, Artificial Sequence
  chemically treated genomic DNA (Homo sapiens) CpG-island No: 36037
acgaagttaaatcggtgaacgtggaagtcgtgcgtgaattggtcgtttttggtgtgatgttgacgtcggacgagaacgtagtgcgcgttgagatgaacgtgtagtatcgcgttattaattcggaaaaatatttgtatagcgtgattagttcggatgatagtttgcgttaggttatcgatagcgttttgcgtggagttatcggtaaatatattatggatcgtattttgacggaaggtcgtatcgtgattcgtagcgatatttagcgcgaattggaagagacgattcgttcgtatgatatgggtattacgttgttggacgttaatttttaggttgttcgttcgtcggaagaagtaaaagcggcgtttgacgatgcgattgtcgcgcgtgaaaacgaatagtaatatattcgtgaagtagaagcgtatattaacgaagtttagtcgcgtgcgaacggttaggcgtaacgtattttcgaagaggcgcgtgcgtataaggtttagattattttggaagtttagggtgaagtggcgcgttttgttaaatttttgtcggaatataaagtcgcgtcggaaattattcgcgagcgtttgtatatcgagacgatggaaaaagtgttgggtaata

SEQ ID NO: 36038 - DNA, 624 bp, Artificial Sequence
  chemically treated genomic DNA (Homo sapiens) CpG-island No: 36038
tattacccaacactttttccatcgtctcgatatacaaacgctcgcgaataatttccgacgcgactttatattccgacaaaaatttaacaaaacgcgccacttcaccctaaacttccaaaataatctaaaccttatacgcacgcgcctcttcgaaaatacgttacgcctaaccgttcgcacgcgactaaacttcgttaatatacgcttctacttcacgaatatattactattcgttttcacgcgcgacaatcgcatcgtcaaacgccgcttttacttcttccgacgaacgaacaacctaaaaattaacgtccaacaacgtaatacccatatcatacgaacgaatcgtctcttccaattcgcgctaaatatcgctacgaatcacgatacgaccttccgtcaaaatacgatccataatatatttaccgataactccacgcaaaacgctatcgataacctaacgcaaactatcatccgaactaatcacgctatacaaatatttttccgaattaataacgcgatactacacgttcatctcaacgcgcactacgttctcgtccgacgtcaacatcacaccaaaaacgaccaattcacgcacgacttccacgttcaccgatttaacttcgt

SEQ ID NO: 36039 - DNA, 624 bp, Artificial Sequence
  chemically treated genomic DNA (Homo sapiens) CpG-island No: 36039
tgttatttaatattttttttatcgtttcgatatatagacgttcgcgagtaattttcggcgcggttttatatttcggtagaagtttagtaaagcgcgttattttattttgagtttttaggatggtttgggttttgtacgtacgcgttttttcgaggatacgttgcgtttgatcgttcgtacgcggttgaatttcgttggtatacgtttttgttttacgaatgtattgttgttcgtttttacgcgcggtaatcgtatcgttaaacgtcgtttttatttttttcggcggacgagtagtttggaagttgacgtttagtagcgtgatatttatgttatacggacgaatcgttttttttagttcgcgttgagtatcgttacgaattacggtacgatttttcgttagaatgcggtttatggtgtatttatcgataattttacgtagggcgttgtcggtagtttgacgtaggttgttattcgggttggttacgttatatagatattttttcggattggtgacgcggtattgtacgtttattttaacgcgtattacgttttcgttcgacgttagtattatattagaagcggttagtttacgtacggtttttacgtttatcggtttgatttcgt

SEQ ID NO: 36040 - DNA, 624 bp, Artificial Sequence
  chemically treated genomic DNA (Homo sapiens) CpG-island No: 36040
acgaaatcaaaccgataaacgtaaaaaccgtacgtaaactaaccgcttctaatataatactaacgtcgaacgaaaacgtaatacgcgttaaaataaacgtacaataccgcgtcaccaatccgaaaaaatatctatataacgtaaccaacccgaataacaacctacgtcaaactaccgacaacgccctacgtaaaattatcgataaatacaccataaaccgcattctaacgaaaaatcgtaccgtaattcgtaacgatactcaacgcgaactaaaaaaaacgattcgtccgtataacataaatatcacgctactaaacgtcaacttccaaactactcgtccgccgaaaaaaataaaaacgacgtttaacgatacgattaccgcgcgtaaaaacgaacaacaatacattcgtaaaacaaaaacgtataccaacgaaattcaaccgcgtacgaacgatcaaacgcaacgtatcctcgaaaaaacgcgtacgtacaaaacccaaaccatcctaaaaactcaaaataaaataacgcgctttactaaacttctaccgaaatataaaaccgcgccgaaaattactcgcgaacgtctatatatcgaaacgataaaaaaaatattaaataaca

SEQ ID NO: 36041 - DNA, 622 bp, Artificial Sequence
  chemically treated genomic DNA (Homo sapiens) CpG-island No: 36041
tattttttcggtttttcggggagcgttcggtagttgcggttttttttcggtattgcggcgtattgcggagtcgtttgttcgttagtttaggtcgtgcggggtttttttcgtcgtttcgcgtcgtcgtagttttttcgtttttttttgtttcgtcgggtcgtcgtttttcgcgttaggcgcgtcgcggggtatttattaatttagagtttttgacgtatatacgcgcgtttttagacggagatttcgtcgtttgttttcgttcgttattttcgttcgtttttcgcgggtttgtatttgtattattcgtatacgtagaaggtgacgcgagcgtttttagtttaggtcgtttaggcggtatttttagttttcgtggtttagttttttttttcgttttcgcgcgtcgtttaaggttttcgtacgtttatagatttgttttcgattgtttatttgtcgtggggtgttggttgttttaagttaagtttattttcgtatttcgtagttttcgtgggtttagttcggggcgtttttcgcgacgttttggagaaaagtttttttagttttagaatttaggcggaaggggaaaagtttattaagagaaagggttagagggtcggttgatggt

SEQ ID NO: 36042 - DNA, 622 bp, Artificial Sequence
  chemically treated genomic DNA (Homo sapiens) CpG-island No: 36042
accatcaaccgaccctctaaccctttctcttaataaacttttccccttccgcctaaattctaaaactaaaaaaacttttctccaaaacgtcgcgaaaaacgccccgaactaaacccacgaaaactacgaaatacgaaaataaacttaacttaaaacaaccaacaccccacgacaaataaacaatcgaaaacaaatctataaacgtacgaaaaccttaaacgacgcgcgaaaacgaaaaaaaaaactaaaccacgaaaactaaaaataccgcctaaacgacctaaactaaaaacgctcgcgtcaccttctacgtatacgaataatacaaatacaaacccgcgaaaaacgaacgaaaataacgaacgaaaacaaacgacgaaatctccgtctaaaaacgcgcgtatatacgtcaaaaactctaaattaataaataccccgcgacgcgcctaacgcgaaaaacgacgacccgacgaaacaaaaaaaaacgaaaaaactacgacgacgcgaaacgacgaaaaaaaccccgcacgacctaaactaacgaacaaacgactccgcaatacgccgcaataccgaaaaaaaaccgcaactaccgaacgctccccgaaaaaccgaaaaaata

SEQ ID NO: 36043 - DNA, 622 bp, Artificial Sequence
  chemically treated genomic DNA (Homo sapiens) CpG-island No: 36043
gttattagtcgattttttgatttttttttttagtgggttttttttttttcgtttgggttttagaattgggaagatttttttttagagcgtcgcggggagcgtttcgggttgggtttacggggattgcggaatacggggatgaatttggtttggggtagttagtattttacggtagatgaataatcgggagtagatttgtgggcgtgcggggattttaggcggcgcgcgggggcggggggaggggttgagttacgggggttagaggtgtcgtttggacggtttgagttgggggcgttcgcgttattttttacgtgtgcgagtgatgtaaatgtagattcgcgaggggcgggcgggggtggcgggcgggggtaggcgacggagttttcgtttgggagcgcgcgtgtgtgcgttaaaagttttgggttgatggatgtttcgcggcgcgtttggcgcggagagcggcgattcggcggggtagaggggggcgggaggattgcggcggcgcggggcggcgaggaaagtttcgtacggtttgggttggcgggtaggcggtttcgtagtgcgtcgtagtgtcgggaaggagtcgtagttatcgggcgtttttcgggggatcgaggagatg

SEQ ID NO: 36044 - DNA, 622 bp, Artificial Sequence
  chemically treated genomic DNA (Homo sapiens) CpG-island No: 36044
catctcctcgatcccccgaaaaacgcccgataactacgactccttcccgacactacgacgcactacgaaaccgcctacccgccaacccaaaccgtacgaaactttcctcgccgccccgcgccgccgcaatcctcccgcccccctctaccccgccgaatcgccgctctccgcgccaaacgcgccgcgaaacatccatcaacccaaaacttttaacgcacacacgcgcgctcccaaacgaaaactccgtcgcctacccccgcccgccacccccgcccgcccctcgcgaatctacatttacatcactcgcacacgtaaaaaataacgcgaacgcccccaactcaaaccgtccaaacgacacctctaacccccgtaactcaacccctccccccgcccccgcgcgccgcctaaaatccccgcacgcccacaaatctactcccgattattcatctaccgtaaaatactaactaccccaaaccaaattcatccccgtattccgcaatccccgtaaacccaacccgaaacgctccccgcgacgctctaaaaaaaaatcttcccaattctaaaacccaaacgaaaaaaaaaaaacccactaaaaaaaaaaatcaaaaaatcgactaataac

SEQ ID NO: 36045 - DNA, 547 bp, Artificial Sequence
  chemically treated genomic DNA (Homo sapiens) CpG-island No: 36045
tgcgttttcgaaaggttgtaaaaatttttttaggttgtagcgttcggttattagtcgggaagagaaatttagtagcgggggaaagttttttcgcggatgttcgttttattttttttatttatcgttttagtcgtcggatatttttgttttgagtggtgttagtattgtagtcgttttagtgcgggcgtcgtttcggttcgttttttcgggttgttttcgtttgttattttcgtttgtagcgcgcggagtggtgatttttttgagcgtgttagcggcgagaggaggggcgggaaagtggttttcggtttgtacgttgcggttttttttttttttttcgtttgttttttttttttggtgttgtagtgtcgggcggcggcgtggcgagagtattagcggtgcgtagggagttacggcgcgcgggggaggcgggattcgcgcgttattcgcggtgtttcggtaagtcgcggtgttgaggcgttgttgcggtgtgggattggggtagggggcggggaaggagagttatttttaagtggtaggtatttttgga

SEQ ID NO: 36046 - DNA, 547 bp, Artificial Sequence
  chemically treated genomic DNA (Homo sapiens) CpG-island No: 36046
tccaaaaatacctaccacttaaaaataactctccttccccgccccctaccccaatcccacaccgcaacaacgcctcaacaccgcgacttaccgaaacaccgcgaataacgcgcgaatcccgcctcccccgcgcgccgtaactccctacgcaccgctaatactctcgccacgccgccgcccgacactacaacaccaaaaaaaaaaaacaaacgaaaaaaaaaaaaaaaaccgcaacgtacaaaccgaaaaccactttcccgcccctcctctcgccgctaacacgctcaaaaaaatcaccactccgcgcgctacaaacgaaaataacaaacgaaaacaacccgaaaaaacgaaccgaaacgacgcccgcactaaaacgactacaatactaacaccactcaaaacaaaaatatccgacgactaaaacgataaataaaaaaaataaaacgaacatccgcgaaaaaactttcccccgctactaaatttctcttcccgactaataaccgaacgctacaacctaaaaaaatttttacaacctttcgaaaacgca

SEQ ID NO: 36047 - DNA, 547 bp, Artificial Sequence
  chemically treated genomic DNA (Homo sapiens) CpG-island No: 36047
tttagaagtatttattatttggaggtggtttttttttttcgttttttgttttagttttatatcgtagtagcgttttagtatcgcgatttgtcggagtatcgcgagtggcgcgcgggtttcgtttttttcgcgcgtcgtgattttttgcgtatcgttggtattttcgttacgtcgtcgttcggtattgtagtattagggggaggaggtaggcggaggagaggaggaggatcgtagcgtgtaagtcgggagttattttttcgttttttttttcgtcgttgatacgtttagaggagttattatttcgcgcgttgtaggcgagagtggtagacggaggtagttcggggaagcgagtcggagcggcgttcgtattgaggcggttgtagtgttgatattatttagggtaagggtgttcgacggttggagcggtgagtgggggaggtgaagcgggtattcgcggggagattttttttcgttgttggattttttttttcgattggtggtcgggcgttgtagtttggggaagtttttgtagtttttcggaagcgta

SEQ ID NO: 36048 - DNA, 547 bp, Artificial Sequence
  chemically treated genomic DNA (Homo sapiens) CpG-island No: 36048
tacgcttccgaaaaactacaaaaacttccccaaactacaacgcccgaccaccaatcgaaaaaaaaaatccaacaacgaaaaaaaatctccccgcgaatacccgcttcacctcccccactcaccgctccaaccgtcgaacacccttaccctaaataatatcaacactacaaccgcctcaatacgaacgccgctccgactcgcttccccgaactacctccgtctaccactctcgcctacaacgcgcgaaataataactcctctaaacgtatcaacgacgaaaaaaaaaacgaaaaaataactcccgacttacacgctacgatcctcctcctctcctccgcctacctcctccccctaatactacaataccgaacgacgacgtaacgaaaataccaacgatacgcaaaaaatcacgacgcgcgaaaaaaacgaaacccgcgcgccactcgcgatactccgacaaatcgcgatactaaaacgctactacgatataaaactaaaacaaaaaacgaaaaaaaaaaaccacctccaaataataaatacttctaaa

SEQ ID NO: 36049 - DNA, 960 bp, Artificial Sequence
  chemically treated genomic DNA (Homo sapiens) CpG-island No: 36049
tcggcgggcgatagatagcggcgggtacgcgggagtcggggtgtaggttgtaaagcggggtttttcggttgtagaagtcgttttcgtgtgtcgttttatagttgcgtacgcgttaggtaatatattttcgttgttcgtcgcggttttgcgttaaagttttttcgggatagtcgtatacgtttttcggattcggcggcgcgtacgtatttagtaatacgtagagtatatcgagggttacgtacggtagtcgcgttttgttaaatatggtttttgttcgggttgttcggtaagggcgatggattgagttgcgggacggcggtcgaggtttttgattttcgagttcgggtcggggttggcgacggtttcgagttacggttttttttagtcggaggaggagagtagtcgagggcgggttgagatcgggcggcgtttttatcgttagtaatggcgttcggggttttttttttatagttttcgcgaatattcggttagtgtcgaggcgttcgtgtgttagtcgcggtagttttgtagttttaggatttttttagtcggtacggtttgtttcggttgtttttcgttcggatttcggcgtttttttttataggcggggcgtttagattttcgttttaaggatggggatcggtagggaggaggaacgcggggtttagtttttttcgttgagtagcgtaggatcgggtagcgcgcgggttcgcgggcggggggagtgtagtaggggcggggttagggaaattttaggtcgcggcggttagttaattagcgtcgtcggttttatttttttcgatttgcggtattcgtttagaagtgcggttttcggtagtcgggcggggcgtgggggcggttttcgtttcgatttagggggttttgttttggatcgtaattgtttaggtggttttcgaattcggtttcggtatttttattaggtattgttgtttttagaga

SEQ ID NO: 36050 - DNA, 960 bp, Artificial Sequence
  chemically treated genomic DNA (Homo sapiens) CpG-island No: 36050
tctctaaaaacaacaatacctaataaaaataccgaaaccgaattcgaaaaccacctaaacaattacgatccaaaacaaaaccccctaaatcgaaacgaaaaccgcccccacgccccgcccgactaccgaaaaccgcacttctaaacgaataccgcaaatcgaaaaaaataaaaccgacgacgctaattaactaaccgccgcgacctaaaatttccctaaccccgcccctactacactccccccgcccgcgaacccgcgcgctacccgatcctacgctactcaacgaaaaaaactaaaccccgcgttcctcctccctaccgatccccatccttaaaacgaaaatctaaacgccccgcctataaaaaaaaacgccgaaatccgaacgaaaaacaaccgaaacaaaccgtaccgactaaaaaaatcctaaaactacaaaactaccgcgactaacacacgaacgcctcgacactaaccgaatattcgcgaaaactataaaaaaaaaaccccgaacgccattactaacgataaaaacgccgcccgatctcaacccgccctcgactactctcctcctccgactaaaaaaaaccgtaactcgaaaccgtcgccaaccccgacccgaactcgaaaatcaaaaacctcgaccgccgtcccgcaactcaatccatcgcccttaccgaacaacccgaacaaaaaccatatttaacaaaacgcgactaccgtacgtaaccctcgatatactctacgtattactaaatacgtacgcgccgccgaatccgaaaaacgtatacgactatcccgaaaaaactttaacgcaaaaccgcgacgaacaacgaaaatatattacctaacgcgtacgcaactataaaacgacacacgaaaacgacttctacaaccgaaaaaccccgctttacaacctacaccccgactcccgcgtacccgccgctatctatcgcccgccga

SEQ ID NO: 36051 - DNA, 960 bp, Artificial Sequence
  chemically treated genomic DNA (Homo sapiens) CpG-island No: 36051
tttttgaaagtagtaatgtttagtgggggtatcgaggtcgagttcggagattatttgagtaattgcggtttagagtaaagttttttggatcggaacgggagtcgtttttacgtttcgttcggttgtcgagagtcgtatttttgggcggatgtcgtaggtcgggagggatgaggtcgacggcgttgattggttgatcgtcgcggtttggggtttttttggtttcgtttttgttgtatttttttcgttcgcgaattcgcgcgttgttcggttttgcgttgtttagcgggaggggttggatttcgcgttttttttttttgtcggtttttatttttaaagcgagagtttggacgtttcgtttgtgggagagagcgtcgggattcggacggggagtaatcggggtaggtcgtgtcggttgaggaggttttgaggttatagagttgtcgcggttggtatacgagcgtttcggtattaatcgagtgttcgcgggggttgtgaggggagggtttcgggcgttattgttggcggtgggagcgtcgttcggttttagttcgttttcggttgtttttttttttcggttgggaggggtcgtagttcggggtcgtcgttagtttcggttcgggttcgagaattaagggtttcggtcgtcgtttcgtagtttagtttatcgtttttgtcgggtagttcgggtagagattatgtttgataagacgcggttgtcgtacgtggttttcgatgtgttttgcgtgttgttgggtacgtacgcgtcgtcgggttcgaggggcgtgtgcggttgtttcgggagggttttagcgtagagtcgcgacgggtagcgggggtgtgttgtttgacgcgtgcgtagttgtggggcgatatacgggggcggtttttgtagtcgagggatttcgttttgtagtttgtatttcggttttcgcgtgttcgtcgttgtttgtcgttcgtcgg

SEQ ID NO: 36052 - DNA, 960 bp, Artificial Sequence
  chemically treated genomic DNA (Homo sapiens) CpG-island No: 36052
ccgacgaacgacaaacaacgacgaacacgcgaaaaccgaaatacaaactacaaaacgaaatccctcgactacaaaaaccgcccccgtatatcgccccacaactacgcacgcgtcaaacaacacacccccgctacccgtcgcgactctacgctaaaaccctcccgaaacaaccgcacacgcccctcgaacccgacgacgcgtacgtacccaacaacacgcaaaacacatcgaaaaccacgtacgacaaccgcgtcttatcaaacataatctctacccgaactacccgacaaaaacgataaactaaactacgaaacgacgaccgaaacccttaattctcgaacccgaaccgaaactaacgacgaccccgaactacgacccctcccaaccgaaaaaaaaaaacaaccgaaaacgaactaaaaccgaacgacgctcccaccgccaacaataacgcccgaaaccctcccctcacaacccccgcgaacactcgattaataccgaaacgctcgtataccaaccgcgacaactctataacctcaaaacctcctcaaccgacacgacctaccccgattactccccgtccgaatcccgacgctctctcccacaaacgaaacgtccaaactctcgctttaaaaataaaaaccgacaaaaaaaaaaaacgcgaaatccaacccctcccgctaaacaacgcaaaaccgaacaacgcgcgaattcgcgaacgaaaaaaatacaacaaaaacgaaaccaaaaaaaccccaaaccgcgacgatcaaccaatcaacgccgtcgacctcatccctcccgacctacgacatccgcccaaaaatacgactctcgacaaccgaacgaaacgtaaaaacgactcccgttccgatccaaaaaactttactctaaaccgcaattactcaaataatctccgaactcgacctcgatacccccactaaacattactactttcaaaaa

SEQ ID NO: 36053 - DNA, 527 bp, Artificial Sequence
  chemically treated genomic DNA (Homo sapiens) CpG-island No: 36053
gttgtttcgtagttaggttggcgtttgtttatattcgcggtagggttacgattagtattaaggcgagtatcgttatcgtttttatcggtgtttagggagggttagcgcgcggcgtttttttttcgtttttttggaattttcgtatttttcgcgcgtttttttttgggtttggtcggtagggggattttcgttcgtttcggggcgcgcgttttttattcgtcggggtttgtcggggtttttggagttttattttagggtttcgcggtcgttggcggttttgaatatcggttttgagtttcgttttgtgttgttgttggaacggtcggcggttaggtaggaaacggttttaggattttttcgaaaggttcgtgtcgaaatttaatttcgtaatttaagggtcgtttttttgacgattttatcgtttatagaaagtggtcggcggttaggtaggggatttttttcgtagaagagtacgggtttatttttgataattcgtttttgaatagtttttagtttattataatatt

SEQ ID NO: 36054 - DNA, 527 bp, Artificial Sequence
  chemically treated genomic DNA (Homo sapiens) CpG-island No: 36054
aatattataataaactaaaaactattcaaaaacgaattatcaaaaataaacccgtactcttctacgaaaaaaatcccctacctaaccgccgaccactttctataaacgataaaatcgtcaaaaaaacgacccttaaattacgaaattaaatttcgacacgaacctttcgaaaaaatcctaaaaccgtttcctacctaaccgccgaccgttccaacaacaacacaaaacgaaactcaaaaccgatattcaaaaccgccaacgaccgcgaaaccctaaaataaaactccaaaaaccccgacaaaccccgacgaataaaaaacgcgcgccccgaaacgaacgaaaatccccctaccgaccaaacccaaaaaaaaacgcgcgaaaaatacgaaaattccaaaaaaacgaaaaaaaaacgccgcgcgctaaccctccctaaacaccgataaaaacgataacgatactcgccttaatactaatcgtaaccctaccgcgaatataaacaaacgccaacctaactacgaaacaac

SEQ ID NO: 36055 - DNA, 527 bp, Artificial Sequence
  chemically treated genomic DNA (Homo sapiens) CpG-island No: 36055
aatattataatgagttaaaagttatttaggggcgagttattagaggtgagttcgtgtttttttgcggagaagattttttatttggtcgtcggttattttttgtgggcggtggggtcgttaaggggacggtttttgggttgcggggttgggtttcgatacgggtttttcggaggggttttggggtcgttttttgtttggtcgtcggtcgttttaatagtagtataaggcgggatttagaatcggtgtttagggtcgttagcggtcgcgaggttttgagatgaggttttaaagatttcgataggtttcggcgggtgggaggcgcgcgtttcggggcgggcgggggtttttttatcggttagatttagggagaggcgcgcggagggtgcgaaggttttagaagggcggggagggggcgtcgcgcgttgattttttttgggtatcggtggggacgatggcggtgttcgttttggtgttggtcgtggttttatcgcgggtgtggatagacgttaatttgattgcgagataat

SEQ ID NO: 36056 - DNA, 527 bp, Artificial Sequence
  chemically treated genomic DNA (Homo sapiens) CpG-island No: 36056
attatctcgcaatcaaattaacgtctatccacacccgcgataaaaccacgaccaacaccaaaacgaacaccgccatcgtccccaccgatacccaaaaaaaatcaacgcgcgacgccccctccccgcccttctaaaaccttcgcaccctccgcgcgcctctccctaaatctaaccgataaaaaaacccccgcccgccccgaaacgcgcgcctcccacccgccgaaacctatcgaaatctttaaaacctcatctcaaaacctcgcgaccgctaacgaccctaaacaccgattctaaatcccgccttatactactattaaaacgaccgacgaccaaacaaaaaacgaccccaaaacccctccgaaaaacccgtatcgaaacccaaccccgcaacccaaaaaccgtccccttaacgaccccaccgcccacaaaaaataaccgacgaccaaataaaaaatcttctccgcaaaaaaacacgaactcacctctaataactcgcccctaaataacttttaactcattataatatt

SEQ ID NO: 36057 - DNA, 969 bp, Artificial Sequence
  chemically treated genomic DNA (Homo sapiens) CpG-island No: 36057
tgtcgtaatttttagtttcggagtaattagtttggttcgatagcggaggtttaagttcgttgggttcgggcgttggaatcgtttcggcggggggaagttcgggtaggacgtagtcgcgttttatagttgaggaaaattcgttgcggcgtagggtaacgtttagaagtcgagagtggtatcgcgacgcgtcggaacgcgttagtattttttatatttaagattagatttttttttttttatttaggacgtttttcgtcgttcgttcggtcgtttttcgtttttatattttttgttagttttatatatagttagataagggaagtaagttagcggcgttcggggacggagtaagcgtagtagtcgtagcgcgcggttttttttttaggtttcggcgttttagttcgtatacgtgtatgcgtatgcgtcgcgttcgggttttttagttttcggtcgtattttttcgcgtagggttagaggtcgtggggcgggttacggtgacgcgcgcggaagcgttttgcggattttcggaaatcgtttcggcggttgagaggttgcggttattgtttggtatttcgacgggaggggtttcggatcgttcggagtcggttgaattttttcggtcgcgagcgatcgtatgagtcgggggattatgttttagttcgaagcgtggttaggcgcgagttgcgtcgagacgtcggcgcgggaggcggcggttacggcgcgggacggcgggaaggcggcggttagcgggtagtcgcggttcgagatgtagtgttcggtcgagtagtgagttcgcgggggcgcggggcgcgggtcgtgggcggcgggttcggtttttttcggaagtcgggttggggtggggagtcgttagcggagggtttttgggcgtttttaattttgagtgaggtcgttggcgataaggaggaattggtagatagtttttttagtgttcgagtgtagatttttaat

SEQ ID NO: 36058 - DNA, 969 bp, Artificial Sequence
  chemically treated genomic DNA (Homo sapiens) CpG-island No: 36058
attaaaaatctacactcgaacactaaaaaaactatctaccaattcctccttatcgccaacgacctcactcaaaattaaaaacgcccaaaaaccctccgctaacgactccccaccccaacccgacttccgaaaaaaaccgaacccgccgcccacgacccgcgccccgcgcccccgcgaactcactactcgaccgaacactacatctcgaaccgcgactacccgctaaccgccgccttcccgccgtcccgcgccgtaaccgccgcctcccgcgccgacgtctcgacgcaactcgcgcctaaccacgcttcgaactaaaacataatcccccgactcatacgatcgctcgcgaccgaaaaaattcaaccgactccgaacgatccgaaacccctcccgtcgaaataccaaacaataaccgcaacctctcaaccgccgaaacgatttccgaaaatccgcaaaacgcttccgcgcgcgtcaccgtaacccgccccacgacctctaaccctacgcgaaaaaatacgaccgaaaactaaaaaacccgaacgcgacgcatacgcatacacgtatacgaactaaaacgccgaaacctaaaaaaaaaaccgcgcgctacgactactacgcttactccgtccccgaacgccgctaacttacttcccttatctaactatatataaaactaacaaaaaatataaaaacgaaaaacgaccgaacgaacgacgaaaaacgtcctaaataaaaaaaaaaaaatctaatcttaaatataaaaaatactaacgcgttccgacgcgtcgcgataccactctcgacttctaaacgttaccctacgccgcaacgaattttcctcaactataaaacgcgactacgtcctacccgaacttccccccgccgaaacgattccaacgcccgaacccaacgaacttaaacctccgctatcgaaccaaactaattactccgaaactaaaaattacgaca

SEQ ID NO: 36059 - DNA, 969 bp, Artificial Sequence
  chemically treated genomic DNA (Homo sapiens) CpG-island No: 36059
gttaaaaatttgtattcggatattgggaaaattgtttgttaatttttttttgtcgttaacggttttatttagaattgaagacgtttagggatttttcgttgacgattttttattttagttcggttttcggaggggatcgagttcgtcgtttacggttcgcgtttcgcgttttcgcggatttattgttcggtcgggtattgtatttcgggtcgcggttgttcgttggtcgtcgttttttcgtcgtttcgcgtcgtggtcgtcgtttttcgcgtcggcgtttcggcgtagttcgcgtttggttacgtttcgggttggggtatagtttttcgatttatgcggtcgttcgcggtcgaaggggtttagtcggtttcgaacgattcggagtttttttcgtcggggtgttaggtagtggtcgtagttttttagtcgtcggggcggttttcgagggttcgtagagcgttttcgcgcgcgttatcgtggttcgttttacggtttttgattttgcgcgaggaggtgcggtcggaggttgaagggttcggacgcggcgtatgcgtatatacgtgtgcgggttgaggcgtcggggtttggagggggaatcgcgcgttgcggttgttgcgtttgtttcgttttcggacgtcgttggtttgttttttttgtttagttgtgtgtgggattggtagagggtgtgagagcgggaaacgatcggacgagcggcggggagcgttttgggtgaggaggaggaagtttggttttaggtgtgaaggatgttgacgcgtttcggcgcgtcgcggtgttattttcggtttttgagcgttgttttacgtcgtagcgggttttttttagttgtgaagcgcggttgcgttttgttcgggttttttttcgtcgggacggttttaacgttcgagtttagcgggtttgggttttcgttgtcgggttaggttagttgtttcggggttgggagttacggta

SEQ ID NO: 36060 - DNA, 969 bp, Artificial Sequence
  chemically treated genomic DNA (Homo sapiens) CpG-island No: 36060
taccgtaactcccaaccccgaaacaactaacctaacccgacaacgaaaacccaaacccgctaaactcgaacgttaaaaccgtcccgacgaaaaaaaacccgaacaaaacgcaaccgcgcttcacaactaaaaaaaacccgctacgacgtaaaacaacgctcaaaaaccgaaaataacaccgcgacgcgccgaaacgcgtcaacatccttcacacctaaaaccaaacttcctcctcctcacccaaaacgctccccgccgctcgtccgatcgtttcccgctctcacaccctctaccaatcccacacacaactaaacaaaaaaaacaaaccaacgacgtccgaaaacgaaacaaacgcaacaaccgcaacgcgcgattccccctccaaaccccgacgcctcaacccgcacacgtatatacgcatacgccgcgtccgaacccttcaacctccgaccgcacctcctcgcgcaaaatcaaaaaccgtaaaacgaaccacgataacgcgcgcgaaaacgctctacgaaccctcgaaaaccgccccgacgactaaaaaactacgaccactacctaacaccccgacgaaaaaaactccgaatcgttcgaaaccgactaaaccccttcgaccgcgaacgaccgcataaatcgaaaaactataccccaacccgaaacgtaaccaaacgcgaactacgccgaaacgccgacgcgaaaaacgacgaccacgacgcgaaacgacgaaaaaacgacgaccaacgaacaaccgcgacccgaaatacaatacccgaccgaacaataaatccgcgaaaacgcgaaacgcgaaccgtaaacgacgaactcgatcccctccgaaaaccgaactaaaataaaaaatcgtcaacgaaaaatccctaaacgtcttcaattctaaataaaaccgttaacgacaaaaaaaaattaacaaacaattttcccaatatccgaatacaaatttttaac

SEQ ID NO: 36061 - DNA, 872 bp, Artificial Sequence
  chemically treated genomic DNA (Homo sapiens) CpG-island No: 36061
tcgttttttttgatattttgtcgggttatatcgaatatgtcgggataacggtattcgtttgtttgtcgtgtggttgacgtacgattcggaatattcggagaatttatttgtcgcgtcgttgtgcgttatggttggacgtttcgcggcgaattggcggcggtgtatgatcgtagtaatatataggtgcgtagttttatttacgatgataatatcggggtcggatggtggcgtatcgttatacgggtcgatcggaaatttgttatcgttacgatagcgacgggcgggtgatagaatagttaaattcggtaggtttaagttatacgtattagtatgagaaggatcgtatgattattatcgatagtttgaatcgtcgtgaagttttgtatacgtagggtgaaggcgggttgaagcgggtggtgaaaaaggaatacgcggacggtagcgttacgtagagttagtttgacgcggtgggtaggtttagggtatagacggatgtcgtaggtaggataatagaatatagttcggatgtggtgacgggttttattacgcgtattattacgtcggatggtagggatcggcgttttattataattattatagttagttaacgttagttatcgggtttgacgggattggaaatacgtcgggaatatgatgaatggggtcgtttgatttaggaaattgtttttgagcggcgatattattcgttatcgttatgataatttatatagtgatttattttgcgtaacggaagatgtaatcggtagtcggaaaattatgacgtggagtcgttacggttagttgttgagttttattgattgtttcggttatgtaattcgttatgattatgatcgttttggttaggtgagcgg

SEQ ID NO: 36062 - DNA, 872 bp, Artificial Sequence
  chemically treated genomic DNA (Homo sapiens) CpG-island No: 36062
ccgctcacctaaccaaaacgatcataatcataacgaattacataaccgaaacaatcaataaaactcaacaactaaccgtaacgactccacgtcataattttccgactaccgattacatcttccgttacgcaaaataaatcactatataaattatcataacgataacgaataatatcgccgctcaaaaacaatttcctaaatcaaacgaccccattcatcatattcccgacgtatttccaatcccgtcaaacccgataactaacgttaactaactataataattataataaaacgccgatccctaccatccgacgtaataatacgcgtaataaaacccgtcaccacatccgaactatattctattatcctacctacgacatccgtctataccctaaacctacccaccgcgtcaaactaactctacgtaacgctaccgtccgcgtattcctttttcaccacccgcttcaacccgccttcaccctacgtatacaaaacttcacgacgattcaaactatcgataataatcatacgatccttctcatactaatacgtataacttaaacctaccgaatttaactattctatcacccgcccgtcgctatcgtaacgataacaaatttccgatcgacccgtataacgatacgccaccatccgaccccgatattatcatcgtaaataaaactacgcacctatatattactacgatcatacaccgccgccaattcgccgcgaaacgtccaaccataacgcacaacgacgcgacaaataaattctccgaatattccgaatcgtacgtcaaccacacgacaaacaaacgaataccgttatcccgacatattcgatataacccgacaaaatatcaaaaaaaacga

SEQ ID NO: 36063 - DNA, 872 bp, Artificial Sequence
  chemically treated genomic DNA (Homo sapiens) CpG-island No: 36063
tcgtttatttgattaaaacggttatggttatagcgggttatataatcggaatagttagtgaagtttagtaattgatcgtaacggttttacgttatggtttttcggttgtcggttgtatttttcgttgcgtagggtaagttattgtgtggattattataacggtagcgggtgatatcgtcgtttaggggtagttttttgaattagacggttttatttattatattttcggcgtatttttagtttcgttaggttcggtggttgacgttaattggttgtggtggttatagtaaaacgtcgatttttgttattcggcgtggtgatgcgcgtgatgaggttcgttattatattcggattgtattttgttgttttgtttgcggtattcgtttgtgttttgagtttgtttatcgcgttaaattgattttgcgtgacgttgtcgttcgcgtgttttttttttattattcgttttagttcgtttttattttgcgtgtgtaggattttacggcggtttaggttgtcggtgatggttatgcggttttttttatattgatacgtgtaatttaagtttgtcgggtttagttgttttgttattcgttcgtcgttgtcgtaacggtaatagattttcggtcggttcgtgtgacggtgcgttattattcggtttcggtattattatcgtaagtaaagttgcgtatttgtgtattgttgcggttatatatcgtcgttagttcgtcgcggggcgtttagttatagcgtatagcggcgcggtaggtaaatttttcgggtatttcgggtcgtgcgttagttatacggtagatagacggatgtcgttgtttcggtatattcggtgtaattcggtagggtattaggaaaagcgg

SEQ ID NO: 36064 - DNA, 872 bp, Artificial Sequence
  chemically treated genomic DNA (Homo sapiens) CpG-island No: 36064
ccgcttttcctaataccctaccgaattacaccgaatataccgaaacaacgacatccgtctatctaccgtataactaacgcacgacccgaaatacccgaaaaatttacctaccgcgccgctatacgctataactaaacgccccgcgacgaactaacgacgatatataaccgcaacaatacacaaatacgcaactttacttacgataataataccgaaaccgaataataacgcaccgtcacacgaaccgaccgaaaatctattaccgttacgacaacgacgaacgaataacaaaacaactaaacccgacaaacttaaattacacgtatcaatataaaaaaaaccgcataaccatcaccgacaacctaaaccgccgtaaaatcctacacacgcaaaataaaaacgaactaaaacgaataataaaaaaaaaacacgcgaacgacaacgtcacgcaaaatcaatttaacgcgataaacaaactcaaaacacaaacgaataccgcaaacaaaacaacaaaatacaatccgaatataataacgaacctcatcacgcgcatcaccacgccgaataacaaaaatcgacgttttactataaccaccacaaccaattaacgtcaaccaccgaacctaacgaaactaaaaatacgccgaaaatataataaataaaaccgtctaattcaaaaaactacccctaaacgacgatatcacccgctaccgttataataatccacacaataacttaccctacgcaacgaaaaatacaaccgacaaccgaaaaaccataacgtaaaaccgttacgatcaattactaaacttcactaactattccgattatataacccgctataaccataaccgttttaatcaaataaacga

SEQ ID NO: 36065 - DNA, 539 bp, Artificial Sequence
  chemically treated genomic DNA (Homo sapiens) CpG-island No: 36065
gcggtcgtgttagattcggtgttgcgggttcggtgtaggatgtaggtcgtgaggttttaggtcgagggttgcgttagcgggtttgtttcggttagtcgggcggtttcgtgtttcggcgtagtttcgttggggtttagatgttcggtttttagggtgcgaggcgcgtatttttcggggaatcgggttgcggagtaggcggttcgttttgggcggcggtggtacgagagggttatttgtttgggtgtcgagaattgtagcgttcgcggtgcgaggcgcggttcgtttcgtttcggtttttagttcggcgcgtacgtatatatttacgtcggtcggcgttcgttgttcgagttttcgtgttaggtttagattttgattaggcgcgggaggcggtgtagggattagaggattttttttttcggcgtttttttcgtttcgttcgaggttgcgaggatttttgggttcgggggtggtgagggagtttcgtttcggttgggttcgggttggggattcggtttttttgggcgggggtcgtacggttg

SEQ ID NO: 36066 - DNA, 539 bp, Artificial Sequence
  chemically treated genomic DNA (Homo sapiens) CpG-island No: 36066
caaccgtacgacccccgcccaaaaaaaccgaatccccaacccgaacccaaccgaaacgaaactccctcaccacccccgaacccaaaaatcctcgcaacctcgaacgaaacgaaaaaaacgccgaaaaaaaaaatcctctaatccctacaccgcctcccgcgcctaatcaaaatctaaacctaacacgaaaactcgaacaacgaacgccgaccgacgtaaatatatacgtacgcgccgaactaaaaaccgaaacgaaacgaaccgcgcctcgcaccgcgaacgctacaattctcgacacccaaacaaataaccctctcgtaccaccgccgcccaaaacgaaccgcctactccgcaacccgattccccgaaaaatacgcgcctcgcaccctaaaaaccgaacatctaaaccccaacgaaactacgccgaaacacgaaaccgcccgactaaccgaaacaaacccgctaacgcaaccctcgacctaaaacctcacgacctacatcctacaccgaacccgcaacaccgaatctaacacgaccgc

SEQ ID NO: 36067 - DNA, 539 bp, Artificial Sequence
  chemically treated genomic DNA (Homo sapiens) CpG-island No: 36067
tagtcgtgcggttttcgtttagggaggtcgagtttttagttcgggtttagtcgggacgaagtttttttattattttcgagtttaggggttttcgtagtttcgggcggggcgaggggaacgtcgggggagggggttttttagtttttgtatcgtttttcgcgtttagttaaggtttgggtttggtacgggggttcgggtagcgggcgtcggtcggcgtgggtatgtgcgtgcgcgtcgggttgggggtcgggacgggacgggtcgcgtttcgtatcgcggacgttgtagttttcggtatttaggtagatggttttttcgtgttatcgtcgtttagagcgggtcgtttgtttcgtagttcggtttttcggggagtgcgcgtttcgtattttgagggtcgggtatttggattttagcggagttgcgtcgggatacgggatcgttcggttggtcgggataagttcgttggcgtagttttcggtttggggttttacggtttgtattttgtatcgggttcgtagtatcgaatttagtacgatcgt

SEQ ID NO: 36068 - DNA, 539 bp, Artificial Sequence
  chemically treated genomic DNA (Homo sapiens) CpG-island No: 36068
acgatcgtactaaattcgatactacgaacccgatacaaaatacaaaccgtaaaaccccaaaccgaaaactacgccaacgaacttatcccgaccaaccgaacgatcccgtatcccgacgcaactccgctaaaatccaaatacccgaccctcaaaatacgaaacgcgcactccccgaaaaaccgaactacgaaacaaacgacccgctctaaacgacgataacacgaaaaaaccatctacctaaataccgaaaactacaacgtccgcgatacgaaacgcgacccgtcccgtcccgacccccaacccgacgcgcacgcacatacccacgccgaccgacgcccgctacccgaacccccgtaccaaacccaaaccttaactaaacgcgaaaaacgatacaaaaactaaaaaaccccctcccccgacgttcccctcgccccgcccgaaactacgaaaacccctaaactcgaaaataataaaaaaacttcgtcccgactaaacccgaactaaaaactcgacctccctaaacgaaaaccgcacgacta

SEQ ID NO: 36069 - DNA, 712 bp, Artificial Sequence
  chemically treated genomic DNA (Homo sapiens) CpG-island No: 36069
ggacgatcggataggttttagtcgcgttaggtgtcgtttgggttggggttcgagacgcgtagggtgcgggagtcgtgtgcggttcgaggttagcgtcgtgtttcgaggtaggtgaggggatcggaatgttatttacgacgttcgtaggtttcgatattttaaggaggcgcgcgaggtttttggggagttcgttttaggtttcgttcgggtagtcgggtcggttcgtaggtttcggtcgcgagcgggcgcgtagggggaggggagggggcggtagcggtagtttcgttgattgggcggcgtttttataagttcgattttattcgttttgaatttcgaagagtgagagaagggaacgcgcgcgttcggtgggggaaggggtgcgcgcgtattcggggtttagtcgtacgcgggtcggcgcgaggcgttcggtcgtacgcgcggtcgcgggggcgcgcgcggtgggggtgtgaggaggaggaggcggcggcggaataggtcggggtaggtcgcgttcgttgtttttttttttgaagagagacgcggggggaggggggtgcggcgagcggttcgttttttttttatcgtttcgtcgtattttaggtgtaatgagggttagttagtttattttaattggtcgcgaggggcgcggggtacggtattagtgcgttggggtgggcggcgggtagcgcgagagaaggaggaggaggtggtt

SEQ ID NO: 36070 - DNA, 712 bp, Artificial Sequence
  chemically treated genomic DNA (Homo sapiens) CpG-island No: 36070
aaccacctcctcctccttctctcgcgctacccgccgcccaccccaacgcactaataccgtaccccgcgcccctcgcgaccaattaaaataaactaactaaccctcattacacctaaaatacgacgaaacgataaaaaaaaaacgaaccgctcgccgcacccccctccccccgcgtctctcttcaaaaaaaaaaacaacgaacgcgacctaccccgacctattccgccgccgcctcctcctcctcacacccccaccgcgcgcgcccccgcgaccgcgcgtacgaccgaacgcctcgcgccgacccgcgtacgactaaaccccgaatacgcgcgcaccccttcccccaccgaacgcgcgcgttcccttctctcactcttcgaaattcaaaacgaataaaatcgaacttataaaaacgccgcccaatcaacgaaactaccgctaccgccccctcccctccccctacgcgcccgctcgcgaccgaaacctacgaaccgacccgactacccgaacgaaacctaaaacgaactccccaaaaacctcgcgcgcctccttaaaatatcgaaacctacgaacgtcgtaaataacattccgatcccctcacctacctcgaaacacgacgctaacctcgaaccgcacacgactcccgcaccctacgcgtctcgaaccccaacccaaacgacacctaacgcgactaaaacctatccgatcgtcc

SEQ ID NO: 36071 - DNA, 712 bp, Artificial Sequence
  chemically treated genomic DNA (Homo sapiens) CpG-island No: 36071
ggttatttttttttttttttttcgcgttgttcgtcgtttattttagcgtattagtatcgtgtttcgcgtttttcgcggttagttggggtgagttggttgatttttattatatttggggtgcgacggagcggtggggagagagcgggtcgttcgtcgtattttttttttttcgcgtttttttttaggggagaaggtagcgagcgcgatttgtttcggtttatttcgtcgtcgtttttttttttttatatttttatcgcgcgcgttttcgcggtcgcgcgtgcgatcgagcgtttcgcgtcggttcgcgtgcggttgggtttcgagtgcgcgcgtatttttttttttatcgagcgcgcgcgttttttttttttatttttcggggtttagggcgggtgaagtcgggtttgtgagagcgtcgtttaattagcggagttgtcgttgtcgtttttttttttttttttgcgcgttcgttcgcggtcggggtttacgggtcggttcggttgttcgggcggggtttgaggcgggttttttaggggtttcgcgcgtttttttggagtgtcggggtttgcgggcgtcgtgggtggtatttcgatttttttatttatttcggggtacggcgttggtttcgggtcgtatacggttttcgtattttacgcgtttcgaattttaatttaggcggtatttggcgcggttgaggtttgttcgatcgttt

SEQ ID NO: 36072 - DNA, 712 bp, Artificial Sequence
  chemically treated genomic DNA (Homo sapiens) CpG-island No: 36072
aaacgatcgaacaaacctcaaccgcgccaaataccgcctaaattaaaattcgaaacgcgtaaaatacgaaaaccgtatacgacccgaaaccaacgccgtaccccgaaataaataaaaaaatcgaaataccacccacgacgcccgcaaaccccgacactccaaaaaaacgcgcgaaacccctaaaaaacccgcctcaaaccccgcccgaacaaccgaaccgacccgtaaaccccgaccgcgaacgaacgcgcaaaaaaaaaaaaaaaaacgacaacgacaactccgctaattaaacgacgctctcacaaacccgacttcacccgccctaaaccccgaaaaataaaaaaaaaaaacgcgcgcgctcgataaaaaaaaaaatacgcgcgcactcgaaacccaaccgcacgcgaaccgacgcgaaacgctcgatcgcacgcgcgaccgcgaaaacgcgcgcgataaaaatataaaaaaaaaaaaacgacgacgaaataaaccgaaacaaatcgcgctcgctaccttctcccctaaaaaaaaacgcgaaaaaaaaaaaatacgacgaacgacccgctctctccccaccgctccgtcgcaccccaaatataataaaaatcaaccaactcaccccaactaaccgcgaaaaacgcgaaacacgatactaatacgctaaaataaacgacgaacaacgcgaaaaaaaaaaaaaaaaataacc

SEQ ID NO: 36073 - DNA, 642 bp, Artificial Sequence
  chemically treated genomic DNA (Homo sapiens) CpG-island No: 36073
attcgagtttatcggcgcgttttttggttattcggtcgtgttgcggtttcggtttcgagcgacgttcggttttgggcgaggcgtcgcgtttttacgcgtaggttaaaggtaagaacgtgcggttggacggttattcgcgtcgggttatacggcgtaatagtttttgtaatggcgttacgtttacgtagcggtttattcggttgtacgagtaggtgcggttgcgtttggtggtcgtgcgtttttggttggagcggcgcgttgcgtttcggttttatcgcgtacgattcgtcgtttatgagcgtttaggatatttttaagtacgtttgttcggatttggttacgcggtcgggttattgggttaaggtattgttcgagaatttggcgttgcgcgatacggtgttggtttattgggtcgatcgttacggtcgcgtgttttatagcgtgaacgacggcgagtcggtgtttttttattgcggcgtggtcgtgggcggttcgttttgggcgtttattgatgtttacggtattatcgacgaggtgtagtttttgggtaggtcgcgggcgcggcgttttttggggatttggtagcggtgtttttgcgcgtgggtgtgtgttttattagtagttatagttatttatggagag

SEQ ID NO: 36074 - DNA, 642 bp, Artificial Sequence
  chemically treated genomic DNA (Homo sapiens) CpG-island No: 36074
ctctccataaataactataactactaataaaacacacacccacgcgcaaaaacaccgctaccaaatccccaaaaaacgccgcgcccgcgacctacccaaaaactacacctcgtcgataataccgtaaacatcaataaacgcccaaaacgaaccgcccacgaccacgccgcaataaaaaaacaccgactcgccgtcgttcacgctataaaacacgcgaccgtaacgatcgacccaataaaccaacaccgtatcgcgcaacgccaaattctcgaacaataccttaacccaataacccgaccgcgtaaccaaatccgaacaaacgtacttaaaaatatcctaaacgctcataaacgacgaatcgtacgcgataaaaccgaaacgcaacgcgccgctccaaccaaaaacgcacgaccaccaaacgcaaccgcacctactcgtacaaccgaataaaccgctacgtaaacgtaacgccattacaaaaactattacgccgtataacccgacgcgaataaccgtccaaccgcacgttcttacctttaacctacgcgtaaaaacgcgacgcctcgcccaaaaccgaacgtcgctcgaaaccgaaaccgcaacacgaccgaataaccaaaaaacgcgccgataaactcgaat

SEQ ID NO: 36075 - DNA, 642 bp, Artificial Sequence
  chemically treated genomic DNA (Homo sapiens) CpG-island No: 36075
ttttttataagtgattgtggttattaatgaaatatatatttacgcgtaaaggtatcgttgttaggtttttagggggcgtcgcgttcgcgatttatttagaagttgtatttcgtcggtgatgtcgtagatattaatgagcgtttagagcgggtcgtttacggttacgtcgtagtggaagagtatcggttcgtcgtcgtttacgttgtagaatacgcggtcgtggcggtcggtttagtaggttagtatcgtgtcgcgtagcgttaggttttcgggtagtgttttggtttagtagttcggtcgcgtgattaggttcgggtaggcgtatttggggatgttttgggcgtttatgagcgacggatcgtgcgcggtgaagtcgaagcgtagcgcgtcgttttagttaggggcgtacggttattaggcgtagtcgtatttgttcgtatagtcggatgggtcgttgcgtgaacgtgacgttattgtagaagttgttgcgtcgtgtggttcggcgcgagtggtcgtttagtcgtacgtttttgtttttggtttgcgcgtggaagcgcggcgtttcgtttaggatcgggcgtcgttcggggtcggggtcgtagtacggtcgggtggttaggaggcgcgtcggtgggttcgggt

SEQ ID NO: 36076 - DNA, 642 bp, Artificial Sequence
  chemically treated genomic DNA (Homo sapiens) CpG-island No: 36076
acccgaacccaccgacgcgcctcctaaccacccgaccgtactacgaccccgaccccgaacgacgcccgatcctaaacgaaacgccgcgcttccacgcgcaaaccaaaaacaaaaacgtacgactaaacgaccactcgcgccgaaccacacgacgcaacaacttctacaataacgtcacgttcacgcaacgacccatccgactatacgaacaaatacgactacgcctaataaccgtacgcccctaactaaaacgacgcgctacgcttcgacttcaccgcgcacgatccgtcgctcataaacgcccaaaacatccccaaatacgcctacccgaacctaatcacgcgaccgaactactaaaccaaaacactacccgaaaacctaacgctacgcgacacgatactaacctactaaaccgaccgccacgaccgcgtattctacaacgtaaacgacgacgaaccgatactcttccactacgacgtaaccgtaaacgacccgctctaaacgctcattaatatctacgacatcaccgacgaaatacaacttctaaataaatcgcgaacgcgacgccccctaaaaacctaacaacgatacctttacgcgtaaatatatatttcattaataaccacaatcacttataaaaaa

SEQ ID NO: 36077 - DNA, 515 bp, Artificial Sequence
  chemically treated genomic DNA (Homo sapiens) CpG-island No: 36077
attttcggtagtagtacgtcgttgtcgttagaaattatttgtcgtacgtcgcgaattcgttgggtgagcgggttattttgtgttttgtttattagcgttattagtttgtaatcgaggtttaaattgataggttcgattagcggaatggttttttaattgatttgttgttcgttggtttcggtgatggtgcgggttagcgtttcgaggtttttttttttcgttttcgtcgttagcggttgtttgtttattcgttagtcggtaaaattaagtagggcgttgaatagtaaaaacggtaggtgcggtattttcggtattatcgttagtacgaatataatttcggtggcggtgtagagtatcgacgggtttgttagtagttggttacgtacgttatgggcgatatcgtcgttgtcgttgacgcgggtgacgataatcgtcgtcgcggtggagagtagtagggaagggatttgcgattaaattaagagattcggttcgttcgaattggttattaggtatat

SEQ ID NO: 36078 - DNA, 515 bp, Artificial Sequence
  chemically treated genomic DNA (Homo sapiens) CpG-island No: 36078
atatacctaataaccaattcgaacgaaccgaatctcttaatttaatcgcaaatcccttccctactactctccaccgcgacgacgattatcgtcacccgcgtcaacgacaacgacgatatcgcccataacgtacgtaaccaactactaacaaacccgtcgatactctacaccgccaccgaaattatattcgtactaacgataataccgaaaataccgcacctaccgtttttactattcaacgccctacttaattttaccgactaacgaataaacaaacaaccgctaacgacgaaaacgaaaaaaaaaaacctcgaaacgctaacccgcaccatcaccgaaaccaacgaacaacaaatcaattaaaaaaccattccgctaatcgaacctatcaatttaaacctcgattacaaactaataacgctaataaacaaaacacaaaataacccgctcacccaacgaattcgcgacgtacgacaaataatttctaacgacaacgacgtactactaccgaaaat

SEQ ID NO: 36079 - DNA, 515 bp, Artificial Sequence
  chemically treated genomic DNA (Homo sapiens) CpG-island No: 36079
atgtgtttgatgattaattcgggcgaatcgggttttttggtttggtcgtagattttttttttgttgttttttatcgcggcggcgattatcgttattcgcgttagcgataacggcgatatcgtttatgacgtgcgtaattagttgttggtaagttcgtcggtgttttatatcgttatcgggattatgttcgtgttggcggtggtatcgggaatgtcgtatttgtcgtttttgttgtttagcgttttgtttggttttatcggttggcggatgagtaaatagtcgttggcggcggaggcggaagagaaaagtttcgaaacgttgattcgtattattatcgaaattagcgagtagtaggttagttgggaaattatttcgttgatcgagtttattagtttaagtttcggttataaattggtggcgttggtggataaagtatagggtaattcgtttatttagcggattcgcggcgtgcggtaggtgatttttgacggtaacggcgtgttgttgtcggagat

SEQ ID NO: 36080 - DNA, 515 bp, Artificial Sequence
  chemically treated genomic DNA (Homo sapiens) CpG-island No: 36080
atctccgacaacaacacgccgttaccgtcaaaaatcacctaccgcacgccgcgaatccgctaaataaacgaattaccctatactttatccaccaacgccaccaatttataaccgaaacttaaactaataaactcgatcaacgaaataatttcccaactaacctactactcgctaatttcgataataatacgaatcaacgtttcgaaacttttctcttccgcctccgccgccaacgactatttactcatccgccaaccgataaaaccaaacaaaacgctaaacaacaaaaacgacaaatacgacattcccgataccaccgccaacacgaacataatcccgataacgatataaaacaccgacgaacttaccaacaactaattacgcacgtcataaacgatatcgccgttatcgctaacgcgaataacgataatcgccgccgcgataaaaaacaacaaaaaaaaaatctacgaccaaaccaaaaaacccgattcgcccgaattaatcatcaaacacat

SEQ ID NO: 36081 - DNA, 738 bp, Artificial Sequence
  chemically treated genomic DNA (Homo sapiens) CpG-island No: 36081
gcgatagtcgttttttttacgcgacgttaaagataattaagttaataatataagtttttgtttgcgtagtaaattggttcgttatcgtattagggatcgtttagagcgtagtgacggtaatttttagttgcgcgtttgtagtaacgttaagcgtcgtcggtttcgttagcgggttacgtagtatttgttgaaatagtacgtttattagttttagattcgcgtttattagtagcgaaatcgttagacgcggtaataagttgtagtgaaaaattatttgttcgatgacgttaatattcggcgattaggtagtttgcgtttattggttacgcggtagcgtttgcgagaagtttatttaggtgagcgtcgtagcgataattattaatagcgttagtaataacgtcgggaaaagcgtaattcgtttatttacgttttattttcgatggcgttatttagaacgcgtataaagtgtattgtcgagagcgtcgtattataaaattagattgtaggtacgcgttgaaagcgttcggcgcggataaacggtatggtttgttatagcggcgttgttattagcgtatttatgtttttgttgttgtcgtgattaaaatagagtatattaacgtttttatacgtcgttagacgatcgatattgacggcggtattgttttagaagttggtttttttttgttaggtatttgggatgtcgtatttattaagaattttttggaataagttgtttgg

SEQ ID NO: 36082 - DNA, 738 bp, Artificial Sequence
  chemically treated genomic DNA (Homo sapiens) CpG-island No: 36082
ccaaacaacttattccaaaaaattcttaataaatacgacatcccaaatacctaacaaaaaaaaaccaacttctaaaacaataccgccgtcaatatcgatcgtctaacgacgtataaaaacgttaatatactctattttaatcacgacaacaacaaaaacataaatacgctaataacaacgccgctataacaaaccataccgtttatccgcgccgaacgctttcaacgcgtacctacaatctaattttataatacgacgctctcgacaatacactttatacgcgttctaaataacgccatcgaaaataaaacgtaaataaacgaattacgcttttcccgacgttattactaacgctattaataattatcgctacgacgctcacctaaataaacttctcgcaaacgctaccgcgtaaccaataaacgcaaactacctaatcgccgaatattaacgtcatcgaacaaataatttttcactacaacttattaccgcgtctaacgatttcgctactaataaacgcgaatctaaaactaataaacgtactatttcaacaaatactacgtaacccgctaacgaaaccgacgacgcttaacgttactacaaacgcgcaactaaaaattaccgtcactacgctctaaacgatccctaatacgataacgaaccaatttactacgcaaacaaaaacttatattattaacttaattatctttaacgtcgcgtaaaaaaaacgactatcgc

SEQ ID NO: 36083 - DNA, 738 bp, Artificial Sequence
  chemically treated genomic DNA (Homo sapiens) CpG-island No: 36083
ttaaatagtttgttttaggaaatttttgatgagtacggtattttaaatgtttggtaaggggaaattaatttttggggtagtatcgtcgttagtatcgatcgtttggcggcgtataaagacgttgatgtgttttgttttgattacgataatagtaaagatatggatgcgttaatggtaacgtcgttgtggtaggttatgtcgtttgttcgcgtcggacgtttttagcgcgtatttgtagtttggttttatggtgcgacgttttcggtaatgtattttgtgcgcgttttggataacgttatcggaggtaaagcgtgagtaaacgaattgcgtttttttcggcgttattgttggcgttgttagtgattgtcgttacggcgtttatttggatgaatttttcgtaggcgttgtcgcgtagttagtgggcgtaggttgtttggtcgtcggatattgacgttatcgagtagatgattttttattatagtttgttgtcgcgtttggcgatttcgttgttggtgggcgcgggtttggggttggtgggcgtgttgttttagtaagtgttgcgtaattcgttggcggagtcgacgacgtttggcgttgttataggcgcgtaattggggattatcgttattacgttttgggcgatttttggtgcgatggcgagttagtttgttgcgtaggtaggggtttgtgttgttggtttaattgtttttggcgtcgcgtgggggaaacggttgtcgt

SEQ ID NO: 36084 - DNA, 738 bp, Artificial Sequence
  chemically treated genomic DNA (Homo sapiens) CpG-island No: 36084
acgacaaccgtttcccccacgcgacgccaaaaacaattaaaccaacaacacaaacccctacctacgcaacaaactaactcgccatcgcaccaaaaatcgcccaaaacgtaataacgataatccccaattacgcgcctataacaacgccaaacgtcgtcgactccgccaacgaattacgcaacacttactaaaacaacacgcccaccaaccccaaacccgcgcccaccaacaacgaaatcgccaaacgcgacaacaaactataataaaaaatcatctactcgataacgtcaatatccgacgaccaaacaacctacgcccactaactacgcgacaacgcctacgaaaaattcatccaaataaacgccgtaacgacaatcactaacaacgccaacaataacgccgaaaaaaacgcaattcgtttactcacgctttacctccgataacgttatccaaaacgcgcacaaaatacattaccgaaaacgtcgcaccataaaaccaaactacaaatacgcgctaaaaacgtccgacgcgaacaaacgacataacctaccacaacgacgttaccattaacgcatccatatctttactattatcgtaatcaaaacaaaacacatcaacgtctttatacgccgccaaacgatcgatactaacgacgatactaccccaaaaattaatttccccttaccaaacatttaaaataccgtactcatcaaaaatttcctaaaacaaactatttaa

SEQ ID NO: 36085 - DNA, 540 bp, Artificial Sequence
  chemically treated genomic DNA (Homo sapiens) CpG-island No: 36085
tgcgtcgttatttgttagcgtcggggttgttcgcgtggacgcggttttttttttggcgtttgtttcgtttgaattttgtaaataaaattcgcggttttagtttcgttagtttgttgtattcgttgttttgcgagtcgtagcgcgcgttttcgggtattagagtttcgttgggcgtggggtcggagattcggattttcgtaattttgggtgttcgcggtttaatagttgatcggtttttttggatcgagggtttattgggtttttttttcgtcgtttttttgttttggtcgtagacggtgattttcggatcggttttggtcgagtttagtgtttgggtagggtttagggcgtacgggttgcgcgcgggttgtggatgtatgacgtcgaatggtttgggaattgatttggagaggagttttcggtggttaagttttcgtttcgtttttttgtcgtttttagttttatttcgcgagttcgggtattgttcggggttgggttttgggagaaagttttttcgttttgtttagtttagagggcgtt

SEQ ID NO: 36086 - DNA, 540 bp, Artificial Sequence
  chemically treated genomic DNA (Homo sapiens) CpG-island No: 36086
aacgccctctaaactaaacaaaacgaaaaaactttctcccaaaacccaaccccgaacaatacccgaactcgcgaaataaaactaaaaacgacaaaaaaacgaaacgaaaacttaaccaccgaaaactcctctccaaatcaattcccaaaccattcgacgtcatacatccacaacccgcgcgcaacccgtacgccctaaaccctacccaaacactaaactcgaccaaaaccgatccgaaaatcaccgtctacgaccaaaacaaaaaaacgacgaaaaaaaaacccaataaaccctcgatccaaaaaaaccgatcaactattaaaccgcgaacacccaaaattacgaaaatccgaatctccgaccccacgcccaacgaaactctaatacccgaaaacgcgcgctacgactcgcaaaacaacgaatacaacaaactaacgaaactaaaaccgcgaattttatttacaaaattcaaacgaaacaaacgccaaaaaaaaaaccgcgtccacgcgaacaaccccgacgctaacaaataacgacgca

SEQ ID NO: 36087 - DNA, 540 bp, Artificial Sequence
  chemically treated genomic DNA (Homo sapiens) CpG-island No: 36087
gacgttttttgagttgggtaaggcgagaggatttttttttagagtttagtttcgagtaatgttcgagttcgcgaggtggggttgggggcgataaggaggcggagcggggatttagttatcggggatttttttttaagttagtttttaaattattcggcgttatgtatttatagttcgcgcgtagttcgtgcgttttggattttatttaagtattaggttcgattagggtcggttcgaaggttatcgtttacggttagggtagaggggcggcgggaaaagggtttagtggattttcggtttaggagggtcggttagttgttgggtcgcgggtatttaaagttgcgggggttcgggttttcgattttacgtttagcggggttttagtattcgagggcgcgcgttgcgattcgtagagtagcgggtgtagtaggttggcggggttgggatcgcgagttttgtttgtaaagtttaggcggggtagacgttagggagggggtcgcgtttacgcgggtagtttcggcgttgataggtagcgacgta

SEQ ID NO: 36088 - DNA, 540 bp, Artificial Sequence
  chemically treated genomic DNA (Homo sapiens) CpG-island No: 36088
tacgtcgctacctatcaacgccgaaactacccgcgtaaacgcgaccccctccctaacgtctaccccgcctaaactttacaaacaaaactcgcgatcccaaccccgccaacctactacacccgctactctacgaatcgcaacgcgcgccctcgaatactaaaaccccgctaaacgtaaaatcgaaaacccgaacccccgcaactttaaatacccgcgacccaacaactaaccgaccctcctaaaccgaaaatccactaaacccttttcccgccgcccctctaccctaaccgtaaacgataaccttcgaaccgaccctaatcgaacctaatacttaaataaaatccaaaacgcacgaactacgcgcgaactataaatacataacgccgaataatttaaaaactaacttaaaaaaaaatccccgataactaaatccccgctccgcctccttatcgcccccaaccccacctcgcgaactcgaacattactcgaaactaaactctaaaaaaaaatcctctcgccttacccaactcaaaaaacgtc

SEQ ID NO: 36089 - DNA, 688 bp, Artificial Sequence
  chemically treated genomic DNA (Homo sapiens) CpG-island No: 36089
cgagtgggttcggagtagggttttgtcgcgaagggtttgggtttaacgttagagcgtggcgcgattttattttggttgtaacgagaggggtgaatgaagtgggcgtcggggattttttagaatcggagttttagacgcgggcgggttaggggtcgtcggaaaattgcgcgcgtttcgttttatttcgttcggtttcgcgtcgcgttttttttttttattgcgtagttttcggttgttttttgtcgtcgtcgggcggattttgtaagtttcgttgttttcgttttcgtatcgtttattttcgttttcggattggcggttttagaaatttttaggttatcggtttttcgttatcggattggttgcgttcgggtgttgaggttcggtttattttttcgggttttttgattacgcgtttgacggttttttcggggttcgggagttaatcgagggcgtttttgtcggggttgtagcggcgggaggtaaggtatggttaggtcggttgggttgtagagcgtcggtacgggtttacgtttcgggtgacgggtttttaggatgttcgggcgcggggcggtttattcgtattttttaatatttttattttcggtttgagttttttagcgtcgtgggaattattttttgttcgttgttgttggttcgtattttagtagcggtttgacgttttttttat

SEQ ID NO: 36090 - DNA, 688 bp, Artificial Sequence
  chemically treated genomic DNA (Homo sapiens) CpG-island No: 36090
ataaaaaaaacgtcaaaccgctactaaaatacgaaccaacaacaacgaacaaaaaataattcccacgacgctaaaaaactcaaaccgaaaataaaaatattaaaaaatacgaataaaccgccccgcgcccgaacatcctaaaaacccgtcacccgaaacgtaaacccgtaccgacgctctacaacccaaccgacctaaccataccttacctcccgccgctacaaccccgacaaaaacgccctcgattaactcccgaaccccgaaaaaaccgtcaaacgcgtaatcaaaaaacccgaaaaaataaaccgaacctcaacacccgaacgcaaccaatccgataacgaaaaaccgataacctaaaaatttctaaaaccgccaatccgaaaacgaaaataaacgatacgaaaacgaaaacaacgaaacttacaaaatccgcccgacgacgacaaaaaacaaccgaaaactacgcaataaaaaaaaaaaacgcgacgcgaaaccgaacgaaataaaacgaaacgcgcgcaattttccgacgacccctaacccgcccgcgtctaaaactccgattctaaaaaatccccgacgcccacttcattcacccctctcgttacaaccaaaataaaatcgcgccacgctctaacgttaaacccaaacccttcgcgacaaaaccctactccgaacccactcg

SEQ ID NO: 36091 - DNA, 688 bp, Artificial Sequence
  chemically treated genomic DNA (Homo sapiens) CpG-island No: 36091
gtggggagggcgttaggtcgttgttaggatgcgggttagtaatagcggataggaggtggtttttacggcgttgggaggtttaggtcggaggtgggggtgttgggggatgcggatgggtcgtttcgcgttcgaatattttggaagttcgttattcgaggcgtggattcgtgtcggcgttttgtagtttagtcggtttggttatgttttatttttcgtcgttgtagtttcgataggaacgttttcggttggttttcgggtttcggaaaagtcgttaggcgcgtgattaaaggattcggggaaatgggtcgggttttagtattcggacgtagttaattcggtagcggaaagtcggtggtttggagatttttggagtcgttaattcggaggcgggggtgggcggtgcgaaggcggggatagcggggtttgtagggttcgttcggcggcggtagggggtagtcgagggttgcgtagtgggggaggagaacgcgacgcggggtcggacggggtagggcggggcgcgcgtagtttttcggcggtttttggttcgttcgcgtttggagtttcgattttgggaggttttcggcgtttattttatttatttttttcgttgtagttagaatagggtcgcgttacgttttaacgttgagtttaggtttttcgcggtaagattttgtttcgggtttattcg

SEQ ID NO: 36092 - DNA, 688 bp, Artificial Sequence
  chemically treated genomic DNA (Homo sapiens) CpG-island No: 36092
cgaataaacccgaaacaaaatcttaccgcgaaaaacctaaactcaacgttaaaacgtaacgcgaccctattctaactacaacgaaaaaaataaataaaataaacgccgaaaacctcccaaaatcgaaactccaaacgcgaacgaaccaaaaaccgccgaaaaactacgcgcgccccgccctaccccgtccgaccccgcgtcgcgttctcctcccccactacgcaaccctcgactaccccctaccgccgccgaacgaaccctacaaaccccgctatccccgccttcgcaccgcccacccccgcctccgaattaacgactccaaaaatctccaaaccaccgactttccgctaccgaattaactacgtccgaatactaaaacccgacccatttccccgaatcctttaatcacgcgcctaacgacttttccgaaacccgaaaaccaaccgaaaacgttcctatcgaaactacaacgacgaaaaataaaacataaccaaaccgactaaactacaaaacgccgacacgaatccacgcctcgaataacgaacttccaaaatattcgaacgcgaaacgacccatccgcatcccccaacacccccacctccgacctaaacctcccaacgccgtaaaaaccacctcctatccgctattactaacccgcatcctaacaacgacctaacgccctccccac

SEQ ID NO: 36093 - DNA, 1262 bp, Artificial Sequence
  chemically treated genomic DNA (Homo sapiens) CpG-island No: 36093
atcgatcggtagggtttaggggcgggtggcgtgattttggtttattttcggtcgcggagacgcggcgtgattttggttaagttttcgtttttttattcgtagatttgcgcggttggatcgttcggttttcgtttcggtcgttaggcgttttgcgtcgttgtttttatttttttcggtttttttcgcgtattttattagttttacgtttacgttgtcggcgtagcggtcgtttggagtcgcgcgtttttttttttttagatgttggtttttatcgcgcgaattgggagggcgcgattcgcgaacgcggtttgcgttgcgagcgcgcggtcgtttcgtaggtcggtgtagttttacgtcgttgacgtatcgcgtttaagatggcggcgcggtcgtcgtcgggggtggcggcggtagagggggcggcggttttggcggtagcggagacggtagtcgtgacggtggtagcggcggcgcgggatttgggtttgggggaatgaggcggtcgcggcgggttagcggcggagtcgtgtagcggagaagttttttttttttgttttttttggtcgagtcgggggcgcgcgcgtacgcggtcgtttagagcgggttttttatttttcgatttttgcgattcgtatcgtatttttattcgggttcggaggatgatgaagtttaagtcgaattagattcgtatttacgacggcgacggttataagaagcgggtcgtatgtttgtgttttcgtagcgagagcgaggaggaggtgaggcggtaggttgggcgggtcggggtcgtcgggttttcggttttttcgggtggaggcgcgaggggcgcggtcgtcggaggagggtgtgttagggtcgtttcgttcgggcggaatgaagtttcgatggaattttttgaggcgaaaaaagggggaaggagaaaggacgttggggttgaggggaagcgggtttgagtgcggttgtatagggcgcgtcgggcggagggggtagtcggtttgtggtcggagcgtttcggtttcgtcgtttgttatcggggagagcggtcgcgggagaaggtagtgggttgggaagagtgcggttttcggtttaggttaacggttttgattttggaagggtcgtttcgtagttgttagttaggtatatgtgtgcggaggtcggcgtgtacgaggcgcgggtcggtttttgtggtagagaaatagtgtattttattggtaggtttggggtttgtcgagggattatatgtttgtgagtttaaagttgag

SEQ ID NO: 36094 - DNA, 1262 bp, Artificial Sequence
  chemically treated genomic DNA (Homo sapiens) CpG-island No: 36094
ctcaactttaaactcacaaacatataatccctcgacaaaccccaaacctaccaataaaatacactatttctctaccacaaaaaccgacccgcgcctcgtacacgccgacctccgcacacatatacctaactaacaactacgaaacgacccttccaaaatcaaaaccgttaacctaaaccgaaaaccgcactcttcccaacccactaccttctcccgcgaccgctctccccgataacaaacgacgaaaccgaaacgctccgaccacaaaccgactaccccctccgcccgacgcgccctatacaaccgcactcaaacccgcttcccctcaaccccaacgtcctttctccttcccccttttttcgcctcaaaaaattccatcgaaacttcattccgcccgaacgaaacgaccctaacacaccctcctccgacgaccgcgcccctcgcgcctccacccgaaaaaaccgaaaacccgacgaccccgacccgcccaacctaccgcctcacctcctcctcgctctcgctacgaaaacacaaacatacgacccgcttcttataaccgtcgccgtcgtaaatacgaatctaattcgacttaaacttcatcatcctccgaacccgaataaaaatacgatacgaatcgcaaaaatcgaaaaataaaaaacccgctctaaacgaccgcgtacgcgcgcgcccccgactcgaccaaaaaaaacaaaaaaaaaaaacttctccgctacacgactccgccgctaacccgccgcgaccgcctcattcccccaaacccaaatcccgcgccgccgctaccaccgtcacgactaccgtctccgctaccgccaaaaccgccgccccctctaccgccgccacccccgacgacgaccgcgccgccatcttaaacgcgatacgtcaacgacgtaaaactacaccgacctacgaaacgaccgcgcgctcgcaacgcaaaccgcgttcgcgaatcgcgccctcccaattcgcgcgataaaaaccaacatctaaaaaaaaaaaaacgcgcgactccaaacgaccgctacgccgacaacgtaaacgtaaaactaataaaatacgcgaaaaaaaccgaaaaaaataaaaacaacgacgcaaaacgcctaacgaccgaaacgaaaaccgaacgatccaaccgcgcaaatctacgaataaaaaaacgaaaacttaaccaaaatcacgccgcgtctccgcgaccgaaaataaaccaaaatcacgccacccgcccctaaaccctaccgatcgat

SEQ ID NO: 36095 - DNA, 1262 bp, Artificial Sequence
  chemically treated genomic DNA (Homo sapiens) CpG-island No: 36095
tttagttttgggtttatagatatataatttttcggtaaattttaaatttgttaatgaagtgtattatttttttgttataaaggtcggttcgcgtttcgtgtacgtcggttttcgtatatatgtgtttggttgataattgcggagcggtttttttaggattaaagtcgttggtttggatcgaaagtcgtattttttttagtttattgttttttttcgcggtcgtttttttcggtaataggcggcggaatcgaagcgtttcggttataagtcggttatttttttcgttcggcgcgttttgtgtagtcgtatttaaattcgtttttttttagttttaacgtttttttttttttttttttttttcgttttaggaaattttatcggaattttatttcgttcgagcggggcggttttggtatattttttttcggcggtcgcgtttttcgcgtttttattcgaaggggtcggagattcggcgatttcggttcgtttagtttgtcgttttatttttttttcgttttcgttgcggaaatataggtatgcggttcgttttttgtagtcgtcgtcgtcgtaggtgcgggtttggttcgatttgagttttattatttttcgggttcgggtgggggtgcggtgcgggtcgtaggagtcgaggggtggggagttcgttttggacggtcgcgtgcgcgcgcgttttcggttcggttaagggaagtagggagggggagttttttcgttatacggtttcgtcgttggttcgtcgcggtcgttttatttttttaggtttaggtttcgcgtcgtcgttgttatcgttacggttgtcgttttcgttgtcgttagggtcgtcgttttttttgtcgtcgttattttcgacgacgatcgcgtcgttattttgggcgcgatgcgttagcggcgtaaggttgtatcggtttgcgggacggtcgcgcgttcgtagcgtaggtcgcgttcgcgaatcgcgtttttttagttcgcgcggtggaaattagtatttgaaaggagagggacgcgcgattttaggcgatcgttacgtcggtagcgtaggcgtagaattggtggggtgcgcggaggaagtcgggggagataagaatagcggcgtaggacgtttagcggtcggagcggagatcgagcggtttagtcgcgtaagtttgcggatggggaagcggggatttggttaaggttacgtcgcgttttcgcggtcgaggatgaattaaggttacgttattcgtttttgggttttgtcggtcggt

SEQ ID NO: 36096 - DNA, 1262 bp, Artificial Sequence
  chemically treated genomic DNA (Homo sapiens) CpG-island No: 36096
accgaccgacaaaacccaaaaacgaataacgtaaccttaattcatcctcgaccgcgaaaacgcgacgtaaccttaaccaaatccccgcttccccatccgcaaacttacgcgactaaaccgctcgatctccgctccgaccgctaaacgtcctacgccgctattcttatctcccccgacttcctccgcgcaccccaccaattctacgcctacgctaccgacgtaacgatcgcctaaaatcgcgcgtccctctcctttcaaatactaatttccaccgcgcgaactaaaaaaacgcgattcgcgaacgcgacctacgctacgaacgcgcgaccgtcccgcaaaccgatacaaccttacgccgctaacgcatcgcgcccaaaataacgacgcgatcgtcgtcgaaaataacgacgacaaaaaaaacgacgaccctaacgacaacgaaaacgacaaccgtaacgataacaacgacgacgcgaaacctaaacctaaaaaaataaaacgaccgcgacgaaccaacgacgaaaccgtataacgaaaaaactccccctccctacttcccttaaccgaaccgaaaacgcgcgcgcacgcgaccgtccaaaacgaactccccacccctcgactcctacgacccgcaccgcacccccacccgaacccgaaaaataataaaactcaaatcgaaccaaacccgcacctacgacgacgacgactacaaaaaacgaaccgcatacctatatttccgcaacgaaaacgaaaaaaaaataaaacgacaaactaaacgaaccgaaatcgccgaatctccgaccccttcgaataaaaacgcgaaaaacgcgaccgccgaaaaaaaatataccaaaaccgccccgctcgaacgaaataaaattccgataaaatttcctaaaacgaaaaaaaaaaaaaaaaaaaaaaacgttaaaactaaaaaaaaacgaatttaaatacgactacacaaaacgcgccgaacgaaaaaaataaccgacttataaccgaaacgcttcgattccgccgcctattaccgaaaaaaacgaccgcgaaaaaaaacaataaactaaaaaaaatacgactttcgatccaaaccaacgactttaatcctaaaaaaaccgctccgcaattatcaaccaaacacatatatacgaaaaccgacgtacacgaaacgcgaaccgacctttataacaaaaaaataatacacttcattaacaaatttaaaatttaccgaaaaattatatatctataaacccaaaactaaa

SEQ ID NO: 36097 - DNA, 873 bp, Artificial Sequence
  chemically treated genomic DNA (Homo sapiens) CpG-island No: 36097
tcgggcgggatttcgggcgatagggttcggcgtttgtaagagcgagacggaggttcgggtaggtcggttgagttaattttttagagtcgaagtggaaggcgcgtttcgagcgttttttttttaggatttcggtgttttttttcgcgtttcgagttcgcgttttttttttttcgtttttagagcgtttttcgtttttttgttttttcgtagttcgttagacgagtcgatggcgcggtttcggagagttcgggagtcgttgttcgtggcgttgttgtcgttggcgtggttggcgtaggcgggtttggcgcgcgcggcgggttttgtgcgtttggcgggcggtttgacgttgggcggtttgttttcggtgtacgcgcggggcgcggcgggtcgggcgtgcgggtagttgaagaaggagtagggcgtgtatcggttggaggttatgttgtacgcgttggatcgcgttaacgtcgatttcgagttgttgttcggcgtgcgtttgggcgcgcggttgttggatatttgttcgcgggatatttacgcgttggagtaggcgttgagtttcgtgtaggcgttgattcgcggtcgcggcgacggcgacgaggtgggcgtgcgttgttcgggaggcgttttttcgttgcgtttcgcgtttttcgagcgcgtcgtggtcgtcgtgggcgtttcggttagtttcgtttttattatggtcgttaacgtgttgcgtttgtttgcggtgagggtcgcggggtcgggttcggtgtttagcgtttttttttcgttttcgttttggggtggtttaagttttttttttttattttttttgaaagagttttcgttttaattattcgaatttatatagcgttaaagaagttttgt

SEQ ID NO: 36098 - DNA, 873 bp, Artificial Sequence
  chemically treated genomic DNA (Homo sapiens) CpG-island No: 36098
acaaaacttctttaacgctatataaattcgaataattaaaacgaaaactctttcaaaaaaaataaaaaaaaaaaacttaaaccaccccaaaacgaaaacgaaaaaaaaacgctaaacaccgaacccgaccccgcgaccctcaccgcaaacaaacgcaacacgttaacgaccataataaaaacgaaactaaccgaaacgcccacgacgaccacgacgcgctcgaaaaacgcgaaacgcaacgaaaaaacgcctcccgaacaacgcacgcccacctcgtcgccgtcgccgcgaccgcgaatcaacgcctacacgaaactcaacgcctactccaacgcgtaaatatcccgcgaacaaatatccaacaaccgcgcgcccaaacgcacgccgaacaacaactcgaaatcgacgttaacgcgatccaacgcgtacaacataacctccaaccgatacacgccctactccttcttcaactacccgcacgcccgacccgccgcgccccgcgcgtacaccgaaaacaaaccgcccaacgtcaaaccgcccgccaaacgcacaaaacccgccgcgcgcgccaaacccgcctacgccaaccacgccaacgacaacaacgccacgaacaacgactcccgaactctccgaaaccgcgccatcgactcgtctaacgaactacgaaaaaacaaaaaaacgaaaaacgctctaaaaacgaaaaaaaaaaaacgcgaactcgaaacgcgaaaaaaaacaccgaaatcctaaaaaaaaaacgctcgaaacgcgccttccacttcgactctaaaaaattaactcaaccgacctacccgaacctccgtctcgctcttacaaacgccgaaccctatcgcccgaaatcccgcccga

SEQ ID NO: 36099 - DNA, 873 bp, Artificial Sequence
  chemically treated genomic DNA (Homo sapiens) CpG-island No: 36099
atagggtttttttgacgttgtgtgaattcgagtgattaaaacggagatttttttagaagaagtaaaggaaggagatttgggttattttagggcgaggacgggagagggacgttggatatcgagttcggtttcgcggtttttatcgtaaataggcgtagtacgttggcgattatgatggagacggagttggtcgaggcgtttacgacggttacgacgcgttcggggggcgcggggcgtagcggagggacgtttttcgggtagcgtacgtttatttcgtcgtcgtcgtcgcggtcgcggattagcgtttgtacgaagtttagcgtttgttttagcgcgtaggtgtttcgcgagtaggtgtttagtagtcgcgcgtttaggcgtacgtcgggtagtagttcggggtcggcgttgacgcggtttagcgcgtatagtatggtttttagtcggtgtacgttttgttttttttttagttgttcgtacgttcggttcgtcgcgtttcgcgcgtgtatcgggaataggtcgtttagcgttaggtcgttcgttaggcgtatagagttcgtcgcgcgcgttaggttcgtttgcgttagttacgttagcggtagtagcgttacgagtagcggttttcgggtttttcggggtcgcgttatcggttcgtttagcgggttgcggggagatagaggggcggggagcgttttgagggcgggggaaggagagcgcgggttcggggcgcggggagggatatcggggttttggggagaaggcgttcggggcgcgttttttatttcggttttggggagttagtttagtcggtttgttcgggttttcgtttcgtttttataagcgtcgaattttgtcgttcggggtttcgttcga

SEQ ID NO: 36100 - DNA, 873 bp, Artificial Sequence
  chemically treated genomic DNA (Homo sapiens) CpG-island No: 36100
tcgaacgaaaccccgaacgacaaaattcgacgcttataaaaacgaaacgaaaacccgaacaaaccgactaaactaactccccaaaaccgaaataaaaaacgcgccccgaacgccttctccccaaaaccccgatatccctccccgcgccccgaacccgcgctctccttcccccgccctcaaaacgctccccgcccctctatctccccgcaacccgctaaacgaaccgataacgcgaccccgaaaaacccgaaaaccgctactcgtaacgctactaccgctaacgtaactaacgcaaacgaacctaacgcgcgcgacgaactctatacgcctaacgaacgacctaacgctaaacgacctattcccgatacacgcgcgaaacgcgacgaaccgaacgtacgaacaactaaaaaaaaaacaaaacgtacaccgactaaaaaccatactatacgcgctaaaccgcgtcaacgccgaccccgaactactacccgacgtacgcctaaacgcgcgactactaaacacctactcgcgaaacacctacgcgctaaaacaaacgctaaacttcgtacaaacgctaatccgcgaccgcgacgacgacgacgaaataaacgtacgctacccgaaaaacgtccctccgctacgccccgcgccccccgaacgcgtcgtaaccgtcgtaaacgcctcgaccaactccgtctccatcataatcgccaacgtactacgcctatttacgataaaaaccgcgaaaccgaactcgatatccaacgtccctctcccgtcctcgccctaaaataacccaaatctccttcctttacttcttctaaaaaaatctccgttttaatcactcgaattcacacaacgtcaaaaaaaccctat

SEQ ID NO: 36101 - DNA, 636 bp, Artificial Sequence
  chemically treated genomic DNA (Homo sapiens) CpG-island No: 36101
tatagttcgatcgcgtttttcgttttcggcgttgtggttttttttcggatatcgtaagtggtggtgtcgtagcgacgtttgggaaatgaagttcggagggataaacgttggcggtttagttagggaaattcgtcggtttttcggcgcgtaggcgtagttgcgttcggtagcgacgggaaacgtttttgaattaggtgtttcgttcgttttttgtgcggtgtggagttgcgcgtttttcgtcgaggcgggtttaggtataggttgtcggtgagggcgggttcggggcgtgcggttgtcgcggcgggattaggacgagggttggtttttgcgcgtgtttgtcgagttttcggtttcgggcgttcgagtcggggcggtttcggtaggtgaattcggtttcggagggggcgtggtttgggaagggtttggcggaggtcgggagggcgtttcgacgtcgttggatttttgggtcgtagtttgggtcggatttcgggggaaacggttttagaatagaaattgtaaaatgtcgtttcggtttagggttcggagtttttcgggcggtttttcgtttttagtgtttgtgggtttaagtttttttttatttcgtttttcggagtttaaattttagatttattcgtt

SEQ ID NO: 36102 - DNA, 636 bp, Artificial Sequence
  chemically treated genomic DNA (Homo sapiens) CpG-island No: 36102
aacgaataaatctaaaatttaaactccgaaaaacgaaataaaaaaaaacttaaacccacaaacactaaaaacgaaaaaccgcccgaaaaactccgaaccctaaaccgaaacgacattttacaatttctattctaaaaccgtttcccccgaaatccgacccaaactacgacccaaaaatccaacgacgtcgaaacgccctcccgacctccgccaaacccttcccaaaccacgccccctccgaaaccgaattcacctaccgaaaccgccccgactcgaacgcccgaaaccgaaaactcgacaaacacgcgcaaaaaccaaccctcgtcctaatcccgccgcgacaaccgcacgccccgaacccgccctcaccgacaacctatacctaaacccgcctcgacgaaaaacgcgcaactccacaccgcacaaaaaacgaacgaaacacctaattcaaaaacgtttcccgtcgctaccgaacgcaactacgcctacgcgccgaaaaaccgacgaatttccctaactaaaccgccaacgtttatccctccgaacttcatttcccaaacgtcgctacgacaccaccacttacgatatccgaaaaaaaaccacaacgccgaaaacgaaaaacgcgatcgaactata

SEQ ID NO: 36103 - DNA, 636 bp, Artificial Sequence
  chemically treated genomic DNA (Homo sapiens) CpG-island No: 36103
aacgagtaaatttaaagtttaaatttcgggaaacggagtagggggaggtttaaatttataaatattaagagcgaaaaatcgttcggagggtttcggattttgaatcgaggcggtattttgtagtttttgttttggagtcgtttttttcggagttcggtttaggttgcggtttaggagtttagcggcgtcgaagcgttttttcggttttcgttaggttttttttaggttacgtttttttcggggtcgggtttatttgtcgaggtcgtttcggttcggacgttcggagtcggggattcggtagatacgcgtagaggttagttttcgttttggtttcgtcgcggtagtcgtacgtttcgggttcgtttttatcggtagtttgtatttgggttcgtttcggcggggggcgcgtagttttatatcgtataagaggcgagcggaatatttaatttagagacgtttttcgtcgttgtcgggcgtaattgcgtttgcgcgtcggagagtcgacgggtttttttggttgaatcgttagcgtttgttttttcggattttattttttagacgtcgttgcggtattattatttacggtgttcgagagagaattatagcgtcgagagcggagaacgcggtcgggttgtg

SEQ ID NO: 36104 - DNA, 636 bp, Artificial Sequence
  chemically treated genomic DNA (Homo sapiens) CpG-island No: 36104
cacaacccgaccgcgttctccgctctcgacgctataattctctctcgaacaccgtaaataataataccgcaacgacgtctaaaaaataaaatccgaaaaaacaaacgctaacgattcaaccaaaaaaacccgtcgactctccgacgcgcaaacgcaattacgcccgacaacgacgaaaaacgtctctaaattaaatattccgctcgcctcttatacgatataaaactacgcgccccccgccgaaacgaacccaaatacaaactaccgataaaaacgaacccgaaacgtacgactaccgcgacgaaaccaaaacgaaaactaacctctacgcgtatctaccgaatccccgactccgaacgtccgaaccgaaacgacctcgacaaataaacccgaccccgaaaaaaacgtaacctaaaaaaaacctaacgaaaaccgaaaaaacgcttcgacgccgctaaactcctaaaccgcaacctaaaccgaactccgaaaaaaacgactccaaaacaaaaactacaaaataccgcctcgattcaaaatccgaaaccctccgaacgatttttcgctcttaatatttataaatttaaacctccccctactccgtttcccgaaatttaaactttaaatttactcgtt

SEQ ID NO: 36105 - DNA, 2165 bp, Artificial Sequence
  chemically treated genomic DNA (Homo sapiens) CpG-island No: 36105
tacgcggggtgcggggtggcggtgatacggaggtaagttaggttagtattttttcggttggtaacggttttattgtataggtgcggggcgtcggggttcgcgcgtttagtttttttcggtttgttcgattttgacgtcgttagttagtaagtgttcgtcgtgttatttttttatgtgtttttttagggtgttgtagacgttgaagggtatttggtagatgtcgtagcggtatatttttttgtcgatttgttcgtgcgtttttatgtggcgcgtgagtttgttgttttgcgcgtacgcgtagttgtatagttcgtatttgtaaggtcgttcgtcggtgtggtttcgtcggtgtatcgttaagttgttgtagtttttgaatattttgtcgtagtattcgtacgtgtcgttgcggcggttttttttggagttgggtcgttcggggttcgggtcgtttaggtgcggggtgttgttttcgttggtcgtgtcgttgcggttcgagaggtcgtcgtttagtaggttttcgggcggcgtggagaagcgtaggttgtcgttttcggacgagtgttcggacgacgtggcgaagggcgattgtcgtgcgttcgtgaagtttaggaaggggttttttatgaagtgtcgcgacgtcgcgtagtttattagttattgcgagtatacgttttcggacgggatgagcgcggcgggcggtagttttaggtttttttttattttgatgcgtttggcggcgttgttgagttcggggttgggtagcggcgcgggtttgcgcgggaagagttcggggaagggttcggtgtttggcgcgaagtcgttttcgcgttcgttgatcgcgtcgttcgcgttcgcgttttcgtagtcgttcgcgtcgtcgtcgtcgttcgcgttttcgtcgttcgtcgtacgttttaggaaggcgtcgcgtttttgtttgtcggttaggagttcgtcgtattgcggtagtgcgtttaggtttacgttttttatgattttgtttagtattagcgttttttcgttagttagcgttttggtcgcgtcgtttttcgcgttcgggatttcgggtattttattatcgtcgttttcgcggttgcggtttagtttcgagtttatgttgaagttcgattcgggtcggttttcgttttttagtagtagttttttttttttttttttttttttttcgtttttttttttcggttcgtggtttagcgacgggtcgttttcgtggtggcggaagttatcgtcggtcgttttgaggttttcgttcgttagttcgttggtgtcgggttcgggggagttggcggtcgagagttcgtcgtcggagcggtcggttagcgagtcggttttgtgtatgtgcgtttttatgtggcgtttgagtttgttggtttgcgagtacgcgtggtcgtatagttggtatttgtagggtttttcgttcgtgtgattgcgtcggtgtacgatgagattgttttggaatttgaaggttttgtcgtagaattcgtacgatttgtttttggttggcggttgcgggggcggcgtgtcgttagggggtatgggcggtagcggcggcgtgtttaggaacggggatttggggttgggttggaaggggtttaggagtcggtgtatagggttgtcgcggttcggggatacgggcggcggcgtggagttgttgttcgttagttcgcggagtcgtcgcgagaagtttatggcgggcgagtcgatggttatggggtttaggcgtatgattcggtcgaaggtattggggtgttgggcgacgagttttattttttcggtattgaggcggtgcgggtttaggtggtggcgcggcgggggattgaagagaggcggcgtgttcggtaggcggttttcgtcgaagttcgggtggtttcgtaggatggggttcgttatgcgtagtaggttgaaggggttgttgtcgtttaggaaatttatgagcggggattgcgttacggttttcggttcgagcggcggcgggatggtgagtcgcggcgtgagcgagttgttggtcggttcgggttttaggtagatgcggaagtcgtgcgtgttttgcgcgtgttgtagtaggaattacgcgttgttgaagggttgtttgtatgttgtgtaaatgtagttggaaggtttatttttatttggggaaatatacg

SEQ ID NO: 36106 - DNA, 2165 bp, Artificial Sequence
  chemically treated genomic DNA (Homo sapiens) CpG-island No: 36106
cgtatatttccccaaataaaaataaaccttccaactacatttacacaacatacaaacaacccttcaacaacgcgtaattcctactacaacacgcgcaaaacacgcacgacttccgcatctacctaaaacccgaaccgaccaacaactcgctcacgccgcgactcaccatcccgccgccgctcgaaccgaaaaccgtaacgcaatccccgctcataaatttcctaaacgacaacaaccccttcaacctactacgcataacgaaccccatcctacgaaaccacccgaacttcgacgaaaaccgcctaccgaacacgccgcctctcttcaatcccccgccgcgccaccacctaaacccgcaccgcctcaataccgaaaaaataaaactcgtcgcccaacaccccaataccttcgaccgaatcatacgcctaaaccccataaccatcgactcgcccgccataaacttctcgcgacgactccgcgaactaacgaacaacaactccacgccgccgcccgtatccccgaaccgcgacaaccctatacaccgactcctaaaccccttccaacccaaccccaaatccccgttcctaaacacgccgccgctaccgcccataccccctaacgacacgccgcccccgcaaccgccaaccaaaaacaaatcgtacgaattctacgacaaaaccttcaaattccaaaacaatctcatcgtacaccgacgcaatcacacgaacgaaaaaccctacaaataccaactatacgaccacgcgtactcgcaaaccaacaaactcaaacgccacataaaaacgcacatacacaaaaccgactcgctaaccgaccgctccgacgacgaactctcgaccgccaactcccccgaacccgacaccaacgaactaacgaacgaaaacctcaaaacgaccgacgataacttccgccaccacgaaaacgacccgtcgctaaaccacgaaccgaaaaaaaaaaacgaaaaaaaaaaaaaaaaaaaaaaaaaactactactaaaaaacgaaaaccgacccgaatcgaacttcaacataaactcgaaactaaaccgcaaccgcgaaaacgacgataataaaatacccgaaatcccgaacgcgaaaaacgacgcgaccaaaacgctaactaacgaaaaaacgctaatactaaacaaaatcataaaaaacgtaaacctaaacgcactaccgcaatacgacgaactcctaaccgacaaacaaaaacgcgacgccttcctaaaacgtacgacgaacgacgaaaacgcgaacgacgacgacgacgcgaacgactacgaaaacgcgaacgcgaacgacgcgatcaacgaacgcgaaaacgacttcgcgccaaacaccgaacccttccccgaactcttcccgcgcaaacccgcgccgctacccaaccccgaactcaacaacgccgccaaacgcatcaaaataaaaaaaaacctaaaactaccgcccgccgcgctcatcccgtccgaaaacgtatactcgcaataactaataaactacgcgacgtcgcgacacttcataaaaaaccccttcctaaacttcacgaacgcacgacaatcgcccttcgccacgtcgtccgaacactcgtccgaaaacgacaacctacgcttctccacgccgcccgaaaacctactaaacgacgacctctcgaaccgcaacgacacgaccaacgaaaacaacaccccgcacctaaacgacccgaaccccgaacgacccaactccaaaaaaaaccgccgcaacgacacgtacgaatactacgacaaaatattcaaaaactacaacaacttaacgatacaccgacgaaaccacaccgacgaacgaccttacaaatacgaactatacaactacgcgtacgcgcaaaacaacaaactcacgcgccacataaaaacgcacgaacaaatcgacaaaaaaatataccgctacgacatctaccaaatacccttcaacgtctacaacaccctaaaaaaacacataaaaaaataacacgacgaacacttactaactaacgacgtcaaaatcgaacaaaccgaaaaaaactaaacgcgcgaaccccgacgccccgcacctatacaataaaaccgttaccaaccgaaaaaatactaacctaacttacctccgtatcaccgccaccccgcaccccgcgta

SEQ ID NO: 36107 - DNA, 2165 bp, Artificial Sequence
  chemically treated genomic DNA (Homo sapiens) CpG-island No: 36107
cgtgtgtttttttaggtaaagatgagttttttagttatatttgtataatatgtaagtagttttttaatagcgcgtggtttttgttgtagtacgcgtagaatacgtacggttttcgtatttatttggagttcgggtcggttagtagttcgtttacgtcgcggtttattatttcgtcgtcgttcgggtcggaggtcgtggcgtagttttcgtttatgaattttttgggcgatagtaatttttttaatttgttgcgtatgacgggttttattttgcgggattattcgggtttcggcgagggtcgtttgtcgggtacgtcgtttttttttagtttttcgtcgcgttattatttggattcgtatcgttttagtgtcgaggagatggggttcgtcgtttagtattttagtgttttcgatcgagttatgcgtttgaattttatggttatcgattcgttcgttatggatttttcgcggcggtttcgcgagttggcgggtaatagttttacgtcgtcgttcgtgttttcgggtcgcggtaattttatgtatcggtttttgaattttttttagtttagttttaagttttcgtttttgagtacgtcgtcgttgtcgtttatgttttttggcggtacgtcgttttcgtagtcgttagttaagagtaagtcgtgcgagttttgcggtaagatttttaagttttagagtaattttatcgtgtatcggcgtagttatacgggcgagaagttttataagtgttagttgtgcgattacgcgtgttcgtaggttagtaagtttaagcgttatatgaagacgtatatgtataaggtcggttcgttggtcggtcgtttcgacgacgggttttcggtcgttagttttttcgagttcggtattagcgagttggcgggcgagggttttaaggcggtcgacggtgattttcgttattacgagagcgattcgtcgttgggttacgagtcggaggaggaggacgaggaggaggaggaggaggaggaggagttgttattggagaacgagagtcggttcgagtcgagttttagtatggattcggagttgagtcgtaatcgcgagaacggcggtggtggggtgttcggggtttcgggcgcggggggcggcgcggttaaggcgttggttgacgagaaggcgttggtgttgggtaaggttatggagaacgtgggtttaggcgtattgtcgtagtacggcgagtttttggtcgataagtagaagcgcggcgtttttttgaagcgtgcggcgggcggcggggacgcgggcgacgacgacgacgcgggcggttgcggggacgcgggcgcgggcggcgcggttaacgggcgcgggggcggtttcgcgttaggtatcgagttttttttcgggtttttttcgcgtaagttcgcgtcgttgtttagtttcgggtttaatagcgtcgttaagcgtattaaggtggagaaggatttggagttgtcgttcgtcgcgtttatttcgttcgagaacgtgtattcgtagtggttggtgggttacgcggcgtcgcggtattttatgaaggatttttttttgggttttacggacgtacgatagtcgtttttcgttacgtcgttcgagtattcgttcgagaacggtagtttgcgtttttttacgtcgttcggggatttgttggacggcggtttttcgggtcgtagcggtacggttagcggaggtagtatttcgtatttgggcggttcgggtttcgggcggtttagttttaaggagggtcgtcgtagcgatacgtgcgagtattgcggtaaggtgtttaagaattgtagtaatttgacggtgtatcggcggagttatatcggcgagcggttttataagtgcgagttgtgtaattacgcgtgcgcgtagagtagtaagtttacgcgttatatgaagacgtacgggtagatcggtaaggaggtgtatcgttgcgatatttgttagatgttttttagcgtttatagtattttggagaaatatatgaaaaagtggtacggcgagtatttgttgattaacgacgttaaaatcgagtaggtcgagaggagttaagcgcgcgggtttcggcgtttcgtatttgtatagtggaatcgttgttaatcgagagaatgttgatttgatttgttttcgtgttatcgttatttcgtatttcgcgtg

SEQ ID NO: 36108 - DNA, 2165 bp, Artificial Sequence
  chemically treated genomic DNA (Homo sapiens) CpG-island No: 36108
cacgcgaaatacgaaataacgataacacgaaaacaaatcaaatcaacattctctcgattaacaacgattccactatacaaatacgaaacgccgaaacccgcgcgcttaactcctctcgacctactcgattttaacgtcgttaatcaacaaatactcgccgtaccactttttcatatatttctccaaaatactataaacgctaaaaaacatctaacaaatatcgcaacgatacacctccttaccgatctacccgtacgtcttcatataacgcgtaaacttactactctacgcgcacgcgtaattacacaactcgcacttataaaaccgctcgccgatataactccgccgatacaccgtcaaattactacaattcttaaacaccttaccgcaatactcgcacgtatcgctacgacgaccctccttaaaactaaaccgcccgaaacccgaaccgcccaaatacgaaatactacctccgctaaccgtaccgctacgacccgaaaaaccgccgtccaacaaatccccgaacgacgtaaaaaaacgcaaactaccgttctcgaacgaatactcgaacgacgtaacgaaaaacgactatcgtacgtccgtaaaacccaaaaaaaaatccttcataaaataccgcgacgccgcgtaacccaccaaccactacgaatacacgttctcgaacgaaataaacgcgacgaacgacaactccaaatccttctccaccttaatacgcttaacgacgctattaaacccgaaactaaacaacgacgcgaacttacgcgaaaaaaacccgaaaaaaaactcgatacctaacgcgaaaccgcccccgcgcccgttaaccgcgccgcccgcgcccgcgtccccgcaaccgcccgcgtcgtcgtcgtcgcccgcgtccccgccgcccgccgcacgcttcaaaaaaacgccgcgcttctacttatcgaccaaaaactcgccgtactacgacaatacgcctaaacccacgttctccataaccttacccaacaccaacgccttctcgtcaaccaacgccttaaccgcgccgccccccgcgcccgaaaccccgaacaccccaccaccgccgttctcgcgattacgactcaactccgaatccatactaaaactcgactcgaaccgactctcgttctccaataacaactcctcctcctcctcctcctcctcctcgtcctcctcctccgactcgtaacccaacgacgaatcgctctcgtaataacgaaaatcaccgtcgaccgccttaaaaccctcgcccgccaactcgctaataccgaactcgaaaaaactaacgaccgaaaacccgtcgtcgaaacgaccgaccaacgaaccgaccttatacatatacgtcttcatataacgcttaaacttactaacctacgaacacgcgtaatcgcacaactaacacttataaaacttctcgcccgtataactacgccgatacacgataaaattactctaaaacttaaaaatcttaccgcaaaactcgcacgacttactcttaactaacgactacgaaaacgacgtaccgccaaaaaacataaacgacaacgacgacgtactcaaaaacgaaaacttaaaactaaactaaaaaaaattcaaaaaccgatacataaaattaccgcgacccgaaaacacgaacgacgacgtaaaactattacccgccaactcgcgaaaccgccgcgaaaaatccataacgaacgaatcgataaccataaaattcaaacgcataactcgatcgaaaacactaaaatactaaacgacgaaccccatctcctcgacactaaaacgatacgaatccaaataataacgcgacgaaaaactaaaaaaaaacgacgtacccgacaaacgaccctcgccgaaacccgaataatcccgcaaaataaaacccgtcatacgcaacaaattaaaaaaattactatcgcccaaaaaattcataaacgaaaactacgccacgacctccgacccgaacgacgacgaaataataaaccgcgacgtaaacgaactactaaccgacccgaactccaaataaatacgaaaaccgtacgtattctacgcgtactacaacaaaaaccacgcgctattaaaaaactacttacatattatacaaatataactaaaaaactcatctttacctaaaaaaacacacg

SEQ ID NO: 36109 - DNA, 638 bp, Artificial Sequence
  chemically treated genomic DNA (Homo sapiens) CpG-island No: 36109
ttggcgtaggtcgagcggatggtggtcgcgcgtagtttttttgtgttttgttatcgcgttttcgttcggtgggttattcgcgcgttcggttcgcggcgtatttgatatttcgggtcgggggcgggagggacgttgtttcggtcgttagttttagtttttggagttcgatatcggttttaagtttcggttcgggcggtagcgagggatgcgtttttttttcggcgcggcgatttatttgtaggcgcgatttcgggtttcggcggcgtttattttcggcggttttaggcggtttttttttatttgattttataggaagcgcgcgtcggaggggcgcggtttagtggcggcgtatatcgttttttgtaggtcgtttgaggaattgtatttgttcggtttagggttgggggcggcgcggggtgttgggggtcggggagatggagcgtgggaaggagtgggaggtggggatggagagaaaagaggatgggaggagaagatacgtggaaaagaaggagaagaaggaggagggagaaaagaaggaaaaggaagcggcgtttacggaggaaaaatttagggggtgggggcgttttggtttgggaggaagggcgggcgtaggtttagatgattagtgttatgtttgt

SEQ ID NO: 36110 - DNA, 638 bp, Artificial Sequence
  chemically treated genomic DNA (Homo sapiens) CpG-island No: 36110
acaaacataacactaatcatctaaacctacgcccgcccttcctcccaaaccaaaacgcccccaccccctaaatttttcctccgtaaacgccgcttccttttccttcttttctccctcctccttcttctccttcttttccacgtatcttctcctcccatcctcttttctctccatccccacctcccactccttcccacgctccatctccccgacccccaacaccccgcgccgcccccaaccctaaaccgaacaaatacaattcctcaaacgacctacaaaaaacgatatacgccgccactaaaccgcgcccctccgacgcgcgcttcctataaaatcaaataaaaaaaaaccgcctaaaaccgccgaaaataaacgccgccgaaacccgaaatcgcgcctacaaataaatcgccgcgccgaaaaaaaaacgcatccctcgctaccgcccgaaccgaaacttaaaaccgatatcgaactccaaaaactaaaactaacgaccgaaacaacgtccctcccgcccccgacccgaaatatcaaatacgccgcgaaccgaacgcgcgaataacccaccgaacgaaaacgcgataacaaaacacaaaaaaactacgcgcgaccaccatccgctcgacctacgccaa

SEQ ID NO: 36111 - DNA, 638 bp, Artificial Sequence
  chemically treated genomic DNA (Homo sapiens) CpG-island No: 36111
gtaaatataatattggttatttgagtttgcgttcgtttttttttttaggttagggcgtttttattttttgggtttttttttcgtggacgtcgtttttttttttttttttttttttttttttttttttttttttttttttacgtgttttttttttttatttttttttttttttatttttattttttatttttttttacgttttattttttcgatttttagtatttcgcgtcgtttttaattttgggtcgggtaggtgtaattttttaggcggtttatagagggcgatgtgcgtcgttattgggtcgcgttttttcggcgcgcgttttttgtgaggttaggtgggaggaaatcgtttggagtcgtcgggagtggacgtcgtcgaggttcggagtcgcgtttgtaggtgagtcgtcgcgtcggggagggagcgtatttttcgttgtcgttcgggtcgggatttggagtcggtgtcgggttttagaggttggggttggcggtcggggtagcgtttttttcgttttcggttcggaatgttaggtgcgtcgcgggtcgggcgcgcgggtggtttatcgggcgggggcgcgatgataaagtataaagggattgcgcgcgattattattcgttcggtttgcgttag

SEQ ID NO: 36112 - DNA, 638 bp, Artificial Sequence
  chemically treated genomic DNA (Homo sapiens) CpG-island No: 36112
ctaacgcaaaccgaacgaataataatcgcgcgcaatccctttatactttatcatcgcgcccccgcccgataaaccacccgcgcgcccgacccgcgacgcacctaacattccgaaccgaaaacgaaaaaaacgctaccccgaccgccaaccccaacctctaaaacccgacaccgactccaaatcccgacccgaacgacaacgaaaaatacgctccctccccgacgcgacgactcacctacaaacgcgactccgaacctcgacgacgtccactcccgacgactccaaacgatttcctcccacctaacctcacaaaaaacgcgcgccgaaaaaacgcgacccaataacgacgcacatcgccctctataaaccgcctaaaaaattacacctacccgacccaaaattaaaaacgacgcgaaatactaaaaatcgaaaaaataaaacgtaaaaaaaaataaaaaataaaaataaaaaaaaaaaaaaataaaaaaaaaaaacacgtaaaaaaaaaaaaaaaaaaaaaaaaaaaaaaaaaaaaaaaaaaaaaaacgacgtccacgaaaaaaaaacccaaaaaataaaaacgccctaacctaaaaaaaaaaacgaacgcaaactcaaataaccaatattatatttac

SEQ ID NO: 36113 - DNA, 592 bp, Artificial Sequence
  chemically treated genomic DNA (Homo sapiens) CpG-island No: 36113
gcgtataagttgtggttcgttatgcgtagcgtttgagttagcgtttagatgtagttgtgggcgaagcgtagcgtttcgattttggtgagtttcgcgtcgtttgggaaggtgggtaggatatcgcgtagggcgtttagtgtcgagttgaggttgtgtattcgattgcgttcgcggtcgttggttttttttcgtcgatttcgtcgttgtttgtttagtgttaattcgtttttaagtcggttgcgtttttcgcgtcgtgttcggagttttttcggggtttttcggtagtttttttttttcgtttttgcgtagttttttcgtgtgcgagtggggttgggcggggcggacgtggggtaggttatttcgtttttcgaggttttggggaaggatcgtttcgttttacgggttatttggatagtgggcgtattcgagggttgaggcgttattttacggcggggttagagggaagggtaagtttgagttcgttattgggcgtagttcgcgatttcgaggttaggtgggaaaaaataaaaatagttatttttttagttttcgttgggttagaggattttttttttttttgttcgtttttcgg

SEQ ID NO: 36114 - DNA, 592 bp, Artificial Sequence
  chemically treated genomic DNA (Homo sapiens) CpG-island No: 36114
ccgaaaaacgaacaaaaaaaaaaaaaatcctctaacccaacgaaaactaaaaaaataactatttttattttttcccacctaacctcgaaatcgcgaactacgcccaataacgaactcaaacttacccttccctctaaccccgccgtaaaataacgcctcaaccctcgaatacgcccactatccaaataacccgtaaaacgaaacgatccttccccaaaacctcgaaaaacgaaataacctaccccacgtccgccccgcccaaccccactcgcacacgaaaaaactacgcaaaaacgaaaaaaaaaaactaccgaaaaaccccgaaaaaactccgaacacgacgcgaaaaacgcaaccgacttaaaaacgaattaacactaaacaaacaacgacgaaatcgacgaaaaaaaaccaacgaccgcgaacgcaatcgaatacacaacctcaactcgacactaaacgccctacgcgatatcctacccaccttcccaaacgacgcgaaactcaccaaaatcgaaacgctacgcttcgcccacaactacatctaaacgctaactcaaacgctacgcataacgaaccacaacttatacgc

SEQ ID NO: 36115 - DNA, 592 bp, Artificial Sequence
  chemically treated genomic DNA (Homo sapiens) CpG-island No: 36115
tcgagggacgggtaggggaaagagggattttttgatttagcgggggttgggaggatggttgtttttgtttttttttatttagtttcggaatcgcggattgcgtttagtgacggatttaaatttatttttttttttgatttcgtcgtaggatgacgttttaattttcgggtgcgtttattgtttaagtgattcgtgagacggagcggtttttttttagagtttcggaagacgaagtgatttgttttacgttcgtttcgtttagttttattcgtatacgggggaattgcgtagaggcggaagagggaggttgtcgaggggtttcgaggaagtttcgggtacggcgcgggggacgtagtcggtttaagagcgagttggtattgagtaagtagcgacggagtcggcgaaagaaggttaacgatcgcgagcgtaatcgaatgtataattttaattcggtattggacgttttgcgcggtgttttgtttatttttttagacgacgcgaagtttattaagatcgagacgttgcgtttcgtttataattatatttgggcgttgatttaaacgttgcgtatagcggattatagtttgtacgt

SEQ ID NO: 36116 - DNA, 592 bp, Artificial Sequence
  chemically treated genomic DNA (Homo sapiens) CpG-island No: 36116
acgtacaaactataatccgctatacgcaacgtttaaatcaacgcccaaatataattataaacgaaacgcaacgtctcgatcttaataaacttcgcgtcgtctaaaaaaataaacaaaacaccgcgcaaaacgtccaataccgaattaaaattatacattcgattacgctcgcgatcgttaaccttctttcgccgactccgtcgctacttactcaataccaactcgctcttaaaccgactacgtcccccgcgccgtacccgaaacttcctcgaaacccctcgacaacctccctcttccgcctctacgcaattcccccgtatacgaataaaactaaacgaaacgaacgtaaaacaaatcacttcgtcttccgaaactctaaaaaaaaaccgctccgtctcacgaatcacttaaacaataaacgcacccgaaaattaaaacgtcatcctacgacgaaatcaaaaaaaaaaataaatttaaatccgtcactaaacgcaatccgcgattccgaaactaaataaaaaaaaacaaaaacaaccatcctcccaacccccgctaaatcaaaaaatccctctttcccctacccgtccctcga

SEQ ID NO: 36117 - DNA, 516 bp, Artificial Sequence
  chemically treated genomic DNA (Homo sapiens) CpG-island No: 36117
gcgtgtcgtcgaggtgtgtatttttagcgatttcgtgttcggtagcgcggacgtatttgttcgtttttttcgttagggatttaattttttgggtttgggcgagaatcgacggcggggaggggttaggtgcgtagggggcggggatagggcgcggggcggggtttacgtgggtgacgcgcggttacgtttttattttgggatatattcggaagcggcgcggcgttttcggggaagatggtttttcggggttgaaggcggtggtgggggaaagtgagtgttttttcggggtcgggttttggcgttcggtgtgggacgggggtcggggacgtacggattttgggattttgggttttatggcggttgggagttgggggtcgggttgggcgttcgagtatttgattttcgagggggcgggcggggacgggtttttagttggacgtttttgtttttcggtgttagaatagaataaaattggggggtcggatttcggggatttaaaggggacgggtagagtgt

SEQ ID NO: 36118 - DNA, 516 bp, Artificial Sequence
  chemically treated genomic DNA (Homo sapiens) CpG-island No: 36118
acactctacccgtcccctttaaatccccgaaatccgaccccccaattttattctattctaacaccgaaaaacaaaaacgtccaactaaaaacccgtccccgcccgccccctcgaaaatcaaatactcgaacgcccaacccgacccccaactcccaaccgccataaaacccaaaatcccaaaatccgtacgtccccgacccccgtcccacaccgaacgccaaaacccgaccccgaaaaaacactcactttcccccaccaccgccttcaaccccgaaaaaccatcttccccgaaaacgccgcgccgcttccgaatatatcccaaaataaaaacgtaaccgcgcgtcacccacgtaaaccccgccccgcgccctatccccgccccctacgcacctaacccctccccgccgtcgattctcgcccaaacccaaaaaattaaatccctaacgaaaaaaacgaacaaatacgtccgcgctaccgaacacgaaatcgctaaaaatacacacctcgacgacacgc

SEQ ID NO: 36119 - DNA, 516 bp, Artificial Sequence
  chemically treated genomic DNA (Homo sapiens) CpG-island No: 36119
atattttattcgttttttttgggttttcggagttcggttttttaattttgttttgttttggtatcggagagtaggggcgtttagttgggaattcgttttcgttcgttttttcgagggttaggtgttcggacgtttagttcggtttttaatttttagtcgttatgaaatttaggattttagagttcgtgcgttttcgattttcgttttatatcggacgttagagttcggtttcggagaggtatttatttttttttattatcgtttttagtttcgaggggttatttttttcgagggcgtcgcgtcgttttcgggtgtgttttaaggtgggggcgtggtcgcgcgttatttacgtggatttcgtttcgcgttttgttttcgttttttgcgtatttggttttttttcgtcgtcggttttcgtttaggtttaggaagttgagtttttggcggggaggacgggtaggtgcgttcgcgttgtcgagtacgaagtcgttggaggtgtatatttcgacgatacgt

SEQ ID NO: 36120 - DNA, 516 bp, Artificial Sequence
  chemically treated genomic DNA (Homo sapiens) CpG-island No: 36120
acgtatcgtcgaaatatacacctccaacgacttcgtactcgacaacgcgaacgcacctacccgtcctccccgccaaaaactcaacttcctaaacctaaacgaaaaccgacgacgaaaaaaaaccaaatacgcaaaaaacgaaaacaaaacgcgaaacgaaatccacgtaaataacgcgcgaccacgcccccaccttaaaacacacccgaaaacgacgcgacgccctcgaaaaaaataacccctcgaaactaaaaacgataataaaaaaaaataaatacctctccgaaaccgaactctaacgtccgatataaaacgaaaatcgaaaacgcacgaactctaaaatcctaaatttcataacgactaaaaattaaaaaccgaactaaacgtccgaacacctaaccctcgaaaaaacgaacgaaaacgaattcccaactaaacgcccctactctccgataccaaaacaaaacaaaattaaaaaaccgaactccgaaaacccaaaaaaaacgaataaaatat

SEQ ID NO: 36121 - DNA, 629 bp, Artificial Sequence
  chemically treated genomic DNA (Homo sapiens) CpG-island No: 36121
acgttgttaatacgagtgatcgtttattttggttcgattatcgattattaatcgttatttattaatgtttcggagattttaggtacgttcgtttttgggggaggggagtagggagattcgtcggacgttttattttttttacgttattttcgtaggttgtgtgtggcgttacgttcgggttagcgttttttattgtttttatttgtttttattgtgcgattttaaggacgggtatttgttggtggacgggtgttacgttaataacgttttaggttagcgagttcgtcggcggttgggttttcggcgtgtttgagcgtgtttgtgcgtgtttgtgtttgtgtgttttatcgcgtaggttttttgtggcggtacgtgcgcgttagtatgacgttgtcgggttatttgttttcgttgtgcgattttaaggacgggtatttatttatggatggcggttatattaataatttgttaggtaagtggtcgttcgtattattcgtatacgtaagtatttttcgtattatatatacgtatacgcgtgggtatatatagataggttcgatgacgggatatatgtttaagttgtttatgtaggggtgtagatatatatgcgtatatatacgattatttgt

SEQ ID NO: 36122 - DNA, 629 bp, Artificial Sequence
  chemically treated genomic DNA (Homo sapiens) CpG-island No: 36122
acaaataatcgtatatatacgcatatatatctacacccctacataaacaacttaaacatatatcccgtcatcgaacctatctatatatacccacgcgtatacgtatatataatacgaaaaatacttacgtatacgaataatacgaacgaccacttacctaacaaattattaatataaccgccatccataaataaatacccgtccttaaaatcgcacaacgaaaacaaataacccgacaacgtcatactaacgcgcacgtaccgccacaaaaaacctacgcgataaaacacacaaacacaaacacgcacaaacacgctcaaacacgccgaaaacccaaccgccgacgaactcgctaacctaaaacgttattaacgtaacacccgtccaccaacaaatacccgtccttaaaatcgcacaataaaaacaaataaaaacaataaaaaacgctaacccgaacgtaacgccacacacaacctacgaaaataacgtaaaaaaaataaaacgtccgacgaatctccctactcccctcccccaaaaacgaacgtacctaaaatctccgaaacattaataaataacgattaataatcgataatcgaaccaaaataaacgatcactcgtattaacaacgt

SEQ ID NO: 36123 - DNA, 629 bp, Artificial Sequence
  chemically treated genomic DNA (Homo sapiens) CpG-island No: 36123
gtaagtgatcgtatgtgtgcgtatgtgtgtttgtatttttgtatgggtagtttgggtatgtgtttcgttatcgagtttgtttgtgtgtgtttacgcgtgtgcgtgtgtgtggtgcgggaggtgtttgcgtgtgcgggtggtgcgggcggttatttgtttggtagattgttgatgtagtcgttatttatgagtaggtgttcgtttttggggtcgtatagcgggggtaggtagttcgatagcgttatgttggcgcgtacgtatcgttatagggagtttgcgcggtgggatatatagatataaatacgtatagatacgtttagatacgtcggaggtttagtcgtcgacgggttcgttgatttgggacgttgttaacgtagtattcgtttattagtaggtgttcgtttttggggtcgtatagtgggggtaggtaggggtagtaggaggcgttggttcggacgtaacgttatatatagtttgcggggatggcgtgaggggggtaaggcgttcgacgagtttttttgttttttttttttaaggacggacgtatttggggttttcggggtattagtgggtggcggttagtggtcggtgatcgggttagggtggacggttattcgtgttaataacgt

SEQ ID NO: 36124 - DNA, 629 bp, Artificial Sequence
  chemically treated genomic DNA (Homo sapiens) CpG-island No: 36124
acgttattaacacgaataaccgtccaccctaacccgatcaccgaccactaaccgccacccactaataccccgaaaaccccaaatacgtccgtccttaaaaaaaaaaaacaaaaaaactcgtcgaacgccttacccccctcacgccatccccgcaaactatatataacgttacgtccgaaccaacgcctcctactacccctacctacccccactatacgaccccaaaaacgaacacctactaataaacgaatactacgttaacaacgtcccaaatcaacgaacccgtcgacgactaaacctccgacgtatctaaacgtatctatacgtatttatatctatatatcccaccgcgcaaactccctataacgatacgtacgcgccaacataacgctatcgaactacctacccccgctatacgaccccaaaaacgaacacctactcataaataacgactacatcaacaatctaccaaacaaataaccgcccgcaccacccgcacacgcaaacacctcccgcaccacacacacgcacacgcgtaaacacacacaaacaaactcgataacgaaacacatacccaaactacccatacaaaaatacaaacacacatacgcacacatacgatcacttac

SEQ ID NO: 36125 - DNA, 500 bp, Artificial Sequence
  chemically treated genomic DNA (Homo sapiens) CpG-island No: 36125
agaaaaaaagagattaggagtttcgtcgttttaggtgggagatatagttcgttcgtttgagttcggggttttacggtgtcgttcgcgtttttatttgagtcgcgcggattcgtcggggttgttatgttggggcgggagcgcgtgacgggcgtcgtacggcggggtagtttgggttcgatcgttcgcgttgttattgcgatttcgttttttcgcggcgcggttttaaatttttcggtattagttgatttgtgtttcggttacgtgattcggtagtttagagttttttacgtgatcgtttttggtttcgttttttgcgttacgataatttttgtcggaatagcgcgtatgtgtttttgtcggcgttttttgggtcgaaggtagtcgttaggttttagcgtcgacgcgttttgggtggcgggggatgggttgattttgagtttggtaacgacgagttttgttttggttttcggttatgtttcgaattcggtgttaggtttgtg

SEQ ID NO: 36126 - DNA, 500 bp, Artificial Sequence
  chemically treated genomic DNA (Homo sapiens) CpG-island No: 36126
cacaaacctaacaccgaattcgaaacataaccgaaaaccaaaacaaaactcgtcgttaccaaactcaaaatcaacccatcccccgccacccaaaacgcgtcgacgctaaaacctaacgactaccttcgacccaaaaaacgccgacaaaaacacatacgcgctattccgacaaaaattatcgtaacgcaaaaaacgaaaccaaaaacgatcacgtaaaaaactctaaactaccgaatcacgtaaccgaaacacaaatcaactaataccgaaaaatttaaaaccgcgccgcgaaaaaacgaaatcgcaataacaacgcgaacgatcgaacccaaactaccccgccgtacgacgcccgtcacgcgctcccgccccaacataacaaccccgacgaatccgcgcgactcaaataaaaacgcgaacgacaccgtaaaaccccgaactcaaacgaacgaactatatctcccacctaaaacgacgaaactcctaatctctttttttct

SEQ ID NO: 36127 - DNA, 500 bp, Artificial Sequence
  chemically treated genomic DNA (Homo sapiens) CpG-island No: 36127
tataagtttggtatcggattcggggtatggtcgggagttagggtagagttcgtcgttgttaaatttagagttagtttatttttcgttatttagagcgcgtcggcgttaggatttagcgattgttttcgatttagagggcgtcggtagaggtatatgcgcgttgtttcggtaggggttgtcgtggcgtagggggcgggattagaggcggttacgtgaggggttttgggttatcgggttacgtgatcgaggtatagattagttgatgtcggagggtttgaagtcgcgtcgcgagggagcgaggtcgtagtgatagcgcgggcgatcggatttaggttgtttcgtcgtacggcgttcgttacgcgttttcgttttagtatgatagtttcggcgggttcgcgcggtttaggtgagggcgcgggcggtatcgtggggtttcgaatttaggcgggcgggttgtgttttttatttggggcggcggagtttttagttttttttttttt

SEQ ID NO: 36128 - DNA, 500 bp, Artificial Sequence
  chemically treated genomic DNA (Homo sapiens) CpG-island No: 36128
aaaaaaaaaaaaactaaaaactccgccgccccaaataaaaaacacaacccgcccgcctaaattcgaaaccccacgataccgcccgcgccctcacctaaaccgcgcgaacccgccgaaactatcatactaaaacgaaaacgcgtaacgaacgccgtacgacgaaacaacctaaatccgatcgcccgcgctatcactacgacctcgctccctcgcgacgcgacttcaaaccctccgacatcaactaatctatacctcgatcacgtaacccgataacccaaaacccctcacgtaaccgcctctaatcccgccccctacgccacgacaacccctaccgaaacaacgcgcatatacctctaccgacgccctctaaatcgaaaacaatcgctaaatcctaacgccgacgcgctctaaataacgaaaaataaactaactctaaatttaacaacgacgaactctaccctaactcccgaccataccccgaatccgataccaaacttata

SEQ ID NO: 36129 - DNA, 709 bp, Artificial Sequence
  chemically treated genomic DNA (Homo sapiens) CpG-island No: 36129
  misc_feature (606)..(606): n is either a, c, g or t
  misc_feature (674)..(674): n is either a, c, g or t
  misc_feature (690)..(690): n is either a, c, g or t
cggattgcgggcgagtttttcgtcgtagtttcgggttgagttagtatcgtcgtacgtatagcggcgagaagtcgtatcgttgtttcgattgcgggaagttttttagttacggtgttattttggtttagtatcgtggtatttatattggggcgcggtcgtattagtgcgcggtttgcggtaaggttttcggtggcgttttacgttgttgaaatatcgtagtagttatagcgaggagaagtcgtattattgttcggtgtgtggtaaggttttcgggtacggttcgtttttggtatagtatttgcgtacgtacggcggttcgcggatttataagtgttcggtgtgcgttaagggtttcggttagggttttgcgttgtttaaatatttgcgtattatacgggcgagcggttttattcgtgttcgtagtgcgtaaggttttcgggtagagttcggcgttgttgtagtattagcgtatatatacggtcgagcgttttatcgttgttttattgcggtaaagtttcgggtagagttttaatttgtaatattatttgcgtatttatacgggcgagcggtttacgtttgttcgtattgttttaagggtttcggagnagtttagcgttgttttagtatttgtacgtgtattcgggcgagcgtttttatcgttgttagttttgcgngaagatttttcgaggnttttttagtttattaagta

SEQ ID NO: 36130 - DNA, 709 bp, Artificial Sequence
  chemically treated genomic DNA (Homo sapiens) CpG-island No: 36130
  misc_feature (20)..(20): n is either a, c, g or t
  misc_feature (36)..(36): n is either a, c, g or t
  misc_feature (104)..(104): n is either a, c, g or t
tacttaataaactaaaaaancctcgaaaaatcttcncgcaaaactaacaacgataaaaacgctcgcccgaatacacgtacaaatactaaaacaacgctaaactnctccgaaacccttaaaacaatacgaacaaacgtaaaccgctcgcccgtataaatacgcaaataatattacaaattaaaactctacccgaaactttaccgcaataaaacaacgataaaacgctcgaccgtatatatacgctaatactacaacaacgccgaactctacccgaaaaccttacgcactacgaacacgaataaaaccgctcgcccgtataatacgcaaatatttaaacaacgcaaaaccctaaccgaaacccttaacgcacaccgaacacttataaatccgcgaaccgccgtacgtacgcaaatactataccaaaaacgaaccgtacccgaaaaccttaccacacaccgaacaataatacgacttctcctcgctataactactacgatatttcaacaacgtaaaacgccaccgaaaaccttaccgcaaaccgcgcactaatacgaccgcgccccaatataaataccacgatactaaaccaaaataacaccgtaactaaaaaacttcccgcaatcgaaacaacgatacgacttctcgccgctatacgtacgacgatactaactcaacccgaaactacgacgaaaaactcgcccgcaatccg

SEQ ID NO: 36131 - DNA, 709 bp, Artificial Sequence
  chemically treated genomic DNA (Homo sapiens) CpG-island No: 36131
  misc_feature (20)..(20): n is either a, c, g or t
  misc_feature (36)..(36): n is either a, c, g or t
  misc_feature (104)..(104): n is either a, c, g or t
tgtttggtgagttggaaagntttcggaaggtttttncgtagagttgatagcgatagggacgttcgttcgaatgtacgtgtaggtgttggagtagcgttgagttntttcgaagtttttggagtagtgcgggtaggcgtaggtcgttcgttcgtgtgaatgcgtaggtggtgttgtaagttggagttttgttcgaagttttgtcgtagtggggtagcggtagggcgttcggtcgtgtgtgtgcgttggtgttgtagtagcgtcgagttttgttcgaaggttttgcgtattgcggatacgggtagggtcgttcgttcgtgtggtgcgtaggtgtttgagtagcgtagagttttggtcgaagtttttggcgtatatcgggtatttgtgggttcgcgggtcgtcgtgcgtgcgtaggtgttgtgttaggagcgagtcgtgttcgaaggttttgttatatatcgggtagtggtgcggttttttttcgttgtggttgttgcgatgttttagtagcgtggagcgttatcgaaggttttgtcgtaggtcgcgtattggtacggtcgcgttttagtgtggatgttacggtgttgagttagggtggtatcgtggttgaaggatttttcgtagtcggggtagcggtacggtttttcgtcgttgtgcgtgcggcgatgttggtttagttcggagttgcggcggaaggttcgttcgtaattcg

SEQ ID NO: 36132 - DNA, 709 bp, Artificial Sequence
  chemically treated genomic DNA (Homo sapiens) CpG-island No: 36132
  misc_feature (606)..(606): n is either a, c, g or t
  misc_feature (674)..(674): n is either a, c, g or t
  misc_feature (690)..(690): n is either a, c, g or t
cgaattacgaacgaaccttccgccgcaactccgaactaaaccaacatcgccgcacgcacaacgacgaaaaaccgtaccgctaccccgactacgaaaaatccttcaaccacgataccaccctaactcaacaccgtaacatccacactaaaacgcgaccgtaccaatacgcgacctacgacaaaaccttcgataacgctccacgctactaaaacatcgcaacaaccacaacgaaaaaaaaccgcaccactacccgatatataacaaaaccttcgaacacgactcgctcctaacacaacacctacgcacgcacgacgacccgcgaacccacaaatacccgatatacgccaaaaacttcgaccaaaactctacgctactcaaacacctacgcaccacacgaacgaacgaccctacccgtatccgcaatacgcaaaaccttcgaacaaaactcgacgctactacaacaccaacgcacacacacgaccgaacgccctaccgctaccccactacgacaaaacttcgaacaaaactccaacttacaacaccacctacgcattcacacgaacgaacgacctacgcctacccgcactactccaaaaacttcgaaanaactcaacgctactccaacacctacacgtacattcgaacgaacgtccctatcgctatcaactctacgnaaaaaccttccgaaanctttccaactcaccaaaca

SEQ ID NO: 36133 - DNA, 517 bp, Artificial Sequence
  chemically treated genomic DNA (Homo sapiens) CpG-island No: 36133
  misc_feature (241)..(241): n is either a, c, g or t
cgttttttgcgggcgtatttttatatttgtttaggtcgattcgtaagcgagaggagggggtattagagttagggcgagagcgtttcgcgcgtgtgtgttcgtgttatgtgtggtgttcgtgttatgtgcggcgtttatgtttatgtgcgcgcgtgtgtgtatttatgtttttgtatggtgtgatattcgtgtttgcgtgcgcgtttatacgtgagtcgaggacgtagttagcgtttagcgntttatagcgggtgcgttggattagattttaaggtattagattaaatttggagcgtttgttataagggtagaagatcggcgtgatttttttacgcgcgttagtcggtgttgttggtggagggaattgatatttaacgtatgtggtttaggagaataaaattttttattgtattttacgtcgcgattttttttagcgaaaggtgttttttttggaagatcgtacgaagtaaggaagagtttttttttttttttttggatatttttttaggaatattag

SEQ ID NO: 36134 - DNA, 517 bp, Artificial Sequence
  chemically treated genomic DNA (Homo sapiens) CpG-island No: 36134
  misc_feature (277)..(277): n is either a, c, g or t
ctaatattcctaaaaaaatatccaaaaaaaaaaaaaaaaactcttccttacttcgtacgatcttccaaaaaaaacacctttcgctaaaaaaaatcgcgacgtaaaatacaataaaaaattttattctcctaaaccacatacgttaaatatcaattccctccaccaacaacaccgactaacgcgcgtaaaaaaatcacgccgatcttctacccttataacaaacgctccaaatttaatctaataccttaaaatctaatccaacgcacccgctataaancgctaaacgctaactacgtcctcgactcacgtataaacgcgcacgcaaacacgaatatcacaccatacaaaaacataaatacacacacgcgcgcacataaacataaacgccgcacataacacgaacaccacacataacacgaacacacacgcgcgaaacgctctcgccctaactctaataccccctcctctcgcttacgaatcgacctaaacaaatataaaaatacgcccgcaaaaaacg

SEQ ID NO: 36135 - DNA, 517 bp, Artificial Sequence
  chemically treated genomic DNA (Homo sapiens) CpG-island No: 36135
  misc_feature (277)..(277): n is either a, c, g or t
ttaatatttttggagggatatttaggaagaggaaaagaggtttttttttatttcgtgcggttttttaaaagaagtatttttcgttggggagagtcgcggcgtggggtgtaatggaaggttttgtttttttgggttatatgcgttagatgttagttttttttattagtagtatcggttggcgcgcgtggggagattacgtcggttttttgtttttgtaataaacgttttagatttggtttggtgttttagggtttggtttagcgtattcgttgtgaancgttaggcgttaattgcgttttcggtttacgtgtggacgcgtacgtagatacgagtgttatattatatagagatatgggtgtatatacgcgcgtatatagatatgggcgtcgtatatgatacgggtattatatatgatacgggtatatacgcgcgaagcgttttcgttttggttttaatgtttttttttttcgtttgcggatcggtttgggtaggtgtgggggtacgttcgtagaaagcg

SEQ ID NO: 36136 - DNA, 517 bp, Artificial Sequence
  chemically treated genomic DNA (Homo sapiens) CpG-island No: 36136
  misc_feature (241)..(241): n is either a, c, g or t
cgctttctacgaacgtacccccacacctacccaaaccgatccgcaaacgaaaaaaaaaaacattaaaaccaaaacgaaaacgcttcgcgcgtatatacccgtatcatatataatacccgtatcatatacgacgcccatatctatatacgcgcgtatatacacccatatctctatataatataacactcgtatctacgtacgcgtccacacgtaaaccgaaaacgcaattaacgcctaacgnttcacaacgaatacgctaaaccaaaccctaaaacaccaaaccaaatctaaaacgtttattacaaaaacaaaaaaccgacgtaatctccccacgcgcgccaaccgatactactaataaaaaaaactaacatctaacgcatataacccaaaaaaacaaaaccttccattacaccccacgccgcgactctccccaacgaaaaatacttcttttaaaaaaccgcacgaaataaaaaaaaacctcttttcctcttcctaaatatccctccaaaaatattaa

SEQ ID NO: 36137 - DNA, 525 bp, Artificial Sequence
  chemically treated genomic DNA (Homo sapiens) CpG-island No: 36137
gtggtgatggggcgtgtaggtgttgttttgtgtttgagtttcgtggtgatgggtcgtggagcgggtgttgtgtgtgacgtggtgatggggcgtgtagtgttgttttgtgtgtgatttcgtggtgatggggcgtgtagtgttgttgtgtgtgagtttcgtggtgatggggcgtgtagtgttgttttgtgtgtgagtttcgtggtgatggggtcgtgtagtgttgttttgtgtttgagtttcgtggtgatggggttgtgtagcgtgttgttttgtgtgtgagttcgtggtggtggggcgtgtagcggtgttgttttgtgtgtgagttcgtggtggtggggcgtgtaggtgttgtttgtgtttgagttcgtggtgatggggcgtgtagcgggtgttgttttgtgtgtgagtttcgtggtgatggggcgtgtagcgggtgttgttttgtgtgtgagtttcgtggtggtggggttgtggagtaggtgttgttttgtgtgtgagtttttggtggtggggttatgtagcggg

SEQ ID NO: 36138 - DNA, 525 bp, Artificial Sequence
  chemically treated genomic DNA (Homo sapiens) CpG-island No: 36138
cccgctacataaccccaccaccaaaaactcacacacaaaacaacacctactccacaaccccaccaccacgaaactcacacacaaaacaacacccgctacacgccccatcaccacgaaactcacacacaaaacaacacccgctacacgccccatcaccacgaactcaaacacaaacaacacctacacgccccaccaccacgaactcacacacaaaacaacaccgctacacgccccaccaccacgaactcacacacaaaacaacacgctacacaaccccatcaccacgaaactcaaacacaaaacaacactacacgaccccatcaccacgaaactcacacacaaaacaacactacacgccccatcaccacgaaactcacacacaacaacactacacgccccatcaccacgaaatcacacacaaaacaacactacacgccccatcaccacgtcacacacaacacccgctccacgacccatcaccacgaaactcaaacacaaaacaacacctacacgccccatcaccac

SEQ ID NO: 36139 - DNA, 525 bp, Artificial Sequence
  chemically treated genomic DNA (Homo sapiens) CpG-island No: 36139
ttcgttatatgattttattattaagaatttatatataaaatagtatttgttttataattttattattacgaagtttatatataaaatagtattcgttatacgttttattattacgaagtttatatatagaatagtattcgttatacgttttattattacgaatttagatataaatagtatttatacgttttattattacgaatttatatatagaatagtatcgttatacgttttattattacgaatttatatatagaatagtacgttatatagttttattattacgaagtttagatatagaatagtattatacggttttattattacgaagtttatatatagaatagtattatacgttttattattacgaagtttatatataatagtattatacgttttattattacgaagttatatatagaatagtattatacgttttattattacgttatatataatattcgttttacgatttattattacgaagtttagatatagaatagtatttatacgttttattattat

SEQ ID NO: 36140 - DNA, 525 bp, Artificial Sequence
  chemically treated genomic DNA (Homo sapiens) CpG-island No: 36140
ataataataaaacgtataaatactattctatatctaaacttcgtaataataaatcgtaaaacgaatattatatataacgtaataataaaacgtataatactattctatatataacttcgtaataataaaacgtataatactattatatataaacttcgtaataataaaacgtataatactattctatatataaacttcgtaataataaaaccgtataatactattctatatctaaacttcgtaataataaaactatataacgtactattctatatataaattcgtaataataaaacgtataacgatactattctatatataaattcgtaataataaaacgtataaatactatttatatctaaattcgtaataataaaacgtataacgaatactattctatatataaacttcgtaataataaaacgtataacgaatactattttatatataaacttcgtaataataaaattataaaacaaatactattttatatataaattcttaataataaaatcatataacgaa

SEQ ID NO: 36141 - DNA, 536 bp, Artificial Sequence
  chemically treated genomic DNA (Homo sapiens) CpG-island No: 36141
  misc_feature (147)..(148): n is either a, c, g or t
  misc_feature (204)..(204): n is either a, c, g or t
  misc_feature (227)..(227): n is either a, c, g or t
  misc_feature (242)..(243): n is either a, c, g or t
  misc_feature (254)..(254): n is either a, c, g or t
  misc_feature (308)..(308): n is either a, c, g or t
  misc_feature (317)..(318): n is either a, c, g or t
  misc_feature (327)..(329): n is either a, c, g or t
  misc_feature (348)..(353): n is either a, c, g or t
  misc_feature (484)..(488): n is either a, c, g or t
  misc_feature (520)..(520): n is either a, c, g or t
tcgaggagacgaagaggaggtatttttttcgtgtttttgtagacggtcggggagggagataggacgtaggagttcggggattttttttttcggcgggaggaagcggtgttttttcgcgtaggttttttttttttttttttcgtcgtnntcgtttcgtttttttttcgattggttgtgtttcggaagtggttataagttgggttncgatgtcgcgagcggaatttcgncgttttcggaagtgnnttgaaggcggngcgttagtttcgagtagtgttcgtttttgttcggggcgttgcggtttcgggcgncgttatgannagtgagttnnntattttcgtggggaatatnnnnnntatcgacgaggacgtgtatcgtttttggttcgatggttattcgggttcgtgaggggcgtgtggggaagttagtcggcggagcggttgtgttgaatgggagagggggcggggttaagatttgggtatttttnnnnnaagtgggcgagcgtttgggaataagaggtgtnataggggtttgggatg

SEQ ID NO: 36142 - DNA, 536 bp, Artificial Sequence
  chemically treated genomic DNA (Homo sapiens) CpG-island No: 36142
  misc_feature (17)..(17): n is either a, c, g or t
  misc_feature (49)..(53): n is either a, c, g or t
  misc_feature (184)..(189): n is either a, c, g or t
  misc_feature (208)..(210): n is either a, c, g or t
  misc_feature (219)..(220): n is either a, c, g or t
  misc_feature (229)..(229): n is either a, c, g or t
  misc_feature (283)..(283): n is either a, c, g or t
  misc_feature (294)..(295): n is either a, c, g or t
  misc_feature (310)..(310): n is either a, c, g or t
  misc_feature (333)..(333): n is either a, c, g or t
  misc_feature (389)..(390): n is either a, c, g or t
catcccaaacccctatnacacctcttattcccaaacgctcgcccacttnnnnnaaaaatacccaaatcttaaccccgccccctctcccattcaacacaaccgctccgccgactaacttccccacacgcccctcacgaacccgaataaccatcgaaccaaaaacgatacacgtcctcgtcgatannnnnnatattccccacgaaaatannnaactcactnntcataacgncgcccgaaaccgcaacgccccgaacaaaaacgaacactactcgaaactaacgcnccgccttcaanncacttccgaaaacgncgaaattccgctcgcgacatcgnaacccaacttataaccacttccgaaacacaaccaatcgaaaaaaaaacgaaacgannacgacgaaaaaaaaaaaaaaaaaacctacgcgaaaaaacaccgcttcctcccgccgaaaaaaaaaatccccgaactcctacgtcctatctccctccccgaccgtctacaaaaacacgaaaaaaatacctcctcttcgtctcctcga

SEQ ID NO: 36143 - DNA, 536 bp, Artificial Sequence
  chemically treated genomic DNA (Homo sapiens) CpG-island No: 36143
  misc_feature (17)..(17): n is either a, c, g or t
  misc_feature (49)..(53): n is either a, c, g or t
  misc_feature (184)..(189): n is either a, c, g or t
  misc_feature (208)..(210): n is either a, c, g or t
  misc_feature (219)..(220): n is either a, c, g or t
  misc_feature (229)..(229): n is either a, c, g or t
  misc_feature (283)..(283): n is either a, c, g or t
  misc_feature (294)..(295): n is either a, c, g or t
  misc_feature (310)..(310): n is either a, c, g or t
  misc_feature (333)..(333): n is either a, c, g or t
  misc_feature (389)..(390): n is either a, c, g or t
tattttagatttttatnatattttttatttttaggcgttcgtttatttnnnnnaaggatgtttaagttttagtttcgtttttttttttatttaatataatcgtttcgtcgattggtttttttatacgttttttacggattcgagtaattatcgagttagaggcgatatacgttttcgtcgatannnnnngtgttttttacgaagatgnnnagtttattnnttatggcgncgttcggggtcgtagcgtttcgagtaggagcgagtattgttcgggattggcgtntcgtttttagnntattttcgggagcgncgagatttcgttcgcggtatcgngatttagtttatgattattttcgggatatagttagtcggggaggggacggggcggnngcggcgagggaagagagggggaggtttgcgcggaggagtatcgttttttttcgtcgggagggggagttttcgggtttttgcgttttgttttttttttcggtcgtttgtaggagtacgaagggagtgtttttttttcgttttttcgg

SEQ ID NO: 36144 - DNA, 536 bp, Artificial Sequence
  chemically treated genomic DNA (Homo sapiens) CpG-island No: 36144
  misc_feature (147)..(148): n is either a, c, g or t
  misc_feature (204)..(204): n is either a, c, g or t
  misc_feature (227)..(227): n is either a, c, g or t
  misc_feature (242)..(243): n is either a, c, g or t
  misc_feature (254)..(254): n is either a, c, g or t
  misc_feature (308)..(308): n is either a, c, g or t
  misc_feature (317)..(318): n is either a, c, g or t
  misc_feature (327)..(329): n is either a, c, g or t
  misc_feature (348)..(353): n is either a, c, g or t
  misc_feature (484)..(488): n is either a, c, g or t
  misc_feature (520)..(520): n is either a, c, g or t
ccgaaaaaacgaaaaaaaaacactcccttcgtactcctacaaacgaccgaaaaaaaaaacaaaacgcaaaaacccgaaaactccccctcccgacgaaaaaaaacgatactcctccgcgcaaacctccccctctcttccctcgccgcnnccgccccgtcccctccccgactaactatatcccgaaaataatcataaactaaatcncgataccgcgaacgaaatctcgncgctcccgaaaatannctaaaaacganacgccaatcccgaacaatactcgctcctactcgaaacgctacgaccccgaacgncgccataannaataaactnnncatcttcgtaaaaaacacnnnnnntatcgacgaaaacgtatatcgcctctaactcgataattactcgaatccgtaaaaaacgtataaaaaaaccaatcgacgaaacgattatattaaataaaaaaaaaaacgaaactaaaacttaaacatccttnnnnnaaataaacgaacgcctaaaaataaaaaatatnataaaaatctaaaata

SEQ ID NO: 36145 - DNA, 866 bp, Artificial Sequence
  chemically treated genomic DNA (Homo sapiens) CpG-island No: 36145
  misc_feature (14)..(14): n is either a, c, g or t
cgtggagtcgaagntcgagttcgtgtttagtatcgaggtttttagtttcggttagaaagatttggaagtcgttggggtcgagagaagtttttgtttagaggtcgtagcgttttcgtcggggtcgcggattcgcgataattttattaaggcgtcgtcgtgggaggcgagcgtttcgtcgtcgtcgcgtaggacgcgggtatttaggcgggcgcgtaggtttgcgttttagtggtcgtgagttttatgttttcgtaggacggcgttgggggttcggtttttagtttttaggcggcgcgcgcgtttagttcgttttcgcgtcgagatgcgggtttgtaggtgtcgttgggcgtcgtcgagacgcgtttcgtggttattgggtttatgatattttaagtcgtcgcgtcgttcgtttttttcgaagtgcgggtgcggttcggtttagcgttggcggtcgttgtagcgttttcggagtcggttgagttcgtgcgagacgtgagttgggacgagaagggtatgacgtgggaggtatacggcgtcgttatggaggtggaggtgttgggtatggttatttagaagtatttggagcgatagatcgaggagtacggtcgttaagggggttcgcgtcgtcgttcgtcgttcgtgtcgtttcggtcgttcgggttcggtgcgtatcggtttttagatggcgtcgttaagcgttcgttcggtttgtttcgcgcgttgttgtagagtgtgcgtcggtcgcggtgttgttcgcgggcgggatttacggtcgagtgatttgtttttattttgtacgttcgagttttcgatttttttaggttttttttttgattataggtttttagaaggggttttttttgcgt

SEQ ID NO: 36146 - DNA, 866 bp, Artificial Sequence
  chemically treated genomic DNA (Homo sapiens) CpG-island No: 36146
  misc_feature (853)..(853): n is either a, c, g or t
acgcaaaaaaaaccccttctaaaaacctataatcaaaaaaaaaacctaaaaaaatcgaaaactcgaacgtacaaaataaaaacaaatcactcgaccgtaaatcccgcccgcgaacaacaccgcgaccgacgcacactctacaacaacgcgcgaaacaaaccgaacgaacgcttaacgacgccatctaaaaaccgatacgcaccgaacccgaacgaccgaaacgacacgaacgacgaacgacgacgcgaacccccttaacgaccgtactcctcgatctatcgctccaaatacttctaaataaccatacccaacacctccacctccataacgacgccgtatacctcccacgtcatacccttctcgtcccaactcacgtctcgcacgaactcaaccgactccgaaaacgctacaacgaccgccaacgctaaaccgaaccgcacccgcacttcgaaaaaaacgaacgacgcgacgacttaaaatatcataaacccaataaccacgaaacgcgtctcgacgacgcccaacgacacctacaaacccgcatctcgacgcgaaaacgaactaaacgcgcgcgccgcctaaaaactaaaaaccgaacccccaacgccgtcctacgaaaacataaaactcacgaccactaaaacgcaaacctacgcgcccgcctaaatacccgcgtcctacgcgacgacgacgaaacgctcgcctcccacgacgacgccttaataaaattatcgcgaatccgcgaccccgacgaaaacgctacgacctctaaacaaaaacttctctcgaccccaacgacttccaaatctttctaaccgaaactaaaaacctcgatactaaacacgaactcgancttcgactccacg

SEQ ID NO: 36147 - DNA, 866 bp, Artificial Sequence
  chemically treated genomic DNA (Homo sapiens) CpG-island No: 36147
  misc_feature (853)..(853): n is either a, c, g or t
acgtagaggggattttttttaggggtttgtgattaagaagggagtttgagaaggtcggaaattcgggcgtataaaatgggggtagattattcggtcgtgggtttcgttcgcgagtagtatcgcggtcggcgtatattttgtagtagcgcgcggaataggtcgggcggacgtttggcggcgttatttgggggtcggtgcgtatcgagttcgaacggtcggggcggtacgggcggcgggcggcggcgcgggtttttttggcggtcgtgtttttcgatttgtcgttttagatgtttttggatggttatgtttagtatttttatttttatggcggcgtcgtatattttttacgttatgtttttttcgttttagtttacgtttcgtacgggtttagtcggtttcgggggcgttatagcggtcgttagcgttgagtcgggtcgtattcgtatttcggggaaggcgggcggcgcggcggtttgaggtgttatgggtttagtggttacggagcgcgtttcggcggcgtttagcgatatttgtaggttcgtatttcggcgcgagggcgggttgggcgcgcgcgtcgtttggaagttgaaggtcgagtttttagcgtcgttttgcggagatatggggtttacggttattgagacgtaggtttgcgcgttcgtttgagtgttcgcgttttgcgcggcggcggcggggcgttcgttttttacgacggcgttttggtgaagttgtcgcgagttcgcggtttcggcgggggcgttgcggtttttgggtaggggtttttttcggttttagcggtttttaggtttttttggtcgagattggaggtttcggtgttggatacgggttcggntttcggttttacg

SEQ ID NO: 36148 - DNA, 866 bp, Artificial Sequence
  chemically treated genomic DNA (Homo sapiens) CpG-island No: 36148
  misc_feature (14)..(14): n is either a, c, g or t
cgtaaaaccgaaanccgaacccgtatccaacaccgaaacctccaatctcgaccaaaaaaacctaaaaaccgctaaaaccgaaaaaaacccctacccaaaaaccgcaacgcccccgccgaaaccgcgaactcgcgacaacttcaccaaaacgccgtcgtaaaaaacgaacgccccgccgccgccgcgcaaaacgcgaacactcaaacgaacgcgcaaacctacgtctcaataaccgtaaaccccatatctccgcaaaacgacgctaaaaactcgaccttcaacttccaaacgacgcgcgcgcccaacccgccctcgcgccgaaatacgaacctacaaatatcgctaaacgccgccgaaacgcgctccgtaaccactaaacccataacacctcaaaccgccgcgccgcccgccttccccgaaatacgaatacgacccgactcaacgctaacgaccgctataacgcccccgaaaccgactaaacccgtacgaaacgtaaactaaaacgaaaaaaacataacgtaaaaaatatacgacgccgccataaaaataaaaatactaaacataaccatccaaaaacatctaaaacgacaaatcgaaaaacacgaccgccaaaaaaacccgcgccgccgcccgccgcccgtaccgccccgaccgttcgaactcgatacgcaccgacccccaaataacgccgccaaacgtccgcccgacctattccgcgcgctactacaaaatatacgccgaccgcgatactactcgcgaacgaaacccacgaccgaataatctacccccattttatacgcccgaatttccgaccttctcaaactcccttcttaatcacaaacccctaaaaaaaatcccctctacgt

SEQ ID NO: 36149 - DNA, 845 bp, Artificial Sequence
  chemically treated genomic DNA (Homo sapiens) CpG-island No: 36149
gggcgcgttcgtgttcgtttcgggaggtttatcgcgtacgcgttgttatttttttcgttttttgttagttaggtcgaagagcgcgcggcgttagcgggggcgttgagtttagtagtgtcgtagcgtcggagtcggagtcggagtcggagcgcgcgagttcgtagggcgcgaggaacgagcggtggttggtacgtattcgagattcgggtattcgtgcgtttttgtttaggattcgcgattcgagcgtttgatttcggttttatttttttttcggtttttggtttattttcggtttggtttagcggagttttcgcgttcgttcgtcgtagtcgtcgttttatttttagtttcggtttcgtatttaggtgaggcggtcgcgcgtcggggatggggaacgggatgaggatggagaggggattggggcgataggagggagttggggaaggggatggaaaatggagggagattcgggggatgcgcgttagtgtgtatttcggagtatgtgagtatgtttcggtgtttgtagttgttcgggcggttgtggggacgtgtgttcgcgtttatgtgggtcggggtattcgtgcgcgttggagcgtttgcgtgttttgtgtgtgtacgtgagtttgttcgtggtgtatgtttgtgtgtatgatcgtgtgattgtgtcgtgcgtgtataggcgggttttggatattcgcgtcgaatttagtatttcggttcgacggggttgtagtttgtagggttcggataatcgaggtagtggtttttttcgcgtttttaggttttaaggacgttaggatttttcgcggttttgaggtttcgtattggggagtggggtgggatgg

SEQ ID NO: 36150 - DNA, 845 bp, Artificial Sequence
  chemically treated genomic DNA (Homo sapiens) CpG-island No: 36150
ccatcccaccccactccccaatacgaaacctcaaaaccgcgaaaaatcctaacgtccttaaaacctaaaaacgcgaaaaaaaccactacctcgattatccgaaccctacaaactacaaccccgtcgaaccgaaatactaaattcgacgcgaatatccaaaacccgcctatacacgcacgacacaatcacacgatcatacacacaaacatacaccacgaacaaactcacgtacacacacaaaacacgcaaacgctccaacgcgcacgaataccccgacccacataaacgcgaacacacgtccccacaaccgcccgaacaactacaaacaccgaaacatactcacatactccgaaatacacactaacgcgcatcccccgaatctccctccattttccatccccttccccaactccctcctatcgccccaatcccctctccatcctcatcccgttccccatccccgacgcgcgaccgcctcacctaaatacgaaaccgaaactaaaaataaaacgacgactacgacgaacgaacgcgaaaactccgctaaaccaaaccgaaaataaaccaaaaaccgaaaaaaaaataaaaccgaaatcaaacgctcgaatcgcgaatcctaaacaaaaacgcacgaatacccgaatctcgaatacgtaccaaccaccgctcgttcctcgcgccctacgaactcgcgcgctccgactccgactccgactccgacgctacgacactactaaactcaacgcccccgctaacgccgcgcgctcttcgacctaactaacaaaaaacgaaaaaaataacaacgcgtacgcgataaacctcccgaaacgaacacgaacgcgccc

SEQ ID NO: 36151 - DNA, 845 bp, Artificial Sequence
  chemically treated genomic DNA (Homo sapiens) CpG-island No: 36151
ttattttattttattttttagtgcgaagttttagggtcgcggagagttttagcgtttttgaaatttggggacgcgggaggggttattgtttcggttattcgggttttgtaaattgtagtttcgtcgaatcggagtgttgggttcggcgcgaatatttaggattcgtttgtatacgtacggtatagttatacggttatgtatataaatatatattacggataagtttacgtgtatatataggatacgtagacgttttaacgcgtacgaatatttcgatttatatgggcgcggatatacgtttttatagtcgttcgggtagttgtaaatatcggagtatatttatatatttcggggtgtatattgacgcgtatttttcgggtttttttttattttttatttttttttttagtttttttttgtcgttttagttttttttttatttttatttcgttttttattttcggcgcgcggtcgttttatttggatgcggggtcggggttggggatggagcggcggttgcggcgggcggacgcgggggtttcgttaggttaggtcggaggtggattaggggtcggaggggggatagggtcgggattaggcgttcgggtcgcgggttttgagtaggagcgtacgagtgttcgggtttcgggtgcgtattagttatcgttcgtttttcgcgttttgcgagttcgcgcgtttcggtttcggtttcggtttcggcgttgcggtattattgagtttagcgttttcgttggcgtcgcgcgtttttcggtttgattgatagggggcggggagggtgatagcgcgtacgcgatgagtttttcggggcgagtacggacgcgttt

SEQ ID NO: 36152 - DNA, 845 bp, Artificial Sequence
  chemically treated genomic DNA (Homo sapiens) CpG-island No: 36152
aaacgcgtccgtactcgccccgaaaaactcatcgcgtacgcgctatcaccctccccgccccctatcaatcaaaccgaaaaacgcgcgacgccaacgaaaacgctaaactcaataataccgcaacgccgaaaccgaaaccgaaaccgaaacgcgcgaactcgcaaaacgcgaaaaacgaacgataactaatacgcacccgaaacccgaacactcgtacgctcctactcaaaacccgcgacccgaacgcctaatcccgaccctatcccccctccgacccctaatccacctccgacctaacctaacgaaacccccgcgtccgcccgccgcaaccgccgctccatccccaaccccgaccccgcatccaaataaaacgaccgcgcgccgaaaataaaaaacgaaataaaaataaaaaaaaaactaaaacgacaaaaaaaaactaaaaaaaaaaataaaaaataaaaaaaaacccgaaaaatacgcgtcaatatacaccccgaaatatataaatatactccgatatttacaactacccgaacgactataaaaacgtatatccgcgcccatataaatcgaaatattcgtacgcgttaaaacgtctacgtatcctatatatacacgtaaacttatccgtaatatatatttatatacataaccgtataactataccgtacgtatacaaacgaatcctaaatattcgcgccgaacccaacactccgattcgacgaaactacaatttacaaaacccgaataaccgaaacaataacccctcccgcgtccccaaatttcaaaaacgctaaaactctccgcgaccctaaaacttcgcactaaaaaataaaataaaataa

SEQ ID NO: 36153 - DNA, 941 bp, Artificial Sequence
  chemically treated genomic DNA (Homo sapiens) CpG-island No: 36153
gaattcgttcgaggacggcgcggaattcgggagtttagcgtcgtagttagggttggttagcgaggggcgtttttttttcgtttttttcggtcgcggttttttcgcggttatagttttttacggttacgaggcggtcgggcggttattgcgtatgtcggggcggtgtcggggcgggagtacggagtcggcgttggggacgcgacgtcgagtttgtaggttttttcgttagttcgtcggatgtagtcgaatcgttcgggcgacggcggcggcggcggcgggagtcggagcgtatttcgtttaggagtcggagtagcggtattgtttggtaagcgtcgcgtttatattcgttgttttttcgggcgggcggcggtagtttttttattcgttcgttgtcgtttcggagtcgttgtttagggttttcgaagttttcggcggcggggttcggatatttcgcgcggtatgagttcgggtgtgtgcgcgcggttgggggcggtgggtgtttgtttttaggtttttcgtcggggcggggcggggcggggcggggcgggggcgggtttttagttttgggtcgaatattagaggggttcggcgggttaggtttatttggttgtggggtcggtttcgcgttcggttttgcgtcgttcgttggttttatacggtatggtcgcgcgggagggggtgtttttcgttattggggggagggcgttttttcgcgttgatttatttttttcggagcgagtttaacgttttattggttttattcgtattattgagtatattcgtcgttatataattagtgtggtatatatttcggggcgcgattatataatatcgcgtttacgcgcgggcgttttattttttcgagtgaggttataggtttatcgtatatatataatggttgttggttattttattagatttatatatacggttatttgtta

SEQ ID NO: 36154 - DNA, 941 bp, Artificial Sequence
  chemically treated genomic DNA (Homo sapiens) CpG-island No: 36154
taacaaataaccgtatatataaatctaataaaataaccaacaaccattatatatatacgataaacctataacctcactcgaaaaaataaaacgcccgcgcgtaaacgcgatattatataatcgcgccccgaaatatataccacactaattatataacgacgaatatactcaataatacgaataaaaccaataaaacgttaaactcgctccgaaaaaaataaatcaacgcgaaaaaacgccctccccccaataacgaaaaacaccccctcccgcgcgaccataccgtataaaaccaacgaacgacgcaaaaccgaacgcgaaaccgaccccacaaccaaataaacctaacccgccgaacccctctaatattcgacccaaaactaaaaacccgcccccgccccgccccgccccgccccgccccgacgaaaaacctaaaaacaaacacccaccgcccccaaccgcgcgcacacacccgaactcataccgcgcgaaatatccgaaccccgccgccgaaaacttcgaaaaccctaaacaacgactccgaaacgacaacgaacgaataaaaaaactaccgccgcccgcccgaaaaaacaacgaatataaacgcgacgcttaccaaacaataccgctactccgactcctaaacgaaatacgctccgactcccgccgccgccgccgccgtcgcccgaacgattcgactacatccgacgaactaacgaaaaaacctacaaactcgacgtcgcgtccccaacgccgactccgtactcccgccccgacaccgccccgacatacgcaataaccgcccgaccgcctcgtaaccgtaaaaaactataaccgcgaaaaaaccgcgaccgaaaaaaacgaaaaaaaaacgcccctcgctaaccaaccctaactacgacgctaaactcccgaattccgcgccgtcctcgaacgaattc

SEQ ID NO: 36155 - DNA, 941 bp, Artificial Sequence
  chemically treated genomic DNA (Homo sapiens) CpG-island No: 36155
tgataggtggtcgtgtgtatgagtttaatggaatgattaatagttattgtgtgtgtgcggtagatttgtggttttattcgaggaaatgaggcgttcgcgcgtgaacgcggtgttgtgtgatcgcgtttcggagtgtgtgttatattggttgtgtgacggcgagtgtgtttagtagtgcgagtggagttagtggagcgttgagttcgtttcggggaagatgaattaacgcgggaggacgttttttttttagtggcgggaagtattttttttcgcgcggttatgtcgtataaagttagcgggcggcgtaaggtcgggcgcggggtcgattttatagttaggtgagtttggttcgtcgggtttttttgatgttcggtttaggattggggattcgttttcgtttcgtttcgtttcgtttcgtttcggcgaggagtttggaaatagatatttatcgtttttagtcgcgcgtatatattcgggtttatgtcgcgcgaggtgttcgagtttcgtcgtcgggggtttcgaggattttggatagcggtttcggggcggtagcgagcggatgaaggggttgtcgtcgttcgttcggaaagatagcgggtgtgggcgcggcgtttattaggtagtgtcgttgtttcggtttttgggcgagatgcgtttcggttttcgtcgtcgtcgtcgtcgtcgttcgagcggttcggttgtattcggcgggttgacgggaggatttgtagattcggcgtcgcgtttttagcgtcggtttcgtgttttcgtttcggtatcgtttcggtatgcgtagtagtcgttcggtcgtttcgtaatcgtgaggggttgtgatcgcggggaaatcgcggtcggagggagcgagggaggggcgtttttcgttggttaattttaattgcggcgttgggttttcgggtttcgcgtcgttttcgagcgggttt

SEQ ID NO: 36156 - DNA, 941 bp, Artificial Sequence
  chemically treated genomic DNA (Homo sapiens) CpG-island No: 36156
aaacccgctcgaaaacgacgcgaaacccgaaaacccaacgccgcaattaaaattaaccaacgaaaaacgcccctccctcgctccctccgaccgcgatttccccgcgatcacaacccctcacgattacgaaacgaccgaacgactactacgcataccgaaacgataccgaaacgaaaacacgaaaccgacgctaaaaacgcgacgccgaatctacaaatcctcccgtcaacccgccgaatacaaccgaaccgctcgaacgacgacgacgacgacgacgaaaaccgaaacgcatctcgcccaaaaaccgaaacaacgacactacctaataaacgccgcgcccacacccgctatctttccgaacgaacgacgacaaccccttcatccgctcgctaccgccccgaaaccgctatccaaaatcctcgaaacccccgacgacgaaactcgaacacctcgcgcgacataaacccgaatatatacgcgcgactaaaaacgataaatatctatttccaaactcctcgccgaaacgaaacgaaacgaaacgaaacgaaaacgaatccccaatcctaaaccgaacatcaaaaaaacccgacgaaccaaactcacctaactataaaatcgaccccgcgcccgaccttacgccgcccgctaactttatacgacataaccgcgcgaaaaaaaatacttcccgccactaaaaaaaaaacgtcctcccgcgttaattcatcttccccgaaacgaactcaacgctccactaactccactcgcactactaaacacactcgccgtcacacaaccaatataacacacactccgaaacgcgatcacacaacaccgcgttcacgcgcgaacgcctcatttcctcgaataaaaccacaaatctaccgcacacacacaataactattaatcattccattaaactcatacacacgaccacctatca

SEQ ID NO: 36157 - DNA, 619 bp, Artificial Sequence
  chemically treated genomic DNA (Homo sapiens) CpG-island No: 36157
gtagtgttagtagcgtgggtattttttattttcggttttatttaacgcgatttttagttttttgagtatttcgttttgttgagtattagttggtttttcgttatagtttgtaacggtagcgtcggaggttaataggataaatcgtaatttatcgtttagcgcggttagtttcgtcgatagtttcggttttgtatataaggttattgtcgtttttagcgagttatttatttttttgtcggtacgcgtttgtttaatgattttgtttatttcgttacgtatttttaatagttcgttttagaacgtatcgtttatcgttttattgtttgttaggttaaataggttttcgtattatttatcggtgaagacgtattttttacgttcgttcggtaggtagttttatattttattagcggtgaaggagaggattggtgttatttagcgtattagcgtttttgcgatgtgatatagcgtagtttggtagttacgacgcgttatattgttcgttttggcggtgtattgacggtttttgatgatgtcgaggtagaaggaatttattttatcggagtagaagcgtattagacgttgtattatttcggtggaatcgtatgtttcgtacggt

SEQ ID NO: 36158 - DNA, 619 bp, Artificial Sequence
  chemically treated genomic DNA (Homo sapiens) CpG-island No: 36158
accgtacgaaacatacgattccaccgaaataatacaacgtctaatacgcttctactccgataaaataaattccttctacctcgacatcatcaaaaaccgtcaatacaccgccaaaacgaacaatataacgcgtcgtaactaccaaactacgctatatcacatcgcaaaaacgctaatacgctaaataacaccaatcctctccttcaccgctaataaaatataaaactacctaccgaacgaacgtaaaaaatacgtcttcaccgataaataatacgaaaacctatttaacctaacaaacaataaaacgataaacgatacgttctaaaacgaactattaaaaatacgtaacgaaataaacaaaatcattaaacaaacgcgtaccgacaaaaaaataaataactcgctaaaaacgacaataaccttatatacaaaaccgaaactatcgacgaaactaaccgcgctaaacgataaattacgatttatcctattaacctccgacgctaccgttacaaactataacgaaaaaccaactaatactcaacaaaacgaaatactcaaaaaactaaaaatcgcgttaaataaaaccgaaaataaaaaatacccacgctactaacactac

SEQ ID NO: 36159 - DNA, 619 bp, Artificial Sequence
  chemically treated genomic DNA (Homo sapiens) CpG-island No: 36159
gtcgtacgaagtatacgattttatcgaagtggtatagcgtttgatgcgtttttgtttcgatgagatgggttttttttatttcgatattattaaagatcgttagtatatcgttaaagcggatagtgtggcgcgtcgtagttgttagattgcgttatattatatcgtagaagcgttggtgcgttggatggtattaatttttttttttatcgttgatgaagtgtggggttatttgtcgggcgaacgtgaaaaatacgtttttatcggtgagtggtacgaaggtttgtttggtttggtagatagtgaagcgatgaacgatgcgttttgggacgagttgttgaaagtgcgtggcgaagtgaataaagttattgagtaagcgcgtgtcgataagaaagtgggtggttcgttggaagcggtagtaattttgtatgtagaatcggaattgtcggcgaaattgatcgcgttgggcgatgaattacgatttgttttgttgattttcggcgttatcgttgtagattataacgaagaattagttgatgtttagtagagcgaagtatttaaagggttgaaagtcgcgttgagtaaagtcgaaggtgagaagtgtttacgttgttggtattat

SEQ ID NO: 36160 - DNA, 619 bp, Artificial Sequence
  chemically treated genomic DNA (Homo sapiens) CpG-island No: 36160
ataataccaacaacgtaaacacttctcaccttcgactttactcaacgcgactttcaaccctttaaatacttcgctctactaaacatcaactaattcttcgttataatctacaacgataacgccgaaaatcaacaaaacaaatcgtaattcatcgcccaacgcgatcaatttcgccgacaattccgattctacatacaaaattactaccgcttccaacgaaccacccactttcttatcgacacgcgcttactcaataactttattcacttcgccacgcactttcaacaactcgtcccaaaacgcatcgttcatcgcttcactatctaccaaaccaaacaaaccttcgtaccactcaccgataaaaacgtatttttcacgttcgcccgacaaataaccccacacttcatcaacgataaaaaaaaaaattaataccatccaacgcaccaacgcttctacgatataatataacgcaatctaacaactacgacgcgccacactatccgctttaacgatatactaacgatctttaataatatcgaaataaaaaaaacccatctcatcgaaacaaaaacgcatcaaacgctataccacttcgataaaatcgtatacttcgtacgac

SEQ ID NO: 36161 - DNA, 521 bp, Artificial Sequence
  chemically treated genomic DNA (Homo sapiens) CpG-island No: 36161
  misc_feature (40)..(40): n is either a, c, g or t
tttcgcgagattaggggatagtaacgttttgtcgacgttngggttgtgtcgggacgcggtttattagtgataggagaagtagtagtagtagtagtagtcggggcgcgtttggcggttttggttgaaagttggtggagttgtttgttcggcgcgaggataattcgggagtttcggttgagtgtatggtttcggtgttcgggtttggataggttagtttgagagtatgcgaagtcggttttcgggtagataataagagatatcgtcgggaagtgttaggaatttcgcgcgttgttcgcggggtttttttgtagtcggggttgggttagaaggatggtaaagttgcgcggcgtcgttcgggttggagtcgtagtcgaggagtcgaagtttttttaggtcgtttagtttcgtcgttagcgttttaatcgcgcggagaattgaatttttttatttttattttttaggttttcggattttgggttttgagggaaattttttcgttcgtattttttattttagttttt

SEQ ID NO: 36162 - DNA, 521 bp, Artificial Sequence
  chemically treated genomic DNA (Homo sapiens) CpG-island No: 36162
  misc_feature (482)..(482): n is either a, c, g or t
aaaaactaaaataaaaaatacgaacgaaaaaatttccctcaaaacccaaaatccgaaaacctaaaaaataaaaataaaaaaattcaattctccgcgcgattaaaacgctaacgacgaaactaaacgacctaaaaaaacttcgactcctcgactacgactccaacccgaacgacgccgcgcaactttaccatccttctaacccaaccccgactacaaaaaaaccccgcgaacaacgcgcgaaattcctaacacttcccgacgatatctcttattatctacccgaaaaccgacttcgcatactctcaaactaacctatccaaacccgaacaccgaaaccatacactcaaccgaaactcccgaattatcctcgcgccgaacaaacaactccaccaactttcaaccaaaaccgccaaacgcgccccgactactactactactactacttctcctatcactaataaaccgcgtcccgacacaacccnaacgtcgacaaaacgttactatcccctaatctcgcgaaa

SEQ ID NO: 36163 - DNA, 521 bp, Artificial Sequence
  chemically treated genomic DNA (Homo sapiens) CpG-island No: 36163
  misc_feature (482)..(482): n is either a, c, g or t
gaggattggagtaaggggtgcgagcggagggattttttttaaagtttagggttcggggatttggaaagtagaagtggagggatttaatttttcgcgcgattgaggcgttagcggcggagttggacggtttgggaaggtttcggtttttcggttgcggttttagttcggacggcgtcgcgtaattttgttatttttttggtttagtttcggttataggaggatttcgcgggtaacgcgcggagtttttggtatttttcggcggtgttttttgttgtttgttcggggatcgatttcgtatgtttttaggttgatttgtttaagttcgaatatcgggattatgtatttagtcgggattttcgggttattttcgcgtcggataggtaattttattagtttttaattaggatcgttaagcgcgtttcggttgttgttgttgttgttgttttttttgttattggtaagtcgcgtttcggtatagtttnagcgtcggtagggcgttgttgttttttggtttcgcgggg

SEQ ID NO: 36164 - DNA, 521 bp, Artificial Sequence
  chemically treated genomic DNA (Homo sapiens) CpG-island No: 36164
  misc_feature (40)..(40): n is either a, c, g or t
ccccgcgaaaccaaaaaacaacaacgccctaccgacgctnaaactataccgaaacgcgacttaccaataacaaaaaaaacaacaacaacaacaacaaccgaaacgcgcttaacgatcctaattaaaaactaataaaattacctatccgacgcgaaaataacccgaaaatcccgactaaatacataatcccgatattcgaacttaaacaaatcaacctaaaaacatacgaaatcgatccccgaacaaacaacaaaaaacaccgccgaaaaataccaaaaactccgcgcgttacccgcgaaatcctcctataaccgaaactaaaccaaaaaaataacaaaattacgcgacgccgtccgaactaaaaccgcaaccgaaaaaccgaaaccttcccaaaccgtccaactccgccgctaacgcctcaatcgcgcgaaaaattaaatccctccacttctactttccaaatccccgaaccctaaactttaaaaaaaatccctccgctcgcaccccttactccaatcctc

SEQ ID NO: 36165 - DNA, 547 bp, Artificial Sequence
  chemically treated genomic DNA (Homo sapiens) CpG-island No: 36165
gattcgtcgtttcgtgtcgttcgtttgtttgggaagcggggtcgttcgggtcgcgtcgtggattttttttataggaaggtcgcgaataggcgagtcgtatcgtttatttcggttttaaaggttatcggcgtcgtcgttttttttattcggtcgcgagtttcgagcgacgttgcgttgacgtggttattttcgcggggagggtcgggtcgggaattgggtatcgttcgttttttagttgttcgcgtttcggcgattttttaggaagacggtttggcggttgtggtagggtatcgtttggtaaagggtacgtaaagttagcggttttttttggtgcgtttagtagggagttagcgttttagttttagtcgagtaggtcggcgtacggtttattattagtagttcgtttttacggtttaattatattatcgcggggagtagttttttttcgggatttcgtttttaaatggaaaattaaatagttcgtttttagattttcgttttttagtaatatagtcgtattttgtaggaagttatattatttgaggtt

SEQ ID NO: 36166 - DNA, 547 bp, Artificial Sequence
  chemically treated genomic DNA (Homo sapiens) CpG-island No: 36166
aacctcaaataatataacttcctacaaaatacgactatattactaaaaaacgaaaatctaaaaacgaactatttaattttccatttaaaaacgaaatcccgaaaaaaaactactccccgcgataatataattaaaccgtaaaaacgaactactaataataaaccgtacgccgacctactcgactaaaactaaaacgctaactccctactaaacgcaccaaaaaaaaccgctaactttacgtaccctttaccaaacgataccctaccacaaccgccaaaccgtcttcctaaaaaatcgccgaaacgcgaacaactaaaaaacgaacgatacccaattcccgacccgaccctccccgcgaaaataaccacgtcaacgcaacgtcgctcgaaactcgcgaccgaataaaaaaaacgacgacgccgataacctttaaaaccgaaataaacgatacgactcgcctattcgcgaccttcctataaaaaaaatccacgacgcgacccgaacgaccccgcttcccaaacaaacgaacgacacgaaacgacgaatc

SEQ ID NO: 36167 - DNA, 547 bp, Artificial Sequence
  chemically treated genomic DNA (Homo sapiens) CpG-island No: 36167
aattttaggtagtgtagttttttgtagaatgcggttgtgttgttaaggaacgaggatttgagagcgggttgtttggttttttatttagaggcgaggtttcgggagaaggttgtttttcgcggtggtgtggttgggtcgtggagacgagttgttgatgatggatcgtacgtcgatttattcggttggaattggggcgttggttttttgttgaacgtattagagggagtcgttggttttgcgtattttttgttagacgatgttttgttatagtcgttaggtcgtttttttggggagtcgtcggagcgcgggtaattgggagacgggcggtgtttagttttcggttcggtttttttcgcggaggtggttacgttagcgtagcgtcgttcggagttcgcggtcggatggggaaggcggcggcgtcggtggtttttggggtcgaagtgggcgatgcggttcgtttgttcgcggtttttttgtaagaaagatttacggcgcggttcgggcggtttcgttttttaggtaggcgggcggtacggggcggcgggtt

SEQ ID NO: 36168 - DNA, 547 bp, Artificial Sequence
  chemically treated genomic DNA (Homo sapiens) CpG-island No: 36168
aacccgccgccccgtaccgcccgcctacctaaaaaacgaaaccgcccgaaccgcgccgtaaatctttcttacaaaaaaaccgcgaacaaacgaaccgcatcgcccacttcgaccccaaaaaccaccgacgccgccgccttccccatccgaccgcgaactccgaacgacgctacgctaacgtaaccacctccgcgaaaaaaaccgaaccgaaaactaaacaccgcccgtctcccaattacccgcgctccgacgactccccaaaaaaacgacctaacgactataacaaaacatcgtctaacaaaaaatacgcaaaaccaacgactccctctaatacgttcaacaaaaaaccaacgccccaattccaaccgaataaatcgacgtacgatccatcatcaacaactcgtctccacgacccaaccacaccaccgcgaaaaacaaccttctcccgaaacctcgcctctaaataaaaaaccaaacaacccgctctcaaatcctcgttccttaacaacacaaccgcattctacaaaaaactacactacctaaaatt

SEQ ID NO: 36169 - DNA, 1238 bp, Artificial Sequence
  chemically treated genomic DNA (Homo sapiens) CpG-island No: 36169
taggtttggttatgtcggtattgtcgggttttttgcgggatatcgtttatttcgatagtatcgttagttattatggcgtgttgttagcgttatatgcgttgatgtaatttttatgcgtattcgttttcggagtattgttcgatcgttttggtcgtcgtttagttttgttcgtttcgttatttggagttattatcgattacgcgattatggcgattatattcgttttgtggattttttacgtcggacgtatcgtggtcggtattatcggcgttataggtgcggttgttggcgtttatatcgtcgatattatcgatggggaagatcgggttcgttatttcgggtttatgagcgtttgtttcggcgtgggtatggtggtaggtttcgtggtcgggggattgttgggcgttatttttttgtatgtattattttttgcggcggcggtgtttaacggttttaatttattattgggttgttttttaatgtaggagtcgtataagggagagcgtcgatcgatgtttttgagagtttttaatttagttagtttttttcggtgggcgcggggtatgattatcgtcgtcgtatttatgattgttttttttattatgtaattcgtaggataggtgtcggtagcgttttgggttattttcggcgaggatcgttttcgttggagcgcgacgatgatcggtttgtcgtttgcggtattcggaattttgtacgttttcgtttaagttttcgttattggtttcgttattaaacgtttcggcgagaagtaggttattatcgtcggtatggcggtcgacgcgttgggttacgttttgttggcgttcgcgacgcgaggttggatggttttttttattatgatttttttcgttttcggcggtatcgggatgttcgcgttgtaggttatgttgtttaggtaggtagatgacgattattagggatagttttaaggatcgttcgcggtttttattagtttaatttcgattattggatcgttgatcgttacggcgatttatgtcgtttcggcgagtatatggaacgggttggtatggattgtaggcgtcgttttatattttgtttgttttttcgcgttgcgtcgcggtgtatggagtcgggttatttcgatttgaatggaagtcggcggtatttcgttaacggatttattattttaagaattggagttaattaatttttgcggagaattgtgaatgcgtaaattaatttttggtagaatatat

SEQ ID NO: 36170 - DNA, 1238 bp, Artificial Sequence
  chemically treated genomic DNA (Homo sapiens) CpG-island No: 36170
atatattctaccaaaaattaatttacgcattcacaattctccgcaaaaattaattaactccaattcttaaaataataaatccgttaacgaaataccgccgacttccattcaaatcgaaataacccgactccatacaccgcgacgcaacgcgaaaaaacaaacaaaatataaaacgacgcctacaatccataccaacccgttccatatactcgccgaaacgacataaatcgccgtaacgatcaacgatccaataatcgaaattaaactaataaaaaccgcgaacgatccttaaaactatccctaataatcgtcatctacctacctaaacaacataacctacaacgcgaacatcccgataccgccgaaaacgaaaaaaatcataataaaaaaaaccatccaacctcgcgtcgcgaacgccaacaaaacgtaacccaacgcgtcgaccgccataccgacgataataacctacttctcgccgaaacgtttaataacgaaaccaataacgaaaacttaaacgaaaacgtacaaaattccgaataccgcaaacgacaaaccgatcatcgtcgcgctccaacgaaaacgatcctcgccgaaaataacccaaaacgctaccgacacctatcctacgaattacataataaaaaaaacaatcataaatacgacgacgataatcataccccgcgcccaccgaaaaaaactaactaaattaaaaactctcaaaaacatcgatcgacgctctcccttatacgactcctacattaaaaaacaacccaataataaattaaaaccgttaaacaccgccgccgcaaaaaataatacatacaaaaaaataacgcccaacaatcccccgaccacgaaacctaccaccatacccacgccgaaacaaacgctcataaacccgaaataacgaacccgatcttccccatcgataatatcgacgatataaacgccaacaaccgcacctataacgccgataataccgaccacgatacgtccgacgtaaaaaatccacaaaacgaatataatcgccataatcgcgtaatcgataataactccaaataacgaaacgaacaaaactaaacgacgaccaaaacgatcgaacaatactccgaaaacgaatacgcataaaaattacatcaacgcatataacgctaacaacacgccataataactaacgatactatcgaaataaacgatatcccgcaaaaaacccgacaataccgacataaccaaaccta

SEQ ID NO: 36171 - DNA, 1238 bp, Artificial Sequence
  chemically treated genomic DNA (Homo sapiens) CpG-island No: 36171
atatgttttgttaagggttggtttgcgtatttatagtttttcgtaagaattgattggttttaatttttggagtggtgaattcgttagcgaggtgtcgtcggtttttatttaggtcgaggtggttcggttttatgtatcgcgacgtaacgcggggaggtagataaggtatagggcggcgtttataatttatgttaattcgttttatgtgttcgtcgaggcggtataaatcgtcgtgacgattagcggtttaatgatcgaagttaggttggtaagagtcgcgagcgatttttgaagttgtttttgatggtcgttatttatttgtttggatagtatggtttgtaacgcgggtatttcgatgtcgtcggaagcgagaagaattataatggggaaggttatttagtttcgcgtcgcgaacgttagtaagacgtagtttagcgcgtcggtcgttatgtcggcgataatggtttgtttttcgtcgaaacgtttggtggcgggattagtgacgaaggtttgagcgagggcgtgtaagatttcgaatatcgtaagcgataggtcgattatcgtcgcgttttagcgaaagcggttttcgtcgaaaatgatttagagcgttgtcggtatttgttttacgagttgtatgataaagaagatagttataagtgcggcgacgatagttatgtttcgcgtttatcggaaggagttgattgggttgaaggtttttaagggtatcggtcgacgtttttttttatgcgatttttgtattaggaagtagtttagtagtaggttgaggtcgttgagtatcgtcgtcgtaaggaatggtgtatgtaaggagatggcgtttaatagtttttcggttacggggtttgttattatatttacgtcgaaataagcgtttatgagttcgaagtggcgagttcgattttttttatcggtgatgtcggcgatataggcgttagtaatcgtatttgtggcgtcggtgatgtcggttacgatgcgttcggcgtagaggatttataggacgggtgtggtcgttatgatcgcgtagtcgatagtggttttaagtagcgaagcgagtaggattgggcggcggttaaagcggtcggatagtgtttcgagaacgggtgcgtatagaaattgtattaacgtatatagcgttagtagtacgttatagtgattggcgatgttgtcggaatggacgatatttcgtaagaggttcggtagtatcggtataattaagttta

SEQ ID NO: 36172 - DNA, 1238 bp, Artificial Sequence
  chemically treated genomic DNA (Homo sapiens) CpG-island No: 36172
taaacttaattataccgatactaccgaacctcttacgaaatatcgtccattccgacaacatcgccaatcactataacgtactactaacgctatatacgttaatacaatttctatacgcacccgttctcgaaacactatccgaccgctttaaccgccgcccaatcctactcgcttcgctacttaaaaccactatcgactacgcgatcataacgaccacacccgtcctataaatcctctacgccgaacgcatcgtaaccgacatcaccgacgccacaaatacgattactaacgcctatatcgccgacatcaccgataaaaaaaatcgaactcgccacttcgaactcataaacgcttatttcgacgtaaatataataacaaaccccgtaaccgaaaaactattaaacgccatctccttacatacaccattccttacgacgacgatactcaacgacctcaacctactactaaactacttcctaatacaaaaatcgcataaaaaaaaacgtcgaccgatacccttaaaaaccttcaacccaatcaactccttccgataaacgcgaaacataactatcgtcgccgcacttataactatcttctttatcatacaactcgtaaaacaaataccgacaacgctctaaatcattttcgacgaaaaccgctttcgctaaaacgcgacgataatcgacctatcgcttacgatattcgaaatcttacacgccctcgctcaaaccttcgtcactaatcccgccaccaaacgtttcgacgaaaaacaaaccattatcgccgacataacgaccgacgcgctaaactacgtcttactaacgttcgcgacgcgaaactaaataaccttccccattataattcttctcgcttccgacgacatcgaaatacccgcgttacaaaccatactatccaaacaaataaataacgaccatcaaaaacaacttcaaaaatcgctcgcgactcttaccaacctaacttcgatcattaaaccgctaatcgtcacgacgatttataccgcctcgacgaacacataaaacgaattaacataaattataaacgccgccctataccttatctacctccccgcgttacgtcgcgatacataaaaccgaaccacctcgacctaaataaaaaccgacgacacctcgctaacgaattcaccactccaaaaattaaaaccaatcaattcttacgaaaaactataaatacgcaaaccaacccttaacaaaacatat

SEQ ID NO: 36173 - DNA, 708 bp, Artificial Sequence
  chemically treated genomic DNA (Homo sapiens) CpG-island No: 36173
ggaatatacgtatataatggtcgaggtatattttagagtatttatagtgagttcggaatatacgtatataatggtcgaggtatattttagaatatttatagtgagtcgggaatatacgtatataatggtcgaggtatattttagaatatttatagtgagtcgggaatatacgtatataatggtcgaggtatattttagaatatttatagtgagtcgggaatatacgtatataatggtcgaggtatattttagaatatttatagtgagtcgggaatatacgtatataatggtcgaggtatattttagagtatttatagtgagtcgggaatatacgtatataatggtcgaggtatattttagaatatttatagtgagtcgggaatatacgtataaaatggtcgaggtatattttagagtatttatagtgagtttggaatatacgtatataatggtcgaggtatattttagaatatttatagtgagtcgggaatatacgtatataatggtcgaggtatattttagagtatttatagtgagttcggaatatatgtatataatggtcgaggtatattttagaatatttatagtgagtcgggaatatacgtatataatggtcgaggtatattttagagtatttatagtgagatcggaatatacgtatataatggttaagatatattttagaatatttatagtgagtcgggaata

SEQ ID NO: 36174 - DNA, 708 bp, Artificial Sequence
  chemically treated genomic DNA (Homo sapiens) CpG-island No: 36174
tattcccgactcactataaatattctaaaatatatcttaaccattatatacgtatattccgatctcactataaatactctaaaatatacctcgaccattatatacgtatattcccgactcactataaatattctaaaatatacctcgaccattatatacatatattccgaactcactataaatactctaaaatatacctcgaccattatatacgtatattcccgactcactataaatattctaaaatatacctcgaccattatatacgtatattccaaactcactataaatactctaaaatatacctcgaccattttatacgtatattcccgactcactataaatattctaaaatatacctcgaccattatatacgtatattcccgactcactataaatactctaaaatatacctcgaccattatatacgtatattcccgactcactataaatattctaaaatatacctcgaccattatatacgtatattcccgactcactataaatattctaaaatatacctcgaccattatatacgtatattcccgactcactataaatattctaaaatatacctcgaccattatatacgtatattcccgactcactataaatattctaaaatatacctcgaccattatatacgtatattccgaactcactataaatactctaaaatatacctcgaccattatatacgtatattcc

SEQ ID NO: 36175 - DNA, 708 bp, Artificial Sequence
  chemically treated genomic DNA (Homo sapiens) CpG-island No: 36175
tgttttcgatttattgtgaatgttttagagtgtattttggttattgtgtgcgtgtgtttcggttttattgtgaatgttttagagtgtatttcggttattgtgtgcgtgtgttttcgatttattgtgagtgttttagagtgtatttcggttattgtgtgtatgtgtttcgaatttattgtgaatgttttagagtgtatttcggttattgtgtgcgtgtgttttcgatttattgtgagtgttttagagtgtatttcggttattgtgtgcgtgtgttttagatttattgtgaatgttttagagtgtatttcggttattttgtgcgtgtgttttcgatttattgtgagtgttttagagtgtatttcggttattgtgtgcgtgtgttttcgatttattgtgaatgttttagagtgtatttcggttattgtgtgcgtgtgttttcgatttattgtgagtgttttagagtgtatttcggttattgtgtgcgtgtgttttcgatttattgtgagtgttttagagtgtatttcggttattgtgtgcgtgtgttttcgatttattgtgagtgttttagagtgtatttcggttattgtgtgcgtgtgttttcgatttattgtgagtgttttagagtgtatttcggttattgtgtgcgtgtgtttcggatttattgtgaatgttttagagtgtatttcggttattgtgtgcgtgtgtttt

SEQ ID NO: 36176 - DNA, 708 bp, Artificial Sequence
  chemically treated genomic DNA (Homo sapiens) CpG-island No: 36176
aaaacacacgcacacaataaccgaaatacactctaaaacattcacaataaatccgaaacacacgcacacaataaccgaaatacactctaaaacactcacaataaatcgaaaacacacgcacacaataaccgaaatacactctaaaacactcacaataaatcgaaaacacacgcacacaataaccgaaatacactctaaaacactcacaataaatcgaaaacacacgcacacaataaccgaaatacactctaaaacactcacaataaatcgaaaacacacgcacacaataaccgaaatacactctaaaacattcacaataaatcgaaaacacacgcacacaataaccgaaatacactctaaaacactcacaataaatcgaaaacacacgcacaaaataaccgaaatacactctaaaacattcacaataaatctaaaacacacgcacacaataaccgaaatacactctaaaacactcacaataaatcgaaaacacacgcacacaataaccgaaatacactctaaaacattcacaataaattcgaaacacatacacacaataaccgaaatacactctaaaacactcacaataaatcgaaaacacacgcacacaataaccgaaatacactctaaaacattcacaataaaaccgaaacacacgcacacaataaccaaaatacactctaaaacattcacaataaatcgaaaaca

SEQ ID NO: 36177 - DNA, 980 bp, Artificial Sequence
  chemically treated genomic DNA (Homo sapiens) CpG-island No: 36177
acggggacgtttattattttagtatcgacgtggggacgtttattattgtagtatcgataaggggtattaatacggggatgtttataattttagtatcgatatggggacgtttattattttagtatcgatacggggatgtttattattttagtatcgacgtggggacgttcgttattttagtatcgataaggggtatcgatacggggacgtttattattttagtatcgataaggggtatcgatacggggatatttattattttagtatcgatacggggacgtttattattttagtatcgatacggggacgattattattttagtatcgatacggggacgtttattattttagtatcgatacggggacgattattattttagtatcgatacggggacgtttattattttagtatcgataaggggtatcgatatggggatgtttattattttagtattgataaggggtatcgatacggggacgtttattttattagtatcgatacggggacgtttattattgtagtatcgataaggggtatcgatatggggacgtttattattttagtatcgatacggggtatcgatatggggacgtttattattttagtatcgatacggggtcgtttattattttagtatcgatacggggatatttattattttagtatcgatacggggtatcgatacggggacgtttattattttagtatcgatacggggacgtttattattttagtatcgatacggggtatcgatacggggacgtttattgttttagtatcgatacggggtattaatatgaggacgtttattattgtagtatcgatatagggatgtttattattttagcgttaatacggggacgtttattattttagtatcgatacggggacgtttatttttttagtattaatacggggacgtttattattttagtatcgataaggggtattgataggggaatgtatattattttagtat

SEQ ID NO: 36178 - DNA, 980 bp, Artificial Sequence
  chemically treated genomic DNA (Homo sapiens) CpG-island No: 36178
atactaaaataatatacattcccctatcaataccccttatcgatactaaaataataaacgtccccgtattaatactaaaaaaataaacgtccccgtatcgatactaaaataataaacgtccccgtattaacgctaaaataataaacatccctatatcgatactacaataataaacgtcctcatattaataccccgtatcgatactaaaacaataaacgtccccgtatcgataccccgtatcgatactaaaataataaacgtccccgtatcgatactaaaataataaacgtccccgtatcgataccccgtatcgatactaaaataataaatatccccgtatcgatactaaaataataaacgaccccgtatcgatactaaaataataaacgtccccatatcgataccccgtatcgatactaaaataataaacgtccccatatcgataccccttatcgatactacaataataaacgtccccgtatcgatactaataaaataaacgtccccgtatcgataccccttatcaatactaaaataataaacatccccatatcgataccccttatcgatactaaaataataaacgtccccgtatcgatactaaaataataatcgtccccgtatcgatactaaaataataaacgtccccgtatcgatactaaaataataatcgtccccgtatcgatactaaaataataaacgtccccgtatcgatactaaaataataaatatccccgtatcgataccccttatcgatactaaaataataaacgtccccgtatcgataccccttatcgatactaaaataacgaacgtccccacgtcgatactaaaataataaacatccccgtatcgatactaaaataataaacgtccccatatcgatactaaaattataaacatccccgtattaataccccttatcgatactacaataataaacgtccccacgtcgatactaaaataataaacgtccccgt

SEQ ID NO: 36179 - DNA, 980 bp, Artificial Sequence
  chemically treated genomic DNA (Homo sapiens) CpG-island No: 36179
gtgttggaatagtgtgtatttttttgttagtgttttttgtcggtgttggaatagtaaacgttttcgtgttggtgttggaagggtgaacgttttcgtgtcggtgttggaatagtgaacgttttcgtattagcgttggaatagtgagtatttttgtatcggtgttgtaatagtgagcgtttttatgttggtgtttcgtatcggtgttggaatagtgagcgttttcgtgtcggtgtttcgtgtcggtgttggaatagtgagcgttttcgtgtcggtgttggaatagtgagcgttttcgtgtcggtgtttcgtgtcggtgttggaatagtgagtgttttcgtgtcggtgttggaatagtgagcgatttcgtgtcggtgttggaatagtgagcgtttttatgtcggtgtttcgtgtcggtgttggaatagtgagcgtttttatgtcggtgttttttgtcggtgttgtaatagtgagcgttttcgtgtcggtgttggtagagtgggcgttttcgtatcggtgttttttgttagtgttggaatagtgagtatttttatgtcggtgttttttgtcggtgttggaatagtgagcgttttcgtgtcggtgttggaatagtgatcgttttcgtgtcggtgttgaaatagtgaacgttttcgtgtcggtgttggaatagtgatcgttttcgtgtcggtgttgaaatagtgaacgttttcgtgtcggtgttggaatagtgagtgttttcgtgtcggtgttttttgtcggtgttggaatagtgagcgttttcgtgtcggtgttttttgtcggtgttgaaatagcgagcgtttttacgtcggtgttggaatagtgagtattttcgtgtcggtgttggaatagtgagcgtttttatgtcggtgttggaattgtgaatattttcgtgttggtgttttttgtcggtgttgtaatagtgagcgtttttacgtcggtgttggaatagtgagcgttttcgt

SEQ ID NO: 36180 - DNA, 980 bp, Artificial Sequence
  chemically treated genomic DNA (Homo sapiens) CpG-island No: 36180
acgaaaacgctcactattccaacaccgacgtaaaaacgctcactattacaacaccgacaaaaaacaccaacacgaaaatattcacaattccaacaccgacataaaaacgctcactattccaacaccgacacgaaaatactcactattccaacaccgacgtaaaaacgctcgctatttcaacaccgacaaaaaacaccgacacgaaaacgctcactattccaacaccgacaaaaaacaccgacacgaaaacactcactattccaacaccgacacgaaaacgttcactatttcaacaccgacacgaaaacgatcactattccaacaccgacacgaaaacgttcactatttcaacaccgacacgaaaacgatcactattccaacaccgacacgaaaacgctcactattccaacaccgacaaaaaacaccgacataaaaatactcactattccaacactaacaaaaaacaccgatacgaaaacgcccactctaccaacaccgacacgaaaacgctcactattacaacaccgacaaaaaacaccgacataaaaacgctcactattccaacaccgacacgaaacaccgacataaaaacgctcactattccaacaccgacacgaaatcgctcactattccaacaccgacacgaaaacactcactattccaacaccgacacgaaacaccgacacgaaaacgctcactattccaacaccgacacgaaaacgctcactattccaacaccgacacgaaacaccgacacgaaaacgctcactattccaacaccgatacgaaacaccaacataaaaacgctcactattacaacaccgatacaaaaatactcactattccaacgctaatacgaaaacgttcactattccaacaccgacacgaaaacgttcacccttccaacaccaacacgaaaacgtttactattccaacaccgacaaaaaacactaacaaaaaaatacacactattccaacac

SEQ ID NO: 36181 - DNA, 509 bp, Artificial Sequence
  chemically treated genomic DNA (Homo sapiens) CpG-island No: 36181
acgcggggaaatagttgtatagttcggtttagagcgttaagcgtatatatcgagtatatttttatacgcgtatatacgcgtttatattcgtttttttttcgggtttcggttttggattcgcgggcgcggattcggtcgttcgttttgggagtcgttatatcgcgcgcgtcgcgttcgtttttttcgtatttttacgcgcgttcggttgggggatttttttcgcgtgttcgaaagggggatatgttatttggatatgtaattgttagtacgggatttgagatttttaaaaaatgaagtcggcgataggattttgggtttgggtgagttttttcgtggcggcggggatcgtttagtttagcgatttttagttaggtgggttttttttggtatttcggtcgtcgaatttgtagtcgtcggcggggttgtttcgagtggtttttttgttttttttatttatttcgggaggcgtggagggatcgtttgatcggggttttttttttgggttttcg

SEQ ID NO: 36182 - DNA, 509 bp, Artificial Sequence
  chemically treated genomic DNA (Homo sapiens) CpG-island No: 36182
cgaaaacccaaaaaaaaaaccccgatcaaacgatccctccacgcctcccgaaataaataaaaaaaacaaaaaaaccactcgaaacaaccccgccgacgactacaaattcgacgaccgaaataccaaaaaaaacccacctaactaaaaatcgctaaactaaacgatccccgccgccacgaaaaaactcacccaaacccaaaatcctatcgccgacttcattttttaaaaatctcaaatcccgtactaacaattacatatccaaataacatatccccctttcgaacacgcgaaaaaaatcccccaaccgaacgcgcgtaaaaatacgaaaaaaacgaacgcgacgcgcgcgatataacgactcccaaaacgaacgaccgaatccgcgcccgcgaatccaaaaccgaaacccgaaaaaaaaacgaatataaacgcgtatatacgcgtataaaaatatactcgatatatacgcttaacgctctaaaccgaactatacaactatttccccgcgt

SEQ ID NO: 36183 - DNA, 509 bp, Artificial Sequence
  chemically treated genomic DNA (Homo sapiens) CpG-island No: 36183
cgaaagtttagggaagaggtttcggttaagcggtttttttacgtttttcgggatgggtgaagagggtaggggagttattcgaggtagtttcgtcggcggttgtaggttcggcgatcggagtgttagaaggaatttatttgattgagaatcgttgggttggacggttttcgtcgttacgagaaggtttatttagatttaaagttttgtcgtcggttttattttttggaagttttagatttcgtgttgataattatatgtttaaatggtatatttttttttcgggtacgcggaggagattttttagtcgggcgcgcgtgggggtgcgaggggggcgggcgcggcgcgcgcggtgtggcgatttttagggcgggcgatcgagttcgcgttcgcgggtttagggtcggggttcgaggagggggcgagtgtgagcgcgtgtgtgcgcgtgtgggagtgtgttcggtgtgtgcgtttggcgttttgggtcggattgtgtagttattttttcgcgt

SEQ ID NO: 36184 - DNA, 509 bp, Artificial Sequence
  chemically treated genomic DNA (Homo sapiens) CpG-island No: 36184
acgcgaaaaaataactacacaatccgacccaaaacgccaaacgcacacaccgaacacactcccacacgcgcacacacgcgctcacactcgccccctcctcgaaccccgaccctaaacccgcgaacgcgaactcgatcgcccgccctaaaaatcgccacaccgcgcgcgccgcgcccgcccccctcgcacccccacgcgcgcccgactaaaaaatctcctccgcgtacccgaaaaaaaaatataccatttaaacatataattatcaacacgaaatctaaaacttccaaaaaataaaaccgacgacaaaactttaaatctaaataaaccttctcgtaacgacgaaaaccgtccaacccaacgattctcaatcaaataaattccttctaacactccgatcgccgaacctacaaccgccgacgaaactacctcgaataactcccctaccctcttcacccatcccgaaaaacgtaaaaaaaccgcttaaccgaaacctcttccctaaactttcg

SEQ ID NO: 36185 - DNA, 1084 bp, Artificial Sequence
  chemically treated genomic DNA (Homo sapiens) CpG-island No: 36185
gcgcgagacgagattaattttcgggataggggagagcggggttattgaacgtaggggatttcgttgagtttttagtttttgagcgtttattttcggtttagttgggggacgcggtttcgggaagaaagttcggaatttcgagtcggttagtcgcgagtagcgagtatcggagcgcgtgggtaggcgcgcggaggtagaggcgggtcggcggttgtttttttaaggggtcggtttttcggcgtcgtcgtttagacgttaggacgtgtcgggttcgtttcgtttcgtttcgaagtcgttcgttttttgtcgagcggcgcgacggtatttgagcgattgcggcggcggcggcggcggcggcggcgtttcggagcgggcggttcgggttgtagtgtcggcgtcgtcgcgttttttcggttttttttttcggtcgtatagggtgagggagagtaggtcgtatcgggacgggcgtcggcggcggggagcgcggggggaggcggcgtcggttcgcgggttttggggtaggcgggagggtcgcgtcgggcgggggggcgcggtcgcggggttcggacgtcgttcgttgggtaggtttcgggtattcggttgtcgtcgcggggtttttgttggggtcgggacgtcgtagggggcgggttcggagggattttttcggtttcgcggggtcgttttgggttcgatttcggttttgtcgcggtattcggggcgcggtcgagggatattttttattttttttaaggacgattttttcgaaggcgaggtcgattcgagcgggttttggggtgatcgaggtatttatttttagttaagtttgagggttttcgggagggaaggcggattatcgttttttcggtcggtggacggaggtagcgcgttttcggcggcgttttcgggtcggagttgggttatatttacgttatgttggagttttagttttcgtcgttgttttcggcggtttgggcgttcgttttttttttcggcgtttttttcgttgttttttgcgagtttttaggttagggcgggaggcggttgggtacggaaagtagtatgaggggggattttggaaaaattt

SEQ ID NO: 36186 - DNA, 1084 bp, Artificial Sequence
  chemically treated genomic DNA (Homo sapiens) CpG-island No: 36186
aaatttttccaaaatcccccctcatactactttccgtacccaaccgcctcccgccctaacctaaaaactcgcaaaaaacaacgaaaaaaacgccgaaaaaaaaaacgaacgcccaaaccgccgaaaacaacgacgaaaactaaaactccaacataacgtaaatataacccaactccgacccgaaaacgccgccgaaaacgcgctacctccgtccaccgaccgaaaaaacgataatccgccttccctcccgaaaaccctcaaacttaactaaaaataaatacctcgatcaccccaaaacccgctcgaatcgacctcgccttcgaaaaaatcgtccttaaaaaaaataaaaaatatccctcgaccgcgccccgaataccgcgacaaaaccgaaatcgaacccaaaacgaccccgcgaaaccgaaaaaatccctccgaacccgccccctacgacgtcccgaccccaacaaaaaccccgcgacgacaaccgaatacccgaaacctacccaacgaacgacgtccgaaccccgcgaccgcgcccccccgcccgacgcgaccctcccgcctaccccaaaacccgcgaaccgacgccgcctccccccgcgctccccgccgccgacgcccgtcccgatacgacctactctccctcaccctatacgaccgaaaaaaaaaaccgaaaaaacgcgacgacgccgacactacaacccgaaccgcccgctccgaaacgccgccgccgccgccgccgccgccgcaatcgctcaaataccgtcgcgccgctcgacaaaaaacgaacgacttcgaaacgaaacgaaacgaacccgacacgtcctaacgtctaaacgacgacgccgaaaaaccgaccccttaaaaaaacaaccgccgacccgcctctacctccgcgcgcctacccacgcgctccgatactcgctactcgcgactaaccgactcgaaattccgaactttcttcccgaaaccgcgtcccccaactaaaccgaaaataaacgctcaaaaactaaaaactcaacgaaatcccctacgttcaataaccccgctctcccctatcccgaaaattaatctcgtctcgcgc

SEQ ID NO: 36187 - DNA, 1084 bp, Artificial Sequence
  chemically treated genomic DNA (Homo sapiens) CpG-island No: 36187
ggatttttttaaagtttttttttatgttgtttttcgtgtttaatcgtttttcgttttgatttggggattcgtaaagggtagcgggaggggcgtcggggaagggggcgagcgtttagatcgtcggaggtagcggcgaggattggaattttagtatggcgtaagtgtggtttagtttcggttcggggacgtcgtcggagacgcgttgttttcgtttatcggtcgaggaggcggtaattcgttttttttttcgggggtttttaggtttggttaaaaataggtgtttcggttattttagggttcgttcgggtcgatttcgttttcgggagagtcgtttttggggagggtggggggtgtttttcggtcgcgtttcgggtgtcgcgatagagtcggggtcgggtttagagcggtttcgcgaggtcgaggaggttttttcgagttcgttttttgcggcgtttcggttttaataagagtttcgcggcggtaatcggatgttcgaggtttatttagcgggcggcgttcgggtttcgcggtcgcgttttttcgttcggcgcggttttttcgtttgttttaggattcgcgggtcggcgtcgttttttttcgcgtttttcgtcgtcggcgttcgtttcggtgcggtttgtttttttttattttgtgcggtcgggaaaggagatcgggaagacgcggcggcgtcggtattatagttcgggtcgttcgtttcgaggcgtcgtcgtcgtcgtcgtcgtcgtcgtagtcgtttaggtgtcgtcgcgtcgttcggtaggaaacgggcggtttcggggcggggcggggcggattcggtacgttttggcgtttgggcggcggcgtcgggagatcggttttttaaagggatagtcgtcggttcgtttttgttttcgcgcgtttgtttacgcgtttcggtattcgttgttcgcggttggtcggttcgggatttcgggtttttttttcgagatcgcgttttttagttgggtcgaaggtggacgtttaggggttggaggtttagcggaattttttgcgtttagtagtttcgtttttttttgtttcgaaggttggtttcgtttcgcgt

SEQ ID NO: 36188 - DNA, 1084 bp, Artificial Sequence
  chemically treated genomic DNA (Homo sapiens) CpG-island No: 36188
acgcgaaacgaaaccaaccttcgaaacaaaaaaaaacgaaactactaaacgcaaaaaattccgctaaacctccaacccctaaacgtccaccttcgacccaactaaaaaacgcgatctcgaaaaaaaaacccgaaatcccgaaccgaccaaccgcgaacaacgaataccgaaacgcgtaaacaaacgcgcgaaaacaaaaacgaaccgacgactatccctttaaaaaaccgatctcccgacgccgccgcccaaacgccaaaacgtaccgaatccgccccgccccgccccgaaaccgcccgtttcctaccgaacgacgcgacgacacctaaacgactacgacgacgacgacgacgacgacgacgcctcgaaacgaacgacccgaactataataccgacgccgccgcgtcttcccgatctcctttcccgaccgcacaaaataaaaaaaaacaaaccgcaccgaaacgaacgccgacgacgaaaaacgcgaaaaaaaacgacgccgacccgcgaatcctaaaacaaacgaaaaaaccgcgccgaacgaaaaaacgcgaccgcgaaacccgaacgccgcccgctaaataaacctcgaacatccgattaccgccgcgaaactcttattaaaaccgaaacgccgcaaaaaacgaactcgaaaaaacctcctcgacctcgcgaaaccgctctaaacccgaccccgactctatcgcgacacccgaaacgcgaccgaaaaacaccccccaccctccccaaaaacgactctcccgaaaacgaaatcgacccgaacgaaccctaaaataaccgaaacacctatttttaaccaaacctaaaaacccccgaaaaaaaaaacgaattaccgcctcctcgaccgataaacgaaaacaacgcgtctccgacgacgtccccgaaccgaaactaaaccacacttacgccatactaaaattccaatcctcgccgctacctccgacgatctaaacgctcgcccccttccccgacgcccctcccgctaccctttacgaatccccaaatcaaaacgaaaaacgattaaacacgaaaaacaacataaaaaaaaactttaaaaaaatcc

SEQ ID NO: 36189 - DNA, 734 bp, Artificial Sequence
  chemically treated genomic DNA (Homo sapiens) CpG-island No: 36189
gttcgcggagtttttgttcgtgtcgtacgttcgggatcgcgaaagtcggggtcgtttcggtttgcgttcgcgtttttaggcgttaatttttttatgggatcggttcgaattttttcgaatcgtatttggcggcgtcgcggttaaggtttcgcgaggatttttcgggcgtcgcgaacgttcgttcgttcgttcgttcgttcgtttcggtcgtcgtcgtcgggcgggttttgggtcggggaggggagtttcgaggagtttttcgaggtcgtttagattttcgggtttcggcggagtttcggtttcgagacgtagggacgattcgcgagcgcggcgggtttcgtttttttttttttcgtttttcgcgggttttagtttgatttttatttggttttcgggcggggcgtgagtagtagtcgggggcgcggaggtttcgcgcgcgacgagggcggcgggggttgggacgatagcggttcgcgcggtttttacgttttcgttgtagttaggagttgaatatttcgtttttttgtacggcgttaatgaggaagatagttacggtaatagtattatttatttttcggcgcgaaacggttgggtcgttttttttttatacgcgcgggcgagcggggcgtggggaaggcgttcgggtttttttggtttgcgttcggggggtattattcgtttcgcgtttcggtattcgtcgaggtttttagatatatttgttttgttgtgggggg

SEQ ID NO: 36190 - DNA, 734 bp, Artificial Sequence
  chemically treated genomic DNA (Homo sapiens) CpG-island No: 36190
ccccccacaacaaaacaaatatatctaaaaacctcgacgaataccgaaacgcgaaacgaataataccccccgaacgcaaaccaaaaaaacccgaacgccttccccacgccccgctcgcccgcgcgtataaaaaaaaaacgacccaaccgtttcgcgccgaaaaataaataatactattaccgtaactatcttcctcattaacgccgtacaaaaaaacgaaatattcaactcctaactacaacgaaaacgtaaaaaccgcgcgaaccgctatcgtcccaacccccgccgccctcgtcgcgcgcgaaacctccgcgcccccgactactactcacgccccgcccgaaaaccaaataaaaatcaaactaaaacccgcgaaaaacgaaaaaaaaaaaaacgaaacccgccgcgctcgcgaatcgtccctacgtctcgaaaccgaaactccgccgaaacccgaaaatctaaacgacctcgaaaaactcctcgaaactcccctccccgacccaaaacccgcccgacgacgacgaccgaaacgaacgaacgaacgaacgaacgaacgttcgcgacgcccgaaaaatcctcgcgaaaccttaaccgcgacgccgccaaatacgattcgaaaaaattcgaaccgatcccataaaaaaattaacgcctaaaaacgcgaacgcaaaccgaaacgaccccgactttcgcgatcccgaacgtacgacacgaacaaaaactccgcgaac

SEQ ID NO: 36191 - DNA, 734 bp, Artificial Sequence
  chemically treated genomic DNA (Homo sapiens) CpG-island No: 36191
ttttttatagtaaggtaggtgtgtttgggggtttcggcgggtgtcggggcgcggggcggatggtgtttttcgggcgtaggttagggaggttcgagcgttttttttacgtttcgttcgttcgcgcgtgtgaggggagggcggtttagtcgtttcgcgtcgggaggtaggtggtgttgttgtcgtgattgttttttttattggcgtcgtgtagagaggcggaatgtttaatttttaattgtagcggaaacgtgggagtcgcgcgggtcgttgtcgttttaattttcgtcgttttcgtcgcgcgcggggttttcgcgttttcggttgttgtttacgtttcgttcgggagttaggtaggggttaggttggagttcgcggagggcggggagggagggggcgaggttcgtcgcgttcgcgagtcgtttttgcgtttcggggtcgaggtttcgtcggagttcgggagtttaggcggtttcgggaggtttttcggggttttttttttcgatttagggttcgttcggcggcggcggtcggagcgagcgggcgggcgagcgagcgagcgttcgcggcgttcgggaagttttcgcgggattttggtcgcggcgtcgttaagtgcggttcgggagagttcgggtcggttttatggagaagttggcgtttggaggcgcgggcgtaggtcggagcggtttcggttttcgcggtttcgggcgtgcggtacgggtaggggtttcgcgagt

SEQ ID NO: 36192 - DNA, 734 bp, Artificial Sequence
  chemically treated genomic DNA (Homo sapiens) CpG-island No: 36192
actcgcgaaacccctacccgtaccgcacgcccgaaaccgcgaaaaccgaaaccgctccgacctacgcccgcgcctccaaacgccaacttctccataaaaccgacccgaactctcccgaaccgcacttaacgacgccgcgaccaaaatcccgcgaaaacttcccgaacgccgcgaacgctcgctcgctcgcccgcccgctcgctccgaccgccgccgccgaacgaaccctaaatcgaaaaaaaaaaccccgaaaaacctcccgaaaccgcctaaactcccgaactccgacgaaacctcgaccccgaaacgcaaaaacgactcgcgaacgcgacgaacctcgccccctccctccccgccctccgcgaactccaacctaacccctacctaactcccgaacgaaacgtaaacaacaaccgaaaacgcgaaaaccccgcgcgcgacgaaaacgacgaaaattaaaacgacaacgacccgcgcgactcccacgtttccgctacaattaaaaattaaacattccgcctctctacacgacgccaataaaaaaaacaatcacgacaacaacaccacctacctcccgacgcgaaacgactaaaccgccctcccctcacacgcgcgaacgaacgaaacgtaaaaaaaacgctcgaacctccctaacctacgcccgaaaaacaccatccgccccgcgccccgacacccgccgaaacccccaaacacacctaccttactataaaaaa

SEQ ID NO: 36193 - DNA, 1179 bp, Artificial Sequence
  chemically treated genomic DNA (Homo sapiens) CpG-island No: 36193
  misc_feature (1130)..(1130): n is either a, c, g or t
cgcggggtttcggagaggggtagtttagaggggtcgggtttgggagtgagattatagcgcgcgttcggtttaggtaaagttcgcggttttcgttttcgtcgtttagtgtattcgcgggaaaggtagtaaagcgagcggcgttttagtgattgtgcggttcgttcggcggggtgtgtgcgtgtgtgtgtgtgcgtgtgtgtgcgtggtgtgtgtgatgtgagtgtggtgcgtatacgggtgtcgtcggggcgtaggcggtgttttcggcgggtgttttgtggttttattaggtagtggttgggttcggttggggcgttcgcgcgggtttcggcgttgacgggcgttttttggcggtcgcgcggacgaggtgcggtttcggcgaggtattggcgcgacgttcgtttcggtttttggcgtttttttgcggcggttttcgggtagcgcgtttgtttgggacgaggtcggttcggaggggttttcggtattttgtaggttggcgattttttcgggttggtgggttttcgcgggtcgcgaggaggtttaggcgtcggggcggggaggtcgcgtatggggttcgtagcggcgggacgggtcgcgggggagaagcggtttttagaggggttttgagtttttcgttcggtttcgtagttgatagggtcgtgtcgtgtcgagggttgtgttattcggcgtagaacggggtggggcgggggtagtaagaggggaaagggggatgggcgagggggaggagaggatgaggaggggaggaggggaagggggatgggcgagggggaggagaggacgaggaggagaggaggggaagggggatgggcgagggggaggagaggatgaggaggggaggaggggaagggggatgggcgagggggaggggaggggaggaggggaagggggatgggcgagggggaggagaggatgaggaggggaggaggggaagggggatgggcgagggggaggagaggattaggaggggaggaggggaaacggggatgggcgagggggaggataggatgaggaggaaaagaggcgaagggggatggtcgaaggggatgagatgatgatgaagagaagatgggaaaggggatgggttatggcgaaagagaggatgaagaggngaggacggggtatgaggatggtttatcggggagtatatgattatgaagt

SEQ ID NO: 36194 - DNA, 1179 bp, Artificial Sequence
  chemically treated genomic DNA (Homo sapiens) CpG-island No: 36194
  misc_feature (50)..(50): n is either a, c, g or t
acttcataatcatatactccccgataaaccatcctcataccccgtcctcncctcttcatcctctctttcgccataacccatcccctttcccatcttctcttcatcatcatctcatccccttcgaccatcccccttcgcctcttttcctcctcatcctatcctccccctcgcccatccccgtttcccctcctcccctcctaatcctctcctccccctcgcccatcccccttcccctcctcccctcctcatcctctcctccccctcgcccatcccccttcccctcctcccctcccctccccctcgcccatcccccttcccctcctcccctcctcatcctctcctccccctcgcccatcccccttcccctcctctcctcctcgtcctctcctccccctcgcccatcccccttcccctcctcccctcctcatcctctcctccccctcgcccatccccctttcccctcttactacccccgccccaccccgttctacgccgaataacacaaccctcgacacgacacgaccctatcaactacgaaaccgaacgaaaaactcaaaacccctctaaaaaccgcttctcccccgcgacccgtcccgccgctacgaaccccatacgcgacctccccgccccgacgcctaaacctcctcgcgacccgcgaaaacccaccaacccgaaaaaatcgccaacctacaaaataccgaaaacccctccgaaccgacctcgtcccaaacaaacgcgctacccgaaaaccgccgcaaaaaaacgccaaaaaccgaaacgaacgtcgcgccaatacctcgccgaaaccgcacctcgtccgcgcgaccgccaaaaaacgcccgtcaacgccgaaacccgcgcgaacgccccaaccgaacccaaccactacctaataaaaccacaaaacacccgccgaaaacaccgcctacgccccgacgacacccgtatacgcaccacactcacatcacacacaccacgcacacacacgcacacacacacacgcacacaccccgccgaacgaaccgcacaatcactaaaacgccgctcgctttactacctttcccgcgaatacactaaacgacgaaaacgaaaaccgcgaactttacctaaaccgaacgcgcgctataatctcactcccaaacccgacccctctaaactacccctctccgaaaccccgcg

SEQ ID NO: 36195 - DNA, 1179 bp, Artificial Sequence
  chemically treated genomic DNA (Homo sapiens) CpG-island No: 36195
  misc_feature (50)..(50): n is either a, c, g or t
gttttatgattatgtgtttttcgatggattatttttatgtttcgtttttntttttttattttttttttcgttatagtttatttttttttttattttttttttattattattttatttttttcgattattttttttcgtttttttttttttttattttgttttttttttcgtttattttcgtttttttttttttttttttaatttttttttttttttcgtttatttttttttttttttttttttttttatttttttttttttttcgtttattttttttttttttttttttttttttttttttcgtttatttttttttttttttttttttttttatttttttttttttttcgtttattttttttttttttttttttttttcgtttttttttttttttcgtttatttttttttttttttttttttttttatttttttttttttttcgtttatttttttttttttttttattattttcgttttatttcgttttgcgtcgagtggtatagttttcggtacggtacggttttgttagttacgaagtcgggcgagaggtttaaggtttttttggagatcgtttttttttcgcggttcgtttcgtcgttgcggattttatgcgcggttttttcgtttcggcgtttgggttttttcgcggttcgcgggggtttattaattcggagaggtcgttagtttgtagggtgtcgggggttttttcgagtcgatttcgttttaggtagacgcgttgttcggagatcgtcgtaagggggcgttaggggtcggggcggacgtcgcgttagtgtttcgtcgggatcgtatttcgttcgcgcggtcgttagagggcgttcgttagcgtcggagttcgcgcggacgttttagtcgagtttagttattgtttggtggagttatagggtattcgtcggaaatatcgtttgcgtttcgacggtattcgtgtgcgtattatatttatattatatatattacgtatatatacgtatatatatatacgtatatatttcgtcgagcgggtcgtatagttattggggcgtcgttcgttttgttgtttttttcgcgggtgtattgagcggcgggagcgggagtcgcgggttttgtttgagtcgggcgcgcgttgtggttttatttttagattcgatttttttgagttgttttttttcgaggtttcgcg

SEQ ID NO: 36196 - DNA, 1179 bp, Artificial Sequence
  chemically treated genomic DNA (Homo sapiens) CpG-island No: 36196
  misc_feature (1130)..(1130): n is either a, c, g or t
cgcgaaacctcgaaaaaaaacaactcaaaaaaatcgaatctaaaaataaaaccacaacgcgcgcccgactcaaacaaaacccgcgactcccgctcccgccgctcaatacacccgcgaaaaaaacaacaaaacgaacgacgccccaataactatacgacccgctcgacgaaatatatacgtatatatatatacgtatatatacgtaatatatataatataaatataatacgcacacgaataccgtcgaaacgcaaacgatatttccgacgaataccctataactccaccaaacaataactaaactcgactaaaacgtccgcgcgaactccgacgctaacgaacgccctctaacgaccgcgcgaacgaaatacgatcccgacgaaacactaacgcgacgtccgccccgacccctaacgcccccttacgacgatctccgaacaacgcgtctacctaaaacgaaatcgactcgaaaaaacccccgacaccctacaaactaacgacctctccgaattaataaacccccgcgaaccgcgaaaaaacccaaacgccgaaacgaaaaaaccgcgcataaaatccgcaacgacgaaacgaaccgcgaaaaaaaaacgatctccaaaaaaaccttaaacctctcgcccgacttcgtaactaacaaaaccgtaccgtaccgaaaactataccactcgacgcaaaacgaaataaaacgaaaataataaaaaaaaaaaaaaaaataaacgaaaaaaaaaaaaaaataaaaaaaaaaaaaaaaaaaaaaaaataaacgaaaaaaaaaaaaaaacgaaaaaaaaaaaaaaaaaaaaaaaataaacgaaaaaaaaaaaaaaataaaaaaaaaaaaaaaaaaaaaaaaataaacgaaaaaaaaaaaaaaaaaaaaaaaaaaaaaaaataaacgaaaaaaaaaaaaaaataaaaaaaaaaaaaaaaaaaaaaaaataaacgaaaaaaaaaaaaaaattaaaaaaaaaaaaaaaaaaacgaaaataaacgaaaaaaaaaacaaaataaaaaaaaaaaaaaacgaaaaaaaataatcgaaaaaaataaaataataataaaaaaaaaataaaaaaaaaaataaactataacgaaaaaaaaaataaaaaaanaaaaacgaaacataaaaataatccatcgaaaaacacataatcataaaac

SEQ ID NO: 36197 - DNA, 667 bp, Artificial Sequence
  chemically treated genomic DNA (Homo sapiens) CpG-island No: 36197
ttagatacggcgtttagttttcgggtttcgggtttagttgagttagggcggcgttttagtcgagtgcggcgtcggaaattcgttcggttgcgttcgaattttcggttagaggttagcgttggaagtttagattatagtattcgggtttaaataggagcggaggcgtcgggaagggtcgggggggtcggttagggtcggttagtttggaagtcgtattttcgcggttttagacgtcggtagggcggagttacgcggtcgtagttttagtcgagacgcgagttcgtggttcgggcgtatgggggttttaacgggagcggttgcgtcgttcggtcgggttaacgtcgtgcgtatgcgtcgattcggcgttattttggtggtcgggcgcggaggtgattttatattgaggcgagcgcggcggtcggggtggtagtggtagtgttcgtgtgtttaggtttgaatcgtcgagggaggaggcggtggaggaagaggtggcggcggtggcggtggtcgtagcggtggcggaggaggcgggtacgaattagttgcgggcggagatatggttaatatcgcggtgtagcgaattaagcgggagtttaaggaggtgttgaagagcgaggaggttagaaatgaattttcggatattttttatttttgtttggggcgggag

SEQ ID NO: 36198 - DNA, 667 bp, Artificial Sequence
  chemically treated genomic DNA (Homo sapiens) CpG-island No: 36198
ctcccgccccaaacaaaaataaaaaatatccgaaaattcatttctaacctcctcgctcttcaacacctccttaaactcccgcttaattcgctacaccgcgatattaaccatatctccgcccgcaactaattcgtacccgcctcctccgccaccgctacgaccaccgccaccgccgccacctcttcctccaccgcctcctccctcgacgattcaaacctaaacacacgaacactaccactaccaccccgaccgccgcgctcgcctcaatataaaatcacctccgcgcccgaccaccaaaataacgccgaatcgacgcatacgcacgacgttaacccgaccgaacgacgcaaccgctcccgttaaaacccccatacgcccgaaccacgaactcgcgtctcgactaaaactacgaccgcgtaactccgccctaccgacgtctaaaaccgcgaaaatacgacttccaaactaaccgaccctaaccgacccccccgacccttcccgacgcctccgctcctatttaaacccgaatactataatctaaacttccaacgctaacctctaaccgaaaattcgaacgcaaccgaacgaatttccgacgccgcactcgactaaaacgccgccctaactcaactaaacccgaaacccgaaaactaaacgccgtatctaa

SEQ ID NO: 36199 - DNA, 667 bp, Artificial Sequence
  chemically treated genomic DNA (Homo sapiens) CpG-island No: 36199
ttttcgttttaggtagaggtgggggatattcgggagtttatttttgattttttcgttttttagtatttttttgaattttcgtttgattcgttgtatcgcgatgttggttatgttttcgttcgtagttgattcgtattcgtttttttcgttatcgttacgattatcgttatcgtcgttatttttttttttatcgttttttttttcggcgatttagatttgagtatacgaatattgttattattatttcggtcgtcgcgttcgttttagtgtggaattattttcgcgttcggttattaaaatggcgtcgggtcggcgtatgcgtacgacgttgattcggtcgggcggcgtagtcgttttcgttggagtttttatacgttcgagttacgagttcgcgtttcggttggggttgcggtcgcgtggtttcgttttgtcggcgtttggggtcgcgagggtgcggtttttaagttggtcggttttagtcggttttttcggtttttttcggcgttttcgtttttgtttaaattcgggtgttgtggtttgggtttttagcgttggtttttgatcgaaggttcgggcgtaatcgaacgggttttcgacgtcgtattcggttggaacgtcgttttgatttagttagattcggaattcggaggttgaacgtcgtgtttag

SEQ ID NO: 36200 - DNA, 667 bp, Artificial Sequence
  chemically treated genomic DNA (Homo sapiens) CpG-island No: 36200
ctaaacacgacgttcaacctccgaattccgaatctaactaaatcaaaacgacgttccaaccgaatacgacgtcgaaaacccgttcgattacgcccgaaccttcgatcaaaaaccaacgctaaaaacccaaaccacaacacccgaatttaaacaaaaacgaaaacgccgaaaaaaaccgaaaaaaccgactaaaaccgaccaacttaaaaaccgcaccctcgcgaccccaaacgccgacaaaacgaaaccacgcgaccgcaaccccaaccgaaacgcgaactcgtaactcgaacgtataaaaactccaacgaaaacgactacgccgcccgaccgaatcaacgtcgtacgcatacgccgacccgacgccattttaataaccgaacgcgaaaataattccacactaaaacgaacgcgacgaccgaaataataataacaatattcgtatactcaaatctaaatcgccgaaaaaaaaaacgataaaaaaaaaaataacgacgataacgataatcgtaacgataacgaaaaaaacgaatacgaatcaactacgaacgaaaacataaccaacatcgcgatacaacgaatcaaacgaaaattcaaaaaaatactaaaaaacgaaaaaatcaaaaataaactcccgaatatcccccacctctacctaaaacgaaaa

SEQ ID NO: 36201 - DNA, 531 bp, Artificial Sequence
  chemically treated genomic DNA (Homo sapiens) CpG-island No: 36201
tttttcgattttttaaaggcgttttttttttagtttttttcgattttagggatttgtaatttgggatttaaagttttcgagagggtagaacgattatttaaaacgaattgcgttagcgagtgttgtcgttttttttaacggttttggaagattatcgtttcgggttttaggcgcgttttgtttcgtgtttattttcgatattatttttaagagcgttatcgcggagcgggcgttttttggacgttgcggggttattcgggttcggtaggttattcgggttcggtagatttcgggcgggttttgagggttgagttaggtttaagagggcgggcggggtcgcggggtatcgataggtcgagggtagggaattgattcggtttacgtagattttcgcgtcgtttttttttcgtttatcgtagttattggtcgattttcgattcgttttttgttttttggggtcgtttatttaatttattagttttttaaattttttttgggattttagtggcgagtattcgtcgttggtttttt

SEQ ID NO: 36202 - DNA, 531 bp, Artificial Sequence
  chemically treated genomic DNA (Homo sapiens) CpG-island No: 36202
aaaaaaccaacgacgaatactcgccactaaaatcccaaaaaaaatttaaaaaactaataaattaaataaacgaccccaaaaaacaaaaaacgaatcgaaaatcgaccaataactacgataaacgaaaaaaaaacgacgcgaaaatctacgtaaaccgaatcaattccctaccctcgacctatcgataccccgcgaccccgcccgccctcttaaacctaactcaaccctcaaaacccgcccgaaatctaccgaacccgaataacctaccgaacccgaataaccccgcaacgtccaaaaaacgcccgctccgcgataacgctcttaaaaataatatcgaaaataaacacgaaacaaaacgcgcctaaaacccgaaacgataatcttccaaaaccgttaaaaaaaacgacaacactcgctaacgcaattcgttttaaataatcgttctaccctctcgaaaactttaaatcccaaattacaaatccctaaaatcgaaaaaaactaaaaaaaaaacgcctttaaaaaatcgaaaaa

SEQ ID NO: 36203 - DNA, 531 bp, Artificial Sequence
  chemically treated genomic DNA (Homo sapiens) CpG-island No: 36203
agaaggttagcggcgagtgttcgttattagggttttagggagggtttggaaaattgatgagttaagtgagcgattttaggggatagagggcgagtcgagagtcggttaatggttgcggtgggcggggagaagacgacgcggggatttgcgtgggtcgggttaattttttattttcgatttgtcgatgtttcgcggtttcgttcgtttttttaagtttggtttagtttttagggttcgttcgaagtttatcgagttcgagtggtttatcgagttcgagtggtttcgtagcgtttaggaggcgttcgtttcgcggtggcgtttttggaggtggtgtcggaggtaggtacgggataggacgcgtttggggttcggggcggtggttttttagggtcgttggggagggcggtagtattcgttggcgtagttcgttttggatggtcgttttgttttttcgggggttttgaattttaagttgtagatttttgaggtcggaggaggttaggagaagggcgtttttggaggatcgggagg

SEQ ID NO: 36204 - DNA, 531 bp, Artificial Sequence
  chemically treated genomic DNA (Homo sapiens) CpG-island No: 36204
cctcccgatcctccaaaaacgcccttctcctaacctcctccgacctcaaaaatctacaacttaaaattcaaaacccccgaaaaaacaaaacgaccatccaaaacgaactacgccaacgaatactaccgccctccccaacgaccctaaaaaaccaccgccccgaaccccaaacgcgtcctatcccgtacctacctccgacaccacctccaaaaacgccaccgcgaaacgaacgcctcctaaacgctacgaaaccactcgaactcgataaaccactcgaactcgataaacttcgaacgaaccctaaaaactaaaccaaacttaaaaaaacgaacgaaaccgcgaaacatcgacaaatcgaaaataaaaaattaacccgacccacgcaaatccccgcgtcgtcttctccccgcccaccgcaaccattaaccgactctcgactcgccctctatcccctaaaatcgctcacttaactcatcaattttccaaaccctccctaaaaccctaataacgaacactcgccgctaaccttct

SEQ ID NO: 36205 - DNA, 591 bp, Artificial Sequence
  chemically treated genomic DNA (Homo sapiens) CpG-island No: 36205
atggtcggtacgcgttgggtattcggggcgttgtttcggggttgcggttgtaattgtagtagttgtcggcgtatcggcgtcgtttgtttgtttttttatttcgtcgttggttttatttcgtcgggcgtttcgggtcgtcgtcgtttgttgttgttgttcggggtcgtcgcggtcgttgttttttagacgcgtggtttttagatcgggtttgtgtttttcgggaggttggcggggtttttcgttgtggttatttttgtcgcggtcgcggtcgtcgcgttttattttgtttttcgtgtttttttgttgtcgtagtcgttggcggcggcggtcgtcgtttcgacgcgtagttatagttaggtacgtgggcgtcgtgagggatttggcgcgagatttttttcgggtcgcgtgtacgcgttttcgcgttttttcgttttttcgtgtgcgtttcgcgggtacgttcggggattcgcgatattcgtcgtatattcgttttcgtttattttgtgtttttattgggttttggaataagggaagtttttttaggcgtcgggttttttgtttgttttgttttcgtttcgagtttttggtcgg

SEQ ID NO: 36206 - DNA, 591 bp, Artificial Sequence
  chemically treated genomic DNA (Homo sapiens) CpG-island No: 36206
ccgaccaaaaactcgaaacgaaaacaaaacaaacaaaaaacccgacgcctaaaaaaacttcccttattccaaaacccaataaaaacacaaaataaacgaaaacgaatatacgacgaatatcgcgaatccccgaacgtacccgcgaaacgcacacgaaaaaacgaaaaaacgcgaaaacgcgtacacgcgacccgaaaaaaatctcgcgccaaatccctcacgacgcccacgtacctaactataactacgcgtcgaaacgacgaccgccgccgccaacgactacgacaacaaaaaaacacgaaaaacaaaataaaacgcgacgaccgcgaccgcgacaaaaataaccacaacgaaaaaccccgccaacctcccgaaaaacacaaacccgatctaaaaaccacgcgtctaaaaaacaacgaccgcgacgaccccgaacaacaacaacaaacgacgacgacccgaaacgcccgacgaaataaaaccaacgacgaaataaaaaaacaaacaaacgacgccgatacgccgacaactactacaattacaaccgcaaccccgaaacaacgccccgaatacccaacgcgtaccgaccat

SEQ ID NO: 36207 - DNA, 591 bp, Artificial Sequence
  chemically treated genomic DNA (Homo sapiens) CpG-island No: 36207
tcgattagagattcgaggcgagaataaaataagtagaagattcgacgtttgggagagttttttttgttttagggtttaataggagtatagggtggacgggggcgggtgtgcggcgagtgtcgcggattttcgggcgtgttcgcgaggcgtatacggagggacggaggggcgcgggggcgcgtgtacgcggttcgggagggatttcgcgttaggttttttacggcgtttacgtatttggttgtagttgcgcgtcgggacggcggtcgtcgtcgttagcgattgcggtagtagagaggtacggagggtagagtaggacgcggcggtcgcggtcgcggtagaggtggttatagcgggaggtttcgttagtttttcgggaggtataggttcggtttggaggttacgcgtttgggaggtagcggtcgcggcggtttcgagtagtagtagtaggcggcggcggttcgagacgttcgacgggatagagttagcggcggagtagaagggtaggtaggcggcgtcggtgcgtcggtagttgttgtagttatagtcgtagtttcggagtagcgtttcgagtatttagcgcgtgtcggttat

SEQ ID NO: 36208 - DNA, 591 bp, Artificial Sequence
  chemically treated genomic DNA (Homo sapiens) CpG-island No: 36208
ataaccgacacgcgctaaatactcgaaacgctactccgaaactacgactataactacaacaactaccgacgcaccgacgccgcctacctacccttctactccgccgctaactctatcccgtcgaacgtctcgaaccgccgccgcctactactactactcgaaaccgccgcgaccgctacctcccaaacgcgtaacctccaaaccgaacctatacctcccgaaaaactaacgaaacctcccgctataaccacctctaccgcgaccgcgaccgccgcgtcctactctaccctccgtacctctctactaccgcaatcgctaacgacgacgaccgccgtcccgacgcgcaactacaaccaaatacgtaaacgccgtaaaaaacctaacgcgaaatccctcccgaaccgcgtacacgcgcccccgcgcccctccgtccctccgtatacgcctcgcgaacacgcccgaaaatccgcgacactcgccgcacacccgcccccgtccaccctatactcctattaaaccctaaaacaaaaaaaactctcccaaacgtcgaatcttctacttattttattctcgcctcgaatctctaatcga

SEQ ID NO: 36209 - DNA, 882 bp, Artificial Sequence
  chemically treated genomic DNA (Homo sapiens) CpG-island No: 36209
tcgattttattcgttcgttgttttgtacgttattgaagtgatcgttttttttgaatttcggtatttaataattcggaagttggacgtttgaagtttatgcggtttagcgtttttatttcggttcgtgttgggggcggggagagaagttcgtagggtttttggcgcggggttcgggtagtcgcggtggcgcggtttatgttcggggttatttttcgcgtttcggggtttcgtaggcgcgagcgcggcgagcggcgcgcggttgagttcgtaggacgttttttagtttcgtcggcggcgcgtcgcgagttttttatttttcgtttatcggcggttgcgcgtattgtatattcgtttgtcgtcgtcgtcgtacgtcgtttgttttttgcgcgtcgtcgtcgcgtttagcgttcgggttcgcgatatcgttcgttaagcgtcgggtcgagtttacgtagtcgcggtttggcggtttcgcggcggcggcgggtgcgggcggtttggtcggtgtcggttaaagggacgagttgtaaatattttaggaagtgataagtcgattttttttttttcgggagtcgttcgtataaagcgttcggcgtcggtaggcgagcgtgcgcgcggcggacgcgcggcgggtatttcggacgatttggcgagcgttggcggtgacggcgcggggttcgcgttcggagcgtttcgtcgcgtatagtaagcgattcggggtcgggcggcggcggcggtggtcggggggttggtttcgagcgaggttcgggtcgtgtgcgtttcggtcgttggttggagggagttcggttcgcgtgcgtaatgggtttgttttttttttttttttttttttaatgttgttggttttttttttttttgttttgt

SEQ ID NO: 36210 - DNA, 882 bp, Artificial Sequence
  chemically treated genomic DNA (Homo sapiens) CpG-island No: 36210
acaaaacaaaaaaaaaaaaaaccaacaacattaaaaaaaaaaaaaaaaaaaaaacaaacccattacgcacgcgaaccgaactccctccaaccaacgaccgaaacgcacacgacccgaacctcgctcgaaaccaaccccccgaccaccgccgccgccgcccgaccccgaatcgcttactatacgcgacgaaacgctccgaacgcgaaccccgcgccgtcaccgccaacgctcgccaaatcgtccgaaatacccgccgcgcgtccgccgcgcgcacgctcgcctaccgacgccgaacgctttatacgaacgactcccgaaaaaaaaaaaatcgacttatcacttcctaaaatatttacaactcgtccctttaaccgacaccgaccaaaccgcccgcacccgccgccgccgcgaaaccgccaaaccgcgactacgtaaactcgacccgacgcttaacgaacgatatcgcgaacccgaacgctaaacgcgacgacgacgcgcaaaaaacaaacgacgtacgacgacgacgacaaacgaatatacaatacgcgcaaccgccgataaacgaaaaataaaaaactcgcgacgcgccgccgacgaaactaaaaaacgtcctacgaactcaaccgcgcgccgctcgccgcgctcgcgcctacgaaaccccgaaacgcgaaaaataaccccgaacataaaccgcgccaccgcgactacccgaaccccgcgccaaaaaccctacgaacttctctccccgcccccaacacgaaccgaaataaaaacgctaaaccgcataaacttcaaacgtccaacttccgaattattaaataccgaaattcaaaaaaaacgatcacttcaataacgtacaaaacaacgaacgaataaaatcga

SEQ ID NO: 36211 - DNA, 882 bp, Artificial Sequence
  chemically treated genomic DNA (Homo sapiens) CpG-island No: 36211
ataaggtagaaaaaaaggaaattagtaatattaggaaaaaagaaaaaaaaaaggtaagtttattgcgtacgcgagtcgggttttttttagttagcggtcgggacgtatacggttcggatttcgttcggggttagtttttcggttatcgtcgtcgtcgttcggtttcgggtcgtttattgtgcgcggcggggcgtttcgggcgcggatttcgcgtcgttatcgttagcgttcgttaagtcgttcggggtgttcgtcgcgcgttcgtcgcgcgtacgttcgtttgtcggcgtcgagcgttttgtacgagcgattttcggggaggaggaaatcgatttgttattttttgaagtgtttgtaattcgtttttttaatcggtatcggttaggtcgttcgtattcgtcgtcgtcgcggagtcgttagatcgcggttgcgtgaattcggttcggcgtttagcgggcggtgtcgcgggttcgggcgttaggcgcggcggcggcgcgtaggaggtaggcggcgtgcggcggcggcggtaggcgagtgtgtagtgcgcgtagtcgtcgatgggcggggagtgagggattcgcggcgcgtcgtcggcggggttagagggcgttttgcgggtttagtcgcgcgtcgttcgtcgcgttcgcgtttgcgaggtttcgggacgcgggaagtggtttcgggtatgggtcgcgttatcgcggttgttcgggtttcgcgttagaggttttacgggttttttttttcgtttttagtacgagtcgggatgaaaacgttgggtcgtataggttttaggcgtttagttttcgggttgttagatgtcgaggtttaaaagaaacgattattttagtggcgtgtaggatagcgggcgggtggggtcgg

SEQ ID NO: 36212 - DNA, 882 bp, Artificial Sequence
  chemically treated genomic DNA (Homo sapiens) CpG-island No: 36212
ccgaccccacccgcccgctatcctacacgccactaaaataatcgtttcttttaaacctcgacatctaacaacccgaaaactaaacgcctaaaacctatacgacccaacgttttcatcccgactcgtactaaaaacgaaaaaaaaaacccgtaaaacctctaacgcgaaacccgaacaaccgcgataacgcgacccatacccgaaaccacttcccgcgtcccgaaacctcgcaaacgcgaacgcgacgaacgacgcgcgactaaacccgcaaaacgccctctaaccccgccgacgacgcgccgcgaatccctcactccccgcccatcgacgactacgcgcactacacactcgcctaccgccgccgccgcacgccgcctacctcctacgcgccgccgccgcgcctaacgcccgaacccgcgacaccgcccgctaaacgccgaaccgaattcacgcaaccgcgatctaacgactccgcgacgacgacgaatacgaacgacctaaccgataccgattaaaaaaacgaattacaaacacttcaaaaaataacaaatcgatttcctcctccccgaaaatcgctcgtacaaaacgctcgacgccgacaaacgaacgtacgcgcgacgaacgcgcgacgaacaccccgaacgacttaacgaacgctaacgataacgacgcgaaatccgcgcccgaaacgccccgccgcgcacaataaacgacccgaaaccgaacgacgacgacgataaccgaaaaactaaccccgaacgaaatccgaaccgtatacgtcccgaccgctaactaaaaaaaacccgactcgcgtacgcaataaacttaccttttttttttcttttttcctaatattactaatttcctttttttctaccttat

SEQ ID NO: 36213 - DNA, 607 bp, Artificial Sequence
  chemically treated genomic DNA (Homo sapiens) CpG-island No: 36213
attgttcgcgggtttttagcgtcgacgggacgaaatcgtttttttcgggattgtttttgttcgatcgcgtcgttatcgtagcgttatcgtcgtcgttagcgttcgagtttatttcgttttacgttttggacggtcgttggggtcgttatagagacggggtataggtagagcggacgagcggatcggcgtttttaggcggcgggaggtcgttttttcgattgttttagttttcgcgttggggttgggatggggacgcgacgttttttgttttattttcggttttttgcgtcggcggggatcgtgcgttttttttatagcgttagtggtatttttttcgtcgaggtttaagagcggttgtatttggggattgttgttcgtgagggattattagaggtattgtattttggaaaacggttggttttcgtatcgtggatatttaaagtcgacgtcgttttatttaaacgtagaaattattttatttttttattgcgtgcgtttgtttgcgaagcgggtgcgagcgtttatttagttatttggttttttggtaagaggttaatttcgtttttggttaagattttgatttgaaaattgcgttttggttttttgt

SEQ ID NO: 36214 - DNA, 607 bp, Artificial Sequence
  chemically treated genomic DNA (Homo sapiens) CpG-island No: 36214
acaaaaaaccaaaacgcaattttcaaatcaaaatcttaaccaaaaacgaaattaacctcttaccaaaaaaccaaataactaaataaacgctcgcacccgcttcgcaaacaaacgcacgcaataaaaaaataaaataatttctacgtttaaataaaacgacgtcgactttaaatatccacgatacgaaaaccaaccgttttccaaaatacaatacctctaataatccctcacgaacaacaatccccaaatacaaccgctcttaaacctcgacgaaaaaaataccactaacgctataaaaaaaacgcacgatccccgccgacgcaaaaaaccgaaaataaaacaaaaaacgtcgcgtccccatcccaaccccaacgcgaaaactaaaacaatcgaaaaaacgacctcccgccgcctaaaaacgccgatccgctcgtccgctctacctataccccgtctctataacgaccccaacgaccgtccaaaacgtaaaacgaaataaactcgaacgctaacgacgacgataacgctacgataacgacgcgatcgaacaaaaacaatcccgaaaaaaacgatttcgtcccgtcgacgctaaaaacccgcgaacaat

SEQ ID NO: 36215 - DNA, 607 bp, Artificial Sequence
  chemically treated genomic DNA (Homo sapiens) CpG-island No: 36215
ataagaggttagaacgtagtttttaagttagaattttagttagaaacgaagttggttttttgttaaggagttaaataattggatggacgttcgtattcgtttcgtagataggcgtacgtagtggagaggtgaagtgatttttgcgtttgggtagagcggcgtcggttttaggtgtttacggtgcggaagttagtcgttttttaaaatgtaatatttttaatggttttttacgaatagtagtttttaaatatagtcgtttttggatttcgacgaaggggatgttattaacgttgtggggagagcgtacggttttcgtcggcgtagggagtcgggggtagagtagagggcgtcgcgtttttattttagttttagcgcgggggttggagtagtcgagagggcggtttttcgtcgtttagaggcgtcggttcgttcgttcgttttgtttgtgtttcgtttttatggcggttttaacggtcgtttaggacgtggagcgaaatgagttcgggcgttgacggcggcggtggcgttgcggtggcggcgcggtcggataagggtagtttcggggaggacggtttcgtttcgtcggcgttggggattcgcgagtagt

SEQ ID NO: 36216 - DNA, 607 bp, Artificial Sequence
  chemically treated genomic DNA (Homo sapiens) CpG-island No: 36216
actactcgcgaatccccaacgccgacgaaacgaaaccgtcctccccgaaactacccttatccgaccgcgccgccaccgcaacgccaccgccgccgtcaacgcccgaactcatttcgctccacgtcctaaacgaccgttaaaaccgccataaaaacgaaacacaaacaaaacgaacgaacgaaccgacgcctctaaacgacgaaaaaccgccctctcgactactccaacccccgcgctaaaactaaaataaaaacgcgacgccctctactctacccccgactccctacgccgacgaaaaccgtacgctctccccacaacgttaataacatccccttcgtcgaaatccaaaaacgactatatttaaaaactactattcgtaaaaaaccattaaaaatattacattttaaaaaacgactaacttccgcaccgtaaacacctaaaaccgacgccgctctacccaaacgcaaaaatcacttcacctctccactacgtacgcctatctacgaaacgaatacgaacgtccatccaattatttaactccttaacaaaaaaccaacttcgtttctaactaaaattctaacttaaaaactacgttctaacctcttat

SEQ ID NO: 36217 - DNA, 588 bp, Artificial Sequence
  chemically treated genomic DNA (Homo sapiens) CpG-island No: 36217
acgcgggcgaacgatgcggttaatcgttataaattgttgaaaaaagatgcgcgtattatcgtcgtttagtaggtagtaaggttggaattcgttatgtgtttgcgtcgtcgttggtcgttggaaaatttttagttttttttggttgagtattcgttggttcgttatttaattcgtcgtttgatttggggcgtttatagcgtcgaaaattagttattggtttgttttcgcgtagtagaagataatagttttagtatcgttgacgatgatttttttattttgtcggaaggcgatatttttatcggtattttttacgttttggaaatattattaacggatgttgtcgttttggttagttttttgtcgattacgaattgttattatcgtttcgttagttcgatcgtaatagttacgttttgatagaagtcgagcgtaatgttagtgaattgattcgttgggtaggtagaaaatgttcgagtggtcgggttatggggttggcgaataaaggttggataaagggcgaattataggatggaggttggatcggatggatgattaaatttttgggtcgttggtcgttaattatggaaa

SEQ ID NO: 36218 - DNA, 588 bp, Artificial Sequence
  chemically treated genomic DNA (Homo sapiens) CpG-island No: 36218
tttccataattaacgaccaacgacccaaaaatttaatcatccatccgatccaacctccatcctataattcgccctttatccaacctttattcgccaaccccataacccgaccactcgaacattttctacctacccaacgaatcaattcactaacattacgctcgacttctatcaaaacgtaactattacgatcgaactaacgaaacgataataacaattcgtaatcgacaaaaaactaaccaaaacgacaacatccgttaataatatttccaaaacgtaaaaaataccgataaaaatatcgccttccgacaaaataaaaaaatcatcgtcaacgatactaaaactattatcttctactacgcgaaaacaaaccaataactaattttcgacgctataaacgccccaaatcaaacgacgaattaaataacgaaccaacgaatactcaaccaaaaaaaactaaaaattttccaacgaccaacgacgacgcaaacacataacgaattccaaccttactacctactaaacgacgataatacgcgcatcttttttcaacaatttataacgattaaccgcatcgttcgcccgcgt

SEQ ID NO: 36219 - DNA, 588 bp, Artificial Sequence
  chemically treated genomic DNA (Homo sapiens) CpG-island No: 36219
tttttatgattaacgattagcgatttaaaggtttgattatttattcgatttagtttttattttgtggttcgttttttatttagtttttattcgttagttttatgattcgattattcgggtattttttgtttgtttagcgggttagtttattggtattgcgttcggtttttgttagggcgtagttgttacggtcgagttggcggaacggtggtagtagttcgtagtcggtaaaaagttgattaaggcggtagtattcgttggtgatatttttagaacgtgaggagtgtcgatagagatatcgtttttcggtagggtgaaaagattatcgttagcggtgttggagttgttattttttgttacgcgaaagtaagttagtagttggttttcggcgttataaacgttttaaattagacggcgggttaagtgacgaattagcggatgtttaattaggaagagttggaagttttttagcgattagcggcggcgtaggtatatggcggattttagttttgttatttgttgggcggcgatggtacgcgtatttttttttagtaatttgtagcggttaatcgtatcgttcgttcgcgt

SEQ ID NO: 36220 - DNA, 588 bp, Artificial Sequence
  chemically treated genomic DNA (Homo sapiens) CpG-island No: 36220
acgcgaacgaacgatacgattaaccgctacaaattactaaaaaaaaatacgcgtaccatcgccgcccaacaaataacaaaactaaaatccgccatatacctacgccgccgctaatcgctaaaaaacttccaactcttcctaattaaacatccgctaattcgtcacttaacccgccgtctaatttaaaacgtttataacgccgaaaaccaactactaacttactttcgcgtaacaaaaaataacaactccaacaccgctaacgataatcttttcaccctaccgaaaaacgatatctctatcgacactcctcacgttctaaaaatatcaccaacgaatactaccgccttaatcaactttttaccgactacgaactactaccaccgttccgccaactcgaccgtaacaactacgccctaacaaaaaccgaacgcaataccaataaactaacccgctaaacaaacaaaaaatacccgaataatcgaatcataaaactaacgaataaaaactaaataaaaaacgaaccacaaaataaaaactaaatcgaataaataatcaaacctttaaatcgctaatcgttaatcataaaaa

SEQ ID NO: 36221 - DNA, 508 bp, Artificial Sequence
  chemically treated genomic DNA (Homo sapiens) CpG-island No: 36221
cgtttttattgttcggggatggggagtaagtttagttagtcgttgttttcgggtgtcgcgtgcgtagttgtacgttatttttagacgaatcgatgattggatggatggtcgtcgtagtcgttatattgatgatacggatgtgttttttcgtatatattatgttatcggagagttgttaacgtatggttatcgtcgggtatgggcgttgtttcgtagataggtagaatttgatggtatgtttgcgattaatgttaaacgtgtttatcggattatgcgttagaatgcgttgttgtttgagcgaaaatttgttgtatcgttatcgaaacgggtatatataggtagagtggtcgtgaaagaaagtaattagcgatggtgttttgacgggttcgagttttgttgtgataacggagagagaattgcgtgttacgttcggcgttggattgtttgtgattcgtgagtattggattgggcgggtattatttcgcggggtttaatagtgtaaatcgtt

SEQ ID NO: 36222 - DNA, 508 bp, Artificial Sequence
  chemically treated genomic DNA (Homo sapiens) CpG-island No: 36222
aacgatttacactattaaaccccgcgaaataatacccgcccaatccaatactcacgaatcacaaacaatccaacgccgaacgtaacacgcaattctctctccgttatcacaacaaaactcgaacccgtcaaaacaccatcgctaattactttctttcacgaccactctacctatatatacccgtttcgataacgatacaacaaattttcgctcaaacaacaacgcattctaacgcataatccgataaacacgtttaacattaatcgcaaacataccatcaaattctacctatctacgaaacaacgcccatacccgacgataaccatacgttaacaactctccgataacataatatatacgaaaaaacacatccgtatcatcaatataacgactacgacgaccatccatccaatcatcgattcgtctaaaaataacgtacaactacgcacgcgacacccgaaaacaacgactaactaaacttactccccatccccgaacaataaaaacg

SEQ ID NO: 36223 - DNA, 508 bp, Artificial Sequence
  chemically treated genomic DNA (Homo sapiens) CpG-island No: 36223
aacggtttatattgttgaatttcgcgggatagtgttcgtttagtttagtgtttacggattataagtagtttagcgtcgaacgtgatacgtagtttttttttcgttattatagtagaattcgaattcgttagagtattatcgttgattgtttttttttacggttattttgtttgtatgtgttcgtttcgatggcggtatagtaggttttcgtttaagtaatagcgtattttggcgtatgattcggtaaatacgtttggtattgatcgtaggtatattattaagttttgtttgtttgcgaagtagcgtttatattcgacgataattatacgttggtagtttttcgataatatggtgtatacggagaagtatattcgtattattagtgtgacgattgcggcggttatttatttagttatcggttcgtttgagaatgacgtgtaattgcgtacgcgatattcggagataacggttgattaagtttattttttattttcgggtaataagggcg

SEQ ID NO: 36224 - DNA, 508 bp, Artificial Sequence
  chemically treated genomic DNA (Homo sapiens) CpG-island No: 36224
cgcccttattacccgaaaataaaaaataaacttaatcaaccgttatctccgaatatcgcgtacgcaattacacgtcattctcaaacgaaccgataactaaataaataaccgccgcaatcgtcacactaataatacgaatatacttctccgtatacaccatattatcgaaaaactaccaacgtataattatcgtcgaatataaacgctacttcgcaaacaaacaaaacttaataatatacctacgatcaataccaaacgtatttaccgaatcatacgccaaaatacgctattacttaaacgaaaacctactataccgccatcgaaacgaacacatacaaacaaaataaccgtaaaaaaaaacaatcaacgataatactctaacgaattcgaattctactataataacgaaaaaaaaactacgtatcacgttcgacgctaaactacttataatccgtaaacactaaactaaacgaacactatcccgcgaaattcaacaatataaaccgtt

SEQ ID NO: 36225 - DNA, 1092 bp, Artificial Sequence
  chemically treated genomic DNA (Homo sapiens) CpG-island No: 36225
tttgcgttcgcgattttatttcgtcggtttgttggatatcgtttattagtttatcgttcgttacgttcgtagcgttaaagaggatatcgtttttttttattagtttatcgagcgagtatatacggttaacgttaacgtttattgttttgtaacgtttgcgtttttgttttgtaatttgtcgatttttcgtgtaattttttttagtttggtaaaagttaattagttcggtttgtatattttcgtttaatgttttaacggtataggtagaaattacgttttttggcgtatcgtcgatggtgtatattatatcgtaaggattattttgttagtaggttagtacgttggcggcgatatcgttattcggtagggtaaaaatttttacgtttagttgtgttgtttttttaatcgcggtatttaggcgcggtttatttagcgtaattatgcgtagtttatttagcggtttgtttaacgttttcgttacgttgcgtaggttgttcgttagaggtaaagatagattaatcgcgttcgtcgttagtcgattaataattagtttttttatatatatatcgggcgtatgtaataggttatttcgaggggcgaaagttatgatcgttagcgtattgttttgttttatcgttattattcgcgtgtttttaatgggattaatcgcgatatcgatttttggtttatcgtttttgtttattttttcgttaatttatagtatcggcgtatggttaatttttttttcgtcgataattattcgtttacgaaaagcgacgtcgtttaatgtttggcgtatcgcggtgatcgttaggttattaattttattttgtcgttatattcggtttgcggttaggtagttaacgttgtttgtttcgtaacgcgaaataatggttacgttaggatattattgcgcggttttttcgatattaacgttaaattgtgttagtagatatttttcggtttgtttattttagatgtcgtgcgtttttttaattagtcgcgttaattttttaaatagcggatcggttttgtttttttcggtaaaatcggtaatggtagtgagcggtatggttacgtcgttataaatga

SEQ ID NO: 36226 - DNA, 1092 bp, Artificial Sequence
  chemically treated genomic DNA (Homo sapiens) CpG-island No: 36226
tcatttataacgacgtaaccataccgctcactaccattaccgattttaccgaaaaaaacaaaaccgatccgctatttaaaaaattaacgcgactaattaaaaaaacgcacgacatctaaaataaacaaaccgaaaaatatctactaacacaatttaacgttaatatcgaaaaaaccgcgcaataatatcctaacgtaaccattatttcgcgttacgaaacaaacaacgttaactacctaaccgcaaaccgaatataacgacaaaataaaattaataacctaacgatcaccgcgatacgccaaacattaaacgacgtcgcttttcgtaaacgaataattatcgacgaaaaaaaaattaaccatacgccgatactataaattaacgaaaaaataaacaaaaacgataaaccaaaaatcgatatcgcgattaatcccattaaaaacacgcgaataataacgataaaacaaaacaatacgctaacgatcataactttcgcccctcgaaataacctattacatacgcccgatatatatataaaaaaactaattattaatcgactaacgacgaacgcgattaatctatctttacctctaacgaacaacctacgcaacgtaacgaaaacgttaaacaaaccgctaaataaactacgcataattacgctaaataaaccgcgcctaaataccgcgattaaaaaaacaacacaactaaacgtaaaaatttttaccctaccgaataacgatatcgccgccaacgtactaacctactaacaaaataatccttacgatataatatacaccatcgacgatacgccaaaaaacgtaatttctacctataccgttaaaacattaaacgaaaatatacaaaccgaactaattaacttttaccaaactaaaaaaaattacacgaaaaatcgacaaattacaaaacaaaaacgcaaacgttacaaaacaataaacgttaacgttaaccgtatatactcgctcgataaactaataaaaaaaaacgatatcctctttaacgctacgaacgtaacgaacgataaactaataaacgatatccaacaaaccgacgaaataaaatcgcgaacgcaaa

SEQ ID NO: 36227 - DNA, 1092 bp, Artificial Sequence
  chemically treated genomic DNA (Homo sapiens) CpG-island No: 36227
ttatttataacggcgtgattatgtcgtttattgttattgtcgattttgtcgaaaaaggtaaaatcgattcgttgtttaaagagttggcgcggttggttgaggaaacgtacggtatttggaatgaataggtcgagaaatatttgttggtataatttggcgttgatatcggggaggtcgcgtaatgatgttttggcgtggttattatttcgcgttacggaataggtagcgttggttgtttggtcgtaaatcggatgtggcgataaaataaaattgatggtttggcggttatcgcgatgcgttaggtattaaacgacgtcgtttttcgtggacgagtggttatcggcgaaggagaaattgattatgcgtcgatgttgtggattggcgaagaggtgggtaaaggcgatgggttagaagtcgatatcgcggttgattttattgaaggtacgcggatggtggcgatggggtagagtaatgcgttggcggttatggttttcgtttttcgagatagtttgttatatgcgttcgatatgtatatgaaaaagttggttgttaatcggttggcggcgggcgcgattgatttgtttttgtttttgacggataatttgcgtaacgtggcgaaagcgttaggtaaatcgttggataagttgcgtatggttacgttggataaatcgcgtttgagtgtcgcgattgaggaagtaatatagttgggcgtgaaggtttttgttttgtcggatggcgatgtcgtcgttagcgtgttgatttgttggtaggataatttttacgatgtgatgtatattatcggcggtgcgttagaaggcgtgatttttgtttgtgtcgttaaagtattaggcggggatatgtaggtcgagttgattgatttttgttaggttaaaggggattatacggaaaatcggtagattgtagagtaggagcgtaagcgttgtaaggtaatgggcgttgacgttaatcgtgtgtattcgttcgatgaattggtgagggggaacgatattttttttagcgttacgggcgtgacgggcggtgagttggtgaacggtatttaatagatcggcgaagtggggtcgcggacgtaga

SEQ ID NO: 36228 - DNA, 1092 bp, Artificial Sequence
  chemically treated genomic DNA (Homo sapiens) CpG-island No: 36228
tctacgtccgcgaccccacttcgccgatctattaaataccgttcaccaactcaccgcccgtcacgcccgtaacgctaaaaaaaatatcgttccccctcaccaattcatcgaacgaatacacacgattaacgtcaacgcccattaccttacaacgcttacgctcctactctacaatctaccgattttccgtataatcccctttaacctaacaaaaatcaatcaactcgacctacatatccccgcctaatactttaacgacacaaacaaaaatcacgccttctaacgcaccgccgataatatacatcacatcgtaaaaattatcctaccaacaaatcaacacgctaacgacgacatcgccatccgacaaaacaaaaaccttcacgcccaactatattacttcctcaatcgcgacactcaaacgcgatttatccaacgtaaccatacgcaacttatccaacgatttacctaacgctttcgccacgttacgcaaattatccgtcaaaaacaaaaacaaatcaatcgcgcccgccgccaaccgattaacaaccaactttttcatatacatatcgaacgcatataacaaactatctcgaaaaacgaaaaccataaccgccaacgcattactctaccccatcgccaccatccgcgtaccttcaataaaatcaaccgcgatatcgacttctaacccatcgcctttacccacctcttcgccaatccacaacatcgacgcataatcaatttctccttcgccgataaccactcgtccacgaaaaacgacgtcgtttaatacctaacgcatcgcgataaccgccaaaccatcaattttattttatcgccacatccgatttacgaccaaacaaccaacgctacctattccgtaacgcgaaataataaccacgccaaaacatcattacgcgacctccccgatatcaacgccaaattataccaacaaatatttctcgacctattcattccaaataccgtacgtttcctcaaccaaccgcgccaactctttaaacaacgaatcgattttacctttttcgacaaaatcgacaataacaataaacgacataatcacgccgttataaataa

SEQ ID NO: 36229 - DNA, 762 bp, Artificial Sequence
  chemically treated genomic DNA (Homo sapiens) CpG-island No: 36229
tgtacgttcgtttgtttaatatgttttatgatgtcgttaattagtattatttcgtcgtcgtagatggtatttacgttaatttttatcgcgttatcgaggaagtggtttagtaatattggcgtatcgttagatacgttgatcgtcgtttggaagtagcgacgtaggttagtttcgttatagacgatttttatcgttcgatcgtcgagaacgtaagacggacgtattattagcgggtagttaatttttttcgttttttttatcgttattttaatagcggtaacggtggcgttcgtcggttgttttagttttagacgtttaatcgtatgttggaagcgtttacggttttttgtacggtcgatagtattcgggttggtgtcgataatcggtacgttagtagtttttagcgcgcgcgttagttttagcggggtttgatcgtcgtattggacgataacgtttttcggtttttcgatacgtacgatttttagtatattttttagagttatcggttcgaagtagaggcggtcggaagtgtcgtagtcggtggagacggttttcgggttatagttaattataatggtttcgtaatcgttttcgcgtagcgttagcgagcgtgtacgtaatagtagtcgaattcgatattttgatcgatatcggttcgggttatcgttaagtattatgaatttttttacggttcggtagaacggattacgtttcgtattgttatttttattaagtggacgtatagtgtaacgacggtgtacg

SEQ ID NO: 36230 - DNA, 762 bp, Artificial Sequence
  chemically treated genomic DNA (Homo sapiens) CpG-island No: 36230
cgtacaccgtcgttacactatacgtccacttaataaaaataacaatacgaaacgtaatccgttctaccgaaccgtaaaaaaattcataatacttaacgataacccgaaccgatatcgatcaaaatatcgaattcgactactattacgtacacgctcgctaacgctacgcgaaaacgattacgaaaccattataattaactataacccgaaaaccgtctccaccgactacgacacttccgaccgcctctacttcgaaccgataactctaaaaaatatactaaaaatcgtacgtatcgaaaaaccgaaaaacgttatcgtccaatacgacgatcaaaccccgctaaaactaacgcgcgcgctaaaaactactaacgtaccgattatcgacaccaacccgaatactatcgaccgtacaaaaaaccgtaaacgcttccaacatacgattaaacgtctaaaactaaaacaaccgacgaacgccaccgttaccgctattaaaataacgataaaaaaaacgaaaaaaattaactacccgctaataatacgtccgtcttacgttctcgacgatcgaacgataaaaatcgtctataacgaaactaacctacgtcgctacttccaaacgacgatcaacgtatctaacgatacgccaatattactaaaccacttcctcgataacgcgataaaaattaacgtaaataccatctacgacgacgaaataatactaattaacgacatcataaaacatattaaacaaacgaacgtaca

SEQ ID NO: 36231 - DNA, 762 bp, Artificial Sequence
  chemically treated genomic DNA (Homo sapiens) CpG-island No: 36231
cgtatatcgtcgttatattgtacgtttatttaatgaagatagtagtgcgaagcgtaattcgttttatcgagtcgtgaaagaatttatggtgtttggcggtggttcgaatcgatatcggttagggtatcgaattcgattattgttgcgtatacgttcgttggcgttgcgcgaagacggttacgaaattattatggttaattgtaattcggaaatcgtttttatcgattacgatattttcgatcgtttttatttcgagtcggtaattttggaagatgtgttggaaatcgtgcgtatcgagaagtcgaaaggcgttatcgtttagtacggcggttagatttcgttgaaattggcgcgcgcgttggaagttgttggcgtatcggttatcggtattagttcggatgttatcgatcgtgtagaagatcgtgaacgtttttagtatgcggttgagcgtttgaaattgaaataatcggcgaacgttatcgttatcgttattgaaatggcggtagagaaggcgaaagagattggttattcgttggtggtacgttcgttttacgttttcggcggtcgggcgatggaaatcgtttatgacgaagttgatttgcgtcgttatttttagacggcggttagcgtgtttaacgatgcgttagtgttgttggattattttttcgatgacgcggtagaagttgacgtggatgttatttgcgacggcgaaatggtgttgattggcggtattatggagtatattgagtaggcgggcgtgta

SEQ ID NO: 36232 - DNA, 762 bp, Artificial Sequence
  chemically treated genomic DNA (Homo sapiens) CpG-island No: 36232
tacacgcccgcctactcaatatactccataataccgccaatcaacaccatttcgccgtcgcaaataacatccacgtcaacttctaccgcgtcatcgaaaaaataatccaacaacactaacgcatcgttaaacacgctaaccgccgtctaaaaataacgacgcaaatcaacttcgtcataaacgatttccatcgcccgaccgccgaaaacgtaaaacgaacgtaccaccaacgaataaccaatctctttcgccttctctaccgccatttcaataacgataacgataacgttcgccgattatttcaatttcaaacgctcaaccgcatactaaaaacgttcacgatcttctacacgatcgataacatccgaactaataccgataaccgatacgccaacaacttccaacgcgcgcgccaatttcaacgaaatctaaccgccgtactaaacgataacgcctttcgacttctcgatacgcacgatttccaacacatcttccaaaattaccgactcgaaataaaaacgatcgaaaatatcgtaatcgataaaaacgatttccgaattacaattaaccataataatttcgtaaccgtcttcgcgcaacgccaacgaacgtatacgcaacaataatcgaattcgataccctaaccgatatcgattcgaaccaccgccaaacaccataaattctttcacgactcgataaaacgaattacgcttcgcactactatcttcattaaataaacgtacaatataacgacgatatacg

SEQ ID NO: 36233 - DNA, 578 bp, Artificial Sequence
  chemically treated genomic DNA (Homo sapiens) CpG-island No: 36233
acgttcgtcgtcggaatatcgtcggtagtattatagttaattgatagaaaaatcgattattttagaataagatgggtttgttgcggcgtagaaagtattttgcgtatcgcgtttattattcgttgcggtttacgtaggaatgcgtagatttgtattgtatatagcggtaatgtttaaatcgttcggtatcggtaagttcgatattcgtaattaatagagtaatattcgttcggcggatatttttattcgttaaacgatttttcgtttttagcgcgttttgagttttaatgttgattttttatttttttaataggtataatttttttagtcgtttcgtcgttatataagtatgcgttacgtcgtttacgtaggcggttattgttattaggtatgttattttaattttttacggtaatttgaagttcggttcgttttgttatttcgcgtatcgttgttatattagttgacgacggcgtaggtattttttttatcgattatgttttttttagtaggcggtatttcggttcgtcgtattgatgaaacggtaatagatggatttgtttgatatttagcgggat

SEQ ID NO: 36234 - DNA, 578 bp, Artificial Sequence
  chemically treated genomic DNA (Homo sapiens) CpG-island No: 36234
atcccgctaaatatcaaacaaatccatctattaccgtttcatcaatacgacgaaccgaaataccgcctactaaaaaaaacataatcgataaaaaaaatacctacgccgtcgtcaactaatataacaacgatacgcgaaataacaaaacgaaccgaacttcaaattaccgtaaaaaattaaaataacatacctaataacaataaccgcctacgtaaacgacgtaacgcatacttatataacgacgaaacgactaaaaaaattatacctattaaaaaaataaaaaatcaacattaaaactcaaaacgcgctaaaaacgaaaaatcgtttaacgaataaaaatatccgccgaacgaatattactctattaattacgaatatcgaacttaccgataccgaacgatttaaacattaccgctatatacaatacaaatctacgcattcctacgtaaaccgcaacgaataataaacgcgatacgcaaaatactttctacgccgcaacaaacccatcttattctaaaataatcgatttttctatcaattaactataatactaccgacgatattccgacgacgaacgt

SEQ ID NO: 36235 - DNA, 578 bp, Artificial Sequence
  chemically treated genomic DNA (Homo sapiens) CpG-island No: 36235
atttcgttgaatattaggtagatttatttgttatcgttttattagtacggcgaatcgaaatatcgtttgttggggaaaatatggtcgatgaaagaggtgtttgcgtcgtcgttagttgatgtggtaacgatgcgcgaaatggtagaacgggtcggattttaggttatcgtgggaggttaaaatggtatatttggtggtagtaatcgtttgcgtaagcggcgtggcgtatatttatatggcggcggaacggttggaaaagttgtgtttgttagagaagtggggagttagtattgaaatttagggcgcgttgggaacggagaatcgtttagcggatgaggatattcgtcgggcggatgttgttttgttgattacggatatcgagtttgtcggtgtcgagcgatttgaatattgtcgttatgtgtaatgtagatttacgtatttttgcgtgagtcgtagcgggtaatgagcgcggtgcgtaaagtgttttttgcgtcgtagtaaatttattttattttggagtagtcggtttttttgttagttggttgtggtattgtcggcgatatttcgacggcgagcgt

SEQ ID NO: 36236 - DNA, 578 bp, Artificial Sequence
  chemically treated genomic DNA (Homo sapiens) CpG-island No: 36236
acgctcgccgtcgaaatatcgccgacaataccacaaccaactaacaaaaaaaccgactactccaaaataaaataaatttactacgacgcaaaaaacactttacgcaccgcgctcattacccgctacgactcacgcaaaaatacgtaaatctacattacacataacgacaatattcaaatcgctcgacaccgacaaactcgatatccgtaatcaacaaaacaacatccgcccgacgaatatcctcatccgctaaacgattctccgttcccaacgcgccctaaatttcaatactaactccccacttctctaacaaacacaacttttccaaccgttccgccgccatataaatatacgccacgccgcttacgcaaacgattactaccaccaaatataccattttaacctcccacgataacctaaaatccgacccgttctaccatttcgcgcatcgttaccacatcaactaacgacgacgcaaacacctctttcatcgaccatattttccccaacaaacgatatttcgattcgccgtactaataaaacgataacaaataaatctacctaatattcaacgaaat

SEQ ID NO: 36237 - DNA, 538 bp, Artificial Sequence
  chemically treated genomic DNA (Homo sapiens) CpG-island No: 36237
atcgtgggatcgtcggtatcgcgtaattaggtgttaattcgattttttgtaggatcgtcgtttaaagggcgtaggagtttgatcggtaaattgttcgtttttgacgatagttcgttagttttcgcgtttttcgtttaatggcgatacgttgtgatggcgggatttgcggttataacggttgtatagttatttcggtgggatcgcgataatttatagcgtgaattttttgttgtagtaaatcgagcgttacggcgaaatcgtgaatggtggcggtcggtgttggcgggtagtcggggatttaaatattaatggggataatggtgtcgttatcgttttagacgttgtagagatcgtggaaaatatcgtcgtcgatatcgtacgcgtcgtaggaaatataaattttatgatcgggggtagatttatacgttcgaagtgtaggtatacgtatcgttcgggtgattgcgttagtaaataataaaatatcggcgtgacgcgggtgatgaaataattttaatgttaaaacgttttgcgtcgaata

SEQ ID NO: 36238 - DNA, 538 bp, Artificial Sequence
  chemically treated genomic DNA (Homo sapiens) CpG-island No: 36238
tattcgacgcaaaacgttttaacattaaaattatttcatcacccgcgtcacgccgatattttattatttactaacgcaatcacccgaacgatacgtatacctacacttcgaacgtataaatctacccccgatcataaaatttatatttcctacgacgcgtacgatatcgacgacgatattttccacgatctctacaacgtctaaaacgataacgacaccattatccccattaatatttaaatccccgactacccgccaacaccgaccgccaccattcacgatttcgccgtaacgctcgatttactacaacaaaaaattcacgctataaattatcgcgatcccaccgaaataactatacaaccgttataaccgcaaatcccgccatcacaacgtatcgccattaaacgaaaaacgcgaaaactaacgaactatcgtcaaaaacgaacaatttaccgatcaaactcctacgccctttaaacgacgatcctacaaaaaatcgaattaacacctaattacgcgataccgacgatcccacgat

SEQ ID NO: 36239 - DNA, 538 bp, Artificial Sequence
  chemically treated genomic DNA (Homo sapiens) CpG-island No: 36239
tattcgacgtagaacgttttggtattaaggttgttttattattcgcgttacgtcgatattttgttatttattggcgtagttattcgggcgatgcgtatgtttgtatttcgggcgtatgagtttgttttcgattataaaatttgtgttttttacggcgcgtgcggtgtcggcggcggtattttttacgatttttatagcgtttggggcggtagcgatattattgtttttattgatgtttggattttcggttgttcgttaatatcggtcgttattatttacggtttcgtcgtggcgttcggtttgttgtaatagaagatttacgttgtggattatcgcgattttatcggggtgattatgtaatcgttgtggtcgtagatttcgttattatagcgtatcgttattgagcgagaagcgcggaggttggcgggttatcgttaggggcgagtaatttgtcgattaggtttttgcgttttttaagcgacgattttataggaaatcgggttaatatttggttgcgcgatgtcgacgattttacgat

SEQ ID NO: 36240 - DNA, 538 bp, Artificial Sequence
  chemically treated genomic DNA (Homo sapiens) CpG-island No: 36240
atcgtaaaatcgtcgacatcgcgcaaccaaatattaacccgatttcctataaaatcgtcgcttaaaaaacgcaaaaacctaatcgacaaattactcgcccctaacgataacccgccaacctccgcgcttctcgctcaataacgatacgctataataacgaaatctacgaccacaacgattacataatcaccccgataaaatcgcgataatccacaacgtaaatcttctattacaacaaaccgaacgccacgacgaaaccgtaaataataacgaccgatattaacgaacaaccgaaaatccaaacatcaataaaaacaataatatcgctaccgccccaaacgctataaaaatcgtaaaaaataccgccgccgacaccgcacgcgccgtaaaaaacacaaattttataatcgaaaacaaactcatacgcccgaaatacaaacatacgcatcgcccgaataactacgccaataaataacaaaatatcgacgtaacgcgaataataaaacaaccttaataccaaaacgttctacgtcgaata

SEQ ID NO: 36241 - DNA, 642 bp, Artificial Sequence
  chemically treated genomic DNA (Homo sapiens) CpG-island No: 36241
atcgtcgtggcgtaatttatagcgcggtagatattttttttgtttggttgttggcgggcgtatcggtttcggtaaaacggaggtttattttagcgtattggaaaacgtgttcgtttagggtaaataggcgttggtgatggtgtcggaaatcggtttgatatcgtaaattatcgttcgttttcgtgaacgttttaatgttttcgtggaagttttgtatttcggtttgaacgatagcgagcgtttttcggcgtggttgaaagcgaaaaatggtgaggcggcgattgtgatcggtattcgtttcgcgttgtttacgtcgtttaaaaatttcggcgtgattgttattgatgaagagtacgatagtttttataagtagtaggaaggttggcgttattatgttcgcgatttggcggtgtatcgtgcgtatagcgagtaaatttcgattatttttggtttcgtaacgttcgcgttggaaacgttatgtaacgtttagtagaaaaaatatcgtttgttgcgtttgattcgtcgggtagggaatgcgcgttcggtaatttaatatgtgttggatttaaaaggttagaaggtgtaggtaggtttggtttcggcgttaattattcgtatgcgttagtatttataggttgataa

SEQ ID NO: 36242 - DNA, 642 bp, Artificial Sequence
  chemically treated genomic DNA (Homo sapiens) CpG-island No: 36242
ttatcaacctataaatactaacgcatacgaataattaacgccgaaaccaaacctacctacaccttctaaccttttaaatccaacacatattaaattaccgaacgcgcattccctacccgacgaatcaaacgcaacaaacgatattttttctactaaacgttacataacgtttccaacgcgaacgttacgaaaccaaaaataatcgaaatttactcgctatacgcacgatacaccgccaaatcgcgaacataataacgccaaccttcctactacttataaaaactatcgtactcttcatcaataacaatcacgccgaaatttttaaacgacgtaaacaacgcgaaacgaataccgatcacaatcgccgcctcaccatttttcgctttcaaccacgccgaaaaacgctcgctatcgttcaaaccgaaatacaaaacttccacgaaaacattaaaacgttcacgaaaacgaacgataatttacgatatcaaaccgatttccgacaccatcaccaacgcctatttaccctaaacgaacacgttttccaatacgctaaaataaacctccgttttaccgaaaccgatacgcccgccaacaaccaaacaaaaaaaatatctaccgcgctataaattacgccacgacgat

SEQ ID NO: 36243 - DNA, 642 bp, Artificial Sequence
  chemically treated genomic DNA (Homo sapiens) CpG-island No: 36243
ttattagtttgtaaatgttggcgtatacgagtgattaacgtcggagttagatttgtttgtattttttgattttttaaatttagtatatgttgaattgtcggacgcgtattttttgttcgacgggttaggcgtagtaggcggtattttttttgttggacgttgtataacgtttttagcgcgggcgttgcggagttaagaataatcgggatttgttcgttgtgcgtacgatatatcgttaggtcgcgggtatgatagcgttagtttttttgttgtttgtaggagttgtcgtgttttttattaatgataattacgtcgagatttttaaacggcgtaaatagcgcggagcgggtgtcgattataatcgtcgttttattatttttcgtttttagttacgtcgaaagacgttcgttgtcgtttaggtcggaatgtagaatttttacgggggtattaaaacgtttacgaaaacgggcgatagtttgcggtgttaggtcgattttcggtattattattagcgtttgtttgttttgagcgagtacgttttttagtacgttgagataaattttcgttttatcggaatcggtacgttcgttagtagttaggtagaaaaagtatttgtcgcgttatgaattgcgttacggcggt

SEQ ID NO: 36244 - DNA, 642 bp, Artificial Sequence
  chemically treated genomic DNA (Homo sapiens) CpG-island No: 36244
accgccgtaacgcaattcataacgcgacaaatactttttctacctaactactaacgaacgtaccgattccgataaaacgaaaatttatctcaacgtactaaaaaacgtactcgctcaaaacaaacaaacgctaataataataccgaaaatcgacctaacaccgcaaactatcgcccgttttcgtaaacgttttaatacccccgtaaaaattctacattccgacctaaacgacaacgaacgtctttcgacgtaactaaaaacgaaaaataataaaacgacgattataatcgacacccgctccgcgctatttacgccgtttaaaaatctcgacgtaattatcattaataaaaaacacgacaactcctacaaacaacaaaaaaactaacgctatcatacccgcgacctaacgatatatcgtacgcacaacgaacaaatcccgattattcttaactccgcaacgcccgcgctaaaaacgttatacaacgtccaacaaaaaaaataccgcctactacgcctaacccgtcgaacaaaaaatacgcgtccgacaattcaacatatactaaatttaaaaaatcaaaaaatacaaacaaatctaactccgacgttaatcactcgtatacgccaacatttacaaactaataa

SEQ ID NO: 36245 - DNA, 533 bp, Artificial Sequence
  chemically treated genomic DNA (Homo sapiens) CpG-island No: 36245
tttcgattacggcgatatgttgaaacgcggtattggttatacgttagaaaatcgtaaagaagcggggattattttttggttgggcgttgacgaaaatatagtgttgattaatcggtaaaaaattagcgttaacggtgtgttgtaatggtttattattcgtcgtttgatcgaagaggtgatgtagcggattacggttaaggtcgttagtagcgaaatatttatcggtacgttttttggtggtaattagtaaaaagtggtgatcggtcgttgggtttatgttgttagttagattttgttgttcgacgagttaacgcgcggcgtcgatatcgaagttaaatagtagatttatcgtattgttcgtgagttggttgtcgaaggaaaaagcgtggtgtttatttttagtgaagtggaggagttgtcgttggtgtgtgatcgtattttgttattatagtacggtacgttttcgtaggagttttacgtttcggttaatgtggattagttgatgttcgttattttgtttgtgtattgatgaa

SEQ ID NO: 36246 - DNA, 533 bp, Artificial Sequence
  chemically treated genomic DNA (Homo sapiens) CpG-island No: 36246
ttcatcaatacacaaacaaaataacgaacatcaactaatccacattaaccgaaacgtaaaactcctacgaaaacgtaccgtactataataacaaaatacgatcacacaccaacgacaactcctccacttcactaaaaataaacaccacgctttttccttcgacaaccaactcacgaacaatacgataaatctactatttaacttcgatatcgacgccgcgcgttaactcgtcgaacaacaaaatctaactaacaacataaacccaacgaccgatcaccactttttactaattaccaccaaaaaacgtaccgataaatatttcgctactaacgaccttaaccgtaatccgctacatcacctcttcgatcaaacgacgaataataaaccattacaacacaccgttaacgctaattttttaccgattaatcaacactatattttcgtcaacgcccaaccaaaaaataatccccgcttctttacgattttctaacgtataaccaataccgcgtttcaacatatcgccgtaatcgaaa

SEQ ID NO: 36247 - DNA, 533 bp, Artificial Sequence
  chemically treated genomic DNA (Homo sapiens) CpG-island No: 36247
tttattagtgtatagatagaatggcggatattagttaatttatattgatcggagcgtgaaatttttgcgagaacgtgtcgtgttgtaataataggatgcggttatatattagcggtaatttttttattttattggagataaatattacgttttttttttcggtagttagtttacggataatacggtaaatttgttgtttggtttcgatatcgacgtcgcgcgttggttcgtcgagtaataaaatttggttggtagtatagatttaacgatcgattattattttttgttgattgttattagaaagcgtgtcgatgggtgtttcgttattggcggttttgatcgtaattcgttgtattattttttcggttaggcggcggatggtggattattgtagtatatcgttggcgttgattttttgtcgattggttagtattgtattttcgttaacgtttaattagggaatgattttcgtttttttgcggttttttggcgtatagttaatgtcgcgttttagtatgtcgtcgtaatcgggg

SEQ ID NO: 36248 - DNA, 533 bp, Artificial Sequence
  chemically treated genomic DNA (Homo sapiens) CpG-island No: 36248
ccccgattacgacgacatactaaaacgcgacattaactatacgccaaaaaaccgcaaaaaaacgaaaatcattccctaattaaacgttaacgaaaatacaatactaaccaatcgacaaaaaatcaacgccaacgatatactacaataatccaccatccgccgcctaaccgaaaaaataatacaacgaattacgatcaaaaccgccaataacgaaacacccatcgacacgctttctaataacaatcaacaaaaaataataatcgatcgttaaatctatactaccaaccaaattttattactcgacgaaccaacgcgcgacgtcgatatcgaaaccaaacaacaaatttaccgtattatccgtaaactaactaccgaaaaaaaaaacgtaatatttatctccaataaaataaaaaaattaccgctaatatataaccgcatcctattattacaacacgacacgttctcgcaaaaatttcacgctccgatcaatataaattaactaatatccgccattctatctatacactaataaa

SEQ ID NO: 36249 - DNA, 776 bp, Artificial Sequence
  chemically treated genomic DNA (Homo sapiens) CpG-island No: 36249
atggtacgggtaataaagtttattacgtcgtttacgttttgcggttcgtaacgtatcgtattattatcgcgtattacgttaatggtatttatgttgtcgagcgaaacgggagttagtgaaagttgcggttgatcgtaaggggcgaaggggacggggatgtcgtttattaggacggtcgagcggttggcgaggcgcgggtttaggtttcggatgttaaagtttatcgttaggtcgtggttgtcggtgtcgttgtttttcggcgcgttgacgttagggatgcggttaagtattttacgtatggtggttgcgtcggttttggcgaaatttttacggcggattacgttacgcgcgttagtatgtttaaatacgtcgtttttacgcgtattatttagttagtcgtcgattacggttagggtatttttttttggtgcgggcgcgggttttagcgtttagttgttattttttagcggttttatttgtagttcgttgtcgtttagtagttgttgtaggtcgttttcgacgtcgtaatcgtcgtgtaggtcgttgttttgtttgtcgcgcgttaggttggcgttaatcgagagggtaaattcgttgtgtgcggtatattgattgagcgttttatcgagcgatttcggtgcgatattaatttgtgtagtaaaagcggaaaacgagagatcggttagcggtagtaggtttaggcgaatggtgttaattaaaggtgttgttttacgaaaaacgcgtaacggcgttatattttttttattattattttg

SEQ ID NO: 36250 - DNA, 776 bp, Artificial Sequence
  chemically treated genomic DNA (Homo sapiens) CpG-island No: 36250
caaaataataataaaaaaaatataacgccgttacgcgtttttcgtaaaacaacacctttaattaacaccattcgcctaaacctactaccgctaaccgatctctcgttttccgcttttactacacaaattaatatcgcaccgaaatcgctcgataaaacgctcaatcaatataccgcacacaacgaatttaccctctcgattaacgccaacctaacgcgcgacaaacaaaacaacgacctacacgacgattacgacgtcgaaaacgacctacaacaactactaaacgacaacgaactacaaataaaaccgctaaaaaataacaactaaacgctaaaacccgcgcccgcaccaaaaaaaaataccctaaccgtaatcgacgactaactaaataatacgcgtaaaaacgacgtatttaaacatactaacgcgcgtaacgtaatccgccgtaaaaatttcgccaaaaccgacgcaaccaccatacgtaaaatacttaaccgcatccctaacgtcaacgcgccgaaaaacaacgacaccgacaaccacgacctaacgataaactttaacatccgaaacctaaacccgcgcctcgccaaccgctcgaccgtcctaataaacgacatccccgtccccttcgccccttacgatcaaccgcaactttcactaactcccgtttcgctcgacaacataaataccattaacgtaatacgcgataataatacgatacgttacgaaccgcaaaacgtaaacgacgtaataaactttattacccgtaccat

SEQ ID NO: 36251 - DNA, 776 bp, Artificial Sequence
  chemically treated genomic DNA (Homo sapiens) CpG-island No: 36251
taaaatgatgatggggaaggtatgacgtcgttacgcgtttttcgtaaaataatatttttggttaatattattcgtttgagtttgttgtcgttggtcggtttttcgtttttcgtttttgttgtataggttaatatcgtatcgggatcgttcgataaagcgtttaattagtatgtcgtatatagcggatttattttttcggttgacgttagtttgacgcgcggtaagtagagtaacggtttgtacggcgattacgacgtcgagagcggtttgtaataattgttggacggtagcggattgtaggtaaaatcgttgggaaataatagttggacgttggagttcgcgttcgtattaaaagaagatgttttgatcgtggtcggcgattggttgggtgatgcgcgtgaaaacgacgtatttgaatatgttggcgcgcgtgacgtgattcgtcgtgaggatttcgttaaaatcggcgtaattattatgcgtgaggtatttaatcgtatttttggcgttagcgcgtcggaaaataacggtatcggtagttacgatttggcgatgaattttggtattcggggtttgaattcgcgtttcgttagtcgttcgatcgttttgatggacggtattttcgtttttttcgttttttacggttagtcgtagtttttattggttttcgtttcgttcggtaatatggatgttattgacgtggtacgcggtggtggtgcggtgcgttacggatcgtagagcgtgggcggcgtggtgaattttgttattcgtgttat

SEQ ID NO: 36252 - DNA, 776 bp, Artificial Sequence
  chemically treated genomic DNA (Homo sapiens) CpG-island No: 36252
ataacacgaataacaaaattcaccacgccgcccacgctctacgatccgtaacgcaccgcaccaccaccgcgtaccacgtcaataacatccatattaccgaacgaaacgaaaaccaataaaaactacgactaaccgtaaaaaacgaaaaaaacgaaaataccgtccatcaaaacgatcgaacgactaacgaaacgcgaattcaaaccccgaataccaaaattcatcgccaaatcgtaactaccgataccgttattttccgacgcgctaacgccaaaaatacgattaaatacctcacgcataataattacgccgattttaacgaaatcctcacgacgaatcacgtcacgcgcgccaacatattcaaatacgtcgttttcacgcgcatcacccaaccaatcgccgaccacgatcaaaacatcttcttttaatacgaacgcgaactccaacgtccaactattatttcccaacgattttacctacaatccgctaccgtccaacaattattacaaaccgctctcgacgtcgtaatcgccgtacaaaccgttactctacttaccgcgcgtcaaactaacgtcaaccgaaaaaataaatccgctatatacgacatactaattaaacgctttatcgaacgatcccgatacgatattaacctatacaacaaaaacgaaaaacgaaaaaccgaccaacgacaacaaactcaaacgaataatattaaccaaaaatattattttacgaaaaacgcgtaacgacgtcataccttccccatcatcatttta

SEQ ID NO: 36253 - DNA, 538 bp, Artificial Sequence
  chemically treated genomic DNA (Homo sapiens) CpG-island No: 36253
agcgtatagttcggagttaagcgcgcggttgaggaacgattagggttttgtaaagttggagtttgggcgcgtagattttcggatcggagttttcggtttgaggtcgttcgttaggaggaaaatgaggtcgttcgaattaagttgggacgcgtagtaaagttcgagtttttcgcgtatattaggggttcgggcgggagcggggagttttggggacggagaaggggcgcgggacgtttggattaggaatttatttgacgtcgagtcgggtagcgtcgaggttgttttttcgcgttgcgtattcgttcgttcgtttcgtattttttttttttttttcgggcgttcgcggtcgtcgcgtttcgggttttgaatttttcgagttcgtcgtttcgcgcggttggagggcgtcggttgtatttattcgttttttggtaggagtcgcgcgcgtttttttttttttttttcgttttgtgtttttaagatttttttttatttttttttttttagtttttatttttttttttttttttttttttttttt

SEQ ID NO: 36254 - DNA, 538 bp, Artificial Sequence
  chemically treated genomic DNA (Homo sapiens) CpG-island No: 36254
aaaaaaaaaaaaaaaaaaaaaaaaaaaataaaaactaaaaaaaaaaaaataaaaaaaaatcttaaaaacacaaaacgaaaaaaaaaaaaaaaaacgcgcgcgactcctaccaaaaaacgaataaatacaaccgacgccctccaaccgcgcgaaacgacgaactcgaaaaattcaaaacccgaaacgcgacgaccgcgaacgcccgaaaaaaaaaaaaaaaatacgaaacgaacgaacgaatacgcaacgcgaaaaaacaacctcgacgctacccgactcgacgtcaaataaattcctaatccaaacgtcccgcgccccttctccgtccccaaaactccccgctcccgcccgaacccctaatatacgcgaaaaactcgaactttactacgcgtcccaacttaattcgaacgacctcattttcctcctaacgaacgacctcaaaccgaaaactccgatccgaaaatctacgcgcccaaactccaactttacaaaaccctaatcgttcctcaaccgcgcgcttaactccgaactatacgct

SEQ ID NO: 36255 - DNA, 538 bp, Artificial Sequence
  chemically treated genomic DNA (Homo sapiens) CpG-island No: 36255
aaggggagggaagaagagaagggaggagtgggggttaggggagagggggtggggagggattttggaggtataaagcggaggggaaggggagggacgcgcgcggtttttattaggaggcgagtgggtgtaatcggcgttttttagtcgcgcggggcggcggattcggaggatttagaattcggagcgcggcggtcgcgggcgttcgggaggaagaggaggagtacgaggcgggcgggcgggtgcgtagcgcgaagaggtagtttcggcgttgttcggttcggcgttaggtgagtttttgatttaggcgtttcgcgtttttttttcgtttttagggtttttcgttttcgttcgagtttttggtgtgcgcggaaggttcgggttttgttgcgcgttttaatttggttcgggcggttttattttttttttagcgggcggttttaggtcgggggtttcggttcgggggtttacgcgtttaggttttaattttgtaagattttagtcgttttttagtcgcgcgtttggtttcgagttgtgcgtt

SEQ ID NO: 36256 - DNA, 538 bp, Artificial Sequence
  chemically treated genomic DNA (Homo sapiens) CpG-island No: 36256
aacgcacaactcgaaaccaaacgcgcgactaaaaaacgactaaaatcttacaaaattaaaacctaaacgcgtaaacccccgaaccgaaacccccgacctaaaaccgcccgctaaaaaaaaaataaaaccgcccgaaccaaattaaaacgcgcaacaaaacccgaaccttccgcgcacaccaaaaactcgaacgaaaacgaaaaaccctaaaaacgaaaaaaaaacgcgaaacgcctaaatcaaaaactcacctaacgccgaaccgaacaacgccgaaactacctcttcgcgctacgcacccgcccgcccgcctcgtactcctcctcttcctcccgaacgcccgcgaccgccgcgctccgaattctaaatcctccgaatccgccgccccgcgcgactaaaaaacgccgattacacccactcgcctcctaataaaaaccgcgcgcgtccctccccttcccctccgctttatacctccaaaatccctccccaccccctctcccctaacccccactcctcccttctcttcttccctcccctt

SEQ ID NO: 36257 - DNA, 652 bp, Artificial Sequence
  chemically treated genomic DNA (Homo sapiens) CpG-island No: 36257
ttcggagtaatagtcgtttgaggattcgaagttgcgggtcggacgagcgtcgagattattgttttttagttttcgcgcgcgttttcgtttttagcgtcgttatcgtcgtcgtcgtcgtttttagcgcggtttcgcgtaggcgcgtttacgatcgcgtcgttttttttttattttttcgttcgtttcgtttcgttggtttcgtcgtcgttatagttgcggcgcggcgcgtagttatagagattcggatgtcgttgggtaggaattgcggtgagggttggcgggcgggggaggggtcgttatagatgacgttattgttttatttagtttttttttttgtcgttgttgttgtcgtcgtttttgttttacggtttggagtattaggtcgaagtcgaagggagcgttcggatttcggatagtagttaggattcgggtttttacgtttcggcgttagggattggatagaatgtgcggttattaggtgtttagtagatcgatagttttttcgtgtcggtttttggttaagtagggattcggaagttatttttacggcgttcgcgttcggagttttggtttttttatttgtttgtagatataaattttattttttgcgaagatggtgtatacgtagtttcgagtatagattcgaagttgt

SEQ ID NO: 36258 - DNA, 652 bp, Artificial Sequence
  chemically treated genomic DNA (Homo sapiens) CpG-island No: 36258
acaacttcgaatctatactcgaaactacgtatacaccatcttcgcaaaaaataaaatttatatctacaaacaaataaaaaaaccaaaactccgaacgcgaacgccgtaaaaataacttccgaatccctacttaaccaaaaaccgacacgaaaaaactatcgatctactaaacacctaataaccgcacattctatccaatccctaacgccgaaacgtaaaaacccgaatcctaactactatccgaaatccgaacgctcccttcgacttcgacctaatactccaaaccgtaaaacaaaaacgacgacaacaacaacgacaaaaaaaaaaactaaataaaacaataacgtcatctataacgacccctcccccgcccgccaaccctcaccgcaattcctacccaacgacatccgaatctctataactacgcgccgcgccgcaactataacgacgacgaaaccaacgaaacgaaacgaacgaaaaaataaaaaaaaaacgacgcgatcgtaaacgcgcctacgcgaaaccgcgctaaaaacgacgacgacgacgataacgacgctaaaaacgaaaacgcgcgcgaaaactaaaaaacaataatctcgacgctcgtccgacccgcaacttcgaatcctcaaacgactattactccgaa

SEQ ID NO: 36259 - DNA, 652 bp, Artificial Sequence
  chemically treated genomic DNA (Homo sapiens) CpG-island No: 36259
atagtttcgggtttgtgttcggggttgcgtgtatattattttcgtagggagtggggtttgtatttgtaggtaggtagaagagttagggtttcgggcgcggacgtcgtaggggtagttttcgagtttttatttggttaagggtcggtacggaggggttgtcgatttattgggtatttaatagtcgtatattttgtttagtttttggcgtcggaacgtgaaggttcgggttttggttgttattcgggattcggacgtttttttcggtttcggtttggtgttttaggtcgtaaggtaaaggcggcggtagtagtagcggtagagaaagaagttgggtaaggtagtgacgttatttgtggcggtttttttttcgttcgttagtttttatcgtagtttttgtttaacgatattcgggtttttgtagttgcgcgtcgcgtcgtagttgtagcggcggcggagttagcggggcggggcgagcggaggggtgggggaggggcgacgcggtcgtgagcgcgtttgcgcggggtcgcgttagaggcggcggcggcggcggtggcggcgttagggacgggagcgcgcgcgggagttagagagtagtggtttcggcgttcgttcggttcgtagtttcgggtttttaggcggttgttgtttcgga

SEQ ID NO: 36260 - DNA, 652 bp, Artificial Sequence
  chemically treated genomic DNA (Homo sapiens) CpG-island No: 36260
tccgaaacaacaaccgcctaaaaacccgaaactacgaaccgaacgaacgccgaaaccactactctctaactcccgcgcgcgctcccgtccctaacgccgccaccgccgccgccgccgcctctaacgcgaccccgcgcaaacgcgctcacgaccgcgtcgcccctcccccacccctccgctcgccccgccccgctaactccgccgccgctacaactacgacgcgacgcgcaactacaaaaacccgaatatcgttaaacaaaaactacgataaaaactaacgaacgaaaaaaaaaccgccacaaataacgtcactaccttacccaacttctttctctaccgctactactaccgccgcctttaccttacgacctaaaacaccaaaccgaaaccgaaaaaaacgtccgaatcccgaataacaaccaaaacccgaaccttcacgttccgacgccaaaaactaaacaaaatatacgactattaaatacccaataaatcgacaacccctccgtaccgacccttaaccaaataaaaactcgaaaactacccctacgacgtccgcgcccgaaaccctaactcttctacctacctacaaatacaaaccccactccctacgaaaataatatacacgcaaccccgaacacaaacccgaaactat

SEQ ID NO: 36261 - DNA, 746 bp, Artificial Sequence
  chemically treated genomic DNA (Homo sapiens) CpG-island No: 36261
ggcggcgcgttcgagcgggtgggggcgcggggacgtttttttttcgttcgggaaaagttttgtaggtcgtttttcggttaggtcggtttgcggtcgtcgtttgtttcgtcgttataaatatttatttcggtcgcggacggttagagggtcgcgtttttttttcgcgttatcgtaattaatatttcgttttcgttttttcgttatcgttttcgtcgagcgttaatttttcgtcgttcgtcgttcggttcgggggaggaggtcggttagggggtggagttgtcgcgttttttttcgggagcgttcgggtagacgttcggtttgtttataggttttaggtttgttcgtcgtcgtcgtcgcgtaggttcgtatcgttcgttagttcgtcgtcggttcgagcgtcgtatttattcggagtagtcgtaggcgggtaggtttttggtcggtcgaggcggcggcggcggtagtcggggagggggttatcgcggcggcgacggcggtagtcgggggaggggttatcgttgtagcggcgggttaggttaggttggggaaggggaggaggaggggtcgtttcgggttgcgttcgggttttcggttgtcggcgttttcgcggtttagattattcgggcgttggagagggaggtagagagtcggtttcggagaaggaggaggaagagttcgaggatttatcgttttcgcgttttagttgtttagagtttttttattttttttttttttttttttttttt

SEQ ID NO: 36262 - DNA, 746 bp, Artificial Sequence
  chemically treated genomic DNA (Homo sapiens) CpG-island No: 36262
aaaaaaaaaaaaaaaaaaaaaaaaataaaaaaactctaaacaactaaaacgcgaaaacgataaatcctcgaactcttcctcctccttctccgaaaccgactctctacctccctctccaacgcccgaataatctaaaccgcgaaaacgccgacaaccgaaaacccgaacgcaacccgaaacgacccctcctcctccccttccccaacctaacctaacccgccgctacaacgataacccctcccccgactaccgccgtcgccgccgcgataaccccctccccgactaccgccgccgccgcctcgaccgaccaaaaacctacccgcctacgactactccgaataaatacgacgctcgaaccgacgacgaactaacgaacgatacgaacctacgcgacgacgacgacgaacaaacctaaaacctataaacaaaccgaacgtctacccgaacgctcccgaaaaaaaacgcgacaactccaccccctaaccgacctcctcccccgaaccgaacgacgaacgacgaaaaattaacgctcgacgaaaacgataacgaaaaaacgaaaacgaaatattaattacgataacgcgaaaaaaaaacgcgaccctctaaccgtccgcgaccgaaataaatatttataacgacgaaacaaacgacgaccgcaaaccgacctaaccgaaaaacgacctacaaaacttttcccgaacgaaaaaaaaacgtccccgcgcccccacccgctcgaacgcgccgcc

SEQ ID NO: 36263 - DNA, 746 bp, Artificial Sequence
  chemically treated genomic DNA (Homo sapiens) CpG-island No: 36263
aaggagaaaaaaaaaagggggagggtaagagagttttaagtagttaaggcgcgaaaacgatgagttttcgagttttttttttttttttttcgggatcggttttttgtttttttttttaacgttcggatgatttgagtcgcgagggcgtcgatagtcgggggttcggacgtagttcggggcggtttttttttttttttttttttagtttgatttggttcgtcgttgtagcggtgatttttttttcggttgtcgtcgtcgtcgtcgcggtgatttttttttcggttgtcgtcgtcgtcgtttcggtcgattagggatttgttcgtttgcggttgtttcgggtaagtgcggcgttcgggtcgacggcgggttggcgggcggtgcgggtttgcgcggcggcggcggcgggtaggtttggggtttgtaaataagtcgggcgtttgttcgggcgttttcgggaggagacgcgataattttattttttggtcggttttttttttcgagtcgggcggcggacggcgaggggttaacgttcggcgagggcggtggcggggaggcgggggcggggtgttagttgcggtggcgcggggagggggcgcgattttttggtcgttcgcggtcgagatgggtgtttgtggcggcgaagtaggcgacggtcgtaggtcggtttggtcggagagcggtttgtagaatttttttcgagcggggagggggcgttttcgcgtttttattcgttcgggcgcgtcgtt

SEQ ID NO: 36264 - DNA, 746 bp, Artificial Sequence
  chemically treated genomic DNA (Homo sapiens) CpG-island No: 36264
aacgacgcgcccgaacgaataaaaacgcgaaaacgccccctccccgctcgaaaaaaattctacaaaccgctctccgaccaaaccgacctacgaccgtcgcctacttcgccgccacaaacacccatctcgaccgcgaacgaccaaaaaatcgcgccccctccccgcgccaccgcaactaacaccccgcccccgcctccccgccaccgccctcgccgaacgttaacccctcgccgtccgccgcccgactcgaaaaaaaaaaccgaccaaaaaataaaattatcgcgtctcctcccgaaaacgcccgaacaaacgcccgacttatttacaaaccccaaacctacccgccgccgccgccgcgcaaacccgcaccgcccgccaacccgccgtcgacccgaacgccgcacttacccgaaacaaccgcaaacgaacaaatccctaatcgaccgaaacgacgacgacgacaaccgaaaaaaaaatcaccgcgacgacgacgacgacaaccgaaaaaaaaatcaccgctacaacgacgaaccaaatcaaactaaaaaaaaaaaaaaaaaaaaaccgccccgaactacgtccgaacccccgactatcgacgccctcgcgactcaaatcatccgaacgttaaaaaaaaaaacaaaaaaccgatcccgaaaaaaaaaaaaaaaaaactcgaaaactcatcgttttcgcgccttaactacttaaaactctcttaccctcccccttttttttttctcctt

SEQ ID NO: 36265 - DNA, 749 bp, Artificial Sequence
  chemically treated genomic DNA (Homo sapiens) CpG-island No: 36265
aggtagggaatgcggtttttcggttagtcgttttcgaggtattttaaggattttagggtcgaaggtttatttcggggttttagttagtgttcgttgcgttgcggtcgtagatattcgggattgcggtggagttttgtttaatttaggtttgtaagtcgggcggtttttcgtttaagtcggttgtatagttttaggcggttttgtttgcgttgtcgcgttttaaggcggttttagttggtggtttttgcgaaaggtcgcgcgtttagcgttcgtagtagacgcggtaggtcgcgtagtaggcggtagcgcggtagggcgcgtagcggcggggggatgtcgtttttggcgtagaggcgattgaagtaagcgagtagtagtagcgggcgcggggtagcgtggagtagggcgagtaggggcgcggcgcgggggtcggggtcgttgatcgggcgaaggtcggcgtcgttttatagtagtagtatagtgttttgttttcgcgttacgcgcgttcgcgtcgtttagagttacggtagcgggtttacgcgcgttacgtgtttttttttttataggtttacgattacgtcgcgttcgtcgtttagcgttgttcgtagtagtttagttagcgtttttattaggcgtcgttgcgttttcgagttcgtcgcgtgtaggaggagtattggtcgcgttgggttcgggtttggtggcgggaagtaatagatgaaggttgggcggttgagagattgtttagtttt

SEQ ID NO: 36266 - DNA, 749 bp, Artificial Sequence
  chemically treated genomic DNA (Homo sapiens) CpG-island No: 36266
aaaactaaacaatctctcaaccgcccaaccttcatctattacttcccgccaccaaacccgaacccaacgcgaccaatactcctcctacacgcgacgaactcgaaaacgcaacgacgcctaataaaaacgctaactaaactactacgaacaacgctaaacgacgaacgcgacgtaatcgtaaacctataaaaaaaaaaacacgtaacgcgcgtaaacccgctaccgtaactctaaacgacgcgaacgcgcgtaacgcgaaaacaaaacactatactactactataaaacgacgccgaccttcgcccgatcaacgaccccgacccccgcgccgcgcccctactcgccctactccacgctaccccgcgcccgctactactactcgcttacttcaatcgcctctacgccaaaaacgacatccccccgccgctacgcgccctaccgcgctaccgcctactacgcgacctaccgcgtctactacgaacgctaaacgcgcgacctttcgcaaaaaccaccaactaaaaccgccttaaaacgcgacaacgcaaacaaaaccgcctaaaactatacaaccgacttaaacgaaaaaccgcccgacttacaaacctaaattaaacaaaactccaccgcaatcccgaatatctacgaccgcaacgcaacgaacactaactaaaaccccgaaataaaccttcgaccctaaaatccttaaaatacctcgaaaacgactaaccgaaaaaccgcattccctacct

SEQ ID NO: 36267 - DNA, 749 bp, Artificial Sequence
  chemically treated genomic DNA (Homo sapiens) CpG-island No: 36267
agggttgagtagttttttagtcgtttagtttttatttgttgtttttcgttattaggttcgggtttagcgcggttagtgttttttttgtacgcggcggattcggaggcgtagcggcgtttggtgggagcgttggttgaattgttacgggtagcgttgggcggcgggcgcgacgtgatcgtggatttgtgggaggggaggtacgtggcgcgcgtgggttcgttgtcgtggttttgggcggcgcggacgcgcgtagcgcgggagtagggtattgtgttgttgttgtggagcggcgtcgattttcgttcggttagcggtttcgattttcgcgtcgcgtttttgttcgttttgttttacgttgtttcgcgttcgttgttgttgttcgtttattttagtcgtttttgcgttaagggcgatattttttcgtcgttgcgcgttttgtcgcgttatcgtttgttgcgcgatttgtcgcgtttgttgcgggcgttggacgcgcggtttttcgtagaggttattagttggggtcgttttggggcgcggtagcgtaggtagagtcgtttagagttgtgtagtcggtttgaacgagaggtcgttcgatttgtagatttaggttgagtagagttttatcgtagtttcgggtgtttgcggtcgtaacgtaacggatattggttggaatttcggaatgagttttcgattttgaaatttttggggtgtttcgaggacgattggtcgaaaagtcgtattttttgttt

SEQ ID NO: 36268 - DNA, 749 bp, Artificial Sequence
  chemically treated genomic DNA (Homo sapiens) CpG-island No: 36268
aaacaaaaaatacgacttttcgaccaatcgtcctcgaaacaccccaaaaatttcaaaatcgaaaactcattccgaaattccaaccaatatccgttacgttacgaccgcaaacacccgaaactacgataaaactctactcaacctaaatctacaaatcgaacgacctctcgttcaaaccgactacacaactctaaacgactctacctacgctaccgcgccccaaaacgaccccaactaataacctctacgaaaaaccgcgcgtccaacgcccgcaacaaacgcgacaaatcgcgcaacaaacgataacgcgacaaaacgcgcaacgacgaaaaaatatcgcccttaacgcaaaaacgactaaaataaacgaacaacaacaacgaacgcgaaacaacgtaaaacaaaacgaacaaaaacgcgacgcgaaaatcgaaaccgctaaccgaacgaaaatcgacgccgctccacaacaacaacacaataccctactcccgcgctacgcgcgtccgcgccgcccaaaaccacgacaacgaacccacgcgcgccacgtacctcccctcccacaaatccacgatcacgtcgcgcccgccgcccaacgctacccgtaacaattcaaccaacgctcccaccaaacgccgctacgcctccgaatccgccgcgtacaaaaaaaacactaaccgcgctaaacccgaacctaataacgaaaaacaacaaataaaaactaaacgactaaaaaactactcaaccct

SEQ ID NO: 36269 - DNA, 940 bp, Artificial Sequence
  chemically treated genomic DNA (Homo sapiens) CpG-island No: 36269
  misc_feature (896)..(896): n is either a, c, g or t
atatttcggagtttagttcgttttttagtttgagcggtgtttacgatgatggaagattttgtaagattttttttgggtcgtttcgaatcgagttgttttagagttgtcgggtaggtgagggggagataggtgtacgagttgatttcgtaggtgatcgaagagggggagggaagtaggttcgatggagtcgatttgtattcgacgtaattcgttgggttcgaaaggggagttaagttagatggaataaacgatttttagttcgagttcggcggggcgaataggatattttgcgttggtttatttgttaaagagggcgagcgcgcgggtcgatcggagtagagcgagagggcggggttaagcggagcggatggggttaagtggacgagtcgagggagtggggcgtagtcgaaagtagtcgagtgaagtcgaatagagacgaggcgcgtttcgggtggtgttaagcggaaatgagtggggtcgagcggggtagggtggagtcgagcggagtcgggtggagtcgagcggagtcgagcgagtgagaagtcggaggtcgagagggtcgggtcgatttgaagaggtggggattgttgagggttggtttgtcggttttggaaattttgttatattgttatttttggatttcgtcgttttcgttttaacggaaaattggggtttttggatttttttgattcgagttgtaattatcgacgagaattttttttattggcggtttcggcgtcggtattttataaaatgagagcggcgagggcggtcgaagacgagtgtgcggagttttaggtttttcgttcgggttcgtttttcgtatattcgggtaggatcggatgtggtgtttttcgttgaagttttcggttttagtttatttgggagcgggtggnggttttggggaatgttattttaaagattttgtttttggggaacg

SEQ ID NO: 36270 - DNA, 940 bp, Artificial Sequence
  chemically treated genomic DNA (Homo sapiens) CpG-island No: 36270
  misc_feature (45)..(45): n is either a, c, g or t
cgttccccaaaaacaaaatctttaaaataacattccccaaaaccnccacccgctcccaaataaactaaaaccgaaaacttcaacgaaaaacaccacatccgatcctacccgaatatacgaaaaacgaacccgaacgaaaaacctaaaactccgcacactcgtcttcgaccgccctcgccgctctcattttataaaataccgacgccgaaaccgccaataaaaaaaattctcgtcgataattacaactcgaatcaaaaaaatccaaaaaccccaattttccgttaaaacgaaaacgacgaaatccaaaaataacaatataacaaaatttccaaaaccgacaaaccaaccctcaacaatccccacctcttcaaatcgacccgaccctctcgacctccgacttctcactcgctcgactccgctcgactccacccgactccgctcgactccaccctaccccgctcgaccccactcatttccgcttaacaccacccgaaacgcgcctcgtctctattcgacttcactcgactactttcgactacgccccactccctcgactcgtccacttaaccccatccgctccgcttaaccccgccctctcgctctactccgatcgacccgcgcgctcgccctctttaacaaataaaccaacgcaaaatatcctattcgccccgccgaactcgaactaaaaatcgtttattccatctaacttaactcccctttcgaacccaacgaattacgtcgaatacaaatcgactccatcgaacctacttccctccccctcttcgatcacctacgaaatcaactcgtacacctatctccccctcacctacccgacaactctaaaacaactcgattcgaaacgacccaaaaaaaatcttacaaaatcttccatcatcgtaaacaccgctcaaactaaaaaacgaactaaactccgaaatat

SEQ ID NO: 36271 - DNA, 940 bp, Artificial Sequence
  chemically treated genomic DNA (Homo sapiens) CpG-island No: 36271
  misc_feature (45)..(45): n is either a, c, g or t
cgttttttaaaagtaaagtttttaaagtgatattttttagaattnttattcgtttttaggtgaattggagtcgaggattttaacggaagatattatattcgattttattcgaatatacgaaaagcggattcgagcggggggtttaaggtttcgtatattcgttttcggtcgttttcgtcgtttttattttataaaatgtcgacgtcgaggtcgttagtgaaaaagattttcgtcggtggttataattcgggttaggggaatttaggagttttagtttttcgttgggacggaaacggcggaatttaaaagtgatagtatgataggatttttagagtcgatagattagtttttagtaatttttatttttttaagtcggttcggttttttcggttttcggttttttattcgttcggtttcgttcggttttattcggtttcgttcggttttattttgtttcgttcggttttatttattttcgtttggtattattcgaaacgcgtttcgtttttgttcggttttattcggttattttcggttgcgttttattttttcggttcgtttatttggttttattcgtttcgtttggtttcgttttttcgttttgtttcgatcggttcgcgcgttcgttttttttggtaggtggattaacgtaagatgttttgttcgtttcgtcgggttcgggttgggggtcgtttgttttatttggtttagtttttttttcgggtttagcgggttgcgtcgggtataggtcggttttatcgggtttgttttttttttttttttcggttatttacgaggttagttcgtgtatttgttttttttttatttattcgatagttttagggtagttcggttcgaaacgatttaggaggggttttgtaaagttttttattatcgtgggtatcgtttaggttgaggaacgaattgagtttcggggtat

SEQ ID NO: 36272 - DNA, 940 bp, Artificial Sequence
  chemically treated genomic DNA (Homo sapiens) CpG-island No: 36272
  misc_feature (896)..(896): n is either a, c, g or t
ataccccgaaactcaattcgttcctcaacctaaacgatacccacgataataaaaaactttacaaaacccctcctaaatcgtttcgaaccgaactaccctaaaactatcgaataaataaaaaaaaaacaaatacacgaactaacctcgtaaataaccgaaaaaaaaaaaaaaaacaaacccgataaaaccgacctatacccgacgcaacccgctaaacccgaaaaaaaaactaaaccaaataaaacaaacgacccccaacccgaacccgacgaaacgaacaaaacatcttacgttaatccacctaccaaaaaaaacgaacgcgcgaaccgatcgaaacaaaacgaaaaaacgaaaccaaacgaaacgaataaaaccaaataaacgaaccgaaaaaataaaacgcaaccgaaaataaccgaataaaaccgaacaaaaacgaaacgcgtttcgaataataccaaacgaaaataaataaaaccgaacgaaacaaaataaaaccgaacgaaaccgaataaaaccgaacgaaaccgaacgaataaaaaaccgaaaaccgaaaaaaccgaaccgacttaaaaaaataaaaattactaaaaactaatctatcgactctaaaaatcctatcatactatcacttttaaattccgccgtttccgtcccaacgaaaaactaaaactcctaaattcccctaacccgaattataaccaccgacgaaaatctttttcactaacgacctcgacgtcgacattttataaaataaaaacgacgaaaacgaccgaaaacgaatatacgaaaccttaaaccccccgctcgaatccgcttttcgtatattcgaataaaatcgaatataatatcttccgttaaaatcctcgactccaattcacctaaaaacgaataanaattctaaaaaatatcactttaaaaactttacttttaaaaaacg

SEQ ID NO: 36273 - DNA, 662 bp, Artificial Sequence
  chemically treated genomic DNA (Homo sapiens) CpG-island No: 36273
tcgtaagtttgcgtcgcgtattttttttgtcgggaataatggcgggagggggaggggatagagaatcgagcgcgggggatcgagttagatttcggggagatagaaattgttttcgtttcgttttttttttgttttgaagtagaaagttcgagttcgagaggtagtggtcgaggacgaaataagtagtttaggaggagggcgatcgcggatcgggggagaggggaaatcgagttagagggaggggcggcgaggggagagcgcgtaggggagacggaaggggttgcgggacggcgttttggggagttggggaggcgattttttgggttttagcgggtttagcgggtgtcgagatgtttcggggcgttcggttagcgcgcgcggggtttcggtcgtttttttgcggtttcgtcggtcgtaggagtttcgttgggttgcgttgcgtaggcggcgggcggcgggaggggaaagttcgcggttcggaagcggcggcggggagtagaatttacgggtttcgcgcgtgtcggcgttgggttacgtggagttgatgttaggcggaggtttcgggttcggacgttttatatcgcgtcgttcgtgtcgggtcgggtagtgtagggtagggtagggtagggtagggtaggatagggtagggtagggtagggtcg

SEQ ID NO: 36274 - DNA, 662 bp, Artificial Sequence
  chemically treated genomic DNA (Homo sapiens) CpG-island No: 36274
cgaccctaccctaccctaccctatcctaccctaccctaccctaccctaccctacactacccgacccgacacgaacgacgcgatataaaacgtccgaacccgaaacctccgcctaacatcaactccacgtaacccaacgccgacacgcgcgaaacccgtaaattctactccccgccgccgcttccgaaccgcgaactttcccctcccgccgcccgccgcctacgcaacgcaacccaacgaaactcctacgaccgacgaaaccgcaaaaaaacgaccgaaaccccgcgcgcgctaaccgaacgccccgaaacatctcgacacccgctaaacccgctaaaacccaaaaaatcgcctccccaactccccaaaacgccgtcccgcaaccccttccgtctcccctacgcgctctcccctcgccgcccctccctctaactcgatttcccctctcccccgatccgcgatcgccctcctcctaaactacttatttcgtcctcgaccactacctctcgaactcgaactttctacttcaaaacaaaaaaaaaacgaaacgaaaacaatttctatctccccgaaatctaactcgatcccccgcgctcgattctctatcccctccccctcccgccattattcccgacaaaaaaaatacgcgacgcaaacttacga

SEQ ID NO: 36275 - DNA, 662 bp, Artificial Sequence
  chemically treated genomic DNA (Homo sapiens) CpG-island No: 36275
cggttttgttttgttttgttttgttttgttttgttttgttttgttttgttttgtattgttcggttcggtacgggcggcgcgatgtgaggcgttcgagttcggagttttcgtttggtattagttttacgtagtttagcgtcggtacgcgcgaggttcgtaagttttgtttttcgtcgtcgttttcgagtcgcggatttttttttttcgtcgttcgtcgtttgcgtagcgtaatttagcggggtttttgcggtcgacgggatcgtagaggggcggtcgggatttcgcgcgcgttaatcgggcgtttcgggatatttcggtattcgttgagttcgttgggatttagggggtcgtttttttagttttttaaggcgtcgtttcgtagtttttttcgttttttttgcgcgtttttttttcgtcgtttttttttttgattcggttttttttttttttcggttcgcggtcgttttttttttggattgtttatttcgttttcggttattgtttttcgggttcgagttttttgttttagagtaggagagaaacggagcgaaagtagtttttgttttttcggggtttgattcggtttttcgcgttcggttttttgttttttttttttttcgttattgttttcggtaggaggagtgcgcggcgtaaatttgcga

SEQ ID NO: 36276 - DNA, 662 bp, Artificial Sequence
  chemically treated genomic DNA (Homo sapiens) CpG-island No: 36276
tcgcaaatttacgccgcgcactcctcctaccgaaaacaataacgaaaaaaaaaaaaaacaaaaaaccgaacgcgaaaaaccgaatcaaaccccgaaaaaacaaaaactactttcgctccgtttctctcctactctaaaacaaaaaactcgaacccgaaaaacaataaccgaaaacgaaataaacaatccaaaaaaaaaacgaccgcgaaccgaaaaaaaaaaaaaaccgaatcaaaaaaaaaaacgacgaaaaaaaaacgcgcaaaaaaaacgaaaaaaactacgaaacgacgccttaaaaaactaaaaaaacgaccccctaaatcccaacgaactcaacgaataccgaaatatcccgaaacgcccgattaacgcgcgcgaaatcccgaccgcccctctacgatcccgtcgaccgcaaaaaccccgctaaattacgctacgcaaacgacgaacgacgaaaaaaaaaaatccgcgactcgaaaacgacgacgaaaaacaaaacttacgaacctcgcgcgtaccgacgctaaactacgtaaaactaataccaaacgaaaactccgaactcgaacgcctcacatcgcgccgcccgtaccgaaccgaacaatacaaaacaaaacaaaacaaaacaaaacaaaacaaaacaaaacaaaacaaaaccg

SEQ ID NO: 36277 - DNA, 1238 bp, Artificial Sequence
  chemically treated genomic DNA (Homo sapiens) CpG-island No: 36277
tgtcgtcggtttttatttaggtcgaggtggttcggttttatgtatcgcgacgtaacgcggggaggtagataaggtatagggcggcgtttataatttatgttaattcgttttatgtgttcgtcgaggcggtataaatcgtcgtgacgattagcggtttaatgatcgaagttaggttggtaagagtcgcgagcgatttttgaagttgtttttgatggtcgttatttatttgtttggatagtatggtttgtaacgcgggtatttcgatgtcgtcggaagcgagaagaattataatggggaaggttatttagtttcgcgtcgcgaacgttagtaagacgtagtttagcgcgtcggtcgttatgtcggcgataatggtttgtttttcgtcgaaacgtttggtggcgggattagtgacgaaggtttgagcgagggcgtgtaagatttcgaatatcgtaagcgataggtcgattatcgtcgcgttttagcgaaagcggttttcgtcgaaaatgatttagagcgttgtcggtatttgttttacgagttgtatgataaagaagatagttataagtgcggcgacgatagttatgtttcgcgtttatcggaaggagttgattgggttgaaggtttttaagggtatcggtcgacgtttttttttatgcgatttttgtattaggaagtagtttagtagtaggttgaggtcgttgagtatcgtcgtcgtaaggaatggtgtatgtaaggagatggcgtttaatagtttttcggttacggggtttgttattatatttacgtcgaaataagcgtttatgagttcgaagtggcgagttcgattttttttatcggtgatgtcggcgatataggcgttagtaatcgtatttgtggcgtcggtgatgtcggttacgatgcgttcggcgtagaggatttataggacgggtgtggtcgttatgatcgcgtagtcgatagtggttttaagtagcgaagcgagtaggattgggcggcggttaaagcggtcggatagtgtttcgagaacgggtgcgtatagaaattgtattaacgtatatagcgttagtagtacgttatagtgattggcgatgttgtcggaatggacgatatttcgtaagaggttcggtagtatcggtataattaagtttatgtttatagtatttagggtgacggtgtcgaggatgacgatgagcgtattgttagattttatatacggtgtttgattgcgttagtaatttaat

SEQ ID NO: 36278 - DNA, 1238 bp, Artificial Sequence
  chemically treated genomic DNA (Homo sapiens) CpG-island No: 36278
attaaattactaacgcaatcaaacaccgtatataaaatctaacaatacgctcatcgtcatcctcgacaccgtcaccctaaatactataaacataaacttaattataccgatactaccgaacctcttacgaaatatcgtccattccgacaacatcgccaatcactataacgtactactaacgctatatacgttaatacaatttctatacgcacccgttctcgaaacactatccgaccgctttaaccgccgcccaatcctactcgcttcgctacttaaaaccactatcgactacgcgatcataacgaccacacccgtcctataaatcctctacgccgaacgcatcgtaaccgacatcaccgacgccacaaatacgattactaacgcctatatcgccgacatcaccgataaaaaaaatcgaactcgccacttcgaactcataaacgcttatttcgacgtaaatataataacaaaccccgtaaccgaaaaactattaaacgccatctccttacatacaccattccttacgacgacgatactcaacgacctcaacctactactaaactacttcctaatacaaaaatcgcataaaaaaaaacgtcgaccgatacccttaaaaaccttcaacccaatcaactccttccgataaacgcgaaacataactatcgtcgccgcacttataactatcttctttatcatacaactcgtaaaacaaataccgacaacgctctaaatcattttcgacgaaaaccgctttcgctaaaacgcgacgataatcgacctatcgcttacgatattcgaaatcttacacgccctcgctcaaaccttcgtcactaatcccgccaccaaacgtttcgacgaaaaacaaaccattatcgccgacataacgaccgacgcgctaaactacgtcttactaacgttcgcgacgcgaaactaaataaccttccccattataattcttctcgcttccgacgacatcgaaatacccgcgttacaaaccatactatccaaacaaataaataacgaccatcaaaaacaacttcaaaaatcgctcgcgactcttaccaacctaacttcgatcattaaaccgctaatcgtcacgacgatttataccgcctcgacgaacacataaaacgaattaacataaattataaacgccgccctataccttatctacctccccgcgttacgtcgcgatacataaaaccgaaccacctcgacctaaataaaaaccgacgaca

SEQ ID NO: 36279 - DNA, 1238 bp, Artificial Sequence
  chemically treated genomic DNA (Homo sapiens) CpG-island No: 36279
gttaaattgttaacgtagttaggtatcgtgtatgaaatttaataatgcgtttatcgttattttcggtatcgttattttggatgttgtaggtataggtttggttatgtcggtattgtcgggttttttgcgggatatcgtttatttcgatagtatcgttagttattatggcgtgttgttagcgttatatgcgttgatgtaatttttatgcgtattcgttttcggagtattgttcgatcgttttggtcgtcgtttagttttgttcgtttcgttatttggagttattatcgattacgcgattatggcgattatattcgttttgtggattttttacgtcggacgtatcgtggtcggtattatcggcgttataggtgcggttgttggcgtttatatcgtcgatattatcgatggggaagatcgggttcgttatttcgggtttatgagcgtttgtttcggcgtgggtatggtggtaggtttcgtggtcgggggattgttgggcgttatttttttgtatgtattattttttgcggcggcggtgtttaacggttttaatttattattgggttgttttttaatgtaggagtcgtataagggagagcgtcgatcgatgtttttgagagtttttaatttagttagtttttttcggtgggcgcggggtatgattatcgtcgtcgtatttatgattgttttttttattatgtaattcgtaggataggtgtcggtagcgttttgggttattttcggcgaggatcgttttcgttggagcgcgacgatgatcggtttgtcgtttgcggtattcggaattttgtacgttttcgtttaagttttcgttattggtttcgttattaaacgtttcggcgagaagtaggttattatcgtcggtatggcggtcgacgcgttgggttacgttttgttggcgttcgcgacgcgaggttggatggttttttttattatgatttttttcgttttcggcggtatcgggatgttcgcgttgtaggttatgttgtttaggtaggtagatgacgattattagggatagttttaaggatcgttcgcggtttttattagtttaatttcgattattggatcgttgatcgttacggcgatttatgtcgtttcggcgagtatatggaacgggttggtatggattgtaggcgtcgttttatattttgtttgttttttcgcgttgcgtcgcggtgtatggagtcgggttatttcgatttgaatggaagtcggcggta

SEQ ID NO: 36280 - DNA, 1238 bp, Artificial Sequence
  chemically treated genomic DNA (Homo sapiens) CpG-island No: 36280
taccgccgacttccattcaaatcgaaataacccgactccatacaccgcgacgcaacgcgaaaaaacaaacaaaatataaaacgacgcctacaatccataccaacccgttccatatactcgccgaaacgacataaatcgccgtaacgatcaacgatccaataatcgaaattaaactaataaaaaccgcgaacgatccttaaaactatccctaataatcgtcatctacctacctaaacaacataacctacaacgcgaacatcccgataccgccgaaaacgaaaaaaatcataataaaaaaaaccatccaacctcgcgtcgcgaacgccaacaaaacgtaacccaacgcgtcgaccgccataccgacgataataacctacttctcgccgaaacgtttaataacgaaaccaataacgaaaacttaaacgaaaacgtacaaaattccgaataccgcaaacgacaaaccgatcatcgtcgcgctccaacgaaaacgatcctcgccgaaaataacccaaaacgctaccgacacctatcctacgaattacataataaaaaaaacaatcataaatacgacgacgataatcataccccgcgcccaccgaaaaaaactaactaaattaaaaactctcaaaaacatcgatcgacgctctcccttatacgactcctacattaaaaaacaacccaataataaattaaaaccgttaaacaccgccgccgcaaaaaataatacatacaaaaaaataacgcccaacaatcccccgaccacgaaacctaccaccatacccacgccgaaacaaacgctcataaacccgaaataacgaacccgatcttccccatcgataatatcgacgatataaacgccaacaaccgcacctataacgccgataataccgaccacgatacgtccgacgtaaaaaatccacaaaacgaatataatcgccataatcgcgtaatcgataataactccaaataacgaaacgaacaaaactaaacgacgaccaaaacgatcgaacaatactccgaaaacgaatacgcataaaaattacatcaacgcatataacgctaacaacacgccataataactaacgatactatcgaaataaacgatatcccgcaaaaaacccgacaataccgacataaccaaacctatacctacaacatccaaaataacgataccgaaaataacgataaacgcattattaaatttcatacacgatacctaactacgttaacaatttaac

SEQ ID NO: 36281 - DNA, 508 bp, Artificial Sequence
  chemically treated genomic DNA (Homo sapiens) CpG-island No: 36281
atcgttcggcgtttttagttagcgcgtagcgggaggcggttgtgtcgtgggttcgtttttcgcgttcgagttgtcgttgtacgtttcgtgcggagttgcggtatcgggagttttcggtggggttgggtttcgtttttcgttttattcggcgttttgttttagattcggtggtcggcggattcgttgcgggttttcgggtcgcggtgatagatttcgtgtttatagggttgcgagttcgggagtttttataggttggcgaacggtcgttcgacggattttatttaggcgggacgcggtaggaggacgttcgttttgtgcggaggggtcgacggcgtcgttcgaagcgtacgtagggtaagtttaggcgttataagttttggatttcgaaatatacgatttttaaaattttaggtttatcgaaaatttcgacgaatacgcgagataatcgtgcgacgcgcgtcggttcgggtcgggcggtcgcgtgtgtaaacggttaggtttaagaatt

SEQ ID NO: 36282 - DNA, 508 bp, Artificial Sequence
  chemically treated genomic DNA (Homo sapiens) CpG-island No: 36282
aattcttaaacctaaccgtttacacacgcgaccgcccgacccgaaccgacgcgcgtcgcacgattatctcgcgtattcgtcgaaattttcgataaacctaaaattttaaaaatcgtatatttcgaaatccaaaacttataacgcctaaacttaccctacgtacgcttcgaacgacgccgtcgacccctccgcacaaaacgaacgtcctcctaccgcgtcccgcctaaataaaatccgtcgaacgaccgttcgccaacctataaaaactcccgaactcgcaaccctataaacacgaaatctatcaccgcgacccgaaaacccgcaacgaatccgccgaccaccgaatctaaaacaaaacgccgaataaaacgaaaaacgaaacccaaccccaccgaaaactcccgataccgcaactccgcacgaaacgtacaacgacaactcgaacgcgaaaaacgaacccacgacacaaccgcctcccgctacgcgctaactaaaaacgccgaacgat

SEQ ID NO: 36283 - DNA, 508 bp, Artificial Sequence
  chemically treated genomic DNA (Homo sapiens) CpG-island No: 36283
ggtttttaggtttggtcgtttatatacgcggtcgttcgattcggatcggcgcgcgtcgtacgattgtttcgcgtattcgtcgagattttcggtaagtttaggattttgaaagtcgtgtgtttcgaagtttaaggtttatggcgtttgagtttgttttgcgtgcgtttcgggcggcgtcgtcggttttttcgtatagggcgagcgtttttttgtcgcgtttcgtttgggtgaggttcgtcgggcgatcgttcgttagtttatagggattttcgggttcgtagttttatgggtacggggtttgttatcgcggttcgggggttcgtagcgggttcgtcggttatcgggtttgggataaagcgtcggatggggcgggagacgggatttagttttatcggaggttttcggtgtcgtagtttcgtacggggcgtgtagcggtagttcggacgcgaaggacgggtttacggtatagtcgtttttcgttgcgcgttggttgggagcgtcgggcggt

SEQ ID NO: 36284 - DNA, 508 bp, Artificial Sequence
  chemically treated genomic DNA (Homo sapiens) CpG-island No: 36284
accgcccgacgctcccaaccaacgcgcaacgaaaaacgactataccgtaaacccgtccttcgcgtccgaactaccgctacacgccccgtacgaaactacgacaccgaaaacctccgataaaactaaatcccgtctcccgccccatccgacgctttatcccaaacccgataaccgacgaacccgctacgaacccccgaaccgcgataacaaaccccgtacccataaaactacgaacccgaaaatccctataaactaacgaacgatcgcccgacgaacctcacccaaacgaaacgcgacaaaaaaacgctcgccctatacgaaaaaaccgacgacgccgcccgaaacgcacgcaaaacaaactcaaacgccataaaccttaaacttcgaaacacacgactttcaaaatcctaaacttaccgaaaatctcgacgaatacgcgaaacaatcgtacgacgcgcgccgatccgaatcgaacgaccgcgtatataaacgaccaaacctaaaaacc

SEQ ID NO: 36285 - DNA, 876 bp, Artificial Sequence
  chemically treated genomic DNA (Homo sapiens) CpG-island No: 36285
ttcgggttcggtttaggtttcgcgggcggggcgcgcgtcgagagaggttggtattttggcgatattttttgagtcgtttcgcggtcggttcgagtcgttattcggcgttcggtaggggggagtttggttgcgggcggggatcggggggcgggtcgcgtcgcgcggagaaaagcgttggtcggagggttcgcggtcgggtcgtcggggtgagcgtgtcgaggcggttgtggcgtaggtttttaggtgagtgtagtttttcgggcggggcgagagttcgcgttgcggttgaagattttaagttttcgattttagtttcgcggttttttcggagggcgggttggggacgtcgggcgtaggggcggggttgggtttcgtcgaggttttttaattttcgtcggacgtttagggttgggcgggagtggggaacgtcgatttaggggagaggttttgcgggagataaaggttacgtttaggggtcgtgtgggtttttgtgcggatacgtgtattttacgtttgtgggtttttgtggatttgcggtcggggacgcgtcgttgtcggtgtttttgtgtgttcgtggttttgcgcggttgttttgcgttcgtgtttacgtttgcgggtttgcgtttggttgtgggcgtcggtgggcgtatcgcgtgttttcgcgtacgtggtcggtgtttgtcgacgtgtttgggttgggtgttcgtagagggtgtgcgtatcgagagtttaacgtcgttttattttttcgttttttcgtcgttttttcgggtttacgatttggttttaaatttttttttcggtttttcgggtaatagttttagttttttttatcgttattcggtcgggggcgtagatagtttttttttttttttt

SEQ ID NO: 36286 - DNA, 876 bp, Artificial Sequence
  chemically treated genomic DNA (Homo sapiens) CpG-island No: 36286
aaaaaaaaaaaaaaaactatctacgcccccgaccgaataacgataaaaaaaactaaaactattacccgaaaaaccgaaaaaaaaatttaaaaccaaatcgtaaacccgaaaaaacgacgaaaaaacgaaaaaataaaacgacgttaaactctcgatacgcacaccctctacgaacacccaacccaaacacgtcgacaaacaccgaccacgtacgcgaaaacacgcgatacgcccaccgacgcccacaaccaaacgcaaacccgcaaacgtaaacacgaacgcaaaacaaccgcgcaaaaccacgaacacacaaaaacaccgacaacgacgcgtccccgaccgcaaatccacaaaaacccacaaacgtaaaatacacgtatccgcacaaaaacccacacgacccctaaacgtaacctttatctcccgcaaaacctctcccctaaatcgacgttccccactcccgcccaaccctaaacgtccgacgaaaattaaaaaacctcgacgaaacccaaccccgcccctacgcccgacgtccccaacccgccctccgaaaaaaccgcgaaactaaaatcgaaaacttaaaatcttcaaccgcaacgcgaactctcgccccgcccgaaaaactacactcacctaaaaacctacgccacaaccgcctcgacacgctcaccccgacgacccgaccgcgaaccctccgaccaacgcttttctccgcgcgacgcgacccgccccccgatccccgcccgcaaccaaactcccccctaccgaacgccgaataacgactcgaaccgaccgcgaaacgactcaaaaaatatcgccaaaataccaacctctctcgacgcgcgccccgcccgcgaaacctaaaccgaacccgaa

SEQ ID NO: 36287 - DNA, 876 bp, Artificial Sequence
  chemically treated genomic DNA (Homo sapiens) CpG-island No: 36287
agggggagggggagggttgtttgcgttttcggtcgggtagcggtggggaggattggggttgttgttcgaggaatcgggagaaaagtttggagttaagtcgtgggttcgaggggacggcgggggagcgggggggtggggcggcgttgggttttcggtgcgtatattttttgcggatatttagtttagatacgtcggtaggtatcgattacgtacgcggagatacgcgatgcgtttatcgacgtttatagttaagcgtaggttcgtaaacgtggatacgggcgtaaagtagtcgcgtaaagttacggatatataaaggtatcgatagcggcgcgttttcgatcgtaaatttataaagatttataaacgtgagatgtacgtgttcgtataaagatttatacggtttttgggcgtagtttttgtttttcgtaagattttttttttgggtcggcgttttttattttcgtttagttttaggcgttcgacgaaagttgaggggtttcggcgggatttagtttcgtttttgcgttcggcgtttttagttcgtttttcgaaggggtcgcgaggttaggatcggggatttgggatttttaatcgtagcgcggattttcgtttcgttcggggaattgtatttatttggaagtttgcgttatagtcgtttcggtacgtttatttcggcggttcggtcgcgggtttttcggttagcgttttttttcgcgcggcgcggttcgtttttcggttttcgttcgtagttaggtttttttttgtcgggcgtcgggtggcggttcgggtcggtcgcggggcggtttagggagtgtcgttaaagtgttagtttttttcggcgcgcgtttcgttcgcggagtttgagtcgagttcggg

SEQ ID NO: 36288 - DNA, 876 bp, Artificial Sequence
  chemically treated genomic DNA (Homo sapiens) CpG-island No: 36288
cccgaactcgactcaaactccgcgaacgaaacgcgcgccgaaaaaaactaacactttaacgacactccctaaaccgccccgcgaccgacccgaaccgccacccgacgcccgacaaaaaaaaacctaactacgaacgaaaaccgaaaaacgaaccgcgccgcgcgaaaaaaaacgctaaccgaaaaacccgcgaccgaaccgccgaaataaacgtaccgaaacgactataacgcaaacttccaaataaatacaattccccgaacgaaacgaaaatccgcgctacgattaaaaatcccaaatccccgatcctaacctcgcgaccccttcgaaaaacgaactaaaaacgccgaacgcaaaaacgaaactaaatcccgccgaaacccctcaactttcgtcgaacgcctaaaactaaacgaaaataaaaaacgccgacccaaaaaaaaaatcttacgaaaaacaaaaactacgcccaaaaaccgtataaatctttatacgaacacgtacatctcacgtttataaatctttataaatttacgatcgaaaacgcgccgctatcgatacctttatatatccgtaactttacgcgactactttacgcccgtatccacgtttacgaacctacgcttaactataaacgtcgataaacgcatcgcgtatctccgcgtacgtaatcgatacctaccgacgtatctaaactaaatatccgcaaaaaatatacgcaccgaaaacccaacgccgccccacccccccgctcccccgccgtcccctcgaacccacgacttaactccaaacttttctcccgattcctcgaacaacaaccccaatcctccccaccgctacccgaccgaaaacgcaaacaaccctccccctccccct

SEQ ID NO: 36289 - DNA, 521 bp, Artificial Sequence
  chemically treated genomic DNA (Homo sapiens) CpG-island No: 36289
gcggagattacgatagtgaggggttacgtagagattacgatagtggggtgttacgtagagattataatagtggggggttataaagagattacgatagtgaggggttacgcggagattacgatagtgaggggttacgtagagattacgatagtggggtgttacgtagagattataatagtggggggttataaagagattacgatagtgaggggttacgcggagattacgatagtggggttacgtagagattatgatagtggggttacgtagagattataatagtggggggttacgcggagattacgatagtgaggggttacgtagagattacgatagtggggtgttacgtagagattataatagtggggggttataaagagattacgatagtgaggggttacgcggagattacgatagtggggttacgtagagattatgatagtggggttacgtagagattataatagtggggggttacgcggagattacgatagtgaggggttacgtagagattataatag

SEQ ID NO: 36290 - DNA, 521 bp, Artificial Sequence
  chemically treated genomic DNA (Homo sapiens) CpG-island No: 36290
ctattataatctctacgtaacccctcactatcgtaatctccgcgtaaccccccactattataatctctacgtaaccccactatcataatctctacgtaaccccactatcgtaatctccgcgtaacccctcactatcgtaatctctttataaccccccactattataatctctacgtaacaccccactatcgtaatctctacgtaacccctcactatcgtaatctccgcgtaaccccccactattataatctctacgtaaccccactatcataatctctacgtaaccccactatcgtaatctccgcgtaacccctcactatcgtaatctctttataaccccccactattataatctctacgtaacaccccactatcgtaatctctacgtaacccctcactatcgtaatctccgcgtaacccctcactatcgtaatctctttataaccccccactattataatctctacgtaacaccccactatcgtaatctctacgtaacccctcactatcgtaatctccgc

SEQ ID NO: 36291 - DNA, 521 bp, Artificial Sequence
  chemically treated genomic DNA (Homo sapiens) CpG-island No: 36291
ttgttgtgatttttgcgtggttttttattgtcgtgattttcgcgtggttttttattgttgtgatttttgcgtggttttattgttatgatttttgcgtggttttattgtcgtgattttcgcgtggttttttattgtcgtgatttttttgtggttttttattgttgtgatttttgcgtggtattttattgtcgtgatttttgcgtggttttttattgtcgtgattttcgcgtggttttttattgttgtgatttttgcgtggttttattgttatgatttttgcgtggttttattgtcgtgattttcgcgtggttttttattgtcgtgatttttttgtggttttttattgttgtgatttttgcgtggtattttattgtcgtgatttttgcgtggttttttattgtcgtgattttcgcgtggttttttattgtcgtgatttttttgtggttttttattgttgtgatttttgcgtggtattttattgtcgtgatttttgcgtggttttttattgtcgtgattttcgt

SEQ ID NO: 36292 - DNA, 521 bp, Artificial Sequence
  chemically treated genomic DNA (Homo sapiens) CpG-island No: 36292
acgaaaatcacgacaataaaaaaccacgcaaaaatcacgacaataaaataccacgcaaaaatcacaacaataaaaaaccacaaaaaaatcacgacaataaaaaaccacgcgaaaatcacgacaataaaaaaccacgcaaaaatcacgacaataaaataccacgcaaaaatcacaacaataaaaaaccacaaaaaaatcacgacaataaaaaaccacgcgaaaatcacgacaataaaaccacgcaaaaatcataacaataaaaccacgcaaaaatcacaacaataaaaaaccacgcgaaaatcacgacaataaaaaaccacgcaaaaatcacgacaataaaataccacgcaaaaatcacaacaataaaaaaccacaaaaaaatcacgacaataaaaaaccacgcgaaaatcacgacaataaaaccacgcaaaaatcataacaataaaaccacgcaaaaatcacaacaataaaaaaccacgcgaaaatcacgacaataaaaaaccacgcaaaaatcacaacaa

SEQ ID NO: 36293 - DNA, 734 bp, Artificial Sequence
  chemically treated genomic DNA (Homo sapiens) CpG-island No: 36293
aaatagttgttttagacgtatagttggttgtcgcgagggttgtagttaacggaggagatgaattggtaggggttggggaaggtgaggttgataggtttttcgcggttggtattggtgttgaaggtatagtttacgcggttgttagtcgtttcgttgttattatttacgtatacggaacgtaggacgtataggattttatatattatgaaggcgttggatgtcgagcgtttgtcgtaattcgttttttacgtgtttttaaagcgtagtgtgtaggggtttagttggtttattattagtcgttcgttgttgtttttagtggcgtagatgatttatagttcgttttcgtttatcgttaggttaatgtcggttttttcgttttagcggtagggcgaggtgttatggtagttggcggtattgatgatcgttttttcgtttttgatgcgcgttcgtaggttatatttgacgatgttgcgcgtgcgttttttgttgtagaagacggtattatcgtagattataaagtttgtgttatttacgcggttgggtaggcggtaggtggtggtgtggcgggcggttacgtagtttttttacgaggtatatttagttagtgtgttcgtgcggtaggggatttagggtattacgtagatgcggttattcgtttgtagcgggtttttgtattatgcgttagattggtgttttgattcgtgtgtcgaggtgggttttagtattttttgtag

SEQ ID NO: 36294 - DNA, 734 bp, Artificial Sequence
  chemically treated genomic DNA (Homo sapiens) CpG-island No: 36294
ctacaaaaaatactaaaacccacctcgacacacgaatcaaaacaccaatctaacgcataatacaaaaacccgctacaaacgaataaccgcatctacgtaataccctaaatcccctaccgcacgaacacactaactaaatatacctcgtaaaaaaactacgtaaccgcccgccacaccaccacctaccgcctacccaaccgcgtaaataacacaaactttataatctacgataataccgtcttctacaacaaaaaacgcacgcgcaacatcgtcaaatataacctacgaacgcgcatcaaaaacgaaaaaacgatcatcaataccgccaactaccataacacctcgccctaccgctaaaacgaaaaaaccgacattaacctaacgataaacgaaaacgaactataaatcatctacgccactaaaaacaacaacgaacgactaataataaaccaactaaacccctacacactacgctttaaaaacacgtaaaaaacgaattacgacaaacgctcgacatccaacgccttcataatatataaaatcctatacgtcctacgttccgtatacgtaaataataacaacgaaacgactaacaaccgcgtaaactataccttcaacaccaataccaaccgcgaaaaacctatcaacctcaccttccccaacccctaccaattcatctcctccgttaactacaaccctcgcgacaaccaactatacgtctaaaacaactattt

SEQ ID NO: 36295 - DNA, 734 bp, Artificial Sequence
  chemically treated genomic DNA (Homo sapiens) CpG-island No: 36295
ttgtagaaggtgttggagtttatttcgatatacgagttagagtattagtttggcgtatggtgtaaggattcgttgtaggcgggtgatcgtatttacgtgatgttttggattttttatcgtacggatatattgattgagtatgtttcgtgggaggattacgtggtcgttcgttatattattatttatcgtttgtttaatcgcgtggatggtataggttttgtggtttacgatggtgtcgttttttataataaggagcgtacgcgtaatatcgttaagtatgatttacggacgcgtattaagagcggggagacggttattaatatcgttaattattatgatatttcgttttatcgttggggcggaaagatcgatattgatttggcggtggacgagaacgggttgtgggttatttacgttattgagggtaataacgggcggttggtggtgagttagttgaatttttatatattgcgttttgagggtacgtgggagacgggttacgataagcgttcggtatttaacgtttttatggtgtgtggggttttgtacgttttgcgtttcgtgtacgtggatgatgatagcgaggcggttggtaatcgcgtggattatgtttttaatattaatgttaatcgcgaggagtttgttagttttattttttttaatttttattagtttatttttttcgttgattataattttcgcgataattagttgtacgtttggaataattattt

SEQ ID NO: 36296 - DNA, 734 bp, Artificial Sequence
  chemically treated genomic DNA (Homo sapiens) CpG-island No: 36296
aaataattattccaaacgtacaactaattatcgcgaaaattataatcaacgaaaaaaataaactaataaaaattaaaaaaaataaaactaacaaactcctcgcgattaacattaatattaaaaacataatccacgcgattaccaaccgcctcgctatcatcatccacgtacacgaaacgcaaaacgtacaaaaccccacacaccataaaaacgttaaataccgaacgcttatcgtaacccgtctcccacgtaccctcaaaacgcaatatataaaaattcaactaactcaccaccaaccgcccgttattaccctcaataacgtaaataacccacaacccgttctcgtccaccgccaaatcaatatcgatctttccgccccaacgataaaacgaaatatcataataattaacgatattaataaccgtctccccgctcttaatacgcgtccgtaaatcatacttaacgatattacgcgtacgctccttattataaaaaacgacaccatcgtaaaccacaaaacctataccatccacgcgattaaacaaacgataaataataatataacgaacgaccacgtaatcctcccacgaaacatactcaatcaatatatccgtacgataaaaaatccaaaacatcacgtaaatacgatcacccgcctacaacgaatccttacaccatacgccaaactaatactctaactcgtatatcgaaataaactccaacaccttctacaa

SEQ ID NO: 36297 - DNA, 905 bp, Artificial Sequence
  chemically treated genomic DNA (Homo sapiens) CpG-island No: 36297
gtcggcggcggtcgggcgatttttgattcgcgcgtcggtcgcgtttttttttcgttggtaggtggatagcggttgcgtcgggtaggtcgcggcgttaatttcggttggtcgatagtcgttgtcgtattgagcgggggcgggggattgcggcgcgcgcggggtcggtcgggcgttcgtcggggtcgttttttgagtttcggagcgttgcgcggtcgttagttagttttcgtcgtttcgtttcgtcggttcgggttcgtagattgcgttttcgtttcgtttttttattttcggattgatattgagcgttttgttggggggtttggcggattcggtattttcgttaatcggcggtttcgtagggcggatttcgggtttagtttagcgtttcggttaatcggacgcgtttgttcgtttagttgcggtttcgcgagcgagtgaatggtcgagagttcgcggtgcgtgtttcgaggttgagagtttatagtggcgcgggaaggtcgcgggagggttaatgggaggcggcgttgagtcgttagttagggcggtttaggttaatgagcggcgggttgcgggggcgttatagatagcggtagagattttgggttgaggttttcgggcgggcgggcgcggagagacgcgggaagtaggggttgggcgggggtcgcggcgtcgtagttagcgtagttagttcgagggtcgtcgtcgtcgtcgtttagcgcgtttcggggtcgtcggtcgtagttagtattcgtcgcgtcgtagtttcgggatcggtttcggtcgtcgtcgtcgcgatgggtaacgtcgtcgtcgttaagaagggtagcgagtaggagagcggtgagtgttcgggttgtgatttcgattttggttttgcgttgttagttttggttttgtttattatt

SEQ ID NO: 36298 - DNA, 905 bp, Artificial Sequence
  chemically treated genomic DNA (Homo sapiens) CpG-island No: 36298
aataataaacaaaaccaaaactaacaacgcaaaaccaaaatcgaaatcacaacccgaacactcaccgctctcctactcgctacccttcttaacgacgacgacgttacccatcgcgacgacgacgaccgaaaccgatcccgaaactacgacgcgacgaatactaactacgaccgacgaccccgaaacgcgctaaacgacgacgacgacgaccctcgaactaactacgctaactacgacgccgcgacccccgcccaacccctacttcccgcgtctctccgcgcccgcccgcccgaaaacctcaacccaaaatctctaccgctatctataacgcccccgcaacccgccgctcattaacctaaaccgccctaactaacgactcaacgccgcctcccattaaccctcccgcgaccttcccgcgccactataaactctcaacctcgaaacacgcaccgcgaactctcgaccattcactcgctcgcgaaaccgcaactaaacgaacaaacgcgtccgattaaccgaaacgctaaactaaacccgaaatccgccctacgaaaccgccgattaacgaaaataccgaatccgccaaaccccccaacaaaacgctcaatatcaatccgaaaataaaaaaacgaaacgaaaacgcaatctacgaacccgaaccgacgaaacgaaacgacgaaaactaactaacgaccgcgcaacgctccgaaactcaaaaaacgaccccgacgaacgcccgaccgaccccgcgcgcgccgcaatcccccgcccccgctcaatacgacaacgactatcgaccaaccgaaattaacgccgcgacctacccgacgcaaccgctatccacctaccaacgaaaaaaaaacgcgaccgacgcgcgaatcaaaaatcgcccgaccgccgccgac

SEQ ID NO: 36299 - DNA, 905 bp, Artificial Sequence
  chemically treated genomic DNA (Homo sapiens) CpG-island No: 36299
gatgatggataaggttagggttggtagcgtagggttaagatcggggttatagttcgggtatttatcgtttttttgttcgttgttttttttggcggcggcggcgttgtttatcgcggcggcggcggtcggggtcggtttcggagttgcggcgcggcgggtgttggttgcggtcggcggtttcggagcgcgttgggcggcggcggcggcggttttcgggttggttgcgttagttgcggcgtcgcgattttcgtttagtttttgtttttcgcgttttttcgcgttcgttcgttcgggaattttagtttaagatttttgtcgttgtttgtgacgttttcgtagttcgtcgtttattggtttaggtcgttttgattgacggtttagcgtcgttttttattggttttttcgcgattttttcgcgttattataggtttttagtttcgggatacgtatcgcggattttcggttatttattcgttcgcgaggtcgtagttgggcgggtagacgcgttcgattggtcgagacgttggattgggttcggggttcgttttgcgaggtcgtcgattggcggaggtgtcgggttcgttaagttttttagtagaacgtttagtgttaattcgggggtgagagggcggggcggagacgtagtttgcgggttcgggtcggcggggcggggcggcggaggttggttggcggtcgcgtagcgtttcgaggtttaggaggcggtttcggcgggcgttcggtcggtttcgcgcgcgtcgtagtttttcgttttcgtttagtgcggtagcggttgtcggttagtcggagttggcgtcgcggtttgttcggcgtagtcgttgtttatttgttagcgggggaggggcgcggtcggcgcgcgggttagaggtcgttcggtcgtcgtcggt

SEQ ID NO: 36300 - DNA, 905 bp, Artificial Sequence
  chemically treated genomic DNA (Homo sapiens) CpG-island No: 36300
accgacgacgaccgaacgacctctaacccgcgcgccgaccgcgcccctcccccgctaacaaataaacaacgactacgccgaacaaaccgcgacgccaactccgactaaccgacaaccgctaccgcactaaacgaaaacgaaaaactacgacgcgcgcgaaaccgaccgaacgcccgccgaaaccgcctcctaaacctcgaaacgctacgcgaccgccaaccaacctccgccgccccgccccgccgacccgaacccgcaaactacgtctccgccccgccctctcacccccgaattaacactaaacgttctactaaaaaacttaacgaacccgacacctccgccaatcgacgacctcgcaaaacgaaccccgaacccaatccaacgtctcgaccaatcgaacgcgtctacccgcccaactacgacctcgcgaacgaataaataaccgaaaatccgcgatacgtatcccgaaactaaaaacctataataacgcgaaaaaatcgcgaaaaaaccaataaaaaacgacgctaaaccgtcaatcaaaacgacctaaaccaataaacgacgaactacgaaaacgtcacaaacaacgacaaaaatcttaaactaaaattcccgaacgaacgaacgcgaaaaaacgcgaaaaacaaaaactaaacgaaaatcgcgacgccgcaactaacgcaaccaacccgaaaaccgccgccgccgccgcccaacgcgctccgaaaccgccgaccgcaaccaacacccgccgcgccgcaactccgaaaccgaccccgaccgccgccgccgcgataaacaacgccgccgccgccaaaaaaaacaacgaacaaaaaaacgataaatacccgaactataaccccgatcttaaccctacgctaccaaccctaaccttatccatcatc

SEQ ID NO: 36301 - DNA, 694 bp, Artificial Sequence
  chemically treated genomic DNA (Homo sapiens) CpG-island No: 36301
tttcggaggagcggtttatggagacgtttatcgagcgcgaaattcgtcgtagttgcgaacgcgaggagagtttgcgtcggagtcggggtttgagttcgggtcgcgtaggtcgtgaattcgtcgagttgcgcgtgcggtcggtgtttaatttgtcgggttttggtttcgcgttttcgcgcgttttggagcgggcgcgggcgggcgcgtagatgtagcgggatatcgagcgggaggtttatcggtaggcggcgttggcgcgtttcgcggttttcgagtcgcgcgttcggtcgtcgtcgtagtcgttgggcgaatttaagcgttttttcgaggtcgcggcggggagcggtttttcggcgggggcgggggacggcgcgggttcgtagaggttgttagagtttgggggacggtcgcgttcggtcgtgtagggcgggtgtcgggtgttgggtagcgtttcgtcgttttttatttcgttattgttggagtaggaggtgcgcgtcgtgcgcgagcgcgagtaggaattgtagcgttagcggcgtagcgtttatggtatcgcggagtttaaggagtttacgtcgagttttatcggtaagtcgcgggcgtagtaacgtcgggatttttagggttttagtcgtttttatcgattgtttaattttagtggttttttttgtggtttttcgattttcggggttttttt

SEQ ID NO: 36302 - DNA, 694 bp, Artificial Sequence
  chemically treated genomic DNA (Homo sapiens) CpG-island No: 36302
aaaaaaaccccgaaaatcgaaaaaccacaaaaaaaaccactaaaattaaacaatcgataaaaacgactaaaaccctaaaaatcccgacgttactacgcccgcgacttaccgataaaactcgacgtaaactccttaaactccgcgataccataaacgctacgccgctaacgctacaattcctactcgcgctcgcgcacgacgcgcacctcctactccaacaataacgaaataaaaaacgacgaaacgctacccaacacccgacacccgccctacacgaccgaacgcgaccgtcccccaaactctaacaacctctacgaacccgcgccgtcccccgcccccgccgaaaaaccgctccccgccgcgacctcgaaaaaacgcttaaattcgcccaacgactacgacgacgaccgaacgcgcgactcgaaaaccgcgaaacgcgccaacgccgcctaccgataaacctcccgctcgatatcccgctacatctacgcgcccgcccgcgcccgctccaaaacgcgcgaaaacgcgaaaccaaaacccgacaaattaaacaccgaccgcacgcgcaactcgacgaattcacgacctacgcgacccgaactcaaaccccgactccgacgcaaactctcctcgcgttcgcaactacgacgaatttcgcgctcgataaacgtctccataaaccgctcctccgaaa

SEQ ID NO: 36303 - DNA, 694 bp, Artificial Sequence
  chemically treated genomic DNA (Homo sapiens) CpG-island No: 36303
ggagagatttcgagaatcggagggttataggaggggttattgaagttgggtaatcggtgggggcggttggaattttgggggtttcggcgttgttacgttcgcggtttatcggtgaggttcggcgtaggttttttgaatttcgcggtgttatagacgttgcgtcgttggcgttgtagtttttgttcgcgttcgcgtacggcgcgtattttttgttttagtagtgacggagtgaaaggcggcggggcgttgtttagtattcggtattcgttttgtacggtcgagcgcggtcgttttttaggttttggtagtttttgcgggttcgcgtcgtttttcgttttcgtcgaggagtcgtttttcgtcgcggtttcgaagaagcgtttgagttcgtttagcggttgcggcggcgatcgggcgcgcggttcggggatcgcggggcgcgttagcgtcgtttgtcggtgggtttttcgttcgatgtttcgttgtatttgcgcgttcgttcgcgttcgttttagggcgcgcgggagcgcggggttaggattcggtaggttgagtatcggtcgtacgcgtagttcgacgagtttacggtttgcgcggttcgggtttaggtttcggtttcggcgtaggtttttttcgcgttcgtagttgcggcggatttcgcgttcgatgggcgtttttatgaatcgttttttcgggg

SEQ ID NO: 36304 - DNA, 694 bp, Artificial Sequence
  chemically treated genomic DNA (Homo sapiens) CpG-island No: 36304
ccccgaaaaaacgattcataaaaacgcccatcgaacgcgaaatccgccgcaactacgaacgcgaaaaaaacctacgccgaaaccgaaacctaaacccgaaccgcgcaaaccgtaaactcgtcgaactacgcgtacgaccgatactcaacctaccgaatcctaaccccgcgctcccgcgcgccctaaaacgaacgcgaacgaacgcgcaaatacaacgaaacatcgaacgaaaaacccaccgacaaacgacgctaacgcgccccgcgatccccgaaccgcgcgcccgatcgccgccgcaaccgctaaacgaactcaaacgcttcttcgaaaccgcgacgaaaaacgactcctcgacgaaaacgaaaaacgacgcgaacccgcaaaaactaccaaaacctaaaaaacgaccgcgctcgaccgtacaaaacgaataccgaatactaaacaacgccccgccgcctttcactccgtcactactaaaacaaaaaatacgcgccgtacgcgaacgcgaacaaaaactacaacgccaacgacgcaacgtctataacaccgcgaaattcaaaaaacctacgccgaacctcaccgataaaccgcgaacgtaacaacgccgaaacccccaaaattccaaccgcccccaccgattacccaacttcaataacccctcctataaccctccgattctcgaaatctctcc

SEQ ID NO: 36305 - DNA, 563 bp, Artificial Sequence
  chemically treated genomic DNA (Homo sapiens) CpG-island No: 36305
  misc_feature (3)..(4): n is either a, c, g or t
  misc_feature (31)..(31): n is either a, c, g or t
  misc_feature (93)..(93): n is either a, c, g or t
  misc_feature (98)..(98): n is either a, c, g or t
  misc_feature (104)..(104): n is either a, c, g or t
  misc_feature (110)..(110): n is either a, c, g or t
  misc_feature (159)..(159): n is either a, c, g or t
  misc_feature (184)..(184): n is either a, c, g or t
  misc_feature (201)..(201): n is either a, c, g or t
  misc_feature (235)..(235): n is either a, c, g or t
  misc_feature (291)..(291): n is either a, c, g or t
ganncgttttttttcgcgtttattcgagcgntatttggtgttcgcgtgcgtgtcgttttttttttgttggtgatagtcgtgcgcgatatttanttttngcgatnggtttncggtttatataagttttgttttcgggtattttttattcgttatggtcgngcgtttggtttttggtgcgttgaantgcggattacgcgtttnatcgttgatggtgtttttagatcgtggttcggtntttatgcgcgtttttagttattgatacgttcgtttttttaagtttcgattttaagntatatcgaacgtttttgtatcgcgtaatattgcgttttttatttgtaaatttttattagttatttgtgtagagtatttgtttatgtacggcggtaagttttttgtaatgttatcgagtattttgtcgggttgtagtacgttgtattatgcgagttaagggtgaacgcgttcgaatacgttgagaatttttcgcgtgacgtcgatttatacgtaattagaagatttagtttatgaggttgcgttcgttcgttcgttatgtttattttttaggt

SEQ ID NO: 36306 - DNA, 563 bp, Artificial Sequence
  chemically treated genomic DNA (Homo sapiens) CpG-island No: 36306
  misc_feature (273)..(273): n is either a, c, g or t
  misc_feature (329)..(329): n is either a, c, g or t
  misc_feature (363)..(363): n is either a, c, g or t
  misc_feature (380)..(380): n is either a, c, g or t
  misc_feature (405)..(405): n is either a, c, g or t
  misc_feature (454)..(454): n is either a, c, g or t
  misc_feature (460)..(460): n is either a, c, g or t
  misc_feature (466)..(466): n is either a, c, g or t
  misc_feature (471)..(471): n is either a, c, g or t
  misc_feature (533)..(533): n is either a, c, g or t
  misc_feature (560)..(561): n is either a, c, g or t
acctaaaaaataaacataacgaacgaacgaacgcaacctcataaactaaatcttctaattacgtataaatcgacgtcacgcgaaaaattctcaacgtattcgaacgcgttcacccttaactcgcataatacaacgtactacaacccgacaaaatactcgataacattacaaaaaacttaccgccgtacataaacaaatactctacacaaataactaataaaaatttacaaataaaaaacgcaatattacgcgatacaaaaacgttcgatatancttaaaatcgaaacttaaaaaaacgaacgtatcaataactaaaaacgcgcataaanaccgaaccacgatctaaaaacaccatcaacgatnaaacgcgtaatccgcanttcaacgcaccaaaaaccaaacgcncgaccataacgaataaaaaatacccgaaaacaaaacttatataaaccgnaaaccnatcgcnaaaantaaatatcgcgcacgactatcaccaacaaaaaaaaaacgacacgcacgcgaacaccaaatancgctcgaataaacgcgaaaaaaaacgnntc

SEQ ID NO: 36307 - DNA, 563 bp, Artificial Sequence
  chemically treated genomic DNA (Homo sapiens) CpG-island No: 36307
  misc_feature (273)..(273): n is either a, c, g or t
  misc_feature (329)..(329): n is either a, c, g or t
  misc_feature (363)..(363): n is either a, c, g or t
  misc_feature (380)..(380): n is either a, c, g or t
  misc_feature (405)..(405): n is either a, c, g or t
  misc_feature (454)..(454): n is either a, c, g or t
  misc_feature (460)..(460): n is either a, c, g or t
  misc_feature (466)..(466): n is either a, c, g or t
  misc_feature (471)..(471): n is either a, c, g or t
  misc_feature (533)..(533): n is either a, c, g or t
  misc_feature (560)..(561): n is either a, c, g or t
atttaggaaatgagtatggcgaacggacgagcgtaattttataaattgggttttttaattgcgtatgggtcgacgttacgcgggaaatttttagcgtgttcgagcgcgtttatttttaattcgtatagtataacgtgttgtaattcgataagatattcgatgatattgtagaggatttgtcgtcgtatataggtaggtgttttgtataggtggttggtggagatttataagtgggaggcgtaatgttacgcgatataggaacgttcggtgtgntttgagatcgagatttgaggaggcgggcgtattaatggttaaaaacgcgtatgagngtcggattacgatttggaggtattattaacggtnggacgcgtggttcgtantttagcgtattaagggttaaacgtncggttataacgaatgagaggtgttcgagagtaggatttgtgtgggtcgnagattngtcgtnagaantggatatcgcgtacggttattattaatagggggaaaacgatacgtacgcggatattagatancgttcggatgggcgcggaaagaagcgnntt

SEQ ID NO: 36308 - DNA, 563 bp, Artificial Sequence
  chemically treated genomic DNA (Homo sapiens) CpG-island No: 36308
  misc_feature (3)..(4): n is either a, c, g or t
  misc_feature (31)..(31): n is either a, c, g or t
  misc_feature (93)..(93): n is either a, c, g or t
  misc_feature (98)..(98): n is either a, c, g or t
  misc_feature (104)..(104): n is either a, c, g or t
  misc_feature (110)..(110): n is either a, c, g or t
  misc_feature (159)..(159): n is either a, c, g or t
  misc_feature (184)..(184): n is either a, c, g or t
  misc_feature (201)..(201): n is either a, c, g or t
  misc_feature (235)..(235): n is either a, c, g or t
  misc_feature (291)..(291): n is either a, c, g or t
aanncgcttctttccgcgcccatccgaacgntatctaatatccgcgtacgtatcgttttccccctattaataataaccgtacgcgatatccanttctnacgacnaatctncgacccacacaaatcctactctcgaacacctctcattcgttataaccgnacgtttaacccttaatacgctaaantacgaaccacgcgtccnaccgttaataatacctccaaatcgtaatccgacnctcatacgcgtttttaaccattaatacgcccgcctcctcaaatctcgatctcaaancacaccgaacgttcctatatcgcgtaacattacgcctcccacttataaatctccaccaaccacctatacaaaacacctacctatatacgacgacaaatcctctacaatatcatcgaatatcttatcgaattacaacacgttatactatacgaattaaaaataaacgcgctcgaacacgctaaaaatttcccgcgtaacgtcgacccatacgcaattaaaaaacccaatttataaaattacgctcgtccgttcgccatactcatttcctaaat

SEQ ID NO: 36309 - DNA, 528 bp, Artificial Sequence
  chemically treated genomic DNA (Homo sapiens) CpG-island No: 36309
gtatttagttcgcgcgtcgtttttaaatagtcggttttcgttttttggttaattatcgttaacgttttttggcggcgcgcgtatttttttagttagttttggagcgtcgatcggcgcgcgtttagatttttcggattaattagcggagtttttttttcgtagcgtgtgaggagggcgaaattatttttaagttttttagcgtgttcgttggaaattaatttttagcgttttcgatttggatgttaacggcgggaatggacggagttatagcgtcggtttttttttggttaattttgagggttttcgtatcggcgtggttcgtttttcgtttcgttttttcgggagatgtatttcgtagcgcgtagcgtcgttattcgtcgagcggtggcgcgcggcgttcgttaaagaaggcgggaagggcggtgttcgtattcgaagtgattggtaggagggagtggggcggagataaagagggttttttgagagtttattggttggattggtaatggtggcgggagtagaaggagg

SEQ ID NO: 36310 - DNA, 528 bp, Artificial Sequence
  chemically treated genomic DNA (Homo sapiens) CpG-island No: 36310
cctccttctactcccgccaccattaccaatccaaccaataaactctcaaaaaaccctctttatctccgccccactccctcctaccaatcacttcgaatacgaacaccgcccttcccgccttctttaacgaacgccgcgcgccaccgctcgacgaataacgacgctacgcgctacgaaatacatctcccgaaaaaacgaaacgaaaaacgaaccacgccgatacgaaaaccctcaaaattaaccaaaaaaaaaccgacgctataactccgtccattcccgccgttaacatccaaatcgaaaacgctaaaaattaatttccaacgaacacgctaaaaaacttaaaaataatttcgccctcctcacacgctacgaaaaaaaaactccgctaattaatccgaaaaatctaaacgcgcgccgatcgacgctccaaaactaactaaaaaaatacgcgcgccgccaaaaaacgttaacgataattaaccaaaaaacgaaaaccgactatttaaaaacgacgcgcgaactaaatac

SEQ ID NO: 36311 - DNA, 528 bp, Artificial Sequence
  chemically treated genomic DNA (Homo sapiens) CpG-island No: 36311
tttttttttgttttcgttattattattaatttagttaataaatttttagaaaattttttttattttcgttttatttttttttgttaattatttcgggtgcgagtatcgtttttttcgttttttttagcgagcgtcgcgcgttatcgttcggcgggtggcggcgttgcgcgttgcgggatgtatttttcggaaaagcgaggcgaggggcgggttacgtcggtgcgggaatttttaggattggttagaaggaggtcggcgttgtgatttcgtttattttcgtcgttgatatttaagtcggagacgttggggattggtttttagcggatacgttaagaagtttggagatagtttcgttttttttatacgttgcggagagggagtttcgttgattggttcgaggagtttgggcgcgcgtcgatcggcgttttaggattggttgagggggtgcgcgcgtcgttagggagcgttggcggtgattggttagagggcggaggtcggttatttgaaggcggcgcgcggattaggtgt

SEQ ID NO: 36312 - DNA, 528 bp, Artificial Sequence
  chemically treated genomic DNA (Homo sapiens) CpG-island No: 36312
acacctaatccgcgcgccgccttcaaataaccgacctccgccctctaaccaatcaccgccaacgctccctaacgacgcgcgcaccccctcaaccaatcctaaaacgccgatcgacgcgcgcccaaactcctcgaaccaatcaacgaaactccctctccgcaacgtataaaaaaaacgaaactatctccaaacttcttaacgtatccgctaaaaaccaatccccaacgtctccgacttaaatatcaacgacgaaaataaacgaaatcacaacgccgacctccttctaaccaatcctaaaaattcccgcaccgacgtaacccgcccctcgcctcgcttttccgaaaaatacatcccgcaacgcgcaacgccgccacccgccgaacgataacgcgcgacgctcgctaaaaaaaacgaaaaaaacgatactcgcacccgaaataattaacaaaaaaaaataaaacgaaaataaaaaaaattttctaaaaatttattaactaaattaataataataacgaaaacaaaaaaaaa

SEQ ID NO: 36313 - DNA, 762 bp, Artificial Sequence
  chemically treated genomic DNA (Homo sapiens) CpG-island No: 36313
  misc_feature (165)..(165): n is either a, c, g or t
  misc_feature (561)..(561): n is either a, c, g or t
aaagttttcggtttgtggcggggaagagtttttaaataaattttgcgcggtagataatatgttattcggtttacgtatttcgtatggagattttgggggcgttatagaggggtgtatattagggcggtgttgcggatataagatgttttacgaatcgcgtttttngacgcgggttaaaggtggtatggattttattagttatgtggcgcgggtgattatataaggggggtattattcgtacgttcgatttgagcggagagagaggatcgagtagatcgcgcggcgtattataagtattttgtgtcgatatatattgattgggcgttagataagcgcggttttaatttaattagatgtgtggcggatatcgttggttgtatcgattaattttaatattaggtcgagttagtcggttcggtattatcgcgtcggcgttgtgcggcgatattatatgacggtggttcgtagcgcgacggcgtacgttcggttgcgtcgatacgtaagtacgtcgtgtataattacgatcgtggggagatgttattaattttggattgaatcgtnttacgggggtggtgtatgtatttatgttcgttcgatagtttggtgtgttgtttgataagaatagtacgtagttttgggggaaagaatataagttcgtgcggcgcgatttatacgggaggcgaggcggcgaggaagagtgtaatttattatattatttagggcgacgcggacgaggtttaataatgtagatacgttaggttg

SEQ ID NO: 36314 - DNA, 762 bp, Artificial Sequence
  chemically treated genomic DNA (Homo sapiens) CpG-island No: 36314
  misc_feature (202)..(202): n is either a, c, g or t
  misc_feature (598)..(598): n is either a, c, g or t
caacctaacgtatctacattattaaacctcgtccgcgtcgccctaaataatataataaattacactcttcctcgccgcctcgcctcccgtataaatcgcgccgcacgaacttatattctttcccccaaaactacgtactattcttatcaaacaacacaccaaactatcgaacgaacataaatacatacaccacccccgtaanacgattcaatccaaaattaataacatctccccacgatcgtaattatacacgacgtacttacgtatcgacgcaaccgaacgtacgccgtcgcgctacgaaccaccgtcatataatatcgccgcacaacgccgacgcgataataccgaaccgactaactcgacctaatattaaaattaatcgatacaaccaacgatatccgccacacatctaattaaattaaaaccgcgcttatctaacgcccaatcaatatatatcgacacaaaatacttataatacgccgcgcgatctactcgatcctctctctccgctcaaatcgaacgtacgaataataccccccttatataatcacccgcgccacataactaataaaatccataccacctttaacccgcgtcnaaaaacgcgattcgtaaaacatcttatatccgcaacaccgccctaatatacacccctctataacgcccccaaaatctccatacgaaatacgtaaaccgaataacatattatctaccgcgcaaaatttatttaaaaactcttccccgccacaaaccgaaaacttt

SEQ ID NO: 36315 - DNA, 762 bp, Artificial Sequence
  chemically treated genomic DNA (Homo sapiens) CpG-island No: 36315
  misc_feature (202)..(202): n is either a, c, g or t
  misc_feature (598)..(598): n is either a, c, g or t
tagtttggcgtatttatattattagatttcgttcgcgtcgttttgaatgatatagtagattatattttttttcgtcgtttcgtttttcgtgtgggtcgcgtcgtacgaatttatgtttttttttttaagattgcgtgttgtttttgttaagtagtatattagattgtcgagcgagtatgagtgtatgtattattttcgtggngcggtttaatttaaggttagtaatatttttttacggtcgtggttgtgtacgacgtatttgcgtgtcggcgtaatcgagcgtgcgtcgtcgcgttacgagttatcgttatgtggtgtcgtcgtatagcgtcggcgcggtgatgtcgggtcggttggttcgatttagtattgaggttagtcggtgtaattagcggtgttcgttatatatttggttaggttggagtcgcgtttgtttgacgtttagttagtgtgtgtcgatataaaatatttgtggtgcgtcgcgcgatttgttcggtttttttttttcgtttaggtcgaacgtgcgagtaatattttttttgtgtgattattcgcgttatatggttggtggggtttatattatttttgattcgcgttnaaaagcgcggttcgtagaatattttgtgttcgtaatatcgttttggtatgtatttttttgtggcgtttttagaatttttatacggggtgcgtaaatcggataatatattgtttgtcgcgtaagatttgtttgagaattttttttcgttataaatcgggggtttt

SEQ ID NO: 36316 - DNA, 762 bp, Artificial Sequence
  chemically treated genomic DNA (Homo sapiens) CpG-island No: 36316
  misc_feature (165)..(165): n is either a, c, g or t
  misc_feature (561)..(561): n is either a, c, g or t
aaaacccccgatttataacgaaaaaaaattctcaaacaaatcttacgcgacaaacaatatattatccgatttacgcaccccgtataaaaattctaaaaacgccacaaaaaaatacataccaaaacgatattacgaacacaaaatattctacgaaccgcgcttttnaacgcgaatcaaaaataatataaaccccaccaaccatataacgcgaataatcacacaaaaaaaatattactcgcacgttcgacctaaacgaaaaaaaaaaaccgaacaaatcgcgcgacgcaccacaaatattttatatcgacacacactaactaaacgtcaaacaaacgcgactccaacctaaccaaatatataacgaacaccgctaattacaccgactaacctcaatactaaatcgaaccaaccgacccgacatcaccgcgccgacgctatacgacgacaccacataacgataactcgtaacgcgacgacgcacgctcgattacgccgacacgcaaatacgtcgtacacaaccacgaccgtaaaaaaatattactaaccttaaattaaaccgcnccacgaaaataatacatacactcatactcgctcgacaatctaatatactacttaacaaaaacaacacgcaatcttaaaaaaaaaaacataaattcgtacgacgcgacccacacgaaaaacgaaacgacgaaaaaaaatataatctactatatcattcaaaacgacgcgaacgaaatctaataatataaatacgccaaacta

SEQ ID NO: 36317 - DNA, 1140 bp, Artificial Sequence
  chemically treated genomic DNA (Homo sapiens) CpG-island No: 36317
gttagcgttggatgcggcgtgcggtcggtaaagattagatcgtttatatagaattggcgatcgttcggcgtatcgttaaaattatcgtcgtaagtcgattacgggttgtcgtttttattatatttaattagcgattgatttatttagttttagacgaagtcgttttgtaaacggggatattgacgaaacgtttgttagtatttagcgaaatcgttaagattgttatttatcgcgtgggcgtattcgtaaaggattagcgggcgcgtttttttaggtagcgaaagttattttttgatggattatttcggtatagtcgggaagggttggtttttatttacgcgcgcgtatatcgggtaaataatatcggtggtcgtggtgtcggtttcgtcgtttttatattgtatcgggcgggaaggatcgatagatttgatttagcgatatagcgcgtcgtgattagcgtcgtggtttgatttattttttagcgattagatgattatattcgggtgattacgatcgcgttgtattattcgcgttacgcgttcgtttatcgtcggtagttagcgcggattatcggttagacgatttattggtattatgtcgtgggttttaatattggttttatttattatatatagggtcgtagcggtcgtatagcgtgtattatagcggatggttcggataatgcgaatagcgtacggcgttaaagttgttttgttttattagtaggatattttgtattatcgtttgtttatttatgatttgattatgtagaggatgatgttcgtgacggttaacgtttcgaattagtaacggtttgtcgtttagtagtagtagattatttttaattcgtatttcgcggaaatcgatatcgtaggtttttgttttaattagcgtgtcgtcggcggtgtgtagtttaattatcgtacgatagagattcgggatttcggcgttttatagtttcgggttttcgacgtttagacgtagtgtgacgcgatcggtataattattacgtttatcgataattttatcgtcgaaaggcgcggtgtcgttggcgatttgcgttttattttgttataaagaaattgttattcgtaggtagttacgtaattcgtcgtatatttgaattttagtttttagtat

SEQ ID NO: 36318 - DNA, 1140 bp, Artificial Sequence
  chemically treated genomic DNA (Homo sapiens) CpG-island No: 36318
atactaaaaactaaaattcaaatatacgacgaattacgtaactacctacgaataacaatttctttataacaaaataaaacgcaaatcgccaacgacaccgcgcctttcgacgataaaattatcgataaacgtaataattataccgatcgcgtcacactacgtctaaacgtcgaaaacccgaaactataaaacgccgaaatcccgaatctctatcgtacgataattaaactacacaccgccgacgacacgctaattaaaacaaaaacctacgatatcgatttccgcgaaatacgaattaaaaataatctactactactaaacgacaaaccgttactaattcgaaacgttaaccgtcacgaacatcatcctctacataatcaaatcataaataaacaaacgataatacaaaatatcctactaataaaacaaaacaactttaacgccgtacgctattcgcattatccgaaccatccgctataatacacgctatacgaccgctacgaccctatatataataaataaaaccaatattaaaacccacgacataataccaataaatcgtctaaccgataatccgcgctaactaccgacgataaacgaacgcgtaacgcgaataatacaacgcgatcgtaatcacccgaatataatcatctaatcgctaaaaaataaatcaaaccacgacgctaatcacgacgcgctatatcgctaaatcaaatctatcgatccttcccgcccgatacaatataaaaacgacgaaaccgacaccacgaccaccgatattatttacccgatatacgcgcgcgtaaataaaaaccaacccttcccgactataccgaaataatccatcaaaaaataactttcgctacctaaaaaaacgcgcccgctaatcctttacgaatacgcccacgcgataaataacaatcttaacgatttcgctaaatactaacaaacgtttcgtcaatatccccgtttacaaaacgacttcgtctaaaactaaataaatcaatcgctaattaaatataataaaaacgacaacccgtaatcgacttacgacgataattttaacgatacgccgaacgatcgccaattctatataaacgatctaatctttaccgaccgcacgccgcatccaacgctaac

SEQ ID NO: 36319 - DNA, 1140 bp, Artificial Sequence
  chemically treated genomic DNA (Homo sapiens) CpG-island No: 36319
gtattggaggttgaagtttagatgtgcggcgagttgcgtgattatttacgggtaatagtttttttatggtagggtgaaacgtaggtcgttagcggtatcgcgtttttcggcggtgaaattatcgatgagcgtggtggttatgtcgatcgcgttatattacgtttgaacgtcgaaaattcgaaattgtggagcgtcgaaatttcgaatttttatcgtgcggtggttgaattgtatatcgtcgacggtacgttgattgaagtagaagtttgcgatgtcggttttcgcgaggtgcggattgaaaatggtttgttgttgttgaacggtaagtcgttgttgattcgaggcgttaatcgttacgagtattattttttgtatggttaggttatggatgagtagacgatggtgtaggatattttgttgatgaagtagaataattttaacgtcgtgcgttgttcgtattattcgaattattcgttgtggtatacgttgtgcgatcgttacggttttgtatgtggtggatgaagttaatattgaaatttacggtatggtgttaatgaatcgtttgatcgatgattcgcgttggttatcggcgatgagcgaacgcgtaacgcgaatggtgtagcgcgatcgtaattattcgagtgtgattatttggtcgttggggaatgaattaggttacggcgttaattacgacgcgttgtatcgttggattaaatttgtcgatttttttcgttcggtgtagtatgaaggcggcggagtcgatattacggttatcgatattatttgttcgatgtacgcgcgcgtggatgaagattagtttttttcggttgtgtcgaaatggtttattaaaaaatggttttcgttatttggagagacgcgttcgttgattttttgcgaatacgtttacgcgatgggtaatagttttggcggtttcgttaaatattggtaggcgtttcgttagtattttcgtttatagggcggtttcgtttgggattgggtggattagtcgttgattaaatatgatgaaaacggtaattcgtggtcggtttacggcggtgattttggcgatacgtcgaacgatcgttagttttgtatgaacggtttggtttttgtcgatcgtacgtcgtatttagcgttgat

SEQ ID NO: 36320 - DNA, 1140 bp, Artificial Sequence
  chemically treated genomic DNA (Homo sapiens) CpG-island No: 36320
atcaacgctaaatacgacgtacgatcgacaaaaaccaaaccgttcatacaaaactaacgatcgttcgacgtatcgccaaaatcaccgccgtaaaccgaccacgaattaccgttttcatcatatttaatcaacgactaatccacccaatcccaaacgaaaccgccctataaacgaaaatactaacgaaacgcctaccaatatttaacgaaaccgccaaaactattacccatcgcgtaaacgtattcgcaaaaaatcaacgaacgcgtctctccaaataacgaaaaccattttttaataaaccatttcgacacaaccgaaaaaaactaatcttcatccacgcgcgcgtacatcgaacaaataatatcgataaccgtaatatcgactccgccgccttcatactacaccgaacgaaaaaaatcgacaaatttaatccaacgatacaacgcgtcgtaattaacgccgtaacctaattcattccccaacgaccaaataatcacactcgaataattacgatcgcgctacaccattcgcgttacgcgttcgctcatcgccgataaccaacgcgaatcatcgatcaaacgattcattaacaccataccgtaaatttcaatattaacttcatccaccacatacaaaaccgtaacgatcgcacaacgtataccacaacgaataattcgaataatacgaacaacgcacgacgttaaaattattctacttcatcaacaaaatatcctacaccatcgtctactcatccataacctaaccatacaaaaaataatactcgtaacgattaacgcctcgaatcaacaacgacttaccgttcaacaacaacaaaccattttcaatccgcacctcgcgaaaaccgacatcgcaaacttctacttcaatcaacgtaccgtcgacgatatacaattcaaccaccgcacgataaaaattcgaaatttcgacgctccacaatttcgaattttcgacgttcaaacgtaatataacgcgatcgacataaccaccacgctcatcgataatttcaccgccgaaaaacgcgataccgctaacgacctacgtttcaccctaccataaaaaaactattacccgtaaataatcacgcaactcgccgcacatctaaacttcaacctccaatac

SEQ ID NO: 36321 - DNA, 533 bp, Artificial Sequence
  chemically treated genomic DNA (Homo sapiens) CpG-island No: 36321
ttgcgtttttcggggggggaggcggaggaggcgggtagcggcggagggaggggagtcggggaggggggcgtcgcgttgggagggaggtagcgcgtacggtgtagtcgggtcgggcgggaggtatggcggggttttcggttttattttcgtcggagacggcggcggtcgttattacggcggtcgtcgtttcgtcgttcgtcgttttttcgtattattaagagtggattttggatattatcgattcgttgcgttcgcgtaaggcgcggtcggatttggagcgtatttgtcggatggtgcggcggcggtacggttcggagtcggagcgtacgcgcgtcgagttcgagaaattgatttagtagcgcgtcgtgtttcgggttagttataaggggagtatttcgtatcgtaacgcggcgcgcgtttagtcgtttcggcgcggagttatttcgttcgagtttatcgatttagttgttgaatttacgtggtgagcgtttgtatatatattgtgaatatattaaagtgttatataatggtaa

SEQ ID NO: 36322 - DNA, 533 bp, Artificial Sequence
  chemically treated genomic DNA (Homo sapiens) CpG-island No: 36322
ttaccattatataacactttaatatattcacaatatatatacaaacgctcaccacgtaaattcaacaactaaatcgataaactcgaacgaaataactccgcgccgaaacgactaaacgcgcgccgcgttacgatacgaaatactccccttataactaacccgaaacacgacgcgctactaaatcaatttctcgaactcgacgcgcgtacgctccgactccgaaccgtaccgccgccgcaccatccgacaaatacgctccaaatccgaccgcgccttacgcgaacgcaacgaatcgataatatccaaaatccactcttaataatacgaaaaaacgacgaacgacgaaacgacgaccgccgtaataacgaccgccgccgtctccgacgaaaataaaaccgaaaaccccgccatacctcccgcccgacccgactacaccgtacgcgctacctccctcccaacgcgacgcccccctccccgactcccctccctccgccgctacccgcctcctccgcctccccccccgaaaaacgcaa

SEQ ID NO: 36323 - DNA, 533 bp, Artificial Sequence
  chemically treated genomic DNA (Homo sapiens) CpG-island No: 36323
ttattattatgtggtattttagtatgtttataatatgtatgtaagcgtttattacgtgggtttagtaattgagtcggtggattcggacggggtggtttcgcgtcggggcggttggacgcgcgtcgcgttgcggtacgagatgttttttttgtagttgattcggagtacggcgcgttgttggattagtttttcgagttcggcgcgcgtgcgtttcggtttcgggtcgtgtcgtcgtcgtattattcggtagatgcgttttaggttcggtcgcgttttgcgcgagcgtagcgagtcgatggtgtttaggatttatttttggtagtgcggggaagcggcggacgacgaggcggcggtcgtcgtggtggcggtcgtcgtcgttttcggcgggggtagggtcgggggtttcgttatgtttttcgttcggttcggttgtatcgtgcgcgttgttttttttttagcgcggcgttttttttttcggttttttttttttcgtcgttgttcgtttttttcgttttttttttcggggggcgtag

SEQ ID NO: 36324 - DNA, 533 bp, Artificial Sequence
  chemically treated genomic DNA (Homo sapiens) CpG-island No: 36324
ctacgccccccgaaaaaaaaaacgaaaaaaacgaacaacgacgaaaaaaaaaaaaccgaaaaaaaaaacgccgcgctaaaaaaaaaacaacgcgcacgatacaaccgaaccgaacgaaaaacataacgaaacccccgaccctacccccgccgaaaacgacgacgaccgccaccacgacgaccgccgcctcgtcgtccgccgcttccccgcactaccaaaaataaatcctaaacaccatcgactcgctacgctcgcgcaaaacgcgaccgaacctaaaacgcatctaccgaataatacgacgacgacacgacccgaaaccgaaacgcacgcgcgccgaactcgaaaaactaatccaacaacgcgccgtactccgaatcaactacaaaaaaaacatctcgtaccgcaacgcgacgcgcgtccaaccgccccgacgcgaaaccaccccgtccgaatccaccgactcaattactaaacccacgtaataaacgcttacatacatattataaacatactaaaataccacataataataa

SEQ ID NO: 36325 - DNA, 829 bp, Artificial Sequence
  chemically treated genomic DNA (Homo sapiens) CpG-island No: 36325
ttaatcgttagtattagataaaacgaatttatcggcgatattaggtcgattagcgggttaaagatatttaaattaggtgttagacgtttgatttcgaaagcgattattagtacgtcggtaatgtcgttcgttagcgtattggcggtaattatcggtaacggagttgttagagcgtaaggaatagtcggttcggttgcgattgtggtatcgattataatggtattattggtagttttttttttttgtcgggtaaatagtttgggcgtaatgaacgtcgtaagattcgtcgcgacgggcggtattagcgcgataacgtcgacgatggcgtattagttataaatgtgtttttttagtagtgagaagtagaagaattaggcggttttattgatggggtcgtttatatcgaacgttagtatcgtatcgattagaaacgttgtcgtaaattttattgatgaggaatggtatttaggaagtggagtagttcgtttatgaggtcggatattatcggttcgataacgtagtaagtgagtacgtcgaaaattagtagagtaacgaacgggattagtattgaatcgagtagcggttgtaatgttttgttaaggcgtattttgcggaattagaagacgaaatagttaatcgttagttttagtattatcgcgtcgaggaatttcgtattcgattgggtgtcgagtagcgttttgtcgttcgttagatagtaaattagaaacgtcggagcgaaagtcggtttatcggtaatcgacgaggtaatataagcgtttatgatggggattataaaggtgaagttaaggtaatcgatggatttaattat

SEQ ID NO: 36326 - DNA, 829 bp, Artificial Sequence
  chemically treated genomic DNA (Homo sapiens) CpG-island No: 36326
ataattaaatccatcgattaccttaacttcacctttataatccccatcataaacgcttatattacctcgtcgattaccgataaaccgactttcgctccgacgtttctaatttactatctaacgaacgacaaaacgctactcgacacccaatcgaatacgaaattcctcgacgcgataatactaaaactaacgattaactatttcgtcttctaattccgcaaaatacgccttaacaaaacattacaaccgctactcgattcaatactaatcccgttcgttactctactaattttcgacgtactcacttactacgttatcgaaccgataatatccgacctcataaacgaactactccacttcctaaataccattcctcatcaataaaatttacgacaacgtttctaatcgatacgatactaacgttcgatataaacgaccccatcaataaaaccgcctaattcttctacttctcactactaaaaaaacacatttataactaatacgccatcgtcgacgttatcgcgctaataccgcccgtcgcgacgaatcttacgacgttcattacgcccaaactatttacccgacaaaaaaaaaaaactaccaataataccattataatcgataccacaatcgcaaccgaaccgactattccttacgctctaacaactccgttaccgataattaccgccaatacgctaacgaacgacattaccgacgtactaataatcgctttcgaaatcaaacgtctaacacctaatttaaatatctttaacccgctaatcgacctaatatcgccgataaattcgttttatctaatactaacgattaa

SEQ ID NO: 36327 - DNA, 829 bp, Artificial Sequence
  chemically treated genomic DNA (Homo sapiens) CpG-island No: 36327
gtagttgaatttatcggttattttggttttatttttatgatttttattatgggcgtttatattgtttcgtcgattgtcgataaatcggttttcgtttcggcgtttttggtttgttatttggcgaacgataaagcgttgttcggtatttagtcgggtgcgggatttttcggcgcggtggtgttggggttggcgattggttatttcgttttttggtttcgtaaagtgcgttttggtaaagtattataatcgttgttcggtttaatgttgatttcgttcgttattttgttggttttcggcgtgtttatttattacgttatcgggtcggtgatgttcgattttatgggcgggttgttttattttttgaatattattttttattaatgaagtttgcggtagcgtttttggtcggtgcgatgttggcgttcgatatgggcggttttattaataaaatcgtttggtttttttgttttttattgttggaaaaatatatttatgattggtacgttatcgtcggcgttgtcgcgttgatgtcgttcgtcgcggcgggttttgcgacgtttattgcgtttaaattgtttattcgataggaaaaagaggttgttagtagtgttattgtggtcggtgttatagtcgtaatcgaatcggttattttttacgttttggtagtttcgttgtcgatgattatcgttaatacgttggcgggcggtattatcggcgtgttggtgatcgttttcggaattaaacgtttggtatttggtttgggtatttttgattcgttgatcggtttgatgtcgtcggtgggttcgttttatttggtgttggcgattgg

SEQ ID NO: 36328 - DNA, 829 bp, Artificial Sequence
  chemically treated genomic DNA (Homo sapiens) CpG-island No: 36328
ccaatcgccaacaccaaataaaacgaacccaccgacgacatcaaaccgatcaacgaatcaaaaatacccaaaccaaataccaaacgtttaattccgaaaacgatcaccaacacgccgataataccgcccgccaacgtattaacgataatcatcgacaacgaaactaccaaaacgtaaaaaataaccgattcgattacgactataacaccgaccacaataacactactaacaacctctttttcctatcgaataaacaatttaaacgcaataaacgtcgcaaaacccgccgcgacgaacgacatcaacgcgacaacgccgacgataacgtaccaatcataaatatatttttccaacaataaaaaacaaaaaaaccaaacgattttattaataaaaccgcccatatcgaacgccaacatcgcaccgaccaaaaacgctaccgcaaacttcattaataaaaaataatattcaaaaaataaaacaacccgcccataaaatcgaacatcaccgacccgataacgtaataaataaacacgccgaaaaccaacaaaataacgaacgaaatcaacattaaaccgaacaacgattataatactttaccaaaacgcactttacgaaaccaaaaaacgaaataaccaatcgccaaccccaacaccaccgcgccgaaaaatcccgcacccgactaaataccgaacaacgctttatcgttcgccaaataacaaaccaaaaacgccgaaacgaaaaccgatttatcgacaatcgacgaaacaatataaacgcccataataaaaatcataaaaataaaaccaaaataaccgataaattcaactac

SEQ ID NO: 36329 - DNA, 1006 bp, Artificial Sequence
  chemically treated genomic DNA (Homo sapiens) CpG-island No: 36329
  misc_feature (569)..(569): n is either a, c, g or t
atacgatcgaagacgagttattgtggtttggtgcgcggtcggcgtggcgaaattggatgaaggttaacggttggcgcgatattttggttaggcgttagtcggaagaattcgcggtttaagtttcgtatttgttatttcggcgtatatatataagttcgataggggttcgtggtggttgtttcggattggtagtgagcgggtgtcggaatgcggatgagttatagtttgcgtcgttgtcgtcgtatcgggtattcgatcgcggtttggtgagatcgttttagggcgtatatagacgttttatcggacgaatgtcgtcggtgaaatttagcggcgaaatatttaggtagtgacggatggtgtttggcgttattttcggttggtattgattacgtaggcgtagcgggtagaagaagttcggtagtaggttattttcggcgggacggaatcgttcgttttttttgatattttgtcgggttatatcgaatatgtcgggataacggtattcgtttgtttgtcgtgtggttgacgtacgattcggaatattcggagaatttatttgtcgcgtcgtntgtgcgttatggttggacgtttcgcggcgaattggcggtggtgtatgatcgtagtggtaaataggtgcgtagttttatttacgatgataatatcggggtcggatggtggcgtatcgttatacgggtcggtcggaaattcgttatcgttacgatagcgacgggcgggtgatagaatagttaaattcggtaggtttaagttatacgtattagtatgagaaagatcgtattattattatcgatagtttggatcgtcgtgaagtgttgtatacgtagggcgaagtcgggttgaagcgggtggtgaaaaaggaatacgcggacggtagcgttacgtagagttagtttgacgtcgtgggtaggtttcgggtatagacggatgtcgtagtaggataatagagtttaggtcggatgttgtgatcggtttatttagcgttttatat

SEQ ID NO: 36330 - DNA, 1006 bp, Artificial Sequence
  chemically treated genomic DNA (Homo sapiens) CpG-island No: 36330
  misc_feature (438)..(438): n is either a, c, g or t
atataaaacgctaaataaaccgatcacaacatccgacctaaactctattatcctactacgacatccgtctatacccgaaacctacccacgacgtcaaactaactctacgtaacgctaccgtccgcgtattcctttttcaccacccgcttcaacccgacttcgccctacgtatacaacacttcacgacgatccaaactatcgataataataatacgatctttctcatactaatacgtataacttaaacctaccgaatttaactattctatcacccgcccgtcgctatcgtaacgataacgaatttccgaccgacccgtataacgatacgccaccatccgaccccgatattatcatcgtaaataaaactacgcacctatttaccactacgatcatacaccaccgccaattcgccgcgaaacgtccaaccataacgcacanacgacgcgacaaataaattctccgaatattccgaatcgtacgtcaaccacacgacaaacaaacgaataccgttatcccgacatattcgatataacccgacaaaatatcaaaaaaaacgaacgattccgtcccgccgaaaataacctactaccgaacttcttctacccgctacgcctacgtaatcaataccaaccgaaaataacgccaaacaccatccgtcactacctaaatatttcgccgctaaatttcaccgacgacattcgtccgataaaacgtctatatacgccctaaaacgatctcaccaaaccgcgatcgaatacccgatacgacgacaacgacgcaaactataactcatccgcattccgacacccgctcactaccaatccgaaacaaccaccacgaacccctatcgaacttatatatatacgccgaaataacaaatacgaaacttaaaccgcgaattcttccgactaacgcctaaccaaaatatcgcgccaaccgttaaccttcatccaatttcgccacgccgaccgcgcaccaaaccacaataactcgtcttcgatcgtat

SEQ ID NO: 36331 - DNA, 1006 bp, Artificial Sequence
  chemically treated genomic DNA (Homo sapiens) CpG-island No: 36331
  misc_feature (438)..(438): n is either a, c, g or t
gtgtaaggcgttgaatgagtcggttataatattcggtttgaattttgttgttttgttgcggtattcgtttgtgttcggagtttgtttacggcgttaaattgattttgcgtgacgttgtcgttcgcgtgttttttttttattattcgttttagttcggtttcgttttgcgtgtgtagtattttacggcggtttaggttgtcggtgatggtgatgcggttttttttatattgatacgtgtagtttaagtttgtcgggtttagttgttttgttattcgttcgtcgttgtcgtaacggtaacggattttcggtcggttcgtgtgacggtgcgttattattcggtttcggtattattatcgtaagtaaagttgcgtatttgtttgttattacggttatatattatcgttagttcgtcgcggggcgtttagttatagcgtatangcggcgcggtaggtaaatttttcgggtatttcgggtcgtgcgttagttatacggtagatagacggatgtcgttgtttcggtatattcggtgtaattcggtagggtattaggaaaagcggacggtttcgtttcgtcggaaatggtttgttgtcgggttttttttgttcgttgcgtttgcgtggttagtattagtcggaagtgacgttaggtattattcgttattgtttgggtatttcgtcgttaaattttatcggcggtattcgttcggtggaacgtttgtgtgcgttttgaagcggttttattagatcgcggtcgagtattcggtacggcggtagcggcgtaggttgtaatttattcgtatttcggtattcgtttattattaattcgagatagttattacgggtttttgtcggatttgtatatgtacgtcgagataatagatgcggagtttaagtcgcgagttttttcggttagcgtttggttagagtgtcgcgttagtcgttgatttttatttagtttcgttacgtcggtcgcgtattagattatagtgattcgttttcggtcgtgt

SEQ ID NO: 36332 - DNA, 1006 bp, Artificial Sequence
  chemically treated genomic DNA (Homo sapiens) CpG-island No: 36332
  misc_feature (569)..(569): n is either a, c, g or t
acacgaccgaaaacgaatcactataatctaatacgcgaccgacgtaacgaaactaaataaaaatcaacgactaacgcgacactctaaccaaacgctaaccgaaaaaactcgcgacttaaactccgcatctattatctcgacgtacatatacaaatccgacaaaaacccgtaataactatctcgaattaataataaacgaataccgaaatacgaataaattacaacctacgccgctaccgccgtaccgaatactcgaccgcgatctaataaaaccgcttcaaaacgcacacaaacgttccaccgaacgaataccgccgataaaatttaacgacgaaatacccaaacaataacgaataatacctaacgtcacttccgactaatactaaccacgcaaacgcaacgaacaaaaaaaacccgacaacaaaccatttccgacgaaacgaaaccgtccgcttttcctaataccctaccgaattacaccgaatataccgaaacaacgacatccgtctatctaccgtataactaacgcacgacccgaaatacccgaaaaatttacctaccgcgccgcntatacgctataactaaacgccccgcgacgaactaacgataatatataaccgtaataacaaacaaatacgcaactttacttacgataataataccgaaaccgaataataacgcaccgtcacacgaaccgaccgaaaatccgttaccgttacgacaacgacgaacgaataacaaaacaactaaacccgacaaacttaaactacacgtatcaatataaaaaaaaccgcatcaccatcaccgacaacctaaaccgccgtaaaatactacacacgcaaaacgaaaccgaactaaaacgaataataaaaaaaaaacacgcgaacgacaacgtcacgcaaaatcaatttaacgccgtaaacaaactccgaacacaaacgaataccgcaacaaaacaacaaaattcaaaccgaatattataaccgactcattcaacgccttacac

SEQ ID NO: 36333 - DNA, 668 bp, Artificial Sequence
  chemically treated genomic DNA (Homo sapiens) CpG-island No: 36333
ttggtaggttacgatgtttttgttggtttatttttatatcgacgttttcggtttgtcggcggggattatgggtacgttgtttttggtttttcgcgtgttcgacgtcgttatcgattcgttgatggggttgttggtagatcgtattcgtacgcggtacggttagtttcgttcgtttttgttgtggggggttatttcgttcggtatcgtttgcgtgttgattttttatacgtcggattttttcgtatagggtaagattatttacgtttgcgtgatttatatttttttgattttggtttatattttcgttaacgtgtcgtattgcgttatgtcgggcgttattatcgtcgattcgaaagagcgttacgttttgtagttttggcgtttttttttggcggcggcgggttcgttcgttattagcggtatcgcgttgtcgttggtgagtattatcggtaaaggggacgagtaggtgggttatttcggcgttatgtgcgtgttggggttgagcggcgtggtgttgttttacgtttgtttttttacgattaaagagcgttatatttttgaggtgtagtcgggttcgtcggtggcgaaagattttaagttgttgttgggtaatagtttagtggcgtattatgtgcgcgttaagatgatggcgattgttttacgtggtg

SEQ ID NO: 36334 - DNA, 668 bp, Artificial Sequence
  chemically treated genomic DNA (Homo sapiens) CpG-island No: 36334
caccacgtaaaacaatcgccatcatcttaacgcgcacataatacgccactaaactattacccaacaacaacttaaaatctttcgccaccgacgaacccgactacacctcaaaaatataacgctctttaatcgtaaaaaaacaaacgtaaaacaacaccacgccgctcaaccccaacacgcacataacgccgaaataacccacctactcgtcccctttaccgataatactcaccaacgacaacgcgataccgctaataacgaacgaacccgccgccgccaaaaaaaaacgccaaaactacaaaacgtaacgctctttcgaatcgacgataataacgcccgacataacgcaatacgacacgttaacgaaaatataaaccaaaatcaaaaaaatataaatcacgcaaacgtaaataatcttaccctatacgaaaaaatccgacgtataaaaaatcaacacgcaaacgataccgaacgaaataaccccccacaacaaaaacgaacgaaactaaccgtaccgcgtacgaatacgatctaccaacaaccccatcaacgaatcgataacgacgtcgaacacgcgaaaaaccaaaaacaacgtacccataatccccgccgacaaaccgaaaacgtcgatataaaaataaaccaacaaaaacatcgtaacctaccaa

SEQ ID NO: 36335 - DNA, 668 bp, Artificial Sequence
  chemically treated genomic DNA (Homo sapiens) CpG-island No: 36335
tattacgtggagtagtcgttattattttgacgcgtatatgatgcgttattgggttgttgtttagtagtagtttaaggtttttcgttatcgacgagttcggttgtattttaaaggtgtagcgttttttggtcgtgaagaagtagacgtagagtagtattacgtcgtttagttttagtacgtatatggcgtcgaagtagtttatttgttcgttttttttgtcgatgatgtttattagcggtagcgcgatgtcgttgatagcgagcgagttcgtcgtcgttaggaagaagcgttaggattgtagggcgtgacgttttttcgggtcggcggtgatgacgttcggtatggcgtagtacggtacgttaacgaaggtgtagattagggttaggagaatgtaggttacgtaggcgtagatgattttgttttgtgcggagaagttcggcgtgtagaaggttagtacgtagacgatgtcgaacgggatggttttttatagtaggaacgggcggaattggtcgtgtcgcgtgcgggtgcggtttattagtagttttattagcgggtcggtgacggcgtcgagtacgcgggagattaaaaatagcgtgtttataattttcgtcgataggtcgaagacgtcggtgtagaaataggttagtaggaatatcgtggtttgttag

SEQ ID NO: 36336 - DNA, 668 bp, Artificial Sequence
  chemically treated genomic DNA (Homo sapiens) CpG-island No: 36336
ctaacaaaccacgatattcctactaacctatttctacaccgacgtcttcgacctatcgacgaaaattataaacacgctatttttaatctcccgcgtactcgacgccgtcaccgacccgctaataaaactactaataaaccgcacccgcacgcgacacgaccaattccgcccgttcctactataaaaaaccatcccgttcgacatcgtctacgtactaaccttctacacgccgaacttctccgcacaaaacaaaatcatctacgcctacgtaacctacattctcctaaccctaatctacaccttcgttaacgtaccgtactacgccataccgaacgtcatcaccgccgacccgaaaaaacgtcacgccctacaatcctaacgcttcttcctaacgacgacgaactcgctcgctatcaacgacatcgcgctaccgctaataaacatcatcgacaaaaaaaacgaacaaataaactacttcgacgccatatacgtactaaaactaaacgacgtaatactactctacgtctacttcttcacgaccaaaaaacgctacacctttaaaatacaaccgaactcgtcgataacgaaaaaccttaaactactactaaacaacaacccaataacgcatcatatacgcgtcaaaataataacgactactccacgtaata

SEQ ID NO: 36337 - DNA, 646 bp, Artificial Sequence
  chemically treated genomic DNA (Homo sapiens) CpG-island No: 36337
tcggtattgatgtcgacgatgtcgtattttagcgtttcgtttacgcggaagacgcggtttaaattacgggcgtagaaataggcggtaaggttaaattcggtgttattggtttgcgtaattatattagttttatttttaaagcggaatagcggggcgagggggtcgaacgttttttttttcgatattttggcgttggtcggaacgtttattagaatggtcggttggaagaagttgtcgtcgcgttcgtgcgttttatcgtcgtaaattacgcgcgcgtttttttttagcgtatcggtaatatgtttttttatttttgttatcgtttttttatcgattagcggttcgatggtgacgtcgttatttagttcgtcgtcgatgtgtagtttgtttattgtttgttgtaatttttcggtaaaacggttatatacgtcgttttgtatatataggcggttggcgtagacgtaggtttgttcggcgttgcggaatttcgaggttagcgcgttttttacggttttgtcgaggtcggtatcgttaagacgataacggcgcgtttcgtttagtttcgcgatatttttttgatgtttttcgcgtttgtttattaattggcgggtaattcggtcgtattcggtattataggttgcgtatt

SEQ ID NO: 36338 - DNA, 646 bp, Artificial Sequence
  chemically treated genomic DNA (Homo sapiens) CpG-island No: 36338
aatacgcaacctataataccgaatacgaccgaattacccgccaattaataaacaaacgcgaaaaacatcaaaaaaatatcgcgaaactaaacgaaacgcgccgttatcgtcttaacgataccgacctcgacaaaaccgtaaaaaacgcgctaacctcgaaattccgcaacgccgaacaaacctacgtctacgccaaccgcctatatatacaaaacgacgtatataaccgttttaccgaaaaattacaacaaacaataaacaaactacacatcgacgacgaactaaataacgacgtcaccatcgaaccgctaatcgataaaaaaacgataacaaaaataaaaaaacatattaccgatacgctaaaaaaaaacgcgcgcgtaatttacgacgataaaacgcacgaacgcgacgacaacttcttccaaccgaccattctaataaacgttccgaccaacgccaaaatatcgaaaaaaaaaacgttcgaccccctcgccccgctattccgctttaaaaataaaactaatataattacgcaaaccaataacaccgaatttaaccttaccgcctatttctacgcccgtaatttaaaccgcgtcttccgcgtaaacgaaacgctaaaatacgacatcgtcgacatcaataccga

SEQ ID NO: 36339 - DNA, 646 bp, Artificial Sequence
  chemically treated genomic DNA (Homo sapiens) CpG-island No: 36339
ggtgcgtaatttgtggtatcgggtgcgatcgaattgttcgttagttaatggataggcgcgaaagatattaagaaagtgtcgcggagttgggcggaacgcgtcgttatcgttttgacgatgtcgatttcgataaagtcgtggaaggcgcgttggtttcgaaatttcgtaacgtcgggtaaatttgcgtttgcgttaatcgtttgtatgtgtaggacggcgtgtatgatcgttttgtcgaaaaattgtagtaggtaatgagtaaattgtatatcggcgacgggttggataacggcgttattatcgggtcgttgatcgatgaaaaagcggtagtaaaagtggaagagtatattgtcgatgcgttggagaaaggcgcgcgcgtggtttgcggcggtaaagcgtacgaacgcggcggtaattttttttagtcgattattttggtggacgtttcggttaacgttaaagtgtcgaaagaagagacgttcggttttttcgtttcgttgtttcgttttaaagatgaagttgatgtgattgcgtaagttaatgatatcgagtttggttttgtcgtttatttttacgttcgtgatttaagtcgcgtttttcgcgtgggcgaagcgttggagtacggtatcgtcggtattaatatcgg

SEQ ID NO: 36340 - DNA, 646 bp, Artificial Sequence
  chemically treated genomic DNA (Homo sapiens) CpG-island No: 36340
ccgatattaataccgacgataccgtactccaacgcttcgcccacgcgaaaaacgcgacttaaatcacgaacgtaaaaataaacgacaaaaccaaactcgatatcattaacttacgcaatcacatcaacttcatctttaaaacgaaacaacgaaacgaaaaaaccgaacgtctcttctttcgacactttaacgttaaccgaaacgtccaccaaaataatcgactaaaaaaaattaccgccgcgttcgtacgctttaccgccgcaaaccacgcgcgcgcctttctccaacgcatcgacaatatactcttccacttttactaccgctttttcatcgatcaacgacccgataataacgccgttatccaacccgtcgccgatatacaatttactcattacctactacaatttttcgacaaaacgatcatacacgccgtcctacacatacaaacgattaacgcaaacgcaaatttacccgacgttacgaaatttcgaaaccaacgcgccttccacgactttatcgaaatcgacatcgtcaaaacgataacgacgcgttccgcccaactccgcgacactttcttaatatctttcgcgcctatccattaactaacgaacaattcgatcgcacccgataccacaaattacgcacc

SEQ ID NO: 36341 - DNA, 942 bp, Artificial Sequence
  chemically treated genomic DNA (Homo sapiens) CpG-island No: 36341
ggatggttagggtatcgttgtttatcgttttttcggaaagggtaagtatggcgtcgttatttagcgtggtggtgttcgttagtgtgtcgttttggcggtgaatagttcgtatttatcgtggtattcgtggtcgtattatcggcgtttagcgtgaatgaattggttttttttagtattagggtattcgtttgaacgttttcgatattgaatgttttttcgtcgtttcgggtattattgatagcggtatcggaatcggttagtagtatatcgttattttttatggatacggtggtggcggtgttatcgttgcggatatttagcggtttcgttattatttacgcgggtattagtggttgtgtgttcggttagtatatttaggcgtcgttattttttagtacgatattattagttttaatttttataatagagaatgtttttaggcggtttatgtcggtaacggttgtagtcgtattggtaattagtgcgtcgttttgttttagggtgatattcgtggttgtattatcggcgtttatttgtagtttgtttttttgattaacggtggtattttcggttatattttcgtaatttgataatttgttagtcgttattgtattataatagtgttagacgttgtatcgtcgttgtgtatatattggtattttttatttagcgtggtatttagtgcgtgattatgtatagtttggtcgtcgtcggtataaattatagtggtatttgtcgtttttttagtttttataatttggcgatcgtttttattgatggttgtgcgtacggattttcgcgaataaattggtcggtattattcgtattttagtatttaggttttttttatcgtttcggtattaaataacggtatttagttgtattgtatcgggtttgacgaattgatagattttattattaatgacgggtttttgtggttat

SEQ ID NO: 36342 - DNA, 942 bp, Artificial Sequence
  chemically treated genomic DNA (Homo sapiens) CpG-island No: 36342
ataaccacaaaaacccgtcattaataataaaatctatcaattcgtcaaacccgatacaatacaactaaataccgttatttaataccgaaacgataaaaaaaacctaaatactaaaatacgaataataccgaccaatttattcgcgaaaatccgtacgcacaaccatcaataaaaacgatcgccaaattataaaaactaaaaaaacgacaaataccactataatttataccgacgacgaccaaactatacataatcacgcactaaataccacgctaaataaaaaataccaatatatacacaacgacgatacaacgtctaacactattataatacaataacgactaacaaattatcaaattacgaaaatataaccgaaaataccaccgttaatcaaaaaaacaaactacaaataaacgccgataatacaaccacgaatatcaccctaaaacaaaacgacgcactaattaccaatacgactacaaccgttaccgacataaaccgcctaaaaacattctctattataaaaattaaaactaataatatcgtactaaaaaataacgacgcctaaatatactaaccgaacacacaaccactaatacccgcgtaaataataacgaaaccgctaaatatccgcaacgataacaccgccaccaccgtatccataaaaaataacgatatactactaaccgattccgataccgctatcaataatacccgaaacgacgaaaaaacattcaatatcgaaaacgttcaaacgaataccctaatactaaaaaaaaccaattcattcacgctaaacgccgataatacgaccacgaataccacgataaatacgaactattcaccgccaaaacgacacactaacgaacaccaccacgctaaataacgacgccatacttaccctttccgaaaaaacgataaacaacgataccctaaccatcc

SEQ ID NO: 36343 - DNA, 942 bp, Artificial Sequence
  chemically treated genomic DNA (Homo sapiens) CpG-island No: 36343
atagttataggaattcgttattaatgataaggtttgttagttcgttaagttcggtatagtgtaattggatatcgttgtttaatatcggggcggtaagggggatttggatgttagaatacgggtgatatcggttagtttgttcgcggggattcgtacgtataattattaataaaaacggtcgttagattgtgagagttgaaggaacggtaaatattattgtggtttatgtcggcggcgattagattgtatatggttacgtattggatattacgttgaatgggggatattagtatgtgtataacggcggtatagcgtttgatattgttgtgatatagtgacggttggtagattgttaaattacgggggtgtggtcgggaatattatcgttaattagaagggtagattgtaggtggacgtcggtggtatagttacgaatgttattttgaagtagggcggcgtattggttattagtacggttgtaatcgttatcggtataaatcgtttgggagtattttttgttgtggaggttaaagttgataatgtcgtattggaaaatggcgacgtttggatgtgttgatcggatatatagttattaatattcgcgtggatgatggcggaatcgttggatgttcgtaacggtggtatcgttattatcgtatttatgggaaatggcggtgtattgttggtcgatttcggtgtcgttgttagtggtattcggagcgacggaaaggtatttagtatcggaggcgtttaggcgaatgttttgatgttggaaaaagttagtttatttacgttgaacgtcggtgatacggttacggatattacggtaaatgcggattgtttatcgttagggcggtatattggcgggtattattacgttgaataacggcgttatatttatttttttcgggaagacggtgaataacgatattttgattattt

SEQ ID NO: 36344 - DNA, 942 bp, Artificial Sequence
  chemically treated genomic DNA (Homo sapiens) CpG-island No: 36344
aaataatcaaaatatcgttattcaccgtcttcccgaaaaaaataaatataacgccgttattcaacgtaataatacccgccaatataccgccctaacgataaacaatccgcatttaccgtaatatccgtaaccgtatcaccgacgttcaacgtaaataaactaactttttccaacatcaaaacattcgcctaaacgcctccgatactaaatacctttccgtcgctccgaataccactaacaacgacaccgaaatcgaccaacaatacaccgccatttcccataaatacgataataacgataccaccgttacgaacatccaacgattccgccatcatccacgcgaatattaataactatatatccgatcaacacatccaaacgtcgccattttccaatacgacattatcaactttaacctccacaacaaaaaatactcccaaacgatttataccgataacgattacaaccgtactaataaccaatacgccgccctacttcaaaataacattcgtaactataccaccgacgtccacctacaatctacccttctaattaacgataatattcccgaccacacccccgtaatttaacaatctaccaaccgtcactatatcacaacaatatcaaacgctataccgccgttatacacatactaatatcccccattcaacgtaatatccaatacgtaaccatatacaatctaatcgccgccgacataaaccacaataatatttaccgttccttcaactctcacaatctaacgaccgtttttattaataattatacgtacgaatccccgcgaacaaactaaccgatatcacccgtattctaacatccaaatcccccttaccgccccgatattaaacaacgatatccaattacactataccgaacttaacgaactaacaaaccttatcattaataacgaattcctataactat

SEQ ID NO: 36345 - DNA, 547 bp, Artificial Sequence
  chemically treated genomic DNA (Homo sapiens) CpG-island No: 36345
  misc_feature (255)..(255): n is either a, c, g or t
  misc_feature (346)..(346): n is either a, c, g or t
tcgttatcgttttattgattggcgtggtgagtgcgtcgtcgttaattagttagcgacgtaaatcgtcgtcggtaaagacgttttgtatttgttgttgagcgttatatatcgttattagttttagatcggtgcggttgagttttagtatcgtatttattacgttggcggttaacgttatttgtgggatggtatcgttacggcgtattagatgatgtattttatttagtaagcgagcgtttagtgtttcggttgggntggagcgggtaaaattttttttattaaattcgcgcgtttgtatgatcgttatcgttagcgcgttatttattattagggtattgacggtgtntgaggtcggcgtaaggtgtatcgggtaggtttcgcgttttacggagattttagtatcgtttttgtcgttaggtttagcggtgacgtcggtttgtcggttatcgttagtagcgcgatagatttattttttagacgcggaataattagatttagttttttcgcgttatcggatgtaagagataaataggtattatatcgcgga

SEQ ID NO: 36346 - DNA, 547 bp, Artificial Sequence
  chemically treated genomic DNA (Homo sapiens) CpG-island No: 36346
  misc_feature (202)..(202): n is either a, c, g or t
  misc_feature (293)..(293): n is either a, c, g or t
tccgcgatataatacctatttatctcttacatccgataacgcgaaaaaactaaatctaattattccgcgtctaaaaaataaatctatcgcgctactaacgataaccgacaaaccgacgtcaccgctaaacctaacgacaaaaacgatactaaaatctccgtaaaacgcgaaacctacccgatacaccttacgccgacctcanacaccgtcaataccctaataataaataacgcgctaacgataacgatcatacaaacgcgcgaatttaataaaaaaaattttacccgctccancccaaccgaaacactaaacgctcgcttactaaataaaatacatcatctaatacgccgtaacgataccatcccacaaataacgttaaccgccaacgtaataaatacgatactaaaactcaaccgcaccgatctaaaactaataacgatatataacgctcaacaacaaatacaaaacgtctttaccgacgacgatttacgtcgctaactaattaacgacgacgcactcaccacgccaatcaataaaacgataacga

SEQ ID NO: 36347 - DNA, 547 bp, Artificial Sequence
  chemically treated genomic DNA (Homo sapiens) CpG-island No: 36347
  misc_feature (202)..(202): n is either a, c, g or t
  misc_feature (293)..(293): n is either a, c, g or t
ttcgcgatgtgatgtttgtttattttttatattcggtggcgcgaaggaattggatttgattatttcgcgtttggaagataaatttatcgcgttgttggcgatgatcggtaaatcgacgttatcgttgggtttggcggtaaaagcggtgttggaattttcgtagaacgcgaagtttgttcgatgtattttgcgtcgattttangtatcgttaatattttgatgatgggtgacgcgttggcgatggcggttatgtaggcgcgcggatttaatgaagaagattttgttcgttttantttagtcggggtattgggcgttcgtttgttgaataaagtgtattatttgatgcgtcgtgacgatgttattttataggtggcgttaatcgttagcgtgatggatgcgatgttggaatttagtcgtatcggtttggggttggtggcggtatgtgacgtttaataataggtataaggcgtttttatcgacggcgatttacgtcgttggttggttggcggcggcgtatttattacgttagttaatgaagcgatgacgg

SEQ ID NO: 36348 - DNA, 547 bp, Artificial Sequence
  chemically treated genomic DNA (Homo sapiens) CpG-island No: 36348
  misc_feature (255)..(255): n is either a, c, g or t
  misc_feature (346)..(346): n is either a, c, g or t
ccgtcatcgcttcattaactaacgtaataaatacgccgccgccaaccaaccaacgacgtaaatcgccgtcgataaaaacgccttatacctattattaaacgtcacataccgccaccaaccccaaaccgatacgactaaattccaacatcgcatccatcacgctaacgattaacgccacctataaaataacatcgtcacgacgcatcaaataatacactttattcaacaaacgaacgcccaataccccgactaaantaaaacgaacaaaatcttcttcattaaatccgcgcgcctacataaccgccatcgccaacgcgtcacccatcatcaaaatattaacgatacntaaaatcgacgcaaaatacatcgaacaaacttcgcgttctacgaaaattccaacaccgcttttaccgccaaacccaacgataacgtcgatttaccgatcatcgccaacaacgcgataaatttatcttccaaacgcgaaataatcaaatccaattccttcgcgccaccgaatataaaaaataaacaaacatcacatcgcgaa

SEQ ID NO: 36349 - DNA, 510 bp, Artificial Sequence
  chemically treated genomic DNA (Homo sapiens) CpG-island No: 36349
tattcgtattgtgttgattgtcgtaggtgagaagggcgcgttgatgtacgtaatggggatcgtcgcggcgatagtaatcgattttggtggttcgattaataaagtcgtaggttttgttgtttttagttttattattgattacgtattatcggttatcgttcgttttatcgttatcgttatttcgtcgattggtttggggttggcgattattatcgatcgtcgtttaatcggtaaacgtttgtttaacgtttaattttattcgtagggtaagatcgttatgtttttggcgtttatggggattagtgagggtgcgatttcgtttgcgttggaaagttttattatcgttatttcgtcgtatatggtcggcgttattgtcggtttaatcgtcgttgtttggttgggcgtagtgtaatggttttcggagttcgttatttgggtatggtcgttggttattaatttgggcgtttatatgcggggatcgcgttgggggtagttataattgcgttgatg

SEQ ID NO: 36350 - DNA, 510 bp, Artificial Sequence
  chemically treated genomic DNA (Homo sapiens) CpG-island No: 36350
catcaacgcaattataactacccccaacgcgatccccgcatataaacgcccaaattaataaccaacgaccatacccaaataacgaactccgaaaaccattacactacgcccaaccaaacaacgacgattaaaccgacaataacgccgaccatatacgacgaaataacgataataaaactttccaacgcaaacgaaatcgcaccctcactaatccccataaacgccaaaaacataacgatcttaccctacgaataaaattaaacgttaaacaaacgtttaccgattaaacgacgatcgataataatcgccaaccccaaaccaatcgacgaaataacgataacgataaaacgaacgataaccgataatacgtaatcaataataaaactaaaaacaacaaaacctacgactttattaatcgaaccaccaaaatcgattactatcgccgcgacgatccccattacgtacatcaacgcgcccttctcacctacgacaatcaacacaatacgaata

SEQ ID NO: 36351 - DNA, 510 bp, Artificial Sequence
  chemically treated genomic DNA (Homo sapiens) CpG-island No: 36351
tattagcgtagttatgattgtttttagcgcgattttcgtatatagacgtttaggttagtgattagcggttatgtttagatagcggatttcgggaattattgtattgcgtttagttagatagcggcggttgagtcgataatagcgtcgattatatacgacggaatggcggtgatggggttttttagcgtaaacggaatcgtatttttattgatttttataaacgttaggaatatggcggttttattttgcggataaagttgagcgttgaataggcgtttgtcggttaaacgacggtcgataatggtcgttagttttagattaatcggcggaataacgatagcgatagaacgagcggtgatcggtaatacgtggttagtggtaaagttgaaggtaataaaatttgcggttttgttgatcgggttattaaggtcgattgttgtcgtcgcggcgatttttattgcgtatattagcgcgttttttttatttgcggtagttagtatagtacggata

SEQ ID NO: 36352 - DNA, 510 bp, Artificial Sequence
  chemically treated genomic DNA (Homo sapiens) CpG-island No: 36352
tatccgtactatactaactaccgcaaataaaaaaaacgcgctaatatacgcaataaaaatcgccgcgacgacaacaatcgaccttaataacccgatcaacaaaaccgcaaattttattaccttcaactttaccactaaccacgtattaccgatcaccgctcgttctatcgctatcgttattccgccgattaatctaaaactaacgaccattatcgaccgtcgtttaaccgacaaacgcctattcaacgctcaactttatccgcaaaataaaaccgccatattcctaacgtttataaaaatcaataaaaatacgattccgtttacgctaaaaaaccccatcaccgccattccgtcgtatataatcgacgctattatcgactcaaccgccgctatctaactaaacgcaatacaataattcccgaaatccgctatctaaacataaccgctaatcactaacctaaacgtctatatacgaaaatcgcgctaaaaacaatcataactacgctaata

SEQ ID NO: 36353 - DNA, 512 bp, Artificial Sequence
  chemically treated genomic DNA (Homo sapiens) CpG-island No: 36353
ttggaagagagtatcgtcgatgaatttttagttttgttaaaatagtaggcgtaaaattggtagtcgggttatttatttgatttcgtaattattatgggtattttaatcgattgcgtttacgtcgattcggtttatagttttattcgggaaggcgaaagtaaagggtaattgttgttggatggtcgtaacgtcgggttggttgtcgttatcggttcgattatttttgtggatgtggattcgaatgcgtttttaagtcgcgaagagattttcggttcggtgttggtggttacgcgttttatattagaagaataggcgttatagtttgttaacgatagttagtacggttttggcgcggcggtatggacgcgcgatttttttcgcgcgtatcgtatgagtcgacgtttgaaagtcggtttcgttttcgttaataattataacgacggcgatatgattcgatgtacgtatattgtgttgcgttaataaagatacgacgttggtatacgtgtcgacga

SEQ ID NO: 36354 - DNA, 512 bp, Artificial Sequence
  chemically treated genomic DNA (Homo sapiens) CpG-island No: 36354
tcgtcgacacgtataccaacgtcgtatctttattaacgcaacacaatatacgtacatcgaatcatatcgccgtcgttataattattaacgaaaacgaaaccgactttcaaacgtcgactcatacgatacgcgcgaaaaaaatcgcgcgtccataccgccgcgccaaaaccgtactaactatcgttaacaaactataacgcctattcttctaatataaaacgcgtaaccaccaacaccgaaccgaaaatctcttcgcgacttaaaaacgcattcgaatccacatccacaaaaataatcgaaccgataacgacaaccaacccgacgttacgaccatccaacaacaattaccctttactttcgccttcccgaataaaactataaaccgaatcgacgtaaacgcaatcgattaaaatacccataataattacgaaatcaaataaataacccgactaccaattttacgcctactattttaacaaaactaaaaattcatcgacgatactctcttccaa

SEQ ID NO: 36355 - DNA, 512 bp, Artificial Sequence
  chemically treated genomic DNA (Homo sapiens) CpG-island No: 36355
tcgtcgatacgtgtgttagcgtcgtgtttttattagcgtagtataatatacgtgtatcgggttatatcgtcgtcgttgtagttattgacgaagacggaatcggtttttaggcgtcggtttatgcggtgcgcgcgggagaggtcgcgcgtttatatcgtcgcgttaaggtcgtattggttgtcgttggtaagttgtagcgtttgtttttttgatgtgaaacgcgtgattattagtatcggatcgaaaattttttcgcgatttaaggacgtattcgggtttatatttataaagatggtcgggtcgatggcggtagttagttcggcgttacggttatttaataatagttgttttttgttttcgttttttcgaataaagttatggatcgagtcggcgtgggcgtagtcgattaaggtgtttatggtggttgcgggattaagtggatggttcggttgttagttttgcgtttgttgttttaatagggttaagaatttatcggcgatgtttttttttag

SEQ ID NO: 36356 - DNA, 512 bp, Artificial Sequence
  chemically treated genomic DNA (Homo sapiens) CpG-island No: 36356
ctaaaaaaaaacatcgccgataaattcttaaccctattaaaacaacaaacgcaaaactaacaaccgaaccatccacttaatcccgcaaccaccataaacaccttaatcgactacgcccacgccgactcgatccataactttattcgaaaaaacgaaaacaaaaaacaactattattaaataaccgtaacgccgaactaactaccgccatcgacccgaccatctttataaatataaacccgaatacgtccttaaatcgcgaaaaaattttcgatccgatactaataatcacgcgtttcacatcaaaaaaacaaacgctacaacttaccaacgacaaccaatacgaccttaacgcgacgatataaacgcgcgacctctcccgcgcgcaccgcataaaccgacgcctaaaaaccgattccgtcttcgtcaataactacaacgacgacgatataacccgatacacgtatattatactacgctaataaaaacacgacgctaacacacgtatcgacga

SEQ ID NO: 36357 - DNA, 967 bp, Artificial Sequence
  chemically treated genomic DNA (Homo sapiens) CpG-island No: 36357
tcgaggtcgggtttgggttcgggtagttaggtttgacgcgggttcgcgttttttttcggtagagaagttcgggacgggtatgtgcgtggtttgcgggagttagatttacgattagtttattttgcgggtgtcgttcgatttcgagtggtacgcggtttgttttaagtgtgtcgagtgtagttagtatttgtacgagacgtgtacgtgtttcgtgagagacgggaagatttattgtaagcgggattatgttaggtgaggtcggcgggaacgcgggttgggttatcgcgcgtaggggtcggggtcgggattggggatgtcggtttgttcgcgcgtttcggttttgtttaggtagacgttttatttgtatgacgtacgggtgtcgtagcgttttttcgggttcgggaatgttcgtaggcgggttatcgtagttttttggtggttataaagtgttttgggcgcgcgtcggagtcgtagtagttagggagatgaggtcggtcgtaggtttagcgttgatatcgtcgtattttgggttcgtaggttgttcggtattaagtgcgttaagtgttaggtgggttttagtagtagcgatttggtgatgagggcgcgggatagcgtgtattatatcgagtgttttcgttgtttcgtgtgtagtcgttagttgttgtttggggacgagttttcgttgcgggagtacgagttgttttgtcgcgtcgattacggttttttgttcgagcgcgtcgcggtcggtagttcgcgtagtttcggttcgtttttcggcgttcgcggtttgtatttgttcggtaagcgcgtcggggtttgtgtcggggtgagcggggtgtatgtgcgtgcgtgtgtgtaggggtacgtttgtgtttttaacgagaagttgttagttgtgtgtggtttcgtttgtcgggatagtgtttttttgtattagtgcggaattgtgtgttgggaataaggttgt

SEQ ID NO: 36358 - DNA, 967 bp, Artificial Sequence
  chemically treated genomic DNA (Homo sapiens) CpG-island No: 36358
acaaccttattcccaacacacaattccgcactaatacaaaaaaacactatcccgacaaacgaaaccacacacaactaacaacttctcgttaaaaacacaaacgtacccctacacacacgcacgcacatacaccccgctcaccccgacacaaaccccgacgcgcttaccgaacaaatacaaaccgcgaacgccgaaaaacgaaccgaaactacgcgaactaccgaccgcgacgcgctcgaacaaaaaaccgtaatcgacgcgacaaaacaactcgtactcccgcaacgaaaactcgtccccaaacaacaactaacgactacacacgaaacaacgaaaacactcgatataatacacgctatcccgcgccctcatcaccaaatcgctactactaaaacccacctaacacttaacgcacttaataccgaacaacctacgaacccaaaatacgacgatatcaacgctaaacctacgaccgacctcatctccctaactactacgactccgacgcgcgcccaaaacactttataaccaccaaaaaactacgataacccgcctacgaacattcccgaacccgaaaaaacgctacgacacccgtacgtcatacaaataaaacgtctacctaaacaaaaccgaaacgcgcgaacaaaccgacatccccaatcccgaccccgacccctacgcgcgataacccaacccgcgttcccgccgacctcacctaacataatcccgcttacaataaatcttcccgtctctcacgaaacacgtacacgtctcgtacaaatactaactacactcgacacacttaaaacaaaccgcgtaccactcgaaatcgaacgacacccgcaaaataaactaatcgtaaatctaactcccgcaaaccacgcacatacccgtcccgaacttctctaccgaaaaaaaacgcgaacccgcgtcaaacctaactacccgaacccaaacccgacctcga

SEQ ID NO: 36359 - DNA, 967 bp, Artificial Sequence
  chemically treated genomic DNA (Homo sapiens) CpG-island No: 36359
atagttttgtttttagtatatagtttcgtattgatatagaaaaatattatttcggtagacggaattatatataattgataatttttcgttagggatataagcgtatttttatatatacgtacgtatatatatttcgtttatttcggtataggtttcggcgcgtttatcgggtagatgtaggtcgcgggcgtcgggaagcgggtcggggttgcgcgggttgtcggtcgcggcgcgttcgagtaggaggtcgtggtcggcgcggtagagtagttcgtgttttcgtagcgagaattcgtttttaggtagtagttggcggttgtatacggagtagcggaagtattcgatgtggtatacgttgtttcgcgtttttattattaggtcgttgttgttgaagtttatttggtatttggcgtatttgatgtcgaatagtttgcgggtttaaggtgcggcggtgttagcgttgggtttgcggtcggttttatttttttggttgttacggtttcggcgcgcgtttaggatattttgtggttattaggagattgcggtgattcgtttgcgggtattttcgggttcgggggagcgttgcggtattcgtgcgttatgtagatgagacgtttgtttgggtagggtcgaggcgcgcggataggtcgatatttttagtttcggtttcggtttttgcgcgcggtggtttagttcgcgttttcgtcggttttatttgatatagtttcgtttgtagtaggttttttcgttttttacgaagtacgtgtacgtttcgtataggtattggttgtattcggtatatttgaggtaggtcgcgtgttattcgaggtcgggcgatattcgtaggataaattggtcgtggatttgattttcgtagattacgtatatgttcgtttcgggtttttttgtcggggaagggcgcgggttcgcgttaggtttgattgttcggatttaggttcggtttcgg

SEQ ID NO: 36360 - DNA, 967 bp, Artificial Sequence
  chemically treated genomic DNA (Homo sapiens) CpG-island No: 36360
ccgaaaccgaacctaaatccgaacaatcaaacctaacgcgaacccgcgcccttccccgacaaaaaaacccgaaacgaacatatacgtaatctacgaaaatcaaatccacgaccaatttatcctacgaatatcgcccgacctcgaataacacgcgacctacctcaaatataccgaatacaaccaatacctatacgaaacgtacacgtacttcgtaaaaaacgaaaaaacctactacaaacgaaactatatcaaataaaaccgacgaaaacgcgaactaaaccaccgcgcgcaaaaaccgaaaccgaaactaaaaatatcgacctatccgcgcgcctcgaccctacccaaacaaacgtctcatctacataacgcacgaataccgcaacgctcccccgaacccgaaaatacccgcaaacgaatcaccgcaatctcctaataaccacaaaatatcctaaacgcgcgccgaaaccgtaacaaccaaaaaaataaaaccgaccgcaaacccaacgctaacaccgccgcaccttaaacccgcaaactattcgacatcaaatacgccaaataccaaataaacttcaacaacaacgacctaataataaaaacgcgaaacaacgtataccacatcgaatacttccgctactccgtatacaaccgccaactactacctaaaaacgaattctcgctacgaaaacacgaactactctaccgcgccgaccacgacctcctactcgaacgcgccgcgaccgacaacccgcgcaaccccgacccgcttcccgacgcccgcgacctacatctacccgataaacgcgccgaaacctataccgaaataaacgaaatatatatacgtacgtatatataaaaatacgcttatatccctaacgaaaaattatcaattatatataattccgtctaccgaaataatatttttctatatcaatacgaaactatatactaaaaacaaaactat

SEQ ID NO: 36361 - DNA, 978 bp, Artificial Sequence
  chemically treated genomic DNA (Homo sapiens) CpG-island No: 36361
cgggcgggggggtattcgttggggagggattcgtggagagggggcgcgggttcggggttcgtcgaggaatttttcggggttgttaggaagttcgtgagaagtcgagtattcggtaagttttattttgtgtagtaatcgttgtttcgcggttgtagttataatcgttaagtttttgagaaatttttttaaaaattgtaatcgttcgggagtcgtcgagggacggcgtttaggtatttaggtttcgcgtttttttcgggagagatttgaggggattcggcgtcgaggggaaggtcgcggggtcgcgggtcggtttagttttatttgtttcgggggtgtcgggcgagaatttcgcgtcgcgttttttaggttgttcgtcgtatttgtcgtcgaatttcgtcgttcgttcgggttttttattaggaatttttcgtttagaattttcgtttcgatttcggtcgtcgtacgttttattcggcgtttgtagtgtttcgtgtgtttttcgtcgtttttgcgttcgtcgagtgcgttcgttgttcgcgtttttaaaagtttcggcgcggcgggtttcgggattacgttttttttcgtttagttttcgatttgtgaggtgcgtttttcgtaagatggcggtagtcgggtttcgggttgggtgggggcggaatttggcggaagtgcgcgttatttttttcgtagatgtaagtggggaggttgtttgttttatagcgggtagggggaagttaggaaaacgtaaataaatttggaggggcggacggtttgggggaatcgttggatcgtttggggtcgggatcgggggttagtttcgaggtttcggttttggggcggttgtatttggtttcgagtttcggtgtacgtggtcggtttagtcgtcgttttttcgaagttttggttaagtggtacgtttgtggttttttttgacgtgattggtaaaaagttttatgggatttttttgaaatttta

SEQ ID NO: 36362 - DNA, 978 bp, Artificial Sequence
  chemically treated genomic DNA (Homo sapiens) CpG-island No: 36362
taaaatttcaaaaaaatcccataaaactttttaccaatcacgtcaaaaaaaaccacaaacgtaccacttaaccaaaacttcgaaaaaacgacgactaaaccgaccacgtacaccgaaactcgaaaccaaatacaaccgccccaaaaccgaaacctcgaaactaacccccgatcccgaccccaaacgatccaacgattcccccaaaccgtccgcccctccaaatttatttacgttttcctaacttccccctacccgctataaaacaaacaacctccccacttacatctacgaaaaaaataacgcgcacttccgccaaattccgcccccacccaacccgaaacccgactaccgccatcttacgaaaaacgcacctcacaaatcgaaaactaaacgaaaaaaaacgtaatcccgaaacccgccgcgccgaaacttttaaaaacgcgaacaacgaacgcactcgacgaacgcaaaaacgacgaaaaacacacgaaacactacaaacgccgaataaaacgtacgacgaccgaaatcgaaacgaaaattctaaacgaaaaattcctaataaaaaacccgaacgaacgacgaaattcgacgacaaatacgacgaacaacctaaaaaacgcgacgcgaaattctcgcccgacacccccgaaacaaataaaactaaaccgacccgcgaccccgcgaccttcccctcgacgccgaatcccctcaaatctctcccgaaaaaaacgcgaaacctaaatacctaaacgccgtccctcgacgactcccgaacgattacaatttttaaaaaaatttctcaaaaacttaacgattataactacaaccgcgaaacaacgattactacacaaaataaaacttaccgaatactcgacttctcacgaacttcctaacaaccccgaaaaattcctcgacgaaccccgaacccgcgccccctctccacgaatccctccccaacgaatacccccccgcccg

SEQ ID NO: 36363 - DNA, 978 bp, Artificial Sequence
  chemically treated genomic DNA (Homo sapiens) CpG-island No: 36363
tagaattttagagaaattttatggagttttttgttagttacgttaaaagaggttataaacgtgttatttaattagagtttcggaaaggcggcggttgggtcggttacgtgtatcgagattcggggttaggtgtagtcgttttagggtcgaggtttcggaattggttttcggtttcggttttaagcggtttagcgatttttttaagtcgttcgtttttttagatttatttacgtttttttgatttttttttgttcgttgtgggataaatagtttttttatttgtatttgcgaggggagtagcgcgtattttcgttaagtttcgtttttatttagttcgaggttcggttgtcgttattttgcggggggcgtattttataggtcgggagttgggcgggaaggggcgtggtttcgggattcgtcgcgtcggggtttttgggagcgcgggtagcgagcgtattcggcggacgtaagggcggcggggagtatacggagtattgtaggcgtcgggtgaggcgtgcggcggtcggggtcgggacgggggttttgggcggggggtttttggtggagggttcgggcgggcggcggggttcggcggtaggtgcggcgggtagtttagggggcgcggcgcggggttttcgttcggtattttcggggtaggtggagttgagtcggttcgcggtttcgcgatttttttttcggcgtcgggtttttttaggtttttttcgaaggaaacgcggagtttgggtgtttgggcgtcgtttttcggcggttttcgagcggttgtagtttttgaaagagttttttaaaggtttgacggttgtgattgtagtcgcggggtaacggttgttatataaagtgaaatttgtcgagtgttcggttttttacgggttttttggtagtttcgggaagtttttcggcggatttcgagttcgcgttttttttttacggatttttttttagcgagtgttttttcgttcg

SEQ ID NO: 36364 - DNA, 978 bp, Artificial Sequence
  chemically treated genomic DNA (Homo sapiens) CpG-island No: 36364
cgaacgaaaaaacactcgctaaaaaaaaatccgtaaaaaaaaaacgcgaactcgaaatccgccgaaaaacttcccgaaactaccaaaaaacccgtaaaaaaccgaacactcgacaaatttcactttatataacaaccgttaccccgcgactacaatcacaaccgtcaaacctttaaaaaactctttcaaaaactacaaccgctcgaaaaccgccgaaaaacgacgcccaaacacccaaactccgcgtttccttcgaaaaaaacctaaaaaaacccgacgccgaaaaaaaaatcgcgaaaccgcgaaccgactcaactccacctaccccgaaaataccgaacgaaaaccccgcgccgcgccccctaaactacccgccgcacctaccgccgaaccccgccgcccgcccgaaccctccaccaaaaaccccccgcccaaaacccccgtcccgaccccgaccgccgcacgcctcacccgacgcctacaatactccgtatactccccgccgcccttacgtccgccgaatacgctcgctacccgcgctcccaaaaaccccgacgcgacgaatcccgaaaccacgccccttcccgcccaactcccgacctataaaatacgccccccgcaaaataacgacaaccgaacctcgaactaaataaaaacgaaacttaacgaaaatacgcgctactcccctcgcaaatacaaataaaaaaactatttatcccacaacgaacaaaaaaaaatcaaaaaaacgtaaataaatctaaaaaaacgaacgacttaaaaaaatcgctaaaccgcttaaaaccgaaaccgaaaaccaattccgaaacctcgaccctaaaacgactacacctaaccccgaatctcgatacacgtaaccgacccaaccgccgcctttccgaaactctaattaaataacacgtttataacctcttttaacgtaactaacaaaaaactccataaaatttctctaaaattcta

SEQ ID NO: 36365 - DNA, 536 bp, Artificial Sequence
  chemically treated genomic DNA (Homo sapiens) CpG-island No: 36365
gtgttattttttttttttaggcggttttcgcggtgcgcgcgatttatgtttatgttcgcgtttattaataaagttgtttatttgttgtcggttcgttagttcgaaaggttgcgcgcgtagatcgagaagtttcgcgatagttagtcgcggttgtttttgcgtttttcgagttggcggggttcgtggtgcgggatcgagattgcgggttatggcgtcgaaggtttttcgttagtattgggatattttcgatggtatcgattgttatcgtaaagtttatagtattattagtattgttagcgtcgttggtgagcgtcggtcgggtttcgagggtggagggtcgaggtcgtagggaggtcgtggggttattgggggttgtttggatcgaacgggtttgggagtttcgcgggtacgtacgtggttgttatcggggtgttttgggcggtcgtagcgggggattttgtgtgaaatggatgttggtagggggtttagtagggttggggagtattgggaggtcgtgatatgcgataagttagttt

SEQ ID NO: 36366 - DNA, 536 bp, Artificial Sequence
  chemically treated genomic DNA (Homo sapiens) CpG-island No: 36366
aaactaacttatcgcatatcacgacctcccaatactccccaaccctactaaaccccctaccaacatccatttcacacaaaatcccccgctacgaccgcccaaaacaccccgataacaaccacgtacgtacccgcgaaactcccaaacccgttcgatccaaacaacccccaataaccccacgacctccctacgacctcgaccctccaccctcgaaacccgaccgacgctcaccaacgacgctaacaatactaataatactataaactttacgataacaatcgataccatcgaaaatatcccaatactaacgaaaaaccttcgacgccataacccgcaatctcgatcccgcaccacgaaccccgccaactcgaaaaacgcaaaaacaaccgcgactaactatcgcgaaacttctcgatctacgcgcgcaacctttcgaactaacgaaccgacaacaaataaacaactttattaataaacgcgaacataaacataaatcgcgcgcaccgcgaaaaccgcctaaaaaaaaaaaataacac

SEQ ID NO: 36367 - DNA, 536 bp, Artificial Sequence
  chemically treated genomic DNA (Homo sapiens) CpG-island No: 36367
ggattagtttgtcgtatgttacgattttttagtgttttttaattttgttggattttttattaatatttattttatataagatttttcgttacgatcgtttaagatatttcgatgataattacgtgcgtattcgcgagatttttagattcgttcgatttaaatagtttttagtaattttacgatttttttgcggtttcggttttttattttcggggttcggtcggcgtttattagcgacgttggtaatattggtggtgttgtaggttttgcggtggtaatcggtgttatcggggatattttagtattgacgaaaaattttcggcgttatagttcgtaatttcgatttcgtattacggatttcgttagttcgggaagcgtaagggtagtcgcggttggttatcgcgagatttttcggtttgcgcgcgtaatttttcgggttagcgggtcggtaataagtgagtaattttattgataggcgcggatatggatatggatcgcgcgtatcgcggggatcgtttggaggaagagagtagtat

SEQ ID NO: 36368 - DNA, 536 bp, Artificial Sequence
  chemically treated genomic DNA (Homo sapiens) CpG-island No: 36368
atactactctcttcctccaaacgatccccgcgatacgcgcgatccatatccatatccgcgcctatcaataaaattactcacttattaccgacccgctaacccgaaaaattacgcgcgcaaaccgaaaaatctcgcgataaccaaccgcgactacccttacgcttcccgaactaacgaaatccgtaatacgaaatcgaaattacgaactataacgccgaaaatttttcgtcaatactaaaatatccccgataacaccgattaccaccgcaaaacctacaacaccaccaatattaccaacgtcgctaataaacgccgaccgaaccccgaaaataaaaaaccgaaaccgcaaaaaaatcgtaaaattactaaaaactatttaaatcgaacgaatctaaaaatctcgcgaatacgcacgtaattatcatcgaaatatcttaaacgatcgtaacgaaaaatcttatataaaataaatattaataaaaaatccaacaaaattaaaaaacactaaaaaatcgtaacatacgacaaactaatcc

SEQ ID NO: 36369 - DNA, 654 bp, Artificial Sequence
  chemically treated genomic DNA (Homo sapiens) CpG-island No: 36369
cgcggtttatacgcgagtttttcgtcgaggatgaattattagttagttcgagttgttatattttattttagtatagttatcgcgagagtttcggggtcgcgtcggcgtgttttacgtacgcgtagtttttcgcggggtcggttagtggtgtcgtcgaggcggggggagtggtttcgcgtcggtcgagtgaggtagggttatacgtaggtgtattcgcgcgtcgatagttcgtgtatcgtgtggtagcggttgtgcgcgtttaggaaggatatttcgttttcgtaggtcgtcgggcggtagtagggttgcgcgcgtattcgttttcgtcgtaggcgtcgtcgttggcgtagtcgtcgtagttcgaggtcgtagacgcgcgcggtagtttcgtaggcgtttgcgtagtagcggaatagtatcgtttcgtcggacgcgtagtttaggtttagttcgtttacgcgtatttttagttcgcgtagttcgtaaggtcgcgtttttaatcgcgtacgcgcgcgtcgtcgttcggggtttcgttcgacggcgcggatttgggggtcgtttagtttagggcgttagttcgcgtagttttatcgtattcggggttttttgtaggagtgtacggtttgcgaggggaggaagagaaaggaggggggg

SEQ ID NO: 36370 - DNA, 654 bp, Artificial Sequence
  chemically treated genomic DNA (Homo sapiens) CpG-island No: 36370
ccccccctcctttctcttcctcccctcgcaaaccgtacactcctacaaaaaaccccgaatacgataaaactacgcgaactaacgccctaaactaaacgacccccaaatccgcgccgtcgaacgaaaccccgaacgacgacgcgcgcgtacgcgattaaaaacgcgaccttacgaactacgcgaactaaaaatacgcgtaaacgaactaaacctaaactacgcgtccgacgaaacgatactattccgctactacgcaaacgcctacgaaactaccgcgcgcgtctacgacctcgaactacgacgactacgccaacgacgacgcctacgacgaaaacgaatacgcgcgcaaccctactaccgcccgacgacctacgaaaacgaaatatccttcctaaacgcgcacaaccgctaccacacgatacacgaactatcgacgcgcgaatacacctacgtataaccctacctcactcgaccgacgcgaaaccactccccccgcctcgacgacaccactaaccgaccccgcgaaaaactacgcgtacgtaaaacacgccgacgcgaccccgaaactctcgcgataactatactaaaataaaatataacaactcgaactaactaataattcatcctcgacgaaaaactcgcgtataaaccgcg

SEQ ID NO: 36371 - DNA, 654 bp, Artificial Sequence
  chemically treated genomic DNA (Homo sapiens) CpG-island No: 36371
ttttttttttttttttttttttttttcgtagatcgtgtatttttgtagggggtttcggatgcgatggagttgcgcgagttgacgttttgggttgggcggtttttaggttcgcgtcgtcgggcggggtttcgggcggcggcgcgcgcgtgcgcggttgggggcgcggttttgcgggttgcgcgagttggaggtgcgcgtgagcgagttgggtttgggttacgcgttcgacgagacggtgttgtttcgttattgcgtaggcgtttgcgaggttgtcgcgcgcgtttacgatttcgggttgcgacgattgcgttagcggcggcgtttgcggcgggagcgggtgcgcgcgtagttttgttgtcgttcgacggtttacgaggacgaggtgttttttttggacgcgtatagtcgttattatacggtgtacgagttgtcggcgcgcgagtgtatttgcgtgtgattttattttattcggtcggcgcggggttatttttttcgtttcgacggtattattggtcggtttcgcgaaagattgcgcgtgcgtagagtacgtcggcgcggtttcgggattttcgcgataattgtattgagataaagtgtggtaattcgagttggttggtgatttattttcggcgaggggttcgcgtgtgggtcgcg

SEQ ID NO: 36372 - DNA, 654 bp, Artificial Sequence
  chemically treated genomic DNA (Homo sapiens) CpG-island No: 36372
cgcgacccacacgcgaacccctcgccgaaaataaatcaccaaccaactcgaattaccacactttatctcaatacaattatcgcgaaaatcccgaaaccgcgccgacgtactctacgcacgcgcaatctttcgcgaaaccgaccaataataccgtcgaaacgaaaaaaataaccccgcgccgaccgaataaaataaaatcacacgcaaatacactcgcgcgccgacaactcgtacaccgtataataacgactatacgcgtccaaaaaaaacacctcgtcctcgtaaaccgtcgaacgacaacaaaactacgcgcgcacccgctcccgccgcaaacgccgccgctaacgcaatcgtcgcaacccgaaatcgtaaacgcgcgcgacaacctcgcaaacgcctacgcaataacgaaacaacaccgtctcgtcgaacgcgtaacccaaacccaactcgctcacgcgcacctccaactcgcgcaacccgcaaaaccgcgcccccaaccgcgcacgcgcgcgccgccgcccgaaaccccgcccgacgacgcgaacctaaaaaccgcccaacccaaaacgtcaactcgcgcaactccatcgcatccgaaaccccctacaaaaatacacgatctacgaaaaaaaaaaaaaaaaaaaaaaaaaa

SEQ ID NO: 36373 - DNA, 604 bp, Artificial Sequence
  chemically treated genomic DNA (Homo sapiens) CpG-island No: 36373
ggtagggcgcgggtttaaggggtttcgggagtttttttcggggtcgggtcgggacgcggttggtgagtttcggtttcggtttttgaattggggggttcgcgtttgttttaaacgtcgttttttttcgttttttatgttattttttgtattaataagatggtggttaaagtaggggaggagagtagtagcgagtcgtcgtcgtcgtcgcgtcgaggttggcgttgaaattttgtttcgtcggggattagcgcgttcgtaggcggtcgttttcgtcgcgggggtcgttagtcgaggtcgcgtcgttttcgtcgagtcgttcgtcggtcgttttcgtcgttcgagtttcgcggttgtcgtagtattttcgggaaggtgagttagtttcggtagttaatgtggttattgaaaatggtttcggagagcgttcggtagtttgttagcgagcgcgggggtcgtcggtgcggggcgggagcggcggttgggggcgggggcggtcgggggtttcggcgcgggtcggggcgggggttcggaacgcgcggcgcggggtggggggcggtcgcgttgtcgaaggtgggtgaatttcggtagtagttgttcgtcgcgg

SEQ ID NO: 36374 - DNA, 604 bp, Artificial Sequence
  chemically treated genomic DNA (Homo sapiens) CpG-island No: 36374
ccgcgacgaacaactactaccgaaattcacccaccttcgacaacgcgaccgccccccaccccgcgccgcgcgttccgaacccccgccccgacccgcgccgaaacccccgaccgcccccgcccccaaccgccgctcccgccccgcaccgacgacccccgcgctcgctaacaaactaccgaacgctctccgaaaccattttcaataaccacattaactaccgaaactaactcaccttcccgaaaatactacgacaaccgcgaaactcgaacgacgaaaacgaccgacgaacgactcgacgaaaacgacgcgacctcgactaacgacccccgcgacgaaaacgaccgcctacgaacgcgctaatccccgacgaaacaaaatttcaacgccaacctcgacgcgacgacgacgacgactcgctactactctcctcccctactttaaccaccatcttattaatacaaaaaataacataaaaaacgaaaaaaaacgacgtttaaaacaaacgcgaaccccccaattcaaaaaccgaaaccgaaactcaccaaccgcgtcccgacccgaccccgaaaaaaactcccgaaaccccttaaacccgcgccctacc

SEQ ID NO: 36375 - DNA, 604 bp, Artificial Sequence
  chemically treated genomic DNA (Homo sapiens) CpG-island No: 36375
tcgcggcgggtagttattgtcgaggtttatttattttcggtaacgcggtcgttttttatttcgcgtcgcgcgtttcggattttcgtttcggttcgcgtcgagattttcggtcgttttcgtttttagtcgtcgttttcgtttcgtatcggcggttttcgcgttcgttggtaaattgtcgagcgtttttcgaagttatttttaatggttatattggttatcggggttgatttattttttcgggaatgttgcggtagtcgcggggttcgggcggcgagagcggtcggcgggcggttcggcggaggcggcgcggtttcggttggcggttttcgcggcgggagcggtcgtttgcgggcgcgttggttttcggcgaggtaaagttttagcgttagtttcggcgcggcggcggcggcgattcgttgttgttttttttttttgttttgattattattttattagtataggaaatgatatggaaaacggaagaaagcggcgtttggggtagacgcggattttttaatttaggggtcggagtcgagatttattagtcgcgtttcgattcggtttcggagaaaattttcggggttttttaggttcgcgttttgtt

SEQ ID NO: 36376 - DNA, 604 bp, Artificial Sequence
  chemically treated genomic DNA (Homo sapiens) CpG-island No: 36376
aacaaaacgcgaacctaaaaaaccccgaaaattttctccgaaaccgaatcgaaacgcgactaataaatctcgactccgacccctaaattaaaaaatccgcgtctaccccaaacgccgctttcttccgttttccatatcatttcctatactaataaaataataatcaaaacaaaaaaaaaaaacaacaacgaatcgccgccgccgccgcgccgaaactaacgctaaaactttacctcgccgaaaaccaacgcgcccgcaaacgaccgctcccgccgcgaaaaccgccaaccgaaaccgcgccgcctccgccgaaccgcccgccgaccgctctcgccgcccgaaccccgcgactaccgcaacattcccgaaaaaataaatcaaccccgataaccaatataaccattaaaaataacttcgaaaaacgctcgacaatttaccaacgaacgcgaaaaccgccgatacgaaacgaaaacgacgactaaaaacgaaaacgaccgaaaatctcgacgcgaaccgaaacgaaaatccgaaacgcgcgacgcgaaataaaaaacgaccgcgttaccgaaaataaataaacctcgacaataactacccgccgcga

SEQ ID NO: 36377 - DNA, 757 bp, Artificial Sequence
  chemically treated genomic DNA (Homo sapiens) CpG-island No: 36377
  misc_feature (76)..(76): n is either a, c, g or t
  misc_feature (525)..(526): n is either a, c, g or t
ggagatttaaggttttttcggtttttgcgattggtcggcgcgatttttagtcgggttttcgttgtttattaggatntggttaggttttgggcgcgtagtcggagttgttcgattggcgggaggggcggtatcggagcgtggaggtggtgaaggtggtggggcggcggaggcggggtcgtattgaggcgttgcggcggcggtggtggcggtggtagcggtggcggttgttcgttttagtttggcgggggcgggggtttggaagatgggggcgggtggaataacgggtcggtgaggagtagtcgtcgttttttcgtcgtcgttggggtagtgtcgcggtggtcgattttggtagtgtcgttagtttttaggtagtcgttttttttttcgatatttcgttttgaggaggttgaggcggaatcgcggttggcggcggggggacggatcggttttgtagtggtcgtagtgatagttcggattcggtttttcgttcgttttgtttcggcgttcgtagttacgatgaatcgnngggcgcggttcgtcgtcgtcgttaattatttgttttgtattaattgtcggaaagtgttgcggaaggtacgggttcggttcggggttttgtcggcgagggtcgttttttgtcggtcggggttcgggcggttcgttttcgggcgcgtattgggggaggttgagagggattttcgggtatcgttttttcgtagggattgagaaagggggcgtgggttgagggtaggagggtttg

SEQ ID NO: 36378 - DNA, 757 bp, Artificial Sequence
  chemically treated genomic DNA (Homo sapiens) CpG-island No: 36378
  misc_feature (232)..(233): n is either a, c, g or t
  misc_feature (682)..(682): n is either a, c, g or t
caaaccctcctaccctcaacccacgccccctttctcaatccctacgaaaaaacgatacccgaaaatccctctcaacctcccccaatacgcgcccgaaaacgaaccgcccgaaccccgaccgacaaaaaacgaccctcgccgacaaaaccccgaaccgaacccgtaccttccgcaacactttccgacaattaatacaaaacaaataattaacgacgacgacgaaccgcgcccnncgattcatcgtaactacgaacgccgaaacaaaacgaacgaaaaaccgaatccgaactatcactacgaccactacaaaaccgatccgtccccccgccgccaaccgcgattccgcctcaacctcctcaaaacgaaatatcgaaaaaaaaaacgactacctaaaaactaacgacactaccaaaatcgaccaccgcgacactaccccaacgacgacgaaaaaacgacgactactcctcaccgacccgttattccacccgcccccatcttccaaacccccgcccccgccaaactaaaacgaacaaccgccaccgctaccaccgccaccaccgccgccgcaacgcctcaatacgaccccgcctccgccgccccaccaccttcaccacctccacgctccgataccgcccctcccgccaatcgaacaactccgactacgcgcccaaaacctaaccanatcctaataaacaacgaaaacccgactaaaaatcgcgccgaccaatcgcaaaaaccgaaaaaaccttaaatctcc

SEQ ID NO: 36379 - DNA, 757 bp, Artificial Sequence
  chemically treated genomic DNA (Homo sapiens) CpG-island No: 36379
  misc_feature (232)..(233): n is either a, c, g or t
  misc_feature (682)..(682): n is either a, c, g or t
taaatttttttgtttttaatttacgtttttttttttagtttttgcggagggacggtgttcggggattttttttagttttttttagtgcgcgttcggggacgagtcgttcgagtttcggtcggtaggaagcgattttcgtcggtaggatttcgggtcgaattcgtatttttcgtagtatttttcggtagttggtatagagtaggtagttggcggcggcgacgggtcgcgtttnncggtttatcgtggttgcgggcgtcgaggtagagcgggcggagggtcgggttcgggttgttattgcggttattgtagggtcggttcgttttttcgtcgttagtcgcgatttcgttttagtttttttaaggcgggatgtcgggaggagaggcgattgtttgaaagttagcggtattgttagagtcgattatcgcggtattgttttagcgacggcggagaggcggcggttgttttttatcggttcgttgttttattcgtttttattttttagattttcgttttcgttaggttaggacgagtagtcgttatcgttgttatcgttattatcgtcgtcgtagcgttttagtgcggtttcgttttcgtcgttttattatttttattatttttacgtttcggtatcgtttttttcgttaatcggatagtttcggttacgcgtttagggtttagttangttttaatgagtaacgagagttcgattgggagtcgcgtcggttaatcgtaggggtcgaggaagttttgaattttt

SEQ ID NO: 36380 - DNA, 757 bp, Artificial Sequence
  chemically treated genomic DNA (Homo sapiens) CpG-island No: 36380
  misc_feature (76)..(76): n is either a, c, g or t
  misc_feature (525)..(526): n is either a, c, g or t
aaaaattcaaaacttcctcgacccctacgattaaccgacgcgactcccaatcgaactctcgttactcattaaaacntaactaaaccctaaacgcgtaaccgaaactatccgattaacgaaaaaaacgataccgaaacgtaaaaataataaaaataataaaacgacgaaaacgaaaccgcactaaaacgctacgacgacgataataacgataacaacgataacgactactcgtcctaacctaacgaaaacgaaaatctaaaaaataaaaacgaataaaacaacgaaccgataaaaaacaaccgccgcctctccgccgtcgctaaaacaataccgcgataatcgactctaacaataccgctaactttcaaacaatcgcctctcctcccgacatcccgccttaaaaaaactaaaacgaaatcgcgactaacgacgaaaaaacgaaccgaccctacaataaccgcaataacaacccgaacccgaccctccgcccgctctacctcgacgcccgcaaccacgataaaccgnnaaacgcgacccgtcgccgccgccaactacctactctataccaactaccgaaaaatactacgaaaaatacgaattcgacccgaaatcctaccgacgaaaatcgcttcctaccgaccgaaactcgaacgactcgtccccgaacgcgcactaaaaaaaactaaaaaaaatccccgaacaccgtccctccgcaaaaactaaaaaaaaaaacgtaaattaaaaacaaaaaaattta

SEQ ID NO: 36381 - DNA, 611 bp, Artificial Sequence
  chemically treated genomic DNA (Homo sapiens) CpG-island No: 36381
ttatttttacggtaaatcgtattcggttgcggtaatcgtcgttttattggttattacgttgattggtgcgtacgttagaaattcgttgattaaatatttttcggaatttattatttttatatcgtcgtattttgtttttcgcgttagttgcgttagcggcgaaattgtcgattagttgtaggatttttttatggtttaatttatggggtacgaaacggttgatgggggtttgtaatgcggacggggcgattagatgcggttggtagttgtagcgttcggtatgtaaaatttgtagggttattttgtcgtttttttgatgtatcgtttcggtaatggtgcgatggtgtgggatttggttggcgtcgttgagtattgcgttattttttatgttaacgtttgttaaatttggtgtaatgtcgtcgttgataattagcgttacgtcgttgacggggcgcgttcggtataaaacgttgttagtcgttcgtatcgttcgggtatttttttagttcggtgtgtattgagtttattaatacgcggttttttaacgtgttaaaatttaaatttagcggggcgtatagcgacgggtagtttatataatcgtttagtatgta

SEQ ID NO: 36382 - DNA, 611 bp, Artificial Sequence
  chemically treated genomic DNA (Homo sapiens) CpG-island No: 36382
tacatactaaacgattatataaactacccgtcgctatacgccccgctaaatttaaattttaacacgttaaaaaaccgcgtattaataaactcaatacacaccgaactaaaaaaatacccgaacgatacgaacgactaacaacgttttataccgaacgcgccccgtcaacgacgtaacgctaattatcaacgacgacattacaccaaatttaacaaacgttaacataaaaaataacgcaatactcaacgacgccaaccaaatcccacaccatcgcaccattaccgaaacgatacatcaaaaaaacgacaaaataaccctacaaattttacataccgaacgctacaactaccaaccgcatctaatcgccccgtccgcattacaaacccccatcaaccgtttcgtaccccataaattaaaccataaaaaaatcctacaactaatcgacaatttcgccgctaacgcaactaacgcgaaaaacaaaatacgacgatataaaaataataaattccgaaaaatatttaatcaacgaatttctaacgtacgcaccaatcaacgtaataaccaataaaacgacgattaccgcaaccgaatacgatttaccgtaaaaataa

SEQ ID NO: 36383 - DNA, 611 bp, Artificial Sequence
  chemically treated genomic DNA (Homo sapiens) CpG-island No: 36383
tatatattggacgattgtatgagttattcgtcgttgtgcgtttcgttggatttaggttttagtacgttaaagaatcgcgtgttgatgggtttaatgtatatcgggttggaggaatattcggacggtgcgagcggttggtagcgttttatgtcgaacgcgtttcgttagcggcgtggcgttgattgttagcggcggtattgtattagatttaataggcgttggtatggaaggtggcgtaatgtttaacgacgttagttagattttatattatcgtattattatcgaagcggtatattaggaaggcggtaaaatagttttgtaaattttgtatatcgggcgttatagttattaatcgtatttggtcgtttcgttcgtattgtaggtttttattaatcgtttcgtgttttatgagttaagttatgaagagattttgtaattgatcgataatttcgtcgttggcgtaattggcgcgggaggtaggatacgacggtgtagaggtgatgggtttcgaagggtatttgattaacgaatttttgacgtgcgtattaattagcgtagtgattagtggggcggcgattatcgtaatcggatgcgatttgtcgtagaagtag

SEQ ID NO: 36384 - DNA, 611 bp, Artificial Sequence
  chemically treated genomic DNA (Homo sapiens) CpG-island No: 36384
ctacttctacgacaaatcgcatccgattacgataatcgccgccccactaatcactacgctaattaatacgcacgtcaaaaattcgttaatcaaatacccttcgaaacccatcacctctacaccgtcgtatcctacctcccgcgccaattacgccaacgacgaaattatcgatcaattacaaaatctcttcataacttaactcataaaacacgaaacgattaataaaaacctacaatacgaacgaaacgaccaaatacgattaataactataacgcccgatatacaaaatttacaaaactattttaccgccttcctaatataccgcttcgataataatacgataatataaaatctaactaacgtcgttaaacattacgccaccttccataccaacgcctattaaatctaatacaataccgccgctaacaatcaacgccacgccgctaacgaaacgcgttcgacataaaacgctaccaaccgctcgcaccgtccgaatattcctccaacccgatatacattaaacccatcaacacgcgattctttaacgtactaaaacctaaatccaacgaaacgcacaacgacgaataactcatacaatcgtccaatatata

SEQ ID NO: 36385 - DNA, 680 bp, Artificial Sequence
  chemically treated genomic DNA (Homo sapiens) CpG-island No: 36385
gaggttcgtgttttttttagagggcgttacggttagcgagtagcgcgcgttgatgtcggagtttaagatttttatttatatcggtaattattttaacgtggttaattttttcggggcgtgtattaagtcgtagggtacggagcgggcggttcgttgggacggcgagatttcgggcgtagggcgtcgcgggcgggagggggcgcgggtgtaaacgcggagcgcgttcgtagcgcgtttcgggtttcgaacgtacggtcgtcgttcggtttcgtcgtaggtttttttatggtgatcgtggagttttgtaagtacggtaatttttttaattttttgcgcgttaagcgggacgtttttagtttttgcgcggtgagcgggcggtttgcggggcgtcgcgggcggcgggggaatggaggcgtttttgcggcggacgattgggcgttttcgagttagtttcgtgtattcgtaggagaagtttttcgagtagcgcggacgttttcgcgttatggtggagttcgttaggttggatcggaggcggtcggggagtagcgatagggtttttttcgcgcggttttcgaagatcgagggcggagcgaggcgggtttttttagattaagaaggtgagagtttggttttttttttttttttagtgtttgacgggttcggttatatttcgtgattag

SEQ ID NO: 36386 - DNA, 680 bp, Artificial Sequence
  chemically treated genomic DNA (Homo sapiens) CpG-island No: 36386
ctaatcacgaaatataaccgaacccgtcaaacactaaaaaaaaaaaaaaaaccaaactctcaccttcttaatctaaaaaaacccgcctcgctccgccctcgatcttcgaaaaccgcgcgaaaaaaaccctatcgctactccccgaccgcctccgatccaacctaacgaactccaccataacgcgaaaacgtccgcgctactcgaaaaacttctcctacgaatacacgaaactaactcgaaaacgcccaatcgtccgccgcaaaaacgcctccattcccccgccgcccgcgacgccccgcaaaccgcccgctcaccgcgcaaaaactaaaaacgtcccgcttaacgcgcaaaaaattaaaaaaattaccgtacttacaaaactccacgatcaccataaaaaaacctacgacgaaaccgaacgacgaccgtacgttcgaaacccgaaacgcgctacgaacgcgctccgcgtttacacccgcgccccctcccgcccgcgacgccctacgcccgaaatctcgccgtcccaacgaaccgcccgctccgtaccctacgacttaatacacgccccgaaaaaattaaccacgttaaaataattaccgatataaataaaaatcttaaactccgacatcaacgcgcgctactcgctaaccgtaacgccctctaaaaaaaacacgaacctc

SEQ ID NO: 36387 - DNA, 680 bp, Artificial Sequence
  chemically treated genomic DNA (Homo sapiens) CpG-island No: 36387
ttgattacgggatataatcgggttcgttaggtattaggaaaagggaagaggttaggtttttatttttttggtttggagaagttcgtttcgtttcgttttcggttttcgagaatcgcgcgaagaggattttgtcgttgtttttcggtcgttttcgatttagtttggcgagttttattatggcgcggaagcgttcgcgttgttcgggagattttttttgcggatgtacgaagttggttcgagggcgtttagtcgttcgtcgtagaggcgtttttattttttcgtcgttcgcggcgtttcgtaggtcgttcgtttatcgcgtaggggttgaaggcgtttcgtttggcgcgtaggaagttggagaggttgtcgtatttgtagaattttacgattattatgagggggtttgcggcgggatcgggcggcggtcgtgcgttcggaattcggggcgcgttgcgggcgcgtttcgcgtttgtattcgcgttttttttcgttcgcggcgttttgcgttcggggtttcgtcgttttagcgggtcgttcgtttcgtattttgcggtttggtgtacgtttcgaggaggttgattacgttgaggtggttgtcgatgtgaatgaggattttgagtttcgatattagcgcgcgttgttcgttggtcgtggcgttttttggaggggatacgggtttt

SEQ ID NO: 36388 - DNA, 680 bp, Artificial Sequence
  chemically treated genomic DNA (Homo sapiens) CpG-island No: 36388
aaaacccgtatcccctccaaaaaacgccacgaccaacgaacaacgcgcgctaatatcgaaactcaaaatcctcattcacatcgacaaccacctcaacgtaatcaacctcctcgaaacgtacaccaaaccgcaaaatacgaaacgaacgacccgctaaaacgacgaaaccccgaacgcaaaacgccgcgaacgaaaaaaaacgcgaatacaaacgcgaaacgcgcccgcaacgcgccccgaattccgaacgcacgaccgccgcccgatcccgccgcaaaccccctcataataatcgtaaaattctacaaatacgacaacctctccaacttcctacgcgccaaacgaaacgccttcaacccctacgcgataaacgaacgacctacgaaacgccgcgaacgacgaaaaaataaaaacgcctctacgacgaacgactaaacgccctcgaaccaacttcgtacatccgcaaaaaaaatctcccgaacaacgcgaacgcttccgcgccataataaaactcgccaaactaaatcgaaaacgaccgaaaaacaacgacaaaatcctcttcgcgcgattctcgaaaaccgaaaacgaaacgaaacgaacttctccaaaccaaaaaaataaaaacctaacctcttcccttttcctaatacctaacgaacccgattatatcccgtaatcaa

SEQ ID NO: 36389 - DNA, 514 bp, Artificial Sequence
  chemically treated genomic DNA (Homo sapiens) CpG-island No: 36389
  misc_feature (179)..(179): n is either a, c, g or t
cgagtttcgcgttagtagagcgttttttattcggtttttcgttcggtttgttatttttatttacggggcgtattgtgtgggttcgggcggttttcgttcgttcgttttttattttcgcggtaggttagcggcgggcggggacgtggcggttcggttagcgtatatgtcgcgattttatntcggcgtcggggttttcgttttttgcgcgtcggaagtcggtgttttggcggcgtgagttttacgcggcgggttttcggtttaggtattagggtcgcgtgcgcgagtcgttcggtaggggtagcggcggttttttcggcgcgcggatttagggaggaggtcggtttcggaggatgggggaggggtagaggcggaggcgacggaagtcgtcggacgtcgggggttgggcgtaggcggggcgagtgcgcgggtggcggttaggtttcggaaaggatatttgttgtacggttttttggatggtggtgtttggggattgggatttttttaatagttgtag

SEQ ID NO: 36390 - DNA, 514 bp, Artificial Sequence
  chemically treated genomic DNA (Homo sapiens) CpG-island No: 36390
  misc_feature (336)..(336): n is either a, c, g or t
ctacaactattaaaaaaatcccaatccccaaacaccaccatccaaaaaaccgtacaacaaatatcctttccgaaacctaaccgccacccgcgcactcgccccgcctacgcccaacccccgacgtccgacgacttccgtcgcctccgcctctacccctcccccatcctccgaaaccgacctcctccctaaatccgcgcgccgaaaaaaccgccgctacccctaccgaacgactcgcgcacgcgaccctaatacctaaaccgaaaacccgccgcgtaaaactcacgccgccaaaacaccgacttccgacgcgcaaaaaacgaaaaccccgacgccganataaaatcgcgacatatacgctaaccgaaccgccacgtccccgcccgccgctaacctaccgcgaaaataaaaaacgaacgaacgaaaaccgcccgaacccacacaatacgccccgtaaataaaaataacaaaccgaacgaaaaaccgaataaaaaacgctctactaacgcgaaactcg

SEQ ID NO: 36391 - DNA, 514 bp, Artificial Sequence
  chemically treated genomic DNA (Homo sapiens) CpG-island No: 36391
  misc_feature (336)..(336): n is either a, c, g or t
ttgtagttgttgaaggagttttagtttttagatattattatttagagaatcgtgtaataagtatttttttcgaggtttggtcgttattcgcgtattcgtttcgtttgcgtttagttttcggcgttcggcgattttcgtcgttttcgtttttgttttttttttatttttcgagatcggttttttttttgggttcgcgcgtcggggaagtcgtcgttgtttttgtcggacgattcgcgtacgcggttttgatgtttgggtcgggggttcgtcgcgtggggtttacgtcgttaaggtatcggttttcggcgcgtaggaggcggggatttcggcgtcggngtgaaatcgcgatatgtgcgttggtcgggtcgttacgttttcgttcgtcgttgatttgtcgcgggggtagggagcgggcgggcgggagtcgttcgggtttatataatgcgtttcgtgggtgggggtggtaggtcgagcgggaggtcgggtggagggcgttttgttgacgcggagttcg

SEQ ID NO: 36392 - DNA, 514 bp, Artificial Sequence
  chemically treated genomic DNA (Homo sapiens) CpG-island No: 36392
  misc_feature (179)..(179): n is either a, c, g or t
cgaactccgcgtcaacaaaacgccctccacccgacctcccgctcgacctaccacccccacccacgaaacgcattatataaacccgaacgactcccgcccgcccgctccctacccccgcgacaaatcaacgacgaacgaaaacgtaacgacccgaccaacgcacatatcgcgatttcacnccgacgccgaaatccccgcctcctacgcgccgaaaaccgataccttaacgacgtaaaccccacgcgacgaacccccgacccaaacatcaaaaccgcgtacgcgaatcgtccgacaaaaacaacgacgacttccccgacgcgcgaacccaaaaaaaaaaccgatctcgaaaaataaaaaaaaaacaaaaacgaaaacgacgaaaatcgccgaacgccgaaaactaaacgcaaacgaaacgaatacgcgaataacgaccaaacctcgaaaaaaatacttattacacgattctctaaataataatatctaaaaactaaaactccttcaacaactacaa

SEQ ID NO: 36393 - DNA, 850 bp, Artificial Sequence
  chemically treated genomic DNA (Homo sapiens) CpG-island No: 36393
tttcgcgtttcgaggaaaggagaatttcgcggcggcgaaggtcgattttggttcggttaggtacgttcgggtcgcggtttagttacgattcgggtagggtttcgcggtttttattagtttcgggaggagtttggtcggtcgggtcgttattatagtggcgtttcggttagttgggcgcgagcggaggcgcgttaagttttggcggcggcgttacggtcgggtagtacgggtttcgtaatttcgcgtcgttattttagcgttttcggaggaatcgggagcggggagtgggggaagggagggcgtcgcgttttattcggagagcgggcggtttttgttcgtcggcgtgtggttggggcgttgcgcggcggcgcggttgcgatagggagggagaagcggtggtgcgagcgttgggtcgcgggagacgagaggcgtcgtcgttatcgtagatagtttcgtaatatggtcgttcggcgttttcgcgggaaaaggcggggttgttcggcgttttttcgtttttttttgtcggtcggtcgttttcgcgtcgcggattgagcgttaacgtcgtcgttgggggtcgttttcgtttcgtttttttcgtaggttcgtagtcgtaggtttggtttcgggcgtggtcgggggtcgcggtttggggtcggttaacgcgaggtgggtggttgcgggttcgggagcgtttagggaaatagggcgaatgcgtcggagggtcgagtttttttagagagcgttgggttttagttaaatttgcggtcgagggaagcggagtcgtttagtttaaagttcggagtgtgttcgtcgtttttttaacgagtggaaatttgaaattttcgttggt

SEQ ID NO: 36394 - DNA, 850 bp, Artificial Sequence
  chemically treated genomic DNA (Homo sapiens) CpG-island No: 36394
accaacgaaaatttcaaatttccactcgttaaaaaaacgacgaacacactccgaactttaaactaaacgactccgcttccctcgaccgcaaatttaactaaaacccaacgctctctaaaaaaactcgaccctccgacgcattcgccctatttccctaaacgctcccgaacccgcaaccacccacctcgcgttaaccgaccccaaaccgcgacccccgaccacgcccgaaaccaaacctacgactacgaacctacgaaaaaaacgaaacgaaaacgacccccaacgacgacgttaacgctcaatccgcgacgcgaaaacgaccgaccgacaaaaaaaaacgaaaaaacgccgaacaaccccgccttttcccgcgaaaacgccgaacgaccatattacgaaactatctacgataacgacgacgcctctcgtctcccgcgacccaacgctcgcaccaccgcttctccctccctatcgcaaccgcgccgccgcgcaacgccccaaccacacgccgacgaacaaaaaccgcccgctctccgaataaaacgcgacgccctcccttcccccactccccgctcccgattcctccgaaaacgctaaaataacgacgcgaaattacgaaacccgtactacccgaccgtaacgccgccgccaaaacttaacgcgcctccgctcgcgcccaactaaccgaaacgccactataataacgacccgaccgaccaaactcctcccgaaactaataaaaaccgcgaaaccctacccgaatcgtaactaaaccgcgacccgaacgtacctaaccgaaccaaaatcgaccttcgccgccgcgaaattctcctttcctcgaaacgcgaaa

SEQ ID NO: 36395 - DNA, 850 bp, Artificial Sequence
  chemically treated genomic DNA (Homo sapiens) CpG-island No: 36395
attagcgggagttttaagtttttattcgttggggaggcggcgggtatatttcgagttttgggttgggcggtttcgtttttttcgatcgtaggtttagttggagtttagcgttttttggaagggttcgatttttcggcgtattcgttttatttttttgggcgttttcgagttcgtagttatttatttcgcgttggtcggttttagatcgcgattttcggttacgttcggagttaggtttgcggttgcgagtttgcgggaggggcggggcgggggcggtttttagcggcggcgttggcgtttagttcgcggcgcgaggacggtcggtcggtagggggaggcgggggggcgtcgggtagtttcgttttttttcgcggaggcgtcgagcggttatattgcggagttgtttgcggtggcggcggcgtttttcgtttttcgcggtttagcgttcgtattatcgtttttttttttttgtcgtagtcgcgtcgtcgcgtagcgttttagttatacgtcggcgggtagaagtcgttcgtttttcgggtaaggcgcggcgttttttttttttttatttttcgttttcggttttttcggagacgttaaggtggcggcgcgaagttgcggggttcgtgttgttcggtcgtggcgtcgtcgttagggtttggcgcgttttcgttcgcgtttagttggtcgaggcgttattgtggtaacggttcggtcggttaggtttttttcggggttggtaggggtcgcgaggttttgttcgagtcgtggttgagtcgcggttcgaacgtgtttggtcgggttaaagtcgattttcgtcgtcgcgggattttttttttttcggggcgcggag

SEQ ID NO: 36396 - DNA, 850 bp, Artificial Sequence
  chemically treated genomic DNA (Homo sapiens) CpG-island No: 36396
ctccgcgccccgaaaaaaaaaaaatcccgcgacgacgaaaatcgactttaacccgaccaaacacgttcgaaccgcgactcaaccacgactcgaacaaaacctcgcgacccctaccaaccccgaaaaaaacctaaccgaccgaaccgttaccacaataacgcctcgaccaactaaacgcgaacgaaaacgcgccaaaccctaacgacgacgccacgaccgaacaacacgaaccccgcaacttcgcgccgccaccttaacgtctccgaaaaaaccgaaaacgaaaaataaaaaaaaaaaaaacgccgcgccttacccgaaaaacgaacgacttctacccgccgacgtataactaaaacgctacgcgacgacgcgactacgacaaaaaaaaaaaaacgataatacgaacgctaaaccgcgaaaaacgaaaaacgccgccgccaccgcaaacaactccgcaatataaccgctcgacgcctccgcgaaaaaaaacgaaactacccgacgcccccccgcctccccctaccgaccgaccgtcctcgcgccgcgaactaaacgccaacgccgccgctaaaaaccgcccccgccccgcccctcccgcaaactcgcaaccgcaaacctaactccgaacgtaaccgaaaatcgcgatctaaaaccgaccaacgcgaaataaataactacgaactcgaaaacgcccaaaaaaataaaacgaatacgccgaaaaatcgaacccttccaaaaaacgctaaactccaactaaacctacgatcgaaaaaaacgaaaccgcccaacccaaaactcgaaatatacccgccgcctccccaacgaataaaaacttaaaactcccgctaat

SEQ ID NO: 36397 - DNA, 682 bp, Artificial Sequence
  chemically treated genomic DNA (Homo sapiens) CpG-island No: 36397
gtgtgtgtgtgaatgtgattattttaggatttttcgggtttcggagacgttatttttttttttgatatttttttttataaatcggtggcgcggcggaggcggtagagtcgggcgggaagcgcggggtcggtcggggcgttcgtcgttcgtcgtcgttttcgcgcgttcgggggtttcggcgtttttcgagttagggcggttagttcgcggttcgtcgtttgatagatgtttatcgttatggagttgtcgtagtagtatttttgggggttcgggcgagcgacgggagtcgggatttgagcgagcgtcggggttagcggagtcggagtcgtcgggatatgggtgagtacgcgcggcgattttggttcgggagttcgggcgtttagttttttttcgcgtcgcgggttttcgtattttcggaatcgggggcgacgtgtgtgttttgtatgtaaaagtttacgtcgttttgttgggtttttgattttgtattcggcgggaagggggagatcgggtcgagggggcgggatgtcggttcgggcgaggttgtaggagatgggcgcgatttcggcgggtcggcgggtgggcggcgatgttggtttaattggagtggttcgttggtggcggcgatggtggaagttttgggttggagggttgggagtttattgagtttcgtttaatttgattt

SEQ ID NO: 36398 - DNA, 682 bp, Artificial Sequence
  chemically treated genomic DNA (Homo sapiens) CpG-island No: 36398
aaatcaaattaaacgaaactcaataaactcccaaccctccaacccaaaacttccaccatcgccgccaccaacgaaccactccaattaaaccaacatcgccgcccacccgccgacccgccgaaatcgcgcccatctcctacaacctcgcccgaaccgacatcccgccccctcgacccgatctcccccttcccgccgaatacaaaatcaaaaacccaacaaaacgacgtaaacttttacatacaaaacacacacgtcgcccccgattccgaaaatacgaaaacccgcgacgcgaaaaaaaactaaacgcccgaactcccgaaccaaaatcgccgcgcgtactcacccatatcccgacgactccgactccgctaaccccgacgctcgctcaaatcccgactcccgtcgctcgcccgaacccccaaaaatactactacgacaactccataacgataaacatctatcaaacgacgaaccgcgaactaaccgccctaactcgaaaaacgccgaaacccccgaacgcgcgaaaacgacgacgaacgacgaacgccccgaccgaccccgcgcttcccgcccgactctaccgcctccgccgcgccaccgatttataaaaaaaaatatcaaaaaaaaaaataacgtctccgaaacccgaaaaatcctaaaataatcacattcacacacacac

SEQ ID NO: 36399 - DNA, 682 bp, Artificial Sequence
  chemically treated genomic DNA (Homo sapiens) CpG-island No: 36399
agattagattaggcgaaatttaataagtttttagttttttagtttaaagtttttattatcgtcgttattaacgagttattttaattgagttagtatcgtcgtttattcgtcggttcgtcggaatcgcgtttattttttgtaatttcgttcggatcggtatttcgttttttcggttcggttttttttttttcgtcgggtgtaaagttaaagatttagtaaggcgacgtgaatttttgtatgtagggtatatacgtcgttttcggtttcgggagtgcgggggttcgcggcgcggagggaggttgggcgttcgggttttcgggttaaggtcgtcgcgcgtgtttatttatgtttcggcggtttcggtttcgttggtttcggcgttcgtttagatttcggttttcgtcgttcgttcgagtttttaaaggtgttgttgcggtaattttatggcgatgagtatttgttaaacggcgagtcgcgagttggtcgttttagttcggggggcgtcggggttttcgggcgcgcggaggcggcggcgagcggcgggcgtttcggtcggtttcgcgtttttcgttcgattttgtcgttttcgtcgcgttatcgatttatggagagagatattaagggggaaaatggcgttttcggagttcgaggagttttggagtaattatatttatatatatat

SEQ ID NO: 36400 - DNA, 682 bp, Artificial Sequence
  chemically treated genomic DNA (Homo sapiens) CpG-island No: 36400
atatatatataaatataattactccaaaactcctcgaactccgaaaacgccattttcccccttaatatctctctccataaatcgataacgcgacgaaaacgacaaaatcgaacgaaaaacgcgaaaccgaccgaaacgcccgccgctcgccgccgcctccgcgcgcccgaaaaccccgacgccccccgaactaaaacgaccaactcgcgactcgccgtttaacaaatactcatcgccataaaattaccgcaacaacacctttaaaaactcgaacgaacgacgaaaaccgaaatctaaacgaacgccgaaaccaacgaaaccgaaaccgccgaaacataaataaacacgcgcgacgaccttaacccgaaaacccgaacgcccaacctccctccgcgccgcgaacccccgcactcccgaaaccgaaaacgacgtatataccctacatacaaaaattcacgtcgccttactaaatctttaactttacacccgacgaaaaaaaaaaaaccgaaccgaaaaaacgaaataccgatccgaacgaaattacaaaaaataaacgcgattccgacgaaccgacgaataaacgacgatactaactcaattaaaataactcgttaataacgacgataataaaaactttaaactaaaaaactaaaaacttattaaatttcgcctaatctaatct

SEQ ID NO: 36401 - DNA, 952 bp, Artificial Sequence
  chemically treated genomic DNA (Homo sapiens) CpG-island No: 36401
tgtcgtcggtttttatttaggtcgaggtggttcggttttatgtatcgcgacgtaacgcggggaggtagataaggtatagggcggcgtttataatttatgttaattcgttttatgtgttcgtcgaggcggtataaatcgtcgtgacgattagcggtttaatgatcgaagttaggttggtaagagtcgcgagcgatttttgaagttgtttttgatggtcgttatttatttgtttggatagtatggtttgtaacgcgggtatttcgatgtcgtcggaagcgagaagaattataatggggaaggttatttagtttcgcgtcgcgaacgttagtaagacgtagtttagcgcgtcggtcgttatgtcggcgataatggtttgtttttcgtcgaaacgtttggtggcgggattagtgacgaaggtttgagcgagggcgtgtaagatttcgaatatcgtaagcgataggtcgattatcgtcgcgttttagcgaaagcggttttcgtcgaaaatgatttagagcgttgtcggtatttgttttacgagttgtatgataaagaagatagttataagtgcggcgacgatagttatgtttcgcgtttatcggaaggagttgattgggttgaaggtttttaagggtatcggtcgacgtttttttttatgcgatttttgtattaggaagtagtttagtagtaggttgaggtcgttgagtatcgtcgtcgtaaggaatggtgtatgtaaggagatggcgtttaatagtttttcggttacggggtttgttattatatttacgtcgaaataagcgtttatgagttcgaagtggcgagttcgattttttttatcggtgatgtcggcgatataggcgttagtaatcgtatttgtggcgtcggtgatgtcggttacgatgcgttcggcgtagaggattaattaatagaaataatttgttttaaagaataaaga

SEQ ID NO: 36402 - DNA, 952 bp, Artificial Sequence
  chemically treated genomic DNA (Homo sapiens) CpG-island No: 36402
tctttattctttaaaacaaattatttctattaattaatcctctacgccgaacgcatcgtaaccgacatcaccgacgccacaaatacgattactaacgcctatatcgccgacatcaccgataaaaaaaatcgaactcgccacttcgaactcataaacgcttatttcgacgtaaatataataacaaaccccgtaaccgaaaaactattaaacgccatctccttacatacaccattccttacgacgacgatactcaacgacctcaacctactactaaactacttcctaatacaaaaatcgcataaaaaaaaacgtcgaccgatacccttaaaaaccttcaacccaatcaactccttccgataaacgcgaaacataactatcgtcgccgcacttataactatcttctttatcatacaactcgtaaaacaaataccgacaacgctctaaatcattttcgacgaaaaccgctttcgctaaaacgcgacgataatcgacctatcgcttacgatattcgaaatcttacacgccctcgctcaaaccttcgtcactaatcccgccaccaaacgtttcgacgaaaaacaaaccattatcgccgacataacgaccgacgcgctaaactacgtcttactaacgttcgcgacgcgaaactaaataaccttccccattataattcttctcgcttccgacgacatcgaaatacccgcgttacaaaccatactatccaaacaaataaataacgaccatcaaaaacaacttcaaaaatcgctcgcgactcttaccaacctaacttcgatcattaaaccgctaatcgtcacgacgatttataccgcctcgacgaacacataaaacgaattaacataaattataaacgccgccctataccttatctacctccccgcgttacgtcgcgatacataaaaccgaaccacctcgacctaaataaaaaccgacgaca

SEQ ID NO: 36403 - DNA, 952 bp, Artificial Sequence
  chemically treated genomic DNA (Homo sapiens) CpG-island No: 36403
tttttattttttggaatagattatttttattggttgattttttacgtcggacgtatcgtggtcggtattatcggcgttataggtgcggttgttggcgtttatatcgtcgatattatcgatggggaagatcgggttcgttatttcgggtttatgagcgtttgtttcggcgtgggtatggtggtaggtttcgtggtcgggggattgttgggcgttatttttttgtatgtattattttttgcggcggcggtgtttaacggttttaatttattattgggttgttttttaatgtaggagtcgtataagggagagcgtcgatcgatgtttttgagagtttttaatttagttagtttttttcggtgggcgcggggtatgattatcgtcgtcgtatttatgattgttttttttattatgtaattcgtaggataggtgtcggtagcgttttgggttattttcggcgaggatcgttttcgttggagcgcgacgatgatcggtttgtcgtttgcggtattcggaattttgtacgttttcgtttaagttttcgttattggtttcgttattaaacgtttcggcgagaagtaggttattatcgtcggtatggcggtcgacgcgttgggttacgttttgttggcgttcgcgacgcgaggttggatggttttttttattatgatttttttcgttttcggcggtatcgggatgttcgcgttgtaggttatgttgtttaggtaggtagatgacgattattagggatagttttaaggatcgttcgcggtttttattagtttaatttcgattattggatcgttgatcgttacggcgatttatgtcgtttcggcgagtatatggaacgggttggtatggattgtaggcgtcgttttatattttgtttgttttttcgcgttgcgtcgcggtgtatggagtcgggttatttcgatttgaatggaagtcggcggta

SEQ ID NO: 36404 - DNA, 952 bp, Artificial Sequence
  chemically treated genomic DNA (Homo sapiens) CpG-island No: 36404
taccgccgacttccattcaaatcgaaataacccgactccatacaccgcgacgcaacgcgaaaaaacaaacaaaatataaaacgacgcctacaatccataccaacccgttccatatactcgccgaaacgacataaatcgccgtaacgatcaacgatccaataatcgaaattaaactaataaaaaccgcgaacgatccttaaaactatccctaataatcgtcatctacctacctaaacaacataacctacaacgcgaacatcccgataccgccgaaaacgaaaaaaatcataataaaaaaaaccatccaacctcgcgtcgcgaacgccaacaaaacgtaacccaacgcgtcgaccgccataccgacgataataacctacttctcgccgaaacgtttaataacgaaaccaataacgaaaacttaaacgaaaacgtacaaaattccgaataccgcaaacgacaaaccgatcatcgtcgcgctccaacgaaaacgatcctcgccgaaaataacccaaaacgctaccgacacctatcctacgaattacataataaaaaaaacaatcataaatacgacgacgataatcataccccgcgcccaccgaaaaaaactaactaaattaaaaactctcaaaaacatcgatcgacgctctcccttatacgactcctacattaaaaaacaacccaataataaattaaaaccgttaaacaccgccgccgcaaaaaataatacatacaaaaaaataacgcccaacaatcccccgaccacgaaacctaccaccatacccacgccgaaacaaacgctcataaacccgaaataacgaacccgatcttccccatcgataatatcgacgatataaacgccaacaaccgcacctataacgccgataataccgaccacgatacgtccgacgtaaaaaatcaaccaataaaaataatctattccaaaaaataaaaa

SEQ ID NO: 36405 - DNA, 594 bp, Artificial Sequence
  chemically treated genomic DNA (Homo sapiens) CpG-island No: 36405
ttcgttttaatttaggatttttttagttttcgtgtgttttcgtttattttagttttcgtcgcgagttttttttttggttttttggtttggcggcgatcgtcggttagtttatttttcggagttgtattgtgagtgcgtttttgttttttggttttcggcggggagggtttttaggtagggtttgggttcgtttcgtgttttttcgagttttgttcgtttcgagtttttttgttgttcgcggttagaacggaggggtaaagtagttttcggcggtttagggggcggacggtcgtgttcgttttagggtcgcgcgaggtataggcgttgcgttttgcggagtcgttgggagaatttcggggtaggtttcggcgcggtaataagtttgcgttttgtttttttagggtagatacgtcgttattttgtagcgggtttcgggcgggttacgcgtgcggcgataggaatttaatttcggtcgattttgggttttaggaattcgttgtttacgtttgcggaggtgcggtagttttagttttaagcgtaggtatgtttttatttttgagcgggaggaaattatttagttttgagtacgtggtt

SEQ ID NO: 36406 - DNA, 594 bp, Artificial Sequence
  chemically treated genomic DNA (Homo sapiens) CpG-island No: 36406
aaccacgtactcaaaactaaataatttcctcccgctcaaaaataaaaacatacctacgcttaaaactaaaactaccgcacctccgcaaacgtaaacaacgaattcctaaaacccaaaatcgaccgaaattaaattcctatcgccgcacgcgtaacccgcccgaaacccgctacaaaataacgacgtatctaccctaaaaaaacaaaacgcaaacttattaccgcgccgaaacctaccccgaaattctcccaacgactccgcaaaacgcaacgcctatacctcgcgcgaccctaaaacgaacacgaccgtccgccccctaaaccgccgaaaactactttacccctccgttctaaccgcgaacaacaaaaaaactcgaaacgaacaaaactcgaaaaaacacgaaacgaacccaaaccctacctaaaaaccctccccgccgaaaaccaaaaaacaaaaacgcactcacaatacaactccgaaaaataaactaaccgacgatcgccgccaaaccaaaaaaccaaaaaaaaaactcgcgacgaaaactaaaataaacgaaaacacacgaaaactaaaaaaatcctaaattaaaacgaa

SEQ ID NO: 36407 - DNA, 594 bp, Artificial Sequence
  chemically treated genomic DNA (Homo sapiens) CpG-island No: 36407
ggttacgtgtttagggttgggtaattttttttcgtttaagggtaggaatatatttgcgtttaaaattgaggttgtcgtattttcgtagacgtagataacgaatttttggagtttaaggtcggtcggggttgggtttttgtcgtcgtacgcgtggttcgttcgaaattcgttataaagtagcggcgtgtttgttttagggaggtaaagcgtaaatttgttatcgcgtcgggatttgtttcgggatttttttagcggtttcgtaggacgtagcgtttgtgtttcgcgcggttttgggacgggtacggtcgttcgttttttgggtcgtcgagggttgttttattttttcgttttggtcgcgggtagtagaggagttcggggcgggtaaagttcgaggggatacggggcgagtttagattttgtttgggagtttttttcgtcggagattaaagggtagaaacgtatttatagtgtaatttcgagggataaattggtcgacgatcgtcgttaggttagaagattaagaagaaggttcgcggcgggaattgaagtgagcggggatatacgagggttgggaagattttgggttggggcgga

SEQ ID NO: 36408 - DNA, 594 bp, Artificial Sequence
  chemically treated genomic DNA (Homo sapiens) CpG-island No: 36408
tccgccccaacccaaaatcttcccaaccctcgtatatccccgctcacttcaattcccgccgcgaaccttcttcttaatcttctaacctaacgacgatcgtcgaccaatttatccctcgaaattacactataaatacgtttctaccctttaatctccgacgaaaaaaactcccaaacaaaatctaaactcgccccgtatcccctcgaactttacccgccccgaactcctctactacccgcgaccaaaacgaaaaaataaaacaaccctcgacgacccaaaaaacgaacgaccgtacccgtcccaaaaccgcgcgaaacacaaacgctacgtcctacgaaaccgctaaaaaaatcccgaaacaaatcccgacgcgataacaaatttacgctttacctccctaaaacaaacacgccgctactttataacgaatttcgaacgaaccacgcgtacgacgacaaaaacccaaccccgaccgaccttaaactccaaaaattcgttatctacgtctacgaaaatacgacaacctcaattttaaacgcaaatatattcctacccttaaacgaaaaaaaattacccaaccctaaacacgtaacc

SEQ ID NO: 36409 - DNA, 824 bp, Artificial Sequence
  chemically treated genomic DNA (Homo sapiens) CpG-island No: 36409
ttcgcgcgtagatatggtttattttcgtgttattgtatgagttatatttaggtcggtttcggatatcgatagttaatggtcgggttcgtttcgttttattcgggattggttgtgcgtgtcgcggttttttatttcgtttcgtttaggattttttcgggattggttgagttattcgatttttttaggggatcggttgcgcgtttcgtttttgtttagagttttttcgggattggttgcgggtttcgcgatttttttgttttttttttcgtttcgcgtcgtttttttggtttgtgcgttcgtcgtaggtcgtaggtttttttgttagttggagttgcgcggtgagtgtatttttagttttcggttttcggtttttcgcggggagggcgttcggtcggttcgtgggttcgattaggggttgggttcgttcggtgtttttacgagttttgttcgtttcgagtttttttgttttcggcggttagaacggaggggtagagtagttttcggcggttcggggggcgggcggcggtgttcgtttcggggttgcgcgaggtataggcgtcgcgtttagcggaatagtcggaggttttcggcgtaggtttgggtatcgtaataattttgcgttttgtttttttagggttgacgcgttattatgtagcgggtttcgggcgggttacgcgtgcgggataggaatttaattttagtcgattttgagttttaggagttcgttttttacgtttgcggaagtgtagttgttttagtttttagcgtaggtatgtttttagttttgagcggggtgggggaaggaatgagttagtttggagtat
